United States Patent 11,141,474 (ARTIFICIAL NUCLEIC ACID MOLECULES ENCODING A NOROVIRUS ANTIGEN AND USES THEREOF) - sequence listing, part 18

SEQ ID NO: 37614 - RNA, 1623 nt, Artificial Sequence
  derived and/or modified sequence opt11 from major_viral_capsid_protein__Norovirus__ALM98922
augaaaauggccucaaacgacgcagcccccagcaacgacggcgcagccggccuuguccccgaaggcaacaacgaaacacuuccucucgaacccguagccggagcagcuauagcagccccugucacuggccaaaacaacaucauugacccuuggauccgcacaaacuucguccaggcccccaacggagaauucaccgucuccccccguaacagcccgggcgaaauccuccucaaccucgaacucggacccgaccucaacccauaccuagcacaccuaucccgaauguacaacggauacgcgggcggaguagaaguccaaguacuccucgcgggaaacgcauucacagccggaaaaauccucuucgccgccguacccccuaacuuccccguagaauucuuauccccagcccaaauaacaaugcucccgcaccucauaguagacguacgcacccucgaacccaucaugauaccacuccccgacguaagaaacacauucuuccacuacagcaaccaacccaacucgcgcaugcgccuggucgccaugcucuauacaccgcuccgcucaaacggcucgggcgacgacguauuuaccgucuccugccgcguccucacacgccccaccccagacuucgaauucaccuaccucguaccacccuccguagaauccaaaaccaaacccuucucccuccccauccucacccuauccgaacuuaccaacuccagauuccccguaccaauagacucucucuucaccgcucaaaacaacguccugcaaguccaaugccaaaacggccgcugcacucuagacggcgaacuacagggcaccacacaacuacuccccuccggaaucugcgcauucagagggaggguaacagcccaaaucaaccaacgagaccgauggcacaugcagcuccaaaaccucaacggcacuaccuaugacccaacagacgacguaccagcaccccugggcacccccgacuucaagggcguaguuuucggaauggucucccaacgcaaugucggcaacgacgcccccggcuccacccgagcccaacaagccuggguuucaaccuacuccccccaauucguuccaaaacucggaucgguuaaccucagaaucucagacaacgacgacuuccaauuccagcccaccaaauucaccccugucgguguaaacgacgacgacgacggccauccauuccgacaaugggaacuacccaacuauuccggagaacucacccucaacaugaaccuagccccacccguagcccccaacuuccccggcgaacagcuccuauucuuccgcucauucguaccguguuccggcggcuacaaccaaggcaucauagacugccucauaccccaagaauggauccagcacuucuaccaagaguccgccccuucccaaucagacguagcccucaucagguacgugaaccccgacaccggccgcacacucuucgaagcaaaacuacaccgauccggcuacaucaccguugcccacuccggcgacuacccccucguagucccagcaaacggacacuuccgauucgacucauggguaaaccaauucuacucacucgccccuaugggcaccggcaacggccgcagacgggcacaauaa

SEQ ID NO: 37615 - RNA, 1623 nt, Artificial Sequence
  derived and/or modified sequence opt11 from major_viral_capsid_protein__Norovirus__ALM98928
augaaaauggccucaaacgacgcugcccccuccaaugacggcgccgccggccucguucccgaaggaaacaacgaaacccuaccacucgaaccaguagccggagcagccaucgccgcccccgucaccggacaaaacaacauaaucgaccccuggauacgcaccaacuucguucaagcccccaacggagaauuuaccguuagcccacgcaacuccccaggagaaauccuacucaaccuagaacuaggaccagaccuaaacccauaucuagcacaccucucccguauguacaacggguacgcuggcggagucgaaguacaaguccuccucgccggcaacgccuucacagccgguaagauccuuuucgccgcaguaccucccaacuuccccgucgaguuccucucccccgcacaaauaaccauguuaccccaccucaucgucgacguccgcacccuagaaccuaucaugauaccccuaccagacguacgcaacacauucuuccauuacagcaaccaacccaacucccgcaugcgccucguggccaugcuauacacuccccucagauccaacggcucaggagacgacgucuucaccgucuccugccgcguacucacccgacccaccccagacuucgaauuuaccuaccucgucccacccuccguagaaucaaaaaccaaaccuuucucccucccaauccuaacucucucagaacuaaccaacucccgauuccccgucccaaucgacucccucuucaccgcacaaaacaacguacuccaaguccaaugccaaaacggacgcugcacccucgacggcgaacuacaaggaaccacccaacuccuccccuccggcauaugcgcuuuccggggccgugucaccgcccaaaucaaccaacgagaccgcuggcacaugcaacuccaaaaucuaaacggcacuacauacgaccccacugacgacguucccgcuccccuaggaacccccgacuucaaaggagucguauucggcauggucucccaacgaaacgucggcaaugacgcccccggcuccacgcgcgcccagcaggcuuggguguccaccuacuccccacaauucguacccaaacucggaucagugaaccuccgaauuuccgacaacgacgacuuccaauuccaacccacuaaauucacccccgucggagucaacgacgaugacgacggccaccccuuccggcaaugggaacuccccaacuacuccggagaacuaacacugaacaugaaccuagccccacccgucgcccccaacuuucccggcgaacaacuccucuucuuucgcuccuucguacccugcucuggaggcuacaaccaaggaauaaucgauugccuaauaccccaagaauggauccaacacuucuaccaagaauccgccccaucccaguccgacguagcccuaauacgcuacguaaacccagacaccggccgcacccucuucgaagccaaacuucaccgcuccggcuacaucacugucgcucauuccggagacuacccacucgucguaccagccaacggccacuuccgauuugacuccuggguaaaccaauucuacucccucgcaccaaugggaacaggcaacgggcgccgacgcgcccaauga

SEQ ID NO: 37616 - RNA, 1623 nt, Artificial Sequence
  derived and/or modified sequence opt11 from major_viral_capsid_protein__Norovirus__ALM98931
augaaaauggccuccaacgacgccgcccccuccaacgacggugcagccggccucguuccagaaggcaacaacgaaacccucccccuagaacccgucgccggcgcagcaaucgccgccccagucaccggccaaaacaacauuaucgacccauggauccguacaaacuuuguccaagcccccaacggcgaauuuaccguauccccacgcaacucccccggcgaaauccuccuaaaccuugaacuaggccccgaccuaaacccauaccuagcccaccuauccagaauguauaacggauacgccggcggcgucgaaguccaaguacuccucgcuggaaacgccuucaccgcaggcaaaauccucuucgcugcagucccacccaacuuccccgucgaguucuuaucacccgcccaaauaacaaugcucccccaccuaauaguagacgucagaacccucgaacccaucaugaucccccuacccgacguccgcaauaccuucuuccacuacagcaaccaacccaauucaagaaugcgccuagucgcgaugcuauacacaccccugcgcuccaacggcuccggugacgacgucuucaccgucucaugccgcguacucaccagacccacucccgacuucgaguucacauaccucguacccccaucaguagaaucaaaaaccaaaccauucucccuaccaauucuaacccucucagaacucaccaacucccgcuucccaguucccaucgacucccuauuuacagcccaaaacaacguacuccaaguccaaugccaaaacggacgaugcacccucgacggugaacuccaaggcacaacacaacuucuuccaucaggcaucugugcauuccgcggccgaguaacagcccaaaucaaccaacgcgacagauggcacaugcaacuccagaaucucaacggcaccaccuacgaccccaccgacgacguccccgcuccccucggcaccccugacuucaaaggcgucgucuucggaaugguaucccaacgaaacguaggcaacgacgcacccggcucaacccgcgcucaacaggcuugggucucuaccuauucaccccaauucguacccaaacucggcucaguuaaccuucgcauaucagacaacgacgacuuccaauuccaacccacuaaauuuacccccgucggcgucaacgacgacgacgacggacaucccuuccgacaaugggaacuccccaacuauuccggcgaacuaacccucaacaugaaccuggcacccccgguugcaccaaacuuccccggcgaacaacuccucuuuuuccgguccuucguuccaugcuccggaggauacaaccaaggcaucauagacugccuaaucccccaagaauggauccaacacuucuaccaagaaucggccccaucacaauccgaugucgcgcuuauaagauacguaaaccccgacacaggccgcacccucuucgaagcaaaacuccaccgcagcggcuacauaacaguagcacacucuggagacuacccucuaguagucccugccaauggacacuuccgcuucgacagcuggguuaaccaauucuacucacucgccccaaugggcaccgguaacggccgccgccgcgcccaguaa

SEQ ID NO: 37617 - RNA, 1623 nt, Artificial Sequence
  derived and/or modified sequence opt11 from major_viral_capsid_protein__Norovirus__ALM98934
augaaaauggcauccaacgacgccgccccauccaacgacggcgcugccggccuaguuccagaaggaaacaacgaaacacucccacuugaacccgucgcaggcgcugccaucgccgcacccgucaccggccagaacaacauaaucgacccauggauccgcacaaauuucguccaagcacccaacggcgaauuuaccguaucaccacgaaacagcccaggagaaauccuccuaaaccucgaacucggcccagaccucaaccccuaccucgcccacuuaucccgaauguacaacggcuacgccggcggaguagaaguccaaguccuccucgcgggcaacgccuucacagcaggaaaaauccuuuucgcagccguaccacccaacuucccugucgaauuucucuccccugcccaaaucacaaugcucccccaccucauaguugacguccguacacucgaaccuaucaugaucccacucccagacgugcgcaacaccuucuuccauuacucaaaccaaccaaacucaagaaugcgccucgucgcaaugcuauacacaccccuccgcucuaacggauccggcgacgaugucuucaccgucuccugccgaguccucacccgacccaccccugacuucgaauuuaccuaccucgucccucccuccgucgaauccaaaaccaaacccuucucccuccccauacucacccuauccgaacucacaaacucccgcuuccccguaccaaucgauucccucuucacagcacaaaauaacguucuccaaguccaaugccaaaauggacgcugcacccucgacggcgaacuccaagguacaacacaacuucuuccaacaggaaucugcgcauuucgcggucgcguaaccgcccaaauaaaccaacgagaccgauggcacaugcaacuccaaaaccuaaacggcacaaccuacgacccaaccgacgacguccccgcuccccuaggcacccccgauuucaaaggcguugucuucgguauggucucacaacgcaacgucggaaacgacgccccaggcuccacccgcgcucaacaagccuggguaucuaccuauucaccccaauuuguccccaaacucggcucaguaaaccuacgcaucagcgacaacgaugacuuccaauuccaacccacaaaauucacaccagucggcgucaacgacgaugacgacggccacccauuccgacagugggaauuacccaacuacuccggagaacucacccucaacaugaaccucgccccacccgucgccccaaacuuccccggcgaacaacuucucuucuuccgcuccuuugucccaugcuccggcggcuacaaccaaggcaucaucgacugccucauaccccaggaauggauccaacacuucuaccaagaauccgcccccucccaaucagaugucgcucucauacgauacguaaaccccgauaccggccgcacucucuucgaagccaaacuacacagauccggcuacaucaccguagcccacucuggagacuacccccuaguagucccagccaacggccacuuccgauucgacuccugggucaaccaguucuacucccucgcacccaugggcacagggaacggacgacgccgagcccaauaa

SEQ ID NO: 37618 - RNA, 1623 nt, Artificial Sequence
  derived and/or modified sequence opt11 from major_viral_capsid_protein__Norovirus__ALM98940
augaaaauggcauccaacgacgccgcacccuccaacgacggcgccgccggccuaguccccgaaggcaacaacgaaacccucccccucgaacccguagcaggcgccgcaaucgccgcccccguaaccggccaaaacaacauuauagaccccuggauucgcaccaacuucguccaagcacccaacggcgaauuuacagucuccccacguaacuccccaggcgaaauucuccucaaccuagaacucggcccugaccucaaccccuaccucgcucaccucuccagaauguacaacggcuacgccggcggaguugaaguccagguucuccuagcaggcaacgcauucacagcagguaaaauccucuucgccgccgucccacccaacuuccccgucgaguuccucucccccgcacaaaucaccaugcugccccaccucaucgucgacguacgcacccuagaaccgauaaugaucccccuaccagacgugcgcaauaccuucuuccacuacuccaaccaaccaaauucccgcaugcgccucgucgccaugcuuuauacaccacuccgguccaacggaucaggcgacgaugucuucacagucuccugccgaguccucacccgacccaccccugacuucgaauuuacuuaucucguuccacccucagucgaaucuaaaacaaaacccuucucacuccccauucucacccuauccgaacucaccaauucccgcuuccccguacccaucgacucccucuucacugcccaaaacaauguccuccaagugcaaugccaaaacggacgcugcacccucgacggcgaacuccaaggcaccacgcaacuccuccccuccggcauaugcgccuuccgcgguagaguuaccgcccaaaucaaccagagagaccgcuggcacaugcaacuccaaaaccucaacggaacuacauacgaccccaccgacgacguacccgccccacuaggaacuccugacuucaaaggcgucgucuucggcaugguuucucaacgcaacguuggcaacgacgcacccggcucuacacgcgcacaacaagcaugggucuccacauacucaccccaguucguccccaaacuaggcuccgucaaccuccgcaucuccgacaacgacgacuuccaauuccaaccuacuaaauucacacccguaggagucaacgacgaugacgacggccaccccuuccgccaaugggaacucccgaacuacuccggugaacuaacucucaauaugaaucuagccccaccagucgccccaaacuuccccggcgaacaacuacucuucuuccguuccuucguacccuguuccggaggcuacaaccaaggcauaguugacugccucaucccacaagaauggauccaacacuucuaccaagaauccgcuccaucccaaucugacgucgcacucauacgcuacguaaaucccgacaccggccgaacccucuucgaagccaaacuccauagauccggcuacaucaccgucgcccacucaggcgacuacccccucguagucccagccaacggccacuuucgcuucgauucauggguuaaucaauucuauucccuugcacccaugggcaccggcaacggucgacgccgcgcacaauaa

SEQ ID NO: 37619 - RNA, 1623 nt, Artificial Sequence
  derived and/or modified sequence opt11 from major_viral_capsid_protein__Norovirus__ALM98943
augaaaauggccucgaacgacgcagcacccagcaacgacggugccgccggacucguacccgaagguaacaacgaaacacucccacuagaacccgucgccggcgccgccaucgccgccccaguuacaggccaaaacaacauaaucgacccuuggauccgcaccaacuucguacaagcucccaacggcgaguucaccgucuccccacgaaacucccccggagaaauccuguuaaaccucgaacuaggccccgaccucaaucccuaccucgcacaccucuccagaauguacaacggcuacgcuggaggcguagaaguacaaguccuccucgccggaaacgccuucaccgccggaaaaauacucuucgccgccgucccacccaauuuucccguagaguuccucucucccgcccaaaucacaaugcucccccaucuaauugucgacguucgcacccuagaacccaucaugauuccccucccagacguacguaacacauucuuucacuauuccaaucaaccaaacucacgcaugcgcuuggucgccaugcuuuacacaccccuccgcuccaacggcucaggcgacgacgucuucaccguaucaugccgaguccuaacccgaccaacaccagacuucgaguucaccuaucuagucccaccguccguugaaucaaaaaccaaacccuucucccuaccuauacucacccugucagaacuaaccaacucccgcuuccccguccccaucgacucccucuucaccgcccaaaacaacguccuccaaguccaaugccaaaacggaagaugcacucucgacggcgaacuacaagggacaacacaacuccucccuuccggcaucugcgccuuccgcggccgcguuaccgcacaaauaaaccaacgcgaccgguggcacaugcaacuucaaaaccuaaacggcaccaccuacgaccccacugacgacgucccugcgccccucggcacccccgacuucaagggagucguuuucggaauggucucccaaagaaacgucggcaacgacgcccccggauccacccgcgcccaacaagccugggucuccaccuauucuccccaauuuguccccaaacuaggguccgucaaccuccgcaucuccgacaaugacgacuuccaauuccaacccaccaaauucacacccgucggcgucaacgacgaugacgauggacacccauuccgccaaugggaacuccccaacuacuccggcgaacuaacacugaacaugaaccucgccccucccgucgcacccaacuuccccggcgagcaacuccucuucuuucgcucuuucguucccugcucaggaggcuacaaccaaggcauaaucgacugccucaucccccaagaauggauccaacacuucuaccaggaaagcgcccccucccaauccgacgucgcccuuauucgcuacguaaaccccgacaccggccgaacacucuucgaggccaaacuccaucguuccggcuacaucaccgucgcacacuccggcgacuacccccucguaguccccgccaacggccacuucagauucgacuccugggucaaccaauucuacagccuugcccccaugggcaccggcaacggacgacgccgugcacaauaa

SEQ ID NO: 37620 - RNA, 1623 nt, Artificial Sequence
  derived and/or modified sequence opt11 from putative_capsid_protein__Norovirus__ABD73936
augaaaauggcaucaaacgacgccaaucccucagacggauccaccgcaaaccucguccccgaagucaacaacgaaguaauggcccuugaacccguaguaggcgcagcaaucgccgcccccgucgccggacaacaaaacgucaucgaccccuggauccgaaacaacuuuguccaggcccccggaggagaguucacaguuucuccccgcaaugccccuggcgaaauccuaugguccgcaccccuaggacccgacuuaaaccccuauuuaucucaccucgcccguauguacaauggcuacgccggcggauucgaaguacaagucauacucgccggcaacgccuucaccgccggaaaaauaauauucgccgccgucccacccaacuucccaaccgaaggauuaucccccucucaaguaaccauguucccccacgugaucguugauguaagacaacuggaacccguccucauaccacuacccgacguaagaaacaacuucuaccacuacaaccaaucaaacgaccccacaaucaaacucauagccaugcucuacacgccacuccgcgcaaacaacgccggcgaagaugucuucacagucucgugccgaguccucacacgacccuccccagauuuugacuucaucuuccucgucccacccacaguugaaucccgcacaaaacccuucaccgugcccauccucaccguagaagaaaugaccaacucucgcuuccccaucccccucgaaaaacucuuuaccggccccucaggcgcauucguaguacaaccccaaaacgggcgcugcaccaccgacggaguccuccucggaaccacacaacucuccccugucaacaucugcacauuccgcggcgacgucacccauaucgcaggaacccacaacuacaccaugaaccucgccucccagaacuggaacaauuacgaccccaccgaagagaucccagccccacuuggcacacccgacuucguaggucgcauccaaggaaugcucacccagacgacccgcggcgacggcuccacccgaggacacaaagcgaccgucagcacaggugacguacacuucacccccaaacucggcuccauacaauucaauacagauaccaacaacgacuuugaaaccggccaaaacaccaaauucacaccagucggcgucguccaagacggcaacggcacccaccaaaacgaaccccaacaauggguccuacccuccuacucaggacgcaccggccacaacguccaccuagccccugccguugcacccaccuuccccggcgaacaacuccucuucuuucgcucaacaaugcccggcuguagcggauacccaaacaugaaccuugacugucuacuaccacaagaauggguccaacacuucuaccaagaagccgcacccgcucaaucagacgucgcccuccuccgcuucgucaaccccgacaccggccgcguccuuuucgagugcaaacuccacaaaucuggcuaugucacugucgcccacacuggacaacacgaccuagucauacccccaaacggcuacuucagauucgacucuugggugaaucaauucuacacacucgcccccaugggaaacggaacaggaagacgcagagcccucuaa

SEQ ID NO: 37621 - RNA, 1560 nt, Artificial Sequence
  derived and/or modified sequence opt11 from structural_capsid_protein__Norovirus__ABY67257
augaaaaugaccgacaaagacacccaagaagccgcccccgcccuaggccaaguacuuccgcccgaagucgaagucgccauccccguugaaccaaccgcuggagcccaaaucgccgcccccaccgccggccaagucaaccccaucgaccccuggaucuucgccaacuucguccaagcaccccaaggcgaguucaccaucuccccaaacaacaaucccggagaaguacuauucgaacuagaacucggccccgaacucaaucccuaccuugcccaccuccggcaaauguacaacggcuggacuggcucaauuagagucaaagucauccuagcaggcaacgcauucucagccggaaaaaucauugucuucugcauacccccaggcuucgacgccuccuaccucaccccuuuccaagccacccaauucccacacguaaucauggacguccgagccgccgaaccuauagaaaucccacucgccgacgucagaaacguacuuuuccaccaaggaccagacucccgcaugcgccucaugggcaugcucuauaccccacuacgcgccaacuccggugcagacccauuugucguuaccggccgcguccucacaugcccuucacccgacuucucauucuucuuucucguaccgcccaccgucgaagaacgcuccacccccuucuccguaccgaauguccccguauacucccuuaccaauucccgagcaccaguccccaucuacgaacuccguucaucccgaucacuaccccucaccguccaauuccagaacggacgcugcacagucgaaggcgaccuccuggguaccacccccuucucagcaggcgaccucugcucauucaugugcauccgcggagauacccaacacaucgccgaacugcucgaacccgacgaaucagccuuugucgucggcgaacgccccgccacacucgguuuccccgacuucucccaaugcguccuccaccuccuccuagccgacggcaccggcaucuggcaccaaucccucgacgucaagaacccacaacacuucacacccgcuaucggacaaguaguccuuuccggugauguuccccucacucgaacacgcguccgacucgacuauguccucucuacaucccgcgauucuuucuggguccugccagacuaccgauccgacguacucggcucagaguucgccccugccgucuccgccccuggcguaggcgaaacccuccucuucuucaugggccgcgcccccguccaagguccauccaacccgcuuccuugccuccuuccccuugaauggguauuccacuucgcauccgaacgccccaccaaacaaucagaugucgcccuccucaacuacgucaacccugacaccggacgcguccucuucgaagcuaaacuauacucauccggcuuccuuacaguaaaccuaggcacagccaacgaagucguccuaccaaccuccggaaucuuuaaguucgccaguugggucucccucuacuaccaacuccgacccgucggaacacucuccgcgggacgacgccuaccccgaguagacggcuacuaa

SEQ ID NO: 37622 - RNA, 1653 nt, Artificial Sequence
  derived and/or modified sequence opt11 from viral_capsid_protein__Norovirus__AHA91656
augaugauggccuccaaagacgccaccagcaacauggacgggacaucaggcgccgggcaauuaguacccgaaaacaacaacaccuccgaaccaauaaacauggaacccguagcuggcgccgugaccgcugccgccaccgcuggccaagucaacaugaucgacccauggaucaugaacaacuacguacaggcaccccaaggcgaauuuaccaucucccccaacaacaccccaggcgacauccucuucgaccuccaacucggcccccaccucaaccccuuccuagcccaccucucucaaauguacaacggcugggucggcaauaugaaaguccgcgucguccucgcaggcaacgcauucuccgccggcaaaaucauaguuugcugcauuccacccggcuucuccgcccccaacauaagcaucgcacaagccaccauguucccacacgucauagccgacguccgcgugcucgaaccuaucgacaucccccucgacgacguccgcaacguucuuuuccacaacaacgacaacggaaaucaaaccaugcgccuacucugcaugcucuacacuccucuccgcucaggcggaaccucaucaggcaccgaccccuucgucaucgccggccgcgucuuaaccugcccaacaccagacuucaacuuuuuauuccucgucccacccacagucgagcagaaaacaaaacaauucuccgugcccaaccucccccuaaacguuaugucaaacagccgcguccccucccuccucaacgcuauggucgucucacccgaccaagcccaagucguacaauuccaaaacggccgauguacccucgacggacaaaugcucggaacaacuacaguaucagccuccugcgucgcccgcuuccgaggaaaaaccuuccaagcccccgacaaccgccucggaauaaaccucgccgaaauauccggcgaacccuaccacgccuucgaauccccagcaccccuuggcuuccccgacuuuggcgacggagacuggcacguaacagccaccaagguaaccccaucacaacuggaagcaaacgacccagucgucaugggcaauguacaacccuacaauccccaauucgcaccacaccucggcacccugguagucgaaaaccccaccccagacaacgucacuacaggaaccgaccuccuauucaacaucaccuggcucagcaauagagcaaacaaccgauucaaccccuggguaauccccaacuacggcucuacacuaacugaggccgcucaacucgcucccuccauauucccacccggauucggagaaaccaucguauacuucaacuccaccuuccccgcaguaggcgccaccacacacgcugccauccccugccuccucccccaagaguucgucgcucauuucguaaacgaacaagcacccauccgaggagaagccgcccuacuacacuacauagaccccgacacccaccgaaacuuaggagaguucaaaaucuacccggaaggcuucgucacaugcgucccaaacgucggcggcacaggcccccaaucccuccccaccaauggcaucuuugucuucgucuccugggucagccgcuacuaccaacucaaaccaguaggcacagcuggccaagcccgacgacucggauuccgccgcgucuaa

SEQ ID NO: 37623 - RNA, 1629 nt, Artificial Sequence
  derived and/or modified sequence opt11 from VP1_capsid_protein__Norovirus__BAL60747
augaagauggcaucaaacgacgccgcaccaucaaccgacggggcugcaggacucguccccgaaagcaacaaugaagucauggcccuggaacccguagcaggcgccgcacuugccgcccccgucacaggccaaaccaacauaauagaccccuggaucagagcaaauuucguccaagcccccaacggcgaguucacagucagcccccgcaacgcccccggcgaaguccuccuaucccuagaacucggccccgaacucaacccguaucucgcccacuuagcccgaauguacaacggcuacgcaggcggcauggaaguccaagucaugcuagccggaaacgcuuucaccgccggaaagcuagucuucgccgccgucccaccccacuuccccguagaaaaccuuucaccccagcaaauuacaauguucccccacgucauuauugacguacgaacccucgaaccaguccuacucccccuccccgacguacgaaacaacuucuuccacuacaaccaaaaagacgacccaaaaaugcgaauaguagccaugcuauacacaccucuucgauccaacggauccggagacgacgucuucaccgucuccugccguguccuaacacguccaucccccgacuucgacuuuaccuaccucguacccccaacagucgaauccaaaaccaaacccuucacccuccccauacugacccucggcgaacuauccaacucccgauuccccgucucaaucgaccaaauguacaccucaccuaacgaagucauuucaguccaaugccaaaacggacgcugcacccuugacggcgaacuacagggcaccacccaacuccaggucuccggcaucugcgcuuucaaaggcgaagucacagcccaccuccacgacaacgaucacuuauacaacguuaccauuacaaaccuaaacggcuccccauucgaccccucggaagaugucccagccccacucggcgucccagacuuccaaggcaggguuuucggcgucauaucccaacgagacaaacaaaaugccgccggacacaacgaacccgcaaacagaggacaugacgccgugguccccacauacacagcccaguacacgcccaaacucggccaaguccaaauaggaacauggcaaacagacgaccugcaaguaaaccaaccugucaaauucacacccguuggccuaaacgacaccgaacacuucaaccagugggucgucccccgcuacgccggcgcacucaaucucaacacaaaccucgcccccuccgucgcaccagucuucccaggcgaacgucuacuguucuuccgauccuacaucccccucaaaggagguuacggcaacccagcaaucgacugccuccucccccaagaauggguccagcacuucuaucaagaagccgcacccagcaugagugaaguugcccucguccgauacaucaacccagacacaggccgcgcacucuucgaagcaaaacuccaccgugccggcuucaugaccguauccagcaacacuuccgcgcccgucguugucccugcaaacggguacuuccgauucgacucguggguaaaucaauucuacucacucgccccaaugggaaccggaaacggcagacgccguguccaauaa

SEQ ID NO: 37624 - RNA, 1629 nt, Artificial Sequence
  derived and/or modified sequence opt11 from VP1_capsid_protein__Norovirus__BAL60751
augaagauggccuccaacgacgccgcacccuccaccgacggagcggccggccuuguccccgaaucaaauaacgaagucauggccuuagaacccgucgccggugccgcacuagccgcacccguaacaggccaaacaaacauaaucgaccccuggauacgagcaaacuucguacaagcccccaacggcgaguucaccguaagcccacgcaacgccccaggcgaaguccuccuaaaccuagaacucggccccgaacucaaccccuaccuagcccaccucgcccgcauguacaacggcuacgcaggcggcauggaaguccaagucaugcuagcuggcaacgcauuuacagccggcaagcuagucuuugccgccguaccgccccacuuccccguggaaaaccucucaccccaacaaaucacgauguucccccacgucaucaucgacguccguacacuagaacccguccuccucccccuccccgauguccgcaacaacuucuuccacuauaaccaaaaagaugaccccaaaaugcgcauagucgccaugcuuuacacaccucuccgaagcaacggcuccggcgacgacguuuucaccgucuccugccgcguccuuacucgcccuucccccgacuucgacuucaccuaccuagucccucccacagucgaaucaaaaacaaaacccuuuacacuacccauccucacacuuggcgaacucucaaacucccgcuucccagucucuaucgaccaaauguacaccucccccaacgaagucaucuccgugcaaugccaaaacggccgcugcacccucgacggagaacuccaaggcacuacccaacuccaaguaucaggcauaugcgccuucaaaggcgaaguaacagcacaucuacacgacaacgaucaccucuacaacguaacaauuaccaacuuaaacggcuccccauuugaccccuccgaagacauaccagcaccacucggaguccccgacuuccaaggccgcgucuuuggcguaaucucccaacgggacaaacacaacucccccggccauaacgaacccgccaaccgcggccacgacgccgucguacccacauacacaucccaauacacccccaaacuaggccagauacaaauaggaaccuggcagaccgacgaccuaaccgucaaccaacccguaaaguucacccccgucggccucaacgacaccgaacacuucaaucaauggguaguccccagauacgccggcgcccucaacuuaaacacuaaccuagcucccuccguugccccaguguucccaggcgaacgccuacucuucuuccgcucauauauaccacucaagggcggauacggcaacccagcuauagacugccuccuaccccaagaguggguccaacacuucuaucaagaagcagcccccucaauguccgaaguugcgcuaguccgauacaucaaccccgacacaggccgcgcccucuucgaagcgaaacuccaccgagccgguuucaugaccguauccucaaacaccucagcacccgucgucgucccugcaaacggauacuuccgcuucgacuccuggguuaaccaguucuacagccucgccccaaugggaaccggcaacggccgacgucgaguacaguaa

SEQ ID NO: 37625 - RNA, 1629 nt, Artificial Sequence
  derived and/or modified sequence opt11 from VP1_capsid_protein__Norovirus__BAL60763
augaagauggccuccaacgacgccgcaccuuccaccgacggcgcagccggacucguaccagaaucgaacaacgaagucauggcccucgaacccgucgccggcgccgcccuagcugcucccgucaccggccaaacgaacauaaucgacccauggauacgcgcaaacuucguccaagcacccaacggcgaguucaccguaucaccccgcaacgcccccggcgaaguccuacuaaaccucgaacucggccccgaacuaaacccauaccuagcccaccucgcacgcauguauaauggcuacgcaggcggaauggaaguccaaguaaugcucgccggaaacgccuucacugccggcaaacucguuuucgccgcaguuccaccccacuuccccaucgaaaaccuuucgccccaacaaaucaccauguucccccacgucauaaucgacgucaggacccuagagcccguucuccucccacuccccgacguccguaacaacuucuuccacuacaaccaaaaagacgaccccaaaaugcguaucgucgccaugcucuauacuccucucagaucgaacggauccggagacgacguauucaccgucucaugccgaguccuaacccggcccuccccugacuuugauuucaccuaccucgucccacccaccgucgaaagcaaaacaaaacccuucacccucccaauccuaacccuuggcgagcuaucaaacucccgcuuccccguaagcaucgaccaaauguacacuuccccaaacgaagucaucagcguccagugccaaaacggacgcugcacccucgauggcgaacuccaaggcaccacccaacuacaagucagcggcaucugcgcauucaaaggcgaagucaccgcacaccuucacgacaacgaccaccucuacaacaucacaaucaccaaccucaacggcuccccuuucgaccccagcgaggacauccccgcaccccucggcguacccgauuuccaaggucgcgucuucggcaucauaucacaacgcgacaagcacaacucaccaggccauaacgaacccgccaaccgaggccacgacgccgucgucccuacauacaccgcccaauauacaccaaaacucggucaaauacaaaucggaaccuggcaaacugacgaucucacaguaagucaacccgucaaauucacccccguaggccucaacgacaccgaacacuuuaaccaaugggucguuccacgauacgcaggagcacuuaaccuuaacacuaacuuagcacccucagucgcacccgucuuucccggcgaaagacuccuauucuuccgcucauacauaccacuaaaaggcggcuacggaaaccccgccaucgacugucuccucccccaagaguggguacagcacuucuaccaagaagcagcccccuccaugucagaagucgcucucguccgauacauaaaccccgacacgggacgagcccuauucgaagccaaacuccaccgcgccggauucaugaccguuucauccaacaccuccgcacccgucguaguccccgccaacggcuauuuccgcuucgacuccugggucaaccaguucuacucccuagcccccaugggaacaggaaacggacgucgccgaguccaauaa

SEQ ID NO: 37626 - RNA, 1629 nt, Artificial Sequence
  derived and/or modified sequence opt11 from VP1_capsid_protein__Norovirus__BAL60765
augaaaauggccuccaacgacgccgcccccuccacagacggcgccgccggccucguuccugaauccaauaacgaagucauggcccuagaacccguggccggcgcagcacuggcagcacccguaacaggccaaaccaacaucauagaccccuggauacgagcuaacuucguccaagcccccaacggagaguucaccgucagcccccgcaacgcccccggcgaaguacuucuaaaccucgaacucggacccgaacuaaacccauaccuagcccaccuugcccgcauguacaacggauacgcaggaggcauggaaguacaggucaugcucgcaggaaaugccuucacagccggaaaauuagucuucgccgccguacccccacacuuuccagucgaaaaccuaucuccacaacaaauuacaauguucccucacgucaucaucgacguccguacccucgaacccguccuacucccccugcccgacguacguaauaacuucuuccacuacaaccaaaaagacgacccaaaaaugcgaauaguugcaaugcucuacacuccccuacgaucaaacgguuccggcgacgacguauucacaguaucuugcagaguucucacccgccccagccccgacuucgacuucacuuaccucguaccacccacagucgaauccaaaaccaaacccuuuacucuccccauccucacccuaggcgaacuaucgaacucacgcuucccugucuccaucgaucaaauguacaccucccccaacgaagucaucucaguccaaugccaaaacggccgcugcacccucgacggugaacuacagggcacgacccaacuccaagucuccggaaucugcgccuucaaaggcgaagucaccgcacaccuucacgacaacgaccaccuauacaacgucaccaucaccaaccucaacggaucaccguucgaccccuccgaagacauccccgccccgcucggcgucccggacuuucaaggcagagucuucggcaucgucucccaacgugauaaacacaacucacccggccacaacgaaccagccaaucgcggccaugacgccgucguccccaccuacacggcccaauauacaccaaaacuaggccaaauacaaaucggcacauggcaaaccgacgaccucaccgucaaccaaccagucaaauuuacaccagucggauuaaacgacauagaacacuucaaccaauggguaguucccagauaugccggcgcccucaacuuaaacaccaaccucgcaccuuccguagcaccugucuucccaggcgaacgccuccucuucuucagaagcuacauaccccucaaaggcggauauggaaacccugcuauagacugccuccuaccacaagaauggguacaacacuucuaucaagaagccgccccauccauguccgaagucgcacugguccgcuacauaaaccccgacacaggccgagcccuuuucgaagccaaacuucaccgugccggcuucaugacaguaucaagcaacaccuccgcacccgucguaguucccgccaacggcuacuuccgauucgacuccuggguaaaccaauucuacucccucgcucccaugggcacaggaaauggccgccgucgcguacaauaa

SEQ ID NO: 37627 - RNA, 1629 nt, Artificial Sequence
  derived and/or modified sequence opt11 from VP1_capsid_protein__Norovirus__BAL60787
augaaaauggccucaaacgacgccgcccccuccacagacggcgccgccggccuuguccccgaauccaacaacgaaguaauggcucucgaaccugucgccggagcagcucuagcagcacccguuacaggccaaaccaacauaaucgacccguggauccgagcuaacuuuguccaagcacccaacggagaguucaccgucucuccccguaacuccccuggagaaguccuccuaaaccucgaacuaggacccgaacucaaccccuaucucgcucaccucgcacgcauguacaacggcuacgccggcggaauggaaguacagguaaugcuugccggaaaugcauucaccgccggcaaacucgucuucgcagccguacccccacacuucccagucgaaaaucucagcccccaacaaauuacuauguucccccacgucauaauagacguccgcacccucgaacccguccuacuaccucucccugauguccgaaacaacuucuuccacuacaaccaaaaggacgaccccaaaaugcgcaucgucgccaugcuauacacaccccucagauccaacggcuccggagacgacgucuucaccgucuccugcagaguccucacccgacccucccccgauuucgacuuuaccuaccuuguaccacccaccgucgaauccaaaaccaaacccuucacacucccaauccuuacccucggcgaacucuccaacucccguuuucccguaucuauugaucaaauguacacaucccccaacgaaguaaucuccguccaaugccaaaacggccgcuguacacucgacggcgaacuccaaggaaccacacaacuacaagucucaggcaucugcgcauucaaaggcgaagucaccgcacaccuucacgacaacgaccaucucuacaacgucacgauaacuaaccucaauggcucaccauucgaccccucugaagacauccccgcuccccuaggcgucccagacuuccaaggccgaguauucgguguaauaagccagcgagacaaacacaauacccccggccauaacgaaccagccaaccgggcccacgacgccgucguaccaaccuacaccgcccaauacacaccaaaacuuggacaaauacaaaucggcaccuggcaaaccgacgaccucaccgucaaccaacccgucaauuucacucccguaggccuauccgacaccgaucacuucaaucaauggguugucccccgcuacgccggggcccuaaaccuaaacacuaaccuagcccccuccguagccccagucuucccaggcgaacgccuccucuucuuccgcuccuacauaccccucaagggcggauacggaaccccggccaucgacugccuacuuccucaagaauggguacaacacuucuaccaagaagccgccccuucaauguccgaagucgcccucguccgauauaucaaccccgacaccggccgcgcccucuucgaggcaaaacuccaccgcgccggcuucaugaccguuuccuccaacacaucagcgccagucguuguacccgccaacggcuacuuccgcuucgacuccuggguuaaucaauucuacucccucgcccccaugggcaccggcaacggccgccgacgcauacaauaa

SEQ ID NO: 37628 - RNA, 1629 nt, Artificial Sequence
  derived and/or modified sequence opt11 from VP1_capsid_protein__Norovirus__BAL60789
augaaaauggccuccaaugacgcagcccccuccaccgacggcgcugcaggcuuaguccccgaaucaaauaacgaaguaauggcccucgaacccgucgccggagcagcccucgcugcccccgucacuggacagaccaacaucauagaccccuggauacgcgccaauuucguacaagcaccaaacggugaguucacggucagcccccgcaacgcacccggagaaguccuacucaaucuagaacucggccccgagcuuaacccuuaccuagcccaccucgcaaggauguacaacggauacgccggcggcauggaaguacaaguaaugcucgccggcaacgccuucaccgcaggcaaacucguuuuugccgccgucccaccacacuucccaguagaaaaccuauccccacaacaaaucaccauguucccacacgucaucauagacguacgcacccucgaaccaguacuccuuccccuacccgacguacgcaacaacuucuuucacuacaaccaaaaagacgaucccaaaaugagaaucgucgccaugcuauauacaccccuacgaucaaacggaagcggagacgacguauucaccguguccugccgcguacucacccgccccagccccgacuucgacuucacauacuuagucccacccaccguagaauccaaaaccaaacccuucacucuucccauccuaacccucggcgaauuauccaacagccgcuucccagucuccaucgaccaaauguacaccuccccaaacgaaguaauuucaguccaaugccagaacggccgcugcacccuagacggcgaacuacaaggcacaacccaacuacaagucuccggaauuugcgcauuuaaaggcgaaguaacugcccaccuccaugacaacgaccaccucuacaacaucaccauaaccaaccucaacggcucccccuucgaccccucagaagacauccccgccccucucggagucccagacuuccaaggacgcgucuucggcaucauaucccaacgcgacaaacacaacucaccaggacacaacgaacccgcaaaccgcggccacgaugccgucguacccacuuacaccgcccaauacacccccaaacuaggccagauacaaaucggcacauggcaaaccgaugaucucaccguaucucaacccgucaaguuuacccccguaggacucaacgacaccgaacacuucaaccaaugggucguaccccgauacgccggcgcccuaaaccucaacaccaaccucgccccauccguugcuccggucuuucccggcgaacgucuccucuucuuuagauccuacaucccacuaaaaggaggcuacggagacccagccaucgacugccuacucccacaagaauggguccaacacuucuaccaagaagccgcaccuucuaugagcgaagucgcccuaguacguuacaucaacccugacaccggacgagcuuuauuugaagccaaacuccaccgcgccggcuucaugacaguauccuccaacaccagcgcccccgucgugguccccgccaacggcuacuuccgcuucgacuccugggucaaccaauucuauucacucgccccaaugggcaccggaaacggacgccgacgcguacaauaa

SEQ ID NO: 37629 - RNA, 1629 nt, Artificial Sequence
  derived and/or modified sequence opt11 from VP1_capsid_protein__Norovirus__BAL60807
augaaaauggccuccaaugacgccgcccccagcacugacggcgcugcaggcuuaguccccgaauccaacaacgaagucauggcacucgaaccagucgccggugcagcccuagcagcccccgucaccggccagacaaacaucaucgaccccuggauccgagcgaacuucguacaagcccccaacggcgaguucaccguaagcccucgcaacucccccggagaagugcuacuuaaccucgaacuaggccccgaacucaauccguaccuagcucaucuagcccgcauguacaacggauacgccgggggcauggaaguacaagucaugcuagccggcaacgcauucaccgccggcaaacucgucuucgccgccgucccaccccacuuccccguugaaaaccuaagcccccaacaaauuaccauguucccgcacguuauaaucgacguccgcacccuagaaccagucuuacucccccuacccgacgugcgcaacaacuucuuccacuacaaucaaaaagacgaccccaaaaugcgcaucgucgccaugcuauacacaccccuccgauccaacgguucgggcgacgacgucuucaccguauccugccgcguccucacacgcccuagcccggacuucgacuucacauaccucgucccacccaccguagaaucaaaaaccaaacccuucacccuacccauccucacccuaggugaacuaucaaacucacgcuuucccguauccaucgaccaaauguacaccucacccaacgaagucaucuccguacaaugucaaaacggccgaugcacccucgacggagaacuccaaggcaccacccaacuacaagucuccggcaucugcgcuuucaaaggcgaagugacagcucaccuccacgacaacgaccaccucuacaacgucaccaucacaaaccucaacggaucccccuucgaccccuccgaagacauccccgcaccccucgguguacccgacuuccaaggccgagucuucggcgucaucucacaacgugacaaacacaacacccccggccacaacgaaccagccaaucgagcccacgacgccgucguaccaacauauacagcccaauacaccccaaaacugggccaaauccaaauaggaaccuggcaaaccgacgaccucacaguuaaccaacccgucaacuucacccccgucggccuuaacgacacagaccacuucaaucaaugggucguaccccgcuacgccggcgcucuuaaccucaacaccaaccucgcccccucagucgcccccgucuucccaggcgaacgccuccuauucuucagauccuacaucccccucaaaggcggauacggaaccccagccaucgacugucuucuaccccaggaauggguccaacacuucuaccaagaagcagcccccagcaugucagaagucgcccuagucagauacaucaaccccgacaccggcagagcccuauucgaagcaaaacuccacagagccggcuucaugacagucuccucaaauaccucugcccccgucgucguacccgccaacggcuacuucagauucgacucuuggguaaaccaauucuacucccucgccccaaugggcaccggaaacggaagacgcaggauccaguaa

SEQ ID NO: 37630 - RNA, 390 nt, Artificial Sequence
  derived and/or modified sequence opt11 from capsid__Norovirus__ACL14997
auggccuccaacgacgccgcccccucuaacgacggcgccgccggacucguccccgaauccaacaacgaaguaauggcccucgaacccgucgccggcgccucccucgccgcccccgucaccggccaaaccaacaucaucgaccccuggauccgcaugaacuucguccaagcccccaacggcgaauucaccgucuccccccgcaacucccccggcgaaguccuccucaaccucgaacucggccccgaacucaaccccuaccucgcccaccucucccgcauguacaacggcuacgcaggcggcauggaaguccaaaucaugcucgccggcaacgccuucaccgccggcaaacucaucuucgccgccgucccccccuacaaccgccgcugcuaa

SEQ ID NO: 37631 - RNA, 561 nt, Artificial Sequence
  derived and/or modified sequence opt11 from truncated_capsid_protein__Norovirus__ACB56490
augaaaauggccuccaacgacgccaaccccucagacggcuccgccgccaaccucguccccgaagucaacaacgaagucauggcccucgaacccgucgucggagccgccaucgccgcccccguagccggccaacaaaacgucaucgaccccuggauccgcaacaacuucguccaagcccccggaggcgaauucaccgucuccccacgcaacgcccccggcgaaauacucugguccgcaccccucggccccgaccucaaccccuaccucucccaccuugcccgcauguacaacggauacgccggcggcuucgaaguccaagucauccucgccggcaacgccuucaccgccggcaaaaucaucuucgccgccgucccccccaacuuccccaccgaaggccucucccccucccaagucaccauguucccccacaucaucgucgacgucaugcaacucgaacccguccucaucccccuccccgacguacgcaacaacuucuaccacuacaaccaauccaacgacucaacaauaaaauucgacuccaacgccgucuacaccaccuaa

SEQ ID NO: 37632 - RNA, 627 nt, Artificial Sequence
  derived and/or modified sequence opt11 from truncated_capsid_protein__Norovirus__ACF77106
augaaaauggcauccaacgacgccaacccauccgacggcuccgccgcaaaccucgucccagaagucaacaacgaagucauggcccucgaacccgucgucggcgccgccaucgccgcccccgucgccggccaacaaaacgucaucgaccccuggauccgcaacaacuucguccaagcccccggcggcgaauucaccgucuccccccgcaacgcccccggcgaaauccuaugguccgcaccccuaggccccgaccucaaccccuaccucucacaccucgcccgcauguacaacggcuacgccggcggcuucgaaguccaagucauccucgccggaaacgccuucacagccggcaaaaucaucuucgccgccgucccccccaacuuccccaccgaaggccucucccccucccaagucaccauguucccccacaucaucgucgacguccgccaacuagaacccguccucauaccucucccugacguccgcaacaacuucuaccacuacaaccaauccaacgacuccaccaucaaacucaucgcaaugcuauacaccccccuccgcgcaaacaacgccggcgaagacgucuucaccgucuccugccgcguccuaacccgccccaucuccuaa

SEQ ID NO: 37633 - RNA, 627 nt, Artificial Sequence
  derived and/or modified sequence opt11 from truncated_capsid_protein__Norovirus__ACF77107
augaaaauggcauccaacgacgccaaccccuccgacggcuccgccgccaaccucguacccgaagucaacaacgaagucauggcccucgaacccgucgucggcgccgccaucgccgcccccgucgccggccaacaaaacgucauagaccccuggauccgcaacaacuucguccaagcccccggaggcgaauucaccgucuccccccgcaacgcccccggcgaaauccucuggucagccccccucggccccgaucucaaccccuaccucucacaccuugcccguauguacaacggcuacgccggcggcuucgaaguccaagucauccuagccggcaacgccuucaccgccggcaaaaucaucuucgccgccgucccccccaacuucccaaccgaaggccuaucccccucccaagucaccauguucccccacaucaucgucgacguccgacaacucgaacccguccucaucccccuccccgacguccgcaacaacuucuaccacuauaaccaaucaaacgacuccaccaucaaacucaucgcaaugcuauacaccccccuacgcgcaaacaacgcaggcgaagacgucuucaccgucuccugccgaguccucacccgacccucccccuaa

SEQ ID NO: 37634 - RNA, 66 nt, Artificial Sequence
  derived and/or modified sequence opt11 from truncated_capsid_protein__Norovirus__ACU28807
augaaaauggccuccaacgacgcccaccccuccgacggcuccgccgccaccuccucccaacgcuaa

SEQ ID NO: 37635 - RNA, 312 nt, Artificial Sequence
  derived and/or modified sequence opt11 from truncated_capsid_protein__Norovirus__ACU28808
augaaaauggcauccaacgacgccaaccccuccgacggcuccgccgccaaccucguccccgaagucaacaacgaagucauggcccucgaacccgucgucggcgccgccaucgccgcccccgucgccggacaacaaaacgucaucgaccccuggauccgcaacaacuucguccaagcccccggcggcgaauucaccgucuccccccgcaacgcccccggcgaaauccucugguccgccccccucggccccgaccucaaccccuaccucucccaccucgcccgcauguacaacggcuacgccggcggccucuaa

SEQ ID NO: 37636 - RNA, 123 nt, Artificial Sequence
  derived and/or modified sequence opt11 from truncated_capsid_protein__Norovirus__ACV03476
augaaaauggccuccaugacccccacccaccucaugggcccccaacccaccuccucccaacgcuccaccaugcgccucuggcucugguccccccucuccgucccccuccuccgccgccucuaa

SEQ ID NO: 37637 - RNA, 87 nt, Artificial Sequence
  derived and/or modified sequence opt11 from truncated_capsid_protein__Norovirus__ACV03479
augaaaauggccuccaugaccccccuccaccucaugauggucccccccgccuccucccaacgcuccaccaugcgccaauggcgcuaa

SEQ ID NO: 37638 - RNA, 1623 nt, Artificial Sequence
  derived and/or modified sequence opt11 from capsid_protein__Norovirus__AFN70960
augaagauggccuccaaagacgccaacccuucagauggcuccacugccaaccuuguaccagaagucaacaacgaagucauggcccucgaaccggucguaggagccgcaaucgcagcccccguagccggucaacaaaacgucaucgaccccuggauccgcaacaacuucguucaagcccccggaggagaguucaccgucucaccccgaaacgccccaggugaaauucuaugguccgcaccccuuggacccgaccucaacccauaccuaucccaccucgcacgaauguacaauggauacgccgguggauucgaaguacaaguaauccucgccgguaacgccuuuaccgccggcaaagugaucuuugcagccguacccccaaauuuccccaccgaaggacuuuccccuucccaagucacaauguucccacacauaguuguagauguacgccagcucgaacccgugcucauaccauuacccgacguacgaaacaacuucuaccacuacaaccaauccaacgaccccaccaucaaacuaaucgccaugcuauacacaccccuucgggccaacaacgcaggcgaagacgucuucaccgucucaugccgcguacucacccgccccuccccagacuucgacuuuaucuuccucgucccacccaccgucgaaucccgcacaaaacccuuuaccguccccauccucacagucgaagaaaugaccaauucccgcuucccuauaccccucgaaaaacucuucaccggccccuccggagccuucguagugcagccccaaaacggacgcugcacuacugacggcguccuucuaggcaccacccaacucucaccagucaacaucuguacauuccgcggcgacgucacacacaucgccggcacacacaacuacaccaugaaccucgccucccaaaacuggaacaauuacgacccaacagaagaaauccccgcaccccuaggaacccccgacuucgucggccgaauacaaggaaugcuaacccaaaccacccgcggagacgguuccacccgaggacacaaagccaccguauccaccggagacguacauuucaccccaaaacucgguucgauccaauucaacacagacaccaacaacgacuucgaaacaggacaaaauacaaaguucacucccgucggcgucguccaagacggaaacggcacccaccaaaacgaaccucaacaauggguacucccaucauacuccgggcgcaccggucacaacguccaccuugcccccgccgucgcaccaacauuccccggcgaacaacuccuauucuuccgaucaaccaugcccggcugcucaggauacccaaacaugaaccucgacugccuccuaccacaagaauggguccaacacuucuaccaagaagccgcccccgcccaaucagacgucgcacuacuacgcuucgucaaccccgacaccggacgcguucuauuugaaugcaaacuccacaaauccggcuauguuacagucgcccacaccggccaacacgaccucgucauacccccaaacggcuacuuccgcuucgacucauggguuaaccaauuuuacacccucgcaccccucggaaacggcaccggacgacgucgcgcccucuga

SEQ ID NO: 37639 - RNA, 1629 nt, Artificial Sequence
  derived and/or modified sequence opt11 from VP1__Norovirus_and/or_Norovirus-like__X81879
augaaaauggccucgaacgacgcagccccgagcaccgauggagccgccggcuuaguccccgaauccaacaacgaaguaauggcacucgaacccguagccggcgcagcacucgccgcccccgucacaggccaaacaaacaucaucgacccauggauccgugccaacuucguacaagcaccaaacggagaguucacugucucaccccgcaacgccccaggagaaguccuccuaaacuuagagcucggcccugaacuuaacccauaccuagcccaccucgcccgcauguacaacggcuacgcaggcggcauggaaguccaagucaugcucgccggaaacgcauucaccgccggaaaacucgucuucgccgccguacccccacacuucccagucgaaaaccuaucuccacagaaaaucaccauguucccccacgucauaauagacguccgcacccucgaaccaguccuccucccccuacccgacguccgcaauucuuucuuccacuacaaccaaaaagacgaccccaagaugcgaaucgucgcaaugcucuacacaccccuccgaagcaacggcuccggagacgacgucuucacugucagcugucgcguccuuacacgcccaucucccgacuucgacuucacauaccucguuccacccacaguagaaagcaaaacaaaacccuuuacccugccaaucuuaacacucggcgaacuauccaacucccgcuuccccgucccaaucgaccaaauguacaccagccccaacgaggucauauccguccaaugccaaaacggccgcugcacccucgacggcgaacuccaaggaaccacucaacuccaagucuccggcaucugcgcauucaagggagaaguaaccgcucaccuacacgacaacgaccaccuaaacaacgucaccaucaccaaccucaacgguuccccuuucgacccaagcgaagacauaccagcaccccucggcguccccgacuuccaaggacgaguauucggugucauaucccaacgcgacaaacaaaacgccgccggucacuccgaaccagcaaaccgcggccacgacgcaguagucccaacauacaccgcccaauacacccccaaacucggacaaauccaaaucgggaccuggcaaacagacgaccucaccgucaaccagcccgucaaauucacccccguaggccucaacgacaccgagcacuucaaccaaugggucguaccccguuacgcaggagcgcuaaaucucaacacuaaccuagcccccuccgucgccccugucuucccaggcgaacgccucuuauucuuccgaagccaccuaccccucaaaggcggauauggcaaccccgcuauugacugccuccugccacaagaauggguccaacacuucuaccaagaagcagcccccagcauguccgaaguagcacucguccgcuacaucaaccccgacaccggccgcgcccuuuucgaagccaaacugcaccgcgccggauucaugaccguaucuucaaauacaucggcccccgucgucgucccagcaaacggauacuuccgcuucgacucaugggucaaccaauucuacucacucgcucccaugggaaccggcaacggacgccgacgcguacaauag

SEQ ID NO: 37640 - RNA, 1728 nt, Artificial Sequence
  derived and/or modified sequence opt11 from VP1__Norovirus_and/or_Norovirus-like__FJ875027
augaaaauggccucaaacgaugccgccccucccuccuccgacggagccgcuaaccuaguccccgaaauaaacaaugaagucauggcacucgaacccguagccggagcccaacuagcagcacccguagccggucaauucaacgcuaucgaucccuggauccgccaaaauuucguacaagcuccagaaggcgaauuuacaguaucuccccgaaacgcuccaggggaaauccuccucaaccuagaacucggcccccaccuaaaccccuuccuccaacaccucgcacaaauguacaacgcauacgccggcggaauggaaguccaagucguccucgcaggcaacgccuucacagcaggcaaaauaauauucgcagcuauaccaccacacuucccucccgaacgucuaucagccgcccaagccacucaauucccccacgucauaguagacguccgucaacuugaacccauaguucucccccuccccgacguaagacacaaccuauuccacuucaaucaacaaaacgacgaacgaaugcaccuagucgcuuuccuuuacaccccacuccgagcuaacucgggaaauggcgacgauguauucaccgucuccugucgaguacucacccguccaucccaagauuucgaauuuauguucuuggucccacccacagucgaaaagaaaaccguagccuucucacucccccagcucgccgucggcgaaaugucuaacucccguuggcccgcccgcaucacuggaaugguagucgacccccgccucccccaaguacuccacauccaaaacggccgcugcacccucgacggcacccucaugggcacaacccaacucaaccccaacgauauuugccgaauccgcggauacuucucuagcucccgccccgaacuccucugcgaaggggaagaauccgaagucaacaccacgcccaccgacucaggagcaaccggagaccagacaccagaaguccgcacuggcacacgcgcaacacaacgaugguucgcagucaccgaacugaauggacaagucuacgacccauucggagaucaaccagcaccccuaggaguccccgacuucaaagcacgaauccucggcgcccuuaugcgccuccccggaaccaauccaaccucuaacucccgcuucgaagacgcauggguggaaaccaacaaccaaaccaccuacgcaccagcaaccggaguugucgccaucaccacaaacgacaacagcucuggcaacuacgccaacgaccaaaccugcgaguucgucccacucgguaucgaaaucacagacuccgccccauacaacgaguucgaccuacccuccuacggcggagcugccuccagcggcaaccgcaaccucgcccccaccgucgccccgacauuccccggagaagcaauacuacucuuuggcuccaacaugcccgucuacaaccgcucauccgguaccgacaacaaagacauacgcugucuccucccuaacgaauacguccaacaucucuacgacacccaagccccuucccuuagcgacguugcccucguacgauacgucaaccgcgacaccggccguguucucuucgaagccaaacuucaccgagacggcuucaugacaguaaacgcuuccuccacuacaguccuccccguagacggcuacuuccgauucgacuccugggucaaccaauucuacgcccucagccccguaggaaacgccuccggccgacgauaa

SEQ ID NO: 37641 - RNA, 1725 nt, Artificial Sequence
  derived and/or modified sequence opt11 from VP1__Norovirus_and/or_Norovirus-like__JF939046
augaaaauggcauccaacgaugccgccuccccaagcuccgacggcgccgcaaaccucguaccugaaaucaacaaugaagucauggcccucgaaccuguagccggcgcccaacucgccgccccagucgccggacaauucaacgcuauagaccccuggauacgccaaaacuucguccaagcccccgaaggcgaguucacggucucgccccguaacgcucccggcgaaauccuccuuaaccucgaacucggcccccaccuaaaccccuuccuccagcaccuagcccaaauguauaacgcauacgccggaggcauggaaguacaaguaguacucgccggcaaugcauucacagcagguaagauaaucuuugcugccguacccccacacuucccucccgaacgccuuuccgcugcccaagccacccaauucccccacgucaucguagacguccgacagcucgaacccaucauccuaccccuacccgacguccgacauaaccuguuccauuucaaccaacaaaacgacgaacgcaugcaucucgucgcuuuccuauacacgccccuucgagccaacuccggauccggcgacgacgucuucaccgucucuugccgcguccucacccgcccaucccaagauuucgaguucauguuccucguacccccaaccgucgaaaagaaaaccgucgccuucucacuaccccaguuagcuauaggcgaaaugucuaacucccgauggccagcccgcaucaccggccucgucgucgacccacgccuaccacaaguacuccacauccaaaacggccgcugcacacucgacggcacccucaugggcaccacccaacucaaccccaacgacaucugucgcauacgcggcuacuucaguagcagccgccccgaacuacucugcgaaaacgaagaauccgcaaccgacccgaugccaacagaaaccgacaccgacaaccaaccacccgaaguacgcgcacaagcccgagcaacccaacgcugguucgccgucacagaacuuaacggacaagucuacgacccuuucggcgaccaacccgcaccccucggcguacccgacuuuaaagcacgaauccuaggagccuuaaugcggcuccccggaacaaauccuaccuccaacucccgcuucgaagacgcaugggucgaaacaaauaaccaaaccaccuacgcacccgccgccggagucgucgcaaucacgaccaacgauaacucauccuccaacuacgcaaaugaccagacuugcgaguucgucccacucggcauagaaaucaccgacuccgccccauaccacgaguucgaccuccccuccuacggcggcgcugcauccuccggaaacagaaaccuugcccccacaguugccccgacuuuccccggcgaagcaauccuccuuuucggcuccaacaugccugucuacaaccgaaacacaggcacauccaacaaagacauacgcugccuacucccaaacgaauacguccaacaccucuacgacacccaagcacccagccucagcgacgucgcccuuguccgcuacguuaaccgagacaccggccgcguacuauucgaagccaaacuccaccgcgacggcuucaugacugucaacgcuuccuccacaaccguccuccccgucgacggcuacuuccgauuugauagcuggguaaaccaauucuacgcucucuccccagucggcaacgccucaggacgccgcuaa

SEQ ID NO: 37642 - RNA, 1722 nt, Artificial Sequence
  derived and/or modified sequence opt11 from VP1__Norovirus_and/or_Norovirus-like__JF930689
augaaaauggcauccaacgacgccaccgcacccucccaagacggcgcugcuaaccucguccccgaaucccaacacgaaguacucgcacucgaacccgucgccggagccgcccucgcugcacccgucgccggccaguucaacgcaauagaccccuggaucaaacaaaacuucguccaagcaccagccggagaguucacuguuagcccucgcaacgcaccaggcgaaauccucauggaucucgaacucggccccgaacucaacccauuccucgcacaccuagcccaaauguacaacgccuacgccgguggaauggaaguacaaaucauacuugccggcaacgccuuuacggcaggaaaaaucauaguuugugccguacccccuaacuucccacccgaccgccucucagccucacaagcaaccaacuucccucacgucauaauggacguccgaacccucgaaccagucauccuaccacuccccgauguccgcgcaggcuucuuccacuacaaccaacuacgcgaaccccgaaugagacucauggccuugcuauacacuccccuacgggccaacggcaccggagacgacgccuucaccguuuccugcagaguccuaacccggcccaugcaggacuuugaguucauguuccucguaccacccaccgucgaaagccgcgucacccccuucucaguccccaccuaccccguagucgaaaugaccaacucacgcuggcccgcccgcaucuccggaaugcacgucaacgccaaccagacccucgcaguccaauuccaaaacggccgcugcacucucgacggccaacucaugggcacaacccaacucugcgccgccgacgugugccgcaugcgcggcagauacacauccacccgagccgaccucgccggagucgaccacaccgaccaaggcccgucccuaggcaccggccccuccgacgacucugucuccguaccagaagccagagcccaaacacgcaccggcguuucagcccaccuccaacuagaagaacucaacggacaacccuacgaggucuacggcgaacaacccgcaccccuaggcacaccagacuuccguugccgacucaugggcgaacucgucagacuacccuccaccuccccagcagcucaaucgcgauuccgugacgccuucuuugacaccuacggcgcacucuucgcucccgccguuggcuccaccaccuucacagugaauaacagcuccaccucagacuucgcaaacggacaacccuucgaauuucucccaaucggaguagaaaucggcaacucggcccaguacgacgaauuugcccuacccucauacaacggcgccaucggagaaaaccgccaccucgccccagucgcagcccccggcuucccaggcgaaaacaucgucuucuucucuucaaaccuuccagucugggacucaaccuccgcgcaaaacaaucgacgcauaaguugccuacucccaaacgaauuuguacaacacuucuacgaccuccaagcccccucacaauccgacgucgcccuacuacguuacguccaccccgaaagcggccgcguucucuucgaaugcaaacucuacagagacggauuccuaacugucaacggggcaucccucgccgaguuccccgugaacggcuacuuccguuucgacucauggguaaaccaauucuucacccucucccccguaggcacaggcuccggacgccgcuaa

SEQ ID NO: 37643 - RNA, 1719 nt, Artificial Sequence
  derived and/or modified sequence opt11 from VP1__Norovirus_and/or_Norovirus-like__GQ443611
augaaaauggcaucaaacgacgcgaccgcacccagccaagauggcgcagccaaccucgucccagaaucacagcacgaaguacuagcccuagaacccguagcuggagccgcccuagccgcccccgucgcaggacaauucaacgcaauugacccauggaucaaacaaaacuucguccaagcacccgcuggagaauucacagucagcccacgaaacgcccccggagaaauucuaauggaccucgaacuaggccccgaacucucacccuuccucgcacaucucgcacaaauguacaacgccuacgccggcggcauggaaguccaaaucauccuugcaggcaacgcuuucacagccgguaaaaucaucgucugcgcagucccaccaaacuucccccccgaucgccucuccgcaucacaagcaacaaauuucccgcacguuauaauggacguacguacccucgaaccagucauccuaccccuaccagacguccgagccggauucuuccacuacaaccaauuacgcgaaccacgcaugcgccuaauggcccuccucuacacaccacuucgagccaacggcaccggagacgaugcauucacagucuccugcagaguccuaacccgaccaaugcaagauuucgaauucauguuccucguaccaccaaccguagaaucacgcguaacccccuucuccguacccaccuaccccgucgucgaaaugaccaacucccgcuggcccgccaggaucuccgguaugcacgucaacgccaaccaaacccuagccguccaguuucaaaacggccgcugcacgcucgacggacaguugaugggaaccacccaacuaugcgccgccgaugucugccgcaugcguggacgcuacacaucgacccgggccgaccuagccggcguugaccacaccgaccaaggccccucccucggcgcagggcccucaaacgaccccguaucuguaccagaagcacgcagccaaacccgaaccuccguaucugcccaccuucaacuagaagaacuaaacggccagcccuacgaagucuacggagaacaacccgcaccccuaggcacucccgacuucugcugccgacuuaugggcgaacuaguccgccuacccucaaccucccccgcagcccaaucccguuuccgcgacgcauucuucgacaccuacggcgcccuauucgcaccagcugucggcuccacaaccuucaccgucaacaacuccucaacauccgauuucgcaaacggccaaccauucgaauuccuccccaucggcguagaaauuggaaauuccgcccaguacgacgaauucgcccuccccagcuacaacggugccaucggugagaaccgccaccucgccccugucgccgcccccggcuuccccggagaaaacaucgucuucuucuccuccaaucuuccagucugggacucuaccucugcucaaaacaaccgccgcauuuccugccuccucccaaacgaauucguccaacacuuuuacgaccuccaagccccaucccaaucagacgucgcccuacuccgcuacguccaccccgaaucaggacgcguacuuuucgaaugcaaacucuaccgagauggcuucuuaaccgucaacggcgccucccuagcugaauucccuguaaacggauacuuuagauucgacuccugggucaaccaauucuuuacacucucccccgucggaaccggaucgggccgcuaa

SEQ ID NO: 37644 - RNA, 1719 nt, Artificial Sequence
  derived and/or modified sequence opt11 from VP1__Norovirus_and/or_Norovirus-like__EU224456
augaaaauggccuccaacgacgccgcacccucuuccgacggagccggcaaccuaguuccagaaucccaccaagaaguacucccacuagcacccguagccggagcggccauagccgcaccaguagucggccaacaaaacaucaucgaccccuggaucaaagaaaauuucguacaagcaccccaaggagaguucaccgucucaccgaagaacuccccaggcgaaguccuaguaaaccucgaacucucacccaaacuaaaucccuaccuagaccaccucuccaaaauguacaacgccuacgccggcggcauggaaaucgaaaucauucucgccggcaacgcauuuaccgccggcaagguacucaucgcagccgucccaccaaacuuccccgucgaaaacaucuccgucucccaagccagucaauucccacacguaauugucgacguacguacccuugagcccauccgucuaccacucccagacgucagaacaaacuucuuccacuacacaacccgagacgaacccaaaaugagaaucgucgcauggcucuacacaccccuccgcaccaacggaucaggcgacgacucauucaccgucuccggucgaauccucacgcgccccucagcagacuucgaguucagcuuccuuguuccacccacagucgaaaccaagaccgucuccuucuccguccccggcuuaaccguagaagaaaugucaaacuccagauggcccgcacaaauuaacggccuagucguccgcggaaaugaagcacaagucguccacuuucagaacggaagaugcacaaccgaaggcaugcuucuaggaaccacuacacuaaaugucaacuccauaugcggacuccggggaaccucaauaucacacgcauccguucgcgaagcacccgcacucuccgaagaaaugccuccccucgaagacgaaguugcccauggcgccgccgcaaccuacgccgucgggcgagcagccgacacaacccucuggauccguguggaagaacccaacggacaacccuacgacaucuucggcgaacaaccagccccacuuggaacaccagacuucaccgccgucaucauaggaaccgccauccgaccgcgaacggccuccggagcuuacuuacacgacgccuacguugacacacgcccaggagacgccgauuucaccccauccaccggcaacaccaaaaucguccuacguggcggcggcagcggacacgugggcgaagggcacuacuggcaauucaaaccaaucgccgucgaaggaggccccaaccgccccgucuaccaagaauacaaccuacccgaauacgcagggcccaccgccucuaaccacaaccucgcuccgcccguagcacccaaaaugcccggagagcuccuucuacuauucgaaucagacaugcccguaugggacaacggcucaggcucagcacccacacagaaaauccacugccuccuccccaacgauuucgucacccacuucuuugaucuacaagccccagcacucgcagaagccgcacuccuccguuacguacauccagacucgggcagaacccuauucgaauguaaacuauaccgagaaggauacaugguaguagucgcacccucaggacgccucgauuucccccuugacggcuacuuucgcuucgacuccuggguaaaugccuucuacguccucaguccaguaggaaacggucaaggccgacgcuaa

SEQ ID NO: 37645 - RNA, 1719 nt, Artificial Sequence
  derived and/or modified sequence opt11 from VP1__Norovirus_and/or_Norovirus-like__EF450827
augaaaauggcaucauccgacgccaccccaucauccgauggugccgguaaccucguuccagaaucccaacaggaaguacucccacucgcaccaguggcaggcgcagcccuagcugccccggucguaggccaacaaaacaucauagaccccuggaucaaagaaaacuucguucaagcaccccaaggcgaguucaccguuucacccaaaaacucccccggagaaguccuagucaaccuagaacucucaccacgucuaaacccauaccuacaucaccucucuaaaauguacaaugccuacgccggaggcauggaaguugaaauaauucuagccggcaacgccuucaccgccgguaaaguucuaauagccgcagucccaccaaacuucccaauagaaaacguauccgccucacaagccagccaauuuccacacgucauugucgacguccgaacacuagaacccaucagacuaccccuccccgacguccgaacuaacuucuuccacuacaccacccaagaagaaccccgcaugcgcaucguagccuggcucuacacaccacuacgaacaaauggcuccggcgacgacagcuucacagucuccggucgcauccuuacccgccccucacccgacuucgaguucagcuuccucguaccacccaccguagaaaccaaaaccgucucuuucucagucccaggacucgucguacaagacaugagcaacucacgauggccagcacaaauuuccggucuagucguccgcggaaaugaagcccaagucguacacuuccaaaacggccgcugcaccacagaaggaaugcuccucggaacuacaacacuaaacaucaacucaauuugcggacuccguggccucuccgucucccaagccuccguccgcggagccccagcccucaccgaagaaaugccaccccuagaagacgaagucgcagacggagccgccgcaaccuacacacucacacgcgccgcagacaccgcccuuuggcuccgcgucgaggaacccgacggccgccccuacgacaucuucggagaucaacccgcaccccucggaacccccgacuucaccgccguaaucguuggcaccgccauacgcccccguaccacaucaggagcauaccuccacgacgcguacgucgacaccacccccggagacgccgacuucaccccaucaacuggcaacaccaaaaucguucuacgcgggggaggcucuggccacgucggccaaggccacuacuggcaauucaaacccaucgcaguagaaggaggaggcagccguccccaauaccaagaauacaaccuacccgacuacgccggaccaaccgccuccaaccacgaccucgccccucccguagcuccccgcaugcccggcgaacuccuccuacuauucgaauccgacaugccagucugggacaacggagccggcgccgcgcccgcacagaaaauccacugccuacuccccaacgaguucaucacccaccucuucgaccuccaagccccugcacuagccgaagcagcccuacugcgauacguccaccccgacuccggccgaacccuauucgaaugcaaacuguaccgcgaagguuacauggucgucgcugcccccguaggccgacucaacuucccccucgacggcuacuuccgauucgacagcuggguauccgcuuucuacguccuaucacccguaggcagcggucaaggcagacgcuaa

SEQ ID NO: 37646 - RNA, 1719 nt, Artificial Sequence
  derived and/or modified sequence opt11 from VP1__Norovirus_and/or_Norovirus-like__JF781268
augaaaauggcauccuccgaugcaacacccagcuccgacggagcaggcaaccuagucccagaaucacaacaggaaguacucccauuagcaccuguagccggggcugcccucgccgcgcccgucgucggccagcaaaacauaaucgacccauggauaaaagaaaauuucguccaagccccucaaggagaguucaccgucucacccaaaaacucccccggcgaaguccuagucaaccucgaacuaucuccccgacucaaccccuaccuagaccaccuauccaaaauguacaacgccuacgccggcggaauggaagucgaaaucauccucgcaggcaacgcguucacggccgguaaaguccucaucgcggccguucccccuaacuucccaaucgaaaacaucuccgccucgcaagccucacaauucccacacgucauagucgacguacgcacccuagaacccauccgccuuccccuccccgacguucguaccaacuucuuccacuacaccacacaagaagaaccgcgcaugcgcaucguagccuggcucuauaccccacuaagaacaaauggaagcggagacgauuccuucacagucuccggucguauacucacccgacccucacccgacuucgaguuuuccuuccugguaccacccaccguagagacuaagacagucaguuucuccguacccggccuaguugucgaagacaugagcaauucgcgauggcccgcccaaaucaacggccuaguaguccgcggaaacgaagcccaaguaguucacuuccaaaacggaagaugcacaacagaaggcacccuacuuggaacaacaacccuaucaauaaacucaaucuguggucuaagaggacucucaguaucccaagcaagcgucagaggcgcacccgcccucacugaagaaaugccgccccuagaagacgaaguagccgacggagccgcggcaaccuauacccuagccagggccgccgacacaacacucuggcuuagagucgaagaaccagacggacgcccguacgacaucuucggcgaccaacccgcaccccuuggcacccccgacuucacagccguaauugucggaaccgccauccggccacgcaccgcauccggcgcguaccuccaugacgccuacguagacaccaccccaggcgacgccgacuucacaccauccaccggcaacacaaaaauuguacuccgcggaggcggcuccggccacguaggacaaggccacuauuggcaauuccgccccaucgccguagaaggcggcggaucccgcccccaauaccaagaauacaaccuccccgacuacgcaggcccuaccgccucaaaccacgaccucgccccacccgucgcaccccgaaugcccggcgaacuccuccuacucuuugaaucagacaugcccgucugggacaacggcgccggcgccgccccagcccagaaaauacacugccugcucccaaacgaguucaucacccaccucuucgaccuccaagccccugcccucgcugaagcagcccuacuccgcuacguccacccagacagcggacgcacccuauucgaaugcaaacuauaccgcgaagguuauauggucguagcagcccccgcaggacgacucaacuucccccuagacggauacuucagauucgacuccuggguuucagcauucuacauacucucccccgucggcagcggccaaggcagacgauaa

SEQ ID NO: 37647 - RNA, 1698 nt, Artificial Sequence
  derived and/or modified sequence opt11 from VP1__Norovirus_and/or_Norovirus-like__KT245136
augaaaauggccucaaacggcgcggcggcgccaucucaagacggcgccgccaaccucguaccagagucacaacaagaagucuuagcccuagaacccgucgccggcgccgcacucgccgcccccguggccggucaauucaacgccauagaccccuggaucaaacaaaacuucguacaagccccugcaggcgaauucaccguaucaccacgcaacgcacccggcgaagugcucauggaucuagaauuaggcccugaaaugaacccguuccucgcccaccuugcacaaauguacaacgcauacgccggcggcauggaaguacaaauaauccucgccggaaacgccuucacagccggcaaaauaauagucugcgcaguucccccaaacuucccccccgaccggcucucagccucacaagccacaaacuucccacacgucauuauggacguccgaacccuagaaccagucguccucccacuccccgacguccgcgccggcuucuuccauuacaaccaacuccgcgaaccccgaaugcgccucaugacccuccucuacaccccucucagagccaacggcacaggcgaugacgccuucacugucucuugccgaguccucacucgccccaugcucgacuucgaauucauguuucucguaccccccacugucgaaucccgagucacucccuucucagucccaaccuaccccguagucgaaaugacaaacucacgcuggcccgcacgaauauccggaaugcaugucaacgccaaucaaacacucgccguacaauuccaaaacggccgcugcacccucgacggccaacucauggguaccacucaacucugcgccgccgacguaugccgaaugcgcggacguuacaccuccacacgcgcagaccccgcaggccucggaugggaccucgacgcaaccacccuaguagacggccccgaggcccgaguacaagcccguauuuccgucuccgcccaccuccaacucgaagaauuauccggccaacccuacgaagucuacggcgaacaacccgccccccucggcaccccagacuuccaaugccgacucaugggcgagcuaguccgccuacccuccgccaaccccguagcccaaagcagauucagagacgcauucuucgacacauacggugcacucuucgcacccgcggucggcucagucacuguuacugucaauaauuccuccucguccgacuucgccaacgaccagcccuucgaauuccucccaaucggcguugaaauaggcaacucagcaagauacgacgaauucgcccuaccuucauacaacggcgccaucggcgaaaaccgacaccucgcccccauagccgcccccgguuuccccggugaaaacuuaaucuucuucuccuccaaccuucccgucugggacagcaccuccgcccagucaaaucgacgcaucucuugccuacuacccaacgaauucauacaacacuucuacgacuugcaagcccccucccaauccgacgucgcccuccuucgcuacguacaucccgaaacagaccgcuuccucuucgaaugcaaacucuaccgagacgccuuccucaccgucaacggagcaucauacgcagaauuccccgucaacggcuauucccgcuucgacucgugggucaaacaauucuucacccucucaccugucgguaccggauccggccgucguuaa

SEQ ID NO: 37648 - RNA, 1659 nt, Artificial Sequence
  derived and/or modified sequence opt11 from VP1__Norovirus_and/or_Norovirus-like__AJ844470
augaaaauggccagcaaagacgccucccccucaacagacggcgccgcaaaucucguccccgaaucccaacaagaaguucucgcccuacaacccgucgcuggugcacaaaucgcugcacccgucgccggccaauucaacgucaucgaccccuggauauaccagaacuucguccaagcccccgaaggagaauuuacugugucuccccguaauucaaccggagagauucucaugaaccucgaacucgggccacaacuuaaucccuaccuagcccaccuagcccgaauguacaacgccuacgcaggcggcuuugaaguccaaguccuucuagccggcaaugcauucaccgcaggcaaaaucaucgucugcgccgucccucccaauuucccccuccaaaacaucucagccgcccaagcaacacaacucccccauguugucguagacguacgacaacucgaacccgucguccuuccccuacccgaugugcgcgccggcuuuuaccacuacaaccaaguugaagaaucccgaaugcgccuuguagccauccuauacaccccacugcgcacaaacuccgccggcgacgacgccuucacaguuucgugccguauccucacccgccccgccccugacuuuuccuucuucuuccuaaucccacccaccaucgaaucaaaaacaacccccuuuacccugccacgccuucccaucuccgaaaugaccaacucacguuucccccucgucaucaaaggcauggucguagaccccaaccucccacuccaagccaacuuccaaaacggacgaauaaccuuagacggcgaacuccaagguaccacccuccccaccagcaccucaauaggcagaaucucaggcaccuacauguccuccaccccauccagaaucauucaacacgaagacuccggagacuccacccaacccagagucuuuaacccuguauggauggaccucaccgaaaacaacuggacagaguuccaaccauucaacgaccaaccugcaccccucggcugccccgacuucaaagccaaaauccucggcacacucauccgccaacccaacaacggcuccuacuacuucgacgccuaccucgacacccgacaacacggcacauucgccccauacaccggacacgccgccguccauucugaccaacaagccggacaccucgcacaaggcuacaaaauucaauucagccccaccggcaucgaauccgaccaaaacacugaccuuaaccaacuaccagacuauggcggcgcaaugacagucuccaaaggacuagcacccgcagccgcccccgacuuccccggcgaaaugauacuauacuucguaagcgacaugcccguccgcaaccccaacggcgaaagacgcgacacggaaauccuaugccuccuaccccaagaaauggucacacacuucuacgaacaacaggcccccucacaaggcgacgucgcucuuguacgcuacaucaacgccgaaacaggccgagugauguucgagggcaaacugcaccgaaacggcuuuuucaccgucuccgccaccgcacgaacccuaaucguccccgacggauacuuccgcuucgacuccuggguuaaucgcuucuacacccuuucccccaugggaacaggcaacggacgucgcagagcccgcuaa

SEQ ID NO: 37649 - RNA, 1659 nt, Artificial Sequence
  derived and/or modified sequence opt11 from VP1__Norovirus_and/or_Norovirus-like__KJ196291
augaaaauggccuccaaagacgccucacccuccacagacggcaccgccaaccuagucccagaaucccaacaagaaguccucgcccuccaaccagucgccggcgcccaaaucgccgcgccugucgccggccaguuuaacgucaucgacccuuggaucuaccaaaacuucguacaagccccagaaggcgaauuuaccguaagcccccgcaacuccacuggcgaaauccucaugaaccucgaacucggcccccaacuaaaccccuaccuggcccaccucgcccgcauguacaacgccuacgcuggaggcuucgaaguccaaguccuccucgccggcaacgccuucaccgccggcaagauaaucgucugcgcagucccacccaacuucccccuccaaaacauauccgcagcccaagccacccaacuuccccacgucgucgucgacguccgccaacucgaacccgucguccucccccuacccgacguccgagccggcuucuaccacuauaaccaaguagaagaaagccguaugagauuaguagccauccucuacacaccccuccgaaccaacucugcuggggacgacgcauucaccgucucuugccgcauccucacccguccugcccccgacuucuccuucuucuuccuuaucccaccaacaaucgaaagcaaaacaacacccuucacccuuccccgacuccccauuuccgaaaugacuaacucccgauucccccucgucauaaagggcaugguuguagaccccaaccucccgcuccaagccaacuuccagaauggccgaaucacacuagacggugaacuccaaggcacaaccuuacccaccucaacauccauaggacgaaucuccggaacccacauguccuccacacccucccgaaucauucaacacgaagacucaggcgacucaacccaaccgcgcgucuucaacccgguauggauggaccuaaccgaaaacaacuggaccgaguuccaacccuucaacgaccaacccgcaccccucggcugucccgacuucaaagccaaaauccucggaacacuaauccgucagccaaacaacggcuccuauuacuuugacgccuacuuagacacucgucaacacggcacauucgcacccuacaccggccacgcagccguucacuccgaccaacaagccggucaucucgcucaagguuauaaaauacaauucucccccaccggcauagaguccgaccaaaacacagaccuaaaccagcuccccgacuacggcggcgccaugacagucuccaagggucucgcaccggccgcagccccugacuucccuggugaaaugauccucuacuucguguccgacaugcccguccgaaaccccaacggcgaacgccgcgacaccgaaauacuaugccuccuaccccaagaaaugguaacucacuuuuaugaacaacaagcucccucccaaggcgacgucgcccuaguccgcuacauaaacgccgaaaccggccgcgucauguucgaaggcaaauuacaucgcaacggauucuucacuguauccgcaaccgcacgaacacucaucguaccggacggcuacuuccgauucgacucauggguaaaccgauucuauacccucucaccaaugggcacaggcaacggacgucgccgagcacgcuag

SEQ ID NO: 37650 - RNA, 1653 nt, Artificial Sequence
  derived and/or modified sequence opt11 from VP1__Norovirus_and/or_Norovirus-like__KU870455
augaaaauggccucaaacgacgcagcccccuccaacgacggcgcagcuaaccuaguuccagaagcaaacaacgaaguaauggcacucgaacccguagucggagccagcauagcagcccccguagucggccaacaaaacaucaucgaccccuggauucgcgaaaacuucguccaggcaccccaaggcgaguucaccguaagcccccgcaacucccccggagaaaugcuacuuaaccuagaacucggacccgaacucaaccccuaccuuucccaccucucccgaauguacaacggcuacgccggcggcaugcaaguacaaguaguccucgccggcaacgccuucaccgccggaaaaauaauauucgccgccguaccgccccacuuccccgucgacaacaucuccgcagcacaaauaaccaugugcccccacguuaucguagacguacgacagcucgaacccguccuucuaccacuacccgacauccgaaacagauucuuccacuacaaccaagaagacacccccagaaugcgcuuaguagcaaugcucuacacaccccugagagccaacuccggcgaagaugucuucaccgucucaugcagaguucucacacgucccgcccccgacuuugaguucacauuccucgucccuccaaccgucgaauccaaaaccaagcccuucacgcuccccauacuaacccucggagaacuaucaaacuccagauuccccgccgccaucgacaugcucuacaccgaucccaacgaaagcauuguaguccaaccccaaaauggccgcugcacccuagacggcacccuccaagguacaacccagcuaguccccacccaaauuugcgccuuccgcggcacccuuauaucacaaaaugcccgcgccgccgaccucaccgacucaccucaacgcgcacgcgaccacccccuccacguacaagucaaaaaucuugacggcacccaauacgacccgacagacgauauccccgcuguacuaggcgccaucgacuucaaaggaacagucuucggcguugccucccaaagagauguuuccggaacccaagaacaaggccacuacgcuacccgcgcacacgaagcucacaucgacaccaccgauccuaaauacgcacccaaacuuggcaccauccucaucaaauccgaauccacugacuucacuacaaaccaacccauacguuucacacccguuggcaugggagacaacaacuggcgccaaugggaacuccccgacuacuccggaucccucacccuuaacaugaaccucgcccccgcagucuccccuuccuucccaggcgaacguauccucuucuuccgaucaauaguaccaucagccggaggauacgguucaggauacaucgacugcuuaauaccccaagaauggguccaacacuucuaccaagaagcagcccccagccaauccgccgucgcucuaguccgcuacgucaaccccgacaccggccgcaacauuuucgaagcaaaacuccaccgcgaaggcuuccucacuguagcaaacuccggcaacaaccccaucguaguaccaccuaacggcuacuuccgcuucgaagccugggucaaccaauucuacacacucgcccccaugggauccggacaaggucgccgucgagcccaauga

SEQ ID NO: 37651 - RNA, 1653 nt, Artificial Sequence
  derived and/or modified sequence opt11 from VP1__Norovirus_and/or_Norovirus-like__AF414408
augaaaauggcauccaacgacgcagcccccucaaacgacggagcagccaaucuugucccugaagcaaacaacgaagucauggcacucgaacccguugucggcgccuccauagcugcucccguagucggacaacaaaacauaauagaccccuggauccgcgaaaacuucguccaagcaccacaaggagaguucacaguauccccucgcaauuccccgggggaaaugcuacucaacuuagaacucgguccagaacuaaaccccuaccucucgcaccuaucacgcauguacaacgguuacgccggaggaaugcaaguacaagucguccucgcuggcaacgccuuuaccgccgguaagaucaucuucgccgcuguaccuccccacuuccccguagaaaacaucucggccgcccaaauaaccaugugcccccacgucauagucgacgucaaacaacucgaaccaguccuccucccacuccccgacauacgcaaccgcuuuuuccacuacaaccaagaagacaccccucgcaugcgccuagucgccaugcucuacacaccccuccgcgccaacuccggcgaagacgucuucaccgucuccugccggguccucacccgcccagccccugacuucgaguucaccuuccucgucccuccaacagucgaaucuaaaaccaaaccuuucacccuccccauccuaacacuaggcgaacuauccaauucccguuucccggccgcaaucgacaugcuuuacaccgaccccaacgaaucaaucgucguccaaccacaaaacggccgcugcacccucgacggcacacuccaagguaccacccaacucguaccaacacaaaucugcgcauuucgaggcacucucaucucacaaaccgcccgcgccgcugacuccaccggcucaccacaacgagcccgaaaccacccacuucauguccaagugaaaaaccuugacggcacccaauaugauccaacugacgacaucccugcaguacucggugccaucgacuucaaaggaaccguauuuggcgucgcaucccaacgcgacgucuccggccaacaagaacaaggccacuacgccacccgcgcucacgaagcacacauagacacaaccgacccaaaauacgccccaaaacucggaacaauauuaauaaaaucagacuccgacgacuuuaauacaaaccaacccauacguuucacccccguaggaaugggcgacaacaacuggcgacaaugggaacuccccgacuacucuggccaccuaacccucaacaugaaccucgcccccgccgucucccccuccuuccccggugaacgaauccucuucuuccgaucgaucguccccuccgcaggcggauacgguucaggcuacauagacugucuaauaccacaagaauggguccaacacuucuaccaagaagccgcacccucccaauccgccgucgcucucgucagauacgucaaccccgacaccggccgcaacauauuugaagccaaacuccaccgcgaaggcuuccucacagucgcaaauucagguaacaaccccauagucgucccacccaacggcuacuuccgcuucgaagccuggguaaaccaauucuacacccucgcccccaugggcuccggacaaggccgccgccgcgcccaauaa

SEQ ID NO: 37652 - RNA, 1653 nt, Artificial Sequence
  derived and/or modified sequence opt11 from VP1__Norovirus_and/or_Norovirus-like__AB084071
augaaaauggccuccaacgacgccgcucccagcaacgacggcgccgccaaccucguccccgaagcaaacaaugaagucauggcccucgaaccagucguaggugcauccaucgccgcaccugucgugggacaacaaaacaucauagaccccuggauccgugaaaacuucguccaagccccacaaggagaauuuaccguaagcccccgcaauucccccggugaaaugcuccucaaccucgaacucgggccugaacucaaccccuaccucagccaccuuuccagaauguacaacggguacgccggaggcaugcaaguacaagucguccuagccggcaacgccuucaccgccggaaaaauaauauucgccgccgucccaccacacuuccccguagacaacaucucagcagcccagauaacaaugugcccccacgucaucgucgacguccgccagcuagaacccguccuacuaccccuccccgacaucagaaaccgguucuuccacuacaaccaggaaaacaccccacgcaugcgccucguagccaugcuguauacaccccuacgcgccaacucaggcgaagacgucuucacagucuccugcagagugcuaacccgccccgcgcccgacuucgaguucaccuuccuuguacccccaacagucgaauccaaaaccaaacccuucacacuacccauucucacacucggagaacuauccaacucacgguuccccgccgccauagacaugcuauacacagaccccaacgaaaguauagucguccaaccacaaaacggccgcugcacacucgacggcacucuccaaggcaccacccagcuaguccccacacaaauaugcgccuuccgcggaacccucaucucccaaaccgcccgugccgccgacuccaccgacuccccacaacgugcacgcgaccauccccuucacguacaggucaaaaaccucgacggcacccaauacgacccaaccgacgacaucccagccguccucggcgcaauagacuucaaaggcacaguauucggagucgccucccaacgcgacguaaguggcccacaagaacaagggcacuacgcuacccgcgcacacgaaacccacaucgacaccaccgaccccaaauacgcccccaaacucggcaccauccuaaucaaauccgaaagcaacgauuucauaacaaaccaaccuauccgauucacaccagucgguaugggcgacaacaacuggcgccaaugggaacuccccgacuacucgggccgacucacccuaaacaugaaccucgccccagccgucucacccuccuucccaggcgaacgcauccuguucuuccgcucaauaguccccuccgccggcggcuacggauccggcuauauagacugcuuaauaccccaagaauggguccaacacuucuaccaagaagcagcaccaucacagucagcuguagcucucguccguuacguuaaccccgacaccggccgcaacaucuucgaagcaaaacuccacagagaaggauuccucaccgucgcaaacucaggcaacaacccuauaguugucccacccaauggauacuuccgauucgaagcauggguaaaccaauucuauacacuagcacccaugggcucaggacaaggccgucgccgcgcacaauaa

SEQ ID NO: 37653 - RNA, 1653 nt, Artificial Sequence
  derived and/or modified sequence opt11 from VP1__Norovirus_and/or_Norovirus-like__AF414407
augaaaauggcauccaacgacgccgcccccucuaacgacggagccgcuaaccuagucccugaagcuaacaacgaagucauggcccucgaaccagucguuggcgccagcauagccgcucccgccgucgggcaacaaaacaucauagaucccuggauccgcgaaaacuucguccaagcaccccaaggcgaguucaccguaucaccacgcaacucaccuggagaaaugcuacucaaccucgaacuaggccccgaacugaaccccuaccuuucccaccugucucgcauguacaacggcuacgccggagguaugcaaguucaaguagugcucgcaggaaacgccuucacugcaggcaaaaucaucuucgcugcagucccaccccacuuccccguagaaaauaucuccgcggcacaaaucaccaugugcccccacgucaucgucgacgucagacaacuagaacccguauuacucccccuaccugacauccgaaaccgcuuuuuccacuacaaccaggaaaacacaccccgcaugcgucuagucgcaaugcucuacacaccccuccgagcaaacagcggagaagacgucuucacaguaucaugccgaguccucaccagaccagccccagauuucgaguucacauuccucguacccccaaccgucgaaucaaaaaccaaacccuucacacuacccacacucacacucggcgaacucuccaacccccgcuuccccgcugcuaucgacaugcucuacaccgacccaaacgaauccaucgucguucaaccacaaaacggccgcugcacacuugacggcacccuacaaggcacaacccagcuaguacccacccaaaucugcgccuucagaggcacacuaaucucccaaaccgcacgcgccgccgacucaacagauucuccccaacgcgcccgcaaccacccccuccacguccaggucaaaaaccucgacggcacccaauacgacccaacagacgacauaccagccgucuuaggagccauagacuuuaagggcaccgucuucggugucgccagccaacgagauguaucaggacaacaggaacaaggccacuacgccacacgcgcacacgaagcccacaucgacacuaccgacccaaaauacgccccaaaacucggcaccauccucauaaaauccgacuccgacgacuucaacacaaaccaacccauaagauucacaccaguuggcaugggagacaacaacuggcgacaaugggaacuacccgacuacucuggccgacucacccucaacaugaaccucgcacccgcaguaucacccucauucccaggggaaagaauccucuucuuccgauccauaguacccucagcaggaggcuacggcucaggcuacaucgacugccucaucccccaagaauggguucaacacuucuaccaagaagccgcacccucacaaucagccgucgcccuaguucgguacguaaaccccgacacaggccgcaacaucuucgaagcaaaacuacacagagaaggcuuccuaacaguagccaauuccgguaacaaucccaucguagucccacccaacggcuacuuccgcuucgaagccugggucaaccaauuuuacacucuagcgcccaugggcuccggccaaggccgccgccgagcacaauaa

SEQ ID NO: 37654 - RNA, 1653 nt, Artificial Sequence
  derived and/or modified sequence opt11 from VP1__Norovirus_and/or_Norovirus-like__AB039777
augaaaauggccaguaacgacgcugcaccauccaacgauggagccgccaacuuaguccccgaagccaauaacgaagucauggcccucgaaccugucguaggcgcauccaucgccgcacccgucguaggacaacaaaacaucauagacccauggauccgugaaaacuucguccaagcuccccaaggcgaguucacaguauccccacgaaacagccccggcgaaaugcugcuaaaccuagaacuuggacccgaacuaaacccauaccuaucacaccuuucuccaauguacaacggauacgccggaggcaugcaaguccaggucguccucgccggcaacgccuucaccgcaggcaaaaucauauucgcagcuguacccccgcacuuucccguagacaacaucuccgccgcccaaaucacaaugugcccacacguaaucguagacguccgccaacucgaacccgucccccucccccuccccgacauacguaaccgcuuuuuccacuacaaccaagaaaacacaccccgcaugcgccucgucgcuaugcuauacacaccccuccgcgccaacuccggcgaagacgucuucaccgucucaugcagaguccucacccgacccgcccccgacuucgaguucacuuuccuugucccacccaccgucgaauccaaaaccaaacccuucaccuuacccauccuuacccuaggcgaacucuccaauagucguuuccccgccgcaaucgacaugcuuuacacugaccccaacgaaucgauagucguccaaccacaaaacggccgcugcacgcuugacggaacacuccaaggaacaacccagcucguaccuacccaaauaugcgccuucagaggcacccucaucucccaaacagcccgcgcagcagacucaaccgacucaccccaacgugcacgugaccacccccuccacguccaagucaaaaaccucggcgguacccaauaugacccaaccgaugacauccccgccguccuuggcgcaaucgacuucaagggcacaguauucggagucgcaucacaacgcgacgucuccggcccccaagaacaaggccacuacgccacacgcgcucacgaagcacacauagacacuacugacccuaaauacgccccaaaacuaggcaccauacucaucaaauccgaaagcaacgacuucaccacuaaucaaccgauacgauucacccccgucggaaugggagacaacaauuggcgacaaugggaacucccagacuacagcggccgacucacccucaacaugaaccucgccccagcaguaucccccucuuuccccggcgaaagaauccuauucuuccguucuauaguacccagcgccggcgguuacggcuccggcuacaucgacugccuaaucccacaagaauggguccaacacuucuaccaagaagccgcaccgucccaauccgccguagcucucguccgauacgugaaccccgacaccggccgcaacauauucgaagccaaacuccaccgcgaaggauuccucaccgucgccaauucaggcaacaacccuauagucgucccgcccaacggcuacuucagauucgaagccuggguuaaucaauucuacacacucgcccccaugggcucuggccagggccgacgucgagcccaauaa

SEQ ID NO: 37655 - RNA, 1653 nt, Artificial Sequence
  derived and/or modified sequence opt11 from VP1__Norovirus_and/or_Norovirus-like__AB078337
augaaaauggccuccaacgacgccgcaccauccaacgacggcgccgccaaccugguccccgaagccaacgaugaagucauggcacucgaacccguagucggagccucaauagcagcaccuguagucggccaacaaaacaucauugaccccuggauccgagagaacuucguccaagcuccccaaggugaguucaccgucuccccacguaacucccccggcgaaaugcuucucaaccucgaauuaggacccgaacucaaccccuaccuaucccaccucucacggauguacaacggcuacgccggagguaugcaaguccaagucguccuagccggcaaugccuuuaccgccggcaaaaucauauucgccgccgucccaccccacuuccccguagaaaacaucuccgcagcacaaauaaccaugugcccacaugucaucguagacguccgccaacucgaaccaguccuucucccacugcccgacauccguaaccgcuucuuccacuacaaccaggaaaacacuccccgcaugcgucucguagcaaugcuauacacuccccuccgagcuaacucaggcgaagacguauucaccgucuccugccgcguucucacccgccccgcccccgacuucgaguucaccuuccuaguaccacccaccgucgaauccaaaaccaaacccuucacacuccccauccucacacugggagaacuuuccaacucacgauuccccgccgccaucgacaugcucuacaccgaucccaacgaaagcaucgucguucaaccccagaacggccgauguacacucgacggcacccuacaaggcaccacacaacucguccccacacaaaucugugcguuccgaggcacccucaucucacaaaccgcacgagccgccgacuccaccgacagcccccaacgcgcucgcaaccacccccuccacguccaagucaaaaaccuagacggcacccaauacgacccaaccgacgacaucccagccguacucggagcaaucgauuucaaaggcacaguauucggugucgcaucccagcgugauguauccggccagcaggaacaagggcacuaugccacccgcgcccacgaagcccacaucgacacaacagaccccaaauacgcccccaaacugggcaccauccuaaucaaauccggcuccgacgacuucaacaccaaccaacccauccgauucacuccagucggaaugggcgacaacaacuggcgacaaugggaacuccccgacuacucaggccgacucacccuaaacaugaaccuagcucccgccguaucccccuccuuccccggagaacgcauccucuucuuucgcucaaucguuccauccgccggcggcuacggcucaggcuacauagacugccucauaccacaagaguggguacaacacuucuaccaagaagcugcccccucccaaucagcaguagcccuagucagauacgucaauccugacacaggccgcaacaucuucgaggcaaaacuacaucgcgaaggauuccucaccguagccaacugcggcaacaacccaaucguagucccacccaacggcuauuuccgcuuugaagccugggguaaccaauucuacacuuuagcacccaugggcucaggacaaggcagacgccgcgcccaauaa

SEQ ID NO: 37656 - RNA, 1653 nt, Artificial Sequence
  derived and/or modified sequence opt11 from VP1__Norovirus_and/or_Norovirus-like__AB039776
augaaaauggccucaaacgacgccgcaccauccaacgacggagccgcaaacuuagugccagaagccaacaacgaaguuauggcccucgaacccgucgucggcgcauccauugccgcuccaguggucggucaacaaaacauuaucgaccccuggauccgcgaaaacuucguucaggccccacaaggagaguucaccgucucaccccgcaacucucccggcgaaaugcuucuaaaucucgaacucggccccgaacuuaaccccuaccuaucacaucucagcccuauguauaacggauacgccggaggaaugcaaguacaaguaguacuagcaggaaacgcauucacagccgguaaaaucaucuucgccgcaguuccuccgcacuuccccgucgacaacauauccgccgcccaaaucacaaugugcccccacguaaucguugacguccgacaacuagaacccguaccacuaccccuacccgacauccgcaacagauucuuccacuacaaccaagaaaacacccccagaaugcgccucgucgccauguuauacaccccacuccgcgcaaacucaggcgaagacgucuucaccguaagcugccgcguacucacaagacccgcacccgacuucgaguucaccuuccucguaccacccaccgucgaauccaaaaccaaacccuuuacccuccccauacugacccuaggagagcucucaaacucccgauuccccgccgcaaucgacaugcuauacacagaccccaacgaauccaucgucguacaaccccaaaauggccgcugcacccucgacggcacacuccaagggaccacccagcuaguaccuacacaaaucugcgccuuccgaggaacccucaucucccaaaccgcacgcgccgccgacuccacagacucuccccaacgcgccagagaucacccacuacacguccaagucaaaaaccucgacggcacccaauaugaccccaccgacgacauccccgccguacucggagccauugacuucaaaggcaccgucuucggcguagccucacaacgagacgucucagguccacaagaacaaggccacuacgccacccgggcccacgaagcgcacauagacaccaccgaccccaaauacgcccccaaacuaggcaccauccucaucaaauccgaaucaaacgauuucacuacaaaccaacccaucagauucacccccgucggcaugggcgacaacaacuggagacaaugggaacuccccgacuacucaggacgacuagcacucaacaugaaccuugcacccgcagucucccccagcuucccaggagaacgaauccucuucuucagaucaaucgucccaucagcuggcggcuacggauccggauauaucgacuaccuaaucccccaagaaugggugcaacacuucuaccaagaggccgccccaucucaaagcgcugucgcccuaguccgcuacgucaaccccgacacaggucgaaauauauucgaagcaaaacuucaccgcgaaggcuuccucacaguagcaaacuccgguaacaaccccaucguaguaccaccuaacggcuacuuccgauuugaagccugggucaaccaauucuauacacuagcccccaugggcuccggucaaggccgacgcagagcacaauaa

SEQ ID NO: 37657 - RNA, 1653 nt, Artificial Sequence
  derived and/or modified sequence opt11 from VP1__Norovirus_and/or_Norovirus-like__KT030674
augaaaauggcaucauccgacgcagcccccucuaccgacggagcaggaaaccucgucccagaaucccaacaagaaguccucccccuugcaccaguagcuggcgcagcuuuagcagccccuguaguuggccaaacaaacaucauugaucccuggauaaaagaaaauuucguccaagcaccccaaggcgaguucaccguaucccccaaaaacucccccggagaaauacucguuaaccucgaacugggacccaaacucaaccccuaccuagaccaccucucacggauguacaacucauacgccggaggcauagacgucauggucguccucgcaggcaacgcauucacagcaggcaaagucuuaaucgcagcaauacccccaaacuucccagucgaagguguauccgccucccaagccacacaguucccacacgucaucaucgacguccgaacacucgaccccgucagacuaccacucccagacgucagauccaccuucuuccacuacaccaacgacaccgaacccaaaaugcgccuaguaaucuggcuauauacaccccuccggacaaauggcuccggggacgauucuuucaccguuuccgggcgaauacugacccgacccucccaagacuucgaguucgcauuccuaaucccaccaacagucgaaacaaaaaccacccccuucagcgucccaggcuucucuguccaagaaauguccaacucacgcuggcccgcagcuaucuccgccauggucguucgaggcaacgaaccccaagucguucaauuucaaaacggacgcgcccaccuagauggaaugcuccuaggcaccacccccguaagccccaacuacauagcaucauaccgcggaaucucaaccggcaacucccgauccgccuccuccgaagccgacgaacgagcagucggcucauucgacguauggguacgccuccaagaaccagacggacaacccuacgacauauucgguaaacaacccgcgcccaucggaacccccgauuucaaagcagucaucgucggcuuugccgcacgcccccucaccuccggcucuuacgccaacgaagccuacgucaacaccaccgccucagacuacgccccagcgaccggaaacaugcgauucaccguccgcaacggcggcaccggucacaucuccgcaaacaaauacugggaguucaaaucauucggcgucgaaggcgaacgccacaccgacauacaguaccaggaauaugaacuccccgacuacucuggccaaguugccuccaaccacaaccuugccccucccguagcuccccgcaugcccggcgaaagccuccuacucuuucaauccaacaugcccgucugggaugacggccgaggcgaaucaacaccaaagaaaauccacugccuacuuccacaagaguucaucggacacuucuucgacaaacaagcccccucacuaggcgacgccgcccuccuucgcuaugucaaucaggaaaccaaccggguacucuucgaaugcaaacuguaccgagacggcuacaucaccgucgccgcaagcuccggccuacucgacuucccacucgacggauucuucagauucgauuccuggguaucauccuucuacauacucucccccgucggaucaggacaaggacgccguuaa

SEQ ID NO: 37658 - RNA, 1653 nt, Artificial Sequence
  derived and/or modified sequence opt11 from VP1__Norovirus_and/or_Norovirus-like__DQ093067
augaaaauggccuccaacgaugccgcccccucgaccgacggcgccggcaaccuagucccagaaucucaacaagaaguccucccccuugcccccgucgccggagccgcccucgcagcucccgucgucggucaaaccaacaucaucgaucccuggaucaaagaaaacuucguucaagcaccccaaggagaauuuacggucucgcccaaaaacucaccaggcgaaauucucgucaaccucgaacucggccccaaauuaaacccuuaccuagaccaccucucacgcauguacaacucauacgccggaggcaucgauguaauggucguccuagccggcaacgccuucacagccggaaaaguccucauugccgcaauacccccaaauuucccagucgaaggcguauccgccucacaagccacacaauucccacacguugucauugacguacgaacccucgacccugucagacucccacucccagacguccgcucuacauucuuccacuacaccaacgacacugaacccaaaaugcgccucgucaucuggcuuuacacaccccuccgaaccaacggcuccggcgacgacuccuucaccgucucagggcgcauccucacccgccccucucaagacuucgaauuugcguucuugauaccucccaccguagaaaccaaaaccacccccuucuccguccccggguucuccguccaagaaaugucgaacagccgcuggccagccgccauaucagcgauggucguccgcggaaacgaaccccaagucguucaauuccaaaauggucgcgcacaccuagacggcaugcuucuaggcaccacccccgucucccccaacuacaucgcaucuuaccgcgguauauccacuggcaacucccgcuccgcauccucagaagccgacgaacgagccguaggauccuucgacguauggguccgccuccaagaacccgacggccaaccauacgacauauucggaaaacaacccgcuccaaucggaacccccgacuucaaagccgucaucgucggcuucgccgcccguccacuuaccuccggcuccuacgccaacgaagcauauguaaacacaacugcuucagacuaugcacccgcuacaggcaauaugcgcuucacaguccgcaacggaggcaccggccacaucucagccaacaaauacugggaguucaaaucauucggagucgaaggcgaaggccacaccaacauccaauaccaagaauacgaacucccugacuacuccggccaagucgccagcaaccacaaccucgcaccacccgucgcaccccgcaugcccggcgaaucccuccuccuauuccaaagcuccaugcccguaugggacgacggccacggugaaagcacccccaagaaaauccacugccuccuaccccaagaguucauaggucacuucuucgauaaacaagcacccagccuuggcgacgccgcccuccuucgauacgucaaccaagaaacaaaccgcguucucuucgaauguaaacuauaccgcgacggcuacauaaccgucgcagccuccagcggccuucucgacuucccucucgacggauucuuccgauucgauucuugggucuccuccuucuacauccuuucccccgucggcuccggccaaggccgucgcuaa

SEQ ID NO: 37659 - RNA, 1653 nt, Artificial Sequence
  derived and/or modified sequence opt11 from VP1__Norovirus_and/or_Norovirus-like__AF195847
augaagauggccuccagcgacgccgcaccauccgcagacggagccggcaaucucguacccgaaucccaacaagaaguccuaccccucgcuccagucgccggggcagccuuagcagcgcccguagucggccaaaccaacaucaucgacccauggaucaaagaaaauuucguacaagcaccccaaggcgaauuuaccgucucccccaaaaacagccccggcgaaauccuugucaaccucgaacucgguccaaaacucaaccccuaccuggaccaccucucccgaauguacaacuccuaugccggcggaauugacguaaugguaguccucgccggaaacgccuucacagccggcaaaguacuaaucgccgccaucccaccuaacuucccagucgaaggcgucagcgcaucccaagccacacaauucccucacgucaucaucgacguccgaacacucgacccaguccgucucccccuaccggacguccgcucaacauucuuccauuauaccaacgacaccgaaccuaaaaugcgccucguaaucuggcucuacacuccacuccggacaaacggaucuggcgaugacucauucacagucucaggccgaauccucacccgcccuucucaagauuucgaauuugccuuccuaauaccucccacaguagaaaccaagaccacccccuucagcguucccggauucuccguucaagaaaugagcaacucaagauggcccgcagcaaucuccgccauggucguccgcgguaacgaaccacaagucguccaauuccaaaacggccgcgcccaccucgacggcaugcuccuaggaaccacccccgucucacccaauuauaucgccucauaccgaggcaucagcacuggcaacucccgguccgcuagcccagaagccgacgaaagagcgguaggcuccuucgauguguggauacgccuacaagaacccgacggccaacccuaugacaucuucggcaaacaacccgcacccaucggcacccccgauuucaaggccgucauaguuggcuucgccgcacggccucucaccuccggaucuuacgccaacgaagcauacguaaacacaaccgccuccgacuaugcccccgcaaccggaaacaugcgcuucaccguccgcaacggcggcagcgggcacaucuccgcgaacaaauacugggaauuuaaguccuucgguguagaaggcgaacgccauaccgacauccaauaccaagaauacgaacuccccgacuacuccggacaaguagcauccaaccacaaccucgcaccacccguagcaccccgaaugcccggcgaaucauuacuccucuuccaaagcaacaugcccguuugggacgacggccacggcgaaaguacacccaagaaaauccacugccuccucccccaagaguucaucggacacuucuucgacaaacaagcccccucccucggcgacgccgcccuccuccgcuacgucaaccaagaaaccaaccgaguacuauucgaaugcaaacuuuaccgugacggcuauauaaccgucgccgcaagcuccggacuccuagacuucccccuagacggcuucuuccgauucgacagcuggguauccucauucuauauccucucucccgucggcuccggccaaggacgucgauaa

SEQ ID NO: 37660 - RNA, 1653 nt, Artificial Sequence
  derived and/or modified sequence opt11 from VP1__Norovirus_and/or_Norovirus-like__JQ970479
augaaaauggccucaucagacgccgcuccauccgcugacggagccggaaaucucguccccgaaucccagcaagaaguacucccucuagcgcccgucgccggcgccgcccucgccgcccccguagucggccaaacaaacaucaucgaccccuggauuaaagaaaacuucguccaagcaccccagggcgaguucacugucucccccaaaaacucaccaggagaaauccucguuaaccuggaacucggaccuaaacucaaccccuaccuagaccaccucucccgcauguacaacucuuacgccggcggcauagacgugaugguaguccucgccggcaacgccuucacagccggaaaaguacucaucgccgccauaccacccaacuuccccgucgaaggaguauccgcaucccaagccacgcaauucccccacguaauaaucgacguaagaacacuagaccccguucgacuacccuugcccgacguccgcuccaccuucuuccacuacaccaacgacaccgagcccaagaugcgccucgucaucuggcuauacacaccacuccgcacaaacggcuccggugacgacuccuucacaguuuccggccgaauccucacacgaccaucacaagacuucgaguucgcauuccucauaccucccacagucgaaaccaaaacuacccccuucucuguccccggcuucucaguccaggaaauguccaauucacgcuggcccgccgccaucuccgccaugguaguccgcgguaacgaaccucaaguaguccaauuccaaaacggcagggcccaccucgacggcaugcuccucggcacaacccccguauccccuaauuacauagccucuuaccgagguauauccaccggcaauucccgaagcgccuccuccgaagccgacgaacgcgccgucggcucauucgacgucuggauacgccuucaagaaccugacggccaaccauacgacaucuucggcaaacaacccgcccccaucggaacccccgacuucaaagcagucaucgucggcuuugcugcacgcccccuuaccuccggcuccuacgcaaaugaagccuacgucaacaccacagccuccgacuacgcacccgccacaggcaacaugcgcuucaccguccgcaacggcggcacaggccacauauccgccaacaaauauugggaauuucgcuccuucggcguugaaggcgaacggcacacagacguccaauaucaagaauacgaacuucccgauuacuccggccaagucgccuccaaccacaaccuagcaccacccgucgcaccccgaaugccaggugaaucccuacuccuguuccaauccaacaugcccgucugggacgacggccgaggagagucaacacccaagaaaauucacugccuucucccucaagaguucauuggccacuucuuugacaaacaagcaccaucccuaggcgacgccgcacucuuacgauacguaaaucaagaaaccaaccggguacuauucgaaugcaaacucuaccgcgacggauacaucacugucgccgcagcauccggucuccuagacuucccccuagacggauucuuccgcuucgacucauggguaagcucauucuacauccuaucgcccgucggcuccggucaaggcagacgcuaa

SEQ ID NO: 37661 - RNA, 1653 nt, Artificial Sequence
  derived and/or modified sequence opt11 from VP1__Norovirus_and/or_Norovirus-like__FM865412
augaaaauggccuccucugacgccgcacccucuacugacggagccggcaaccucguccccgaaagccaacaagaaguccuaccucuggcccccguugccggagccgcccuagcagcacccgucgucggacaaacuaauaucaucgaccccuggaucaaagaaaacuucguccaagccccacaaggagaauuuaccgucucccccaaaaacuccccaggcgaaauccucgucaaccucgaacucggcccaaaacuaaacccuuauuuagaccaccuauccagaauguacaacuccuacgccggcggcaucgacgucaugguaguccucgcaggaaacgcuuucaccgcaggaaaaguucucauagccgcgauaccacccaacuuccccguagaaggcgucuccgccucucaagccacccaauucccccacgucaucaucgacguccgcacccuagaucccguccgccuaccccuacccgauguccgauccacauucuuccacuauaccaacgacaccgaacccaaaaugcgccucgucaucuggcuguacaccccucuccgcaccaacggcuccggcgaugacuccuuuacagucagcggccguauccucacucgucccucccaagacuucgaauuugcauuccuaaucccacccaccguagaaaccaaaaccacucccuucuccguccccggauucucuguccaagaaauguccaacucccgauggcccgccgccaucucagcaauggucguaagaggaaacgaaccccaagucguccaauuccagaauggucgcgcccaccucgacggcaugcuccuuggcaccaccccaguauccccaaacuacaucgccuccuacagaggaaucucaacaggaaacucccgcucagccucaucagaagcugacgaacgcgcaguaggcuccuucgacgucuggguacgccuacaagaaccggacggccaacccuacgacaucuucggcaaacaacccgcucccauaggcacacccgacuucaaagcugucaucgucggcuucgccgcccgcccccucaccuccggcucuuacgcuaacgaagcguacgucaacacgacggccagcgacuacgcgcccgcaacaggaaacaugcgcuucacaguccgcaacggcggcaccggacacaucuccgcaaacaaauacugggaguucaaauccuucggcgucgaaggcgaacgccacaccaacauccaguaccaagaauacgaacuacccgacuacucaggccaaguugcauccaaccacaaucuagcgcccccagucgcgccccgaaugcccggcgaaucacuccuacucuuccagucaaacaugcccguaugggacgacggccauggagaaucaacccccaagaaaauccacugccuccuaccccaggaauuuauaggucacuucuuugacaaacaagccccaagccucggagacgccgcacuccuccgauacgucaaccaagaaaccaaccgcguccucuucgaaugcaaacucuaccgagacggcuacaucaccgucgcagcauccagcggccuacucgacuuuccacucgacggcuucuuccgguucgacuccuggguaucauccuucuacauccuaucccccguaggcuccggccaagggcgccgcuaa

SEQ ID NO: 37662 - RNA, 1653 nt, Artificial Sequence
  derived and/or modified sequence opt11 from VP1__Norovirus_and/or_Norovirus-like__AF414426
augaaaauggcuagcagcgacgcagcccccucuaccgacggcgccggcaacuuagucccagaaucccaacaagaaguacuuccacucgcaccaguugccggugcugcacucgccgcccccgucgucggccaaaccaacauaaucgaccccuggaucaaagaaaacuucguacaagcuccccaaggcgaguucaccgucucacccaaaaauagcccaggcgaaauccuagucaaccuagaacucgguccaaaacugaacccauaccuagaccaucucagccgaauguauaacagcuacgccggcggcaucgacguaaugguuguccucgccggcaacgccuucaccgccggcaaaguccuaaucgccgccaucccacccaacuuccccgucgaaggcguuagcgccucacaagccacccaauucccccacguaaucauugacguccgaacacuagaccccguccgccucccucuccccgacguacgcuccaccuucuuccacuacacuaacgacaccgaaccaaaaaugcgccucgucaucuggcucuacacaccccucagaaccaacggaucgggggacgacucauucaccguaucuggcagaauccucacacgcccaucacaagacuucgaauuugccuuccucaucccacccaccgucgaaacaaaaacaacacccuucuccguccccggcuucuccguacaagaaaugagcaacucacgcuggcccgccgccaucuccgcaauggucguucguggcaacgaaccccaagucguccaauuccaaaacggccgagcccaccuugacggcaugcuccuuggcaccaccccaguuucaccuaacuacaucgcaucauacagaggaaucucuacgggcaacucccgcuccgcauccucagaagccgacgaacgcgcuguuggcuccuuugaugucuggguacgccuccaagaacccgacggucaacccuacgauaucuucggaaaacaacccgcccccaucggcacacccgacuucaaagccgucaucgucggcuucgccgcccgcccacucaccucuggcuccuacgcaaacgaagcauauguaaacacuacagccucagacuacgcccccgcaacaggaaacaugcgcuucaccguacguaacggaggcaccggccacauauccgcaaacaaauacugggaguucaaaucuuucggcguugaaggcaagagacacacuuccauacaauaccaagaauacgaacuccccgacuacucaggccaagucgcaagcaaccauaaccucgcaccacccguagcuccccgaaugccuggcgaaucacuacuacuguuccaaucaaacaugcccgucugggacgacggucacggcgaauccacccccaagaaaauacacugccuccucccccaagaguucaucggacacuucuucgacaaacaagcccccucccugggagacgcagcacuccuccgcuaugucaaucaagaaacuaaccgcguccucuucgaaugcaaauuauaccgagaugguuacaucaccgucgccgccuccucaggccuccuagacuucccacucgacggguucuuccgcuucgacucauggguuucauccuucuacauacuaucccccguaggauccggccagggccgccgguag

SEQ ID NO: 37663 - RNA, 1653 nt, Artificial Sequence
  derived and/or modified sequence opt11 from VP1__Norovirus_and/or_Norovirus-like__AF414427
augaaaauggccucaagcgacgcagcacccucagcagacggcgccggcaaucucgucccagaaagccaacaagaaguccuaccacuagccccagucgcaggugccgcucuagccgcuccagucgucggccaaacaaacaucaucgauccauggaucaaagaaaacuucguccaagccccgcaaggcgaauucacaguuuccccuaaaaacucccccggcgaaauacucguaaaccuugagcucggacccaaacuaaacccauaucuagaccaccuaucccguauguacaacucauacgccggcggaaucgacgucaugguuguccucgccggaaaugcauucacggccggcaaaguccuuauagccgcaauccccccuaacuucccuguugaaggcguguccgccucacaagcuacccaauucccccaugucaucaucgacguacgcacccucgacccagucagacucccccuccccgacguacgcuccaccuucuuccacuacaccaaugacaccgaacccaaaaugcgacucguaauauggcucuacaccccacuccgcaccaacggauccggcgacgacucuuucaccguaucaggccgcauucuuacacggcccagccaagauuucgaauucgccuuccuuauccccccaacggucgagaccaaaaccacacccuucuccguccccggcuuuucaguccaagaaauguccaauucaagauggccagccgccaucucagccauggucgucagaggcaacgagccccaagucguccaauuucaaaacggccgagcacaccucgacggcauguuacuuggcaccacacccguauccccaaacuacauagccucauaccgcggaaucuccacaggaaacuccagaucagcauccacugaagccgaugaacgagccgucggauccuucgacgucuggauccgacuacaagaacccgacggucaaccauacgacaucuucggcaaacaaccagcaccaauaggcacccccgacuucaaagccgucaucguaggcuucgccgcccgcccucucacaagcggauccuacgccaacgaagccuacgucaacacuacugcuuccgacuacgcccccgcuaccggcaacaugcgcuucaccguccgcaacggcggcagcggccauaucucugcaaacaaauauugggaauucaaaucauucggcgucgagggcgaacgccacaccgacauccaauaccaagaauacgaacucccugacuauuccggccaagucgccucuaaccacaaccucgcgccccccgucgccccccggaugcccggugaaucccuacuccuuuuccaauccaacaugccgguaugggacgauggacacggcgaaagcaccccaaaaaaaauccacugccuccucccccaagaauucaucggccacuucuucgauaaacaagcacccucacugggcgacgccgcacuccuacgcuacgucaaccaagaaaccaaccgcguacucuuugaaugcaaacuuuaccgcgacggcuacauaacagucgcagccuccuccggacuccuugauuucccacuggacggcuuuuuccgcuucgacuccugggucuccuccuucuacauccucuccccaguaggcucaggucaaggucgacgcuaa

SEQ ID NO: 37664 - RNA, 1653 nt, Artificial Sequence
  derived and/or modified sequence opt11 from VP1__Norovirus_and/or_Norovirus-like__JQ613567
augaaaauggccuccucagacgccgcucccuccaccgacggcgccggcaaucuaguacccgaaagccaacaagaaguacuaccccucgcaccagucgccggagcggcccucgcagcccccgucgucggccagaccaacaucauagacccguggauaaaagaaaacuuuguucaagccccucaaggcgaauucacagucucccccaaaaacucucccggcgaaauccucguaaaccucgaacuaggaccaaaauugaaucccuacuuagaccaccuaucccgaauguacaacuccuacgccggaggcauugauguuauggucguccucgccgggaacgccuucacagcuggcaaaguccuaauagcagcuaucccgcccaacuucccuguagaaggcgucucagccagccaagcaacacaauucccccacgucauuaucgacguccgcacacucgacccagucagacuuccgcuucccgacguccgauccaccuucuuccacuacacaaacgauacugaacccaaaaugcgucuugucaucuggcuauacaccccccuccgcaccaacggcucuggcgacgacuccuuuacugucucaggucgaauccucacacggccaucacaagacuucgaauucgcuuuccucaucccccccacagucgaaaccaaaaccacacccuucagcguccccgguuucuccguccaagaaaugucaaacucccgauggcccgcagccauaucagcuauggucguccgcgguaacgaaccacaagucguucaauuccaaaacggccgcgcccaccucgacggcaugcuccucggcaccaccccagucucacccaacuauauugccuccuaccguggcaucuccacaggcaacucccgcuccgccuccuccgaagccgacgagcgcgccguaggguccuucgacguauggguccgccuacaagaacccgacggucaacccuacgacaucuucggaaaacaacccgcacccauaggcaccccagacuucaaagccgucaucgucggcuuugccgcccgcccccucaccuccggcagcuacgccaacgaagcauacguaaauacaacagccuccgacuacgcucccgccaccggcaacaugcgcuucaccguccgcaacggcggcaccggccacauauccgccaauaaauacugggaauucaaauccuucggggucgagggcgaacgccacacugacauacaauaccaggaauacgaacuccccgacuacucaggucaagucgccucgaaccacaaccucgccccgccugucgcaccacgcaugcccggcgaaagccuccuccuauuccaauccaacaugcccgucugggacgacggccacggugaaucaacacccaaaaaaauccacugccuccuaccccaagaauucaucggccacuucuucgaccgccaagcccccucacuuggcgacgcagcccugcuacguuacgucaaccaggaaaccaaccgcguccucuuugagugcaaacuauaccgagacggguacaucaccguggcagccuccuccggccuacucgacuucccccuagacggcuucuuccgcuucgacuccugggucagcucauucuacauccuaucacccguaggcucaggccaaggucggagauaa

SEQ ID NO: 37665 - RNA, 1653 nt, Artificial Sequence
  derived and/or modified sequence opt11 from VP1__Norovirus_and/or_Norovirus-like__KC894731
augaaaauggccuccagcgacgccgcgccauccaccgacggcgccgguaaucucguaccagaaucccaacaagaaguccuaccccucgcccccgucgccggcgcagccuuagccgcccccgucgucggccaaacaaacaucaucgacccauggauaaaagaaaacuuuguccaagccccacaaggugaguucaccgucucucccaaaaacucaccaggagaaauccucguaaaccucgaacucggcccuaaacucaacccauaccucgaccaccucucccgaauguacaacuccuacgccggcggcauagacgucauggucguacuagccggcaaugcauucacugcuggcaaaguacuaauagcagccauaccuccaaacuuccccgucgaagucguauccgccagccaagccacccaauucccccacgucaucaucgacguacgcacccuggaccccguccgccucccccuaccugacguccgcagcaccuucuuccacuacacaaacgacaccgagccaaaaaugagacuuguuaucuggcucuacacaccccuacgaaccaacggaucaggcgacgacucauucaccgucucuggccgcauccucacccgaccaucccaagacuucgaauuugcauuccucaucccucccacagucgaaaccaaaaccacucccuucuccguccccgguuucucaguacaagaaaugagcaacucccgcuggcccgccgccaucuccgccaugguuguacgcggcaacgaaccacaagucguccaauuccaaaacggccgagcucaucuagacggcaugcuccuaggcaccacucccgucucuccaaacuacauugccuccuaccgcgguaucagcaccggcaacuccagauccgccuccccugaagcagaugaacgcgccguaggcuccuucgacguguggguacgacuucaagaaccagacggccaacccuacgacauauucggcaaacagcccgcacccauaggaacaccagacuucaaggccgugaucguaggcuucgccgcacgcccccuaaccuccggaucuuacgccaacgaagccuacgucaacaccaccgcuuccaacuacgcccccgccacaggcaacaugcgcuucacaguccgcaacggcggcaccggccacacaucagccaacaaauacugggaauuuaaguccuucggaguggaaggagaacgccacaccgguauccaauaccaagaauacgaacuccccgacuacuccgggcaaguugccuccaaccacaaccucgccccacccgucgccccacgcaugcccggugaaucacuucuccucuuccaaagcaacaugccagucugggacgauggccacggcgaauccacccccaagaaaauccacugccuccucccccaagaauuuaucggccacuucuucgacaaacaagcucccucauuaggcgacgccgcacuccuaagauaugucaaccaagaaacuaaccgaguccucuucgaauguaaacuuuacagagacggguacaucacugucgcagccucaucaggccuccucgacuuccccuuagauggcuucuucagauucgacuccuggguauccuccuucuacauccucucucccgucggcagcggccaaggccgucgcuaa

SEQ ID NO: 37666 - RNA, 1647 nt, Artificial Sequence
  derived and/or modified sequence opt11 from VP1__Norovirus_and/or_Norovirus-like__AF427118
augaaaauggcauccaacgacgcagccccauccuccgacggagccgccggccuaguccccgaauccaacaacgaagucauggcccucgaaccagucgcaggcgcaucccucgcugccccagucaccggacaaaccaauauaaucgaccccuggauccgcaugaacuucguccaagcccccaacggagaguucaccgucagcccaagaaacucacccggagaaguacuccuaaaucuagaacuaggccccgaacugaacccauaccucgcccaucuuucccgaauguacaacggauacgccggaggcauggaaguacagauuaugcucgcuggcaacgccuuuaccgccggcaagcucaucuucgcagcagucccaccccacuuccccaucgaaaaccuuucacccccacaaauaacgauguucccccacguaauaaucgauguccgcacacucgaaccaguccuacuucccaugccagacauaagaaacuccuucuuccacuucauccaacgcgaugaacccaaaaugcgucucgucgccaugcuuuacacaccccuacgcuccaacggauccggcgacgacgucuuuaccguaucaugccgcguucuuacccgccccacccccgacuucgauuucaccuaccuggucccacccacagucgaauccaaauccaaacccuucacacuucccauccucacccucggcgaacuaaccaacucacgauucccccugcccauagacguccucuacacaaaccccaacgaauccgccauaguacaaugccaaaacggcagauguacacucgauggcgaacuccaagguacgacacaacuacuccccacgggcaucugcgccuuccgaggcaaagucacccaacaaguacaggacgaacaccgaggcacccacuggaacaugacagucacuaaucuaaacggcacccccuucgacccaaccgaagacguaccagcaccacuuggaacucccgauuucucaggacaaaucuacggcguaaucucccaacgaaauacuaacacaguacccggagaaggagaccuacccgcgaaccgcgcccacgaagccgucaucgccaccuacagcccaaaauucacaccaaaacuaggcaauauccaauucuccaccugggaaacccaggacguaaguuccggccaacccacaaaauucacccccgucggacucgccagcguagaugccaacucacacuuugaccaauggacacucccuuccuacagcggcgcccucacccuaaacaugaaccuagcccccuccgucgcacccgucuuccccggcgaaugccuccuauucuuccgcucauucaucccccucaaaggcggcuacggcaacccagccaucgacugccucaugccccaagaauggguacaacaccuguaccaagaauccgcaccuucccucucagacgucgcccuuguccgauacguaaaccccgaaacuggacgcacccucuucgaagcaaaauuacaccgaaauggcuuccuaaccgucgcacgcaacuccgccgguccaguugucgccccaacuaacggcuacuuccgauucgacucauggguuaaccaauucuauacucuagcccccaugggcaacggauccggacgacgccgcaugcaauga

SEQ ID NO: 37667 - RNA, 1647 nt, Artificial Sequence
  derived and/or modified sequence opt11 from VP1__Norovirus_and/or_Norovirus-like__AY237415
augaaaauggcauccaacgaugccgcucccagcuccgacggcgccgccggccucgugcccgaauccaacaacgaaguaauggcccucgaaccagucgcaggcgcaucccuagccgcccccguaaccggacaaacaaacaucaucgaucccuggauacgaaugaauuucguacaagcuccgaacggcgaauuuaccgucuccccacgcaacucacccggagaaguccuccucaaccuagaacucggacccgagcucaaccccuaccucgcccaccucucccgaauguacaacggcuacgcuggcggaauggaggugcagauaaugcucgccggcaacgccuucaccgccggcaaacucaucuucgcagccguuccaccccauuuccccaucgagaaccuauccccgccccaaaucacuauguucccccacguaaucaucgacguccgcacccucgaacccguccuuuuacccaugcccgauauacgcaacuccuucuuccacuuuauccaacgcgacgaacccaagaugcgacucguagcaaugcuauacacaccccuccgguccaacggauccggcgaugacguuuucaccgucaguugccguguccuuacccgucccacccccgacuucgacuucaccuaccuagucccacccacugucgaaucuaaaagcaaacccuucacacuccccaucuuaacccucggagaacucaccaacucccgauucccccuccccaucgacguccucuacacaaacccaaaugaauccgccaucguccaaugccaaaacggcagaugcacccucgacggagaacuccagggaacaacccaacuccuccccaccggcaucugcgccuuccgcggcaaggucacacaacaaguccaagacgaacaccgcggaacacacuggaacaugacaguaaccaaccucaacgguacccccuucgaccccaccgaagacguccccgcaccccucggcaccccugacuucucaggacagaucuacggaguaauaucccaacgcaacaccaacacaguacccggagaaggaaaccuccccgccaaucgugcacacgaggccgucaucgccaccuacagccccaaauucacccccaaacucggcaauauccaauucuccacaugggaaacucaagacgucucuagcggccaacccacuaaauucacacccgucggccucgcaucuguagacgccaacucucacuucgaccaauggacacuccccuccuacuccggagcauuaacacuuaacaugaaccucgcccccucugucgcaccaguauuccccggcgaaugccuacucuucuuccgauccuucaucccauuaaaaggaggcuacggcaaccccgccaucgacugccucaugccccaagaauggguacaacaccucuaccaggaaucggccccaucccuauccgacguagcccuaguccgauacgucaaccccgaaacaggacgcacccucuucgaagcaaaacuacaccgaaacggcuuccucaccgucgcccgaaauuccgccggcccagucgucgcacccaccaacggauacuuccgcuucgauucauggguaaaccaauucuacacccucgccccaaugggcaacggcucuggccgccgcagaaugcaauaa

SEQ ID NO: 37668 - RNA, 1647 nt, Artificial Sequence
  derived and/or modified sequence opt11 from VP1__Norovirus_and/or_Norovirus-like__AF504671
augaaaauggccagcaaugacgcugcuccauccaacgacggcgcagccggccuagucccagaaucuaacaacgaaguaauggcccuagaaccagucgcuggagccucacuagcugcccccgucaccggacaaacuaacaucaucgacccauggauccgcaugaacuucguucaagccccaaacggagaguucaccgucucuccccgcaacucccccggcgaaguccuacucaaccucgaacugggacccgaacuaaaccccuaccuugcccaccucucccgcauguacaacggauacgccgggggcauggaaguucaaaucaugcucgcuggcaacgccuucaccgccgguaaacucauauucgcugccguacccccacacuuccccaucgaaaaccuauccccaccgcaaaucaccauguucccccaugucaucauugacgugcgcacccucgaaccaguccuacuaccaaugcccgacauccgcaauuccuucuuccacuucauccaacgagacgaaccuaaaaugcgccucgucgccaugcucuacacaccccuccgcuccaacggaucaggcgacgacgucuucacagucuccugccgcguccucacccgcccuacccccgacuuugacuuuaccuaccuaguacccccaacagucgaauccaaaucaaaaccauucacccuccccauccuuacacucggcgaacucaccaacuccagauucccccuacccaucgacguacuguacaccaaucccaacgaauccgccaucguccaaugccaaaacggccgcugcacacucgacggugaacuccaaggcacaacccaacuccucccuaccggcaucugcgccuuccgagguaaaguaacacaacagguacaagacgaacaccgcggcacacacuggaacaugacaguuaccaaccucaacgguaccccauuugaccccacagaagacguacccgcaccccuaggcacaccagacuucucggggcaaaucuacggcgucaucagccaacgcaauacaaacaccguucccggcgaaggaaaccuucccgcaaaccgcgcacacgaagccgucaucgccaccuacuccccuaaauucacccccaaacucggcaacauacaauuuucaacaugggaaacacaagacguauccuccggccagccaaccaaauucacaccaguaggccucgccuccgucgacgccaauucccacuucgaucaauggacccucccauccuacucaggugcccuuacccuaaacaugaaccucgcccccuccgucgcaccugucuucccaggcgagugccuccuauucuuucgcuccuucauaccccucaaaggcggauauggcaacccagccauagacugccuaaugccucaagaauggguccaacaccuuuaccaagaaagcgcacccucacucuccgacgucgcccucguccgauacguuaacccagaaaccggacgcacacucuuugaagccaaauuacaccgaaacggcuuccucacaguagcccgcaauuccgcaggaccagucgucgcccccacgaacggcuauuuccgcuucgacuccuggguuaaccaauucuacacccuugccccuaugggcaacggcuccggccgucgccgcaugcaguga

SEQ ID NO: 37669 - RNA, 1647 nt, Artificial Sequence
  derived and/or modified sequence opt11 from VP1__Norovirus_and/or_Norovirus-like__KJ194504
augaaaauggccucaaacgacgcagccccaucaaacgacggagccgccggccuagucccagaaaucaacaacgaagcaauggcacuagaacccgucgccggagccgccaucgccgcaccacuaacaggccaacaaaacauaaucgaccccuggaucaugaacaacuucguacaagcccccggcggcgaguucaccgucucaccccgcaacuccccgggcgaaguccuccuaaaccucgaacucggaccagaaauaaaccccuaccucgcgcaccuugcccgaauguacaauggcuaugccgggggcuucgaaguccaagucguccucgccgggaacgccuucaccgcaggcaaagucaucuucgcagccauaccacccaacuucccuaucgacaaccucucagcagcacaaaucaccauguguccacacguuauugucgacguuagacaacuugaacccaucaaccuccccaugccggacguccgcaacaauuucuuccacuacaaccaaggcucagacucacgcuuaagacucgucgcaaugcuauacacuccacuacgagcaaacaacagcggugacgacgucuucaccgucucaugccgaguccucacacgcccaucacccgauuucuccuucaacuuccuagucccucccacuguagaauccaaaacaaaaccauucacccuccccauacucaccaucuccgaaauguccaacuccagauuccccgucccuauagacucccuccauacauccccaaccgaaaacaucgucguucaaugccaaaacgggcgcgucacucuagacggcgaacucaugggcacaacacaacuccuaccaagccaaaucugcgcuuuccgcggcacccucaccagaagcacaucccgcgcaagcgaccaagccgacacacccaccccuagacaauucgaucacagauggcacauacagcuagacaaccucaacggcacccccuacgaccccgccgaagauaucccagccccacuaggcacaccagacuuucgaggcaaaguauucggcgucgccucccaacgcaaccccgacggcacaacccgcgcccacgaagccaaagucgacaccacaaccaaccgcuucacccccaaacuaggaucccucgaaaucauuacggaauccgaagacuucgacaccaaccaauccacaaaauucacacccgucggcguaggcgucgacaacgaggaagaguuccaacaauggucccuacccaacuacuccggucaguucacccacaacaugaaccucgcacccgcugucgcccccaacuuccccggcgaacaacugcuauucuuccguucccaacuccccucauccggcggaugguccaacggcauacucgacugccuggucccccaagaauggguccaacacuucuaccaagaauccgcacccgcacaaacccaaguagcccuagucagauacguaaacccagacaccggacgcguacucuucgaagccaaacuccacaaacucggcuucaugaccaucgccaaaaauggcgacuccccaaucaccgucccacccaacggcuacuuccgauuugaaucauggguuaaccccuucuacacccuagcacccaugggcaccggcaacggaagaaggcgcauucaauag

SEQ ID NO: 37670 - RNA, 1647 nt, Artificial Sequence
  derived and/or modified sequence opt11 from VP1__Norovirus_and/or_Norovirus-like__KJ194500
augaagauggcauccaacgacgcagccccauccaacgacggcgccgcgggccucguccccgaaauaaacaaugaagcaauggcccuagaacccgucgccggugccgccauagccgccccacuaacaggacaacaaaacaucauagaccccuggauaaugaauaauuucguccaggcccccgguggugaauuuacaguuagcccccgaaacucacccggcgaaguccuccucucccucgaacucggaccugaaaucaacccauaucuagcucaccucgcccgcauguacaacgguuacgccggcggauucgaaguacaaguaguccucgcuggcaaugccuucaccgcaggcaaaauuauauucgccgccauaccaccgaacuuccccaucgacaaccucuccgccgcccaaaucacaaugugcccccacguaaucgucgacguccgacagcucgaacccguaaaccuaccgaugcccgacguccgcaacaacuucuuccacuacaaccaauccuccgaaucccgcuuacgccucaucgccaugcucuacacaccacuccgcgcuaacaacucuggagaugacguauucacaguauccugccgcguacuaacccgaccaucccccgacuucuccuucaacuuccucgucccacccaccguugaauccaaaaccaaaccauuuacccuacccauccucacaaucucugaaaugucaaacucccgcuucccaguacccaucgacucacuccacaccucgcccacugaaaauauagucguccaaugccaaaacggccguguaacucucgauggcgaauuaaugggaaccacccaacuccucccgucccaaauaugcgcauuccgcggaacccucaccggaucgacaucccgagcauccgaccaaaccgacaccccaacaccccgccaauucgaucgacgcuggcacauccaacucgacaaucuuaacggaacccccuacgaccccgccgaagacauacccgcaccccucggcacccccgacuuccgcggcaaaguauucggaguagccucacagcgcaacccagaccgagccaccagagcccacgaagcaaaagucgacaccaccuccgaccgauuugcccccaaacuaggaucacucgaaaucacaacggaaucuggcgacuucgaagccaaccaaccgaccaaauucacccccgucggaaucggcgucgacaacgaagccgaguuccaacagugguccuuaccaaacuacuccggccaaauuacacacaacaugaaucucgccccagccgucgcccccaacuucccaggcgaacaacuacuauucuuccgcucacagcucccguccuccggaggcugguccaacggcguccucgacugccuccucccccaagaauggguccaacacuucuaccaagaaagcgcacccgcccaaacccaaguugcccucguccgcuacgucaaucccgauaccggacgcguucuauucgaagcaaaacuacauaaacucggcuucaugaccauagcuaaaaacggagacucucccaucaccgucccaccaaacggcuacuuccgcuucgaaucaugggucaaccccuucuacacacuagcacccaugggcacaggcaacggccgacgacgaauccaauga

SEQ ID NO: 37671 - RNA, 1647 nt, Artificial Sequence
  derived and/or modified sequence opt11 from VP1__Norovirus_and/or_Norovirus-like__DQ093063
augaaaauggccuccaacgacgcagccccaucaaacgacggcgcugccggccucguacccgaaaucaacaaugaagccauggccuuagacccagucgccggcgccgccaucgccgccccacuuaccggccaacaaaacaucaucgaccccuggaucaugaacaacuucgugcaagcccccggcggcgaguucaccgucucaccccguaacucccccggugaaguccuccucaaccucgaacuaggccccgaaaucaaucccuaccucgcucaccuagcucgcauguacaacggauacgcaggaggcuucgaaguccaagucguccucgccgguaaugccuucacugccggcaaggucaucuucgccgccauacccccgaacuuccccaucgacaaccucucggcugcgcaaaucaccaugugcccccacguuaucguagacguccgacaacucgaacccaucaacuuaccaaugccagacguccgaaacaacuucuuccacuacaaccaaggcagcgacucccgucuccgccucaucgccaugcuauacaccccacuccgagccaacaacuccggcgacgacguauucaccgucuccugccgaguacucacccgacccucucccgacuucucuuuuaacuuccuaguuccacccacugucgaaucgaaaaccaaacccuucaccuuacccauccuaaccaucucugaaaugucuaacucccgauucccugucccaaucgacucucuccacaccucccccaccgaauccguugucguacaaugccaaaacggccgcgucacccucgacggagaacucaugggcaccacccagcuucucccaucacaaauaugcgcuuuccgcggaacccuaacccgccccaccaaccgcgccuccgaccaagccgacacagccaccccacgucucuucaaccaccaauggcacauacaacuugacaaccuaaacggaacaccauacgaccccgccgaagacaucccagcaccccucggcaccccagacuuccgagguaaagucuuuggcguugccucacaacgcgacccagacggcaccacccgugcccacgaagccaaaguggauaccaccuccggacguuucacucccaaacuaggcucacucgaaaucaccacagaaucagacgacuucaaccaaaacaaacccacccgcuuuacccccgucggcauuggagucgacaacgaagccgacuuccaacaauggauccuucccgacuacucaggacaauucacccacaacaugaaccucgccccagccgucgcacccaacuuuccaggcgaacaacuccucuucuuccgaucccagcuacccuccucaggaggacguucuaacggcauacuugacugucuuguuccccaagaauggguacagcacuucuaccaagaaucagccccugcccaaacucaaguagcauuaguacgcuacgucaacccagacaccggccgagucuuauucgaagccaaacuccacaaaaugggcuucaugacuaucgccaaaaacggcgacucacccaucacaguaccucccaacggauacuuccgcuucgaauccuggguaaaccccuucuauacccucgcuccgaugggcaccggcaaaggacgcagacgcauacaauaa

SEQ ID NO: 37672 - RNA, 1647 nt, Artificial Sequence
  derived and/or modified sequence opt11 from VP1__Norovirus_and/or_Norovirus-like__AY030313
augaagauggccucaaacgacgccgcccccuccaacgacggagcggcuggccuaguccccgaaaucaacaaugaagccauggcccuugacccuguugccggagcagccauagcagcaccacuaacaggccaacaaaacauaaucgacccauggauaaugaacaacuucguccaagcaccaggcggcgaguucacugucagcccccgcaacuccccaggagaaguacuucuaaaucuugaacuuggcccagaaaucaaccccuaccucgcccaccucgcccgcauguauaacggcuaugccggcgguuucgaaguccaaguaguauuagcaggaaaugcguucaccgccggcaaagucauuuucgccgccauacccccaaacuuccccaucgacaacuuaucagccgcccaaaucaccaugugcccccacguaaucguagacguccgccaacuugaaccaaucaaccuacccaugcccgacguccgcaacaacuucuuccacuacaaccaaggcagcgacucccgccuucgccuaaucgccaugcucuacacaccccuccgugccaacaacagcggcgacgaugucuucaccguuuccugccgaguccucacccgacccagccccgacuucucuuucaacuuccucguaccacccacaguagaaagcaaaacaaaaccauucacccuccccauucucaccaucuccgaaaugucaaacucaagauucccuguccccaucgauucccuccacaccuccccuacagaaucuaucgucguacaaugccaaaacggacgcguaacccucgacggcgaacucaugggaaccacccagcuucucccgaaccaaauaugcgccuuccgcggcacucucaccagaucgaccaaccgcgcuagcgaccaagcggacaccgcuacaccccgccuauucgaccaucacuggcacauccaacucgacaaccuaaacggcacccccuacgaccccgccgaagacauacccgcaccccuaggcacccccgauuuuagaggcaaaguuuucggcguagccucccaacgaaaccccgacucaaccacccgagcccacgaagccaaaguugacacgaccucaggacgauucacccccaaacuaggcucccucgaaauaaccacagaaucagacgacuucgaccccaaccaaucaacaaaauucacccccgucgggaucggagucgacaacgaagccgacuuccaacaauggucccuucccgacuacuccggucaauucacucacaacaugaaucucgcccccgccguagcccccaacuuccccggagaacaacuccucuucuuccggucccaacuaccauccucuggcggacgcagcaacggcauccuagauugccucgucccucaagaauggguccaacacuucuaucaagaauccgcccccgcucaaacccaaguugcccucguccgcuacgucaaucccgacacaggccgcguccuauucgaagccaaacuacacaagcuaggauucaugacaauugccaaaaacggcgacucccccaucacagucccaccaaacggcuacuuccgauuugaaagcugggucaacccauucuauacccucgccccuaugggcaccgggaauggacgccgccgcauccaauaa

SEQ ID NO: 37673 - RNA, 1647 nt, Artificial Sequence
  derived and/or modified sequence opt11 from VP1__Norovirus_and/or_Norovirus-like__U02030
augaaaauggcauccaacgacgccgcccccuccaaugacggagccgccugccucguccccgaaauaaacaacgaagccauggcccuagaacccguagcuggcucagccaucgccgccccacuaaccggccaacaaaauaucaucgauccauggaucaugaauaacuucguccaagcccccggcggcgaauuuacagucagcccccgcaacagccccggcgaaguccuacucaaccucgaacuaggcccagaaaucaaccccuaccuagcccaccuagcccgcauguacaauggauacgccggaggcuucgaaguccaagucgugcucgcgggcaacgccuucaccgcaggcaaaauuaucuucgccgccaucccacccaacuuccccauugacaaccucucagcugcccagaucaccaugugcccacacgucaucguagacguacggcaacuagaacccaucaaccuccccaugccagacguccggaacaacuucuuccacuacaaccaaggauccgacucaagauuacgucuuaucgccaugcuuuacaccccacuccgcgcuaacaacucgggugacgacguauucacgguauccugccgcguccucacacgcccaagccccgacuucuccuucaauuucuuaguaccacccaccgucgaaaguaaaacaaaacccuucacccuccccauccucaccaucuccgaaauguccaacagcagauuccccguacccaucgacucacuccacaccuccccaaccgaaaacauagucguacaaugccaaaacggccgcgucacucuggauggagaacuaaugggcacaacacagcuccuuccaucccaaaucugcgccuuccgcggcacccuuacacgcuccaccucccgcgcuuccgaccaagccgacacacccacaccccgacucuucaauuacuacuggcauauccaacucgacaaccucaauggaaccccauacgaucccgccgaagacauccccgccccacugggcaccccagacuuccgcggaaaagucuucggugucgcaucgcaacgcaacccagacagcaccacacgcgcccacgaagcuaaagucgacaccaccucaggccgcuucacucccaaacucggaucacuagaaauaaccaccgaauccgacgacuucgacccaaaccaaccaacuaaauucaccccagucggcguaggcgucgacaacgaagccgaguuccaacaauggucccuccccaacuacucuggacaauucacacacaauaugaaccucgcccccgccguagcccccaacuuccccggcgaacaacuccucuucuuucgcucccagcuacccuccucuggcggccgcuccaacggcguacuagacugccucgucccccaagaauggguccaacacuucuaccaagaaucagcucccgcacaaacccaaguagcacucguccgcuacguaaaccccgacacaggacgcguccuauucgaagcaaagcuccacaagcucggcuucaugaccaucgccaagaacggagacucaccgaucaccgucccacccaacgguuacuucagauucgaauccuggguaaaccccuucuauacucuugcccccaugggcacaggcaauggacgucgccgaauacaauaa

SEQ ID NO: 37674 - RNA, 1647 nt, Artificial Sequence
  derived and/or modified sequence opt11 from VP1__Norovirus_and/or_Norovirus-like__AB039782
augaaaauggcaucuaacgacgccgcccccuccaacgacggcgcagccggacucguccccgaaaucaacaacgaagcaauggcucuggaaccagucgcaggcgcagcuauugcggcuccccugacaggccaacaaaacaucaucgaccccuggaucaugaacaacuucguacaagcccccggaggcgaauuuacugucuccccaagaaacuccccaggcgaaguccuucucaaccucgaacuaggaccagaaauaaaccccuaccucgcccaccucgcccgcauguacaacggauacgccggcggcuucgaaguacaagucguccuagccggcaacgcauucaccgcuggaaagguuaucuucgccgcaaucccacccaacuuccccaucgacaaccucuccgccgcccaaaucaccaugugcccccacguaaucgucgacguccgccaacucgaacccauuaaccuccccaugccagacguccgcaacaacuucuuccauuacaaccaaggaucagacucccgccucagauuaaucgcaaugcuauacaccccacuccgcgcaaacaacuccggcgacgacgucuuuacaguaucaugccguguccuaacccgacccuccccagauuucuccuucaacuuccuaguucccccaaccgucgaaucaaaaaccaaacucuucacccuucccauccuaaccauauccgaaauguccaacagccgcuuccccguccccaucgacucccuccacacauccccuaccgaaaacaucgucguccaaugccaaaacgggcgcguaacccucgauggcgaacucaugggaacuacccaacuccuaccaucacagauaugcgccuuuagaggaacccucacucgcuccaccucucgugcuuccgaccaagcggacaccccaacaccccgccuauuuaaccaccgauggcacauccaacuagacaaccugaacggaaccccauacgacccagccgaagacauccccgcaccucucggaaccccagacuuccguggcaaagucuucggaguagccucacagcgcaaccccgauuccaccacccgcgcccacgaagccaagguagacaccacguccggccgguucacccccaaacuuggcucccucgaaauaaccaccgaguccgacgacuucgacaccaaccaaucaacaaaauucacacccgucggcaucggcgucgacaacgaagcggaguuccaacaauggucccucccaaacuauagcggucaauucacccacaacaugaaccuugccccugccgucgcccccaacuuccccggcgaacaacuccucuucuuccgcucacaacuaccauccucaggaggccgaucaaacggaguccucgacugccuagucccccaagaauggguucaacacuuuuaccaagaauccgcgccagcacaaacccaagucgcccucguuagauacguaaacccagacaccggccgcguccucuucgaagccaaauuacacaaacucggcuucaugacaauagcuaaaaacggcgauucacccauaaccguaccucccaacggcuacuuccgcuucgaaucaugggucaaccccuucuacacccucgcacccaugggaaccgguaacggccgccgccguauacaauaa

SEQ ID NO: 37675 - RNA, 1647 nt, Artificial Sequence
  derived and/or modified sequence opt11 from VP1__Norovirus_and/or_Norovirus-like__U46039
augaaaauggcauccaacgacgccgcacccuccaacgacggcgccgccggccucguccccgaaaucaacaacgaagccauggcacuggaacccguugccggagccgcaaucgcggcaccccuuacaggccaacaaaacauaaucgacccauggaucaugaacaacuucguacaagcccccggcggagaguucacugucagcccucgcaacucccccggcgaaguccuacucaaccuagaacucggccccgaaauaaacccuuaccuagcccaccuagcccgaauguauaacggcuacgccggcggcuucgaaguccaaguuguacucgcaggcaacgccuuuaccgcaggaaaaguaaucuucgccgcgaucccacccaacuuccccaucgacaaccucagcgccgcccaaauuaccaugugcccccacguaaucgucgauguccgacaacucgaacccaucaaccuccccaugcccgacguacgcaauaacuucuuucacuacaaccaaggcucugacuccagacuccgacuaauagcaaugcuguucaccccacuccgugccaacaacucaggcgacgacgucuucacugucagcugcaggguccugacccgcccaucacccgacuuuucauucaauuuccucgucccacccacggucgaaucaaaaauaaaacccuucacucuccccauccuacccaucucagaaauguccaacucccgcuuccccguccccauagacucccuccauaccucccccaccgaaaacaucgucguccaaugccaaaacggcagagucacccucgacggcgaacuaaugggcaccacccaacucuucccaucccaaauaugugccuuucgcggcacacucacucgcucaaccucccgagcauccgaccaagcagacacuuccacgcccagacucuucaacuacuacuggcacauucaacuagacaaccucaauggaacuccuuacgaccccgccgaagacauaccagcaccccucggaacccccgacuuccaaggcaaaguauucggcguugcuucgcaaaggaaccccgacuccaccacacgcgcccacgaagcuaaaguagacacaaccucuggucgcuucaccccaaaacuaggaucccucgaaaucuccaccgaaucagacgacuucgacucaaaccaaccaaccaaauucacccccgucgguauaggcguagacaacgaagccgacuuccaacaauggucacucccuaacuacucaggccaauucacacacaauaugaaccuugcacccgccgucgcccccaucuuccccggugagcaaauccuuuucuuccgcucgcaaguccccuccuccggcgguagauccaacggaguccucgacugccuugucccccaagaauggguccaacacuucuaucaagaauccgcacccgcccaaacccaaguagcccucguacgcuacgucaaucccgacacaggccgaguccucuucgaagccaaacuacauaaacucgguuucaugaccaucgccaaaaacggcgacucccccauaaccgucccucccaacggcuacuuccgcuucgaauccuggguaaaucccuucuacacccuagcacccaugggcacuggcaacggcagacgccgaauacaauaa

SEQ ID NO: 37676 - RNA, 1647 nt, Artificial Sequence
  derived and/or modified sequence opt11 from VP1__Norovirus_and/or_Norovirus-like__DQ093066
augaaaauggcuuccaacgacgccgccccgucuaacgacggcgccgcaggucucguccccgaaaucaacaacgaagccauggcacuggaccccguagcaggcgccgccaucgccgccccauuaacaggccaacagaacaucaucgaucccuggaucaugaacaacuucguacaggccccagguggcgaguucacggucucaccucgcaacucccccggagaagucuuauuaaaccuagaacucggaccagaaaucaaccccuaucuagcccaccucgcacgcauguauaacggauacgccggcggauucgagguccaagucguucuugcaggcaacgcauucacagcaggcaaaguuauauucgccgccaucccucccaacuuccccaucgacaaccuaucagccgcccagaucaccaugugcccccaugucaucguagacguccgacaauuagaacccaucaaccuacccaugcccgacgucagaaacaauuucuuccauuacaaccaaggcagcgacucccgccucagacucaucgccaugcuguacacaccccuacgagcaaauaacucaggagacgacgucuucaccgucuccugccgaguucucacccgccccuccccugacuucaguuucaacuuccucguaccacccaccgucgaaucaaaaaccaaacccuucacccucccaauccuaaccaucucagaaaugucuaauucccgcuucccuguacccaucgacucacuucacaccucuccaaccgaaaacaucguuguccaaugccaaaacggacgagucacacucgacggcgagcucaugggcaccacccaacuccuacccucacagaucugcacauuccgcggcacccucacccgcucuaccucacgagccuccgaccaagccgacacagccaccccacgccuauucaauuacuacuggcacauccaacuggacaaccucaacggcacccccuacgaccccgccgaagacauacccgcaccccuaggcacccccgacuuccgcggcaaaguauucgguguagccucccaacgcaaccccgacuccaccacacgagcucacgaagccaaagucgacacaaccucaggccgcuuuauccccaaacucggaucccucgagauuuccacagaauccgacgacuucgaccaaaaccaacccacaagauuuaccccaguaggcaucggcguagacaacgaagcaggcuuccaacaauggucacuccccgacuacucaggccaauuuacccacaacaugaaccuugcccccgccgucgcucccaacuuccccggcgaacaacuccucuucuuccgaucccaacuacccucgucgggcggccguagcaacgggauacuagacugccucguaccucaagaauggguacagcacuucuaccaagaaucagccccagcucaaacccaaguagcccucguccgcuacguaaacccugacaccggccgcguuuuauucgaagcaaaacuacacaaacuaggcuucaugacaaucuccaaaaacggagacucccccaucacagucccucccaaugguuacuuucgauucgaauccugggucaacccauucuacacacucgccccaauggguaccggaaacggacgacgacgcauccaauaa

SEQ ID NO: 37677 - RNA, 1647 nt, Artificial Sequence
  derived and/or modified sequence opt11 from VP1__Norovirus_and/or_Norovirus-like__DQ093062
augaaaauggccuccaacgacgcagcacccucaaacgacggcgcagcaggacucguacccgaaauuaacaacgaagcaauggcccucgaacccgucgcaggcgccgccaucgcagcgccccuaaccggccaacaaaacauaaucgacccauggauaaugaacaacuucguacaagcccccgguggcgaguucacaguuucaccccguaacucccccggugaaguccuacucaaccuagaauuaggccccgaaaucaacccauaccuagcccaccucgcccgaauguacaacggcuacgccgguggauucgaaguccaaguaguccuugcaggaaacgcauucaccgcaggcaaagucaucuucgccgcaaucccacccaacuuccccaucgacaaccucuccgccgcacaaaucaccaugugcccucacgucauagucgacguccgacaacucgaaccuaucaaccuccccaugccugauguaagaaacaacuucuuccacuacaaccaaggcagugacucccgccuacgacucaucgccaugcucuacacaccccuacgagcaaacaacucuggcgacgacguuuucaccgucucaugccgaguucucacccgccccucacccgacuucuccuuuaauuuccucgucccacccaccguagaaagcaaaaccaaacucuucacucuccccauccucacuauauccgaaaugagcaacucccgcuuccccguccccaucgacucccuccacaccucccccacagaaaauaucguaguacaaugccaaaacggaagagucaccuuagacggcgaacucaugggcacuacacagcuucuucccucccaaaucugcgccuuccgaggcacacucacacgacccacaucccgcgccuccgaccaagcugacacccccacgccccgccucuucaaccaccgcuggcacauacaacucgacaaccuaaacggaacacccuacgaucccgccgaagauauccccgcaccccugggcacacccgacuucagaggaaaagucuucggagucgcaucccagcgcaacccagauuccacaacccgcgcacacgaagcuaaggucgacacuaccuccggccgcuucacacccaaacucggcucccucgaaaucacgacagaauccgacgacuucgacaccaaccaaucaacuaaauucacccccgucggcauaggcguagacaacgaagccgaguuccaacaauggucccuaccaaacuacucaggucaauuuacgcacaauaugaaccucgcccccgccgucgcccccaacuuccccggcgaacaacuacuauucuuccgcagccaacuccccucuuccggcggccgaucaaacgguguacucgacugucucguaccucaagaauggguccagcacuucuaccaagaauccgccccugcacaaacccaagucgcccucgugaaauacguaaaccccgacaccggccgcguccuuuucgaagccaaacuucacaaacucgguuuuaugaccauagccaagaacggcgacucccccaucaccguuccucccaacggauacuucagguucgaauccuggguaaaccccuucuauacacuagcacccaugggcaccgggaacggacgccgccgcauacaauga

SEQ ID NO: 37678 - RNA, 1647 nt, Artificial Sequence
  derived and/or modified sequence opt11 from VP1__Norovirus_and/or_Norovirus-like__GU930737
augaaaauggccuccaacgacgccgcaccauccaacgacggagccgccaaccucguccccgaagcaaacuccgaaguuauggcccucgaacccgucgucggcgcaagcauagcagcccccgucgucgggcaacaaaacaucaucgaccccuggauacgcgaaaauuucguccaagcaccccaaggagaguucaccgucucaccccgaaacucaccuggcgaaaugcuccuaaaccuagaacuaggucccgaacuaaacccauaccucucacaccucagccguauguacaacggcuacgccggcggcaugcaaguccagguaguccuugcaggcaacgcauucaccgccggcaaaauuaucuuugcagccguaccuccccacuucccagucgaaaacaucucagccgcccaaaucaccaugugcccacacguaaucgucgacguaagacaacucgaacccguccuucuaccccuacccgacauccgcaaccguuucuuccacuacaaccaagaagacacuccacgcaugagacuugucgcuaugcuguacaccccucuccgcgcaaacagcggcgaagacguauucacugucucaugccgaguacuaacccgccccgcucccgacuucgaguucacauucuuaguaccacccaccguagaaucaaaaacaaaacccuucacacuccccauacucacccucggagaacucucaaacucucgauuccccgcgcccaucgacaugcucuacacagaccccaacgaagcaaucgucguucaaccccaaaacggccgaugcacacuagacggcacucuccaaggcacaacccagcuaguacccacccaaauaugcuccuuccgagguacacucauaucacaaacuucccgcucagccgacucaaccgauuccgcaccuagaguaagaaaccaccccuuacauguccaacuuaaaaaccuagacggaacgcccuacgacccaaccgacgaaguccccgccguccuaggagccaucgacuucaagggcacagucuucggcguggccucccaacgaaacaccacgggcaacagcgaagaaggcgcaacccgcgcccacgaaguacacauugacaccaccaacccgagauacaccccaaaacucggaagcguauucaugcacuccgaaucaacagacuucgacgacggccaaccaacccgcuuuacccccaucggcaugggagccgacgacuggagacaaugggaacuuccugaauacuccggacaucucacacuuaacaugaaccuagcaccggccgucgcccccgccuucccaggagaacgcauccucuucuuccgcuccguagucccuucugccggcgguuacggaucgggccaaaucgacugccucaucccccaagaauggguccaacacuucuaucaagaagccgcacccucccaauccgcagucgcccuaauccgcuacgucaaccccgacaccggccgaaacauauuugaagcaaaacuacaccgcgaaggcuucaucacagucgccaacucaggaaacaaucccaucgucgucccacccaacggcuacuuccgauucgaagccugggucaaccaauucuacacauuaacacccaugggcaccggucaaggccgucgucgaguacaauaa

SEQ ID NO: 37679 - RNA, 1647 nt, Artificial Sequence
  derived and/or modified sequence opt11 from VP1__Norovirus_and/or_Norovirus-like__AF414412
augaaaauggccagcaaugacgcagcccccuccuccgacggcgcagccgggcucguacccgaaaucaacaacgaagccauggcccuagaaccaguagccggcgccgccaucgccgcgccccucacaggccaacaaaacaucaucgacccauggaucaugaacaacuucguccaagcccccggcggcgaguucacagucucaccccgcaacucccccggcgaaguccuauuaaaccucgaacuaggcccagaaaucaaccccuaccucgcacaccuagcccgcauguacaacggcuacgcaggcgguuucgaaguccaagucguccucgccggcaaugccuucacagcugguaaaguaauuuucgccgcuauuccacccaacuuccccaucgacaaccucuccgcagcccaaaucaccaugugcccccacguaauaguagacguacgccaacucgaacccauaaaccuccccaugcccgauguccgcaacaacuucuuccacuacaaccaaggcucagacagcagacuccgccuaaucgcaaugcucuacacaccccuucgcgcaaauaacucgggcgacgacguauucaccgucagcugccgcguccuaacccgacccucccccgauuucucauucaacuuccucgucccacccacagucgaauccaagaccaaacuauucacacuacccauccuuaccaucuccgaaaugucuaauucacgguucccuguccccauugacucccuucauaccagucccacugaaaacauagucguccagugccagaacggccgggucacacucgacggcgaacuuaugggcaccacacaacuacuaccaagccaaauuugcgcauuccguggcacucuaacucgaucgaccucccgcgcuuccgaccaagccgacacucccacaccccgucucuuuaacuacuacuggcacauacaacucgacaaccuuaacgguacccccuacgaccccgccgaagacaucccagccccacuuggaacaccagacuucagaggaaaaguuuucggcguagcaucccaacgcaacccagacucaacaaccagagcccacgaagccaaagucgacaccaccuccggcagauucacccccaaacucggcagccuugaaaucuccacagaauccgaugacuucgaccccaaccaaccaacaaaauucaccccagucggaauaggcguugacaacgaagccgacuuccaacaauggucucucccuaacuacuccggccaauucacccacaacaugaaccucgcccccgccguagcccccaacuucccuggcgaacaacuccucuucuucagaucccaacgcccaucaucaggcggccgcucaaauggaauccuagacugccucgucccacaagaauggguccaacacuucuaccaagaaucagcccccgcacagacccaagucgcacucgucagauacgucaaccccgacacaggcagaguccucuucgaagccaaacuacacaaacuuggauucaugaccauagccaaaaacggcgacucuccuauaacuguaccucccaacggcuacuuccgcuucgaaucaugggucaaccccuucuauacccucgcccccaugggcaccggcaacggacgacgccgaauccaauaa

SEQ ID NO: 37680 - RNA, 1647 nt, Artificial Sequence
  derived and/or modified sequence opt11 from VP1__Norovirus_and/or_Norovirus-like__AB039781
augaaaauggcauccaacgacgccgcucccuccaacgauggcgccgcaggccucguccccgaaauaaacaacgaagccauggcacuugaacccguagccggcgccgccaucgcugcaccccuuaccgggcaacaaaacaucauugacccauggaucaugaacaacuucguucaagcccccggaggcgaguucaccgucucaccccgaaauucccccggcgaaguccuccucaaccucgaacugggccccgaaaucaaccccuaccuugcccaccuagcccgaauguacaacggguacgcaggcggcuucgaaguccaaguaguccuagcaggaaacgccuucaccgccggcaaaguaaucuucgccgccauaccacccaacuucccaaucgacaaccuaucugccgcccaaaucacaaugugcccacacguaaucgucgacguucgccaacucgagcccaucaaccucccuaugccugacguccgaaacaacuucuuccacuauaaccaaggcagcgacucacgccuccgacucaucgccaugcucuacaccccacuccgcgcaaacaacuccggcgacgacgucuucacaguaucaugccgcguacuaacacgacccucccccgacuucuccuucaacuuccuaguaccgcccaccgucgaauccaaaaccaaacuauucacccuccccauccucaccauauccgaaauguccaacucacgcuuccccgucccaaucgacucccuccacacuucccccaccgaaaacaucguuguacaaugccaaaacggccgagucacccuugacggugaacuaaugggagccacccaacuacucccuucccaaauaugcgcauuccguggaacccuaacccguagcaccucacgcgccucagaccaaaccgacacccccacaccccgauuauucaaccaccguuggcacauacaacucgacaaccucaacggaaccccauacgaccccgccgaggacaucccagcgccccucggcacccccgacuuccgcggcaaagucuucggcguagccagccaacguaacccugacucaaccacgagagcccacgaagcuaaagucgauaccaccucaggaagauuuacaccaaaacucggcucccuagaaauaaccaccgagucagacgaccuggacaccaaccaguccacaaaauucaccccugucggcaucggagucgacaacgaagcugaguuccaacaauggucacuccccaacuacucaggacaauucacacacaacaugaaccucgcacccgcaguagcauuaaauuucccaggagaacaacuacucuucuuccgcucccaauuacccucguccggcggccgcucaaacggaguccuagacugccuaguaccccaggaauggguccagcacuucuaccaagaaucugccccagcccaaacucaaguagcccucguccgauacgucaaccccgacacuggucgcguccucuucgaagccaaacuccacaaacuaggcuucaugaccaucgccaaaaacggcgacucacccauuaccgucccacccaacggauauuuccgcuucgaguccugggucaaccccuucuacacccucgcccccaugggcaccggcaauggccggcgccgcauacaauaa

SEQ ID NO: 37681 - RNA, 1647 nt, Artificial Sequence
  derived and/or modified sequence opt11 from VP1__Norovirus_and/or_Norovirus-like__LC035073
augaaaauggccuccaacgacgcaaccccauccaacgacggagcugccggacucguucccgaaaucaacaacgaagccauggcacucgacccagucgcuggcgccgccauagcugcuccacucaccggacaacaaaacauaaucgaccccuggauaaugaacaacuucguccaggcacccggcggcgaauucacaguuucuccacgcaacucaccaggagaaguccuacuaaaccucgaacucggccccgaaauaaaccccuaccucgcacaccucgcgcgcauguacaacggauacgcaggcggcuucgaaguccaagugguccucgccggcaacgccuucaccgccgguaaaaucaucuucgccgccauccccccaaacuucccaaucgauaaccucucugcagcacaaaucaccaugugcccucacguaauagucgacguccgccaacucgaacccgucaacuuaccaaugcccgacguccggaacaauuucuuccacuacaaccaagguucggacucccgacuccgccuaauagcuaugcuuuacacaccucuccgagcaaacaacuccggcgacgacgucuucaccgucagcugccguguccucacccgccccucccccgaauucuccuucaacuuccuggucccacccacagucgaaucuaaaacuaaacccuucacccucccgauacucaccauauccgaaaugucaaacagccgauuucccguccccaucgacucccuccauaccucaccaacugaaaacauagucguccaaugucaaaacggccgaguaacccuagacggcgaacuaaugggcaccacccaacuacuucccucccaaaucugcgccuuccguggaguucucacaagaucaaccucccgcgccuccgaccaagcagacacagccaccccccgucuuuucaacuacuauuggcauauccaacucgacaaucuaaacggcacccccuacgaccccgccgaagacauuccuggccccuuagggacccccgacuuccgaggcaaaguauucggagucgcaucccaacgcaaccccgacagcaccacgcgcgcacacgaagcaaaaguagacaccacauccggacgcuucacccccaaacuuggcucucuagaaaucucgacggaaucugacgacuucgaccaaaaccaacccaccagauucacacccguaggcaucggcgucgaccacgaagcagacuuccaacaguggucucuacccgacuacuccgggcaauucacacacaacaugaaccucgcccccgccguagcaccgaacuuccccggcgaacaacuccucuucuuccgcucacaacuccccucuucaggaggccgcucaaacgguauccuagacugccuaguaccccaagaauggguacaacacuucuaccaagaauccgcacccgcacaaacacagguagcccuugucagauacgucaacccagauaccggccgcguccuauucgaagccaaacuccacaaacucggcuucaugacaaucgcaaaaaacggggacuccccgaucacagucccucccaacgguuacuucagauucgaaucaugggucaaucccuucuacacccucgcucccaugggcacaggcaacggacgacgacgaguccaauaa

SEQ ID NO: 37682 - RNA, 1647 nt, Artificial Sequence
  derived and/or modified sequence opt11 from VP1__Norovirus_and/or_Norovirus-like__AF539440
augaaaauggcauccaaugacgcaaccccaagcaacgacggagccgccggccugguccccgaaaucaacaacgaagccauggcccuugaccccgucgcuggcgcagcuaucgccgcuccccucacaggccaacaaaauaucaucgacccauggauaaugaacaacuucguccaggcccccggcggagaguucacagucagcccccguaacucccccggcgaaguccuacucaaccucgaacucggacccgaaauaaaccccuaucucgcccaccucgcacgcauguacaacggcuacgccggcggcuucgaaguacaagucguacucgcaggcaacgccuucacugccggaaaaaucaucuucgcagccaucccaccaaacuuccccaucgacaaccucucugcagcccaaaucaccaugugcccccacgucaucguagacguccgccagcuagaacccgucaaccuucccaugccagauguccguaacaacuucuuccacuacaaccaaggcuccgacucccgccuccggcuaaucgccaugcuauacacuccacuacgcgcgaacaacucaggagacgacguguucaccguaucuugcagaguccuaacccgccccucccccgacuuuucauucaacuuccuuguaccacccaccguggaauccaaaaccaaacccuucacccuccccauccuaaccaucuccgaaaugucaaacucaagauuccccguucccaucgacucccuccacaccuccccaaccgaaaauauagucguccaaugccaaaacggcagaguaacccucgauggagaacuaaugggcacaacacaacuucucccaucacaaauuugcgccuuccgaggcguccucacccguuccaccucccgagcuuccgaucaagcagacacagccacaccucgccucuuuaacuauuacuggcacauccaacucgacaacuugaacgggaccccauacgaccccgccgaagacaucccuggccccuuaggcacaccagacuuccgaggcaaaguauucggagucgccucccaacgcaaccccgacuccacuacccgcgcacaugaagcaaaaguagacaccaccgcaggccgcuucaccccaaaacuaggcuccuuagaaaucuccacugaaucagacgacuucgaccaaaaccagccaacacgcuucaccccugucggcgucggcgucgaccacgaagcagacuuccaacaauggucacuaccagacuacucaggccaauucacccacaacaugaaccucgcacccgccgucgccccaaacuuccccggcgaacaauugcuauucuucagaucccaacuccccucuuccggcggccgcuccaacggcauccuugacugccuagucccccaagaguggguccaacacuucuaccaagaaucugcccccgcccaaacacaaguagcccuugucagauacgucaacccagacaccggccgaguucucuucgaagccaaacuccacaaacuaggcuucaugacaaucgccaaaaacggugauagccccaucacaguucccccaaacggcuauuuccgauucgaauccugggucaaucccuucuauacacucgcaccaaugggcaccggcaacggcagacgccguauccaauaa

SEQ ID NO: 37683 - RNA, 1647 nt, Artificial Sequence
  derived and/or modified sequence opt11 from VP1__Norovirus_and/or_Norovirus-like__AF414414
augaagauggccuccaacgacgccgccccuucuaacgacggagcagccggccuagucccugaaaucaacaacgaagcaauggcccucgaacccgucgcaggagcagcuaucgccgcaccccucacuggccaacagaacauaaucgacccauggaucaugaacaauuucguucaagcccccgggggcgaguucaccgucucuccccgcaacucccccggagaaguacuccucaaccucgaacucggccccgaaaucaaccccuaccucgcacaccuagcgcgaauguauaacggcuacgccggcggauucgaaguccaagucguccuggccggcaacgccuucaccgccggaaaagucauauuugccgccaucccacccaacuuccccaucgacaaccucuccgccgcccaaaucacaaugugcccccacgucaucguagacgucagacaacuugaacccauaaaccuccccaugcccgacguccgaaacaacuucuuccacuacaaccaaggauccgauagccgccuacgacucaucgccaugcucuauacaccccuacgcgccaacaacuccggcgacgacguauucaccgucucaugccgcguccucacacgccccucccccgacuucucauuuaacuuccucguaccacccacagucgaauccaaaacaaaacuauucacacuccccauccucacuauaucagaaaugucaaauucucgcuuccccguuccaauugacucccuacacacaucccccacagaaaauaucgucguucaaugucaaaacggccgcgugacccucgacggcgaauuaaugggcaccacccagcuccuacccucccaaaucugcgccuuccgcggcacacucacccgauccaccagccgagccuccgaccaagccgacacaccuacuccccgacucuucaaccaccgcuggcacauacaacucgacaaccuaaacggcacccccuacgacccagccgaagacauccccgcuccacuaggaacucccgacuuccggggcaaagucuucggugucgccucacagcgcaaucccgacucgacaacacgcgcucaugaagccaaaguagacaccacauccggccgcuucacaccaaaacucggcucccuagaaaucaucaccgaauccgacgacuucgacacaaaccaauccaccaaauucacccccguaggcaucggcgucgacaacgaaucagaguuccaacaauggucccuacccaauuacucuggacaauucacccacaauaugaaccuagcccccgccgucgcccccaacuuccucggcgaacaauuauuauucuuccgaucccaacuacccagcucuggcggccgcucgaauggcguccucgacugccuagugccacaagaauggguccaacacuucuaccaagaauccgcaccagcccaaacucaaguagcccuaguacgcuacgucaaccccgacaccggacgaguccuauucgaagcaaaauuacacaaacuuggauucaugacaaucgcuaaaaacggagacucacccauaaccguuccaccuaacggcuauuuccgauucgaaucgugggucaaccccuucuacacccucgcacccaugggaacaggaaacggacgacgccgcauucaauaa

SEQ ID NO: 37684 - RNA, 1647 nt, Artificial Sequence
  derived and/or modified sequence opt11 from VP1__Norovirus_and/or_Norovirus-like__AB190457
augaaaauggcuucaaacgacgccaccccaucaaacgacggugccgccggccuaguccccgaaaucaacaacgaagccauggcauuagaccccgucgccggagccgcuaucgcagcuccccucaccggccaacaaaacaucaucgaccccuggauuaugaacaacuuuguacaagcccccggcggcgaguucaccgucagcccccgcaacucuccaggagaaguccuccucaaccucgaacucggaccugaaaucaaccccuaccuugcccaccucgcccgaauguacaacggcuacgccggcgguuucgaaguucagguaguccucgccggcaaugccuucacagccggcaaaauaauuuucgcagcaauacccccaaacuucccaaucgacaacuuaucggccgcacaaaucacaaugugcccccacgucauaguugacguacgccaacucgaacccguaaaccucccuaugccggaugucaggaacaacuucuuccacuacaaccaaggaucagacuccagacuccgccuaaucgccaugcuauacacuccucuccgagccaacaacucaggcgacgacguauucacaguuuccugucgcguacucacacgaccuucccccgauuucuccuuuaacuuccucgucccucccacugucgaaagcaaaaccaaaccauuuacccuccccauccucacuauaagcgaaauguccaacucacguuuccccguacccaucgacucacuccacaccucccccacagagaacaucgucguccaaugccaaaacggacguguaacacuagacggcgaacuuaugggcaccacucaacuccucccaucccaaaucugugccuuccgcggcguacucacucgcagcaccuccagagcauccgaccaagcagacacagccacuccccgacucuucaacuacuacuggcacauccagcucgacaaccuaaacggcaccccauacgaccccgcugaagacaucccaggcccccuuggcacacccgacuuccgaggaaaaguauucggagucgccucccaacgcaaccccgacucuaccacccgagcccacgaagccaaaguugacacaaccgccggcagauucacccccaaacuuggaucccuagaaaucuccaccgaaucgggcgacuucgaccaaaaccaacccacccgauucacaccagucggcauaggagucgacaacgaagcagacuuccaacaauggucucucccagacuauucaggacaauucacccauaacaugaaccucgcaccagccguagcacccaacuucccaggcgaacaacuacucuucuuccgcucccaacucccaucuuccggcggccgcuccaauggcauacucgacugccucgucccacaagaauggguccagcacuuuuaccaagaauccgcacccgcccaaacccaagucgcccucguccgcuacgucaauccagacacaggccgcguccucuucgaagccaaauuacacaaacugggcuuuaugaccaucgccaagaacggcgacucccccauaacuguacccccgaacggcuacuucagauucgaauccugggucaaccccuucuacacccucgcccccaugggaacaggcaauggcagacgacgcauacaauaa

SEQ ID NO: 37685 - RNA, 1647 nt, Artificial Sequence
  derived and/or modified sequence opt11 from VP1__Norovirus_and/or_Norovirus-like__AF425768
augaaaauggccuccaacgacgccaccccguccaacgacggcgccgccggccucgucccagaaaucaacaacgaagccauggcccucgaccccguggccggcgcagccaucgcugccccgcucaccggccaacaaaacaucaucgaccccuggaucaugaauaacuucguccaagcccccggcggcgaguucacagugaguccccgcaacucccccggcgaaguccuccuaaaccuagaacuaggccccgaaaucaaucccuaucuagcccaucucgcccgcauguacaacggcuacgcuggcggcuucgaaguacaagucguacucgcaggcaacgcguucaccgcaggcaagauaaucuucgcugccaucccacccaacuuccccaucgacaaccucuccgcagcacaaaucacaaugugcccacaugucauagucgacguccgccaacuagaacccgucaaccuacccaugcccgacguccgcaacaacuuuuuccacuauaaccaaggaucagacucucgacuucgacucaucgccaugcucuacacaccccuccgcgcaaacaacuccggagacgacgucuucaccgucuccugccgaguccucacccgccccucacccgacuucucauucaacuuccucguacccccaacagucgaauccaaaaccaaacccuucacccuaccaauccucaccauaagcgaaaugucaaacucccgcuuccccgucccuauagacucacuccacaccuccccgaccgaaaacaucgucguacaaugccaaaacggcagaguaacccucgacggcgaacucaugggcaccacccaacuacuccccucccagaucugcgccuuccgcggaguccucacccgcuccaccucccgagcuuccgaccaagccgauaccgcaacaccccgucucuucaacuacuacuggcacauccaacuagacaaccucagcggcacccccuacgaccccgccgaagacauccccggcccacuugguacacccgacuuccgaggaaaaguuuucggcguugccucacaacgaaaccccgacagcaccacccgcgcacacgaagccaaagucgacaccacagccggccguuucacacccaaacucggcucccuagaaauaucuaccgagucagacgauuucgaccagaaccaacccacucgauucacccccgucggcgucggcgucgaccacgaagcagacuuucagcaauggucccuccccgauuacucuggccaauuuacccacaacaugaaccuagcccccgcugucgcccccaacuucccaggcgaacaacuccuuuucuuccgaucccaacuucccagcuccggcggccgcuccaacggcauacuagauugccucgucccccaagaauggguccaacauuucuaucaagaaucugcccccgcccaaacccaagucgcccucgucagauacguaaaccccgauacaggccgaguacuauuugaagccaaacuacacaaacucggcuucaugacaaucgcuaagaacggcgacucccccauaacaguaccacccaacggcuauuuucgcuucgaauccuggguaaaccccuucuacacccucgcccccaugggaaccggcaacggccgucggcgcauacaauaa

SEQ ID NO: 37686 - RNA, 1647 nt, Artificial Sequence
  derived and/or modified sequence opt11 from VP1__Norovirus_and/or_Norovirus-like__AF414415
augaaaauggccuccaacgacgccgcccccucuaacgacggggcagccggccuaguaccagaaauaaacaacgaagccauggcacuugaaccagucgccggcgcggccaucgccgccccacucacaggccagcaaaacaucaucgacccuuggaucaugaacaacuucguccaagcgccagguggagaauuuaccgucucaccccgcaacucccccggcgaaguccuauuaaaccuagaacugggucccgaaaucaaccccuaccucgcacaucuugcccgcauguauaauggauaugccggcggcuucgaaguccaagccguccucgcaggcaaugccuucaccgccggaaagguaaucuucgcagcuauacccccuaacuuccccauagacaaccuaucugcagcccaaaucacuauguguccacacgucauuguagacguccgccaacuugaacccauaaaccuacccaugcccgacguccgcaacaacuucuuccacuacaaucaaggaagcgacucucgccuccgccuaaucgcuaugcucuacacuccccuacgagcaaacaacucaggcgacgacguuuucaccguuuccugccgcguccuaaccaggcccucgccagacuucucuuucaauuuccuggucccucccaccguagaauccaaaacaaaacucuucacccucccaauccucaccauauccgaaauguccaacucacgguuccccguaccaauagauucccuccacaccucgcccaccgaaaacaucgucguccaaugccaaaacggccgcguaacccuugacggcgaacuuaugggcaccacccaacuccuaccuucccaaaucugcgccuuccgcggcacacucacccgcucaaccucccgagcaagugaccaagcagacacacccacaccccgccucuucaaccaccgcuggcacauccaauuagacaaccuaaacggcacuccauacgaucccgccgaagacauaccagcaccccuaggcacccccgacuuccgcggcaaggucuucggagucgcaucacaacguaaccccgacucgacaacccgagcacacgaagcuaaagucgacaccaccucagaccgcuucacccccaaauuaggaucacuagaaauaaucacagaaucaggcgacuucgacacaaaucaaucaacaaaauuuacaccugucggcaucggaguagacaacgaagcagaguuccaacaauggucccuacccaacuacuccggacaauucacucacaacaugaaucuagcucccgccgucgccccaaacuuccccggcgaacaacuacuauucuuccgaucacaacuucccucauccggcggccgcuccaacggcguccucgacugccuugucccacaagaauggguacaacacuucuaccaagagucagcaccagcccaaacucaagucgcacucguccgcuacgucaaccccgacaccggacgaguccuauucgaagcaaaacuucacaaacucggcuucaugaccauagccaaaaacggagacucccccaucacaguacccccgaacggcuacuuucguuucgaaagcuggguaaaccccuucuacacccucgcccccaugggcacaggcaacggccgucgacgcauccaauag

SEQ ID NO: 37687 - RNA, 1647 nt, Artificial Sequence
  derived and/or modified sequence opt11 from VP1__Norovirus_and/or_Norovirus-like__KT779557
augaaaauggccucaaacgacgcagcccccucaaacgacggugcagcuggccuaguccccgaaaucaacaacgaagcaauggcccuagaccccgucgccggagccgcaauugccgccccacuaaccggccaacaaaacaucaucgaccccuggauaaugaacaacuuuguccaagcaccaggcggugaauuuacugucuccccacgcaacuccccaggcgaaguccuacucaaucucgaacuuggccccgaaauaaacccauaccucgcacaccucgcccgcauguacaacggcuacgcaggcggcuucgaaguccaaguagugcucgccggaaacgcuuucacagccggcaaagucaucuuugccgcaauaccacccaacuuccccacugacaaccucagcgccgcccaaauuacaauguguccucacgucaucgucgacguccgccaacuagaacccaucaaccuccccaugccagauguccgcaacaacuucuuccacuacaaccaaggcuccgacucacgccucagauugauagccaugcucuacacaccacuacgcgccaauaacagcggcgacgacguuuucacagucucaugccguguacucacccguccaucaccagacuucagcuucaacuuccuugucccacccaccgucgaauccaaaaucaaaccauucacccuacccauucuuaccaucuccgaaaugucgaacucacgcuuccccguacccaucgacagccuccacaccagcccaacagacaacaucgucguccagugucaaaacggucgaguaacccuugacggagaacucaugggcaccacccaacuucuacccucccaaaucugcgccuuccgcggcguccuaacccgcucuaccagccgugccagcgaccaagcagacgcagccaccccucgccuauucaauuaccacuggcacauccaacucgacaaccucaacggcacacccuacgaccccgccgaagacauccccgcaccccugggaacaccagacuuccgcgggaaaguauucggcguagccucacaacgcaaccccgacagcaccacccgagcccacgaagccaaagucgacacaaccuccggucgcuucaccccaaagcuagguuccuuagaaauaagcaccgaauccggcgacuucgaccaaaaccaaccuauccgauucacaccaguaggaaucggcgucgacaaugaagccgacuuccaacaauggacacucccagacuacuccggccaauuuacccacaacaccaaccuagccccagccgucgcccccaauuuccccggagagcagcuccuuuucuuucgcucccagcucccaagcuccggcggucgauccaacggcauacucgacugccucgucccccaagaauggguacaacauuucuaccaagaauccgcccccgcccaaacccaagucgcccucguacgcuaugucaaccccgacaccggccgcguacuauucgaagccaaacuccacaaacucggcuacaugaccauagccaaaucuggcgacucaccuauaaccguaccacccaacggauacuucagauucgaaucaugggucaaccccuucuacacccuagcccccaugggcaccggcaacggccgcagacgcauccaauaa

SEQ ID NO: 37688 - RNA, 1647 nt, Artificial Sequence
  derived and/or modified sequence opt11 from VP1__Norovirus_and/or_Norovirus-like__AY247432
augaaaauggccuccaaugacgccacccccuccaacgacggcgcagcaggccucgucccagagaucaacaacgaagccauggcccuugacccuguugccggcgcagccaucgcugcuccccucaccggacaacaaaacaucauagacccauggaucaugaauaauuucguccaagcucccggcggcgaauuuacuguuucuccacgcaauucacccggcgagguccuccucaaccuggaacucggcccggagaucaacccauaccuagcccaccucgcccgcauguacaacggcuacgccgggggcuucgaaguccaagucguccucgccggaaacgccuucacagccggcaaaaucaucuucgcagccaucccacccaacuuccccauagacaaccucucagcagcccagauuacuaugugcccccacgucaucgucgacguccgccaacucgaaccagucaaccuaccaaugccagacguccgaaacaacuucuuucacuacaaccaaggcucagacucacgccuccgucucauugccaugcuguacacaccccuacgcgccaacaacucaggugacgacgucuucaccgucuccugccgcguccuaacccgcccuucacccgacuuuuccuucaacuuucucguaccuccaaccguagaauccaaaaccaaaccauucacccucccaauccucacuauaucugaaaugucaaacucccgcuucccagugccaauugacucccuucacaccucacccaacgguaacuucgucguacaaugccaaaacggucgcgucacccucgacggcgaacuuauggguaccacacaacuacucccuucccagaucugcgccuuccgcggcguacucaccagacaagucucacgcgccggcgaucagaucgacaccgcaacaccacgcuccuucggcaaccacuggcacauccaacucgacaaccucaacggcacucccuacgacccagccgaagacauccccgguccccucggcacccccgacuuccaaggaauagucuucggcgucgccucucaacgcaacucugacggcaccacccgcgcucacgaagcaaaagucgacacccgcacuggucguuucacccccaaacuaggcucccuugucauaucaacagacucagaagacuuucaacaaaacaagccaacccgauucacacccguaggcguuggagucgacucagaagaagaguucgaccaauggucccuuccugacuacuccggccccaucacccauaacaugaaccuagcccccgcagucgcuccuaacuucccaggcgaacaacuccuguucuuccgcucccaacuccccucaucuggcggaaucucaaaaggaauccuugacugccuagucccccaagaauggguacaacacuucuaccaagaauccgccccugcccaaacccaagucgcccuaguccgauacguaaaccccgacacuggccgcguacucuucgaagcuaaacuacacaaacuaggcuucaugaccaucgccaaagauggcgacucccccauaacagucccuccuaacggcuacuuccgcuucgaaucuugggucaacccauucuacacucuugcacccaugggcaccggcaacggccgccgacgcauccaguag

SEQ ID NO: 37689 - RNA, 1647 nt, Artificial Sequence
  derived and/or modified sequence opt11 from VP1__Norovirus_and/or_Norovirus-like__AF414411
augaaaauggccucuaacgacgccgcacccuccaacgacggcgccgccggccucguccccgaaaucaacaacgaagccauggcacucgaacccgucgccggcgccgccauagccgcaccccuaacuggacaacaaaacauaaucgaccccuggauuaugaacaacuucguccaagcaccuggaggcgaguucaccguauccccacgaaacuccccaggcgaagugcuccucaaccucgaacucgggcuagaaaucaaccccuaccucgcacacuuagcccguauguacaauggcuacgccggcguauucgaaguccaagucguccuugccggcaacgccuuuacugccggcaaagucauauuugcagccauaccacccaacuuucccauagauaacuuauccgccgcacaaaucacaaugugcccccacgucaucgucgacguccgccaacucgaacccaucaaccucccaaugccagacgucagaaauaacuucuuccacuacaaccaagggucagacucucgccuucgucuaaucgccaugcuuuacacaccccucagagccaacaacucaggagacgacgucuucaccgucuccugucggguccucacccgacccagccccgacuucuccuucaauuuccuagugccacccaccguagaauccaaaacaaaacucuuuacccuacccauccuaacaauuagcgaaauguccaacucgagauuccccguccccaucgacucucuucacacaucccccaccaaaaacaucgucguccaaugccaaaacgguagagucacacuagacggcgaacuaaugggcacuacccaauuacuccccucccaaauaugugccuuccgcggaacacugacccgcagcaccucgcgggcuuccgaccaggccgauacccccacaccccgacucuucggccacagguggcacauccaacuagacaacuuaaacggcacccccuacgacccugccgaagacauaccagcaccucucggcacuccagauuuccgcggcaaaguuuucgguguagccucacaaagaaaccccgacuccacaacccgagcccacgaagcaaaagucgacaccacaagcggacgcuucacccccaaacucggcucccuugaaauaaucacagaauccgacgacuucgacacaaaccaaagcacaaaauucacacccgucggcaucggaguagacaacgaagcagaguuccaacaauggucacucccaaacuacucuggccaauucacccacaacaugaaucucgcccccgcgguagcccccaacuuccccggcgaacaacuccucuucuuccgcucacaacuuccaucaucaggcgggagauccaacggagucuuagacugccuugucccccaggaauggguacaacacuuuuaccaagaauccgcacccgcacagacccaagucgcccucguacguuacguuaaccccgacacugggagaguccucuucgaagccaagcuccacaaacucggcuucaugacgaucgccaaaaacggugacucacccauaaccgucccucccaacggcuacuuccgcuucgaaucaugggucaaccccuucuacacccucgcccccaugggaaccggcaauggucgccgccgaauccaguaa

SEQ ID NO: 37690 - RNA, 1647 nt, Artificial Sequence
  derived and/or modified sequence opt11 from VP1__Norovirus_and/or_Norovirus-like__AJ277617
augaaaauggccucaaacgacgccgcccccucuaacgacggcgccgccggccuuguacccgaaaucaacaacgaagccauggcacucgaacccgucgccggcgccgccauugccgcaccccucaccggccaacaaaacauaauagaccccuggaucaugaacaacuuugcccaagccccuggaggagaauuuaccgucuccccacgaaacucccccggcgaaguccuccuaaaucuagaacucggacccgaaaucaaccccuaucuagcacaccuugcacgcauguacaacggauacgccggcggauucgaaguccaagucguccucgccggcaacgccuucaccgcaggaaaaguaaucuucgcagcaauacccccgaacuuccccaucgauaaccucagcgccgcccaaaucaccaugugcccccacgucauaguagacguccgccagcuagaaccaauaaauuuacccaugcccgacguucgcaacaacuucuuccacuacaaccaaggcagcgacucacgacuacgccuaaucgccaugcucuacacaccacuccgcgcgaacaacuccggagaugaagucuuuaccgucucaugcagaguccuuacccgccccucccccgacuucagcuucaacuuccuaguacccccaaccgucgaauccaaaacaaaacuauuuacccucccuauacugaccauuucugaaauguccaauucucgcuucccaguccccaucgacagcuuacacaccucccccaccgaaaacauaguaguccagugucaaaacggccgagugacucuagacggcgaacuaaugggcaccacacaacuccuuccaucccaaaucugcgccuuccgcggcacacuaacccgauccaccucccgcgccuccgaccaagccgauacccccaccccucgcuuauucaaucaccgcuggcacauccaacucgacaauuuaaacggcacacccuacgaccccgcugaagacauccccgcaccccucggcacacccgacuuccgcggcaaagucuucggagucgccucucagcgcaacccugacuccaccacaagagcccaugaagccaaagccgacaccacuuccggccgcuucacacccaaacucggcucucucgaaaucauuaccgaaucagacgauuucgacacaaaccaauccacaaaguucacccccguuggcauuggcgucgacaacgaagccgaauuucaacaguggucacuccccaacuauuccggccaauucacccacaauaugaaccuagcccccgccguagcucccaacuucccuggcgaacaacuccuauucuuccgaucucaacuacccuccuccggcggccgcuccaacggcguccuagacugccucauaccacaagaauggguucaacacuucuaccaagaauccgccccagcccaaacccaaguugcccuuguccgauacgucaaccccgacaccggccgcgucuuauucgaagccaaacuccacaaacuaggcuucaugaccaucgccaaaaacggagacucccccauaaccgucccacccaacggcuaccuacgauuugaauccugggucaaccccuucuacacccuagcccccaugggaaccgguaacggccgucgacgcauccaauaa

SEQ ID NO: 37691 - RNA, 1647 nt, Artificial Sequence
  derived and/or modified sequence opt11 from VP1__Norovirus_and/or_Norovirus-like__LC036561
augaaaauggcauccaacgacgcaacaccauccaacgacggcgcagccggccucguccccgaaaucaacaacgaagccauggcccuugaccccgucgcaggcgccgcaaucgccgccccacucaccggacaacaaaacauaaucgacccauggauuaugaacaacuucguccaagcccccggaggcgaguucaccgucucaccccguaacucaccaggcgaaguacuccucaaccuagaacucggcccagaaauaaacccauaccucgcccaccucgcucguauguacaacggcuaugcuggcggcuucgaaguccaagucguccuugcgggaaaugccuuuacagccggcaaaaucaucuuugccgccaucccaccuaacuuccccauagacaaccucuccgccgcccaaaucaccaugugcccccacgugauugucgacguucgccaacuugaaccuguaaaccuuccgaugcccgacguccguaacaacuucuuccacuacaaccaaggcuccgacucacgccuccgccuaaucgcaaugcucuacacuccccuacgugccaauaacucaggcgaugacgucuucaccgucucaugccgcguccucacccgccccucccccgaguucucauucaacuuccucgucccucccaccguggaauccaaaaccaaacccuuuacccuccccauccucacgaucuccgaaaugucuaacucucgcuuccccguacccaucgacucccuccacacuucccccacagaaaacaucguaguacaaugccaaaauggcagagucacccucgacggcgaacugaugggaaccacccaacuccuccccagccaaaucugcgccuuccgaggcgucuuaacucgcuccaccucacgagccucugaccaggccgacacagccacaccccgccuauuuaacuacuacuggcacauccaacuugacaaccuuaacggaacacccuacgaccccgcagaagacauccccggcccucucggcaccccggacuuucgcggaaaagucuucggcguagcuucacaacggaacccggacuccacuacacgcgcccaugaagccaagguagacaccaccucaggccgcuucacaccgaaacucgggucccucgaaaucucaacagaauccggcgacuucgaccaaaaccaacccacccgcuucacaccugucggcaucggcguagaccacgaagccgacuuccaacaauggucccuccccgacuacuccggccaauucacacacaauaugaaccucgcucccgccguagccccgaacuuuccaggagaacaacuccucuucuuccgcucccaacuucccucauccggcggacguuccaacggaauccuagacugccuagucccccaagaauggguacaacacuuuuaucaagaaucagcacccgcacaaacgcaagucgcccuugucagguacgucaaucccgacaccggccgaguccucuucgaagccaaacuccacaaacuaggcuucaugacuauagccaaaaacggagacucccccaucaccgucccucccaacggauauuuccgcuucgaaagcugggucaacccuuucuacacccucgcacccauggguaccggcaacggacgccggagaguacaauaa

SEQ ID NO: 37692 - RNA, 1647 nt, Artificial Sequence
  derived and/or modified sequence opt11 from VP1__Norovirus_and/or_Norovirus-like__KT732274
augaaaauggccuccaacgacgccacccccagcaacgacggcgccgcuggccuagucccagaaauaaacaacgaagccauggcccuagacccagucgccggagccgcaaucgccgcuccccuaacaggccaacaaaacaucauagaccccuggauuaugaacaacuuuguacaagcacccggcggcgaguucacagucagcccccgaaacagccccggcgaaguccuacucaaccuagaacuaggcccugaaaucaaccccuaccucgcccaccucgcccgaauguacaacggcuacgcgggagguuucgaaguacaaguaguacuggccggcaacgccuucacagccggcaaaaucaucuucgccgccauaccgcccaacuucccuaucgacaaccuauccgcagcccaaauuacuaugugcccacacgucauaguggacguaagacaacucgaaccagucaaccucccaaugcccgacguucgcaacaacuucuuccacuacaaccaaggcagcgacucaagacuccgucuagucgccaugcucuacaccccacuacgagccaacaacuccggcgacgacgucuucacagucuccugccguguccuaacacgcccuucccccgaguucuccuucaacuuccucguacccccaaccgucgaauccaaaaccaaacucuucacccuccccauacucacuauauccgaaaugucaaacucacgcuuccccgucccaauagacucacuccacaccucacccaccgaaaacaucgucguccaaugccagaacggacgcgucacacuagacggagaacucaugggcaccacacaacuccucccuucccagauuugcgcauuuagaggcguacucacccgcucaaccucacgagcaagcgaccaagccgauaccgcaacaccccgccuauucaauuacuacuggcacauccaacucgacaaccuaaauggcacacccuaugaccccgcagaagauauccccggcccacucggcacccccgacuuccgcggcaaaguauucggugucgccucacaacgcaaccccgacucuaccaccagagcccacgaagccaaaguggacacaaccucaggacgguucacccccaaacucggcucacuagaaaucuccaccgaauccggcgacuucgaccaaaaccaacccacccgcuucacaccagucggaauaggugucgacuccgaagcagacuuccaacaauggucccuuccagacuacucaggucaauucacacauaacaugaaccuagcccccgccgucgcgccaaacuuccccggcgaacaacuacuauucuuccgcucccaacucccuuccuccggaggccgcucaaacggcauacucgauugccuagucccacaagaauggguccaacacuucuaccaagaauccgcacccgcacaaacccaaguagcccuggugcgauacguuaacccagacaccgguagaguccucuucgaagccaaacuccacaaacucggcuucaugaccauagccaaaaacggcgacucaccuauaaccgugccucccaacggcuacuuccgcuucgaaucauggguaaaccccuucuacacacuagcccccaugggcacagggaacggccgacgccgcguccaauaa

SEQ ID NO: 37693 - RNA, 1647 nt, Artificial Sequence
  derived and/or modified sequence opt11 from VP1__Norovirus_and/or_Norovirus-like__AY247439
augaaaauggccuccaacgacgcagcccccucuaacgacggcgccgccggccuaguacccgagaucaacaacgaagccauggcacucgaccccgucgccggagccgcaauagccgcuccccuaaccggacaacaaaacauaauagaccccuggaucaugaacaauuucguccaagccccaggaggugaauuuacuguaucccccagaaacucaccaggcgaaguucuacugaaccuagaacucggacccgaaaucaacccuuaccucgcccaccucgcccguauguacaacggcuacgccggaggcuucgaaguccaaguaguccucgccggaaacgccuucacugcaggcaagaucaucuucgcugccaucccuccaaauuucccuauagacaaccuuagcgccgcacaaaucaccaugugcccacacguaauagucgauguacgacaacucgaacccgucaaccucccaaugcccgacguccgcaacaacuucuuccacuacaaccagggcuccgacucacgccuccgccugaucgcgaugcucuauaccccauuacgagcaaacaacucaggcgacgauguauucacaguauccugccgaguccucacacgaccauccccagacuucuccuucaacuucuuagucccucccaccgucgaauccaaaaccaagcccuucacccuacccauccucaccaucuccgaaauguccaacucccguuuccccguaccaauagacucccuccacaccucucccaacaacaacuucguuguccaaugccaaaacggucgaguaacccucgacggcgaacuaaugggcacaacccaacuacucccaucccaaauaugcgccuucagagguguccuagcccgucaaaucaacagagccggcgaccaaaucgacaccacaacccccagaucauucgaucaccacuggcacauccaauuagacaaccuaaauggaacacccuaugacccagccgaagacaucccuggaccacucggaacacccgguuucaaaggaaucgucuucggcgucgccucccaacgcaacuccgacggcaccacccgcgcccacgaagcaaaagucgacacacgcaccggccgcuucacacccaaacucggaagccuagucaucuccacggacagcgaagacucccaacaaaacaaaccaacacgauucacgcccguaggcguaggcguagacaacgaagaagaguucgaccaauggagccucccaaacuacuccggacccaucacccacaacaugaaccucgcccccgcaguagcccccaauuuccccggcgaacaacuccucuucuuccgcucccaacuacccuccucuggcggaaccucaaaaggcauccucgacugccucguaccccaagaauggguacaacacuucuaccaagaauccgcccccgcccaaacacaaguugcccuaguucgcuaugucaacccugacaccggccgaguccuauucgaagcaaaacuacacaaacucggcuucaugaccauagcaaaagacggcgauucccccauaaccgucccacccaacggcuacuuccgauucgaauccugggucaaccccuucuacacccucgcacccaugggcacuggcaacggucggcgccgcauccaauag

SEQ ID NO: 37694 - RNA, 1647 nt, Artificial Sequence
  derived and/or modified sequence opt11 from VP1__Norovirus_and/or_Norovirus-like__AF539439
augaaaauggcuuccuccgacgccacucccuccaaugacggcgccgccggccuaguccccgaaauuaacaacgaagccauggcucuagaccccguagcaggcgccgcaaucgccgcaccccucaccggccaacaaaacaucauagacccauggauaaugaacaacuucguacaggcccccgggggcgaguucacaguuuccccacgcaacucccccggcgaacuccuacuaaaccucgaauuaggacccgagaucaaccccuaucucgcccaccuagcccguauguacaacggcuaugccggcggcuucgaaguccaagucguccuugcuggaaacgcuuuuacggccggaaaaauaauauucgccgccauaccgcccaacuuccccaucgacaaccuguccgccgcccaaauaaccaugugcccccacgucaucgucgacguccgccaacuagaaccugucaaccucccuaugccggauguccggaacaacuucuuccacuacaaccaaggcagcgacucccgucuccgacucaucgcuaugcucuacacaccccuacgcgcaaacaacuccggcgacgacguauuuacuguuucuugccgcguccucacacgccccucccccgauuucagcuuuaacuucuugguaccacccacaguugaauccaaaacaaaacccuucacccuccccauccuaaccaucuccgaaauguccaacucacguuuccccguacccaucgacucucuacauaccucccccacugaaaacaucgucguccaaugucagaacggccgcgucacccuagacggcgaacucaugggcacaacucaacuucuccccucucaaaucugcgccuuccgcggcguacucacccgcuccaccucccgagccuccgaucaagcagauacccccacaccccgucuuuucaacuacuacuggcacauccaacucgacaaucuuaacggcacccccuacgaccccgcagaagacauucccggcccccucggcaccccagacuuccgaggcaaggucuucggcguagccucacagcgcaaccccgacuccacaacccgagcccaugaagccaaagucgacaccacagccggccgcuucacccccaagcucggcucgcuugagaucucaaccgaauccggagacuucgaccaaaaucaacccacccguuucaccccugucggaaucggcguagaccacgaggcagacuuccaacaauggucccuacccgacuacuccggccaauucacccacaacaugaaccucgcucccgccguugcacccaacuuucccggcgaacaacuccucuucuuccguucccaacuccccucaagcggcggccgcuccaacggcauccuagacugccucguaccccaagaauggguacaacacuuuuaucaagaaucagcccccgcccaaacccaaguagcccucguccgauacgucaaccccgacaccggccguguacucuucgaagccaaacuccauaaacucggauuuaugaccauagccaaaaacggggauuccccaaucacugucccacccaauggcuacuuccguuucgaauccugggucaaccccuucuacacccucgcuccaaugggaacuggcaacggccgccgucgaauccaauaa

SEQ ID NO: 37695 - RNA, 1647 nt, Artificial Sequence
  derived and/or modified sequence opt11 from VP1__Norovirus_and/or_Norovirus-like__AF414413
augaaaauggccucaaacgacgccgcaccuucgaacgacggagccgccggccucguccccgaaauaaacaacgaagcaauggcacuagaaccaguugccggugcagcaaucgcagcaccccuaaccggacagcaaaacaucauagacccauggaucaugaauaacuucguccaagcacccggcggcgaguucaccgucucaccccggaacucccccggcgaaguacuccucaaccucgaacuuggaccagagaucaacccauaccucgcucaccucgcucgcauguacaacggcuacgccggcggauucgaaguacaggucguccucgccggaaaugccuucacagcaggaaaagucaucuucgccgccauacccccuaacuuccccauagacaaccucagcgccgcccaaaucacaaugugcccacacgucauagucgacguccgacaacucgaacccaucaaccuccccaugcccgacguacgcaacaacuucuuccacuacaaccaaggcuccgacucccgccuacgccucaucgccaugcucuacacaccacuacgagccaacaacuccggcgacggcguauucaccgucuccugccgcguccuaacccgacccuccccagauuucucauucaacuuucuuguucccccaacugucgaaucuaaaacucgguuauucacccuccccauccucacaaucucagaaauguccaacagccgcuuccccguccccauagacucacuccacacuucccccaccgaaaacaucgucguccagugccaaaacggccgagucacccuugacggagaacucaugggcacgacgcaguuacucccaucccaaaucugcgcauuccgaggcacacucacccguuccaccucgagagcauccgaccaggcugacacccccaucccccgacuauucaaccaccgcuggcacauacaacuugacaaccugaacggcacacccuacgacccagcugaagacauccccgcuccacuaggaacaccugacuuccgaggcaaaguauucggcguagccucccaacgcaacccagacucuaccacaagagcccacgaagcaaaaguagacgccacacccggccgauucacccccaaacugggcucccucgaaaucaucaccgaauccgacgacuucgacacuaaccaauccacaaaauucacccccgucggcaucggcguagauaacgaggcugaguuccagcaaugguccuuaccaaacuacucaggccaguucacccacaacaugaaccuugcaccagccgucgcucccaacuuuccaggugaacaacuccucuucuuccgaucacaacugcccagcuccggcggucgcuccaacggcguauuagacugccuggucccucaagaauggguccaacacuucuaccaagaaucagcccccgcucaaacucaaguagcccuaguccgguacgucaaccccgacaccggacguguacuauucgaagcaaaacuccacaaacucggcuucaugacaaucgccaaaaacggcgacuccccaauaaccgucccaccuaacggcuacuuccgcuucgaaagcugggucaaccccuucuacacacucgcacccaugggaaccggcaacggccgcagaagaauccaauaa

SEQ ID NO: 37696 - RNA, 1647 nt, Artificial Sequence
  derived and/or modified sequence opt11 from VP1__Norovirus_and/or_Norovirus-like__AF427112
augaaaauggcaucaaacgacgccacacccuccaaugacggcgccgccggucuaguacccgagaucaacaacgaagccauggcucucgaccccguagcaggagcugcaaucgccgcuccccucacaggccaacaaaacaucaucgaccccuggaucaugaacaauuucguccaagcccccggaggugaguucacagucagcccaagaaauagcccaggcgaaguccuccugaaccuagaacucggccccgaaaucaaccccuaccuagcccaccuagccagaauguauaauggcuacgcaggaggcuuugaaguccaaguaguccucgcuggcaacgcauuuacagcaggcaagaucaucuucgccgcaaucccacccaacuuccccaucgacaaccucucagcugcacaaaucacuaugugcccccacguuauaguagacguccggcaacuagaaccugucaaccuaccaaugccugacguccgaaacaauuucuuccacuacaaccaaggcucugacucccgccuccgccucaucgcaaugcucuacaccccacuccgagcaaacaacucuggcgacgacgucuuuaccgucuccugccgcguccuaacccgaccuucacccgacuucaguuucaacuuccuugucccacccacagucgaaucaaaaaccaaacccuucacccucccaauccugaccaucucagaaauguccaacucccgauuccccguacccauagacucccuccacacccguccaaccgaaaacauaguuguccaaugucaaaacggucguguuacccucgacggagaacucaugggaaccacccaacuacuccccucccaaauaugcgcauucaggggcguccuaacacgauccacuucccgcgccagcgaccaagccgacaccgccacaccacgccuauucaacuacuacuggcauauacaacucgacaaccucaauggaacccccugcgaccccgcagaagacauccccggaccccucggaacccccgauuuccgaggcaaagucuucggcgucgccucacaacgaaaccccgacuccaccaccggcgcccacgaagccaaagucgacaccaccgccggcagauucacccccaagcucgggucccucgaaaucuccacagaaucaggcgacuucgaccaaaaccaaccaaccaaauuuacacccguaggcauuggaguagaccacgaggccgacuuccaacaauggucacuacccgacuacucuggccaauucacacacaacaugaaccucgccccagccguagcccccaacuuccccggcgaacaacuccucuucuuccgaagccaacucccaucauccggaggacguucuaacggcauccuugacugccucgucccacaagaauggguacagcacuucuaccaagaaagcgcccccgcccaaacccaagucgcccuuguccgcuacguaaaccccgacaccggccgcguccucuucgaagccaaacuccauaaacucggcuucaugaccaucgccaaaaacggcgacucccccauaaccgucccacccaacggguacuuccgcuucgaauccugggucaaccccuuuuacacccuugcccccaugggcacaggcaacggccgccggcgaauacaauaa

SEQ ID NO: 37697 - RNA, 1647 nt, Artificial Sequence
  derived and/or modified sequence opt11 from VP1__Norovirus_and/or_Norovirus-like__AF190817
augaagauggccuccaacgacgccacuccaucuaacgacggugccgccggccucgucccagaaauaaacaacgaagcuauggcccucgacccaguagcuggcgcugccaucgccgcccccuuaacaggacaacaaaacaucaucgaccccuggauaaugaauaacuucguccaagcccccggcggagaguucaccgucucccccagaaacccucccggcgaaguccuccucaaccucgaacucggccccgaaaucaauccuuaccuugcccaccucgcccgaauguacaacggcuacgcaggcggauucgaaguccaaguaguccuagccgguaacgcauucaccgccggcaaaauaaucuucgcugccaucccgccaaacuucccuaucgacaaucucuccgcugcacaaaucacaaugugcccccacguuauaguugacguccgccaacuggaacccguaaaccuucccaugccagacguccgcaacaacuucuuccacuacaaccaaggcucagacucccgccuacgccuuauagccaugcuauauacuccuuuacgcgccaacaacagcggagacgacgucuuuaccguaucaugccguguccugacccgaccauccccugacuucuccuucaacuuccucguaccucccacuguugaaucaaaaaccaaacccuucacgcuccccauccuaaccaucucagaaaugagcaacagccgcuuccccguucccaucgaaucccuccacaccgggccaaccgaaaacauuguaguacaaugucaaaacggacgugucacccuugacggcgaacucaugggaaccacccaacuccuccccucccaaauaugcgccuuccgcgguguccucacccgauccaccucucgcgccuccgaccaagccgacaccgcaaccccuagacuauucaacuacuacuggcacguacaacuagacaaucuaaacggcaccccuuacgaucccgccgaagacauacccggcccccuuggcacacccgacuuccgcggaaaaguuuucggcgucgccucacaacgcaacccggacucgaccacacgcgcccacgaagcaaaaguagacaccaccgccggccgauucaccccaaaacucggcucccucgaaaucuccacagacuccucagacuucgaccaaaaccaacccacacguuuuacucccgucggcauaggcguggauaacgaagcagacuuucaacaauggucacuacccgacuacuccggacaauucacccacaacaugaaccucgccccugccgucgcaccaaacuuccccggcgaacaacuacucuucuuccgcucccaacuaccaagcucaggcggccgauccaacggcguccucgacugccucguaccccaagaaugggcucaacacuucuaccaagaauccgccccugcucaaacccaagucgcccuuguaagauacgucaauccagacacaggccgcguccucuucgaagcgaaacuacacaaacucggcuuuaugacaauagccaagaacggcgacucaccaaucacaguacccccuaacgguuacuucagauucgaauccugggucaacccauucuacacccucgccccaaugggaaccggcaauggacggcgccgcauccaauaa

SEQ ID NO: 37698 - RNA, 1647 nt, Artificial Sequence
  derived and/or modified sequence opt11 from VP1__Norovirus_and/or_Norovirus-like__LC035072
augaaaauggccuccaacgacgccacacccuccaacgacggcgccgcaggacucguccccgaaaucaacaaugaggccauggcccuggaccccguagcaggcgccgccaucgccgcaccccucaccggccaacaaaacgucaucgaccccuggaucaugaacaacuucguacaagccccaggcggcgaauuuacggucucaccccgcaacuccccaggagagguacuacucaaccucgaacuuggacccgaaauaaaccccuaccucgcccaccuugcgcgaauguacaacggcuacgccggaggcuucgaaguccaaguaguacuagccggaaaugcauucaccgcuggaaaaauaaucuucgcagccauacccccuaacuuucccaucgacaaccuauccgccgcccaaauaaccaugugcccccacguaauaguagacguucgccaacucgaacccguaaaccuuccaaugcccgacgucagaaacaacuucuuucacuauaaccaaggcucagauucccgacuucgccucaucgccaugcucuacaccccacuucgcgccaacaacuccggagacgacguauucaccgucuccugccgcguccucacccgcccaagucccgaguucuccuucaacuuccucgucccaccaaccgucgaaagcaaaaccaaaccauucacccucccuauccucaccauaagcgaaauguccaacucucgauucccaguccccauagacucccuacacaccuccccuacagaaaacaucguaguucagugucaaaacggccgcgucacccucgacggagaacucauggguaccacucaacuccuccccagccaaaucugcgccuuccgaggcguccuaacccgauccacuucccgagccucagaccaagcugacacagcaacaccccgacuauucaacuacuacuggcauauccaacucgacaaccccaacggcaccccauacgaccccgccgaagacaucccaggcccccucggaacccccgacuuccgaggcaaagucuucggagucgccucccaacgcaacccugacuccaccaccagagcccacgaagcaaagguagacacaaccucaggcagauucacccccaaguuaggaucacuugaaaucucuacagaauccgacgacuucgaccaaaaccaaccaacccgcuuuacacccgucggcaucggcgucgaccgcgaagcagacuuccagcaguggucucucccagacuacuccggccaauucacacauaacaugaaccuagcccccgccguugccgcaaacucgccaggagaacaacuuaucuucuuuuggucccaaucacccuacugcggaggccgguccaaccgcguccucgacugcauggucccccaagaauggguacaacacuucuaccaagagucagcccccgcacagacccaacucgcccuaguacgauaugucaaccccgacaccggccgaguucucuucgaagcuaaauuacacaaacuaggauucaugaccaucgccaaaaacggcgacucucccaucacagucccacccaacggcuacuuccguuucgaauccugggucaacccauucuacacccucgccccaaugggcaccggcaacggacgacgcagaguucaauaa

SEQ ID NO: 37699 - RNA, 1647 nt, Artificial Sequence
  derived and/or modified sequence opt11 from VP1__Norovirus_and/or_Norovirus-like__DQ093064
augaaaauggccuccaacgacgcagccccauccaacgacggcgccgcuaacuuagucccagaagccaacaacgaagucauggcacuagaacccgucgucggagccagcaucgcagcccccgucgucggccaacaaaacaucauagaccccuggauacgagaaaacuucguacaagcuccccaaggcgaauuuacaguaucaccacgcaacucaccuggcgaaaugcuauuaaaccuagagcuuggccccgaacucaaccccuaccucucacaccugagccgcauguacaacgguuacgccggcggcaugcaaguccaagucguacucgcugguaacgccuucaccgccggcaagaucaucuucgccgcagucccaccccauuuccccguagacaacaucuccgcagcccaaauuaccaugugcccccacgucauagucgacguccgacaacucgaacccguccuacucccacucccagacauccgcaaccgauucuuccacuacaaccaagaaaacacaccccgcaugcgacuugucgccaugcucuacaccccacuccgcgccaacucaggagaagacguuuucaccguuucuugucgcguacuaacccgccccgcacccgauuucgaguucaccuuccucguaccucccaccguagaauccaaaaccaaacccuucacccugccaauacuaacccuaggagaacucucaaacucacgcuucccugccgcaauagacauguuauacgcagaccccaacgaauccauaguaguacagccccaaaacggccguugcacccucgacggaacacuacaaggcaccacccaauuaguccccacccaaauaugcgccuuccgaggcacacucauaucccaaaccgcacgcgcaaccgacagcacagacuccccacaacgcgcacgcgaccacccccuccacguccaaguaaagaaccuagacggcacccaauacgaccccaccgacgacauccccgccguccucggcgccaucgacuucaaaggcaccgucuucggcgucgcuucccaacgagacgucuccggcccacaagaacaaggacacuaugcaacccgugcccacgaagcacacaucgacacaaccgaccccaaauaugcccccaaacuaggaacaauccucaucaaauccgaauccaacgacuucaucacaaaccaaccuauccgauucacacccgucggaaugggagauaacaacuggcgccaaugggaacuaccugacuacuccggccgccucacccucaacaugaaccuagccccagccgucucaccauccuucccaggcgaacgcauacuuuucuuccgcucaaucguacccuccgccggcggauacgguuccggcuacauagacugccuaauaccccaagaauggggccaacacuucuaccaagaagccgcaccuucacaaucagccgucgcccuuguacgcuacgucaacccagacaccggccgcaacauauucgaagcaaaacuacaccgcgaaggcuuccucaccguagccaacucaggcaacaacccuauagugguacccccaaacggcuauuuccgcuucgaagccugggucaaccaauucuacacccucgcucccaugggauccggccaaggaaggagacgcuga

SEQ ID NO: 37700 - RNA, 1647 nt, Artificial Sequence
  derived and/or modified sequence opt11 from VP1__Norovirus_and/or_Norovirus-like__L23830
augaaaauggccucaaacgacgccgcccccuccaacgacggagcagccggccuugucccagaaaucaacaacgaggccauggcucucgacccagucgccggugccgccauagccgcaccccucaccggccaacaaaacauuauagaccccuggaucaugaacaacuuuguacaagcaccaggcggcgaguucaccguaucacccagaaacucaccuggcgaaguccuucucaacuuagaacucggcccagaaaucaauccauaccucgcccaccucgcccgcauguacaacggauacgccggcggcuucgaaguccaaguuguccuagccggaaacgcauucacagccgcaaaggucaucuucgccgcaauuccaccaaacuuuccaaucgacaaccucuccgcagcacaaauaaccaugugcccccacgucauagucgacguccgccagcucgaacccauaaaccucccaaugcccgacguccgaaacaacuucuuccacuacaaccaaggauccgacucaagacuacgacucaucgcaaugcuauacacaccccuccgagcaaacaauuccggcgacgaugucuucaccgucucuugccgcguccucacacgccccucccccgauuucuccuucaacuuccucgucccaucaacaauggaauccaaaacaaaacccuucacccuccccauccuuacaauauccgaaauguccaacucacgcuucccaguccccaucgauucccuacacaccuccccaacugaguccaucgucguucaaugccaaaacggccgcguaacauuggacggcgaacucaugggaacaacacaacuauuacccaaccaaaucugcgccuuccgcggcacucuaacccgcucuaccaaccgugccuccgaccaagcugacaccgccacuccccggcuauucaaucaccacuggcacauacaacucgacaaccuaaacggaacacccuacgaccccgccgaagacaucccugcaccucuaggaaccccagacuuccguggcaaaguauuuggugucgcuggacaacgcaaccccgacuccaccacucgagcccacgaagccaaagucgacacaacuuccggacgcuucacccccaaacuaggcucacuagaaaucaccacagaaucagacgacuucgaccccaaccagucuacaaaauucacacccgucggcaucggcgucgacaacgaagccgacuuccagcaauggucacuccccgauuacagcggccaauucacccacaacaugaaccucgcaccagccguggcccccaacuucccaggcgaacaacuccuauucuuccgaucccaacuacccuccucaggcggccgcucaaacggcaucuuagacugccuggucccccaagaauggguacaacacuucuaccaagaauccgccccagcacaaacacaagucgcacucguucgcuacguuaacccagacacaggacgaguccucuucgaagccaaacuucacaaacucgguuucaugaccaucgccaaaaacggcgacucgcccauaacugucccacccaauggcuacuuccgauucgaaucauggguuaaccccuucuacacacucgccccaaugggaaccggcaauggccgacgccgcauccaauaa

SEQ ID NO: 37701 - RNA, 1647 nt, Artificial Sequence
  derived and/or modified sequence opt11 from VP1__Norovirus_and/or_Norovirus-like__KX907728
augaaaauggccuccaaugaugccccacccagcuccgacggagccggaaaccuaguccccgaaagccaccaagaaguccuaccacuugcacccgucgcaggagccgaacucgccgccccagucguaggccaaaccaacaucaucgacccauggaucaaagaaaacuucguccaagccccacaaggcgaauuuaccgucucccccaaaaacgcgccaggagaaauccuagucaaccucgaacucggcccaaaccucaaccccuaccuugaacaccucucccgcauguacaaugccuacgcaggcggaauagaagucgaaaucauacucgcaggcaaugcauucaccgccggcaaaauccucaucgccgccguacccccaaauuucccaguagaauccgucucagccucccaagccacccaauucccccacgcaaucguggacguacgaacccucgaacccguccgccuaccacuaccugauguuagaucgaacuucuuucacuacaccaccaaagacgaaccaaaaaugcgacucguaaucuggcuauacacaccccuccgcacuaacggauccggcgacgacucauucacaguaucagguaggcuacucacccgccccucaauggacuuccaauucucauuucucgugcccccaacagucgaaaccaaaaccguacuauucaccguccccggacugacuccccaagaaaugagcaacucgcgauggcccgcccaaauuuccggcauggucguucgaggaaacgaaccacaagucguacaguuccaaaacgggcgaugccacaccgacggaacccuacuugguacuacaaccgucagcgaacaaugcaucgccggauucgucgggacuuccaccaacacaagaucagcaaccggcuccacaaccgagacacguacuggugacaccgaccucuggcuccgacucgaagaacccaacggacaacccuaugacaucuucggcgaccaacccgccccacucggcacccccgauuuccgagcggucaucgucggcuucgccucccgaccucaaacacaaggcucguacaugaacgaagcauacgucaauaccgucgacucacacuucgccccagcaaccggcaacaccaaaauaauacuacgacgaggaggcaccggacaugucggcggcggacaccucuggaaauuccgacccuucggcguugaaggcggcgaaggacgagucuccuaccaagaauacguacuccccaacuacucuggcgccaccgcaucaaaccacaaccucgcaccucccguugccccacggaugcccggugaacuucuacuccucuucgaauccgacaugccaguaugggacgacggucacggcgccgcccccgcccagaaaauacacugccuacucccccaacaauucauaacccacuuuuucgacagccaagcacccgcccucgccgaagccgcucugcucagauacguacacccagacuccagccgcguccucuucgaaaccaaacuauaccgugaaggcuucaugguaguauccgccccaacaggccgcuucgacuucccacuagacggcuacuuucgcuucgacuccugggucaacuccuucuacguccucuccccaguugguagcgggcaaggccggcgguaa

SEQ ID NO: 37702 - RNA, 1644 nt, Artificial Sequence
  derived and/or modified sequence opt11 from VP1__Norovirus_and/or_Norovirus-like__AB039779
augaaaauggcgucaaacgacgccgcccccucaaacgacggcgcagccaaccuggucccagaagccaacaacgaagugauggcccucgaaccaguggucggcgcuucaaucgccgcccccgucguuggacaacaaaacaucaucgaucccuggauacgcgaaaacuucguucaagcaccccaaggcgaauuuaccgucucaccucgaaacucuccaggcgagaugcuacucaaucucgaacucggccccgaacuaaaccccuaccucucacaccuaucccgcauguacaacggcuacgccggaggcaugcaaguccaagucgucuuagcagguaacgcauucaccgcaggaaagaucaucuucgccgccgucccaccccacuuccccguagaaaacauaucugccgcccaaauuacaaugugcccccacgucauaguagacguccgccaacucgaaccaguguuacucccccuccccgauauacgaaacagauucuuccacuacaaccaggaagacaccccgcgaaugcgucuagucgccaugcuauacacgcccuuacgagccaacuccggagaagauguauuuacagucucaugccgaguacuaacacgaccugccccagacuucgaguucacguuccuggucccacccacagucgaauccaaaaccaaacccuucacacuccccauccucacccuaggcgaacuguccaauucacguuuccccgcacccaucgacauguuauacaccgaccccaacgaaacaauaguaguacaaccacaaaacggccggugcacccuugacggcacacuucaaggaaccacccaacucguacccacccaaaucugcucuuuccgcggcacccucaucucccaaacaccccgauccgcugauucuaccgacuccgccccacgcguccgcaaccacccccuccacguccaacucaaaaaucucgacggcacccccuacgaccccaccgacgaaguucccgcagucuugggagccaucgauuucaaagguaccguauucggcgucgccucacaacgaaacaccaccggauccuccguaggcgcaacccgcgcccacgaaguccacaucgacacaacaaaucccagauacacacccaaacuuggauccguccucauguacuccgaaucuuccgacuuugacgacggccaaccaacacguuucacccccauuggaaugggcgcagacgacuggcaccaaugggaacucccagaauacucaggccaucucacccucaacaugaaccucgcucccgccgucgcacccgccuuccccggcgaacgcauccucuuuuuccgguccguaguacccuccgccggcggauacggaucuggucaaauagacugccuaauaccacaagaauggguacaacacuucuaccaagaagccgccccaucacaauccgccguagcacucauacgauacgucaacccagacaccggacgcaacaucuucgaagccaaacuccaccgcgaaggcuucaucacagucgccaacucuggaaacaaccccauagucguacccccaaacggcuacuuccgcuucgaagccugggucaaccaauucuacgccuuaaccccaaugggcaccggucaaggcagacgccgaguccaauaa

SEQ ID NO: 37703 - RNA, 1644 nt, Artificial Sequence
  derived and/or modified sequence opt11 from VP1__Norovirus_and/or_Norovirus-like__AB039778
augaaaauggccucaaacgacgccgcccccuccaacgacggcgccgccaaccuaguccccgaagcuaacaacgaagucauggcucuagaaccgguggucggcgccagcaucgcagccccagucgucggacaacaaaacauaauagaccccuggauccgcgagaacuucguccaagccccgcaaggggaguucaccgucucuccccgcaacucccccggugaaaugcuacucaaccucgaacucggacccgaacuuaaccccuaccuuucccaucucucucgcauguacaacggcuacgccggcggcaugcaaguacaggucguccucgcaggcaacgccuucacagcgggcaaaaucaucuucgccgccgucccuccccacuuccccguagaaaauaucucugcagcacaaaucaccaugugcccccacgucaucguagacguccgccaacuagaacccguccuccucccacuccccgacauccgcaaccgcuucuuccauuacaaccaagaagacacaccccgcaugcgccuaguugcgaugcucuacaccccacuccgcgccaacucuggcgaagacguguucaccgucucaugcagaguccuaacccgcccugcccccgacuucgaguucaccuucuuagucccacccaccguugaauccaaaaccaaacccuucacccucccaauacucacacuuggcgaacucuccaacucacgcuuccccgccccgaucgacaugcuauacacagacccaaacgaaaccauagucguccaaccccaaaauggcagaugcacacucgacggcacccuccagggaacaacacagcuaguccccacacaaauuugcuccuuccgcggcacccuaaucucccaaaccucccgaucagcugacucaaccgacucugcuccucgcguccgaaaccacccccuccacguccaacucaaaaaccucgacggaacccccuacgaccccacugaugaaguccccgcuguacucggcgcaauugacuucaaagguaccguauucggcguagccucccaacgcaacacaaccggcuccuccgucggagccacccgcgcacacgaaguccacaucgacacaacaaauccccgcuacaccccaaaacucggauccguccuaauguacuccgaaucauccgacuucgacgacggacaacccacccgcuucacacccauaggcaugggcgccgacgacuggcaccaaugggaacuccccgaguauucaggccaccuaacccuaaacaugaaccucgcccccgcgguugcacccgcauuucccggcgaacgcauccucuucuuccgcuccgucguccccuccgccggaggcuauggcuccggacaaauagauugccucaucccccaagaauggguccaacacuucuaccaagaagccgcaccuucacaauccgccgucgcacuaauucgcuacgucaaccccgacaccggccguaauauauucgaagcaaaacuccaccgcgaaggguucaucacuguugccaacuccggaaacaacccaaucguugugcccccaaacggguacuuccgcuucgaagccugggucaaccaauucuacacccugacccccaugggcacuggacaaggccggcgacgcguacaauaa

SEQ ID NO: 37704 - RNA, 1644 nt, Artificial Sequence
  derived and/or modified sequence opt11 from VP1__Norovirus_and/or_Norovirus-like__KY424345
augaagauggcauccaacgacgccgcccccuccaacgacggcgccgccaaccuaguccccgaagccaacaacgaagucauggcacuagaaccaguagucggugccuccaucgcagcccccgucgucggccaacaaaauaucaucgaccccuggauccgcgaaaacuucguucaagcaccccaaggagaauuuacagucagcccccgcaacuccccuggugaaaugcuccuaaaccuugaacucggaccggaacuaaaccccuaccucucccaccugucccgaauguacaacggauacgccggcggaaugcaaguccaagucgucuuagccggcaacgccuucaccgccggcaaaaucaucuucgccgccgucccaccccacuuccccgucgaaaacaucuccgccgcccaaaucaccaugugcccccacgucaucgucgacguacgccaacuggaaccagucuuacucccccuacccgacauccgcaaccgcuucuuucacuacaaccaggaaaacacaccccgcaugagacucgucgccaugcuauacacuccccuccgcgcgaacuccggcgaagacgucuuuaccgucucaugccguguccucaccagaccagcacccgacuucgaguucaccuuccucguacccccuaccgucgaaucaaaaaccaaaccuuucaccuuacccauccucacccucggcgagcucucuaacuccagauuuccagcuccaauagacaugcucuacaccgacccaaaugagggcaucgucgugcaaccccaaaacggccgaugcacacuagacggaacacuccaaggcacaacccaacucguccccacccaaaucugcgccuucagaggaacacuaaucggccaaaccagccgcagcagcgauuccaccgauucugcaccccgacgacgcgaccacccccuccacguacaacucaaaaaccuagacggaacccaauacgauccaacagacgaagucccggccguccuaggcgccaucgacuuuaagggcgccguuuucggcguugccagccaacgcgacgucucagguacccaaguaggagcaacccgagcccacgaaguacacauaaacacgacagacccccgcuacacaccaaaacucggcuccauccuaaugcacucugaauccgacgacuucgucaccggccaacccauucaauucacccccgucggaaugggcgacaacgacuggcaccaaugggaacuaccagacuacucaggccaucuaacacuaaacaugaaccuagccccagccguagcacccgccuucccaggagaacgcauccuauucuucagaagcaucgucccauccgccggcgguuacggcagcggacaaaucgacugucucaucccacaagaauggguccaacacuucuaccaagaagcggcccccucacaauccgcaguagcacucauacgcuacgucaaucccgacacaggacgcaacaucuucgaggccaaacuacaccgcgaaggguucaucaccguagccaacuccggcaacaacccuaucgucgucccgcccaacggcuacuuccgcuucgaggcauggguaaaccaguucuacacccucacuccaauggguaccggccaaggccgacgacgcaaccaauaa

SEQ ID NO: 37705 - RNA, 1644 nt, Artificial Sequence
  derived and/or modified sequence opt11 from VP1__Norovirus_and/or_Norovirus-like__HQ169542
augaugauggcaucaaacgacgccgcccccuccaacgacggcgccgccaaccucguaccagaagcuaacaaugaaguaauggcacucgaaccuguagucggcgccucaauagcagcaccaguagucggccaacagaacauaaucgaccccuggauccgagaaaacuucguccaagcuccucaaggcgaauuuacugucagcccccgaaacuccccaggcgaaaugcuccuaaaccucgaacucggccccgaacucaaccccuaccucucccaccuaucacgcauguacaacggauacgccggcgguaugcaagugcaggucguacucgccggcaacgcuuucaccgcaggaaaaaucauuuucgcugcugucccuccacacuuccccgucgaaaacaucucagcagcacaaaucacaaugugcccacacgucaucgucgacguccgccagcuagaacccgugcuacucccccuacccgauauccgaaaccgauucuuccacuacaaucaagaagacaccccucgcaugcgccuagucgccaugcucuacacgccccuacgagccaacuccggagaagacguguucaccgucuccugccggguccuaacccgccccgcccccgacuucgaguucaccuucuuagucccaccgacuguagaauccaaaaccaaaccauucacccucccaauccucacacuaggagaacucuccaacucccgauucccagcccccaucgacaugcucuacaccgaucccaacgaaaccauagucguacaaccccaaaaugguagaugcacccucgacggaacccuccaaggaaccacacaacucguccccacucaaaucugcuccuuccgaggaacccucgucagccaaaccucccgaucagccgacuccaccgacuccgcaccccgaguccgaaaucacccucuacacguccaacucaaaaaccuagacggaaccccuuacgaccccacggacgaaguccccgccguccucggcgcaaucgacuucaaaggcaccgucuucggcgucgccucucaacgcaacaccaccggcggaagcguaggcgcaacacgugcccacgaaguccacaucgacacaacaaauccccgcuacaccccaaaacucggcucaguccucauguauucagaaucauccgacuucgacgacggccaacccacccguuucacccccauaggcaugggugcugacgauuggcgccagugggaacuccccgaauauuccggacaccucacccucaacaugaaccuggcacccgcugucgccccugccuucccuggcgaacgcauccucuucuuccgguccgucgucccauccgccgguggauacggcucaggccaaauagacugucuuauaccccaagaauggguccaacacuucuaccaagaagcugcccccucacaaagcgccguugcuuuaauccgauacgucaacccugacaccggccgcaacaucuucgaagcaaaacuacauagagaaggauucaucaccgucgccaacuccggaaacaaccccaucgucguacccccaaauggcuacuuccgcuucgaagcaugggucaaccaauucuauacccuuacccccaugggaacaggacaagggcgccgccguguucaauaa

SEQ ID NO: 37706 - RNA, 1644 nt, Artificial Sequence
  derived and/or modified sequence opt11 from VP1__Norovirus_and/or_Norovirus-like__KX228762
augaagauggccagcaacgaugccgccccguccaacgacggggccgcgaaucucguccccgaagcaacaaacgaaguaauggcacuugaaccaguagucggagccucaauagcugcacccgucgucggccaacaaaacauuauagaucccuggauccgcgaaaauuucguccaagcaccccaaggugaauuuacaguaaguccccgcaacucaccaggagaaaugcuacuaaaccuugaacuaggcccagaacuaaacccguaccucucccaccucagcagaauguacaacggcuacgccggaggcaugcaaguccaagucguccucgccggcaacgccuucaccgccggaaaaauaauauuugccgccgucccaccccacuuccccgucgaaaacauauccgccgcacaaaucaccaugugcccacacgucaucguagauguccgccaacuagaacccguccuccucccccucccagacauccguaacagauucuuucacuacaaccaagaaaacacaccccgaaugcgccuuguagccaugcucuacaccccacuccgagcaaacuccggcgaagacguauucaccgucucuugccgaguccucacccgacccgcacccgauuucgaguucaccuuucucguaccaccuacugucgaaucaaagaccaaacccuucacccuccccauacuuacccucggcgaacugucaaacucccgauuucccgccccuaucgacaugcuuuauaccgauccaaacgaagccauuguaguccaaccucaaaacggccguuguacacucgacggcacccuccaaggcaccacccaacucguacccacccaaaucuguucuuuccgaggaacccucaucucacaaacaucccgauccgccgacucaacagacuccgcaccccggguacgaaaccacccccuccacguccaauuaaagaaccuagacggaaccccauacgacccaaccgacgaagucccagccguguuaggugccaucgacuucaaaggcaccgucuucgguguugccucccaacgcaacaccaccggcaacuccaucggagcaacacgcgcacacgaaguccauauugacaccacaaacccccguuacacccccaagcucggaucaguccucaugcacuccgaauccaacgacuuugacgacggccaaccaacccgcuucacaccaaucggcaugggcgcugacgacuggcaccaaugggaacucccggaauacuccggccaccucacccucaacaugaaccuagcacccgccgucgcccccgccuuccccggagaacgcauccuauucuuccgcuccguugucccauccgcaggcggcuacggaagcggacacaucgacugccucaucccucaagaauggguccaacacuucuaccaagaagcagcgcccucucaaagcgccgucgcgcucauacgcuacgucaaccccgacaccggccguaacaucuucgaagcgaaacuucaccgagaaggcuucaucaccguugcuaacagcggcaacaaccccaucgucgucccucccaacggcuacuuccgcuucgaagccugggucaaccaauucuacacccucacuccaaugggcaccggccaaggccgccgacgcguacaauaa

SEQ ID NO: 37707 - RNA, 1644 nt, Artificial Sequence
  derived and/or modified sequence opt11 from VP1__Norovirus_and/or_Norovirus-like__AF414410
augaaaauggcaucuaacgacgccgcuccaucaaacgacggcgcagccaaccucguccccgaagccaacaacgaaguaauggcccucgaaccagucgucggagccuccauagccgcccccgucgucggacagcaaaacauaauugacccauggauacgcgaaaacuucguacaagccccacaaggcgaauucaccgucuccccccgcaacucccccggcgaaauccuacuuaaucuagaacucggcccagaacucaaccccuacuuaucccaccucucacggauguacaauggauaugccggcggcaugcaaguacaagucguucucgcagguaacgcauucaccgccgggaaaaucaucuucgcagccguacccccccacuuccccgucgaaaacauauccgcagcccaaaucacgaugugcccccacgucaucguugacguacgacaacucgaaccagucuuccuaccccuccccgacauccguaaccgguucuuccauuacaaccaggagaacaccccccgcaugcgucucgucgcuaugcuuuacaccccucuccgagcaaacucaggagaagauguguuuaccgucuccugccgaguccucacccgucccgcccccgacuucgaauuuacauuccuuguaccccccacagucgaaagcaaaaccaaacccuucacccuccccauccuaacccucggcgaacuaagcaacagccgauuccccgcaccaaucgacaugcucuacaccgacccaaacgaaacuaucguuguccaaccacaaaacggcagaugcacccucgacggcacccuccaaggaaccacacaacucgucccaacacaaaucugcuccuuuagaggcacccucaucucccaaaccagccgcuccgccgauuccacugacuccgccccacgcgcucgcaaccacccccuccacguccaacuaaaaaacuuagauggcacacccuacgacccaaccgacgaaguacccgccguucuuggagcaauagacuucaaaggcaccgucuucggcgucgccucccaacgcaauacaacuggcucaucagucggcgcaacccgagcacacgaaguacacaucgacacaaccgacccccgauacaccccuaaacucggauccguccuaauguacucagagagcaacgacuucgaugacggccaacccacccgcuucacaccaauaggaaugggcgccgacgacuggcaccaaugggaacuccccgaauacuccggacaccuaacccucaacaugaaccucgcccccgccgucgcccccgccuuccccggagaacgcauacucuuuuuccgcuccguugucccauccgccggcggguacgguagcggccaaaucgacugccucaucccacaagaauggguucaacacuucuaccaagaagcugccccaucccaauccgccgucgcacuuauccgcuacguaaacccagacaccggccggaacaucuucgaagccaaacuccaccgcgaaggauucaucaccgucgccaacucaggaaacaaccccaucgucgucccuccaaacgguuacuuccgcuucgaagccugggucaaccaauuuuauacccuaaccccaaugggcaccggccaaggccgaagacgcguccaauaa

SEQ ID NO: 37708 - RNA, 1644 nt, Artificial Sequence
  derived and/or modified sequence opt11 from VP1__Norovirus_and/or_Norovirus-like__KU935739
augaaaauggcuucuaacgacgccgcacccuccaacgacggcgccgcuaaccucguucccgaagcaaccaacgaaguuauggcccucgaacccgucgucggugcguccaucgccgcccccgucguaggccaacaaaacaucaucgacccauggauacgagaaaacuucguccaggcaccccaaggcgaauuuaccgucagcccccgcaacucccccggagaaaugcuccucaaccucgaacucggacccgaacuaaaucccuaccuaucccaccucucccgcauguacaacggauacgcaggcggcaugcaaguucaaguuguccucgccggcaacgccuucacagcgggcaaaaucaucuucgccgccguucccccacacuucccuguagaaaacaucucagcugcccaaaucaccaugugcccacacgucaucgucgacguacgacaacucgaacccguacuccuaccccuaccagauauccgaaaccgcuucuuccauuacaaccaagaaaauacaccccgcaugcgccuugucgccaugcucuacaccccacucagagccaacuccggagaagacguauucaccgucuccugcagaguccucacacgccccgccccagacuucgaauuuaccuuccuugugccacccaccguagaaagcaaaaccaaaccauucacccuccccauccuuacacuaggagaacucagcaacucccgcuucccggcgccaaucgacaugcucuacacugacccuaacgaagcaaucgucguacaaccgcagaacggccggugcacccucgacggaacacuacaaggcacaacccaacucguuccaacacaaaucugcuccuuccgaggaacccucaucucacaaaccucacgaucagccgacagcaccgacuccgcaccccgcgcccguaaccacccauuacacguccaacucaaaaaccuagacggcacacccuacgacccgaccgacgaaguccccgccguccucggcgccauagacuucaaaggcaccgucuuuggcgucgccucccaacgaaacaccacuggaaacucaaucggcgccacccgcgcccacgaaguacacauagacaccacuaacccacgcuacacacccaaacucggauccguccucauguacucagaauccaacgacuuugacgacggccagccuacccgauucaccccaauaggcaugggugccgacgacuggcaccaaugggaacuaccagaauacuccggccaccucacacucaacaugaaccucgccccagcaguagccccagcauuccccggugaacgcauccuauucuucagaucgguaguaccauccgcaggcgguuacggcucaggccacaucgacugccucaucccccaagaauggguccaacacuucuaccaagaagcugcuccuucccaaucagccgucgcccuaauccgauacguuaaucccgacacaggccgcaacauuuucgaagccaaacuccaccgcgaaggcuucaucaccguagccaacagcggcaacaacccaaucguagucccacccaacggcuacuuccgauucgaagccugggucaaccaauucuacacacucacccccaugggaacaggccaaggcagacgccgaguccaauaa

SEQ ID NO: 37709 - RNA, 1644 nt, Artificial Sequence
  derived and/or modified sequence opt11 from VP1__Norovirus_and/or_Norovirus-like__KX268709
augaaaauggcaagcaacgacgccgcccccucuaacgacggugcggccaaccucgucccugaagccaccaacgaggugauggcccucgagcccguaguuggggccuccauagccgcucccgucgucggccaacaaaacaucauagaucccuggauucgagaaaauuucguccaggcaccccagggcgaauuuacugucagcccccgcaacucccccggagaaaugcuacucaaccucgaacucggccccgaacucaaccccuaccucucccacuuaagccgcauguacaauggauaugccggcggcaugcaaguacaagucguccucgccggcaacgccuucacugccggcaaaauaaucuucgccgcagucccaccacacuuccccgucgaaaacauaucggccgcucaaaucaccaugugcccacacgucaucguagacguccgccaacucgagcccguccuccugcccuuacccgacaucagaaacagauucuuccacuacaaccaagaaaacaccccaagaaugcgccucgucgccaugcucuacacaccccuacgugcaaacucaggcgaagacgucuucaccguuucgugccgcguccucaccagacccgcccccgacuucgaguucacauuccuugucccaccaaccgucgaauccaaaaccaaaccauuuacccuacccauacucacccucggcgaacuuuccaacucacgcuuuccagcaccaaucgacaugcucuacacugaccccaacgaagccaucguuguccaaccacagaauggacgaugcacuuuagacggcacacuccaaggcacuacccaacucgugcccacacaaauaugcucauuccgcggcacacucaucucccaaacauccagaucagccgacucaaccgauucugccccacgagccagaaaccacccacuucacguacaacucaagaaccuugacggaaccccauacgaucccacagaugaagucccagcaguucucggcgcaauagauuucaaaggcaccgucuucggcgucgcuucccaacgaaacaccaccggcaacuccaucggcgcaacgcgugcccacgaaguacacaucgacaccaccaacccacguuacacaccaaaacucggaucaguccuaaugcacucggaauccaccgacuucgacgacggacaacccacgcgcuucacuccuauaggaaugggcgcagacgacuggcaccagugggaacuccccgaauacucaggccaccuaacucucaacaugaaccuagccccugccguugccccagccuuccccggagaacgcauccucuucuuccgaucagucguccccuccgcaggcggcuacggauccgggcacaucgacugcuuaaucccccaagaauggguccaacacuucuaccaagaagccgcccccucucaauccgccgucgcucuaauacgcuaugucaaccccgacacaggccgcaacauauucgaagcaaaacuccaccgagagggcuucaucacagucgccaacuccggaaacaaccccaucgucgucccgcccaacggcuacuuccgauucgaagcaugggucaaccaguucuacacccucacccccaugggaaccggccaaggccgccgccgaguccaauaa

SEQ ID NO: 37710 - RNA, 1644 nt, Artificial Sequence
  derived and/or modified sequence opt11 from VP1__Norovirus_and/or_Norovirus-like__KX158282
augaaaauggcauccaacgacgccgcaccaucaaacgacggcgccgccaaccuuguaccagaagcaaccaacgaaguaauggcucuagaacccguagucggcgccucuaucgccgcccccgucgugggucaacaaaacaucauagacccauggauccgcgaaaacuucguacaagcgccccaaggcgaguucaccgucucuccccgaaacucacccggagaaaugcuccuaaaccucgaacucggacccgaacucaacccguaccucucacaccucucccgaauguacaacggcuacgccggcggcaugcaaguccaaguaguccucgccggaaacgccuuuaccgccggcaaaauaaucuucgccgcggucccaccucacuuccccgucgaaaacauauccgccgcccaaauaaccaugugcccacacgucauuguagacguccgccaacuagaaccgguccuccuaccccuccccgacauucgaaauagauucuuccauuacaaccaagaaaacacaccccgcaugcgccucgucgcgaugcucuacacaccccuacgcgccaacucaggcgaagaugucuucacaguuucgugccguguccucaccagaccagcccccgacuucgaguucaccuuccucgucccacccaccgucgaaucaaaaacaaaacccuucacccuccccauccucacacuuggagaacucucaaauucacgcuuccccgcccccaucgauaugcuauacaccgaccccaaugaagcuauaguaguccaaccccaaaacggacguugcacccucgacgguacccuccaaggcacaacucaacuugucccaacccagaucuguucauucagaggcacccucaucagccaaaccuccagauccgccgacuccacagacagcgccccacgcgugcgcaaccacccccuacacguacaacucaaaaaccuagauggcacccccuacgacccaaccgaugaaguccccgccguacuuggcgccaucgacuucaaaggaacaguccucggaguagccucucaacgaaacaccacaggcuccucuauaggcgccacccgagcucaugaaguccacaucgacaccaccaacccccgcuauacacccaaacucggcucaguccucaugcacuccgaaagcacagacuucgacgacggacaacccacccgcuucaccccaauaggcaugggcgccgacgacuggcaccaaugggaacuccccgaauacuccggccaccuaacccucaacaugaaccucgcccccgccgucgcacccgccuucccaggcgaacguauccuauucuuccgaucaguaguucccagcgccggcggauacggauccggccacaucgacugccucaucccucaagaauggguacaacacuucuaccaagaagcggcccccucccagucagccguagcacucauccgcuacguuaaccccgacaccggacgcaacaucuucgaagcaaaacuccaccgagaaggcuucauuaccguagcaaacucaggcaacaaccccauagucguacccccaaacggcuacuuccgauucgaagcaugggucaaucaauucuacacccucacacccaugggcaucggccaaggacgccgacgcguacaauaa

SEQ ID NO: 37711 - RNA, 1644 nt, Artificial Sequence
  derived and/or modified sequence opt11 from VP1__Norovirus_and/or_Norovirus-like__AB126320
augaaaauggccucauccgacgcagccccauccacagacggcucagcccgccuaguuccugaagucaacaacgaaacaauggcccuagaaccggucgucggcgccccucucgcugcccccgucgcaggacaacacaauauaaucgaccccuggaucaaaaugaauuucguacaagccccaaacggagaguucaccgucucuccacgcaacgccccaggcgaaauccuccucgaccuagaacuaggacccgaucuuaaccccuaccuaucucaccuagcccgcauguacaacggcuacgccggcggcauggaagugcaagucguccucgccggcaacgcauuuacagcuggcaaaaucaucuucgcagccguuccacccaacuuccccgcagaaaaccuaucagccgcucaagugacaaugugcccacacgucaucgucgauguacgccagcuagaacccguaaugcuccccaugcccgacauccgaaacaagcuauuccacuacaaccaagucgacgaccccaaauuacgacuccucgcguaccucuauacaccccugcgagcaaacaaugcuggcgacgaugucuucaccgucucaugccguguccucaccagacccacccccgacuucgaguucauguucuuaguuccacccaccgucgaaucaaaaaccaaaccauucucccuaccuucacugacccucgacgaacucuccaacucucgcuucccagcccccauaguccaacucuacaccaacccacacgacaaccuaguaguacaaccacagaacggacgcugcaccauagacggccuccuccaaggcaccacacaacuugucuccugcaacgucugcucauuccguggaaccaucggugacggacaacccgcaucccacucagaagaagaaaucaugccaauggccuucaacauacaacgcgaaauaaugcucgaaaaccucgacggcacccccuaugacccggccgacgacauacccgccguccucggaucgcccgacuuccaagguguaaucuucggcauccuaucacaacgaaacaccgacggccaaacuagagcacacgaagcaaaagucgacacccgggccgcacgauuugccccaaaacugggcuucgucgucgccaccgucgaguccacggacuuccacgcgaaccaaccaucccgauucacccccguaggccucggaggcgauaacaaccaagacuucaaccaauggcgacuccccgccuacggaggagcacuaaccaacaacaccaaccucgccccacccguaaugccagucuaccccggcgaacaacuacucuucuuccgcucccaacuccccuccucuggcggcgucguaggcggcuggcucgauugccuucucccucaggaauggguccaacacuucuuccaagaaucagcuaccucccaauccgacgucgcccuaguaagauacaucaaccccaccaccggccgaguacucuucgaggccaaacuucacaagcaaggcuuccugaccgucgccgccucagggagcuacccccuaguugucccagcugacgguuacuuucgauucgaaucaugggucaaccaauucuauacccucgcucccaugggaaacggcuccggccgccgccgcgcccgcuaa

SEQ ID NO: 37712 - RNA, 1644 nt, Artificial Sequence
  derived and/or modified sequence opt11 from VP1__Norovirus_and/or_Norovirus-like__AY077644
augaaaauggcaucaaacgacgccuccccuuccgcagacggauccgccggccuagucccagagguaaacaacgaaacaauggcccucgaacccguagucggugcaccucucgccgcacccguagccggccaacacaacauaauagaccccuggauuaaaaugaacuucguacaagcccccaacggcgaguucaccgucucaccccgaaacgccccaggagaaauccuacuagaccucgaacucggcccagaccucaaccccuaccuuucccaccuggcccgcauguacaacggcuacgcaggaggcauggaaguacaaguaguccucgcuggcaacgcauucaccgccggcaaaaucauuuucgcugccguacccccuaacuuuccugccgaaaaccucuccgccgcgcaagucaccaugugcccucacgucauaguagacgucagacaacucgaaccaguuaugcucccuaugccugacauucgcaacaaacucuuccauuacaaccaagucgacgacccaaaacuccgacuucucgccuaccuguacacaccccuccgagccaauaaugccggagaugacgucuucaccguauccugccgaguacucacgcgcccaacccccgacuucgaguucauguuccuaguucccccaaccgucgaaagcaaaacgaaacccuucuccuugcccucacucacccucgaugaacucuccaacucccgauuuccagcccccauagugcaacuuuacacaaacccacaugacaacuuagucguacaaccacaaaacggacgcuguaccaucgacggacuccuccaaggcaccacccagcuagucuccugcaacguaugcuccuuccgcggcacucuaggcgacggacaacccgccucccacuccgaagaagaaauaaugccaauggcauucaacauccaaagagaaauaaugcuggaaaaccucgacggcucaccauacgaccccaccgacgacauacccgcuguacucggcucgcccgauuuccaaggcguaguauucggcauccucucccaacgaaacacagauggacaaacccgagcccacgaagcaaaagucgauacccgucuugcccgcuuugcccccaaacucggauucgucgucgcaaccgucgaaaacacagacuuccacgccaaccaacccugcagauucaccccagucggcuuaggaggcgacaacaaccgcgauuucaaccaauggggacuaccagcauacggcggcgcccucaccaacaacacaaaccucgccccucccgucaugcccgucuaccccggcgaacaacuccucuucuuccgaucacaacuccccuccuccggaggagucgucggaggcuggcucgacugccuacucccccaagaguggguacaacauuucuuccaggaaucagccaccucccaauccgacgucgcacucguacgcuacaucaaccccacaaccggacgaguacucuucgaagccaaacuucacaagcaaggauuccuuacagucgccgcgucagguucauacccccuaguuguccccgccgacggguacuucagauucgaauccugggucaaccaauucuauacauuagcacccaugggcaacggcuccggacgccgacgcguccgauaa

SEQ ID NO: 37713 - RNA, 1644 nt, Artificial Sequence
  derived and/or modified sequence opt11 from VP1__Norovirus_and/or_Norovirus-like__AY823306
augaaaauggccuccuccgacgccgcccccucuuccgacggauccgccggccucguccccgaagucaacagcgaaaccauggcacuugaacccgucgucggcgcaccacucgcagccccagucgccggccaacacaacauuauagacccauggauuaaacucaacuucguccaagcaccaaacggugaauucaccgucucaccacgaaacgcacccggcgaaauccuacuggaccucgaacuaggccccgaccugaaccccuaccucgcacaccucucacgcauguauaacgccuacgccggcggcauggaaguucaagucauauuagccggaaacgccuucacugccggcaaaaucaucuucgccgccguccccccaaacuucccccucgaaaaccuauccgcugcacaaaucaccaugugcccacacauaauagucgacguaagacaacuagaacccgucaugcuccccaugccagacguaagaaacagacucuuccacuauaaccaaguacgcgaaccccgccugcgacucguagccuaccuguauaccccccuacgggccaacaacgccggugacgacguuuucacagucucaugccgcguacucacacgccccagccaagacuucgaauucauguuccucgucccucccuccguagaaucaaaaaccaaacccuucucacuccccaaccuaacccuagccgaacuaucuaauucccgcuucccccuacccaucgaacaacucuacacuaacccacuagauaaccucgugguccagccccaaaacggccgcugcacaaucgacggcauacuccucggcaccacccaacuagucccaucccuaaucugcucaaugagaggcacccuagaagcagaccaagccucaggucacaccgacgacgaaucuguccaaucuagagcauucaaccgccaacgcagccuaaugcucgaaaacccagacggcucagccuucgaccccucagacgaaguccccgcaguacucggcguccccgacuuccgcggcguagucuucggaguucucagccaacgcaacaacggcgacaccacccgcucccacgaagccaaaauagacacccgccgcccccgauacgcccccaaacucggauucguugaaguauuaaccgaauccgacgacuuccaaaacggccccccuacuaaguucacuccugucggacucggcggugacggcaacccagauuuccagcaaugggcacuucccgacuacggcggagcccucacaaacaacacuaaccucgcccccccuguugucccaguuuaccccggggaacaaauccuauuuuuccgcucccaacucccguccagcggaggcacugucgccggcuggcuugacugccugcuaccccaagaauggauacaacauuucuaucaagacuccgcagcagcacaaucagacgucgcccuagucagauacauuaacccggccacgggccgaguacucuucgaagccaaacuccaccgccaaggcuuccuaaccguauccgccgccggaccccaccccgucgucgcaccagccgacggcuacuuccgcuucgaaucuugggucaaucaauucuacacccucgcacccaugggcaacggcuccggccgacgccgcgucuaa

SEQ ID NO: 37714 - RNA, 1638 nt, Artificial Sequence
  derived and/or modified sequence opt11 from VP1__Norovirus_and/or_Norovirus-like__KF586508
augaugauggccucuaaagacgccaccuccaacauggacggcacauccggcgccggacaacucgucccagaaaauaauaacacauccgaacccauaaacauggaacccguagcaggcgcagucaccgccgccgccaccgccggacaaguaaacaugauagacccauggaucaugaacaacuacguccaagcaccccaaggcgaguucacaaucuccccuaacaacacccccggagacauacucuucgaccuacaacucggaccccaccucaacccuuuccucgcccaccucucccaaauguacaacggaugggucggcaacaugaaaguccgcgucguccucgccggcaacgccuucagcgcuggcaaaauuauuguaugcugcauaccaccaggcuucuccgccccuaacauuucuaucgcucaagcuaccauguucccucacgucaucgccgacguacgcguacuagaaccuauagacaucccccucgacgacguccgcaacguccucuuccauaacaacgacaacggaaaccaaaccaugcgucuucuaugcaugcuuuacacaccccuccgcucaggagguaccucaucgggcaccgacccauucguaauagcuggacgcguucuaaccugcccaaccccagacuucaacuuccucuucuuaguaccacccaccgucgaacagaaaaccaaacaauucucagugcccaaucucccccucaauguaauguccaacucccgaguacccucacuauuaaacgccauggucgucucccccgaucaagcccaaguaguccaauuccaaaacggccgcugcacccucgacggccaaaugcucggcaccaccaccguaucagccuccugcgucgcccguuuccgaggcaaaaccuuccaagcccccgacaaccgccucggaauaaaccucgccgaaaucucuggcgaacccuaccacgccuucgaaucccccgcaccccucggauuccccgacuucggcgacggcgacuggcacgucacagccacaaaaguaacccccucacaacuagaagccaacgaccccgucgucaugggcaacguccagccauacaacccacaguucgcuccccaccuaggaacccucgucgucgaaaacccaacucccgacaacguaacaacaggcaccgaccuccuuuucaacaucacauggcuaucaaaccgagccaacaaccgcuucaacccaugggucaucccuaacuacggaucaacccucacugaagccgcccaacuagcccccucaaucuucccacccggauucggcgaaacuaucgucuacuucaacagcaccuuccccgccgucggcgcaaccacccacgcagccaucccaugccuccuuccucaagaguucguugcccacuucgucaacgaacaagcacccauacgaggagaagccgcccuccuccauuauaucgaucccgacacacacagaaaccucggcgaauuuaaaauauacccagaaggcuucgucaccuguguccccaacgugggcggcacaggcccccaaagccuacccacaaacggcaucuucguuuucguuucuuggguuucccgauacuaucaacucaaacccguaggcacagccgggcaagcacgccgccucuaa

SEQ ID NO: 37715 - RNA, 1638 nt, Artificial Sequence
  derived and/or modified sequence opt11 from VP1__Norovirus_and/or_Norovirus-like__HQ637267
augaugauggccuccaaagacgcaaccuccaacauggacggaaccucaggcgcaggacaacucguccccgaaaacaacaacaccucggaacccaucaacauggaacccgucgccggagccgucacagcagcggccacugcuggccaagucaacaugaucgacccauggaucaugaauaacuacguccaagcaccccaaggagaauuuaccaucucucccaacaacacacccggcgauauccucuucgaccuccaacucgguccccaccucaacccauuccuagcccaucucucacaaauguacaacggauggguuggcaacaugaaaguccgcgucguccuugccggcaacgccuucuccgcaggcaaaaucaucgucugcugcauacccccuggauucuccgcaccaaauaucuccaucgcccaggcaaccauguucccacacgucaucgcagauguccgcguccucgaaccaaucgacaucccacucgacgacguacgaaacguucucuuccauaccaacgacaacggcaaccagaccaugcgccuccucugcaugcuauauacuccccuccgcagcggagguaccuccagcggcaccgaucccuucguaaucgcaggccgaguccuaaccugccccacccccgauuucaauuuccucuuccuaguacccccaaccgucgaacaaaagaccaagcaauucuccgucccaaaccucccccucaacgucauguccaacucccgcguccccucacuccucaacgccauggucgucucucccgaccaagcccaaguuguccaauuccaaaacggaagauguacccuagacggccaaaugcuaggaacaacaaccgucuccgcaucaugcgucgcucgguucagaggcaaaacuuuccaagcccccgacaaccgccugggcaucaaccucgcagaaaucuccggagaacccuaccacgcguucgaaucucccgccccucucggauuccccgacuucggugacggagacuggcacguaacugccacaaaagucacuccaucucaacucgaagcaaacgacccuguaguaguaggcaacguccaacccuacaacccccaauucgcuccccaccucggcacccucgucgucgaaaacccaaccccagaccaaguugccaccggcaccgaccuccuauucaacauuaccuggcucuccaaccgagcaaacaaccguuucaacccaugggucauccccaacuacggcuccacccucaccgaagccgcccaacucgcccccuccauuuuuccucccggauucggagaaacaaucguauacuucaacuccacuuuccccgcagucggcgccacaacucacgccgcaauaccaugccuccucccacaagaauuuguagcccacuucgucaacgaacaagcaccaauccgcggcgaagccgcccuacuccacuacauagauccagauacacaccgcaaccucggagaguucaaaauauaccccgaagguuucgucacauguguucccaacguaggcggcacaggcccccaaucucucccaaccaacggagucuucguauucgucuccugggucucccgcuauuaccaacuaaaaccagucgggaccgcuggucaagcccgaagacucuag

SEQ ID NO: 37716 - RNA, 1629 nt, Artificial Sequence
  derived and/or modified sequence opt11 from VP1__Norovirus_and/or_Norovirus-like__AY134748
augaaaauggcauccaacgacgcagcccccagcaccgacggagcagccggccucguccccgaaucaaacaacgaagucauggcacucgaacccguagcaggagcagcucucgcugcacccgucaccggccaaaccaacaucauugaccccuggauccgcgcaaacuucguacaagccccuaacggcgaauuuacaguaucgccccgcaacgcccccggcgaagugcuccuaaaccucgaacucggccccgagcuaaaccccuaccucgcccaccuagcucgaauguacaauggcuacgccggcggaauggaaguccaagucaugcucgccggcaacgccuucaccgccggcaaacuggucuucgccgccguacccccucacuucccaguggaaaaucuaagcccccaacaaauaaccauguucccccacgucauaauugacguccgaacccuagagccaguacuccucccacuccccgacguccgaaacaacuucuuccauuacaaccaaaaggaugaccccaaaaugcgaaucgucgccaugcucuacacaccacuccgcucaaacggaucaggcgaugacguauucacagucucaugccgcguacucacucgacccagccccgacuucgacuucacauaccucgucccaccaaccguagaaucaaaaacaaaaccauuuacacuccccauacucacgcuaggcgaacucagcaacucccgauucccugucuccaucgaccaaauguacaccucacccaacgaaguaaucuccguccagugccaaaacggacgaugcacgcuagacggcgaacuacaagggacuacccaauuacaagucuccggaauuugcgcauucaaaggcgagguuaccgcccaccuucaagauaacgaccaucuauacaacaucaccaucacaaaccuaaacggcucacccuucgaccccucagaagacauaccagcgccgcuaggcguccccgacuuccaaggucgcguuuucggcgucaucacacaacgagauaaacaaaacgcugccggccaaucgcaacccgccaaucgcggccacgacgcaguagucccuaccuacaccgcccaauacacaccaaaacuuggacaaguacaaauuggcacauggcaaacagacgaccucaaagucaaccaacccgucaaauucacacccguaggccuaaaugacaccgaacacuucaaccaauggguagucccccgauacgccggcgcccucaaccucaacaccaaccucgcacccuccgucgccccaguauuccccggcgaacgccuacucuucuuccgauccuaccuaccccucaaaggaggauacgggaaccccgccaucgacugccuccucccccaagaauggguccaacacuucuaccaagaagcagcccccuccaugucagaagucgcacucguacgcuauaucaaccccgacaccggacgcgcccuauucgaagccaaacuacaccgggccggcuucaugacagucucauccaacacaagcgccccagucgucguaccagcaaacggcuacuuccgcuucgacagcuggguaaaccaauucuauucacuagcccccaugggcacaggaaacggccgacgcagaauacaauga

SEQ ID NO: 37717 - RNA, 1629 nt, Artificial Sequence
  derived and/or modified sequence opt11 from VP1__Norovirus_and/or_Norovirus-like__AY054300
augaaaauggccuccaacgacgccgcccccucaaccgacggcgcagcaggacuuguccccgaaagcaacuccgaagucauggcccucgagccuguugccggcgccgcgcucgccgcccccgucaccggccaaaccaacauaaucgaccccuggauccgcgcaaacuucguacaagcacccaacggcgaguucacaguuuccccucgcaacgccccaggcgaaguccuacuaaaccuagaacuaggacccgaacucaacccuuaccuagcacaccucgcacgcauguacaacggcuacgccggcggcauggaaguccaagucaugcucgccggaaacgcauucaccgcaggcaaauuaguauucgccgccgucccuccccacuuuccagucgaaaaccuuucaccccaacaaauaacaauguucccccacgucauaauagacguucgcacucucgaacccguccuccuaccccucccagauguacgcaacaacuucuuccacuacaaucaaaaagacgacccgaaaaugagaaucgucgcuaugcucuacacaccacuacgcucaaacggaucuggcgacgacgucuucacagucuccugcaggguccucacccgcccauccccagacuucgacuucaccuaccucgucccacccaccguagaaucaaaaaccaaaccauucacccuccccauccuaacccuuggcgaacuuagcaauucccgcuucccaguacccaucgaucaaauguucacuucacccaacgaagucauauccguacagugucaaaacggccgaugcacauuagacggcgaacuccaagggaccacccaacuccaagucucuggcauuugcgcauucaaaggcgaagucacagcccaccuacacgacaacgaccaccucuacaacgucaccauaaccaaccuaaauggcucacccuucgaccccuccgaggacauccccgcgccccuuggaguacccgauuuccaagggcgagucuucggcgucauaucacaaagagacaagcaaaacgccgccggacacuccgaacccgcaaaccgcggccacgacgcuguaguacccacauacaccgcccaguauacacccaaacugggccagauccaaauaggaaccuggcaaaccgacgaccuccaagucaaccaacccguaaaauucacacccgugggccuuaacgacacagagcacuucaaucaauggguagucccccgcuaugccggcgcccucaaccugaauaccaaccucgcucccuccgucgcacccgucuucccaggcgaaagacuccucuucuuccgcuccuaccucccccucaaaggcggcuacggcaaccccgcaauugacugccuucuaccacaagaauggguccaacacuucuaccaagaagcugcucccuccaugucagaagucgcccucguccgcuacaucaaccccgacaccggccgagcacuauuugaagccaaacuacaccgagcagguuucaugaccgucuccuccaacaccucagcccccgucgucgucccagccaacggcuacuuccgcuucgacuccuggguuaaucaguucuacucccucgcccccaugggcaccggaaacggccgacgacgcguacaauaa

SEQ ID NO: 37718 - RNA, 1629 nt, Artificial Sequence
  derived and/or modified sequence opt11 from VP1__Norovirus_and/or_Norovirus-like__KY485125
augaaaauggccucaaacgacgccgcacccagcaccgacggcgccgcaggccucgucccagaauccaacaacgaagucauggcccucgaacccgucgccggagcugcccuagccgcaccaguaaccggucaaaccaacaucauugaccccuggauccgcgccaacuucguccaagcaccuaacggcgaguucacugucucccccagaaacgcaccaggcgaaguccuccucaaccucgaacucggccccgaacucaaucccuaccucgcccaccuagcacgcauguacaacggcuacgccggcggcauggaaguccaagucaugcucgccggaaacgccuucaccgcaggaaaacucguauuugcagcagucccuccccacuuccccguagaaaaccucuccccacaacaaauuaccauguucccacacgugauaaucgacguacgcacccucgaaccaguacuccucccacuacccgacguacgcaacaacuucuuccauuacaaccaaaaagacgaccccaaaaugcgaauagucgccaugcucuacacuccccuacgcucaaacggaucaggcgacgacgucuucaccgucuccugccgcguuuuaacccgacccucacccgacuucgacuucaccuaccucgucccacccaccguagaaagcaaaaccaaacccuucacccuacccauccuaacacucggugaauuauccaacucucgcuuucccgucucaauagaccaaauguacaccucccccaacgaaaucaucucuguccaaugccaaaauggacgaugcacacuagacggcgaacuccaggggaccacacaacuucaggugucuggaaucugcgccuucaaaggagaagucacagcccaccuccaugacaacgaccaccucuacaacguaaccaucacuaaccucaaugggucacccuucgaccccucugaagacauccccgcgccccuuggagucccugacuuccagggccgcgucuucggaaucaucucccaacgugacaaacacaacucacccggacacaacgaacccgccaaucgcggccaugacgcagucgucccaaccuacaccgcccaauacaccccaaaacuaggccaaauccaaaucggcacauggcaaaccgaugaccucacugucaaccaaccagucaaguucaccccagucggccucaacgacaccgaacacuucaaucaaugggucguaccacgcuaugccggcgcccuaaaccucaacacuaaccuugcccccuccguagcccccguuuuccccggcgaacgccuacuauuuuuccgcuccuacauaccacuuaagggcggauacggcaaccccgcaaucgauugccuccuaccacaagaauggguccaacacuucuaucaagaagccgccccaucuaugucagaagucgcccucguccgauacaucaaccccgacacaggccgcgcacucuucgaagcaaaacuccaccgcgccggcuucaugaccguauccuccaauacauccgcccccguagucguaccugccaacgguuacuuccgguucgacuccugggucaaccaauucuacagccucgcccccaugggaaccggaaacggccgccgcagaguacaauga

SEQ ID NO: 37719 - RNA, 1629 nt, Artificial Sequence
  derived and/or modified sequence opt11 from VP1__Norovirus_and/or_Norovirus-like__KY485123
augaaaauggcgucaaacgacgccgcaccaaguacugacggagccgccgggcucguacccgaauccaauaacgaagucauggcacuugaaccaguggccggagcagcccucgcagccccagucacuggccaaaccaacauaauagaucccuggauccgcgccaauuucguacaagcccccaacggcgaguucacaguaagcccccgaaacgcccccggcgaaguucuccuaaaucucgaacucggccccgaacuuaaccccuaccucgcacaccuagcccgcauguacaacggccacgccggcgguauggaaguacaagucaugcucgcaggaaacgccuuuaccgcuggaaaacugguuuucgcggcagucccaccacacuuccccguagaaaaccuaucuccccaacaaaucaccauguucccccaugucaucauugacguccgcacacucgaacccguccuccucccccuacccgacguucgcaacaacuucuuccacuacaaccaaaaagacgaccccaaaaugcgcaucguagccaugcuauacacccccuuacgcuccaacggcagcggcgacgacguuuucaccguauccugcagaguacuuacucgacccuccccugacuucgacuucacauaccuagugccgccaaccguagaaucaaaaaccaaacccuucacccuccccauccucacccuaggcgaacucuccaacagccgcuuccccguauccaucgaucaaauguacacgucccccaacgaagucaucuccguacaaugccaaaacggacgcugcacccucgacggcgaacuacagggcaccacccaacuccaagucucaggcaucugcgcuuuuaaaggcgaagucaccgcacaccuccacgacaacgaccaccuauauaacguaaccaucaccaaucuaaacggauccccauucgacccuagcgaagacauccccgcuccccuaggcguccccgacuuccaaggccgcgucuucggcauuaucucccaacgcgacaaacacaacuccccaggccacaacgaaccugccaacagaggccacgacgccgucguccccaccuacacagcccaauauacacccaaauuaggucaaauacaaauaggaaccuggcaaacagacgaccucaccguaaaccagccuguaaaauuuacccccgucggccucaaugacaccgaacacuucaaccaauggguaguaccccgcuacgccggcgcacuuaaccuaaacaccaaccucgcccccagcguugcccccguauuccccggcgaacgccuccucuucuuccgcuccuauauaccccuaaaaggcggauacggaaacccagccaucgacugccuccuaccccaagaauggguacaacacuucuaucaagaagcagcacccuccauguccgaggucgcucucgucagauacauaaaccccgacaccggccgagcacuauucgaagccaaacuccacagagcaggcuucaugaccgucagcuccaacacauccgcacccgucguaguacccgccaacggcuacuuccgauucgacagcuggguaaaccaguuuuacucacuagcccccaugggcaccggaaacggccgaagacgcguccaauag

SEQ ID NO: 37720 - RNA, 1629 nt, Artificial Sequence
  derived and/or modified sequence opt11 from VP1__Norovirus_and/or_Norovirus-like__KY485126
augaaaauggccucaaacgacgccgcccccagcaccgacggcgcggccggccucguccccgaauccaacaacgaagucauggcucucgaacccgucgcaggcgccgcccuugccgcccccgucacgggccaaacaaacauaaucgacccauggauacgagccaacuucguacaagcacccaacggugaguucaccguuucaccacgcaacgcaccgggcgaaguccugcuuaaccuugaacucggcccugaacuaaaccccuaccuagcccaccuugcacgaauguacaacggcuacgccggagguauggaaguccaagucaugcuagccggcaacgccuucacagccgggaaacuuguauucgcagcuguaccaccccauuucccaguugaaaaccuaucaccccaacaaaucaccauguucccccacgucaucaucgacguccgcacccucgaaccagucuuacucccacuucccgacguacgcaacaacuucuuccacuacaaccaaaaagacgacccaaaaaugcgaaucgucgcaaugcucuacacaccacuccgauccaacggcuccggcgacgacgucuucacugucuccugccgcguccugacccgccccuccccagacuucgacuucaccuaccuaguaccacccacagucgaauccaaaaccaaacccuucacacuacccauccucacacucggcgaacucuccaauucccgauuccccgucuccaucgaccaaauguacacaucaccaaacgaaaucaucuccguccaaugccaaaacggaagaugcacccucgacggcgaacuccaaggcaccacacaacugcaagucuccggaaucugcgccuucaaaggagaagucaccgcccaccuccacgacaacgaccacuuauacaacgucaccauaaccaaccuuaacggaucaccguucgacccuuccgaagacauaccugccccucucggaguccccgacuuucaaggccgcgucuucggaaucaucucacaacgcgacaaacacaacucccccggccacaacgaacccgcaaaccgcggacacgacgccgucguccccacauacacagcacaauacacccccaaacucggccaaauccaaaucggaaccuggcaaaccgacgacuuaaccguaaaccaaccagucaaauucacccccgucggccucaaugacacggagcacuucaaccaaugggucguaccacgcuaugcgggcgcacuaaaccucaauaucaaccucgcaccaagcguagcgccagucuuccccggcgaacgacuccucuucuuccgauccuacaucccacucaaaggcggauacggcaaccccgccaucgauugccuccucccacaagaauggguccaacacuucuaccaagaagccgcuccaucaaugagugaaguugcacuuguccguuacaucaauccagacacaggcagagcccucuucgaagccaaacuccauagagccggcuuuaugacggugagcuccaauaccucugcacccgucgugguccccgcuaacggcuacuuccguuucgacuccuggguaaaccaauucuacucacuagcccccaugggaacaggcaacggccgccgacgaguacaauag

SEQ ID NO: 37721 - RNA, 1629 nt, Artificial Sequence
  derived and/or modified sequence opt11 from VP1__Norovirus_and/or_Norovirus-like__U70059
augaaaauggccucuaacgaugccgcacccuccacugauggagccgcuggccucguaccagaaagcaacaacgaagucauggcccucgaacccgucgcuggugcagcccucgccgcaccaguaaccggacaaaccaacaucauagaccccuggauacgggccaacuucgugcaggcccccaacggcgaguucaccgucuccccucguaacgcccccggagaaguccuccucaaccucgaacuggggcccgaacuuaaccccuaccuagcccaccucgcacgcauguacaacggcuacgcuggcggcauggaaguccagguuaugcucgccggaaacgccuuuaccgcaggaaaacucguauucgccgcaguacccccacacuucccagucgaaaaccuaucaccccaacaaaucaccauguucccccacgucaucaucgacguccgaacccucgaacccguccuccuaccccuaccagacgucagaaacaacuucuuccauuacaaucaaaaagacgaccccaaaaugagaaucgucgccauguuauacaccccacuacgcucaaacggcucaggcgacgacguauucaccgucuccugccgcgugcucacccgccccagccccgacuucgacuucaccuaccuaguacccccaacagucgaauccaaaacaaagccauucacccuacccauccucacccuaggcgagcuaucaaacagccguuuccccgucuccauagaccaaauguacaccuccccaaacgaagucaucuccguccaaugccaaaacggccgcugcacccuagacggagagcuacaaggaaccacccaacuacaagucuccggcaucugcgccucaaaaggcgaagucacggcucaccuccaagacaacgaucaccucuauaacaucacaaucaccaacuuaaacggcagccccuucgaucccuccgaagacauccccgccccucuaggcgucccagacuuccaaggccgagucuucggagucaucacccaacgagacaaacaaaacgccgcaggucaaucacagcccgcaaaccgaggccacgacgcagucguacccaccuacacagcacaauacaccccaaaauuaggacaaguacaaauaggaaccuggcaaacagacgaccucaaagucaaccaacccgucaaauucaccccugucggacuaaacgacaccgaacacuucaaccaaugggucguaccaagauacgccggcgcacucaaccucaacacuaaccuagcccccuccguagcccccgucuuccccggagaacgccuucuauucuuucgaagcuaccucccacuaaaagguggcuacggaaacccugccauagacugucuccuaccacaagaauggguccaacacuucuaccaagaggccgccccauccaugucagaagucgcccuaguacgcuacaucaaccccgacaccgggcgcgcccucuucgaagcaaaacugcacagagccggcuucaugaccgucagcuccaacaccuccgcacccgucgucguacccgccaacggcuacuuccgauucgacucuugggucaaccaauucuacucccuagcccccaugggcacaggaaacggccgccgacgcguccaauaa

SEQ ID NO: 37722 - RNA, 1629 nt, Artificial Sequence
  derived and/or modified sequence opt11 from VP1__Norovirus_and/or_Norovirus-like__LC145808
augaaaauggcaucaaacgaugccgcacccuccacagauggagcggccggccucgucccagaauccaacaacgaaguaauggcacucgaaccaguagcaggcgcagcccuagccgccccagucacuggacaaacuaacaucaucgacccauggauccgcgccaacuucguccaagcacccaacggagaauuuaccguauccccacgaaacucccccggagagguacuccucaaccucgaacucggccccgagcucaaccccuaccuugcccaccucgcucgcauguacaacggcuacgccggugguauggaaguacaagucaugcucgcuggcaacgcauucaccgccggcaaauuggucuucgcagccgucccaccccacuuccccguagaaaaccuaucaccccaacaaaucaccauguuuccccacgucaucaucgacguccggacccucgaacccguccuccucccccuacccgacguccgcaacaacuucuuccauuacaaccaaaaagacgaccccaaaaugcgcaucgucgccaugcuauacacaccccucagauccaacggcaguggagacgacgucuucacagucucaugccgcgucuuaacccgcccgucccccgacuucgacuucacauaccuaguuccuccuacgguagaauccaaaacaaaaccauucacacuacccauccugacacugggcgaacuaagcaacuccagauucccagugagcauagaccaaauguacaccucccccaacgaagucaucucaguccaaugccaaaacggacgcugcaccuuagacggagaacuccaaggaaccacccaacuccagguaucggggauuugcgccuucaaaggcgaagucaccgcacaccuccacgauaacgaccaccuauacaacgucaccaucaccaaccucaacggcucaccuuucgaccccucagaagacauccccgccccacucggaguaccagacuuccagggacguguauucggcgucaucagccaacgagacaaacacaacgcccccggccacaacgaacccgcaaaccgcgcccacgacgcaguaguacccaccuacacagcccaauauacccccaaacucggccaaauccaaaucggcacauggcaaacagacgaccucaccgucaaccaaccaguaaaauucacucccgucggccuaaacgacacggaccacuucaaccaaugggucguuccccgcuacgcuggcgcacucaaccucaacaccaaccuagcccccuccgucgcccccguauucccaggcgaacggcuacucuucuuccgcucauacauaccccucaaaggcggcuaugguacccccgcaauagacugccuacucccccaagaauggguccaacacuucuaccaagaagccgcaccauccauguccgaaguagccuuaguccgcuacaucaaccccgacaccggccgcgcccucuuugaagccaaacuccaccgcgcaggcuucaugacaguaucauccaacacauccgcaccagucguggucccagcaaacggauacuuccguuucgacuccugggucaaccaauucuacucccuagcuccaaugggcaccggcaacggaagacgacgcauccaauaa

SEQ ID NO: 37723 - RNA, 1629 nt, Artificial Sequence
  derived and/or modified sequence opt11 from VP1__Norovirus_and/or_Norovirus-like__LC145795
augaaaauggcauccaacgacgcagcucccucaacagacggugcagcuggacucgucccugaaucuaacaacgaagucauggcacucgaaccgguagccggcgcagcgcucgccgcccccguaaccggacaaacaaacaucauagaccccuggauccgugcaaacuucguacaagccccaaacggugaauuuacagucucaccccgcaacucgcccggcgagguccucuuaaaccucgaacuaggaccagagcucaacccuuaccucgcucaccucgcacgaauguacaacggauacgccggaggcauggaaguucagguaaugcucgccgguaaugccuucacagcaggcaaacucgucuucgccgcagucccaccccacuuccccgucgaaaaccuaucaccccaacaaaucaccauguucccccacguaaucaucgacguaaggacccucgaaccaguccuucucccccuuccagauguccgaaacaacuucuuccacuacaaccaaaaagaugauccaaaaaugcgaauugucgcaaugcuauacaccccacuccgauccaacggcuccggcgacgacgucuucaccguauccugccgcguccucacacgccccuccccagacuucgacuucacauaucucgugcccccaacagucgaaagcaaaaccaagcccuucacccuaccaauccucacccucggcgaacucagcaacucccguuucccagucagcaucgaccaaauguacaccucccccaacgaggucaucuccguacagugccaaaacggccgcugcacacuugacggcgaacuccaaggaaccacucaacuccaagucucuggcaucugcgccuucaaaggagaaguaacagcacaccuccacgauaaugaccaccuguacaacgucacaaucacaaaccuuaacggcucccccuucgaccccucagaagacauccccgccccucucggcguacccgacuuccagggacgcguauucggcguaaucucccagagagacaaacacaacaccccaggccacaacgaaccagcuaacagagcccacgacgccguuguaccuacauacacagcacaauacaccccuaaacucggccaaauucaaauuggcacuuggcaaaccgaugaccuaaccaucaaccaacccgucaaguucacacccgucggcuuaaacgauacagaccacuucaaccaaugggucgucccccgcuacgccggagcacugaaccucaacaccaaccucgcccccuccguagcccccguuuuccccggagaaagacuacuauucuuccgauccuacaucccccucaaaggcggcuauggcacccccgccaucgacugccuccucccacaagaauggguccaacacuucuaccaagaagcagcacccucgaugucagaggucgcccucguccgcuacauuaaccccgacacaggccgcgcccucuucgaagccaaacuccaccgcgccggauucaugaccgucucuuccaauacauccgcccccgucgucguacccgccaacggcuacuuccgauucgacucauggguaaaccaauuuuacucucuggcccccaugggaaccggcaacggccggcgccgcauccaauaa

SEQ ID NO: 37724 - RNA, 1629 nt, Artificial Sequence
  derived and/or modified sequence opt11 from VP1__Norovirus_and/or_Norovirus-like__AB629941
augaaaauggccagcaaugacgcagcaccauccaccgacggcgcagccggccucgucccagaauccaacaacgaagucauggcccucgaaccaguugccggagccgcccucgccgccccuguaaccggacaaaccaacauaaucgaccccuggauccgagccaacuucguccaagcacccaacggagaguucaccgucagccccagaaaugcgcccggcgaaguacuccucaaccucgaacuaggcccagaacuaaaccccuaccucgcacaccucgcaagacucuauaacggcuaugcaggcggaauggaaguacaaguaaugcucgccggcaaugccuucacggccggcaaacuugucuuucccgccgucccaccucacuuccccaucgaaaaccucucaccacagcagaucacaauguucccccacgucauaaucgacguccgcacccuugaacccguccuacucccccucccagacgucagaaacaacuucuuccacuacaaccaaaaggacgaccccaagaugcgcauagucgcaaugcuauacacaccccuacgcucuaauggcuccggcgacgacguauucaccgucagcugucgcguacuuacccguccaucucccgacuucgacuucaccuaccucgucccuccuaccgucgaaucaaaaacaaaaccauucacacucccaauccuaacccucggcgaacuuuccaacucaagauuccccgucagcaucgaccagauguacacuucaccuaacgaaguaauauccguccaaugccaaaacggacgaugcacccuugacggagaacuccaaggcacaacccagcuccaagucucuggcauaugcgccuucaaaggugaagucaccgcccaccuccacgacaacgaccaccuuuacaauauuacaaucacuaaccucaauggaucccccuucgaccccuccgaagacauacccgcaccacucggcguuccugacuuucaaggccgagucuucggcauaaucucacaacgagacaaacacaacucucccggccacaacgaacccgccaaccgcggccacgacgcaguaguaccaaccuauacagcucaauacaccccaaaacuaggccaaauucaaaucggaacauggcaaaccgacgaccucaccgucucccagcccgucaaauucacccccgucggccuaaacgacauagaacauuucaaccaaugggucguaccacgcuacgccggcgcccucaaccucaacacgaaccuagcaccaucuguugcacccguauucccuggugaacgccuccuauucuuccgauccuacaucccacucaaaggaggcuacggcaacccugccauagauugccuacucccccaagaauggguccaacacuucuaucaagaagcagcccccuccaugucagaagucgcacucguacgcuacauuaaccccgacaccggacgcgcacuauucgaagccaaacuccaccgagccggcuucaugaccguaucaagcaacaccucagccccuguugucguacccgcaaacgguuacuuccgauucgacuccugggugaaccaauucuacucacucgcccccaugggcacaggcaacggcagacgccgcguccaauaa

SEQ ID NO: 37725 - RNA, 1629 nt, Artificial Sequence
  derived and/or modified sequence opt11 from VP1__Norovirus_and/or_Norovirus-like__LC145792
augaaaauggcaucaaacgacgccgccccaucuaccgauggcgccgcaggccucguacccgaaucaaacaacgaagucauggcgcucgaaccgguagccggcgcagcacucgccgcccccgucacuggacaaaccaacauaauagacccauggauccgagccaacuuuguccaagccccaaacggcgaguucaccgucucaccccgcaacuccccgggcgaaguccuccuaaaccucgaacucggcccagaacucaaucccuaucuagcccaucuugcacgcauguacaacgguuacgccggaggcauggaaguacaaguaaugcucgccggcaacgccuucaccgccggaaaacucgucuuugccgccgucccaccccacuuccccguugaaaaccucucaccccaacagaucaccauguucccucacgucauaauagacguccgaacacucgaacccguccuguuaccccuucccgacguacgaaacaacuucuuccauuacaaccaaaaggacgauccaaaaaugcgaauagucgccauguuauacacaccccuccgcuccaacggcuccggcgacgacgucuucaccguauccugccgcguccucacaagacccuccccugacuucgacuucaccuaccuugucccacccaccgucgaauccaaaaccaaacccuuuacacucccaaucuuaacccucggcgaacuuuccaacucccgauucccagucuccauagaccaaauguacacaucaccgaacgaaguaaucucaguccaaugccaaaacggccgcugcacacucgacggcgaacuccaaggcacaacccaacuccaagucucaggcaucugugccuucaaaggcgaaguaacugcacaccuccacgacaaugaccaccucuacaacguaacaaucacaaaucucaacggaucgcccuucgaccccuccgaagacauaccagcgccccucggcgucccagacuuccaaggccgcgucuucggagucauuucccaacgagacaaacacaacacccccggacacaacgaacccgccaaccgggcccaugacgcagucguccccaccuacaccgcacaauacacccccaaacucggccaaauacaaaucggaaccuggcaaacagacgaccuaacuguuaaccaaccaguuaaauucacaccagucggacucaacgacaccgaccacuucaaccaauggguacucccccgcuacgcaggagcccucaaccucaacacuaaccuagccccguccgucgcacccgucuuccccggcgaaagacuccucuucuuccgcuccuacaucccccugaagggaggcuauggaacccccgccaucgacugccugcuaccccaagaauggguccaacacuucuaccaagaagccgcacccuccaugucagaagucgcccucguccgcuacaucaacccagacacuggacgcgcucuauucgaagccaaacugcaccgcgccggcuucaugacagucucguccaauacaagugcccccguuguuguccccgccaacggcuacuucagauucgacucuugggucaaccaauuuuacuccuuagcaccaaugggcaccggcaacggccgccgccgaauccaauaa

SEQ ID NO: 37726 - RNA, 1629 nt, Artificial Sequence
  derived and/or modified sequence opt11 from VP1__Norovirus_and/or_Norovirus-like__LC145786
augaaaauggccuccaacgacgccgcccccucuaccgacggcgccgcgggccuaguccccgaauccaacaacgaagucauggcacuugaacccgucgcaggcgccgcccucgcggcccccgucaccggacaaaccaacaucauagauccauggauccgcgcgaacuucguccaggccccaaacggagaguucaccgucuccccacgcaacucccccggcgaagucuuacugaaccucgaacucggccccgaacucaaccccuaucucgcccaucucgcacgcauguacaacggcuacgcaggcggcauggaaguccaaguaaugcucgcuggcaacgccuucaccgccggcaaacucgucuucgccgcagucccuccccacuuucccgucgaaaaccuaucuccccaacaaauaacaauguuuccacaugucaucaucgacguucguacacuagaaccaguccuacucccucucccagacguucgcaacaacuucuuccacuacucccaaaaagacgacccuaaaaugcgaaucgucgcaaugcucuacacaccacuccgaucaaacggcucaggcgacgacguauucaccgucuccugucguguacucacccgccccucccccgacuucgacuuuaccuaccuagucccuccaacaguggagucaaaaaccaaaccguucacccucccaaucuuaacccuaggcgaacucagcaacucccgauuccccguauccauugaccaaauguacaccagcccaaacgaagucaucuccguccaaugccaaaacggccgcugcacucucgauggcgaacuccaaggcacaacccaacuucaaguauccggcaucugcgcguucaaaggagaagucacagcccaccuccacgacaacgaccaccucuacaacgucacaaucacaaaccucaauggcucuccguucgacccauccgaagacauccccgccccucuaggcguccccgacuuccaaggcagagucuuuggcguaaucagccaacgcgacaaacacaauacacccggacacaacgaaccagccaaccgagcccacgacgccguaguacccaccuacaccgcccaauacacacccaagcucggccaaauacaaaucggcaccuggcaaacagacgaccucacagucaaccaacccguaaaguucacccccgucggacucaaugacaccgaccauuucaaccaaugggucgucccccgcuaugccggagcucuaaacuuaaacacaaaccucgcacccuccgucgcacccguauuccccggagagcgccuccucuucuuucgcuccuacaucccccucaaaggagguuacggcaccccugcaaucgacugccuccucccccaagaauggguacaacacuucuaccaagaagcagcccccuccaugagcgaagucgcccucguccgcuacauaaaccccgacaccggcagagcccuuuucgaagccaaacuccaucgagccggcuucaugacggucuccuccaacaccagcgcccccgucgucguacccgccaacggcuacuuccgauucgacucauggguuaaccaauucuacucacucgcgccaaugggcaccgguaauggccgucgccgcauucaauaa

SEQ ID NO: 37727 - RNA, 1629 nt, Artificial Sequence
  derived and/or modified sequence opt11 from VP1__Norovirus_and/or_Norovirus-like__LC145793
augaaaauggcuuccaacgacgccgcccccuccaccgacggagcugcaggccucguccccgaauccaacaaugaagucauggcacuagagccaguagccggcgucgcccuagcagcccccgucaccggacaaaccaacaucauagaccccuggauccgcgcaaacuucgugcaagcuccaaacggcgaguucaccguauccccacgcaacucccccggcgaaguacuccucaaccucgaacugggccccgaacucaaccccuaccuagcccaccucgcccgaauguacaacggauacgccggaggcauggaaguacaagucaugcuagccggcaaugccuucacugccggcaaacucguauuugcagccguuccuccccacuuuccugucgaaaaucuaucaccccaacaaauaacaauguucccacacguaaucaucgacguacgcacccuagaaccaguccuacucccccuccccgacgugcgaaacaacuucuuccacuacaaccaaaaagaugaccccaaaaugcgcauagucgcaauguuauacacaccccuccgaucuaacggcuccggcgacgaugucuucaccgucucaugccgcguccucacccgccccucacccgacuucgacuucaccuaccuagucccacccaccgucgaauccaaaaccaaacccuucacacucccaauccuuacccucggcgaacucuccaacucccgcuuucccgucuccaucgaccagauguauaccucccccaacgaagucaucuccguccaaugccaaaacggccgcugcacacuggacggagaauuacaaggcacaacucaacuccaagucucaggcauaugcgcauucgaaggagaagucaccgcccaccuacaugacaacgaccaccucuacaacgucaccaucacaaaccuaaacggaucacccuucgacccauccgaagacauccccgcaccccuuggcgugcccgauuuccaaggacgcguauucggcguaaucucccaacgugacaaacacaacacacccggccacaaugaaccagccaaccgugcccaugacgcagucguccccaccuacaccgcccaauacacccccaaacuaggccaaauccaaaucggaacauggcaaaccgacgauuuaaccguaaaccaacccguaaaauucacacccguaggccucaacgacaccgaccacuuuaaccaaugggucguaccccguuacgcaggggcccuuaaccucaauaccaaccucgcaccaucugucgccccaguauuccccggcgaacgccuccucuuuuuccgcuccuacaucccccucaaaggcggauacgguacucccgccaucgacugccuccucccacaagaguggguccaacacuucuaccaagaagcugcccccucaaugucagagguggcauugguccgauacauaaaccccgacaccggucgcgcucucuucgaagccaaacuccaucgagcaggauucaugaccgucucuuccaacaccuccgccccaguugucgucccagccaacggcuacuuucgcuuugauagcuggguaaaccaauucuacucucucgccccaauggguacaggcaacggacgccgccgcauacaauaa

SEQ ID NO: 37728 - RNA, 1629 nt, Artificial Sequence
  derived and/or modified sequence opt11 from VP1__Norovirus_and/or_Norovirus-like__LC145791
augaaaauggccucuaaugacgucgcccccuccaccgauggcgcagccggccuagucccugaaagcaacaacgaagucauggcccuggaacccgucgcuggcgcagcccucgccgccccagucacaggccaaaccaacaucaucgaccccuggauccgcgcaaacuucguacaggcacccaacggagaguucacugucucaccccgcaauuccccuggggaaguccuccuuaaccucgaacucggacccgaacucaacccauaccuggcucaccuugcccgcauguacaacggcuaugccggcggaauggaaguccaagucaugcucgccggcaacgccuucaccgccggcaaacucguauucgcagccguacccccucacuucccagucgagaaccucagcccacaacaaaucaccauguucccccacguaauaauagauguacgcacccucgaacccguacuccucccccucccagacguccgaaacaauuucuuccacuacaaccaaaaagacgaccccaaaaugcgcauaguagccaugcucuacacuccccuccgcuccaacggcucaggcgacgacgucuucaccgucuccugccgcguacuaacccgaccauccccagacuucgacuucaccuaccuggucccucccaccgucgagucaaaaaccaaacccuucacucuccccauccucacccuaggagaacucuccaacagccgauuccccguuuccaucgaccaaauguacaccucacccaacgaggucaucuccguacaaugccaaaauggccgauguacucucgacggcgaacuacaaggaacuacacaacuccagguaucaggcaucugcgcuuucaaaggcgaagucaccgcgcaccuccacgacaacgaucaccucuacaacgucaccauaacuaaccucaacggcagccccuuugacccauccgaagacauaccagcgccccuaggcguccccgacuuccagggucgaguauucggcguaaucucacaacgagacaaacacaacaccccaggccacaacgaaccagcaaaccgcgcacacgacgccgucguccccaccuacaccgcccaauacacccccaaacuaggucaaauccaaaucggcacauggcaaacagaugaccucaccgucaaccaacccgucaaauucacucccgucggccucaacgacacugaccacuucaaucaaugggucgucccccguuacgcaggagcucuuaaccucaacacuaaucucgccccaagcgucgcccccguauucccaggcgaacgacuauuauucuuccguuccuacauuccccucaaagguggcuacggcaccccagccaucgacugccuacucccacaagaauggguccaacacuucuaccaagaagccgcacccuccauguccgaagucgcacucguacgauacaucaaccccgauacaggucgugcccucuucgaagcaaaacugcacagagccggauuuaugaccgucucuuccaacaccucagcccccgucgucguuccagccaacggcuauuuccgcuucgacucauggguaaaccaauucuacucacucgcccccaugggcaccggcaacggccgccgaagaauccaauaa

SEQ ID NO: 37729 - RNA, 1629 nt, Artificial Sequence
  derived and/or modified sequence opt11 from VP1__Norovirus_and/or_Norovirus-like__LC145788
augaaaauggccuccaacgacgcagccccaagcaccgacggagcagcaggccucguacccgaauccaacaaugaagucauggcacucgaaccaguagccggcgccgcccucgccgcccccgucaccggacaaaccaacauuauagacccauggauccgcgccaacuucguucaagcccccaacggcgaguucaccgucuccccaagaaacuccccuggcgaaguccuacucaaccucgaacuagggcccgaauuaaacccauaccuugcccaccuagcacgcauguacaacgguuacgccggcggcauggaaguccaggucauguuagcaggcaacgccuucacagccggcaaacucguuuucgcugccgucccaccucacuuccccgucgaaaaccuuagcccacaacaaauaaccauguucccacacgucaucaucgacguccgcacccucgaacccguccucuuaccccuccccgacguccgaaacaacuuuuuccacuacaaccaaaaagacgacccaaaaaugagaauaguugccaugcuauacaccccacuucguuccaaugguucaggcgacgacguauucaccguaucaugccgcguccucacccgcccauccccagacuucgacuucaccuaccucguaccacccaccgucgagucuaaaaccaaacccuucacacuccccauccucacccucggcgaacucuccaacagccgauucccagucucaaucgaccaaauguacaccucccccaacgaaguuauaucaguacaaugccaaaacggacguugcacacuugacggcgagcuacaaggcaccacccaacuucaaguauccggcaucugcgcauuuaaaggagaaguaacagcccaccuccaugacaacgaccaccucuacaacgugaccaucaccaaccucaacggcucacccuucgacccauccgaagacauccccgcaccucugggaguccccgacuuccaaggccgagucuucggcgucaucucccaacgcgacaaacacaacacacccggacacaacgaacccgccaaucgcgcccacgacgcagucguccccaccuacacagcacaauacacccccaaacuaggccaaauccaaauaggaaccuggcaaaccgacgaccucgccgucaaccaaccagucaaauucacacccgucggccuuaacgauaccgaccacuucaaccaauggguggucccaagauacgcaggcgcguuaaaccuuaacaccaaccucgcacccuccguagccccaguauuccccggagaacgccuccucuucuucagaucauacaucccacuaaaaggaggauacggcacacccgcaauagacugccuccucccccaggaauggguccaacauuucuaccaagaagccgccccauccaugucagaagucgcccucguccgauacaucaaucccgacaccggccgcgcccuauucgaagcgaaacuacaccgagccggcuuuaugaccgucuccucaaacaccucagcaccagucgucgucccagccaacggcuacuuccguuucgacuccugggucaaccaauucuacucccuagccccaaugggcacaggaaacggacgucgccgcauccaauga

SEQ ID NO: 37730 - RNA, 1629 nt, Artificial Sequence
  derived and/or modified sequence opt11 from VP1__Norovirus_and/or_Norovirus-like__LC145803
augaaaauggcuuccaacgacgcagcccccuccaccgacggcgccgcaggccucgucccagaauccaacaacgaagucauggcccucgaaccaguagccggcgccgcccucgccgcccccgucacuggccaaaccaacauaaucgaccccuggauacgcgccaacuucguccaagccccuaacggcgaguucacggucucaccccgaaacuccccgggcgaaguccuccuaaaccuagaacucggacccgaacucaaucccuacuuagcccaccuagcacgcauguauaacggcuacgcaggcggcauggaaguccaagucaugcuagccggcaacgccuucacagccggcaaacuugucuuugccgcaguaccaccccacuuccccgucgaaaaccucucaccccagcaaauaaccauguucccccacgucaucaucgacguccgcacccucgaacccguacuccucccccuacccgauguccgaaacaacuuuuuccacuauaaccaaaaagacgaccccaaaaugcguauaguggccaugcuguacacaccccuacgaucaaauggaucaggcgacgacgucuucaccguaagcugccggguacucacccgccccagccccgacuucgacuucaccuaccuaguaccaccaacgguagaaaguaaaaccaagccauucacccuccccauccuuacacucggcgaacucuccaacucgcgauuccccgucagcauagaccaaauguacaccagcccaaacgaaguaauaagcgugcaaugccaaaacggccgcugcacccuagacggcgaacuccaaggcaccacccaacuucaagucuccggcauuugcgccuucaaaggagaaguaacugcccaccuccacgacaacgaccaccucuacaacguaacaaucaccaaccucaauggcuccucauucgacccauccgaagacauccccgcaccccucggcaucccagacuuccaaggucgcgucuucggaguaauaucccaaagagacaagcacaacacaccaggacacaacgaacccgccaaccgagcccacgacgccgugguacccacauacacagcacaauacacccccaaauuaggccaaauacaaaucggcaccuggcaaacugacgaccucaccguaaaccaaccaguaaaauuuaccccaguaggacuaaacgacaccgaccacuucaaccaauggguagucccacgcuacgccggcgcccucaaccucaacaccaaccuagcacccucagucgcccccgucuuccccggagaacggcuccucuucuuccgaucuuacaucccacucaaaggcgguuacggcaccccagcaauugacugccuacucccccaggaauggguccaacacuucuaccaagaagcagcacccucaaugucagaaguagcccucguacgcuacauuaaccccgacaccggucgcgcacuauucgaagcaaaacuccaccgagcaggcuucaugacaguauccuccaacacguccgcccccguaguuguaccagcaaacggauacuucagauucgacucaugggucaaccaauuuuacucccucgccccaaugggaacgggcaacggccgacgacgcauccaguga

SEQ ID NO: 37731 - RNA, 1629 nt, Artificial Sequence
  derived and/or modified sequence opt11 from VP1__Norovirus_and/or_Norovirus-like__LC145804
augaaaauggccucaaacgacgccgcccccuccaccgacggcgcagccggacucguccccgaaucaaacucagaagucauggcacuagaacccgucgcaggagccgcccucgccgcuccugugaccggccagaccaacauuaucgaccccuggauucgcgccaacuucguccaagccccaaacggagaguucaccgucucuccccgaaauagccccggcgaaguccuccucaaucucgaacuaggacccgaacuaaaucccuaccucgcccaccucgcccgaauguacaacggauacgcgggaggaauggaaguccaagucaugcucgcgggcaacgccuuuaccgccggaaagcuagucuuugccgcaguuccaccacauuucccagucgaaaaccuaucuccccaacaaauuacuauguucccccacgucaucaucgacguacgaacccucgaacccguccuccucccccugcccgacguccgcaacaauuucuuucacuacaaccaaaaagacgaccccaaaaugcgcaucgucgcgaugcucuacaccccacuacgguccaacggauccggcgacgaugucuucaccguauccugccgaguucuaacacgccccucacccgacuuugacuucacauaccucguaccacccaccguggagucaaaaacuaaacccuucacccucccaauccucacucucggcgaacucuccaacucccgcuuccccgucucaauugaccaaauguacacaucucccaacgaagucaucuccguacaaugccaaaacggacgaugcacucuagacggugaacuccaaggcaccacucaacuccaagucucaggcauaugcgccuucaaaggcgaggucaccgcccaccuccaugauaacgaccaccuuuacaacgucacaauaaccaaccucaacggcucccccuucgaccccucugaagacauccccgcaccacuaggcguccccgacuuccaaggaagagucuucggcguaaucucacaaagagacaaacacaacacccccggccacaacgagccagcaaacagagcccacgacgccguaguacccaccuauacagcccaauacacacccaaacuuggccaaauccaaaucggcaccuggcagaccgacgauuuagccgucaaccaacccgucaaauucacacccgucggucuaaacgacaccgaccacuucaaccaaugggucgucccccgcuacgcaggcgcccuaaaucuaaacaccaaccuagcacccuccguagcacccgucuuccccggagaacgacuccuauucuuucgcuccuacaucccccucaaaggcggcuacggcacuccagccaucgacugccuacuaccacaagaauggguccaacacuucuaccaagaagcggcacccucaauguccgaagucgcccuaguccgauacaucaaccccgacaccggccgagcccucuucgaagccaaacuccaccgcgcaggauucaugaccgucuccuccaacacuucagcccccguagugguuccggcaaacggcuacuucagauucgacuccuggguaaaccaauucuacucccucgcaccaaugggcacaggaaacggccggcggcgcauucaauaa

SEQ ID NO: 37732 - RNA, 1629 nt, Artificial Sequence
  derived and/or modified sequence opt11 from VP1__Norovirus_and/or_Norovirus-like__LC145801
augaaaauggcaucaaacgacgccgcucccuccaccgacggagcagccggccuaguccccgaaucuaccaaugaagucauggcccuagagccaguagccggcgccgcccuagccgcacccgucaccggacaaaccaacaucaucgaucccuggaucagagccaacuucguacaagcacccaauggcgaguucaccgucucaccccgcaacucacccggcgaaguacuacucaaccucgaacucggccccgaacuuaaccccuaccucgcccaccucgcgcgcauguacaacggcuacgccggcggaauggaaguccaaguaaugcuagccggcaacgcuuucaccgcuggaaaacucgucuucgccgccgucccuccccacuuccccgucgaaaaccuaucaccccaacaaauaaccauguuuccacacgucaucauagacguccgcacccuggagccaguccuccucccacucccugacguacgcaacaacuucuuccacuacaaccaaaaagaugaccccaaaaugagaaucgucgcaaugcucuacaccccacuccgcuccaacggguccggcgacgacgucuucaccgucaguugccguguccuuacccgccccucucccgacuucgauuucaccuaccucgucccgcccacgguugaauccaaaaccaaacccuucacucuccccaucuuaacacucggcgaacucucaaacucccgcuuccccguauccauagaccaaauguacacaucacccaacgaaguaauaucaguacaaugccaaaacggucgcuguacccuagacggcgaacuccaaggcaccacacaacuacaagucuccggaaucugcgcauucaaaggagaagucacagcccaccuccacgacaacgaccaucucuacaacguaaccauaacaaaccucaacggcucacccuucgacccauccgaagacauaccugcaccucucggggcccccgacuuccaaggccgagucuucggaguaaucagccaacgugacaaacacaauacccccggccacaacgaaccagcaaaccgagcccacgacgcuguagucccaaccuacaccgcacaauauacucccaaacucggccaaauucaaaucggcaccuggcaaaccgacgaucucacagucaaucaaccuguuaaauucaccccagucggacucaaugacaccgaccacuucaaccaaugggucgucccccgguacgccggugcccuaaaccuaaacaccaaccuugccccaucagucgcaccugucuucccaggugaacgacuccuuuucuuccgaagcuauaucccacucaaaggcggcuacggaacccccgcuaucgacugccuccugccacaagaauggguacaacauuucuaccaggaagccgcccccuccauguccgaagucgcccuuguccgcuacaucaauccugacaccggccgagcacucuucgaagccaaacuccacagagcaggauuuaugaccgucucauccaauaccucugcaccuguagucguccccgccaacggcuacuuucguuucgacucaugggucaaccaauucuacucccuagccccgaugggcaccggcaacggccgccgucggauacaauaa

SEQ ID NO: 37733 - RNA, 1629 nt, Artificial Sequence
  derived and/or modified sequence opt11 from VP1__Norovirus_and/or_Norovirus-like__LC145802
augaaaauggccucaaacgacgcagcucccucaacagacggcgcagccggccugguccccgaauccaacaaugaagucauggcccucgaaccgguugcaggcgccgcccuggcagcccccgucaccggccaaacuaacaucaucgauccauggauccgcgccaacuucgugcaagcacccaacggcgaguucaccguauccccacguaacuccccaggcgaaguacuccucaaccucgaacucggacccgaacucaacccauaccuugcacaccuugcccgcauguacaacggacacgccggcggaauggaaguacaagucaugcuugccggcaacgccuucaccgcugguaaacugguauuugcagcaguacccccacacuucccugucgaaaaccuuucaccccaacaaauaaccauguucccucacgucauaauagacguccgcacacucgaacccguccuccuuccccuuccagacgucagaaacaacuucuuccacuacaaccagaaggacgaccccaaaaugcgcaucgucgccaugcuguacacaccgcuacgcuccaacggcagcggcgacgacgucuucacagucucaugccgaguccuuacacgccccucaccagacuuugaguucacauaccuuguaccacccaccguagaauccaaaacaaaacccuucacacuucccauccucacccuaggagaacuaucaaacucccgcuucccugucucuaucgaccaaauguacaccuccccaaacgaaguaaucucuguucaaugccaaaacggacgaugcacacucgacggcgaacuacaagguaccacacaacuccaagcaucaggcauuugcgccuuuaaaggcgaaguaaccgcccaccuccacgacaacgaucaccucuacaacguaaccaucaccaaccucaacggauccccauucgaccccagcgaagacaucccagcaccccucggaguccccgacuuucaaggccgcgucuucggcguaaucucccagcgagacaaacacaacgcccccggccacaacgaacccgccaaccgcgcccacgacgccguaguccccaccuacaccgcacaauacaccccaaaacuaggacaaauucaaauaggaaccuggcaaacagacgaccuaaccguuaaccaacccgucaaauuuacuccugucggccucaacgauaccgaccacuucgaccaauggguagucccacgcuacgcuggcgcacucaaccuaaacaccaaccucgcacccagcgucgcaccaguauuccccggagaacgucuccuuuucuuccgaucauacaucccacucaaagguggauacggaacacccgccaucgacugccuacuaccccaagaauggguacagcacuucuaccaagaggcagcccccuccauguccgaagucgcacucguccgcuacauaaaccccgacacuggcagagcucuauucgaagccaaacuccaccgagccggauuuaugaccgucuccuccaacacaagcgcccccgucguagucccagccaacggcuacuuccgcuuugauuccugggucaaccaguucuacucacuagcacccaugggcaccggaaacggccgucggcgaauccaauaa

SEQ ID NO: 37734 - RNA, 1629 nt, Artificial Sequence
  derived and/or modified sequence opt11 from VP1__Norovirus_and/or_Norovirus-like__LC145805
augaagauggcaucaaaugacgccgcaccguccaccgacggugcagcagguuuaguaccagaaucaaacuccgaagucauggcacuugaacccgucgcaggagcagcuuuagccgccccagucacuggccaaacaaacaucaucgacccuuggauccgcgccaacuucguucaagccccaaacggcgaguuuacagucucaccccgcaacuccccaggcgaaguccuccugaaccucgaacucggccccgaacucaaccccuaccucgcccaccuagcaagaauguacaacggcuacgccggcgguauggaaguccaaguaaugcuagccggaaacgccuucaccgcaggaaagcuagucuucgccgcgguaccuccccauuuuccagucgaaaaccuuucaccccaacaaauuaccauguuuccgcaugucauaaucgacguccgcacacuagaacccguccuacucccccuacccgacguccgaaacaacuucuuccacuacaaccaaaaagacgacccaaaaaugcgaauagucgccaugcuauacaccccacuucgaucaaacggcuccggcgacgacgucuucaccguauccugccguguacucacccgccccucacccgacuucgacuucaccuaccuagucccacccaccgucgaaucaaaaaccaaacccuucacccuacccauccucacacuaggagaacucucaaacucccgcuuccccguauccaucgaccaaauguacaccagccccaacgaagucauaucuguacagugccaaaacggcagaugcacccuagacggagaacuccagggaacaacucaacuccaagucagcggcaucugcgccuucaaaggagaagucacagcgcaccuacacgacaacgaccaccucuacaacguaaccaucacaaaccuaaacggauccccauucgaccccucugaagacauacccgcuccacucggaguacccgacuuccagggcagagucuucggcguaaucucacaacgcgacaaacacaauacccccggccacaacgaacccgccaaccgagcacacgacgccgucguacccaccuauaccgcccaauacaccccaaaacucggacaaauccaaauaggaacguggcaaacagacgaccuugcugucaaccaacccgucaaguucacaccugucggacucaacgauaccgaccacuucaaccaaugggucguaccccgcuacgccggagcccucaaucucaacacaaaccuagcccccaguguugccccaguauuccccggcgaacgucuccucuucuuccgaagcuauauaccccucaaaggaggcuacggcaccccagcgaucgacugucuccucccccaagaauggguccaacacuucuaccaagaagcagcccccuccaugucagaaguagcccuaguccgcuacauaaaccccgauaccggccgcgcccucuucgaggcaaaacuccaccgcguaggauucaugaccgucagcucaaacacauccgcgcccgucgucguucccgccaacggauacuuccgcuucgacuccuggguuaaucaauucuacucacuagcccccaugggcaccggcaacggccgccgacgaauccaauaa

SEQ ID NO: 37735 - RNA, 1629 nt, Artificial Sequence
  derived and/or modified sequence opt11 from VP1__Norovirus_and/or_Norovirus-like__LC145797
augaaaauggcuuccaacgacgccgcccccuccacggacggagcagcaggccucgucccagaaucaaacaacgaaguaauggcucuugaacccguagccggugucgcacucgccgccccaguaaccggacagacaaacauaauagauccuuggauccgagcaaacuucgucccggcacccaacggcgaguucaccgucucaccccgaaacuccccaggcgaaguccuccucaaccucgaacuaggacccgaacucaauccauaucucgcccaccucgccaggauguacaacggauacgccggcggaauggaaguccaaguuaugcuagccggcaacgccuucaccgccggcaaacucguuuuugccgccguacccccacacuuccccgucgaaaaccuaucaccccaacaaaucaccauguucccccacgucaucauagacguucgcacacuggaaccgguccuacucccccuaccugacguccgcaacaacuucuuccauuacaaccaaaaagacgaccccaaaaugcgcauaguugccaugcuauacacaccacuccgcuccaacggaucaggcgacgacgucuucacaguauccugccguguccucacacgacccucccccgacuucgacuucaccuaccucgucccucccacagucgaauccaaaaccaaacucuucacccuacccauccucacccucggcgaacuuucaaacucacgauuccccgucucaaucgaccaaauguacacuucucccaacgaagucaucucgguucaaugccaaaacggccgcugcacccucgacggggaacuccaaggcaccacacaacuacaaguauccggcaucugcgccuucaaaggcgaaguaacagcacaccuacacgacaacgaccaccucuacaacgucaccaucacaaacuuaaacggaucccccuucgaccccucugaagacauacccgccccacucggcguccccgacuuccaaggccgaguuuucggaguaaucucgcaacgggacaaacacaacauaucuggacauaacgaaccagccaaccgagcucacgaugccgucgucccuaccuacaccgcccaauacacccccaaacuuggccaaauccaaauaggcaccuggcaaaccgacgaccucaccgucaaccaaccaguaaaauucacccccgucggucuaaacgacaccgaccacuucaaccaaugggucgucccccgauacgccggagcccucaaccuaaacacaaaccucgcccccagcgucgccccugucuuccccggcgaacgacuacuauucuuccgcuccuacaucccccucaaaggaggauacggcacccccgccauagauugccuccuaccacaagaauggguccagcacuucuaccaagaggcagcccccuccauguccgaagucgcccucgucagauacaucaaccccgacaccggcagagcccuuuucgaggcaaaacuccaccgagcaggcuuuaugaccguaagcagcaacacuuccgcaccagucgucguccccgccaacggauauuuccgcuucgacuccugggucaaccaauuuuacucccuagcgccaaugggcacuggcaacggccgccgccgaauccaauaa

SEQ ID NO: 37736 - RNA, 1629 nt, Artificial Sequence
  derived and/or modified sequence opt11 from VP1__Norovirus_and/or_Norovirus-like__LC145806
augaaaauggccagcaacgacgccgccccaucaacagacggagccgcuggccucguaccagaauccaacuccgaagucauggcccuagaacccgucgcaggcgcagcccuagccgcacccgucaccggccaaacaaacaucauugaccccuggauccgagccauauucguccaagcaccaaacggagaguucaccgucucaccccgcaacucccccggcgaagucuuacucaaccucgaacucggcccagaacucaacccauaccucgcacaccucgcccgaauguauaacggcuacgccggcggaauggaaguccaagucaugcuugcuggcaacgccuucacagccggcaaacucguauucgccgccguaccaccccacuuccccguagaaaaccucucaccccaacaaauaacuauguucccccacguaauuauagacguacguacccucgaacccguccuccuaccccuacccgacguccgaaacaacuucuuccacuacaaccaaaaagacgaccccaaaaugcgcauagucgccaugcuauauaccccucuacgcucaaacggcuccggcgaugacguuuucacagucuccugcagaguccucacccgccccuccccagacuucgacuucaccuaccucguaccacccacagucgagucaaaaacaaaaccauucacacuacccauccuuacccucggcgaacucucaaacagccgauucccagucucaaucgaucaaauguacacaucaccaaacgaaguaaucucaguccaaugccaaaacggacgcugcacucucgacggcgaacuccaaggcaccacccaacuccaagucucaggaauaugugccuucaagggugaaguaaccgcgcaccuucacgauaacgaccacuuauauaacgucaccauaacaaaccucaacggcucucccuuugacccauccgaagacaucccagcaccccugggcgucccagacuuccaagggcgcgucuucggcguaaucucccaacgcgauaaacauaacacccccggccacaaugaacccgcaaaccgagcacacgacgccguaguccccaccuacaccgcccaauacacccccaaacucggccagauccaaaucgggaccuggcaaacagacgaccucgccgucaaccaaccugucaaauucacacccgucggccuaaacgacacagaccacuucaaucaaugggucgucccaagauacgccggcgcgcucaaccugaacaccaaccuagcccccuccgucgcacccgucuucccaggcgaacgccuacucuucuuccgcagcuacauaccccuuaaaggcggauacggcaccccggccaucgacugccuccuaccucaagaauggguccaacacuucuaccaagaagcggcccccucaauguccgaagucgcgcuuguccgcuacaucaaccccgacacaggccgcgcacucuucgaagccaaacuccaccgagcaggcuucaugacagucucauccaacaccuccgccccagucgucguucccgccaacggcuacuuccgauuugacuccuggguaaaucaauucuacucccuugcacccaugggcaccgguaacggacgucgccgaauccaauag

SEQ ID NO: 37737 - RNA, 1629 nt, Artificial Sequence
  derived and/or modified sequence opt11 from VP1__Norovirus_and/or_Norovirus-like__KU306738
augaaaauggccucuaacgacgccgcccccucaaacgauggagccagcucccuaguccccgaaauaaacaacgaaacaauggccuuagaacccgucgcuggcggagccauugccgcuccacuaacuggacaaaccaacuucauagacccuuggauacgcaauaauuacguucaggccccaaacggcgaguucaccaucucaccccgcaacucccccggcgaaauacuccucaaccuagaacucggccccgaacucaaccccuuccuugcacaccuagcucgcauguacaacggcuacgccggcggaguugacguccaagucaucauggccggcaacgccuucaccgcaggcaaagucaucuucgcagccguaccaccgcacuuccccgucgaaucccuaucacccccacaaauaacaauguucccccacaucaucguagacguccguacacuugaaccaaucaacauccccauaccagacguucgcaacaacuuuuuccacuacaaccaaaauaacgaaccacgaaugcgccuaguagccaugcucuauacaccgcuccgcuccaacggauccgccgacgacgucuucaccgucuccugccgcguccucaccaaacccagcgccgacuucgaguucaacuaccuagucccacccaccguagaaucacgcaccaaacccuucaccauaccaauucucacaaucggugaaaugaccaauucccgcuucccagucgccaucgacaugcucuacaccucacccaccgaaaaccuagucguucaaccccaaaacggccgcugcacacuagaaggcgagcuucucggcaccacacagcuagucacccccaacauuuguucccuacgcggcgcgauaacaggccaugaaggcaacgacgacaaccacaaauggcacaugaccgucacaaacccaaacggcuccgcauucgauccaacagaagacguccccgccccgcucggcacccccgacuucaucggcgacgucuacggcguacucucccaacgaaaccgcaauaucgaauccggccaaacugcccccgcaaacagaagccacgaagccgucaucuccacccgcucuaacaaauucacccccaaauuaggauccgucaugaucgcaaccuggaacaccaacgacguugaaaaccaacccacaaaauucacaccugucggacucgaaaacccaggcagcuuccaccaaugggaacuccccaacuacucgggcgcccucacccuaaacaugggccucgccccucccgucuuccccaccuaccccggcgagcaacuccucuucuuccgcucuuacaucccccucaaaggcggcuucggcaacuccaucauagacugucucgucccacaagaauggauccaacacuucuaccaagaauccgcacccucucagaccgacgucgcccuuauccgcuacgucaaccccgaaaccggccgcguucucuuugaagccaaacuccaccgccaaggcuucaucaccguugccaaaaccggcgacuccccuauaaacguccccgccaauggauacuuccgcuucgacuccugggucaacuccuuuuacucacuagccccaaugggcacgggaaacggacggcgucguauacaauaa

SEQ ID NO: 37738 - RNA, 1629 nt, Artificial Sequence
  derived and/or modified sequence opt11 from VP1__Norovirus_and/or_Norovirus-like__KM036380
augaaaauggcauccaaugacgcagcccccucaaacgacggugcugcaucucuagucccagaagccaucaaugaaaccaugccccucgaaccagucgccggcgccuccaucgccgcuccuguugccggccaaacaaacaucaucgaccccuggauccgaacaaacuucguccaagcaccuaacggcgaguucaccgugucaccccgcaacucccccggagaaauccuacuuaaccucgaacucggcccagaccucaaccccuaccuugcccaccucucccgaauguacaacggcuacgcaggcggcgucgaaguacagguucuccuagccggcaacgccuucaccgccggcaaaauccuuuucgccgccaucccucccaacuuccccgucgacaugauaucccccgcccaaauuaccaugcucccccaccucauugucgacguccgcaccuuggaacccaucaugaucccccuuccagacgugcguaacgucuucuaccacuucaacaaucaaccccaaccccgcaugcgucucguagcaaugcuauacaccccacuccgcuccaacggcagcggcgacgacguuuucaccguauccugucgcguacucacccgaccaacacccgacuucgaguucauauaucucgucccaccauccgucgaaagcaaaacgaaacccuucacccucccaauccucaccaucuccgaacucacaaacucccgcuuccccaucccaaucgaacaacuuuacacugcaccuaacgaaaacaacguaguccaaugccaaaauggccgcugcacccucgacggcgaacuccaaggcaccacacaacuccucuccagcgccgucugcuccuaucgaggacgaaccgucgccaacucgggcgacaacugggaccagaaccuccuacagcucaccuaucccuccggagcuucuuacgacccaaccgacgaaguucccgcaccccucgguacacaagacuucuccggcauacuauacggcguacuaacacaagacaacguuuccgaaggcacgggcgaagccaaaaaugccaaaggagucuauauaucaaccacaagcggccgcuuuacacccaaaaucggcaccauaggccuacacucgaucacagaaaacguacacccaaaccaacaaucccgcuucacccccgucggcguagcccaaaacgaaaacaccccuuuccaacaauggguccucccccacuacgccggugcacucgcccuaaacaccaaccuugcccccgccgucgcccccaccuucccaggagaacagcuacucuuuuuccgcucccgagucccuugcguacaaggccuacgcggccaagacgccuucaucgacugccuccucccacaagaaugggucaaccacuucuaccaagaagccgcucccucccaagccgacgucgcacucauccgcuaugucaacccagacaccgguagaacccucuuugaagccaaacuccaccgcuccgguuucaucacugucucucacaccggcaacuacccccucgucgucccacccaacggucacuuccgcuucgacucauggguaaaccaauucuauucccucgcacccaugggcacaggcaacggacgacgacgcguccaauaa

SEQ ID NO: 37739 - RNA, 1629 nt, Artificial Sequence
  derived and/or modified sequence opt11 from VP1__Norovirus_and/or_Norovirus-like__AY113106
augaaaauggcuucaaacgacgccgcucccuccaacgacggcgcagccucccucguucccgaaggaaucaacgagaccaugccacuagaacccgucgccggcgcaucaaucgccgcacccgucgccggccaaaccaacaucaucgaccccuggauucggacgaacuucguccaagccccaaacggcgaauuuaccgugagccccagaaacuccccaggagaaauacuccucaaccucgaacuuggcccagaccucaaccccuaccuagcccaccucucacgcauguacaacggauacgccgguggcgucgaaguccaaguccuccucgccggcaaugccuucacagcuggaaaaauacucuucgcagccaucccaccuaacuucccugucgacaugauaucaccagcucaaaucaccaugcucccacaccuuaucgucgacguccgcacacuugaacccaucaugauaccacuaccagacguacgcaacgucuucuaccacuucaacaaucaaccccaaccacgcaugcgacucgucgccaugcuuuacaccccacuccgcagcaacggcucaggcgacgacguauucaccgucucaugccgcguacucacacgccccaccccagacuucgaguucauauaccucguacccccaucugucgaaucaaagaccaaaccauucacacucccaauccucaccaucucagaacugaccaacucccgcuuccccauucccauagaacagcuauauacagcccccaacgaaaccaacgucguccaaugccaaaacggacguugcacccucgacggcgaacugcaaggcacuacccaacuacucuccucagccgucuguuccuacagaggaagaacagucgccaacaacggugacaacugggaccaaaaucuacuccaacucaccuauccaaacggcgccuccuacgacccaaccgacgaaguccccgcuccccucggcacccaagacuucuccggcaugcucuacggcgucuuaacccaggacaacgucaacgucucuacaggcgaagccaaaaacgccaaaggcauauacaucucaaccacaagcgggaaguucacccccaaaguaggguccaucggccuccacucaaucaccgaacacguccaccccaaccaacaauccagauucaccccagucggaguagccguaaacgaaaacacccccuuccaacaauggguccuuccccacuacgccggcucccucgcccucaacaccaaccucgccccugcagucgcuccuaccuucccuggcgaacaauuauuauucuuuagaucucgcguucccugcguccaaggacuccaaggccaagacgccuucaucgacugccuccuaccccaagagugggucaaucacuucuaccaagaagccgcccccucccaagccgacgucgcacucauccgauacguaaaccccgauaccggccgcacccucuuugaagcaaaacuccaccgcucaggcuucaucacugucagccauaccggagcuuauccccuagucgucccacccaacggccacuuccgcuucgacuccuggguaaaccaguucuacucccucgcccccaugggcaccggaaacggacgccgacguauccaauaa

SEQ ID NO: 37740 - RNA, 1629 nt, Artificial Sequence
  derived and/or modified sequence opt11 from VP1__Norovirus_and/or_Norovirus-like__AB078334
augaaaauggccucgaacgacgccgccccaucaaacgacggcgcagccucccuaguccccgaaggcauuaacgaaacaaugccacuagaaccagucgcaggcgcauccaucgccgccccagucgcagggcaaacgaacaucaucgaccccuggauucgcaccaacuucguccaagccccaaacggugaauuuaccgucagcccucgcaacucacccggcgaaauccuacucaaccuagaacucggcccugaccucaaccccuaccucgcccaccucucacgcauguacaacggcuacgcuggaggcgucgaaguacaaguccuacucgcuggcaacgccuucacggccgguaaaauacucuucgccgccaucccacccaacuuccucgucgacaugauaucccccgcccaaaucaccaugcucccacaccugaucgucgacgucagaacucuagaacccaucaugaccccacuccccgacguucgcaauguauucuaccacuucaacaaucaaccccaacccagaaugcgccucgucgccaugcucuacacaccccucagauccaacggaucuggcgacgacguuuucacugucuccugccguguccuaacccgacccacaccagacuucgaguucaucuaccucguacccccuuccgucgaaucuaaaacaaaacccuucacccuaccaauacucaccaucucugaacucacuaacucacgcuucccuaucccuaucgaacaacuauauacugcccccaaugaaaccaacgucguacaaugccaaaacggccgaugcacacucgacggagaacuacaaggaacaacacagcuccuauccuccgccguuugcuuccuucaaggacgaaccguagccgacaauggcgacaacugggaccaaaaucuacuccaacuaacauaccccaacggcgcaucauacgacccuacagacgaaguaccagcaccccucggcacccaagacuucuccggcaugcucuauggcguacuuacccaagacaacguaaacguuuccaccggagaagccaaaaacgccaaaggcauuuacauaucaacaacaucaggcaaauucacccccaaaauuggcucaaucggccuccacucaaucacugaacacguccacccaaaccaacaaucccgauucacaccagugggaguggcggucgacgaaaacacaccauuccaacaauggguccucccccacuacgccggaucacuagcccucaauaccaaccucgcucccgccgucgccccaaccuucccuggcgaacaacuccucuucuuccggucccgcguccccugcguccaaggccuccaaggucaagacgcauuuauagacugccuccucccccaagaaugggucaaccacuuuuaccaagaagcagcccccucccaagccgacgucgcacuuauacgcuacgucaacccggacaccggccgcacccuauucgaagcaaaacuccaccguucgggcuucauaaccguaucccacacaggggcguacccccucgucgucccacccaacggccacuuccgauucgacuccugggucaaccaauucuacagccucgcccccaugggaaccggcaacggccgccgacgaauccaguaa

SEQ ID NO: 37741 - RNA, 1629 nt, Artificial Sequence
  derived and/or modified sequence opt11 from VP1__Norovirus_and/or_Norovirus-like__KM289172
augaaaauggccucaaacgacgccgcuccauccaacgacggcgccgcuggccugguccccgaaaucaauaacgaagccauggcucuagaccccguagcaggagcagcuaucgcagcaccccucacuggccaacaaaacaucauagacccauggauaaugaacaacuucguacaagcccccggcggagaguucaccguaucccccagaaacucccccggcgaaguacuacuaaaccuggaacuugguccagaaauuaaccccuaccucgcccaccuagcccguauguacaacggauacgccggcggcuucgaaguacaagugguccucgccggcaacgcauucacugccgguaaaguuaucuucgccgcaaucccacccaacuucccaaccgacaaccucuccgccgcccaaaucacuaugugcccccaugucaucgucgacguuaggcaacucgaacccaucaaccuacccaugccagacguccgcaacaacuuuuuccacuacaaucagggcucagacucccgacuccgccucaucgccaugcucuacacaccccuccgugcaaacaauuccggugacgacgucuucaccguauccugccgcguccuaacccgccccucacccgacuucuccuucaacuuccuaguuccucccaccgucgaaagcaaaaccaaacccuucacccuucccauccucacaaucagcgaaauguccaacucccgcuuccccguccccaucgacucccuccacaccucacccaccgacaacauagucguacaaugccaaaacggccgcguaacccucgacggugaacucaugggcacaacacaacuccuccccucccaaauuugugccuucagaggcguccucacccgcuccaccucccgcgcauccgaccaagccgauaccgccacaccucgccucuucaacuacuacuggcacauccaacuagacaaccuaaacgguaccccauacgacccagcagaagacauccccgccccacuuggaacacccgacuuccgcggaaaagucuucggcgucgccagucagcgcaaccccgacuccacuacccgagcacacgaagcaaaaguagacaccacuuccggccgauucacccccaaacuaggaucccucgaaaucuccaccgaaucuggcgacuuugaccaaaaccaaccuacucguuucacaccugugggcauuggugucgacucggaagccgacuuccaacaauggacccuacccgacuacucaggccaguucacccacaacaugaaccucgcuccagcagucgccccaaacuuccccggcgaacaacuuuuauuuuuccgcucccaacuccccuccucagguggacgaucaaacggcauccuagauugccuaguaccccaagaauggguccaacauuucuaccaagaaucagcgcccgcccaaacccaaguagcccuaguccgcuacguaaaccccgauaccggacgcguccuauucgaagccaaacuacacaaacuaggcuauaugaccauagccaaguccggcgacucccccauuaccguucccccaaacggcuacuuccgauucgaauccugggucaacccauucuacacacucgcacccaugggcacuggcaacuaa

SEQ ID NO: 37742 - RNA, 1629 nt, Artificial Sequence
  derived and/or modified sequence opt11 from VP1__Norovirus_and/or_Norovirus-like__AY130762
augcgcauggccuccuccgacgcccccgucuccggcacagauggcgccgccggccucguccccgaaucccaacaagaaguuuuaccuuuggaaccaguagccggcguccaacuagccgcacccguggccggccaauccaacauaaucgaccccuggauccgcaugaacuucguacaagcacccgccggcgaauuuacugucagcccccgcaaugccccaggcgaaguacucauagaccucgaacuaggcccagaacucaaccccuaccuuaaccaccuagcccgcauguacaacggcuacgucggaggcauggaagucgaagucguccuagccgguaacgccuucacagccggaaaaauccucuucgccgccgucccucccuccuuccccacccacggcaucuccgccgcccaagcaacaaugcuaccccacguuaucgucgacguccggcaacuugaacccguccggcucccccuccccgauguccgcaaugucauguuccacuucugccaagaaaacaaagaaccccguaugcgcauaguagcaauccuauacacuccccuccgcgccaacggcgcaggcgacgacgucuucaccguguccugccgcguccucaccagacccagcccagacuucgacuucaucuuccucgucccacccuccgucgaaucgaaacuaaaacaauucacccuucccaacuuacaacccaacgaaaugacaaacucaagguucccaacaggcaucacucaacucuacaccuccccuaauaccaaccucgucguccaauuccaaaacggccgaugccuacuagacggcacccuccucggaacaacucccguccgugccgccgacaucugcuccuuccguggagucaccuccacagaaguugacgcaaccgacaguccccgcgucgccggaucccaucgaauuaugguacaacucaaagaacccgacggagaagaguucucaccgacaggacccaacccugcccccguaggcaccccugacuuccaagccgccaucuucggcacccuaucccaacgcaacaccggaggcgccggucaaaacucuaaccgugcucacuucgccuacuucuacacgcgcaaccccacauucgcaccuggcaucggcaccguuguuuucucguucgacacaacugacuuccaaaaccgccaacccaccaaauucucacccuccggaguauucgacgacaacuccuccgaaccauucaaccaauucucccuacccuacuacaacggcucacuaggugccguugaugccggaaaacuagccccacccguugcccccaacuaccccggagaacaaauacuguacuuccgcggcaacaucccuuucaaaggcggcuacggcgaaggcgaaauagacucacuacuuccccaagaauggaucacacacuucuacgcagaacaagcucccacccagggagacgccgcccuacuccgcuacuacaaccccgauacaggaagaguacucuucgaaugcaaacuccaccgcgaaggcuucaucaccaucaacuacaccgguucaaacgcccucgccguacccgucaacggcguauuucgcuucgaaggcuggguaaacaaauucuacacacuaacccccauguga

SEQ ID NO: 37743 - RNA, 1629 nt, Artificial Sequence
  derived and/or modified sequence opt11 from VP1__Norovirus_and/or_Norovirus-like__KJ196290
augcgaauggcauccucagacgcaccuguguccggcacagacggagccgcaggacucguuccagaaucacagcaggaaguccugccacuggaaccagucgccggcguccagcuagccgcaccagucgccggacaauccaacaucauagacccuuggauccgcaugaacuucguccaagcacccgccggagaauuuacagucagcccccgaaacgcacccggcgaaguacucauugaccuagaauuaggccccgaacucaaccccuaccucaaccaccucgcccgcauguauaacggauacguaggcggaauggaagucgaagucguccuagcaggaaacgccuucacugccggcaaaauccucuucgccgccgucccaccauccuuccccacacacggcaucuccgccgcccaagcaaccaugcuaccccacgucauagucgacguucggcaauuggaacccguccgacucccccuaccagacguacgaaacguaauguuccacuucugccaagaaaacaaagaacccagaaugcgaaucgucgccauccuauacacaccccuacgagccaacggcgcaggcgacgacgucuucaccgucuccugccgcguacucacgcgacccagucccgacuucgacuuuauauuccuaguaccucccuccgucgaauccaaacucaaacaauucacccugcccaaccuucaacccaacgaaaugaccaauucccgcuuccccaccggcaucacccaacucuacaccucccccaacacuaaccuugucguccaauuccaaaacggacgcugccuccuagacgguacccugcucggcaccacccccguccgcgccgccgacaucugcuccuuccgaggcgucaccuccacagaaguagacgccaccgacucaccacgcgucgccggcagccaccgaaucaugguccaacuccgcgaaccagacggagaagaguucuccccuacaggcccuaaccccgccccugucggcacccccgacuuccaagcagccaucuuuggcacccuaucccagcgcaauacaggcggcgcaggccaaaauuccaaccgugcccacuuugccuacuucuacacccgcaaccccacauucgcacccggcauaggcacugucgucuucucauucgacacuaccgacuuccaaaaccgacaacccaccaaguucucccccucuggcguauuugacgacgacucauccgaacccuucaaccaauucucccuacccuacuacaacggaucccuaggcgccgucgacgcuggcaaacuagcuccacccguugccccuaacuacccaggcgaacaaauccucuacuuccgcggcuccgugcccuucaaaggcggcuacggcgaaggcgaaauagacucgcuacuaccacaagaauggaucacacacuucuaugcagaacaggcccccacccaaggugacgccgcccuucuccgauacuacaaccccgacaccggccgagucuuauucgaaugcaagcuccaccgcgaaggcuucaucaccaucaauuacaccggauccaacgcccuagccguaccagucaacggcguuuuccgcuuugaaggcugggucaacaaauucuacacucuaacccccauguga

SEQ ID NO: 37744 - RNA, 1629 nt, Artificial Sequence
  derived and/or modified sequence opt11 from VP1__Norovirus_and/or_Norovirus-like__GQ856474
augcgaauggccuccucagacgcaccagucuccggcacagacggcgccgccggacucguucccgaaucacaacaagaaguccucccccucgaacccguagccggaguacaacuugcagcccccguagcuggccagucaaacaucaucgacccauggauccgcaugaacuucguccaagcccccgccggcgaguucaccguaucaccccgagacgcccccggcgaaguccucaucgaccuagaauugggccccgaacuaaacccuuaccuaaaccaccuugcccgcauguacaacggcuacguaggcggaauggaaguagaagugguacuagccggcaacgcauucaccgccggcaaaauccuauucgcugccguaccacccucauuccccacccacggaauauccgcagcccaagcaacgaugcucccccacgucaucgucgacguccgccaacucgaacccguacgucucccccuucccgacguacgaaacgucauguuccacuucugccaagaaaauaaagaaccccgcaugcgcaucgucgcaauacucuacacuccccuacgcgccaacggcgcaggcgacgacgucuucaccguauccugcagaguccucacccgaccaagccccgacuuugacuucauuuuccucguccucccuucagucgaauccaaacucaaacaauucacacuccccaaccuacaaccaaacgaaaugaccaacuccagauuccccacaggaaucauacaacuuuauaccucccccaacacuaaccucguaguccaauuccaaaacggcagaugccuccuagacggcacacuccucggcaccacaccaguccgcgccgccgacaucuguuccuuccgcggcgucacaucaaccgaaguagacgcaaccgacucaccccgcgucgcaggcucccaccggaucaugguccaacucaaagaacccgacggagaagaguuuucccccacaggaccaaacccagcaccaguaggcacaccugacuuccaagcagccauuuucggcacacucucucaaagaaacaccggcggcgcgggccaaaacagcaaccgagcgcguuuugcauacuuuuauacacgcaacccgaccuuugccccagguaucggaacugucguauucuccuucgacaccaccgacuuccaaaaccgccaacccacaaaauucucucccagcggcgucuucgacgacgacuccuccgaacccuucaaccaauucucccuaccauacuacaacggaucccucggcgccgucgacgcgggaaaacuagccccgcccgucgccccaaacuaccccggcgaacaaauccucuauuuccguggcaacauccccuucaaaggaggcuacggagaaggcgaaaucgacucccuacucccgcaagaauggaucacccacuucuacgccgaacaagccccaacccaaggcgacgccgcucuccuccgauacuacaaccccgacacuggacgaguccucuucgaaugcaaacuccacagagaaggcuucaucaccauuaacuacaccggcagcaacgcccuagccgucccagucaacggcgucuuucgcuucgaaggcugggucaauaaauucuacacccuaacacccauguaa

SEQ ID NO: 37745 - RNA, 1629 nt, Artificial Sequence
  derived and/or modified sequence opt11 from VP1__Norovirus_and/or_Norovirus-like__LC145787
augaaaauggccuccaacgacgccgcaccgucuaccgauggagccgccggccuagucccagaauccaacaacgaagucauggcccuugaacccguagccggugccgcccucgccgcccccgucaccggacaaaccaauauaaucgaccccuggauacgugccaacuucguacaagcaccaaacggugaguucaccgucagcccucguaacgcaccuggcgaaguccuccuaucacucgaacucggcccagaacuaaacccuuaccucgcccaccucgcacgcauguacaauggcuacgccggcggcauggaaguacaaguaaugcucgccgguaacgccuucacagccgggaaacuggucuucgccgcagucccaccucacuucccagucgaaaaccucucaccccagcaaaucacaauguucccucacgucaucaucgacguccgaacccucgaaccaguccuauuaccccucccagacguccgcaacaacuucuuccacuauaaccaaaaagacgaccccaaaaugcgcauagucgcaaugcucuacacaccacuccgcuccaacggcuccggugacgacgucuucaccgucucuugucgaguccuuaccagaccaucccccgauuucgacuucaccuaccucguacccccaacugucgaauccaaaacaaaacccuucacccucccaaucuuaacccucggagaacucuccaacucacgauuccccguguccauagaccaaauguacaccucacccaaugaagucauaagcguacaaugccaaaacggacggugcacacucgacggagaacuccaaggaaccacccaacuacaagucuccggcaucugcgccuucaaaggcgaagucaccgcccaccuccaugacaacgaucaccuuuacaacgucaccauaacuaaccuaaacggcucccccuucgauccuuccgaagacguuccagcaccccucggcgucccugacuuccagggccgcgucuucggaaucaucucucaacgcgacaagcacaacuccccaggccauaacgaaccagccaaccgcggccacgacgcagucgucccaaccuacaccgcucaauacacccccaaacucggucaaauacaaauaggaaccuggcaaaccgacgaccuuaccgucaaccaaccugucaaauucacaccagucggccucaacgacacagaacacuucaaccaaugggucgucccccgcuacgcuggcgcccuaaaucucaacaccaaccucgcccccucuguagcccccguauuccccggggaacgccuccuauucuuccgcuccuacgucccccuuaaaggcggcuacggcaaccccgccauugacugccuucuaccccaagaauggguacaacacuuuuaccaagaagcagccccauccauguccgaaguggcccuaguccgcuacauaaacccagauacuggccgcgcacucuucgaagccaagcugcaccgugccggcuucaugaccgucucuuccaauacauccgcccccguuguuguccccgcaaacggauacuucagauucgacuccugggucaaccaauucuacucccuggcuccuaugggaacaggcaacggccgccgccgcguccaauaa

SEQ ID NO: 37746 - RNA, 1629 nt, Artificial Sequence
  derived and/or modified sequence opt11 from VP1__Norovirus_and/or_Norovirus-like__AB629946
augaaaauggccuccaacgacgccgccccaucaacagauggcgcagcuggccucguccccgaguccaacaacgaagucauggcccucgaaccagucgccggcgccgcuuuggcugccccuguaaccggccaaacuaauaucauagacccuuggauccgcgccaacuucguccaagccccgaacggcgaguucaccgucucaccccgaaacgcccccggagaaguacuccugucccucgaacucggcccagaacuaaacccauaccucgcacaccucgcccgaauguacaacggcuacgccggcggcauggaaguacaaguaaugcucgccggcaaugcauucacagccggaaaacucgucuucgccgcaguuccuccccacuuccccguagaaaaccuaagcccccaacaaauaacaauguucccccauguaauaauugacguccgaacacucgaacccguucuacuaccccuaccagacguacgcaacaacuucuuccauuacaaccaaaaagacgaccccaaaaugcgcaucgucgccaugcuuuacacaccgcuccgcuccaacggcuccggcgacgacguuuucacugucuccugucgcguacuaacccgcccaucccccgacuucgacuucaccuaccucgucccacccaccgucgaauccaaaacaaaacccuucacacucccuauccuuacccucggcgaacucucaaacucacgauuuaccgucucaaucgaccaaauguacacaagccuuaacgaaguaaucuccguacagugccaaaacggccgcugcacccuagacggcgaacucaggggaaccacccaacuccaagucuccgguaucugcgccuucaaaggcgaaguuaccgcucacguccacgacaacgaccaccucuacaacgucaccaucaccaaccucaacgguagccccuucgaccccucggaagacguaccagcaccccucggaguccccgacuuccaaggcagaguauucggcaucaucucccagcgagacaaacacaauucgcccggccacaacgaaccugccaaccgcggacacgacgccguaguccccaccuacacagcucaauacaccccaaaacucggccaaauacaaaucgguacauggcaaacagacgaucucaccgucaaccaacccguaaaauucacacccgucggccucaaugauaccgaacacuucaaucaauggguugucccccgcuacgccggcgcacucaaccuuaacaccaaccucgcccccuccgucgccccuguauuccccggcgaacgucuccucuucuucagauccuacgucccccucaaagguggcuauggcaaccccgcaaucgacugccuccucccccaagaauggguacaacacuuuuaccaggaagccgcccccucuauguccgaagucgcacuuguuagauacaucaaccccgacaccggacgcgcccucuucgaagcaaaacuacaucgagccggcuuuaugaccgucuccuccaacacauccgcccccgucgucguuccagccaacggcuacuuccgauucgacucaugggucaaccaguucuacagucuggcgccuaugggcacaggcaacggcagacgccgcguccaauga

SEQ ID NO: 37747 - RNA, 1629 nt, Artificial Sequence
  derived and/or modified sequence opt11 from VP1__Norovirus_and/or_Norovirus-like__KT962983
augaaaauggcaucaaacgaugcagcaccauccacggacggagccgccggucucgucccagagucaaacacugaggucauggcacuagaacccgucgccggagccgcucucgccgcuccuguuacaggucaaaccaacaucaucgaccccuggauacgcgccaacuucguccaagcccccaacggcgaguucacagucucaccccgcaacgccccaggcgaagucuuacucaaccuagaauuaggccccgaacuaaaccccuaccucgcacaccuagcccgcauguauaacggcuacgcaggcggcauggaaguccaagucaugcucgccggcaacgccuucaccgcuggaaagcuagucuucgccgccguacccccacacuuccccgucgaaaaccucucaccccaacaaaucaccauguucccgcacgucauaauagacguccgaaccuuggaacccguccuccucccacucccagacgucagaaacaacuucuuccacuacaaucaaaaagacgacccuaaaaugcgcaucgucgccaugcucuacaccccgcucagauccaacggcuccggagaugacguauucacaguauccugccgaguccucacccguccaucccccgacuucgacuucacguacuuagucccaccaacagucgaaucaaaaaccaagcccuucacccuccccauccucacccugggagaacucagcaacagcagauuccccgucuccaucgaccaaauguacaccagccccaacgaagucauuucaguucaaugccaaaacggucguugcacacuagacggcgaacuccaaggcacaacacaacuacaagucuccggcauaugcgcauuuaagggcgaaguaaccgcacaucuccacgacaacgaccaccuauacaacaucaccaucaccaaccuaaacggauccccguucgaccccuccgaagacauccccgcaccccucggcguaccagacuuccaaggccgcgucuucggaaucaucagccagcgcgacaaacacaacucucccggacacaacgaacccgcaaaccgcggccacgacgcuguaguccccaccuacacugcacaauacacacccaaacucggacaaauccaaauaggaaccuggcaaaccgacgaccuaaccguaaaccaaccugucaaauuuacacccgucggccuaaaugacacugaacacuucaaccaaugggucgucccccgcuacgcaggcgcacucaaccuaaacacgaaccuagccccauccguagcacccgucuucccaggagagcgccucuuauucuuccgcucuuacaucccccucaaaggcggcuacggaaaucccgcaaucgacugccuacuaccccaagaauggguccaacacuucuaccaagaagccgcaccaagcaugucugaaguagcccuaguacguuacaucaaucccgacacaggacgagcccuauucgaagccaaacuccaccgagcaggcuucaugacuguuuccuccaacaccuccgcccccguagucguaccugccaauggauacuuccgcuucgacucaugggucaaccaauucuacucccucgcacccaugggaacaggaaacggccgucgccgcguacaauag

SEQ ID NO: 37748 - RNA, 1626 nt, Artificial Sequence
  derived and/or modified sequence opt11 from VP1__Norovirus_and/or_Norovirus-like__AB083780
augaaaauggccuccaacgacgccgcacccucgaacgacggagccgccggccucguaccugaaaucaacaccgaaguaauggcccucgaacccgucgccggcggagccaucgccgcacccuuaaccggccaaacaaacaucaucgaccccuggauacgaaacaacuucguccaagccccaaauggcgaauuuaccaucagcccccgcaacuccccaggcgaaauacuccucaacauggaacucggacccgaacuaaaccccuuccuagcacaccucucccguauguacaacgguuucgccgggggaauggaaguccaaguccuaauggccggcaacgcauucacagccggcaaagucauauucgccgcugucccaccacacuuccccgucgaaaaccucucaccaccucaaaucaccauguuuccacacauaauaaucgacguucgaacccucgaacccguccuccuccccaugcccgacguccgcaaccaauucuuccacuacaaccaagucaacgaaccccgcaugcgccuagucgccaugcuauacacaccccuccgauccaacggcucaaccgaagacgucuucaccgucuccugccgaguacugacacguccaucaccagacuuugaguucaauuaccuugucccacccacaguagaaucccgaaccaaacccuucacacuacccguacucaccaucggugaaaugaccaacucacguuuccccgcccccaucgauaugcuauacacguccccgaacggaaacgucgucguccaaccacaaaacggccgcugcacacuagacggggaacuacagggcuccacgcaacuuguccccgcuaacgucugcgccuuccgcggaaaaauuaccgcccgcaucgucgaccaagcagcccaucaauggcacaugcagaucgacaaccccaacggaacccuguucgaccccacagaagauguccccgcaccccuaggcaccccagauuuuaaagccaaaaucuucgguguaauaucacaacgcaacgacuacaacgauggcucccaaggaccugccaaccgugcgcaugacgcagucguaccgacuaccucagccaaauucacucccaaacuuggcuccauacucgucggcacaugggaaaacaacgauauagaaacccaacccucaaaauucacccccgucggccuacuagaaaugaacgauuucaaccaauggucacuaccaaacuauucgggcgcccucacccuaaacaugggccucgccccagcaguauuccccaccuucccuggugaacaaauccuauucuuccgcuccuucauuccccuaaaaggaggacacggaaacccagccaucgacugccuacucccacaggaauggauacaacacuucuaccaagaauccgcacccagccagaccuccgucgcccucauccgcuacgucaaccccgacaccggccgcguccucuucgaaggaaaacugcaccgacaaggcuucauaacaauugccaaaucaggggacggccccaucguuguuccacccaacggguacuuccgauucgacucaugggucaaccaauucuacucacucgcccccaugggcaacggcaacggacgacgccgcauacaauaa

SEQ ID NO: 37749 - RNA, 1626 nt, Artificial Sequence
  derived and/or modified sequence opt11 from VP1__Norovirus_and/or_Norovirus-like__KX987840
augcgcaugucugacggagcugcacccaaagccaauggauccgaagccuccgggcaggaccucguucccaccgccguagaacaagcaguuccuauccaacccguugccggggccgcacucgccgcccccgcagccggccaaaucaaccaaaucgacccauggaucuuccaaaacuucguccaaugcccacucggagaauuuagcaucagcccacgcaacaccccaggagaaauacuauucgaccucgcacucggccccggucucaacccauaccucgcccaucucucagccauguacaccggauggguaggcaacauggaaguccaacucguacuagccggaaacgcauucacagccggaaaaguaguaguugcccuaguacccccguacuuccccaaagguucacucacuaccgcacaaauaacaugcuucccgcacguaaugugcgacguccgaacacuugaaccaauacaacuuccacuccuagauguacgucguguauuauggcacgccacccaagaccaagaagaauccaugcgccucguuugcaugcuauacacccccuuacgcacaaauucacccggcgacgagagcuucgucguauccggccgccuacucagcaaaccagccgcagacuucaacuucgucuaccuaaccccucccaucgaacgcaccauauaccgaauggccgaccuccccgucauccaaccccggcucugcacgcacgcccgcuggcccgcacccguauauggacuacucgucgaccccucccucccaucaaacccacaauggcaaaacggacgagugcacgucgacggcacccuauuaggcacaacacccaucagcggcuccugggucucuugcuucgcugccgaagcggccuacgaauaccaaucaggcacgggagaagucgccaccuucacccucaucgaacaagacggcuccgcguacguccccggagaccgagccgcaccccuaggcuaccccgacuucucaggacaacuagaaauagaaguucaaaccgaaaccacaaaacccggcgacaaacucaaaguaaccacauuugaaaugauacuaggccccaccaccaacgucgaccaagcccccuaccaaggccgagucuacgccuccgucaccgcugcugcaacacucaaccucgucgacggacgcguacgcgccgucccccgauccauauacggcuuccaagaugucauccccgaauacaacgacggacucuuagucccccuugccccacccauaggccccuuccuacccggcgaaguccuccuccgauuccgcaccuacaugcgacaaauugacagcucagaugcagcagccgaagccaucgacugcgcccucccacaagaguucaucuccugguucgccucaaacgcauucaccguccaaagcgaagcacuccuccuacgauacagaaacacccugaccggccaauuacuauucgaauguaaacuauacucagaagguuacauagcacucagcuaccccggcuccggcccccuaaccuuccccacagauggcuuuuucgaagucgucuccugggucccccgccuauaccaacuugccuccguagguucccucgccacaggacgcacccucaaacaguaa

SEQ ID NO: 37750 - RNA, 1626 nt, Artificial Sequence
  derived and/or modified sequence opt11 from VP1__Norovirus_and/or_Norovirus-like__KR349276
augcgcaugucagacggggccgcccccaaagccaacggcucugaagccaacggacaagaccucgucccaaccgccgucgaacaagccguacccauccaacccgucgccggcgccucacuagcagcccccgccgccggccaaauuaaucaaauugaccccuggaucuuucaaaacuucguacaaugcccacucggcgaguucuccaucucaccccgcaacacccccggcgaaauccuguucgaccuagcccucggccccggacucaacccauaccucgcccaccuuuccgcuauguacacgggaugggucggcaacauggaaguacagcuaguacuugcaggcaaugcauucaccgcaggaaaagucguugucgcccuaguaccacccuauuuccccaaaggcagucuaaccacugcgcaaaucacaugcuucccacacgucaugugcgacguucgcacacucgaacccauccaacucccccuccuagacguaagacgcguccuuuggcacgccacacaagaccaagaagaaucaaugcgccucgucugcaugcuauacacaccccuccgcaccaacucccccggagaugaauccuucgucgucucuggccgccugcucuccaagcccgccgcagacuucaacuucgucuaccuaacacccccaauagaacgaaccauauacagaaugguagaucugcccgucuuacaaccccgccucugcacacaugcccgcuggccagccccagucuacggccuccucguagaccccucccuaggauccaacccacaauggcaaaacggacgaguccacgucgacggcacauuacucggcaccacaccaaucucaggcucaugggucucacucuucgcagccgaagccgccuaugaguuccaauccggcacaggcgaagucgccacauucacccuuauagaacaagacggcuccgcuuacgucccuggcgaacgugcagcaccccucggcuaccccgacuucucuggucaacuagaaaucgaaguacaaaccgaaaccaccaaaaccggagacaaacucaaaguaacaaccuucgaaaugauccugggaccuaccacaaacgucgaccaagccccauaccaaggccgcguauacgcaucccuuacgaccgccgcaucccuugauuuggucgacggccgcguacgagcaguaccacgaucaauauacggcuuccaagauguaaucccagaauacaacgauggccuccuagucccccuugccccucccauuggccccuuccucccuggcgaaguccuccuacgcuuccgcacauacaugcgccagaucgacuccagcgacgccgcugccgaagcaauagacugcgcccucccucaagaguucguuucuugguucgccucuaacgccuucacaguacaauccgaagcccuccuccuccgcuaccgaaacacacucaccggccaacuacuauucgaaugcaaacuuuacuccgaaggcuacaucgcacucucuuacucaggcuccggcccacuaacauucccuacagacggcuucuucgaagucgucagcuggggcccccgacuuuaccaacucgccuccguuggaucgcucgccacaggacgcacacuaaaacaauaa

SEQ ID NO: 37751 - RNA, 1626 nt, Artificial Sequence
  derived and/or modified sequence opt11 from VP1__Norovirus_and/or_Norovirus-like__KM102449
augcgcauguccgacggagcagcccccaaagccaauggaucagaagccaucggccaagaccuaguccccacugcaguagaacaagcgguaccaauacaacccguugccggugcagcccuugcagcccccgcagccggacaaaucaaccagaucgaccccuggauauuucaaaacuuuguacaaugcccccucggcgaauuuucuaucucaccccgaaacacccccggcgaaauacucuucgaucucgcccuaggaccgggccuaaacccauaccucgcacaccucuccgcaauguacacaggcuggguuggcaacauggaaguccaacucguccucgccggcaacgccuucaccgccggcaaagucguagucgcacucgucccacccuacuuccccaaaggcucccucacuacugcacaaauaaccugcuucccacacguuaugugcgacguccgcgcccuagaaccaauacaacuaccacuacuagacguccgccgaguacucuggcacgccacgcaagaccaagaagaauccaugcgccucgucugcaugcuguacacaccacuacgaaccaacucccccggagaugaaucauucgucgucuccggccgccuccuaagcaaacccgccgcugacuuuaacuuuguauaccucacaccacccaucgaacgaaccgucuaccgcauggucgaucuaccaguccuccaaccucgucuaugcacucacgcccgcuggcccgcucccguauacggccugcucgucgaccccucccuacccuccaacccccaauggcaaaacggccgcguacacgucaacgguacccuccuaggaacaacucccgucucaggguccugggucagcugcuucgccgccgaagcagccuacgaguuccaaagcggcacuggcgaaguggcaaccuucaccaugauagaacaagacggaucagcauacgucccaggugaccgcgcugcaccccucggcuaccccgacuucucuggacaacucgaaaucgaaguccaaaccgaaacgaccaaauccggagacaaacucaaagucaccacauucgaaaugauccucggaccaacaacaaacgcagaccaagccccauaucaagguaagguauacgccuccuuagcagccgccgcaccccucgaucucgucgacggccgcguccgcgcagucccccgauccguauacuucuuccaagacguccuacccgaauacaacgacggacuccucgucccacuugccccaccccucggacccuuccuccccggcgaaguucuccuacgauuccggaccuacguccgucaacucgacaccgcagacgccgccgcccaaccaauugacugcgcacucccccaagaguucaucagcugguucgcuucaaauucauucaccguccaaucggaagcccuccucauccgcuaucgcaacacacucacgggccaacuccuauucgaagcaaaacuauacagcgaaggcuacauugccgucuccuacuccggcucaggcccccucacuuuccccaccgacggauucuucgaagucguaucauggguacccagacucuuucaauuagccuccgucggcagccuagcaaccggccgcacccugaaacaauaa

SEQ ID NO: 37752 - RNA, 1626 nt, Artificial Sequence
  derived and/or modified sequence opt11 from VP1__Norovirus_and/or_Norovirus-like__KC792553
augcgcaugucugacggggcugccccaaaagccaacggauccgaagccucuggccaagaccucgucccaaccgccgucgaacaagcugucccaauccaaccaguagccggugccgcacucgccgcccccgccgccggccaaauaaaccaaaucgaccccuggauauuccaaaauuucguccaaugccccuuaggagaauucuccauaucaccucgcaacacacccggggaaauccuauucgaccucgcccucggacccggccucaaccccuaccucgcacaccucuccgccauguacaccggaugggucggcaacauggaaguacaacuaguacucgccggaaacgccuucaccgccggcaaagucgucgucgcccucgucccccccuacuuccccaaaggcucccucacaacagcccaaauaacaugcuucccccacgucaugugcgacguucgcacacuagaacccauacaacucccccuccucgacguccgccgaguacucuggcacgccacacaagaccaggaagaaucaaugcgccucguuuguauguuauacacaccccuccggaccaacucccccggagacgagucauucguagucucuggacgccuccucaguaaacccgcugcagauuucaacuucguauaccucacgccgccaaucgaacgcaccauuuaccgcauggucgaccuccccguacuccaaccccgacucugcacccacgcccgcuggccugcaccaguuuacggccuucuagucgacccaucacuccccuccaauccgcaauggcagaacggccgcguacacguagacggaacacuccugggcacaacacccgucucaggcuccugggucucauguuucgcagccgaagcugccuacgaauuccaaucaggcaucggccaaguggccaccuucacaaugaucgaacaagauggauccgccuacguuccaggcgaccgcgcagcgccccucggauaccccgacuacuccggccaacuagaaauagaaguccaaaccgaaaccacuaaagccggcgacaaacucaaagucaccaccuucgaaaugauccucggcccaacaacaaacgccgaccaagcuccuuaccaaggccgcgcuuacgcaagccucaccgccgccgccagccuagaucuugucgacggccgcguacgagccgucccccgcuccaucuacuccuuccaagacguacuacccgaauacaacgacggccuucuaguaccccuugcccccccucucggacccuuccuacccggagaaguccuccuccgcuuucgcacauacaugagacaacucgacacagccgacgcagccgcucagcccaucgacugcgccuuaccacaagaauucguuucuugguucgccucaaacagcuucaccguccaaucagacgcucuucucguccgcuaccgcaauacccucacaggccaacuacuauucgaagcaaaauuauacucagaagguuauauagccguaaguuauucuggaucagguccacucaccuucccugcagacggcaucuucgaaguagucuccugggucccaagacucuuccaacuagccuccgucgguucucuagccaccggccgaacccugaaacaauaa

SEQ ID NO: 37753 - RNA, 1626 nt, Artificial Sequence
  derived and/or modified sequence opt11 from VP1__Norovirus_and/or_Norovirus-like__AB809991
augaaaauggccuccaaugacgccgccccuucaaacgauggcgcagccucucucguucccgaagccaucaacgaaaccaugccacuagaacccgucgccggcgcaagcaucgccgccccaguagcuggacaaaccaacauuaucgacccauggauccguacaaacuucguccaagcaccaaacggcgaguucaccgucuccccacgcaacucccccggcgaaauccuccucaaccuagaacuaggccccgacuuaaaccccuaccuagcccaucucucacgcauguacaacggauacgccgguggcgucgaaguccaaguacuccuagcaggcaacgccuucacagccggcaaaauccuuuucgccgcaaucccucccaacuuccccgucgacaugauaagccccgcacaaauaaccaugcucccucaucuaaucgucgacguacgcacacucgaaccaauaaugauaccucuccccgacguaagaaacgucuucuaccacuucaacaaucaaccccaaccacgcaugcgacucgucgccaugcuauacacaccccuucguuccaacggcuccggcgaugacguuuucaccguuucgugccgcguccucacccgaccaacccccgacuucgaguucaucuaccucguaccaccuagcguugaauccaagaccaaacccuucacacuacccauccucacaaucuccgaauuaaccaacucucgauuccccauccccauagaacaacuauauaccgcccccaacgaaaacaacgucguccagugucaaaacggccgaugcacccuggacggcgaacuucaaggcaccacccaacuccucuccucggccguaugcucuuaccguggccgaaccgucgcaaacucaggcgacaacugggaucaaaaccuccuccagcucacauacccaucuggcgccucauacgaccccaccgacgaaguucccgcaccccucggaacacaagacuucuccggcauacucuacggcguccucacccaagacaacgucucggaaggcacaggagaagccaaaaacgcaaaaggagucuauauauccaccaccagcggcaaguucacccccaaaauaggcucaaucggccuucauucaauuaccgaaaacguccaccccaaccaacaaucucgcuucacaccagucggcgucgcccaaaaugaaaacacccccuuccaacaaugggucuuaccacacuaugccggcgcccucgcccuaaacacaaaccuagcccccgccgucgcaccaaccuuccccggcgaacaacuccucuucuuccgcucccgugucccaugcguacaaggccuccaaggccaagacgccuucauagacugcuuacucccacaagaauggguaaaccacuucuaccaagaagccgccccaucccaagccgaugucgcucuaauccgcuacgucaaucccgacaccggccgcaccuuguucgaagccaaacuccaccgcuccggcuucaucaccgucucacacaccggcgccuacccauuagucguucccccaaacggccacuuccgcuucgacuccugggucaaccaauuuuauucccucgcccccaugggcacuggaaacggacgccgucgcgucuaa

SEQ ID NO: 37754 - RNA, 1626 nt, Artificial Sequence
  derived and/or modified sequence opt11 from VP1__Norovirus_and/or_Norovirus-like__AB809990
augaaaauggccucgaacgacgcagccccguccaacgacggcgccgccucccuaguacccgaagcaaucaacgaaacaaugccccuugaacccgucgcaggagcuagcaucgccgcccccgucgccggccaaaccaacaucaucgacccauggaucagaaccaacuuuguccaagcacccaacggcgaguucacagucucaccccgcaacuccccaggcgagauccuccucaaccuagaacucggaccagaccuaaacccauaccucgcacaccuuuccagaauguacaacggauacgccggcggaguagaaguccaaguccugcucgccggcaacgccuucacagccggcaaaauccuuuucgcagcuaucccacccaacuuccccguugacaugaucucucccgcccaaaucacaaugcucccacaccuaaucgucgacguacgcacucuagaaccuaucaugaucccacuccccgacguccguaacgucuuuuaucacuucaacaaccaaccacaaccacgcaugcgccuagucgcaauguuauacacaccccucagauccaacggcucaggcgacgacguauucacuguaucaugccguguccuaacccgccccacaccugacuucgaguucaucuaccuaguuccucccagcguugaauccaaaaccaaacccuucacgcuacccauacucaccaucucugaacuaacaaacucccgauuccccauccccaucgaacaacucuauaccgcccccaacgaaaacaacgucguccaaugccaaaauggucgcugcacccucgacggugaacuccaaggaaccacacaacuccucuccucugccguaugcuccuaccguggacgcaccgucgcaaauuccggcgacaacugggaccaaaaccuacuccaacucaccuaccccucaggagccuccuacgacccaacagacgaaguccccgcaccccuuggcacccaagacuucuccggcauauuauacggcguccucacccaggacaacgucagugaagguaccggcgaagccaaaaacgccaaaggagucuacauaucuaccacuuccggaaaauucacccccaaaauaggauccaucggccuacacucaauaaccgaaaacguccacccaaaccaacaaucccguuucacacccgucggcgucgcccaaaacgaaaacacgcccuuccaacaauggguccuaccacacuacgcuggcgcccuugcccuaaacaccaaccucgccccagccguagccccuaccuuccccggcgaacaacucuuauucuuccgaucucgaguccccugcguccaaggccuccgcggccaagacgcauucaucgacugccuccuaccacaagaauggguaaaccacuucuaccaagaagccgcaccuucccaagccgacguugcccucauacgcuacguaaaccccgacacaggucgaacccuuuucgaagccaaacuacaccgcucaggcuucaucaccgucucccacaccggcgcauacccccuaguaguucccccaaacgggcacuuccguuucgacuccugggucaaccaauucuacagucuagcaccuaugggaaccgggaacggccgccgccgcgucuaa

SEQ ID NO: 37755 - RNA, 1626 nt, Artificial Sequence
  derived and/or modified sequence opt11 from VP1__Norovirus_and/or_Norovirus-like__AB809977
augaaaauggccagcaacgacgcagcaccaucuaacgacggcgccgcaucacucguacccgaagcaauuaacgaaaccaugccccuagaaccugucgcaggcgccucaaucgccgcccccgucgccggacaaaccaacauaaucgaccccuggauccgcaccaacuucguccaagcacccaacggggaguucacuguaucaccccgaaacuccccaggagagauccuacucaaccucgaacuuggacccgaccuuaaccccuaccucgcccaccucucccgcauguauaacgguuacgccgguggaguagaaguccagguccuccucgccggcaacgccuucaccgcuggcaaaauccuauucgcagccauucccccuaacuuccccguagacaugaucucccccgcccaaauuacaaugcuaccccaucucaucguggacguccguacccucgaacccauaaugaucccccucccugacguucgcaacguauucuaccacuuuaacaaccaaccucagccucgcaugcgccuagucgccaugcuauacacuccccuccgauccaacgguucaggcgacgacguguucaccgucucaugucgcguccucacccgucccacccccgacuucgaguucaucuaccuuguaccacccuccguagaaucaaaaacaaaacccuucacccuacccauccucaccaucuccgaacuuaccaacucccguuuccccauccccauagaacaacuauacacagcccccaacgaaaacaacgucguacaaugccaaaacggccgcugcacccuagacggagaacuccaaggcacaacacaacuccucucauccgcagucugcucuuaccguggacgaacaguagcaaacucaggcgacaacugggaccaaaaccuccuacaacucaccuaucccucaggagccuccuacgaccccaccgacgaaguccccgccccacucggaacccaggacuucuccggaauccucuacggcguccuaacccaagauaaugucuccgaacgcacaggcgaagcuaaaaacgcaaaaggcaucuacauauccacaacuuccggcaaauucacacccaaaaucggcuccaucggucuccacucaaucaccgagaacguacaccccaaccaacaauccagauuuacccccgucggugucgcccaaaacgaaaacacacccuuccaacaauggguccucccucacuaugccggcgcacucgcccucaacacaaaucucgccccggccgucgccccuaccuuccccggcgaacaacuacuauuuuuccguucccgaguacccuguguccagggccuucaaggccaagacgccuucaucgacugccuacuuccacaagagugggucaaucacuucuaccaggaagccgcccccucacaggccgacgucgcucucauccgcuacguaaaccccgauacgggacgaacacucuuugaagcaaaacuccaccgcuccggcuuuauaacagucucccacacaggugccuacccccucgucgucccacccaauggucacuucagauucgacuccuggguaaaccaauucuacucacucgcccccauggguaccggcaacggccgacgccgagucuag

SEQ ID NO: 37756 - RNA, 1626 nt, Artificial Sequence
  derived and/or modified sequence opt11 from VP1__Norovirus_and/or_Norovirus-like__AB809987
augaaaauggcgucaaacgacgcagcacccagcaacgacggcgccgcaucccucgucccugaagcuaucaaugaaaccaugccccucgaaccagucgcaggagcauccaucgccgcucccgucgccggucaaaccaacauaauagacccauggauccguaccaacuucguccaagcgcccaacggcgaguucacagucucaccccgcaacucaccaggagaaauacuccuuaaccucgaacucggccccgaccuaaaccccuaccucgcccacuuaucucgcauguacaacggcuacgccggaggcgucgaaguccaaguccuacuugccggaaacgccuucaccgccggcaaaauauuauucgccgcaaucccacccaacuuccccgucgacaugaucucccccgcccaaaucacaaugcucccccaucuaaucgucgacguacgcacacuugaacccaucaugauaccccuccccgacguccguaacgucuucuaccacuucaacaaccaaccccagccccgaaugcgccuaguagcgaugcucuacacaccccuccgcucaaacggcuccggcgacgacguauucacagucucuugccgugugcucaccagaccaaccccagacuucgaguucaucuaccucguaccacccuccguugaauccaagaccaaacccuucacccucccaauccuaaccaucagcgaacuaaccaacucccgauuccccauacccaucgaacaacucuacaccgccccaaacgaaaacaacgucguccaaugccagaacggacgcugcacccucgauggcgaacuccaaggaacaacgcaacuccuuucaucagccgucugcuccuaccguggccgcaccgucgccaacuccggagacaacugggaccaaaaucuucuccaacuaacauaccccucaggcgcauccuacgaccccaccgacgaaguacccgcaccccuuggcacacaagacuucuccgguauccuguacggcguccucauacaagacaacguauccgaaggcaccggcgaagccaaaaaugccaaaggcgucuacauaucuaccacguccggcaaauucacccccaaaaucggaagcaucggacuccauuccaucaccgaaaacguccacccuaaccaacaauccagauucacacccgucggcgucgcccaaaacgaaaauaccccauuccaacaguggguacucccccacuacgccggcgcccuagcccuaaacaccaaccuagcuccagcagucgcacccaccuucccgggggaacaacuccucuucuuccgcucacgcguccccugcguacaaggccuacgcggccaagacgcguucaucgacugccuacucccacaagaaugggucaaccacuucuaccaagaagccgcucccucacaagcugacgucgcccuaauacgauacgucaaccccgacaccggucggacccucuucgaagcuaaacugcaccgcuccggcuucaucaccguaucacacaccggcgcauauccccuaguagucccaccaaacggccacuuccgcuucgacuccuggguuaaucaauucuacucccucgccccaaugggcaccggcaacggaagacgacgcgucuaa

SEQ ID NO: 37757 - RNA, 1626 nt, Artificial Sequence
  derived and/or modified sequence opt11 from VP1__Norovirus_and/or_Norovirus-like__AJ844469
augaugauggcaucuaaagacgcccccuccaacauggacggcacauccggagccggacaacucguccccgaagcaaacaccgccgaucccaucccucucgaacccguugucggugccgccaccgccgccgccacugccggccaagucaacaugauugacccauggauaaugaacaacuucguccaaucacccgaaggcgaauuuaccauauccccaaacaacaccccgggcgacauacucuucgaccuacaacucggcccccaccuuaaucccuuccuccaacaccucucccaaauguacaacggcuggguaggaaauaugcgcguccgcauccuccucgccggcaacgccuucucagccggcaaaaucauaaucugcugcgucccacccggcuucaccgcacaaaacaucucaaucgcacaagcuaccauguucccacacguaauugccgacguccgcguacucgaaccaaucgaaaucccacuagacgacguccgcaauguacucuuccacaccaacgaaaacaaaccgaccaugcgccuccucugcaugcuuuacacuccccuccgcgccggaggcgccuccgcaggcaccgacccauuugucaucgccggccgcguccuaaccugccccucacccgacuucaauuuucucuuucuggucccaccaagcgucgaacagaaaacccgccaacucaccguccccaacaucccgcucaacaaccuauccaacucuagagucccagccaugauaucaaaaauggccaucucuuccgacgccaaccaaguaguccaauuccagaacggccgaugcaccaccgacggccaacuccucggaacuacacccauauccgccucacaagucgcacgcauacgaggaaaagucuucuccaccucuuccggaaaaggacuuaaccuuuccgaacuagacggcucaccuuaccacgcuuucgaaucccccgcccccgucgguuucccggaccuaggcuacugcgacuggcacgucuccuccuucaaagccgaccacaacuccucauccgacccgauaucacgacucgacaucaaacaaggcgccuccuucgcuccccaccuaggcuccaucgaauauaccaccucccaaaaccccgacggcgaccaacuaggcacccuuacuuggaucagcucaccaucagacgacacccccggacacggaacaauaaaccucuggaaaauccccucguacggaucgacugucaccgaauccguccaccuagccccacccaucuacccacccggguucggcgaaacgcucgucuacuucaugucugacuuccccauaggacacacuaacuccaacauggcccaaguaccauguacccuaccccaagaguucguagcccacuuuguaaacgaacaagcccccguccgaggcgacgccgcccuucuccacuacgucgacccugacacccaccgcaaccuuggcgaguucaaacucuaccccgaaggcuauauaaccugcgugcccaacacuggcggcggaggaccacaaucccuacccaucaacggcgucuucaucuucucuuccugggucuccagauacuaccaacuaaaaccagucgguacagccggccccgcccgucgacuauaa

SEQ ID NO: 37758 - RNA, 1626 nt, Artificial Sequence
  derived and/or modified sequence opt11 from VP1__Norovirus_and/or_Norovirus-like__AY675555
augaaaauggcuuccaaagacgccccauccaacauggacggcaccuccggcgcgggccaacucguacccgaagccaacacagccgacccaaucccccuagaaccaguagucggcgcugccaccgccgcagccaccgccggccaagucaacaugaucgaccccuggaucaugaacaacuucguacaaucaccugaaggagaauuuaccauaagccccaacaacacccccggugacaucuuauucgaccuccaauugggaccccaccuuaaccccuuccuccaacaccuaucccaaauguacaacggcuggguaggaaacaugcguguucgcauccuacuagcaggcaaugcauucucugccggcaaaaucaucaucugcugcgugcccccaggcuuuacagcccaaaauaucagcaucgcucaagcuaccauguucccccacguuaucgcugacguucgaguccucgaacccaucgaaaucccccucgacgacguacgcaacguccuuuuccacacaaaugaaaaccgaccaaccaugcgacuccucugcaugcuuuacacaccacuucgagcuggcggagccuccgcaggcacagaccccuucgucaucgccggacgaguccuaaccugcccuucacccgacuucaacuuccuuuuccucgucccaccauccguugaacaaaagacccgccaacucaccguacccaacaucccacucaacaaucucucaaacuccucaguacccgccaugauaaacaaaauggccaucucaucagacgcuaaccaaguuguucaauuccaaaacggccgcugcaccaccgacggucaacuacugggcacaacaccaaucucggcaagccaaguugcacgaauccgcggaaaagucuucuccaccucaucagguaaaggacuuaaccuauccgaacuagacggauccccauaccacgccuucgaaucccccgcaccagucggcuuccccgaccucggccacugcgacuggcacgucucgucauucaaagccgaccaaaacucaagcggcgaccccaucucacgacuagacauuaaacaaggcgcauccuuugcaccccaccugggcuccaucgaauacaccacuucccaaaacccugacggcggccaacucggcacacucacguggaucuccucccccuccgacgacacgcccggccacggcaccaucaaccuauggaaaauaccaucauacggcuccacagucacagaauccguccaucuugccccgcccauauacccucccggcuucggcgaaacccucgucaaccucauguccaacuuccccaucggccauaccaacagcaacauggcccaaguccccugcacccucccucaagaguucguugcccacuucgucaacgaacaagcuccuguccgaggagacgcagcccuccuccauuacguagacccggacacucaccgcaaccuaggcgaguucaaacucuacccagaaggcuacauuaccugcguacccaacaccggaggaggcggaccccaaucccuuccuacaaauggcguauucaucuucucaagcugggucucccgauacuaccaacucgaaccagucggaaccgcuggccccgcccgccgccuauag

SEQ ID NO: 37759 - RNA, 1626 nt, Artificial Sequence
  derived and/or modified sequence opt11 from VP1__Norovirus_and/or_Norovirus-like__EU085479
augaagauggccaguuccgacgccacacccucaaacgacggagcugcaggacuuguaccugaaaucaacaacgaggccauggcccuagaccccgucgcaggcgccgcaauagccgcaccccucaccggccagcaaaacauaauagaccccuggaucaugaauaacuucguccaagcccccggcggcgaguucaccguaucuccccgaaacuccccaggugaaguccuccuuaaccucgaacucggaccagaaaucaaccccuaccuggcacaccuagccaggauguacaacggauacgccggcggauucgaaguacaaguaguccucgccggcaacgccuucaccgcaggcaaaaucauauuugcagccauacccccuaacuuucccaucgacaaccuuucagcagcacaaaucacaaugugcccccacguaaucguggacguacgucaacucgaacccguaaaucuacccaugcccgacguucgcaacaacuucuuccauuacaaccaaggcagcgacucccgucuacgcuuaaucgcaaugcucuacacaccccuccgcgcaaacaacuccggcgacgacguuuucaccgucuccugccgcguccucacccgccccucucccgacuucucauucaauuuccucgucccucccaccguagaaucaaaaaccaaacccuucacccuccccauccucaccaucucagaaaugucaaacucccgcuuccccguucccauagacucccuucacaccucccccacugaaaacaucguuguacaaugccaaaacggacgcgucacucucgacggcgaacucaugggcaccacccaacuacucccaucacaaaucugcgccuuccggggcguacucacccgcagcacaucucgcacaagcgaccaagccgacacagccaccccacgccuauucaacuauuacuggcacauccaacuugacaaccuaaacggaacccccuacgaccccgccgaagacaucccaggcccccucgguacuccugacuuccgcggaaaagucuucgggguagcaagccaacgcaaccccgauucaacaacuagggcccacgaagccaaaguagacacaacagccggccgcuucacccccaaacucgggucacucgaaauaucaacugaaucuagcgacuucgaccaaaaucaacccacccgcuucaccccagucggaaucggcguagaccaugaaaccgacuuccaacaauggucacuacccgacuacuccggccaauucacucacaacaugaaccuagcccccgcaguugcccccaacuucccaggagaacaacuccucuucuuucgcucccagcuccccucuagcggcggccgcuccaacggcauccucgauugucuaguaccacaagaauggguccaacacuucuaucaagaaucagcccccgcccaaacccaagucgcccuaguccgcuacguuaacccugacaccggaagaguccuauucgaagccaaacuccacaaacuaggcuucaugaccauagccaaaaacggagacucacccaucaccgucccucccaacggguacuuccgcuucgaauccuggguaaaucccuucuacacccucgcccccaugggcucaggcuaa

SEQ ID NO: 37760 - RNA, 1626 nt, Artificial Sequence
  derived and/or modified sequence opt11 from VP1__Norovirus_and/or_Norovirus-like__AF542090
auggcaaguaaagacgcaccagucuccggcaccgacggagcagccggccuugucccagaaagccaacaagaagucuuaccacuagaaccggucgccggcguacaacuagcugccccaguggccgggcaauccaacaucauagaucccuggauccgcaugaacuucguacaagcacccgccggcgaguucacagucucaccccgaaacgcccccggagaaguacucauagaccucgaacucggcccugaacuaaacccauaccuaaaccaccucgcccgaauguacaacggcuacgucggaggcauggaaguagaagucguacuagccggcaaugccuucacagccggcaagguccucuuugccgccguaccaccauccuuccccacccacggcaucacugccgcgcaagccacuaugcucccacacgucaucgucgacguccgccagcuagaacccguaagacuaccccuccccgacguccggaacgucauguuccacuuuugccaagaaaacaaagaaccccgaaugcgcaucguagccauccuauacaccccucuccgcgcaaacggcgccggagacgauguauucaccgucuccugccgcguacuaacccgccccucacccgacuucgacuucauauuccuagucccgcccucaguagaauccaaacuaaaacaauucacacuccccaaccuacaacccaacgaaaugacaaacagccguuuccccacaucuguaacccaacucuauaccucacccaacacuaaucuaguaguccaauuccagaacggccgcugccaacuagacggcacacuacugggcacaacucccguccgcgccgccgacaucugcucauuccgaggaauaaccucagccgaggucgacaccacagacucaucacgcguggccggcucccaccgaguaaugguccaacuaaaagaacccgacggcgaagaguucuccccgacaggcccaaaccccgcaccagucggcacacccgacuuccaagccgccaucuucgggacccuaucccaacgcaacaacaccggcggcucaggacaaaacaguaaccggucccacuucgccuacuucuacacacgaaacccuacauucgcaccagguaucggcaccguagucuuuuccuuugacaccaccgacuuccaaaaccgacaacccacaaaauucucgccauccggcgucuacgacgacgacucaucagaacccuucaaccaauucucacuacccuacuacaacggcucccucggcgccgucgacgccggcaaacucgccccgcccguagcccccaacuaccccggcgaacaaauacuauacuuccggggaaacauccccuucaaaggaggcuacggcggcggagaaauugacugccuccuaccccaggaauggauaacccaccucuacgccgaacaagccccaacacaaggugacgcagcccuccuucgcuacuacaaccccgacaccggucgaguccuauucgaaugcaaacuccaccgcgaaggauucauaacaauaaacuacaccggaagcaacgcacuggccguccccgucaacggaguauucagauucgaaggauggguaaacaaauucuacacccucacccccauguaa

SEQ ID NO: 37761 - RNA, 1623 nt, Artificial Sequence
  derived and/or modified sequence opt11 from VP1__Norovirus_and/or_Norovirus-like__KM386680
augaaaauggccucaaaugacgccacccccucaaacgacggcgccgccggcuuaguccccgaguccaacaacgaagccauggcccucgaacccgucgucggugccagccucgccgcaccagucacaggucaaacuaauaucauagaccccuggauacgcacaaacuucguucaggccccaaacggagaguucaccguauccccacgaaacuccccaggcgaaauccucgucaaccucgaacuaggcccagaacucaaccccuaccuagcccaccuugcucguauguacaacgguuacgcaggcgggauggaaguacaagucaugcuagcagguaacgccuuuaccgcaggaaagauaauuuucgccgcagucccacccuauuuccccgucgaaaaccucuccccgccccaaaucaccauguucccccacgucauaaucgaugucagaacacuagaacccguccuacuccccaugcccgacguaagaucuacccucuuccacuucaaccaaaaggacgaacccaaaaugcgccuugucgcaaugcucuacacaccccuacguucaaacggcuccggcgacgacguauuuaccguuuccugccgcauccucacucgacccucuccugaguucgacuucacauaccucgugccacccaccgucgaauccaaaaccaaacccuucacccuuccaguccucacacucggcgaacucuccaacagucgcuucccacucuccaucgacgaaauggucacgucacccaaugaauccaucguaguacaaccacaaaacggccggguaacucucgacggcgaacuacucggcaccacacagcuccaagcaugcaacaucugcucaauucgcggcaaagucaccggacaaguaccgaacgaacaacauauguggaaccuagaaauuaccaaccuaaacggcacacaauucgaccccacagacgacgucccagcaccccuuggugucccagacuucgccggugaaguauucggcguccucucacagcgcaaccgcggcgaauccaaccccgccaacagagcacacgacgcagucgucgcaacauacuccgauaaauacacaccuaaacucggccucguccagauaggcaccuggaacaccaacgacgucgaaaaccaacccaccaaauucacccccauaggucuaaacgaaguagcaaacggccaccgcuucgaacaauggacacuuccccgcuacagcggcgcucucacccuaaacaugaaccuugccccugcagucgcaccccuauuucccggcgaacgacuacucuucuuccgaucuuacgucccccuaaaaggaggcuucggcaacccagcaaucgacugccucgucccccaagaauggguccaacacuucuaccaagaauccgccccuucccucggagauguagcauuaguccgcuacgucaaccccgacacaggccgcguccuauucgaagccaaacuacacaaaggcggauuccucacugucucauccacauccacaggccccgucgucguaccagccaacggcuacuuccgcuucgacucguggguaaaccaauucuacucgcuugccccaaugggaaccggcaacggccgcagacgcuuccaauaa

SEQ ID NO: 37762 - RNA, 1623 nt, Artificial Sequence
  derived and/or modified sequence opt11 from VP1__Norovirus_and/or_Norovirus-like__AF397156
augaaaauggcauccaaugacgcaacacccucaaacgacggcgcugccggcuuaguacccgaauccaacaacgaagccauggcacuagaacccgucguaggcgccucccucgcggcccccgucaccggccaaacuaacaucauagaccccuggauccgcaccaacuucguccaagcgccgaacggcgaguucacagucucaccccgcaacuccccaggcgaaauccucgucaaccuagaacucggccccgaacucaaccccuaucucgcccaccuagccaggauguauaacggcuacgcaggcggcauggagguacaaguuaugcucgcaggaaacgccuucaccgcaggaaaaauaauauucgcagccgucccaccuuacuuccccgucgaaaaccucagccccucacaaaucaccauguucccacacgucaucaucgacguccgaacgcuagaaccaguccuacuuccaaugcccgacguccgaucaacccuuuuccacuucaaccaaaaagacgagcccaaaaugcgucucguugcaaugcucuacacaccccuacgcagcaacggcuccggcgacgacguauucaccguauccugccgaauccuaacccgccccagccccgaguucgacuucaccuaccucguacccccaacaguagaauccaaaaccaaacccuucacccuacccguauuaacccuaggagaacucagcaacucccgcuucccccuauccaucgacgaaauggucaccucccccaaugaaucaaucgucgugcaaccccaaaacggccgagucacccuagacggcgaacucuuggguacuacccaacuccaagcgugcaacauaugcuccauccgcggaaaagucaccggacaagugccaaaugaacaacacauguggaaccucgaaaucacaaaccuuaacggaacacaauucgaccccacggacgacguacccgccccucuaggcgugccagacuucgccggcgaagucuuuggcguccucucucaacgcaaccgcggcgaaagcaacccagccaaccgagcacacgacgcaguuguagcuacauacucagacaaauacaccccaaaacucggccuaguccaaauaggaacauggaacaccaacgacgucgaaaaccagcccaccaaauucacacccaucggacucaacgaaguagccaacggacaccgcuucgaacaauggacccuaccgcgauacuccggagcccuaacccucaacaugaaccucgcccccgccgucgcaccacuauucccuggcgaacgauuacuuuucuuccgcucguacgugccccucaaaggcggauucggcaaccccgccaucgacugccucguaccacaggaauggguccaacacuucuaccaagaaucugccccaucccucggcgacguagcccuaguucgguacgucaaccccgacacuggccgaguucuuuucgaagcaaaacuacacaaaggcggcuuccucacagucagcuccaccuccaccggcccugucgucguaccagccaacggcuauuuccgcuucgaccccuggggaaaccaguucuacucccuagcacccauggguaccggcaacggaagacgccgcuuccaauaa

SEQ ID NO: 37763 - RNA, 1623 nt, Artificial Sequence
  derived and/or modified sequence opt11 from VP1__Norovirus_and/or_Norovirus-like__AF414422
augaaaauggccagcaacgacgccacccccuccaaugacggagccgccggccucguccccgaauccaacaacgaagcuauggcccucgaaccaguagucggcgccucacuagccgcuccagucaccggccaaaccaacaucauagaccccuggaucagaacaaacuucguccaagccccaaacggcgaauuuacagucucuccccgcaacuccccuggcgaaauccucguaaaccuggaacuggguccugaacugaaccccuaccucgcccaucucgcccggauguacaacggcuacgcaggaggcauggaaguccaaguaaugcuggcaggcaacgccuucaccgcagggaaaaucaucuucgcggccguacccccauacuucccagucgaaaaccucuccccaucccaaauaaccauguucccacacgucaucauugacguccgcacccucgaaccaguccuccuccccaugcccgacgugcguucuacccuauuccacuucaaccaaaaagacgaaccaaaaaugcgccucgucgccaugcuauacacaccucuacgcuccaauggcucuggcgacgacguuuucaccgucagcugccgaauacucacccgacccucuccagaguucgacuucaccuaucucgucccacccaccgucgaauccaaaaccaaaccauucacccucccgguccucacgcucggcgaacuauccaauagccgcuucccacucucuaucgacgaaaugguaaccuccccaaacgaauccaucgucguccaaccacaaaacggccgcgucacucucgacggcgaacuccuaggcaccacacaaccccaagcaugcaacaucugcuccauccgcgggaaagucacuggccaaguccccaacgaacaacacacauggaaccucgaaauuaccaaccuuaacggcacccaauucgaccccacugacgacgucccagccccacucggaguacccgacuucgcgggcgaagucuucggcguccucucccaacgcaaucgaggcgaaucaaacccagccaaccgagcccacgacgccgucgucgcaaccuauuccgacaaauacacccccaaacucggacucguacagaucggcacauggaacacaaacgacguagaaaaccaacccaccaaguucacgcccaucggccuaaacgaaguagccaacggccaccgguucgaacaauggacccuccccagauauucaggcgcccugacccucaacaugaaccucgccccagcuguagcuccccucuucccuggagaacgacuccucuucuuccgcuccuaugugccccucaagggcggcuucggcaauccugccaucgacugccucguuccacaagaauggguccaacacuucuaucaagaaagcgcccccucccucggcgacgucgcccuuguucgauacgucaacccagacaccggccgcguccucuucgaagccaaacuccacaaaggugguuuccucaccgucuccucaacuucgaccgguccaguaguaguucccgcaaacggcuacuucggauuugacuccugggucaaccaauucuauucccuugccccaaugggcaccggaaacggccgccgccguuuccaauaa

SEQ ID NO: 37764 - RNA, 1623 nt, Artificial Sequence
  derived and/or modified sequence opt11 from VP1__Norovirus_and/or_Norovirus-like__AF414423
augaagauggcauccaacgacgccacucccuccaacgacggcgccgccggccucguacccgaauccaacaacgaagccauggcccuagaaccugucgucggugcaucacucgcagccccagucaccggccaaacaaacaucauagaccccuggauaagaacaaacuucguccaagccccaaacggcgaguucacugucagcccccgcaacucacccggcgaaauacucguaaaccucgaauccggaccugaacuuaaccccuaccuugcccaucucgcccggauguauaacggcuacgccggcggcauggaaguccaagucaugcucgccggcaacgcauucaccgcaggcaaaaucaucuuugccgccguaccacccuacuuccccguagaaaaccucuccccaucccaaaucacaauguucccccacgugaucaucgauguucgcacccucgaaccaguucuccuccccaugcccgacguccggagcaccccauuccacuucaaccagaaagacgagcccaaaaugcgccucgucgcaaugcuguacacaccccucagauccaacggcucaggagacgacgucuucaccgucuccugccgaauccuaacccgccccucuccagaguucgacuuuaccuaccucguacccccaaccgucgaauccaaaacaaaaccauucacccucccuguccucacccucggagaacuuagcaauucccguuucccucuaagcaucgacgaaauggucacuucccccaacgaaagcaucgucguccaaccccaaaacggccgaguaacccuagacgguggcuuacucggcaccacacaacuccaagccugcaacaucugcucaauccguggcaaagucaccggucaagucccuucagaacaacacauguggaaccuagaaauaaccaaccuaaacggcacccaauucgaccccacagacgacguccccgcuccccucggaguaccagacuucgccggcgaagucuucggaguacuuucucaacgcaaccgcggcgaauccaacucugccaaccgagcacacgacgccguagucgcaaccuacuccgacaaauacaccccuaaacuuggccucguccaaaucggaacauggaacaccaacgaugucgaaaaccaaccaaccaaauuuaccccaauaggccucaacggcguagccaacggccaccgcuuugaacaauggacucuaccccguuacuccggagcccucacucuaaacaugaaccuugcccccgccguagcaccccucuuucccggcgaacgccuccuauucuuccgcucuuacguccccuuaaaaggcggcuucggcaaccccgccaucgauugucuugucccccaagaauggguacaacacuucuaccaagaauccgccccuucgcuuggagacgucgcucuagucagguacgucaaccccgacacgggccgcguccucuucgaagcaaaacuccacaaaggaggauuccuuacugucucuagcaccucaaccggaccaguagucgugccagccaacggcuacuuccgcuucgacucuugggucaaccaauucuacucacucgccccaaugggcaccggaaacggccgacgccgauuccaauaa

SEQ ID NO: 37765 - RNA, 1623 nt, Artificial Sequence
  derived and/or modified sequence opt11 from VP1__Norovirus_and/or_Norovirus-like__GQ856476
augaaaauggccuccaacgacgccgcacccuccaacgacggagccgccggccucguacccgaagucaauaacgaaaccauggcacuggaacccguagccggagcuuccauugccgccccgcucaccggacaaaacaacgucaucgaccccuggauccgccucaacuucguccaggcuccaaacggcgaguucacagucucaccccgaaacucacccggugaaauacuacucaaccucgaacucggccccgaacucaaccccuaccuagcccaccuuucccguauguacaacggcuacgccggcggcgucgaaguccaaguccugcucgccggcaacgccuucaccgcagguaaacucguauucgcugccaucccgccccacuucccugucgacaaccuuuccccgggacaaaucacaauguucccacacgucaucauagacguccgcacccucgaacccguccuucucccccuacccgacgucagaaauaacuucuuccacuauaaccaacaauccgaccaaagaaugcgucucgucgccaugcuauacacaccccuacgcuccaauggauccggugacgacgucuucaccgucuccugccguguacucacacgccccaguccagacuucgacuuuaacuaccucguacccccaacagucgaauccaaaaccaaaccauucuccguacccgugcuaacccuuaacgaacucaccaacucacgguuccccguacccaucgacgccauguacaccucccccaacgacuccaucguaguccaaccucaaaacggccgcgccacuauagacggcgaacuacucggaaccacacaacuuauacccuccggcauaugcuccuuccgcggcaaaauaacaacucaccuggccgacgaccgucaccucuggaacauacaagucucaaaccucaacggaaccccuuucgacccaacagacgacgucccagcuccccuuggcaugcccgauuucuccggccaaaucuucggagucgucucucaacgcgacacaggaaccaauccugccaaucgggcacaugacgccguccuagcaacauauuccgccaaauacaccccaaaacucggcucaguacaaauaggcaccugggacaccgaggaucuacucgaacgccaaccagucaaauucacucccgucggccucaaugaaaucggccaggauaaacacuucgaccaauggguuuuaccaaacuacuccggagcacucggccuuaauaugcaccuggcccccgcagucucaccacucuuccccggugaacgucuccuauucuuccgaucauacaucccccuaaaaggcggucacggcgaccccuucaucgacugccucgucccccaagaguggauacaacacuucuaccaagaauccgcccccgcccaauccuccgucgcccuccuacgcuacguaaaccccgacacaggacgcacucucuucgaagcuaaacugcacaaaggagguuucauaaccgucuccucaaccgaaaaccgacccgucauugucccacccaacggcuacuuucgcuucgacucaugggucaaccaauucuacucccucgcccccaugggcacaggcaacggccgacgucgaaugcaauga

SEQ ID NO: 37766 - RNA, 1623 nt, Artificial Sequence
  derived and/or modified sequence opt11 from VP1__Norovirus_and/or_Norovirus-like__AJ277607
augaaaauggcuuccaacgacgccacccccuccaacgacggcgccgccggccucguacccgaaagcaacaacgaagcuauggcccucgaacccgucguaggagcuucacuagccgcaccagucacuggacaaaccaacauaaucgacccauggaucagaacaaacuucguccaagcccccaacggugaguucacugucuccccuaaaaacucacccggcgaaauccucgucaaccucgaacuaggccccgaacucaaccccuaccuggcccaccucgcacgcauguacaacggcuacgccggcggcauggaaguacaagucaugcucgccggcaacgcuuucacagcuggaaaaauuaucuucgccgccguacccccauacuuccccgucgaaaaccucucccccucacaaaucacaauguucccccacguaauaauagacguccgaacccucgaacccguacuucucccgaugccagacguccgaucaacccuauuccacuucaaccaaaaagacgaacccaaaaugcgccucgucgcaaugcucuacacgccccucagauccaacgguucaggcgacgacgucuuuaccgucucaugccgaauccucacccgccccucacccgaguucgacuucaccuaccucguucccccaaccgucgaaagcaaaacuaagcccuucacacuccccguacuuacgcucggcgaacucuccaacucccgauucccgcucuccaucgacgaaaugguaaccagccccaacgaauccaucguaguacaaccucaaaacggccgaguuacccucuacggcgaacuccucggcacagcccaacuacaggcaugcaacaucugcuccauacgaggcaaaguaaccggccaauuccccaaugaacaaaacauguggaaucucgaaaucaccaaccucaacggcacccaguucgaccuaaccgacgacguucccgcaccgcuaggcguccccgacuucgcuggcgaaguuuucggcguccuaucacaacgaaaccggggcgaaucaaacccugcaaaccgcgcccacgaugcagucguagcaaccuacagcgauaaauacaccccaaaacucggccucguucaaaucggcaccuggaacaccaacgauguugaaaaccaaccaaccaaauucacccccaucggccuuaacgaagucgcgaacggccaccgcuuugaacaauggacccuaccccgguacucaggagcgcuaacacuuaacaugaaccucgcacccgcaguagccccauuauuuccuggcgaacgccuccuauucuuccgaucauacguaccauuaaaagguggauucggcaacccagccauagauugccucgucccacaagaaugggugcaacacuucuaccaagaaucugccccaucccucggcgacgucgcccucguccguuacguuaaccccgacacuggacguguccucuucgaagccaaacuacacaaaggcggcuuccucacaguuuccucaaccuccaccggacccgucgucguacccgccaacggcuacuuccgauucgacuccugggucaaccaauucuacucucuugccccgaugggcacuggcaacggacgucgcagauuccaauaa

SEQ ID NO: 37767 - RNA, 1623 nt, Artificial Sequence
  derived and/or modified sequence opt11 from VP1__Norovirus_and/or_Norovirus-like__AY772730
augaaaauggccagcaacgacgccgcuccauccaacgacggcgccgccggccucgucccagaaguaaacaacgaaaccauggcccuagaacccgucgccggcgccagcauugccgcuccccuaaccggacaaaacaacgucaucgaccccuggauacgccuaaacuucguccaagcccccaacggagaauuuaccgucucuccacgcaacucacccggcgaaauccuacucaaccucgaacuagguccagaacucaaccccuaccucgcccaccucgcccggauguacaauggcuacgccggcggagucgaagugcaaguccuacucgccggauccgccuucacugcaggaaagcucgucuucgccgcuaucccaccccauuuucccguagacaaccucucacccggccaaaucacuauguucccacacgucaucaucgacguccgcacacuugaaccuguccugcucccucuaccagacguccgcaacaacuuuuuccacuacaaucaacaaagcgaccaacgaaugcgacuugucgccaugcucuacaccccacuacgcucaaacggcagcggcgacgacguauucaccguguccugccgaguccucacccgcccuucacccgacuucgacuucaacuaccucguacccccaaccgucgaaucaaaaaccaaaccauucucuguucccguccuaacccucaacgaacucacaaacucccgcuuccccguccccauagacgcuauguacacuucccccaacgacagcaucgucguacaaccacagaacggccgagccaccaucgacggcgaacuacucggcacaacacaacucauccccuccggcaucugcuccuuccgcggcaaaaucacaacucaccucuccgacgacagacaccuuuggaacauccaggucucaaaccuaaacggaacaccuuucgacccaaccgaugauguccccgcuccccucggcaugccagacuucuccggccaaaucuucggcguagugucacaacgcgacaccgguaccaaccccgcaaacagggcccacgacgcagcacuagccaccuacuccgccaaauacacccccaaacucggcucaguccaaaucggcgcaugggacacagaagaccuccucgaacgccaaccagucaaauucucgcccgucggacucuccgaaauaggccaagacaaacauuucgaccaauggguccucccaaauuacucaggggccuuaggacuaaacguacaccucgcacccgccguaucaccucucuuccccggagaacgccuccuauucuuccgcuccuacaucccacucaaaggcggccacggcgaccccuucaucgacugccuaguaccccaagaauggauacaacauuucuaccaagaaucagcucccgcccaaagcucagucgcccuccucagauaugucaaucccgacaccggcagaacccucuucgaagccaagcuccacaaagaaggcuucauuacagucucaagcaccgaaaacagacccguuaucguaccacccaacggcuacuucagauucgacucauggguaaaccaauucuacucucuagcccccaugggaacagguaacggcagacgacguaugcaauaa

SEQ ID NO: 37768 - RNA, 1623 nt, Artificial Sequence
  derived and/or modified sequence opt11 from VP1__Norovirus_and/or_Norovirus-like__KT315718
augaaaauggcaucaaacgaugccgcuccguccaacgacggagcagcaggccucgucccugaaggcaacaaugaaacacucccccuagaacccguagccggagccgccauagcagcccccgucaccggccaaaacaacaucauagaccccuggaucagaaccaauuucguccaagcccccaacggcgaguucacagucagcccccgcaacucccccggcgaaauccuccucaaccucgaacuaggccccgaccuaaaccccuaccuagcucaccuaucccgcauguacaacgguuacgccggcggagucgaaguucaaguccuucuagccggcaacgccuucaccgccggcaagauccuauucgccgccgucccacccaacuuccccguugaguuccuuucccccgcccagauaaccaugcucccccaccuuauugucgacguacgcacccuugaacccaucaugaucccccuccccgacguccgcaacacauucuuccacuauaacaaccaaccaaacucccgcaugagacucguugccaugcuauacacucccuuacgcuccaacggcuccggcgacgauguauuuacagucucaugccgcguccuaacucgccccacccccgacuucgaauuuacuuaccucgucccacccuccgucgaaucaaaaaccaaacccuucucucucccgauacucacccuauccgaacucacaaacucccguuuccccguccccaucgacucacuuuucacagcccaaaacaaugucuuacaaguccaaugccaaaacggccgcugcacucuugacggagaauuacaaggcacaacccaacuacuccccuccggcaucugcgccuuccgcggccguguuaccgcccaaaucaaccaacgcgaccgcuggcacaugcaacuucaaaaccucaacggaaccacauacgacccuacggacgacguaccugcuccccucggaaccccagacuucaaaggcgucguauucgguauggucucucagagaaacgucggcaaugacgcccccgacucaacacgcgcucaacaagcuagcgucucaaccuacucuccccaauucguaccuaaacucggcuccguaaaucuucgaaucuccaacaacgacgauuuccaauuccaaccaacuaaauucaccccaguugguguaaacgacgacgacgacggacaccccuuccgccaaugggaacuacccaauuauuccggugaacucacccucaacaugaaccuagccccacccguagcccccaacuucccaggcgaacaacuccuauucuuccgcuccuucguacccugcuccgggggcuacaaucaaggcauaauagacugccucauaccccaggaauggauccaacacuucuaccaagaauccgccccaucccaaucagacgucgcacucauccgcuacgucaauccagacacaggacgcacccuauucgaagccaaacuacaccgcuccggcuacauaaccguagcccacucaggcgacuacccccucgucguccccgccaauggacacuuucgauucgacuccugggucaaucaauucuacucccuagcccccaugggcaccggaaauggacggcgccgcgcacaauga

SEQ ID NO: 37769 - RNA, 1623 nt, Artificial Sequence
  derived and/or modified sequence opt11 from VP1__Norovirus_and/or_Norovirus-like__KT315708
augaaaauggccuccaacgacgccgcccccuccaacgauggagccgccggccucgucccagaaggaaacaacgaaacacucccccucgaacccguagccggagccgcgauagcagccccagucacuggacaaaacaauauaauagaccccuggauccgcaccaacuucguccaagcgccaaacggcgaguucacuguaucaccccggaacucccccggugaaauccuccuuaaccuagaacuaggaccugaccuaaaccccuaccucgcccaccuaucacgcauguacaacgguuacgcaggcggagucgaaguucaaguccuccuugccggcaacgccuucaccgccggcaaaauccuuuuugccgccgucccacccaacuuccccguagaauuucucagucccgcacaaaucaccaugcucccacaccuaaucgucgacgugcgcacccucgaacccaucaugaucccuuugcccgacguacgcaacaccuucuuccacuacuccaaccaacccaauucccguaugcgccuuguagcaaugcucuacacaccccuccgcuccaacggcucaggagacgacgucuuuaccgucuccugccgcguacuaacccgccccacccccgacuucgaguucaccuaccucguacccccauccgucgaauccaaaaccaaaccauucucccucccuauccucacauuauccgaacuaaccaacucccgcuuucccguccccaucgacucccuauucaccgcacaaaacaacguccuucaaguccagugccaaaacggcagaugcacccucgacggcgaacuccaaggcaccacccaacuccucccaucaggcaucugcgcauucagaggacgcguaacagcacaaauaaaccagcgcgaucgguggcacaugcaacuccaaaaccuuaacggcaccaccuacgaccccaccgaugacguacccgcaccccucggcacccccgacuucaaaggcguaguauucggcaugguaucacaaagaaacgucggcaacgacgcucccggcuccacaagagcccaacaagccuggguauccaccuacagcccccaauucguccccaaacuaggauccguaaaccuacgcauuucggacaacgacgauuuccaauuccaacccacaaaauucacaccagucggcgucaacgacgaugacgauggacacccauuccgccaaugggaacuccccaacuauuccggcgaauuaacccuaaacaugaaccucgcacccccaguagcccccaacuuccccggcgaacaacuccucuucuuccgcuccuucguacccugcuccggcggcuacaaccaaggcaucaucgacugccuuaucccccaagaauggauacaacacuucuaucaggaauccgcccccucucaauccgacgucgcccucauccguuacguuaacccagacacaggccgcacacuauucgaggccaaacuccacagauccggcuacaucacagucgcacacucaggcgauuacccccuagucgucccagcaaacggcuacuuccgcuucgacucaugggucaaccaauuuuauucccuugcacccaugggcacaggaaacggacgacgucgagcccaauaa

SEQ ID NO: 37770 - RNA, 1623 nt, Artificial Sequence
  derived and/or modified sequence opt11 from VP1__Norovirus_and/or_Norovirus-like__KT315697
augaaaauggccuccaacgacgccgcccccuccaacgacggcgccgcaggccuaguccccgaagggaacaacgaaacucucccccucgaaccaguagccggcgccgcuaucgccgcccccguaaccggucaaaacaacaucauagaccccuggauccgcacaaacuucguccaagcccccaacggagaauuuaccgucuccccacgaaacucgccuggcgaaauccuucucaaccuagaacuaggacccgaccucaaccccuaccucgcccaucucucacgcauguacaacggcuacgccggcggcguugaaguccaaguucuccucgccggcaacgccuucacagccggaaaaauccuauucgccgccguacccccuaacuucccagucgaguuccuaucacccgcccaaaucaccaugcucccgcaccuaaucgucgacguccggacacucgaacccauaaugaucccacuacccgacguccgcaauaccuucuuccacuacuccaaccaacccaacucccgcaugcgacuugucgccaugcucuacacaccccuacgcucaaacggaagcggcgacgacguauucaccguguccugccgcguuuugaccagaccaaccccggacuucgaauuuaccuaccuuguaccucccagcguagaaucaaaaacgaaacccuucucacuccccauacucacccucucagaacuaacaaacucccgcuuccccguccccauagacagccucuucaccgcccaaaacaacguccuacaaguccaaugccaaaacggccguuguacccucgacggcgaauuacaaggaacaacacaacuucuccccuccggaaucugcgccuuccggggccgcguaaccgcccaaaucaaccaacgcgaccgcuggcacaugcaacuccaaaaccucaacggcacuacauacgacccaacagacgacgucccagcaccccucggcacucccgauuuuaaaggcguugucuucggcauggucucccagcgaaaugucgguaacgacgccccagguuccacccgcgcccaacaggcuugggucuccacauacuccccacaauucguccccaaacucggcuccgucaaccuccgcaucucagacaacgacgacuuccaauuccaaccaacgaaauucaccccugucggagucaacgacgaugacgacggacaccccuuccgucaaugggaacuacccaauuacucaggagaacucacccuaaacaugaaccuugccccaccugucgcccccaacuuccccggcgaacaacuucuuuucuucagauccuuuguccccugcuccggaggcuacaaccaaggcaucauugacugccucaucccccaagaauggauccaacauuuuuaucaagaaucggcaccaucucaauccgacguggcacucauccgauacgucaacccagauaccggcagagcucucuucgaagccaaacuccaccgaucuggcuacaucaccgucgcccacucaggcgacuacccucuaguagugcccgcaaauggacacuuccgcuucgauuccuggguaaaccaauucuacucccuagccccaaugggcacuggcaauggaagacgucgagcccaauaa

SEQ ID NO: 37771 - RNA, 1623 nt, Artificial Sequence
  derived and/or modified sequence opt11 from VP1__Norovirus_and/or_Norovirus-like__KT315689
augaaaauggccucaaacgacgccgcccccuccaaugacggcgccgccggccucguccccgaaggcaacaaugaaacccucccccucgaacccgucgccggcgccgccaucgcugcccccgucaccggacaaaauaauaucaucgaccccuggauacgcaccaacuucguacaagccccuaacggcgaauuuaccgucucuccccguaacuccccuggcgaaauccuacucaaccuagaacucggcccagaccucaaccccuaccuagcccaccuaucccgcauguacaauggcuacgcaggcgguguagaaguccaaguccugcucgcuggcaacgccuucacugccggcaaaauucucuucgcagccguacccccaaacuucccagucgaauuucucucucccgcgcaaauaaccaugcucccccaccucauuguugacguucgcacacucgaacccaucaugaucccccucccagacguccgaaauacauucuuccacuacuccaaccagcccaauucccgcaugagacucgucgccaugcucuacacuccccucagauccaacggcuccggcgacgaugucuucaccguaucuugcagaguucuuacccggccaacccccgacuuugaauuuaccuacuuaguaccacccuccguggaauccaaaaccaaacccuucucacuccccauccucacccucucugaacucaccaacucccgcuuccccguccccaucgacucccucuucaccgcccaaaacaacguauuacaaguccaaugccaaaauggccgcugcacucucgacggcgaacuacaaggcacaacacaacuucuucccucaggcauuugcgccuucagagguagaguaacagcacaaauaaaccaacgcgaccgcuggcauaugcaacuccaaaacuuaaacggcaccaccuacgaccccaccgacgacguucccgcuccccuaggaacccccgacuucaaaggcgucgucuucggaauggucagccagcgcaaugucggcaacgaugcccccggauccacccgcgcccaacaagccugggucucuacuuacucgccccaauucguacccaaacucggauccguaaaccuccgcaucuccgacaacgacgauuuucaauuucaaccaacaaaauucaccccagucggagucaacgacgacgacgauggucaccccuuccgccagugggaacuccccaacuacuccggcgaacucacacuaaauaugaaccucgcacccccagucgcccccaauuuccccggcgaacagcuuuuauuuuuccgcagcuucguccccugcuccggcggcuauaaccaaggcaucaucgacugccuuaucccacaagaauggauucaacacuucuaccaagaauccgcccccucccaaucugacguagcccucauccgcuaugucaacccagacaccggcagaacccucuucgaagccaaacuacaccgcucuggcuacaucacagucucccacucaggugacuacccacucgucgugcccgccaacggccacuuccgcuucgacuccuggguaaaccaguucuacucccuugccccgaugggcaccggaaacggucggcgccgcgcacaauaa

SEQ ID NO: 37772 - RNA, 1623 nt, Artificial Sequence
  derived and/or modified sequence opt11 from VP1__Norovirus_and/or_Norovirus-like__KX216805
augaaaauggccucuaacgacgccgcuccuucaaacgacggcgccgcaggacucgucccagaaggcaauaacgaaacccuuccccuagaaccagucgccggagcagccaucgccgccccagucaccggccaaaauaacauuaucgaucccuggauccgcacuaauuucguccaagcccccaauggcgaauuuacagucagcccccgaaacuccccaggagaaauucuccucaaccucgaacuaggcccugaccuuaaccccuaccuagcccaccuaucccgcauguauaacggcuacgcaggcggcgucgaaguccaaguccuccucgcggguaacgcuuucaccgccggaaaaauccuauucgcagcaguuccaccaaacuucccuguugaguuccucuccccagcucaaaucacaaugcuaccccaucucaucgucgacguacgaacgcuugaacccaucaugauccccuuacccgacguccgcaacaccuuuuuccacuacucgaaccaaccuaacucacgcaugcgccuugucgcaaugcucuacacaccccuccgcucaaacggauccggcgacgacgucuucaccgucuccugccgcguccucacccgccccacccccgacuucgaauuuaccuaccuaguuccucccucggucgaaucgaaaaccaaacccuucucacuccccauccucacucuauccgaacuuacgaacucccgcuuucccguaccaauagacucccuuuucacagcucaaaacaacguucuccaaguccaaugccaaaacggccgcugcacccucgacggcgaacuccaaggcacaacucaacuccuccccacaggaaucugcgcauucagaggccgcgucaccgcucaaaucaaccaacgcgaccgauggcacaugcaacuucaaaaccugaacggaaccaccuacgauccuaccgacgacguccccgccccacuaggaacaccagacuucaaaggaguaguauuuggaaugguaucacaacguaacgucggcaacgacgccccuggauccacaagggcccaacaagccugggucucaacauauagcccacaauucguccccaaacucggcuccgucaaccuccgcaucuccgacaacgacgacuuccaauuccaaccuaccaaauucacaccagucggcguaaacgacgacgacgacggccauccauuccgccaaugggaacuccccaacuacuccggagaacuuacccucaacaugaaccuagccccacccguugcccccaacuuccccggagaacaacuccuauucuuccgauccuuuguacccugcucuggcggcuacaaccaaggcauaaucgacugccucaucccccaagaauggauccaacacuucuaccaggaauccgcaccaucccaguccgacguugcccucauccgauacgucaacccagacaccgggcgcacccuauucgaggccaaacuccaccgauccggauacaucaccguagcccacucgggcgacuacccccucguaguccccgccaacggauacuuccgcuucgacucuuggguaaaccaauucuacucacucgcccccauggguaccggcaacggccgccgucgcgcccaguaa

SEQ ID NO: 37773 - RNA, 1623 nt, Artificial Sequence
  derived and/or modified sequence opt11 from VP1__Norovirus_and/or_Norovirus-like__KU557859
augaaaauggcuucaaacgacgccgccccuuccaacgacggcgccgccggacucgucccugaaggcaacaacgaaacacucccccuagaacccgucgccggagccgccaucgccgcuccugucaccggccaaaacaacauaaucgacccauggauccgcacaaacuucguccaagcacccaacggcgaauucacugucucaccacgaaacuccccaggcgaaauccuucucaaccucgaacuaggccccgaccuaaacccuuaccuugcacacuuauccagaauguauaacggauacgccggaggcguugaaguccagguccuccucgccgguaaugcauuuacugcaggcaaaauccuauucgccgccgucccgcccaacuuccccgucgaauuccuaucccccgcacaaaucacaaugcucccucaccuaauaguagacguccgcacgcuugaacccaucaugaucccccucccagacguacgaaacaccuucuuccacuacuccaaccaacccaacagccgcaugcggcuaguagccaugcucuacaccccccuacgcucgaacgguuccggagacgaugucuucaccguuuccugccgcguucucacacgaccaacacccgacuucgaauucaccuaccuagucccccccucaguugagagcaaaaccaaaccauucucucuccccauacucacccucuccgaacucaccaacucccgcuuccccguccccaucgacucccuauucaccgcccaaaauaacguccuccaaguucaaugccaaaacgguagaugcacccuugacggugaacuucaaggaaccacccaacuccucccauccggcaucugcgcauucagaggccgcguuacugcacaaaucaaccaacgcgaccgcuggcacaugcaacuacaaaaccucaacggaaccacauacgaccccacugacgacgucccagccccccucggcaccccugacuucaaaggcguuguuuucggcaugguaucacaacgaaacgucggcaacgacgcucccggaucuacacgcgcccaacaagccugggucuccaccuauucuccccaauucgucccgaaacuagguuccgucaaccuccgcaucuccgacaacgaugacuuccaauuccaacccacaaaauucacacccguaggagucaacgacgacgacgauggccacccuuuccgccaaugggaacuaccaaacuacuccggagaacucacgcuuaacaugaaccucgccccacccguagccccaaacuucccaggcgaacaacuccuuuucuuccguucauucguucccugcuccggcggcuacaaccaaggugucauagacugccucaucccacaagaauggauccaacauuucuaccaagaauccgccccaucucaauccgacguagcccuaauacgcuacguaaaccccgacaccggaagaacacuauucgaagccaaacuccaccgcucagguuacaucaccgucgcccacuccggcgacuacccacucguuguccccgccaauggccacuuccgauucgacucauggguaaaccaauucuacucacucgccccaaugggcaccggaaacggucgccgccgagcccaauaa

SEQ ID NO: 37774 - RNA, 1623 nt, Artificial Sequence
  derived and/or modified sequence opt11 from VP1__Norovirus_and/or_Norovirus-like__KU557828
augaaaauggcaucaaacgacgccgcacccaguaacgacggcgcagcaggccugguccccgaaggcaacaacgaaacgcucccucucgaacccgucgccggagcagcaaucgccgccccagucacaggccaaaauaauauuauugauccauggauccgcaccaacuucguccaagcacccaacggcgaauuuaccguaagcccacgcaacucaccaggcgaaauccuucuaaaccuagaacucggcccugaccuuaacccauaccucgcccaccucucccgcauguacaacgguuaugccggcggagucgaaguacaaguccuacuugcaggcaaugccuucaccgccggaaaaauccucuucgccgccguaccacccaacuuccccguagaauuucucucacccgcccaaaucacaaugcuaccacaccuaauagucgacguacgcacacuugaaccuaucaugaucccccuuccugacguacgcaacacguucuuccacuacucaaaccaaccaaacucgcguaugcgacucgucgccaugcuauacaccccacucagaucaaacggcaguggcgacgacguuuucaccgucuccugccgaguccucacacgcccuaccccugacuucgaguucaccuaccuagucccacccuccgucgaauccaaaaccaaacccuucucacugccgauccucacccuuuccgaacucaccaacucccguuucccaguacccaucgacucacuguucaccgcacaaaauaacguccuucaaguccaaugccaaaacggacguugcacccucgacggugaacuccaaggaaccacccaacuccuccccucuggcaucugcgccuucagaggccgaguaaccgcccaaaucaaccaacgcgaccgauggcauaugcaacuacaaaaccucaacggcaccaccuacgacccaacugacgacgucccagccccucucggcaccccagacuucaaaggaguagucuucggcauggucagccaacgcaacguaggcaacgacgcucccgacuccacccgcgcucaacaagccuggguuucaacauacucaccacaauucguccccaaacucgguucaguaaaccuaagaaucucagacaacgacgacuuccaauuccagcccacgaaauucacacccgucggcgucaacgacgaugacgacggccaccccuuccgccaaugggaacuucccaacuacuccggcgaacuuacccuaaacaugaaccuagcuccacccgucgcccccaacuuccccggggaacaacuacuuuucuuucgcagcuucguacccugcagcggcggcuacaaucaaggcauaaucgauugcuuaauaccccaagaauggauccaacacuucuaccaagaauccgcccccucacaauccgacgucgcccucauccgcuacguuaacccugacacaggacgaacccuuuucgaagccaaacuacaccgcucgggcuauaucacaguagcccacuccggcgacuacccccuagucgucccagcuaacggucacuucagauucgacagcuggguaaaccaauucuacucacuagcacccaugggcacaggcaacggccgacgacgcgcccaguga

SEQ ID NO: 37775 - RNA, 1623 nt, Artificial Sequence
  derived and/or modified sequence opt11 from VP1__Norovirus_and/or_Norovirus-like__KT315692
augaaaauggcaucaaacgacgcagcuccaucuaacgacggcgcagccggccuaguccccgaaggcaacaaugaaacccucccacucgagcccguagccggugcagccaucgccgccccagucaccggccagaacaacaucaucgaccccuggauacgaaccaacuucguacaagcccccaacggcgaguucaccgucagccccagaaacagccccggagaaauccuccucucccucgaacuaggccccgaccucaaucccuaccucgcucaccucucacgaauguacaacggcuacgccggcggcgucgagguccaaguccuccucgcaggcaacgccuucaccgccgggaagauacuauucgccgccgucccacccaacuuccccguagaguuccuauccccugcccagaucaccaugcuaccccaccucaucguggacguacgaacccucgaaccaauaaugauaccccuacccgauguucgaaacaccuucuuccauuacuccaaccaacccaacuccagaaugcgccuagucgccaugcucuauacaccccuccguuccaacggcucaggugacgacgucuucaccguuucaugcagaguucucaccagacccacucccgauuucgaauuuaccuaccuaguaccacccucuguugaauccaaaacgaaacccuucucccugcccauccucacccucuccgaacucacuaacucccguuuccccguucccauagacucccucuucacugcucaaaauaacguucuccaaguacagugccaaaacggccgcuguacccuugacggcgaacuccaaggcaccacccaacuccuacccaguggcauuugugccuucaggggacgcguaacugcccaaauaaaccaacgagaccgauggcacaugcaacuccaaaaccucaauggaacaaccuacgacccuaccgacgacgucccagcaccauuagguacccccgacuucaaaggcgucguauucggaaugguaagccaacgaaacgucggcaacgacgcacccggaagcacccgcgcccaacaagcaugggucuccaccuacucaccccaauucguuccaaaacucggcuccguuaaccuacgcaucuccgacaacgacgauuuccaauuucaacccacaaaauuuaccccaguuggcgucaacgacgacgacgacggccaccccuuccgccaaugggaacuucccaacuacuccggagaacuaacccucaacaugaaccucgcaccacccguugcacccaacuuccccggcgaacaacuccuauucuuccgcuccuucguccccugcuccggcggauacaaccaaggaaucauugacugccuaaucccgcaagaauggauacaacacuucuaccaagaauccgcccccucacaauccgacguugcccucauccgcuacgucaacccugacacuggccgcacacucuucgaagccaagcuccaccgcucaggcuacaucaccgucgcccacuccggagacuacccucucgucguacccgcaaacggccacuuccgauucgacuccugggucaaccaauucuacucccuagcccccaugggcaccggcaacggccgccgccgagcacaauaa

SEQ ID NO: 37776 - RNA, 1623 nt, Artificial Sequence
  derived and/or modified sequence opt11 from VP1__Norovirus_and/or_Norovirus-like__KX168437
augaaaauggccuccaacgacgccgccccauccaacgacggcgcugcaggccucgucccagaaggcaauaacgaaacccucccccuagaaccaguggccggcgcagccauagccgcuccagucacaggacaaaacaacauuaucgaccccuggauccgcaccaacuucguccaagccccaaacggcgaauuuacaguaucaccccgaaacucccccggcgaaguauuacuaaaccucgaacuaggcccugaccuaaaucccuaccucgcacaccucucccgcauguacaacggcuaugccggcggcgucgaaguucagguuuugcuagccggcaacgcuuucacagcugguaaaauccucuucgcagccgucccucccaacuuccccguagaauuucucucccccgcccaaaucaccaugcucccucaccucaucgucgacguccgcacccuagaacccauuaugaucccucucccagauguucguaauaccuucuuccacuacuccaaccaacccaacucccgcaugcgccuaguagccaugcucuacacaccccuccgcuccaacggauccggcgacgauguguucaccguauccugccguguucucacccgcccaaccccagacuucgaguucaccuaccucguaccacccuccgucgaauccaaaaccaaacccuucucccuccccauucucaccuuauccgaacuaacaaacucccgcuucccuguccccauugacucccucuucaccgcacaaaacaacgugcuccaaguucaaugccaaaacggacgcugcacccuugacggcgaacuccaaggcacaacccaacuccucccuuccggcauaugcgcauuccgcggccgcguuacggcccaaauuaaccaacgcgaccgcuggcacaugcaacuccaaaaccugaacggaacaacguacgaccccaccgaugacguccccgccccacucggcacucccgauuucaaaggagucgucuucggcauggucucccaacgaaacgucggcaacgacgcacccggaucaacccgcgcacaacaagcaugggucucaaccuacucaccacaauucgucccuaaacucggaagcgucaaucuacgaauuucagacaacgacgacuuccaauuccaacccaccaaauucacacccgucggagucaacgacgacgacgacggccauccauuccgccaaugggaacuccccaacuacuccggcgaacucacacucaacaugaaccucgccccucccgucgcccccaacuucccaggcgaacagcuacuauucuuccgaucauucgucccaugcucaggcggcuauaaccagggaaucaucgacugccuaaucccucaagaauggauccaacacuucuaccaagaaucagccccuucccaaucagacguagcccuaauccguuaugucaacccugacacuggucgcaccuuauucgaagccaaacuccacagauccggcuacaucaccguagcgcauucuggcgacuacccccucgucguccccgcuaacggccauuuccgcuucgacagcugggucaaccaauucuacagcuuagcccccaugggcacgggcaauggacgaagacgcgcacaguaa

SEQ ID NO: 37777 - RNA, 1623 nt, Artificial Sequence
  derived and/or modified sequence opt11 from VP1__Norovirus_and/or_Norovirus-like__KX168440
augaaaauggcauccaacgacgccgcacccuccaacgauggcgcugccggccucguccccgaaggaaacaacgaaacccucccccuagaaccaguagccggcgccgcuaucgcugccccagucacaggucaaaacaacaucaucgaccccuggauacgcaccaacuucguccaagcccccaacggcgaauuuacagucucaccccgaaacuccccaggugaaauccuccucaaccucgaacuuggcccugaccucaaccccuaccuagcucaccucucccgcauguacaacggcuacgccggaggcgucgaaguacaaguacugcucgccggcaacgccuuuaccgccggcaaaauacucuucgcagccguacccccaaacuuccccgucgaauuucucucacccgcccaaaucacuaugcucccacaccuaaucgucgacguccgcacccuagaacccaucaugaucccccuacccgauguucgcaauaccuucuuccacuacuccaaccaacccaacucucgcaugcgccuaguagccaugcucuacacaccucuccgaucuaacggcucaggcgacgacgucuucaccguauccugccgcguccuaacccggcccacccccgacuucgaguucaccuaccucgucccuccaucagucgaauccaaaacaaaaccauucucccuaccaauacucacacuauccgaacucacaaacucacgauucccaguaccaauagacucacucuucacagcccaaaacaacguacuccagguccaaugccaaaacggacguugcacccuugacggagaacuccaaggaaccacccaacuacuccccagcggcauaugcgcauuccgcggucgaguaacagcccaaaucaaccaacgagaccgcuggcacaugcaacuccaaaaccugaacggcaccacauacgaccccaccgacgacguaccagccccucucggaacucccgacuucaagggagucgucuucggcauggucucccaacguaacguuggcucagaugccccaggcaguacccgcgcccaacaagcaugggucucaaccuauucaccccaauucguccccaaacuagguucaguuaaccuccgcauaagcgauaacgacgacuuccaauuccaacccacaaaauucacacccgucggcgugaacgaugaugacgacggccaccccuuccgccaaugggaacuccccaacuacucaggcgaacuaacccuaaacaugaaccucgcaccucccgucgcaccaaacuuccccggagaacaacuccuauucuuccgcucuuucguucccugcagcggcggauacaaccaaggcaucauagacugucucaucccacaagaauggguccaacacuucuaccaagaauccgcccccucucaaucggacgucgcacucauccgcuacguaaaccccgacaccggccgcacccuauucgaagccaaacuccacagauccggcuacaucaccgucgcccacucgggugacuacccacucguagucccagccaacggccacuucagauucgacucauggguuaaccaauucuacucucuggccccaaugggcacaggcaauggucgacgccgcgcccaauaa

SEQ ID NO: 37778 - RNA, 1623 nt, Artificial Sequence
  derived and/or modified sequence opt11 from VP1__Norovirus_and/or_Norovirus-like__KX216793
augaaaauggcauccaacgaugcagcccccuccaacgacggcgccgcaggacucguccccgaagggaacaacgaaacacucccgcucgaacccgucgccggugcagcuaucgcagcuccugucaccggucaaaacaacaucaucgacccauggauuagaacaaacuucguccaagcaccaaacggcgaauuuaccguaucaccccgaaacagccccggagaaauccuacucaaccucgaauuaggacccgaccucaaccccuaccuagcccacuugucccgaauguauaacggcuacgccggcggcgucgaaguacaaguccuccuagcuggcaacgcauucaccgcaggcaaaauucuuuucgcagccguaccaccgaacuuccccgucgaauuucucuccccugcccaaauaaccaugcucccccaccucaucgucgacguacguacucuugaacccauaaugauaccacuacccgacguacgcaacaccuucuuccacuacagcaaccaacccaacucccgcaugcgccuggucgccaugcuauacacaccccuuagaucaaacgguuccggugacgacgucuucaccgucagcugucgcguccuaacucgaccuaccccagacuucgaguucaccuaccucgucccaccauccguugaauccaaaaccaaacccuucucccuacccauccucacucuauccgaacucaccaacucccgguuccccguaccaaucgacagucuauucacugcacaaaacaacguccuacaaguccaaugccaaaacggccgcugcacccucgacggagaacuccagggcaccacgcaacucguccccucaggcaucugcgcauuccgcggacgcgucaccgcccaaaucaaccaacgcgaccgcuggcacaugcaacuacagaaccuuaacggcaccaccuacgacccaaccgacgacgucccagcaccccucggcacccccgacuucaaaggcguagucuucggaauggucucacaacgcaacguaggcaacgaugcccccggcucaacccgcgcccaacaagccuggguaucaaccuauucuccccaauucgucccaaaauuaggcuccguaaaccuccgcaucuccgacaaugacgacuuccaauuccagcccaccaaauucaccccaguaggcguuaacgacgacgaugacggccacccauuccgucagugggaacucccaaacuacuccggagaacucacccucaauaugaaccucgccccuccagucgcccccaacuucccaggcgaacagcuccuuuucuucagauccuucgucccauguuccggcggauauaaccagggaauaaucgacugccuaaucccccaagaauggauccaacacuucuaccaagaauccgcccccucccagucagacguagcccucauccgcuacgucaaccccgacacaggcagaacccuuuuugaagccaaacuccaccgcuccggcuacauaacagucgcccauuccggcgacuacccccucgucguccccgccaacggacacuuccgauuugacuccugggucaaccaauucuacucacuagcccccaugggcaccggaaacggccgccgccgugcccaguag

SEQ ID NO: 37779 - RNA, 1623 nt, Artificial Sequence
  derived and/or modified sequence opt11 from VP1__Norovirus_and/or_Norovirus-like__KU557881
augaaaauggccuccaacgacgcagcacccuccaacgauggcgcagccggauuaguaccagaagguaacaacgaaacccuaccccucgaacccgucgccggcgccgccaucgccgccccagucacaggccaaaacaauaucauugacccauggauccgaaccaauuucguucaagccccaaacggcgaauuuaccguaagcccacgcaacucccccggcgaaauacuucucaaccuugaacuuggccccgaucucaaccccuaccucgcacacuuaucccggauguauaacggcuacgccggaggcguugaaguacaaguccuccucgccggcaacgccuucaccgcaggcaaaauccuauucgccgccguacccccaaacuucccagucgaguuccucuccccugcacaaaucaccaugcuaccacaccuuauugucgacgugcgaacucucgaacccaucaugaucccccuacccgacguccgaaacacauucuuccacuacuccaaucaacccaauucccgcaugcgccucguggcuaugcucuacacaccccuacgcucaaacggcuccggcgacgacgucuucacugucucgugccgaguccucacacgccccacccccgacuucgaguucacuuaccucguacccccaucagucgaaucaaaaacaaagccauucucacuacccaucuuaacccucuccgaacucaccaacagccgauucccuguccccaucgacucucucuucaccgcccagaacaacguccuccaaguccaaugccaaaacggacguugcacccucgacggcgaacuacaaggaaccacccaacuacuccccagcggcaucugcgcuuucagaggccgugucaccgcccaaauaaaucaacgagaccgauggcacaugcaacuccaaaaccucaacggcacaacauacgacccaaccgacgacguuccugcuccacucggcaccccagacuucaagggcguagucuuuggcauggucucccaacgcaacguugguaacgacgccccagguuccacacgagcccaacaagcauggguauccaccuacagcccccaauucguccccaaacucggcuccgucaaccuccgcaucuccgacaacgacgauuuccaauuucaaccaaccaaauucacccccguuggcguaaacgacgacgacgacggccaccccuuccgccaaugggaacuccccaacuacucuggagaauuaacacucaacaugaaccuagccccaccugucgcccccaacuuccccggcgaacaacuccucuucuuccgcucccuaguacccugcucuggcggcuacaaccaaggaaucauagacugccucaucccacaagaauggauccaacacuucuaccaagaaucagcccccucacaauccgacguagcccucauuagauacgucaaccccgacacaggacguacacuauuugaagccaaacuacaccgcuccggauauaucaccguggcacacuccggcgacuauccccucguaguacccgccaacggccacuuccguuucgacuccugggucaaccaauucuacucucucgcccccaugggaacaggcaacggccgacgacgagcacaguaa

SEQ ID NO: 37780 - RNA, 1623 nt, Artificial Sequence
  derived and/or modified sequence opt11 from VP1__Norovirus_and/or_Norovirus-like__KY424350
augaaaauggcuuccaacgacgccgcccccagcaacgacggcgccgccggccuuguccccgaaggcaauaacgaaacccuuccacucgaaccagucgccggagcagccaucgccgccccagucacaggccaaaacaauauaaucgaccccuggauccgcaccaacuucguccaagcacccaacggcgaauuuaccguuucaccccgcaacuccccaggcgaaauacugcucaaucucgaacugggcccagaccucaaccccuaccucgcccaccucucacgcauguacaacggcuacgccggaggagucgaaguccaaguacuccuugccggcaacgcuuucacugcgggcaaaauccucuucgcagccguacccccaaacuuccccgucgaguuccucucccccgcccaaaucaccaugcuuccacaucuaaucgucgacguccgcacccucgaaccaaucaugaucccccuucccgacguccgcaacaccuucuuccauuacuccaaucaacccaauaaccgcaugcgccuugucgccaugcuauauacaccacuccgcuccaauggauccggcgacgaugucuucacuguauccugucgcguccucacacgccccacccccgacuucgaguucaccuaccuaguacccccauccgucgaaucaaaaaccaaacccuucucucucccaauccucacccucuccgaacuaacuaacucccgauuucccguccccauagacucccuuuucacagcccaaaacaacguccuccaaguccaaugucaaaacggccgcugcacccuagacggagaacuccaaggaacaacacaacuccucccauccggcaucugcgcauuccgaggccgcguuaccgcccaaaucaaccaacgcgaucgcuggcacaugcaacugcagaaucucaacgggacuaccuacgaucccacagacgauguccccgccccucucgggacccccgacuucaaaggagucgucuucggcauggucucccaacgcaacgucggcaacgacgccccaggaucaacccgugcccaacaagccugggucuccaccuacucuccccaauuuguccccaaacucggcucaaucaaccuccgcaucucagacaacgaugacuuccaauuccaacccaccaaauucaccccagucggagucaacgacgacgaugauggccaccccuuccgccaaugggaacuccccaacuacuccggcgaacucacacuaaacaugaaccuugcuccacccgucgcaccuaacuuucccggcgagcaacuccuauucuuccgaucauucguccccugcagcggcggcuacaaccaaggcauuaucgacugccucauuccccaagaauggauccagcauuucuaccaagaauccgccccaucccaauccgacguagcauuaauccgcuacgucaaccccgacaccggacgcacccuauucgaagcaaaacuccaccgaucagguuacauaaccguagcccacucuggcgacuacccucucgucgucccagcuaauggccauuuccgcuucgacucauggguaaaccaauucuauucccucgcacccaugggcacagguaacggccgacgccgugcacaauga

SEQ ID NO: 37781 - RNA, 1623 nt, Artificial Sequence
  derived and/or modified sequence opt11 from VP1__Norovirus_and/or_Norovirus-like__KU557884
augaaaauggccuccaacgacgcagcacccucaaaugauggagcugcaggccucgugcccgaaggcaacaacgaaacacuuccgcuugaaccagucgcaggcgccgccaucgccgcccccgucaccggccaaaacaacauuaucgaccccuggauacgcacaaacuucguccaagcccccaacggcgaauuuacggucucaccaagaaacucccccggcgaaauacuucucaaccucgaacuuggccccgaccuaaaccccuaccuagcccaccuuagccgaauguacaacgguuacgcaggcggcgucgaaguccaaguacuccucgccggcaacgccuucaccgccggcaaaauccucuucgcagcaguaccacccaacuuccccgucgaauuucucucccccgcccaaaucacuaugcuaccccaccuaauagucgacguccgcacccucgaaccaaucaugauaccacuccccgacguccgcaacaccuucuuccacuacuccaaccaacccaauagccgcaugcgacuggucgccaugcucuacaccccacuccgcuccaacggcuccggagacgacgucuucaccgucuccugccgcguccucacucgccccacaccugacuucgaguucaccuaccuaguucccccuuccgucgaaucaaaaacaaagccuuucucacucccuauccuuacacucuccgaacuaacuaacucccgcuucccaguccccaucgacucucucuucacugcccaaaauaacguccuccaaguccaaugccaaaacggccgcugcacccucgacggagaacuccaaggcacaacccaauuauuaccaucuggcauaugcgccuuccguggccgcgucaccgcccagauaaaccaacgcgaucgcuggcacaugcaacuccaaaaccuaaacggcgccacuuaugacccaaccgacgacgucccugcaccccuaggcacacccgacuucaaaggugucgucuucgggauggucucccaacgaaacguuggcuccgacgcacccggaucuacccgcgcccaacaagccuggguauccaccuacucuccacaauucguccccaaacucggcuccguaaaccuccgcaucucggacaacgacgacuuccaauuccaacccacuaaauucacacccgucggugugaacgacgaugacgacggccaccccuucagacaaugggaacuccccaacuacucaggugaacuaacccuaaacaugaaccucgccccgcccgucgcucccaacuucccuggagaacaacuacucuucuuucguuccuucguacccugcucuggcggguacaaccaaggcauaaucgacugccucaucccacaagaauggauccaacacuucuaccaagaaucagcccccucucaauccgaugucgcccucaucagauacgucaaccccgacacaggacgcacccuuuucgaagccaaacuacaccgcucaggcuauauaacaguugcccacuccggcgacuacccccucgucguccccgcaaacggccacuuccgcuucgacucuugggucaaucaauucuacucccucgcacccaugggcacagguaacggccgucgccgcgcccaauaa

SEQ ID NO: 37782 - RNA, 1623 nt, Artificial Sequence
  derived and/or modified sequence opt11 from VP1__Norovirus_and/or_Norovirus-like__KU561253
augaaaauggccuccaaugacgccgcaccauccaacgacggcgccgccggccucgucccggaaggcaacaacgaaacccucccacucgaacccgucgcaggagcagccaucgccgcccccgucacuggccaaaacaacauaauagaccccuggauccgaaccaacuucguccaagcccccaacggagaauucacugucuccccccguaacucacccggagaaauccuccucaacuuggaacuaggcccugaucucaaccccuaucucgcccaccucuccagaauguacaacggauaugcaggcggcgucgaaguccaaguacuccuagcaggcaacgcauucacagcaggcaaaauacucuucgcagccguaccccccaacuuccccgucgaauuccuaucccccgcccaaaucaccaugcuuccacaccucauuguagacguccgcacccucgagcccaucaugauuccacugccagacguacgaaacacauucuuccacuacuccaaucagccuaacucacgcaugcgacuaguugccaugcuauacacaccacugagaucgaacggcucaggcgacgacgucuucacaguauccugccgaguccuuacucgacccacccccgacuucgaauucaccuaccuaguacccccuuccgucgaauccaaaaccaaacccuucagccuccccauccuaacucuaagcgaacucaccaacucaagauuccccgucccaauagacucucuauucaccgcccaaaacaacguccuccaaguacaaugccaaaauggccgaugcacacucgauggcgaacuccagggaaccacacaacuacuccccuccggaaucugcgccuuccgcggccgagucaccgcccaaaucaaccaacgcgaccgauggcacaugcaacuccaaaaccucaacggcaccacauacgauccuaccgacgacguccccgcaccccucggcacccccgacuucaaaggcgucgucuucggcauggucucucaacgaaacgucggcaacgacgcaccaggaagcacacgagcccaacaagccugggucuccaccuacuccccccaauucguaccaaaacucggcuccgucaaccuccgaaucagcgacaacgacgacuuccaauuucaaccgacaaaauucacaccagucggcgugaacgacgacgacgacggccacaccuuccgccaaugggaacugccaaacuacucaggcgaacucacccuaaacaugaaccuagcaccaccaguugcccccaacuuccccggcgaacaacuccuauucuuccgaucuuucguccccugcuccggcggcuacaaccaaggcauaauugacugccucaucccacaagaauggauccaacacuucuaccaagaaucagccccaucccaguccgacgucgcccuaaucagguacgucaacccagacaccggccgcacccuauucgaagccaaacuccaucgcagcggcuacauuaccguugcacacucaggagacuauccacuaguugugccugccaauggccauuuccgcuucgacucauggguaaaccaauucuacucccuagcgccuauggggaccggaaacggccgacgccgcgcacaauga

SEQ ID NO: 37783 - RNA, 1623 nt, Artificial Sequence
  derived and/or modified sequence opt11 from VP1__Norovirus_and/or_Norovirus-like__KP902588
augaaaauggccuccaacgacgccgccccauccaacgauggcgcagccggccucguuccagaaggaaacaaugaaacccuaccucucgaaccugucgccggagcagccaucgccgcccccgucaccggccaaaacaauaucauugaccccuggauacggacaaacuucguacaagccccaaacggcgaauuuacagucucaccccgaaauuccccaggcgaaauccuccucaaccucgaacucggccccgaccuaaaccccuacuuagcccaucucucccgaauguacaauggcuacgccggcggcguagaagugcagguacuccucgcaggcaacgcauucaccgcgggaaaaauccuauucgccgccguacccccuaacuuccccgucgaauuucuauccccagcccaaauaaccaugcuaccccaccuaaucgucgacguccgcacccucgaacccaucaugauuccccuccccgacguccgaaacaccuucuuccacuacuccaaccaacccaacucacgcaugcgacucgucgccauguuauacaccccacuucgcucaaacggcucaggagacgacgucuucacggucucaugcaggguccuaacacgucccaccccggauuucgaguucaccuaccucguacccccauccgucgaaucgaaaaccaaacccuucagccucccaaucuuaacacuaucagaacuaaccaacucccgauucccaguacccaucgacucacucuucaccgcucaaaacaacguacuacaaguccaaugccaaaacgguagaugcacccucgacggugaacuccaaggaaccacacaacuucucccauccggcaucugcgcuuuccggggaagagucaccgcccaaaucaaccagcgcgaccgauggcacaugcagcuccaaaaccuaaacggcacaaccuacgacccaaccgacgacguccccgcaccccucgguacacccgauuucaaaggcguagucuucggaauggucucccaacgcaacgucggcucagaugccccaggcucuacccgcgcacaacaggccuggguaucaaccuacuccccacaauucguccccaaacuuggaucagucaaccuccgcaucuccgauaacgacgacuuccaauuccaaccgaccaaauucacccccgucgguguaaaugacgacgacgacggacaucccuuccgacagugggaacuucccaacuacagcggcgaacuuacccucaauaugaaccuagccccacccgucgcacccaacuuccccggcgaacaacuccuguucuuccgcuccucgguccccugcuccgggggcuauaaucaaggcauuaucgacugccucaucccacaagaauggauccaacacuucuaccaagaauccgccccgucacaaucagacgucgcacucauacgauacgucaaccccgacacgggccgcacccuauucgaagcaaaacuccacagauccggcuacaucaccgucgcccacucaggugacuacccacucgucgucccagcaaacggccacuuucguuucgacucauggguaaaccaguucuacucccucgcuccaaugggcacaggcaacggacgccgccgagcccaauaa

SEQ ID NO: 37784 - RNA, 1623 nt, Artificial Sequence
  derived and/or modified sequence opt11 from VP1__Norovirus_and/or_Norovirus-like__KX168456
augaagauggccucuaacgaugccgcaccaucaaaugacggcgccgccggccucguacccgaagggaauaaugaaacacuaccacucgaacccgucgccggcgcagccauagccgcccccgucacaggccaaaacaacaucauagaccccuggauccgcaccaacuucguccaagccccaaacggcgaguucaccgucagcccccgcaacucccccggugaaauacuccuuaaccucgaacuugguccugaccucaacccauaccuagcacaccucucccguauguacaacgguuacgccgguggcguagaaguacaaguacuacucgcaggaaacgcguucacagccggcaaaauccucuucgcugccguacccccaaacuucccagucgaguuccuuuccccagcacaaaucacgaugcuuccacauuuaauagucgacguacgcacucuagaacccaucaugauaccacuucccgacguccgcaacaccuucuuccacuacagcaaccaacccaauucccgcaugcgccugguugccaugcuauacacaccacuccgauccaacggauccggagacgacgucuucacagucucaugccgaguacucaccagacccaccccagacuucgaauuuaccuaucuaguaccuccauccgucgaaagcaaaacaaaacccuucucacuacccauacucacccuaucagaacucaccaacucccgauuccccguucccaucgacucccucuucacugcgcaaaacaacguccuacaaguccaaugccaaaacggccgcugcacacuagacggagaacuccaaggcaccacucaacuccuccccucaggcaucugcgcauuccgcggucguguaacagcacaaaucaaucaacgcgaccgcuggcauaugcaacuccaaaaccucaacggcacaaccuacgacccuaccgacgauguccccgccccucuaggaacacccgacuucaagggcguagucuucggcauggucucccaacgcaacguaggcucagacgccccaggcagcacacgcgcccaacaagccuggguguccaccuauaguccacaguucguccccaaacucggauccgucaaccuccgaaucuccgacaaugacgauuuucaauuccaacccacuaaauuuacccccguaggagucaacgacgacgauggcggccacccauuccgacaaugggaauuaccgaacuauuccggcgaacuaacacuaaacaugaaccucgccccacccgucgcccccaauuuccccggagaacaacuccuauucuuccgauccuucguucccugcuccggcggcuacaaccaaggaaucauagacugccucaucccccaagaguggauccaacacuucuaucaagaauccgcccccucccaguccgaugucgcccuuauccgcuacgucaacccagacacaggccgcacccuauucgaagcaaaacuccaccgcuccgguuacaucaccgucgcccacuccggagacuacccccucgugguccccgccaacggccacuuccgcuucgacuccugggucaaucaauucuacucacucgcccccaugggcacaggcaacggccgacgccgcgcccaauaa

SEQ ID NO: 37785 - RNA, 1623 nt, Artificial Sequence
  derived and/or modified sequence opt11 from VP1__Norovirus_and/or_Norovirus-like__KX168444
augaagauggcauccaacgacgcggcccccuccaaugauggcgcagcaggccuaguacccgaaggaaacaacgaaacccucccccucgaacccgucgccggagccgcgauagccgccccaguaaccggacaaaacaacauaaucgacccauggauccgcacuaacuuuguacaagcccccaacggcgaauuuaccgucuccccacgaaacucaccuggagaaauccuccucaaccucgaacucggccccgaucucaaccccuaccucgcgcaccuuagccgaauguacaacggcuacgcaggcggugucgaaguccaaguccuccucgccggcaacgccuucaccgccggcaaaauacucuucgccgcaguacccccaaacuuccccgucgaauuucucucccccgcccaaaucacaaugcuaccccaccucaucgucgacguccgcacacucgaaccaaucaugaucccacucccugacguccgcaacaccuucuuccacuacuccaaccaacccaauucccgaaugcgccucgucgccaugcuauacacaccccuccgaucaaacggcuccggcgacgacgucuucaccgucagcugccgcguccucacccgccccacccccgacuuugaguucacauaccuaguacccccuuccgucgaauccaaaacaaaaccauucagccucccaauacuaacccucagcgaacuaaccaacucccgcuuuccaguccccaucgacucucucuucacagcccaaaacaacguccuccaaguccaaugccaaaacggacgcugcacucucgacggcgaacuccaaggcacaacacaacugcuccccagcggaaucugugccuuuaggggccgcgucaccgcccaaaucaaccaacgcgaccguuggcacaugcaacuccaaaaucuuaacggcaccacuuacgaccccacagacgacguccccgccccacucggcacccccgacuucaagggcguagucuucggcauggucucacaacgcaacgucggaaacgacgccccuggcuccacccgcgcccaacaagccuggguuuccaccuacucaccacaauucgucccaaaacuuggcucugucaaccuccgaaucagcgacaacgaugacuuccaauuccaaccaaccaaauucaccccagucggcguuaacgacgaugacgauggucaccccuucagacaaugggaacucccaaacuacuccggcgaacucacccuaaacaugaaccucgccccaccagucgcuccaaacuucccgggugaacagcuccuauucuuccgauccuucgucccaugcagcggcggauauaaccaagguauuauagacugccucauaccccaagaauggauccaacacuucuaccaggaauccucacccucacaguccgacgucgcccucaucagauacgucaaccccgacacaggccgcacucuauucgaagccaaacuucaccgcuccggcuacaucacagucgcccacuccggagacuacccacucgucgucccagcuaauggccacuuccgcuucgacuccugggucaaccaauucuacucauuagcccccaugggcacaggcaacggccgccgccgugcccaauaa

SEQ ID NO: 37786 - RNA, 1623 nt, Artificial Sequence
  derived and/or modified sequence opt11 from VP1__Norovirus_and/or_Norovirus-like__KX216806
augaaaauggcaacgaacgacgcagcccccucuaacgacggcgcagccggccucguccccgaaggaaacaacgaaacacucccccucgaaccagucgcaggcgccgccaucgccgccccuguuaccggccaaaacaacauuaucgacccuuggauucgaaccaauuucguccaggcccccaacggcgaauuuaccguaucgccccgaaacuccccgggcgaaauccuacucaaccucgaacuuggccccgaccucaacccauaccucgcacaccucucccgaauguauaauggcuacgccggcggcgucgaaguccaaguacuucucgcaggcaacgccuucaccgccggcaaaauacucuucgccgcagucccacccaacuuccccgucgaguuccuauccccugcccaaauaacuaugcucccacaccucaucgucgacguccgcacccucgaaccaaucaugaucccccuccccgacgucagaaacaccuucuuucacuacuccaaccaacccaauucccgcaugcgccuagucgcaaugcucuacacaccccuccgaagcaacggcucaggagacgacgucuucacuguauccugccgcguacucaccagaccaacccccgacuucgaguucacauaccucguacccccaagcgucgaauccaaaacaaaaccauucucccuacccauccucacccuaucagaauuaaccaacucccgcuucccagucccaaucgacucccucuucaccgcccaaaacaacguacuccaaguucaaugucagaacggccgaugcacacucgacggcgaacuacaagguaccacacaacuucuuccuuccggaaucugcgccuuccgcggccgcguuacagcccagaucaaccaacgagaccgguggcacaugcaacuccaaaaucucaacggcacaaccuacgacccaacagacgacgucccagccccacucggcacucccgacuucaaaggcguuguuuucggcauggucucgcaacggaacguaggaaacgacgcccccggcuccacccgcgcacaacaggcuuggguuuccaccuacucaccacaauucguccccaaacuaggaucagucaaccuccgcaucuccgacaacgacgacuuccaauuccaacccaccaaauucacacccgucggcgucaacgacgacgacgacggucacccauuccgccaaugggaacuccccaauuacuccggagaacucaccuuaaacaugaaccuagccccacccguagcccccaacuuccccggggaacaacuacuauucuuucgcagcuucguccccugcagcggcggcuacaaccaaggaaucaucgauugccuaauuccucaagaauggauccaacacuucuaccaagaaagcgcacccucccaaucugacguagcccuuauccgcuacguaaacccagauaccggccguacccuauucgaagcaaaacuacaccgcucaggcuauaucaccguugcucacuccggagacuauccacucguaguaccugccaacggccacuuccgcuucgacuccugggucaaccaauuuuacucccucgcccccaugggcaccggcaacggccgacgacgcgcacaauaa

SEQ ID NO: 37787 - RNA, 1623 nt, Artificial Sequence
  derived and/or modified sequence opt11 from VP1__Norovirus_and/or_Norovirus-like__KX216794
augaaaauggccagcaacgaugccgccccaucaaacgacggggcagcaggccuaguccccgagggaaacaacgaaacccuaccucucgagcccgucgccggagcagcaaucgcagccccuguaacaggacaaaacaacaucaucgacccauggauccgaaccaacuucguccaagcccccaacggcgaauuuaccgucuccccucgcaacagcccaggagaaauccuccucaaccucgaacucggccccgaucucaacccauaucucgcccaccuuucacgaauguacaacggauacgccggcggcguagaaguccaaguccugcucgcaggcaacgccuuuaccgccgguaagauucucuucgccgcaguuccacccaacuuucccguagaauuucuaucucccgcccaaaucacaaugcucccccaucucauaguagacguacgcacccucgaaccaaucaugaucccacuccccgacguccgaaacaccuucuuucacuacuccaaccaaccaaacucccgcaugcgacucguugcaaugcucuauaccccacuccgcuccaacgguuccggcgacgacgucuucaccgucuccugccgcguccucacacgaccuacccccgacuucgaguucaccuaccuugugcccccauccguagaaucaaaaaccaaacccuucucuuuacccauccucacccucugcgaacuuaccaauucccgcuuccccguccccaucgacucccucuuuacggcacaaaauaacguucuccaaguccagugccaaaacggucgcugcacucuagacggcgaacuucaaggaaccacccaacuccuccccucuggcaucugugccuuccgaggucgcgucaccgcccaaauaaaccaacgggaccgauggcacaugcaacuccaaaaccucaacgguacaacuuacgaccccacagacgauguccccgcuccacucggcaccccugacuucaaaggcgucgucuuuggcaugguaucccaacguaacguaggcaacgacgcacccggcagcacccgcgcucaacaagccuggguuuccacauacuccccacaauucgucccuaaacucggauccguuaaccuccgcaucuccgacaacgacgauuuccaauuccaacccaccaaauuuacccccguaggcguaaacgacgacgacgacggccaccccuuccggcagugggaacuccccaauuacucaggcgaacuaacccucaacaugaaccucgccccaccagucgcacccaacuuccccggagaacaacuuuuauucuuccguucguuugucccuugcucaggaggcuauaaccaaggcaucauugacugccucaucccccaagaauggauacaacacuucuaccaagaguccgcccccucccaaucugacguagcccugauacgauacgucaaccccgacaccggccgcacacuuuucgaagccaaacuacaccgauccggcuauaucacggucgcccauuccggcgacuacccccucgucguaccagccaauggccacuuccgcuucgacuccugggucaaccaauucuacucacuugccccaaugggcaccggcaacggacgucgacgagcccaauaa

SEQ ID NO: 37788 - RNA, 1623 nt, Artificial Sequence
  derived and/or modified sequence opt11 from VP1__Norovirus_and/or_Norovirus-like__KX420895
augaaaauggcgagcaaugacgccgcccccuccaacgacggagccgccggccuagugccugaaggcaacaaugaaacccuaccacuugaacccguagccggagccgccauagccgccccaguaacaggccaaaacaacauaaucgacccguggauccgcaccaacuucguccaagccccaaacggagaauuuaccgucucaccccgcaacucccccggagaaauccuucuaaaccuugaacucggcccagaucucaacccauaccucgcccaccucagccgcauguacaacgguuacgcaggcggggucgaaguccaaguccuccucgccggcaaugcauucaccgcaggaaaaauacuuuucgcugccgucccacccaacuuccccguugaauuuuuaucacccgcccaaaucacaaugcuaccccaccucaucguagacguccgcaccuuagaaccgaucaugaucccucuccccgacguacgaaacacauucuuccacuacuccaaccaacccaacucccgaaugcgccuaguagcaaugcucuacacaccccuacgcucaaacggcucaggcgacgacgucuucaccgucucaugccguguacuaacccgacccaccccagacuuugaguucaccuaccucguaccgcccuccguagaauccaaaaccaaacccuuuucccuacccauacucacccucuccgaacugaccaacucucgcuuccccgucccaaucgacucccucuucaccgcccaaaacaacgcccuccaaguacaaugccaaaacggccgaugcacacuagacggcgaacuacaaggcacaacacaacuucuacccuccggcaucugugccuuccgcggccgagugaccgcucaaauaaaccaacgcgaccgcuggcacaugcaacuacaaaaucuaaacggcacuaccuacgaccccacugacgacguccccgccccucucggcacccccgacuucaaaggagucgucuuuggcauggucagccaacguaacguaggaaacgaugcaccaggcagcacacgcgcccaacaagccuggguaucaaccuacagcccacaauucguacccaaacucgguuccgucaaccuacgcaucuccgacaacgacgacuuccaauuccaacccacuaaauucacaccagucggagucaacgacgacgacgacggccaccccuuccgccaaugggaacuccccaacuacuccggagaacuaacacucaacaugaaccucgccccacccguagcgcccagcuuccccggcgaacaacuacucuucuuccgcuccuucguccccugcuccggaggauacaaccaaggcaucaucgauugccucaucccccaagaauggauacaacacuuuuaccaagaaucagccccuucacaguccgacgucgcccucauacgcuacgucaaccccgacaccggacguacccucuucgaagcgaaacuucaccgcucaggcuacaucacagucgcacacuccggagacuacccccuagucguucccgccaacggacacuuccgcuuugacucaugggucaaccaguuuuauucgcucgccccaaugggaaccggaaacggccgcagacgcgcccaauaa

SEQ ID NO: 37789 - RNA, 1623 nt, Artificial Sequence
  derived and/or modified sequence opt11 from VP1__Norovirus_and/or_Norovirus-like__KT591501
augaaaauggccucuaacgacgccgcaccaucuaaugacggagccgcaggccuuguccccgaaggcaacaacgaaacgcucccccuagaacccguugccggggccgccaucgcggcccccgucacaggccaaaacaacauaaucgacccauggauccgcaccaacuucguccaagcccccaauggcgaguucaccguaucaccccggaacucccccggagaaauccuacucaaccucgaacucggcccugaccuaaaccccuaccucgcccaccuaucacgcauguacaacggcuacgccgguggcgucgaaauacaaguccuacucgccggaaacgccuucaccgccggaaagauacuauucgcugccgucccaccuaacuucccugucgaguuccucucccccgcucaaaucaccaugcuaccccaucucauagucgaugucagaacccucgaacccaucaugauuccccuccccgacguucguaauaccuuuuuccacuauuccaaccaacccaacucacgcaugcgccuugucgccaugcucuacacuccccuccgcucaaacggcuccggcgacgacgucuucacaguauccugccgcguauuaacccgucccacccccgacuucgaauuuacuuaccuagucccacccuccguagaaucaaaaacaaaacccuucucucuucccauccucacccuguccgaacucaccaacucccgcuuucccguccccaucgauagccucuucacagcccaaaacaacgucuuacaaguucaaugccaaaacggacgaugcacccucgacggcgaacuacaaggcaccacccaacuccucccuuccgguaucugcgccuuccgaggccgcgucaccgcccaaaucaaccaacgcgaccgcuggcauaugcaacuacagaaccucaacggcaccacauacgacccaaccgacgacguccccgcaccccucggaaccccugacuucaaaggcgucgucuucggcauggucucacagcgcaacguuggcagcgacgccccaggcuccacccgagcccaacaagcauggguuuccacauacuccccacaguucguccccaaacucggcuccgucaaucuacgaauauccgacaacgacgacuuucaauuccaacccaccaaauuuacccccgucggcgucaacgacgacgacgacggucaccccuuccgacaaugggaacuucccaacuacucaggcgaacuaacccucaacaugaaccucgcacccccagucgcccccaacuuccccggcgaacaacuccuuuucuuccgcucauucguaccuugcuccgguggcuacaaccaaggcauaauagacugccugaucccacaagaauggauacaacacuuuuaccaagaauccgcaccaucccaaucugacgucgcccuaauacgcuacgucaaccccgacaccggccgcacccucuucgaagccaaacuccaccguagcgguuacaucaccguggcacacucaggcgacuacccacucgucguccccgcaaacggccacuuccguuucgacuccugggucaaccaauucuacagccuagcccccaugggcaccggcaacggccgccgccgagcccaauga

SEQ ID NO: 37790 - RNA, 1623 nt, Artificial Sequence
  derived and/or modified sequence opt11 from VP1__Norovirus_and/or_Norovirus-like__KT315714
augaaaauggccucaaacgacgccgcccccuccaacgauggcgccgccggccuagucccagaaggcaacaacgaaaccuuaccacuagaacccgucgcuggcgcagccauugccgcacccgucaccggccaaaacaacaucaucgaccccuggauccggaccaauuucguacaagccccaaacggcgaguucaccguuagcccccgaaacuccccuggcgaaauccuccucaaucuagaacuaggccccgaccucaacccauaccuagcccaccucuccaggauguauaacggauacgcuggcggcgucgaaguccaaguccuccuagcaggcaaugccuucaccgccggcaaaauccuauucgccgccguaccacccaacuuccccgucgaguuccuaucccccgcccagaucaccaugcuaccccaccuaaucgucgacguccgcacccucgaacccaucaugaucccccuccccgacguccgcaacacguucuuccacuacuccaaccaacccaacucccgcaugcgccuugucgccaugcucuacacaccccuccgaucuaacggcuccggagacgacguuuucaccgucuccugccgcguccucacccguccaaccccagauuucgaguucaccuaccucguaccaccaucagucgaauccaaaaccaaacccuucucacuccccauccuuacacuauccgaacuaacaaacucccgauuucccguccccaucgacucgcuuuuuaccgcacaaaacaacguccuccaaguacagugccaaaacggccgcugcacccucgauggcgaacuccaagguacaacacaacuccuuccaucaggaauaugcgccuuccgaggcagagucacagcacaaaucaaccagcgagaccgcuggcacaugcaacuacaaaaccuaaacggcaccaccuacgacccaaccgacgacguucccgcucccuuaggcaccccagacuucaaaggcguaguauucggcauggucucacaacgcaacgucggcucugacgcucccggcucaacacgugcccaacaagccuggauaagcacauauucaccccaguucgucccaaaacuaggcuccgucaaucuucgcaucagcgacaaugacgacuuucaauuccaaccgacuaaauucacccccgucggaguaaacgacgacgacgacggacaccccuuucgucaaugggaacuacccaacuauuccggagaacucacccuaaacaugaaccuagccccuccugucgcccccaacuuccccggugagcagcuccucuuuuuccgcucauucgucccauguucuggaggauacaaccagggcaucauagauugccuaauaccccaagaauggauacaacauuucuaucaagaaagugcccccucacaauccgacgucgcacucauccguuacgucaaccccgauaccggccgaacacucuucgaagccaaacuacaucgauccggcuacaucaccguagcccacuccggugacuauccccucguuguccccgcaaacggacauuuccgauucgacuccuggguaaaccaauucuacucacuagcccccaugggcaccggcaacggccgccgccgcgcacaauaa

SEQ ID NO: 37791 - RNA, 1623 nt, Artificial Sequence
  derived and/or modified sequence opt11 from VP1__Norovirus_and/or_Norovirus-like__KT315673
augaaaauggccuccaacgacgccgcccccuccaacgacggugccgccggccucguucccgaaggaaacaacgaaacccuaccucucgaaccaguagccggugcagcaaucgccgccccagucacaggccaaaacaacauaauagaccccuggauacgaaccaacuucgugcaggccccaaacggcgaauuuacagucucccccaaaaacucgccaggcgaaauccuccucaaucuagaacucgguccagaccucaauccauaccuagcccaccucagccgaauguacaacggauacgcaggcggagucgaaguccaaguccuacuagcaggcaacgcauucacagccggcaaaauccuauucgccgccgucccacccaacuuccccguagaauuucuuucgcccgcccaaaucaccaugcuaccccaccucauugucgauguccguacacucgaaccaaucaugaucccacuccccgacguccgcaacaccuucuuccacuacagcaaccaacccaacucucgcaugcgccucgucgcuaugcucuacacaccccuacgaucuaacgguuccggagacgacguauucaccgucuccugccguguccuuaccagacccacccccgacuuugaguucaccuaucucgucccacccucagucgaaucaaaaaccaaacccuucucccuccccauccuaacccuaucggaacucaccaacucccgcuuccccguccccaucgacucacucuucaccgcccaaaacaacguccuccaaguccaaugucaaaacggccgauguacccuagacggcgaacuccaaggaacaacccaacuacuacccuccggaaucugcgccuucagaggccgaguaaccgcacaaauaaaccaacgcgaccgcuggcacaugcaacuccaaaaccucaacggcaccaccuacgacccaacggaugacguccccgccccacuaggaacccccgacuucaaaggaguagucuucggaauggucucccaacguaacguaggcaacgacgcucccggcuccacccgcgcccaacaagccugggucucuaccuacucuccccaauucguccccaaacucggcuccgugaaccuccguauauccgacaacgacgacuuccaauuccagcccaccaaauucacaccagucggagucaaugacgacgacgacggacaccccuucagacaaugggaacuaccaaauuacucuggcgaacuaacacucaacaugaaccucgccccgcccgucgcccccaacuuucccggugaacaacugcuauucuuccgcucauucguccccugcagcggcggcuauaaccaaggcaucaucgacugccucaucccgcaagaauggauccaacacuucuaccaagaauccgcacccucccaaucggacguagcccucauacgauauguaaaucccgacaccggccgcacccuauucgaagccaaacuacacagguccgguuacaucaccguugcacacucuggagauuacccacucguaguccccgccaauggacacuuccgauucgauagcuggguaaaccaauucuacucccucgccccaaugggcaccggaaacggcagacgccgagcacaauaa

SEQ ID NO: 37792 - RNA, 1623 nt, Artificial Sequence
  derived and/or modified sequence opt11 from VP1__Norovirus_and/or_Norovirus-like__KX216792
augaaaauggccucaaacgacgcagcccccuccaacgacggcgccgcaggccuaguccccgaaggaaacaacgaaacccuaccccucgaacccgucgccggagcugcaaucgccgcacccgugacaggccaaaacaacaucaucgacccguggauccgcacgaacuucguccaagccccaaacggagaauuuaccgucucgccccgcaauucccccggcgaaauccuccucaauuuagaacuuggaccugaccucaaccccuaccucgcccaccucagccgaauguacaacggcuacgcaggcggcgucgaagugcaaguacuacucgccgguaacgccuucaccgccggcaaaauccuauucgccgccguuccacccaacuuccccguagaguuccucagucccgcacagauaaccaugcucccccauuuaaucgucgacguacgcacacuagaacccaucaugaucccucuccccgacguccgaaacaccuucuuccacuacagcaaccaacacaacucacgcaugcgccucguggccaugcuauacacuccccugcgcucaaacgguuccggcgacgacguauucaccguauccugccgcguccucacccgcccuaccccagauuucgaauuuaccuaccucguaccacccuccgucgaaucaaaaaccaaacccuucucccuccccauccucacccuguccgaacucacuaacucccgcuuccccguacccauagacucccucuucacagcccaaaacaacguacuccaaguccaaugccaaaacggccgauguacacuagacggagaacuacaaggaaccacccaacuacuacccucagguauaugcgccuuccgcggccgcguuacugcccaaaucaaccaacgcgaccgauggcauaugcaacuacaaaaccucaacgguaccacauacgaccccacugacgacgucccagcaccacucggaacccccgacuucaaaggcgucgucuucggcauggucucccaacgcaacguaggcaacgacgccccaggcucaacucgcgcacaacaagccugggucucaacuuacucaccccaauucguuccaaaacucgguuccguaaacuuccgcaucuccgacaacgacgacuuccaauuccaaccaaccaaauucacgcccguuggcguaaaugacgacgacgacggccaccccuuccgccaaugggaacuucccaacuacucgggagaacucacauuaaacaugaaccucgcaccacccgucgccccaaacuucccaggagaacaacuccuauucuuucgcagcuucguacccugcuccggcggauacaaucaaggcaucaucgacugccuuaucccccaagaauggauacaacacuucuaccaagaauccgccccaucccaauccgacgucgcacuaauccgcuacguuaaccccgacaccggccgcacccuauucgaagccaaacuucaccgcucugguuacaucaccgucgcacacucuggcgacuacccacucgucguaccugccaauggccauuuucgcuucgacuccugggucaaccaauucuacucccuagcucccaugggcaccggcaacggccgccgacgcgcccaauga

SEQ ID NO: 37793 - RNA, 1623 nt, Artificial Sequence
  derived and/or modified sequence opt11 from VP1__Norovirus_and/or_Norovirus-like__KU953398
augaagauggccuccaacgacgccgcccccuccaacgacggcgccgcuggccuuguuccagaaggaaacaacgaaacccucccccucgaacccgucgccggcgccgccaucgcagcccccgucacuggccagaacaacaucauagacccauggauccguacaaauuucguccaagcucccaacggugaauuuaccguaucaccacgcaacucccccggagaaauccuacucaaccucgaacugggccccgacuuaaaccccuaccucgcacaccucuccagaauguauaacggauacgcaggcggugucgaaguccagguccuucuugccggcaacgccuucaccgccggaaaaauacucuucgccgccgucccacccaacuuccccgucgaauuucucucccccgcacaaaucacuaugcuaccacaccucaucguugacguccgcacacucgaacccaucaugaucccccuucccgacguccgcaacaccuucuuccacuacucaaaccaaccaaacucucgcaugcgccuugucgccaugcuauacacuccccuccguuccaacggcuccggcgacgacguauucaccgucuccugccgcguccuaacccgcccaacacccgacuucgaguucaccuaccucgucccaccauccgucgaauccaaaacuaaaccuuucagcuuaccuauccugaccuuaucagaacuuaccaauucccgcuuccccguacccauugauucccucuucacugcccaaaacaacguccuccaaguucaaugccaaaacggccgauguacccuagacggcgaacuacaaggcacuacccaacuccuacccuccgguaucugcgccuuccgaggccgcguaaccgcacaaaucaaccaacgcgaucgcuggcauaugcagcuccaaaaccuaaacggcaccaccuacgaccccaccgacgacguccccgcaccccuaggaacucccgacuucaagggcgucguauucggcauggucucccaacguaacguagguaccgacgcccccggcuccacacgagcucaacaagccugggucuccaccuacucaccccaauucguccccaaacucggcuccguaaaccuccgcauuuccgauaacgacgacuuccaguuccaacccaccaaauucacccccguaggcgucaaugacgacgacgacggccaccccuuccgacaaugggaacuacccaacuauucaggcgaacuaacccucaacaugaaccucgccccacccgucgcaccgaacuuccccggcgaacaacucuuauucuuccgcucauucguacccuguucuggaggcuauaaccaaggcaucauugauugccucaucccccaagaauggauccaacacuucuaucaagaauccgcacccucacaauccgacgucgcccuaauccgcuacgucaauccggacaccggacgaacacuauucgaagccaaacuccaccgauccggcuacauaaccgucgcccacuccggagacuacccuuuagucguaccagccaacggccacuuucgcuucgacagcugggucaaccaauuuuacucacucgcccccauggguaccggcaacggccgccgccgcgcgcaauaa

SEQ ID NO: 37794 - RNA, 1623 nt, Artificial Sequence
  derived and/or modified sequence opt11 from VP1__Norovirus_and/or_Norovirus-like__KU557888
augaaaauggcauccaacgacgccgccccauccaacgacggcgccgcaggacucgugccugaaggcaacaacgaaacacucccccucgaaccuguugccggcgcagcaauagccgccccgguaacuggacaaaacaacauaauugacccauggauacgaacgaacuucguccaagccccaaacggugaauuuaccgucucuccccgcaacucccccggcgaaaucuuacucaaccuagaacucggcccagaccuuaaccccuaucuagcccaucugucccgaauguauaacggcuacgccggcggcguagaaguccagguacuccuagccggaaacgccuucaccgccggcaaaauccuuuucgccgccguaccacccaacuucccaguagaauuucucucucccgcacaaauaacaaugcucccccaccucauagucgacguccgaacccuagaacccaucaugauaccccuaccagaugucagaaacaccuucuuccacuacucaaaccaacccaacucacgcaugcgccucgucgcaaugcucuacacaccccuccgauccaacggcuccggcgacgacgucuucaccguauccugccgcguccucacccgccccacccccgacuucgaauuuaccuaccucgugcccccgucugucgaaucaaaaacaaaacccuucucccuaccuaucuuaacccuaucagaacucacaaacucacguuucccaguccccaucgacucccucuucaccgcccaaaacaacguccuccaaguacaaugccagaacggccgcugcacacucgacggcgaacuucaaggcuccacacaacuccuaccauccggcauuugcgccuuccgcggccgaguaaccgcucaaauaaaccaacgcgaucguuggcacaugcaacugcaaaaccucaacggcaccacauacgacccaacugacgacguccccgcaccccuaggcacccccgacuucaaaggcguaguauucggcauggucucccaacgcaacgugggcaacgacgcaccaggauccacacgugcacaacaagccugggucuccaccuauucgccccaauucgucccaaaacugggauccguuaaccugcgcaucuccgacaacgacgacuuccaguuccagcccaccaaauucacacccguaggaguaaacgacgaugaugacggccaccccuuccgacagugggaacuacccaauuacuccggcgaacuaacacuuaacaugaaccucgccccacccgucgccccuaacuuucccggugaacaacuccuauucuuccgcucuuucguccccugcuccggcgguuacaaccaggguaucaucgauugccucaucccccaagaauggauacaacacuucuaccaagaauccgcccccucacaaucagacgucgcacucauacgguacgucaaccccgacacgggacgcacacuauucgaagccaaacuacaccgauccggcuacaucaccgucgcccacucaggcgacuacccccucguaguaccugcaaacggccacuucagauucgacucuuggguaaaccaauucuauucccucgcccccaugggcacugguaacggucgccgccgagcccaauaa

SEQ ID NO: 37795 - RNA, 1623 nt, Artificial Sequence
  derived and/or modified sequence opt11 from VP1__Norovirus_and/or_Norovirus-like__KU557808
augaaaauggcaucgaacgacguagcucccuccaaugacggcgccgccggauugguacccgaaggcaacaaugaaacauuaccacucgaaccagucgccggcgccgccaucgccgccccaguaaccggacaaaacaacauaauugaccccuggauccgcaccaacuucguacaagcuccaaacggcgaauuuacaguauccccacgaaacucacccggcgaaauacuccuaaaucucgaacucggccccgaccuaaaucccuaccuagcgcaccucucucgcauguacaacggauacgccggcggcgucgaaguccagguacuccuagccggaaacgccuucaccgcagguaaaauccucuucgccgccgucccacccaacuucccugucgaauuucucucucccgcgcaaaucaccaugcucccccaccugaucgucgacguacgaacacuagaaccaauaaugauuccccuacccgacguacgaaacaccuucuuccacuauucaaaccaacccaacucccgcaugcgccuagucgcaaugcuauacacccccuuacguucaaacggcucaggggacgacgucuucacagucuccugccgcguccuuacccgacccacccccgacuucgaguucaccuaccucguacccccuuccgucgaaucuaaaaccaaacccuucucacuccccauccuuacccucuccgaacuaaccaauucacgcuuuccaguuccuauagauucccuauucaccgcccaaaacaacguacuccaaguacaaugccagaacggccgcugcacccucgacggcgaacuccaaggcacuacucaacuacuaccauccggcauaugcgccuuccguggccgagucacagcacagaucaaccaacgagaccgcuggcacaugcaauuacaaaaccuuaacggcaccacauaugaccccaccgacgacguacccgcaccccucgguacccccgacuucaaaggcgucgucuuuggaauggucucccagcgcaacgucggcaacgacgccccaggaucuacccgagcccaacaagccugggucucaacauacucuccccaauucguccccaaacucggcuccgucaacuuacgaaucuccgacaacgacgacuuccaauuccaaccaaccaaauucaccccagucggugucaacgacgacgacgauggccaccccuuccgccaaugggaacuacccaacuauucgggagaacucacacucaacaugaauuuagccccacccgucgccccaaacuuccccggcgaacaacuccucuucuuccgauccuucguccccuguucaggcggcuacaaccaaggcauuaucgacugccucaucccacaagaauggguacaacacuucuaccaagaauccgcccccucacaaucggacguagcccuaauacgcuacguaaacccagacaccggccgaacccucuuugaagcaaaacuccaccgcuccggcuacaucaccguagcccacucaggcgacuauccccuaguggucccugccaacggccacuuccgauucgacuccuggguaaaccaauucuacucccucgcucccaugggaacaggaaacgggcgccgcagagcccaauaa

SEQ ID NO: 37796 - RNA, 1623 nt, Artificial Sequence
  derived and/or modified sequence opt11 from VP1__Norovirus_and/or_Norovirus-like__KU557807
augaagauggccuccaacgacgucgccccauccaacgacggagcagccggcuuaguacccgaaggcaacaacgaaacccuuccccucgaacccgucgccggcgcagcaauagcagccccugucaccggccaaaacaauaucaucgacccuuggauccgaaccaacuucguacaagcucccaacggcgaauuuaccgucagcccccgaaacucaccaggagaaauccuccucaaccucgaacucggcccugaucuaaacccuuaccucgcccaccuauccagaauguauaauggcuacgcuggcggagucgaaguacaaguccuccucgccggcaacgccuucacugccggcaaaauccuauucgcagccguucccccaaauuuccccgucgaguuccucucccccgcccaaaucaccaugcuaccacaccucauagucgacguacgcacacucgaacccauuaugaucccccuucccgacguacgcaacacuuucuuccacuacucuaaccaacccaacucacgcaugcgccuugucgccaugcuauacacuccccuacgauccaacggcuccggcgacgauguauucaccgucuccugccguguacuuacacgacccaccccagacuucgaguucacauaccucgucccucccuccgucgaauccaaaaccaaaccuuucucgcuacccauccucacucuaucagaacuuaccaacucacgcuucccaguacccaucgacagucuuuucaccgcacaaaauaacguccuccaaguccaaugccagaacggccgcugcacacucgacggcgaacuccaaggaacaacccaacuacuccccuccggcaucugcgccuuccguggccgcguaaccgcacaaaucaaccagcgcgaccgcuggcacaugcaacuacaaaaccucaacggaacuaccuacgaccccacagacgacguccccgccccucuuggcacccccgacuucaaaggugucgucuucggcaugguuucacaacgcaacgucggcaacgaugcccccggcuccacccgagcccaacaagccugggucuccaccuacucaccccaauucguccccaaacuaggcuccgucaaccuccgcauuucagacaacgaugacuuccaauuccaaccuacgaaauucacccccgucggagucaacgacgacgaugacggccacccauuucgccaaugggaacuccccaacuacuccggcgaacucaccuuaaacaugaaccucgcacccccuguagcccccaacuuuccuggcgaacaacuacucuucuuccgauccuucguccccugcucaggcggcuacaaccaaggaaucaucgacugcuuaauaccccaagaauggauccagcacuucuaccaagaauccgcucccucucaaucagacguagcccuuauccgcuacgucaacccagacaccggccgaacccucuucgaagccaaacuucaccgcucagguuacauaaccguagcccacucaggugacuacccccucgucguacccgcuaacggccacuucagauucgacuccugggucaaccaauucuauucacucgcacccauggguacaggcaacggccgccgccgcgcacaauaa

SEQ ID NO: 37797 - RNA, 1623 nt, Artificial Sequence
  derived and/or modified sequence opt11 from VP1__Norovirus_and/or_Norovirus-like__KX371111
augaaaauggccuccaacgacgccgcacccucaaacgacggcgccgcaggccucguucccgaaggcaacaacgaaacacuaccacucgaacccgucgcaggcgcagcuaucgccgccccaguaaccggccaaaacaacaucauugaccccuggauacgcaccaacuucguacaagcacccaacggcgaauuuaccguauccccucgcaacucaccuggcgaaauccuccucaaccucgaacucggcccagaccuaaacccauauuuagcccaccuaucacguauguacaacggcuacgccggggguguagaaguccaaguccuacucgcaggaaacgccuucaccgcaggcaaaauccucuucgccgccguacccccaaauuuccccguagaauuucuauccccagcacaaauuacaaugcucccacaucuuaucguagacguucgcacccucgaacccaucaugaucccccucccagacguacguaacaccuucuuucacuacuccaaccaacccaacucucgcaugcgacucgucgccaugcucuacacaccccuccgcucaaacggaucaggcgacgacguauucaccgucucaugccgaguacucacucgucccacacccgauuucgaguucacuuaccucgugccucccucugucgaauccaaaaccaaacccuucuccuuacccauccuuacucucucggaacuaaccaacucucgauucccaguccccauagacucccuguucaccgcacaaaacaacguccuacaaguacagugccaaaacggacgcugcacccucgacggcgaacuccaaggcacaacucaacuccuccccacgggcaucugcgcauuccgcggccgcgucaccgcccaaaucaaccagcgcgaccgcuggcacaugcaacuccaaaaccuuaauggcacaaccuacgaucccaccgacgacguccccgcaccccuaggaaccccagacuucaaaggcguagucuucggcauggucucccaacgaaacgucggcuccgacgccccaggauccacccgcgcgcaacaagccuggguaucgacuuacuccccucaauucguccccaaacuuggcucugucaaccuccgcauaucagauaacgacgacuuccaauuccagcccacaaaguucacccccguaggcgucaacgacgacgacgauggccaccccuuccgacaaugggaacuccccaacuacuccggcgaacucacacuaaacaugaaccucgccccacccgucgcaccaaacuucccaggcgaacaacuccucuucuuccgcuccuucguccccugcuccggcggcuacaaucaaggaauaauagacugccuuaucccacaagaguggauccaacacuucuaccaagaauccgccccaucccaaucagacguugcccuuauccgcuaugucaacccagacaccggcagaacccuauucgaagccaaacuccauagaucaggcuacaucaccgucgcacacuccggagacuauccccuugucguccccgccaacggacauuuccgcuucgauucaugggucaaccaauucuacucacuugcccccaugggaaccggcaacggccgccgacgagcccaauaa

SEQ ID NO: 37798 - RNA, 1623 nt, Artificial Sequence
  derived and/or modified sequence opt11 from VP1__Norovirus_and/or_Norovirus-like__KX371110
augaagauggccagcaacgacgccgcccccuccaaugacggcgcagccggccuaguccccgaaggaaacaacgaaacccucccucucgaacccgucgccggagccgcaauagcagcucccguaaccggacaaaacaacauuaucgacccguggauccgaaccaacuucguccaagccccaaacggcgaauuuacuguaucaccccgcaacuccccgggcgaaauccuccuaaaccucgaacucggucccgaccucaaccccuaccuagcccaccuaucacgaauguauaacggcuacgccggcggcguagaaguccagguccuccucgccggaaacgccuucaccgccggcaaaauccuauucgcagcuguaccacccaauuuccccgucgaguuccucucccccgcacaaaucacaaugcuuccccaccuaauaguugacguccgcacccucgaacccauaaugaucccccugccagacguacgcaacacauucuuccacuacagcaaccaacccaacucucgaaugcgucucgucgccaugcuauacacuccccuucgauccaacggcucaggcgacgaugucuucaccgucuccugcagaguacucacgcgacccacccccgacuuugaguucacauaccuaguucccccuucagucgaauccaaaacuaaacccuucucacuucccauacucacccuuuccgaacugaccaacucacgcuuucccguccccauagacucacuauucaccgcccaaaacaacguccuccaaguccaaugccaaaacggccgaugcacacucgacggagaacuccaaggaaccacgcaacuacuaccaucugguaucugugcauuccgcggccgcguaacugcacaaauaaaccaacacgaccgcuggcacaugcaacuccaaaacuuaaacggcacgacauaugacccaacagacgacgucccagcaccccuaggaaccccagacuucaaagguguaguauucggaauggucucgcaacgcaacgucggcaccgacgccccaggaucaacccgagcccaacaagccugggucuccacuuacucaccacaauucguccccaaacucggaucagucaaucuccgcaucuccgacaacgacgacuuccaauuccaacccaccaaauucacccccguaggcgucaacgacgacgacgacggccaucccuuccgccaaugggaacuccccaacuacucaggcgaacucacacuaaacaugaaccucgccccacccgucgcccccaacuucccuggcgaacaacuccuauucuuucguuccuucguaccaugcuccggcggcuacaaccaaggcauaaucgacugccuaaucccccaggaauggauccaacacuucuaccaagaaucagcccccucccaauccgacguagcacucauucgauacguaaaccccgacaccggccgcacacucuucgaagcuaaacuccaucgcucaggcuacaucaccguugcccacucaggcgacuacccacucgucgucccagccaacggacacuuccgcuucgacuccuggguaaaccaauucuacucccucgcccccaugggaacaggcaacggccgacguagagcacaauga

SEQ ID NO: 37799 - RNA, 1623 nt, Artificial Sequence
  derived and/or modified sequence opt11 from VP1__Norovirus_and/or_Norovirus-like__KX134669
augaaaauggcauccucggacgcugcccccuccaacgauggcgccgccggccucguccccgaaggcaacaaugaaacccucccccucgaacccguagcaggagcagcaauagccgcacccgucacaggucaaaacaacaucaucgaccccuggauccgcacuaacuucguccaagcccccaacggcgaguucacaguaucaccccgcaacuccccaggcgaaauccuccucaaccuagaacucggacccgaccucaacccauaucucgcacaccucucccgaauguacaacggcuacgccggcggcgucgaaguacaaguacugcucgccggcaacgccuucaccgccggcaagauccuauucgccgcagucccacccaacuuccccgucgaguuccucucccccgcccaaaucacuaugcuaccccaccucauaguagacguccgcacccuagaaccaauaaugaucccccuccccgacguccgcaacaccuucuuccauuacagcaaccaacccaacucccgaaugcgccucgucgcaaugcucuauaccccacuccguucaaacgguuccggcgacgacguauucaccgucuccugccgagugcucacacgaccaacuccagacuucgaguucacuuaucucguaccacccuccgucgaauccaaaaccaaacccuucucucuccccauccuaacgcuguccgaacucaccaacucaagauuccccgucccaauagacucacucuucacagcccaaaacaacguccuacaaguccagugccagaacggacgcugcacccucgacggcgaacuccagggcaccacccaacuccuccccuccgggaucugcgcauuccggggaagaguuaccgcccaaaucaaccagagagaccguuggcacaugcaacuacaaaaccuaaacggaaccacauacgaccccaccgaugacguccccgccccacuuggcacacccgacuucaaaggagucguuuucggcauggucagccaacgaaauguaggcaacgaugcaccaggcuccaccagagcucaacaagccuggguauccacuuacucuccccaauucguccccaaacucggcuccgucaaccuccgaauuucugacaaugacgacuuccaguuccaacccaccaaauuuacacccgucggaguuaacgacgacgacgacggccacccguuccgccaaugggaacuccccaacuacuccggagaacuaacccuaaacaugaaccuagccccgcccguagccccaaacuuucccggcgaacaacuacuauucuuucgcuccuucgucccaugcagcggaggcuacaaucaaggcaucauugacugccucaucccccaagaauggauccaacacuuuuaccaagaaucagcccccucacaaucagaugucgcccucauccgcuauguaaaccccgacacuggccguacacucuucgaagccaaacuccaccgauccggcuacaucaccgucgcacacuccggcgacuacccuuuagucguccccgcaaauggccacuuccgauucgacucaugggucaaccaguucuacucccucgcuccuaugggaaccggaaacggccgacgccgagcccaauaa

SEQ ID NO: 37800 - RNA, 1623 nt, Artificial Sequence
  derived and/or modified sequence opt11 from VP1__Norovirus_and/or_Norovirus-like__KU557871
augaaaauggccucuaacgacgcagcccccucaaacgacggcgccgccggccucguuccagaaggcaauaacgaaacacuaccccuagaacccgucgccggugccgcaaucgccgcccccguaaccggacagaacaacauaaucgaccccuggauucgaacuaacuucguccaagcaccuaacggcgaauuuacugucuccccucgcaacucccccggcgaaauccuacugaaccuagaacucggccccgaccucaaccccuaccucgcucaccucucacgaauguacaacggauacgcaggaggagucgaaguacaaguacuacucgccggcaacgccuucaccgcaggcaaaauacucuucgccgccgucccacccaacuuccccgucgaauuuuuaucacccgcccaaauuaccauguuaccccaccuaaucguugacgugcgaacccucgaacccaucaugauuccccuccccgacguccgaaacacuuucuuccacuacagcaaccaacccaauucccgaaugcgccuagucgccaugcuuuacacaccacuacguuccaacggcuccggcgacgacgucuucaccgucagcugccgaguccucacccgacccacacccgacuucgaguucacauaccuagugccucccucuguagaauccaaaacaaaaccuuucucccuccccauucucacccuaucagaacuaacuaacucccgcuuucccguccccaucgacucccucuucacagcccaaaacaacgcacuccaaguacaaugccaaaacggccgaugcacccuugacggcgaacuccaaggaacuacucaacuccuccccuccggaaucugcgcuuuccgaggacgcguaacagcccaaauaaaucaacgcgaccguuggcacaugcaacuacaaaaccuuaacggcacaacguacgaccccaccgacgacguccccgccccuuuaggcaccccagacuucaaaggcgucgucuucgggaugguuucacaacgcaacguagguaacgaugcccccggaucuacccgcgcccaacaagccugggucuccaccuacuccccacaauucguccccaaacucggcuccgucaaccucagaaucucugacaacgacgacuuccaauuucaaccaacuaaauucacccccguuggcguaaacgacgacgacgacggacacccauuccgccaaugggaacuacccaacuacucaggcgaacucacccucaacaugaaccuugccccucccgucgcccccaacuuucccggcgaacaacuucucuucuuccgcuccuucguccccugcuccggcggcuacaaccaaggaaucauugacugccuaauuccccaagaauggauacaacacuucuaccaagaaucugcccccucacaaucagacgucgcgcuaauccgcuacguuaacccagacacaggccgcacacucuucgaagccaaacuccaccgcuccggcuacaucaccguagcccacuccggcgacuacccccucguagucccagccaauggccacuuccgcuucgacuccuggguaaaccaauucuacagucuugcccccauggguaccggcaacggccgccgccgcgcacaauag

SEQ ID NO: 37801 - RNA, 1623 nt, Artificial Sequence
  derived and/or modified sequence opt11 from VP1__Norovirus_and/or_Norovirus-like__KX371108
augaaaauggccuccaacgacgcagcccccuccaacgauggcgcagcuggccuugucccugaaggcaauaacgaaacccucccccucgaacccgucgccggcgcagccauagccgcacccgucaccggccaaaacaacauaauagaccccuggauacgcacaaacuuuguccaagccccaaacggcgaauuuaccgucagcccccgcaacuccccuggagaaauccuccucaaccuugaacucggcccagaucucaaccccuaucucgcccaccucucgcgaauguacaacggcuacgcaggcggagucgaaauccaaguccuccucgccggaaacgcguucaccgccggcaagauacuauucgccgcagucccucccaacuucccugucgaauuucuauccccagcacaaaucaccaugcucccccaccuuaucguagacguccggacacucgaaccaaucaugauaccccuccccgacguccgaaacaccuucuuccacuauuccaaccaacccaacuccagaaugcgacucgucgccaugcucuacacaccccuccguucaaacggcucuggagacgacguauucaccgucucuugccgcguucucacacgacccacccccgacuucgaguucacauaccucguacccccaucagucgaauccaaaacuaaacccuucucccuccccauccuaacccucuccgaacuaacaaacucccgcuuccccguccccaucgacucacuauucaccgcccaaaacaacguauuacaaguccaaugccagaacggccgcugcaccuuagacggcgaacuccaaggaacaacacaacuccucccuaccggaaucugcgccuuccguggacgcgucaccgcccaaaucaaccaacgcgaccgcuggcacaugcaacuccaaaaccuaaacggcacuacauacgacccaaccgacgacgucccugcaccacucggcaccccugauuucaaaggugucgucuucgggauggucucacaacgcaacgucggcuccgacgcacccggcagcacccgcgcccaacaagccugggucagcaccuacuccccacaauucguacccaaacucggcuccguaaaccuacgcaucuccgacaacgaugauuuccaauuccagcccaccaaauuuacccccguaggcgucaaugacgacgacgauggucacccauuccgacaaugggaacucccaaacuacucuggggaacuuacccucaacaugaaccucgccccacccgucgcacccaacuuucccggcgaacaacuccucuucuuccgcucguucguucccugcuccggcggcuacaaucaaggcaucauagacugccucauaccacaagaauggauacaacauuucuaccaagaaagcgcccccucccaaucugacgucgcccucauccgcuacguaaaccccgacacaggccgcacccuauucgaagccaaauuacaccgaucaggauacaucacugucgcccauuccggcgauuacccccucgucguuccagccaacggccauuuccgcuucgacuccuggguaaaccaauucuacucccuugcccccaugggcacaggcaacggucgccgccgcgcccaauaa

SEQ ID NO: 37802 - RNA, 1623 nt, Artificial Sequence
  derived and/or modified sequence opt11 from VP1__Norovirus_and/or_Norovirus-like__KU557829
augaagauggcauccaaugacgccgcccccuccaacgacggugcagcaggccucguccccgaggggaacaacgaaacccucccccucgaacccgucgccggcgcagccaucgcagcacccguaacaggccaaaacaacaucaccgacccguggauccgcaccaacuucguacaagcccccaacggagaguucacagucucuccccguaacuccccaggugaaauccuccucaaccuagaacucggacccgaucuaaaccccuaccucgcccaccuaucaagaauguacaacggauacgccggaggcguugaaguccagguccuccuugcaggcaaugcuuucaccgccggaaaaauccucuucgccgccgucccaccaaacuuccccguagaguuccucucccccgcccagaucaccaugcucccacacuugaucgucgacguccgcacccucgaaccuaucaugaucccacuucccgacguccgcaacaccuucuuccacuauagcaaccaaccgaacucccgcaugcgccucgucgcuaugcucuacacaccacuccgaucaaacggcuccggcgacgacgucuucacuguauccugccgaguccucacccgacccaccccagacuucgaauuuacauaccuugucccaccguccguagaauccaaaaccaaaccauucucccuccccauacucacccuauccgaacucaccaacucucgcuuucccgucccuaucgacucauuauucacagcccaaaacaacguacuucaaguccaaugccaaaacgggcgcugcacccuagacggcgaacuccaagggaccacccaacuacucccaagcggcauaugcgcauuccgaggccgcgucaccgcccaaaucaaccaacgcgaccgcuggcacaugcaacuccaaaaccuaaauggaacaaccuacgaccccacagacgacguacccgccccacucggcacuccagacuucaaaggcguaguguucggcauggucucacaacgaaacgucggcaacgacgcaccagacucaacccgcgcacaacaagcaugggucucuacguacucuccccaauucguaccaaaacucggcucgguuaaccucaggauuuccgacaacgacgauuuccaauuccaacccacaaaauucacaccagucggaguaaaugacgacgacgacggacaccccuuccgccaaugggaacuacccaacuacuccggcgaacuaacacuuaacaugaaccucgccccacccguugccccaaacuuccccggugaacaacuccucuucuuccgcuccuucguccccugcuccggcggcuacaaccaaggcaucaucgauugcuuaauaccacaagaauggauacaacacuucuaccaagaaucagcuccaucccaauccgaugucgcacugauccgcuacgucaacccugacaccggccguacccuuuucgaggcuaaacuccaucgauccggauacaucacagucgcccacuccggcgacuacccacuugucgucccagcaaacggccauuuccguuucgacuccugggucaaccaauuuuacucccuugcucccaugggcacaggcaauggccgccgacgagcccaauaa

SEQ ID NO: 37803 - RNA, 1623 nt, Artificial Sequence
  derived and/or modified sequence opt11 from VP1__Norovirus_and/or_Norovirus-like__KX168452
augaaaauggcguccaacgacgcagcacccucaaacgacggcgccgccggacucgucccagaaggcaauaacgaaacacucccacucgaacccgucgccggcgccgccauagcagccccaguuaccggccagaacaauaucauagaccccuggauacgaaccaacuucguccaagcuccaaauggugaauuuacaguauccccacguaacuccccaggcgaaauacuacucaaccuagaacucggacccgaccuaaaccccuaccucgcccaucucucaagaauguacaauggauacgccggcggagucgaaguacaaguacuccucgcgggcaacgccuucaccgccggcaaaauccuauucgccgccguaccacccaacuuccccgucgaauuucucuccccagcacaaaucacaaugcucccccaccuaaucgucgacguccgaacacucgaacccaucaugaucccccuucccgacguccgaaauacauucuuccacuacagcaaccaaccaaacucaagaaugcgccuagucgcaaugcuuuacacaccccuccguucaaacggcucaggugacgacguuuucaccgucuccugccguguccuaacccgccccacccccgacuucgaguucacauaucucguacccccauccguagaauccaaaacaaaacccuucucccuccccauccuuacucucucagaacucaccaacucacgauuccccgcaccaauugauucacuguucacagcucaaaacaacguccuccaaguccaaugucaaaacggccgcugcacccuugacggcgaacuccaaggcacaacgcaacuauuacccucaggcaucugugccuuucgcggccgaguaacagcacaaaucaaccagcgagaccgcuggcacaugcaacuucaaaaucuaaacgguacaaccuacgacccaaccgacgacguaccagcaccacuaggcacgccugacuucaaaggcgucguuuucggcauggucucucaacgcaacgugggcagugacgcacccggcuccacccgagcccagcaagccugggucucuacauacucuccccaauucguaccuaaacucggauccgucaaccuccgcaucucugacaacgacgacuuccaauuucagccaaccaaauucacccccguaggcguaaaugaugacgacgacggccaccccuuccgccaaugggaacuccccaacuacucaggcgaacucacccucaacaugaaccuagccccacccguugcccccaacuuccccggagaacagcuccucuucuuccgcagcuucguaccaugcucaggaggcuacaaccagggcauaaucgacugccucaucccccaagaauggauccaacacuucuaucaagaauccgcccccucacaauccgacguugcccuuauccgcuacguaaaccccgacacaggccgcacccuuuuugaagccaaacuccaccgcucagguuacaucaccguggcccacagcggcgacuacccuuuagucgucccagccaacggacauuuccgcuucgacuccugggucaaccaauucuacucucuagcacccaugggcaccggaaauggucgucgccgagcccaauga

SEQ ID NO: 37804 - RNA, 1623 nt, Artificial Sequence
  derived and/or modified sequence opt11 from VP1__Norovirus_and/or_Norovirus-like__KU953393
augaagauggccucaaacgacgccgccccaucaaacgauggagccgccggccucguccccgaagguaacaacgaaacucuaccccucgaacccguagccggagccgccauagccgccccugucacuggccaaaacaauauaaucgacccauggauacgcacaaacuucguccaagcccccaacggugaguucaccgucucccccaggaacucccccggcgaaauccuccucaaccuagaacucggccccgaccuaaaccccuaccucgcacaccugucccgcauguacaacggcuaugccggcggcgucgaaguccaaguccuacucgccggcaacgcuuucaccgcaggcaagauacuauucgccgccguaccuccaaacuucccaguugaguuccucuccccugcccaaauaaccaugcuaccucaucucauugucgacguccggacgcucgaacccauaaugauaccucuccccgacgucagaaacaccuucuuccacuacuccaaccaacccaacucccgcaugcgucucguagcaaugcucuacacaccccuacgauccaacgguuccggagacgacgucuucaccguaucaugccgaguccuaacccgcccuacccccgacuucgaguucaccuaccuagucccgcccucagucgaauccaaaaccaaacccuucucccuccccauccuuacccugucugaauuaacuaacucccgcuuccccguccccauagacucacucuucaccgcccaaaauaacguccuccaaguacaaugucagaacggccgauguacccuggacggagaacuacaaggaaccacccaacuucuaccaucguccaucugcgcauuccgcggacgaguaacugcccaaauaaaccaacgcgaccgcuggcacaugcaacuacagaaccuaaaugguaccaccuacgacccgaccgaugacguacccgcaccccucgggacccccgacuucaaaggaguagucuuuggcaugguaucacagcgcaacgucggauccgacgcaccaggcuccacccgagcacaacaagcauggguuuccaccuacuccccacaauucguccccaaacuaggauccgucaaccuccgcaucucagacaacgacgacuuccaauuccaaccuacaaaauuuacccccguaggcgucaacgacgacgacgacggccacccauuccgccaaugggaacuaccuaauuacucaggcgaacuuacacuaaacaugaacuuagcaccacccgucgcacccaauuuccccggcgaacaacuucuauucuuccgcagcuuuguccccugcucuggcggcuauaaucaaggaauaaucgacugccuuaucccccaagaauggauacaacacuucuaccaagaauccgcccccucccaguccgacgucgcccucauccgauacguuaaccccgauaccggacgcacacucuucgaagccaaacuccaccgcuccggcuacaucaccgucgcacacuccggagacuacccgcucguuguccccgccaacgggcacuuccgauucgacuccugggucaaccaauucuacucacucgcccccaugggaaccgguaauggccgccgacgcgcccaauaa

SEQ ID NO: 37805 - RNA, 1623 nt, Artificial Sequence
  derived and/or modified sequence opt11 from VP1__Norovirus_and/or_Norovirus-like__KR052020
augaaaauggccucuaacgaugcagcccccucaaacgacggugccgccggccucgucccugaaggcaacaacgaaacccuaccauuagaacccguagccggcgcagccauugccgcccccgucacuggccaaaauaauaucaucgacccauggauacgaaccaacuuuguccaagcccccaacggcgaauuuaccgucucaccacgcaacagccccggagaaauccuacucaaccucgaacucggaccagaccucaaccccuaccucgcacaccucuccagaauguacaacggauacgccggaggcgucgaaguucaaguucuccuugccggaaacgcauucaccgccggcaaaauccucuucgcggccgucccacccaacuucccugucgaauuucuaucacccgcacaaauaaccaugcuaccccaccuuaucguggacguacgcacccucgaacccaucaugauuccccuacccgauguccgaaacaccuucuuccacuacuccaaccaacccaacucucgaaugcgccucgucgccaugcucuacaccccauuacgcuccaacggcagcggagacgacgucuucaccgucuccugccgcguccucacccgccccacccccgacuucgaauuuaccuaccuaguacccccauccgucgaaucuaaaaccaagcccuucucccuccccauccucacccuaucugaacucaccaacucacgauuccccguccccaucgacucccuauucacggcccaaaacaacguccuccaaguccaaugccaaaacggccgcugcacccucgacggcgaacuccaaggcaccacacaacuccuccccuccggcauaugcgccuuccgcggccgaguuacugcccaaaucaaccaacgcgaucgcuggcacaugcaacuccaaaaccucaacggcacaaccuacgaccccaccgacgacguucccgccccucuaggaacacccgacuucaaaggcguagucuucggcaugguaucacaacgcaacgucggcaacgacgcacccggcuccacccgcgcccagcaggccugggucuccacuuacuccccacaauucguucccaaauugggcuccgucaaccuccgcauaucagacaacgaugacuuccaauuccaaccaacaaaauucacccccgucggggucaacgacgacgacgacggccaccccuuccgucaaugggaacucccaaacuacagcggcgaacucacacuaaacaugaacuuagccccgccgguagcaccaaacuucccaggagaacaacuucucuucuuccguucauucguacccugcuccgguggcuacaaucaaggcaucaucgauugccucauaccacaagaauggauacaacacuucuaccaagaauccgcacccucccaacccgacgucgcccucauccgcuacguaaacccagacaccggccgaacgcuuuucgaagccaaacuacaccgcucaggauauaucaccgucgcccacucaggagacuacccccucgucgucccagccaacggucauuuccgauucgacuccugggucaaccaauucuacucccucgccccaaugggcacuggcaauggccgccgacgcgcccaauga

SEQ ID NO: 37806 - RNA, 1623 nt, Artificial Sequence
  derived and/or modified sequence opt11 from VP1__Norovirus_and/or_Norovirus-like__KT315687
augaaaauggcauccaacgacgccgcaccauccaacgacggcgcagcuggacucguccccgaaggaaacaacgaaacccucccccucgaacccguagccggcgcagccauugccgccccaguaaccggccaaaacaacaucauagacccauggaucagaaccaacuucguccaagcccccaauggcgaauuuacuguauccccacgcaacucuccaggagaaauccuccucaaccuagaacucggacccgaccuuaaccccuaccuugcccaccucagccgcauguacaacggcuaugccggcggcguagaaguccaaguacuccucgccggcaacgccuucacagcagguaaaauccucuucgcagccguaccgcccaacuuccccgucgaguuccuuucucccgcucaaaucaccaugcucccccaccucaucguagacguacgcacccucgaaccuauaaugauaccccuacccgacguccgcaacacauucuuccacuacucaaaccaacccaacucccgcaugcgccucgucgcaaugcuauacacaccccuacgcuccaacggauccggcgacgacgucuucaccgucucuugccgaguccuuacccgccccaccccagacuucgaguucaccuacuugguuccaccaucagucgaauccaaaaccaaacccuucucucuacccauacucaccuuaucagaacuuaccaacucccgcuuccccguccccauagacucccucuucaccgcccaauccaacguacuacaaguccaaugccagaacggccgcugcacucuagauggagaacuccaaggcaccacgcagcuccucccaacuggcauaugcgccuuccgaggccgcgucaccgcacagaucaaccaaagagaccgcuggcacaugcaacuccaaaaucucaacggcaccacauaugaccccaccgacgacguccccgccccacuaggaacccccgacuucaaaggcguagucuucggaauggucucccaacgcaacgucggcaacgacgcuccagguuccacccgcgcacaacaagcaugggucuccaccuacucuccccaauucguccccaaacucggcuccgucaaccugcgcaucuccgacaaugacgacuuccaauuucaacccaccaaguucacaccagucggagucaacgacgacgacgacggccacccauuccgccagugggaacuccccaacuacuccggcgaacucacacuuaauaugaaccucgcacccccagucgcccccaacuuccccggugaacaacugcuauucuuccgaucauucguucccugcucaggaggcuacaaccaaggaaucaucgacugccuaaucccccaagaauggauccaacacuucuaccaagaauccgcccccucacaaucagacgucgcucucauccgauacgugaaccccgacaccggccgcacucucuuugaagcgaaacuucaccgcuccggcuacauaaccgucgcccacuccggugacuacccccucgucguuccugccaacgggcacuuccgauucgacuccugggucaaccaauucuacucacucgcccccaugggcacuggaaacggcagacgccgugcacaauaa

SEQ ID NO: 37807 - RNA, 1623 nt, Artificial Sequence
  derived and/or modified sequence opt11 from VP1__Norovirus_and/or_Norovirus-like__KX356908
augaaaauggcaucuaacgaugccgccccuuccaaugauggcgcagccggccucguaccugagggcaacaacgaaacacucccccucgaacccguagccggagccgcaaucgcagcccccguaacaggucaaaacaacaucauugacccauggauccgcaccaacuucguacaagcacccaacggcgaauuuaccguauccccgcguaacucccccggcgaaauccuucucaaccucgaacucggacccgaucucaaccccuaccuugcccaccuaagucgcauguacaacggcuacgcaggcggcgucgaaguccaaguacuccuagccggcaacgcauucaccgcaggcaaaauccuauucgccgccgucccacccaacuuccccguagaauuuuuaucccccgcccaaaucacuaugcuuccgcaccuuaucgucgacguccgaacccuugaaccaaucaugaucccucuccccgacguacggaacacauucuuccacuacuccaaccaacccaacucucgaaugcgacuugucgccaugcuauacacaccacuucgcuccaacggcuccggagacgacgucuucacuguuuccugccguguccucacccgacccacacccgacuucgaguucaccuaccucgucccucccucuguugaaucaaaaaccaaaccauucucccuacccauacucacccucuccgaacuaaccaacucccgcuuccccgucccaauagacucccuauucacagcccaaaacaacguccuccaaguccaaugccagaacggucgcugcacuuuagacggcgaacuccaaggcaccacccaacuccucuccucagacaucugcgccuuccgaggccgcgucaccgcacaaaucaaccaacgcgaccgcuggcacaugcaacuccaaaaccuaaacggcacuaccuaugaccccaccgacgacguacccgcaccccucggcacccccgacuucaaaggagucguauucggcauggucucccaacgcaacguaggcuccgacgcccccggaagcacccgggcucaacaagccuggguuuccacuuauucaccccaauucguccccaaacucggauccguaaaccuccgaaucuccgacaacgacgacuuccaguuccaacccacaaaauucaccccaguaggcgucaacgacgacgacgacggacaccccuuccgacaaugggaacuaccaaacuacuccggcgaacucacccuuaacaugaaucucgccccacccgucgccccuaacuuccccggagaacaacuucucuuuuuccgcuccuuugucccuugcagcggaggcuacaaccaaggaauaaucgacugccuaaucccccaagaguggauacaacacuucuaccaagaguccgccccaucccaauccgaugucgcccuaauucgcuacgucaaccccgacacaggacgaacccucuucgaagccaaacuacaucgcucgggcuacauuacagucgcccacagcggcgaccacccacucguagucccagccaacggccacuuccgcuucgacuccugggucaaccaauucuacucacuagccccuaugggcaccggaaacggccgccggcgcgcacaauaa

SEQ ID NO: 37808 - RNA, 1623 nt, Artificial Sequence
  derived and/or modified sequence opt11 from VP1__Norovirus_and/or_Norovirus-like__KX024652
augaaaauggcaucaaacgacgccgccccauccaaugacggcgcugcgggccuagucccagaaggcaauaacgaaacccuaccccuugaaccaguugccggcgccgccaucgccgccccagucacaggccaaaacaacaucauagaccccuggauacgcacuaacuucguucaagcacccaacggagaauuuaccgucuccccacgcaacagccccggcgaaauccuacucaaccuagaacucggccccgaccucaaccccuaucucgcccaccuuucacgcauguacaacggcuacgcaggaggcgucgaaguacaaguccuccuagccggcaacgccuucacagccggcaaaauacuauucgcggccguucccccuaacuuccccgucgaguucuuauccccagcacaaauaaccaugcucccccaccucaucgucgacguccgcacacucgaaccaauaaugaucccacuucccgauguccgcaacaccuucuuccauuauuccaaccagcccaacucucgaaugcgacucgucgcaaugcucuacacaccccucagaucaaacggcucaggcgacgacgucuucaccgucucaugucgaguccuuacgagacccacacccgacuucgaauuuaccuaccucgucccacccucggucgaaucgaaaacaaaacccuucucacuccccauacuaacccucuccgaacuaacaaacucucgcuuccccgucccaaucgacucccucuucaccgcccaaaacaacguccuacaaguacaaugccaaaacggacgcugcacccucgacggcgaacuccagggcaccacacaacuucuucccucuggcauuugcgccuucagaggccgcgucaccgcccaaaucaaucaacgcgaccgcuggcacaugcaacuccaaaaccucaacggcaccaccuaugaucccaccgacgacgucccagccccucucggcaccccugacuuuaaaggaguagucuucggcauggucucccaacgcaacguagguaacgacgcccccgguagcacacgcgcacaacaggccuggguauccaccuauagcccacaauucgugcccaaacucgguuccgucaaccugcgaaucuccgacaacgacgacuuccaauuccacccuaccaaauucaccccagucggaguuaacgacgacaacgacggcccucccuuccggcaaugggaacuucccaacuacucuggagaacucacccucaacaugaaccuagcaccucccguagcccccaacuuuccaggcgaacagcuucucuucuuccgauccuucguccccugcucaggaggauacaaccagggaaucaucgauugccuaauuccccaagaauggauacaacacuucuaccaagaaucagcccccagucaauccgacgucgcccucauucgauacgucaacccugacaccggcagaacccucuucgaagccaaacuccaccgauccggcuacaucaccgucgcccacuccggcgacuacccccucgucgucccugccaauggccacuuucgguucgacuccuggguaaaccaauucuacucccucgcacccaugggcaccggcaauggccgacgacgagcucaauaa

SEQ ID NO: 37809 - RNA, 1623 nt, Artificial Sequence
  derived and/or modified sequence opt11 from VP1__Norovirus_and/or_Norovirus-like__KT315706
augaagauggcaucaaacgacgcagcccccagcaacgacggcgccgccggccuagucccagaaggcaacaaugaaacccucccccuugaaccaguugcaggagccgccauagccgcacccgucaccggucaaaacaauaucauagaccccuggauccgcaccaacuucguucaagcacccaacggagaguucaccguuucaccaagaaacucaccaggagaaauccuacucaaccucgaacuugguccugaccucaaccccuaccucgcccaccucucccgaauguacaacggauacgccgggggcgucgaaguacaaguccucuuagccgguaacgcauucaccgccggcaagauacucuucgcagcagucccacccaacuuccccguugaauuucucagccccgcccaaauuaccaugcucccccaccugauaguggacguccgcacucucgaacccaucaugauaccccucccugacguacgcaacacguucuuccacuacucuaaucaacccaacucacgaaugcgucuaguggccaugcuauacacgccccuccgcuccaacggcucaggcgacgacguuuucaccgucucaugccgaguucuaacccgcccuaccucagacuuugaauuuaccuaccucgucccacccuccgucgaauccaaaacaaagcccuucucucucccaauccuaacccuauccgaacuaacuaacucucgcuuccccguacccaucgacucuuuauucaccgcccaaaacaacgucuuacaaguccaaugccaaaacgggcgcugcacacucgacggcgaacuccaaggcaccacucaacuucuccccagcggcaucugcgccuuccgugguagagucaccgcccagaucaaccaacgugaccgcuggcacaugcaacuacaaaaccucaacggcacgaccuacgaccccaccgacgacguccccgcaccccucggcacccccgacuucaaaggagucguauucggaauggucucccaacgcaacgucggaaacgacgcacccggcuccacacgcgcacaacaagccugggucucgaccuacucaccccaauucguccccaaacucgguuccguaaaccuccgcaucucagacaacgacgacuuccaauuccaacccacaaaauucacccccgucggcgucaacgacgaugacgacggacacccauuccgacaaugggaacuccccaacuacagcggagaacuuacccucaacaugaaucuagccccgcccgucgcccccaacuuccccggcgagcaacuacucuucuuccgcucauucguaccaugcuccggcggcuacaaccaaggcauaauagacugccuuaucccccaagaauggauccaacacuucuaccaagaaucugcacccucccaauccgacguagcccucauccgcuacgucaaucccgacacagggcgcacccucuuugaagccaaacuucaccgcuccggcuauaucacagucgcccacuccggugacuacccccucgucguaccagcaaacggccacuuccgauucgacuccugggucaaccaauucuacagccucgcccccaugggcaccggcaacggccguagacgagcccaguaa

SEQ ID NO: 37810 - RNA, 1623 nt, Artificial Sequence
  derived and/or modified sequence opt11 from VP1__Norovirus_and/or_Norovirus-like__KX134670
augaaaauggcaucaaacgacgccgcucccuccaacgacggcgccgccggccucgucccagaaggcaacaacgaaacccuaccucucgaacccgucgcaggcgccgccaucgccgcaccaguaaccggccaaaacaacauaaucgacccauggauccgaaccaacuucguccaagcacccaacggcgaauucaccgucuccccccgcaacuccccaggcgaaaucuuacuaaaccuagaacucggaccagaucucaacccauaccucgcacaccuaucacgcauguauaacggcuacgccggaggcguagaaguucaaguccuccucgccggcaaugccuucaccgcagguaaaauccucuucgcagccgucccccccaacuuccccguugaauuccucucccccgcccaaaucaccaugcucccucaccucauaguggacguacgaacccucgaacccaucaugauucccuuacccgacguacgcaacacauucuuccauuacuccaaccaacccaacucccgcaugcgacucgucgccaugcuauacacaccccuccgcuccaacggcagcggcgacgacguguucaccgucuccugccgcguccuaacuaugcccaccccagacuucgaauucacuuaccucgucccaccaucagucgaaucuaaaaccaaaccauuuucccuccccauccuuacacucucagaacucacaaacucacgcuuccccgucccaauagacucacucuuuaccgcacaaaacaacguccuucaaguccaaugccaaaacggccguugcacccuagauggcgaauuacaaggcacaacccaacuacuaccaacaggcaucugcgcauuccgcggacgagucaccgcccagaucaaccaacgcgaccgauggcauaugcaacugcaaaaccucaauggaaccacauacgaccccaccgacgauguccccgccccccucggcaccccggacuucaaaggagucguauucggcauggucucccaacgaaacgucggaaacgacgcaccaggcuccacccgcgcacagcaagccugggucuccaccuacuccccucaauucguccccaaacuaggcuccguuaaccuccgcauaucagacaacgacgacuuccaguuccaacccacaaaauucacccccguaggaguaaacgacgacgacgacggacacccauucagacaaugggaacugcccaauuacuccggcgaacucacccuaaacaugaaccuagcuccacccgucgcccccaacuucccuggcgaacaauuacuauucuuccgcucguucguaccaugcuccggcgguuacaaccaaggaauaaucgacugccucauuccccaagaauggauacaacauuucuaccaagaaucagcccccucacaaucugacguugcccucauccgcuacgucaaccccgacaccggccguacccuauucgaagcaaaacuccaccguucaggauacaucacugucgcacacucaggcgacuacccccucgucguacccgcaaacggccacuuccgcuucgacuccuggguaaaccaauucuacucccuagcaccuaugggcaccggaaacggacggagacgcgcccaauaa

SEQ ID NO: 37811 - RNA, 1623 nt, Artificial Sequence
  derived and/or modified sequence opt11 from VP1__Norovirus_and/or_Norovirus-like__KT780399
augaaaauggccucaaacgacgccgcccccagcaacgacggagccgccggccucguccccgaagguaacaacgaaacacuuccccucgaacccguagccggugcagcaaucgccgcacccgucacaggccaaaacaacaucauagaccccuggauccgcaccaacuucguccaagcccccaacggcgaguucacagucuccccacgcaacucccccggcgaaauacuccucaaccuagaacucggcccagaccuaaaccccuaccucgcacaccucucccguauguacaacggcuacgcaggcggcgucgaaguccaaguucuccuagccggaaacgccuucacagccggcaaaauccuauuugcagcagucccacccaacuuucccgucgaguuccucucacccgcucaaauuaccaugcucccccaccucaucguugacguccgaacacucgaaccaauaaugauaccccuccccgacguccgcaacaccuucuuccauuacucaaaccaaccaaauucccgcaugcgccuaguagccaugcucuacaccccacuacgcuccaacggcuccggagacgacgucuucaccguauccuguaccguacuaacaagaccaacaccagacuucgaguucacauaccucguaccucccuccgucgaaucaaaaaccaagcccuucucacuccccauccucacccuaucagaacucacgaacucacgauuccccgucccaaucgauucccucuucaccgcucaaaacaacguccuccaaguacaaugccaaaacggccgaugcacccucgacggcgaacuccaaggaacaacccaauuacucccuaccgguaucugcgcuuucagaggacgcgucacagcucaaauaaaccaacgcgaccgcuggcacaugcaacuacaaaaccucaacggcaccaccuacgaccccacagacgacguccccgcuccccucggcaccccagacuucaaaggaguaguauucggcaugguaucucaacgcaacgucggcaacgacgcacccgguuccacacgagcccaacaggccugggucuccacauacuccccgcaguucguaccaaaauuaggcucugucaaucuacguaucuccgauaaugacgacuuccaauuccaaccaaccaaauucaccccaguuggcgucaacgacgacgacgacggccacccauuccgccaaugggaacucccaaacuacuccggcgaacucacacucaacaugaaccuagccccacccgucgcucccaacuuccccggcgaacaacuccuauucuuccgauccuucgucccaugcucuggcggcuacaaccaaggcaucaucgacugccucaucccccaagaauggauccaacacuucuaccaagaauccgcaccaagccaauccgacgucgcccuaaucagauacgucaacccugacaccggccgaacacucuucgaagccaaacuacaccgaucaggcuacaucaccguugcacacuccggugacuacccccuagucgucccagccaacggccauuuccgcuucgacuccugggucaaucaauucuacucacucgcacccaugggcacaggcaacggccgcagacgagcccaauaa

SEQ ID NO: 37812 - RNA, 1623 nt, Artificial Sequence
  derived and/or modified sequence opt11 from VP1__Norovirus_and/or_Norovirus-like__KP902577
augaaaauggccucaaaugacgccgccccauccaacgacggcgcagcaggccuagucccagaaggcaacaacgaaacucucccacucgaacccguagccggagcagcaauagcugcaccaguaacaggccaaaacaacaucaucgaccccuggauacgaacaaacuucguccaagcccccaacggagaauuuacugucucuccccgcaacuccccaggagaaauccuacuaaaccuugaacucgggccugaccucaaccccuaucucgcacaccucucccguauguacaacgguuaugcuggcggcgucgaaguacaaguccuccuugcaggcaaugcuuucaccgcaggcaaaauccucuuugccgccguuccacccaacuucccugucgaguuccucucaccagcccagaucaccaugcucccccaccugauaguagacguccgcacccucgaacccaucaugaucccccuaccggacguacgcaacaccuuuuuccacuauucaaaccaacccaacucccgcaugcgacuugucgcaaugcucuacaccccacuccgcucaaaugguuccggcgacgacguauucaccgucuccuguacuguacucaccacccccacacccgacuucgaguucaccuaccucgucccacccagcgucgaaucuaaaaccaaaccuuucucucuacccauucucacacuaucagaacucacaaacagccgauuccccguccccauugacucacucuucaccgcccaaaacaacguccuucaaguucagugccaaaacggccgcuguacccucgacggagaacuacaaggaaccacccaacuucuaccgacagguaucugcgcuuuucgcggacgcguuaccgcccagaucaaccaacgagaccgauggcacaugcaacuccaaaaccugaacggcacuaccuacgacccaacagacgacguaccagcaccauuaggcacaccagacuucaaaggcgucguauucggcauggucucucaacgcaacgucggcaacgacgcccccggcuccacccgagcacaacaagccuggguaucuaccuacucuccccaauucgucccaaaacucggcuccguaaaccuccgcaucuccgacaaugacgacuuccaauuccaacccaccaaauucacccccgugggcgucaaugacgacgacgacggccacccguuucgacaaugggaacuccccaacuacuccggcgaacuaacucucaacaugaaccuugcacccccagucgccccuaacuuucccggcgaacagcuccucuucuuccgcuccuucgucccaugcuccggcggcuacaaccaaggaauaaucgacugucuaaucccccaggaauggauccaacacuucuaccaagaauccgcacccagccaaagcgacgucgcacucauccgauacgugaaucccgacacuggccgaacccucuucgaagccaagcuccaucgcagcgguuacaucacgguugcccacucaggcgacuaccccuuagucgucccagccaacggccauuuccgcuuugacuccugggucaaccaauucuacucccucgcccccaugggcaccggcaacggacgccgccgggcccaauaa

SEQ ID NO: 37813 - RNA, 1623 nt, Artificial Sequence
  derived and/or modified sequence opt11 from VP1__Norovirus_and/or_Norovirus-like__KU587628
augaaaauggccucuaacgacgccgcccccuccaacgacggcgccgccggacuuguccccgaaggaaacaacgaaacccuaccccucgaacccguugccggagcugccaucgccgcccccgucaccggucaaaacaacauuauagauccauggauacgcaccaacuucguccaagcacccuacggcgaguucacagucucaccccgaaacucccccggcgaaauccuccuaaaucucgaacucggcccagaccucaacccuuaccucgcacaccuaucccgcauguacaacgguuacgcagggggcgucgaaguccaaguccuucuagcaggcaacgccuucaccgccgguaaaaucuuauucgcagccguacccccaaauuucccugucgaguuccucuccccagcccaaauaacaaugcucccucaucucaucguugacguaagaacacucgaacccaucaugaucccccuacccgacguacgcaacacauucuuccacuacuccaaccaacccaacucccgcaugagacucguagccaugcuauacacaccccuaagauccaacggauccggcgacgacgucuucaccgucuccugcagaguccucacccgccccaccccagacuucgaguucaccuaccucguaccucccuccguggaauccaaaaacaaacccuucucacuccccaucuucacccuaucagaacuuaccaacucccgcuuucccguccccaucgacucauuauucaccgcucaaaacaacguacuccaaguccaaugucaaaacggccgaugcacacucgacggugaacuucaagguaccacccaacuccuaccgaccggaauaugcgccuuccgcggccgaguuaccgcacaaauaaaccaacgugaccgcuggcacaugcaacuccaaaaccuaaacggaacaaccuacgaccccacagacgacguacccgcaccccuaggcacccccgauuucaaaggcgugguuuucggcaugguaucccaacgaaacguuggcaacgacgcccccggcuccacccgcgcccaacaagccugggucucaacauacagcccccaauucguaccaaaacucggcucggucaaccuccgaaucuccgacaacgacgacuuccaauuccaacccaccaaauucacccccguaggcgucaacgacgacgacgacggccacccauuccgccaaugggaacuacccaacuacucaggagaacucacccucaacaugaaucuugccccacccgucgccccaaacuuccccggagaacaacuucucuucuuccgaucuuucguccccugcucaggcggcuauaaccagggaaucaucgacugcuuaaucccccaagaauggauccaacacuucuaucaagaauccgccccuucccaauccgacgucgcacuaauccgcuacguaaaucccgacaccggacgcacacucuucgaagccaaacuacaccgcucaggcuacauaaccgucgcacacuccggagacuacccucucgucguacccgccaacggucacuuccgguucgacuccuggguaaaccaauucuacucccuggcccccaugggcacaggcaauggccgacgccgcgcucaauaa

SEQ ID NO: 37814 - RNA, 1623 nt, Artificial Sequence
  derived and/or modified sequence opt11 from VP1__Norovirus_and/or_Norovirus-like__AF414409
augaaaauggccucgaacgacgccgcacccuccaacgauggcgccgcgggccucguccccgaaaucaacaacgaagucaugccccuagaacccgucgcaggcgcaucccucgccacccccguaguuggccaacaaaacauaaucgacccauggauccgaaacaacuucguacaagcacccgcuggagaguucaccgucucuccacgcaacucacccggcgaaauccuacucgaccuagaacuaggcccagaacucaacccuuacuuagcccaccucgcccgcauguacaacggccacgcaggcgguauggaaguccaaauaguucucgccgguaacgcuuucacagccggcaaaaucauauucgccgcaaucccgccaggauuccccuacgaaaacuuaagucccucccaaauaacuaugugcccccacgucaucauagacgucagacaacuggaacccguacuccucccgaugcccgacauccgcaacaacuucuuccacuacaaccaaggcaacgaccccaagcuccgccuagucgcgaugcucuacacuccccucagagccaacaacucuggagacgacguauucaccgucucaugccgaguccucaccaaacccuccccagacuucgaauuuacauuccuagucccacccacaguugaaucaaaaacaaaacaauuuacacuacccauccucaaaaucuccgagaugacuaacucccgcuuccccguccccguagagaugauguacacaucacguaacgaaaaccaagucgugcaaccccaaaacggacgagucacucucgacggcgaacuccucggcacgacaccccucuuagcagucaacauaugcaaauucaaaggcgaaguaaucgccaaaaacggcgacguaagauccuaccgaauggacauggaaaucaccaacaccgacggaacucccauagaucccaccgaagacaccccaggcccaaucggcucuccggauuuccaaggaauccuauucggagucgccagccaaagaaauaaaaacgaacaaaaccccgccacgcgcucccacgaagccaacaucaacaccggcggcgaccaauacgcacccaaacucgcccaagucaaaaucuucagccaaucacaagacuucgaaguccaccaacccaccgucuucacccccguaggcgucgccggagacaccucacaccccuucagacaauggacccucccacgguacggcggccaccucacuaacaacacacaccucgccccggcgguagcaccccuauuccccggagaacaaauccuuuucuuccgcucacaaaucccauccucuggcggccacgaacucgguuacauggacugcuuagucccacaagaauggguccaacauuucuaucaagaagccgcaacugcccaauccgaagucgcacucauacgcuucaucaaccccgacacaggcagaguacuauucgaagcaaaacuccacaaacagggauucaucacagucgcccacaccggcgacaacccaauagucaugccacccaauggcuacuuucguuucgaagcguggguaaaucaauucuacucacucgcacccgucggaaccggaaauggacgccgccgaauccaauaa

SEQ ID NO: 37815 - RNA, 1623 nt, Artificial Sequence
  derived and/or modified sequence opt11 from VP1__Norovirus_and/or_Norovirus-like__KT943504
augaaaauggccaguaacgacgcagcacccuccaacgacggagccgccggcuuaguccccgaaaucaacaacgaagucaugccccuagagccuguagccggcgccucccucgccacccccgucguaggacaacaaaacaucauugacccuuggauccgcaccaauuucguacaagcccccgcaggcgaguucacagucucaccucgaaacucccccggagaaauccuccuggaccucgaacucgggccagaacuaaacccauaccuagcccaccuagcccgaauguacaacggccacgccggcgguauggaaguccaaaucguucuagcgggcaacgccuucacugccgguaaaaucauauucgccgcuaucccucccggauucccauacgaaaaccucuccccaucccaaauaacaaugugcccacauguaauaauugacguccgccaacuagagcccguccuccuaccaaugccagauaucagaaacaacuucuuccacuacaaccaaggaaacgaccccaaacuacgacuugucgccaugcuguacacaccccuccgcgccaacaacucuggagacgacgucuucaccgucuccugccgcguccucaccaagccgucccccgacuucgaguucaccuuccucgucccacccaccgucgaauccaaaaccaaacaauucacccugcccauccucaaaauuagcgaaaugacgaacucccgcuucccaguccccgucgaaaugauguacacagcccgcaaugaaaaccaagucguccaaccccaaaacggccgagucacccuagacggagaacugcucggcaccaccccgcuccuagccgucaacaucugcaaauucaaaggcgaaauaaccgccaaaucagucgacguccgauccuaccgcauggauauggaaaucaccaacaccgacggcacacccaucgacccaaccgaagauacccccggcccuauaggcucaccagacuuccgcggcauccucuuuggcgucgccucccaacgcaacaagggcgaacagaucccagccacccgcgcacaugaagcaaacaucaacaccggaggagaccaauacgcuccaaaacuagcccaagucaaauucuucuccgguucccaagacuucgaaguccaccaacccaccgucuucacacccguaggagucgcaggcgacuccucacaccccuuucaacaaugggcccuaccacguuacgguggacaccucaccaacaauacccaccuagcccccgcagucgcaccacuauuccccggcgaacaaauccucuucuuccgcucccaaauccccucauccggcggccacgaaaugggcuacauggacugccuagucccccaggaauggguccaacacuucuaccaagaagccgccacagcucaaagcgaagucgcucuuauccgauucguaaaccccgacacaggacgaguacuauucgaagccaaacuucacaaacaaggcuucaucacaguugcacacaccggcgacaaccccaucgucaugccacccaacgggcacuucagguucgaagccuggguaaaccaauucuacucccucgcgccagucggcaccggcaacggccgacgccguauccaauaa

SEQ ID NO: 37816 - RNA, 1623 nt, Artificial Sequence
  derived and/or modified sequence opt11 from VP1__Norovirus_and/or_Norovirus-like__KT943505
augaaaauggcgagcaacgacgccgcccccuccaacgacggcgccgccggccucgucccagaaauaaauaacgaagucaugccccucgaacccgucgcaggagccucccuagccacccccguaguuggacaacaaaacauaaucgaccccuggaucagaaccaacuucguccaagcacccgccggcgaguucacagucuccccucgaaacucucccggcgaaauacuccuagaccucgaacucggcccagaacucaacccauaccuagcacaccucgcacgaauguauaacggacacgcaggcggcauggaaguacaaaucguacuagccggaaacgccuucaccgcaggaaaaauaaucuucgccgcaauacccccaggcuuccccuacgaaaaccucagcccaucgcaaaucacuaugugcccccacgucauaauagacguccgucaacucgaacccguccuacuccccaugcccgacauccgcaacaacuucuuccacuauaaccaaggcaacgauccaaaacuccgacuugucgccaugcucuacacaccccuccgugccaacaacucaggcgacgacguauucaccgucuccugccgcguacucaccaagcccagcccugacuucgaguucaccuuccucguacccccgaccgucgaaucuaaaaccaaacaauucacacucccaauccuuaaaaucucagaaaugaccaacagucgcuuccccguccccguagaaaugauguauaccgcaagaaacgaaaaccaagucguccaaccacaaaacggacgcgucacacuugacggagaacuacuuggcacuacaccccuacuggcagucaacaucugcaaauuuaaaggcgaaaucaccgccaaauccgucgacguccgauccuaccgaauggacauggaaaucaccaacaccgacggaaccccaaucgaccccaccgaagacacccccggacccaucgguucccccgauuucagagggauauuauuuggcgucgccucacaacgcaauaaaggcgaacaaauccccgcuacucgcgcccacgaagccaacaucaacacagggggcgaccaauacgcacccaaacucgcccaagucaaauucuucucaggcagccaagacuuugaaguacaccaacccaccgucuucacacccgucggugucgccggcgacucuucacaccccuuccaacaaugggcucucccccgcuacggcggccaccuaacaaacaacacccaccucgcaccagcugucgcaccccucuuccccggcgaacaaauccuauucuucagaucccaaauacccuccuccggcggccacgaauuaggauacauggacugccuagucccacaagaauggguccaacacuucuaccaagaagccgccacagcccaauccgaagucgcccucauacgcuuugucaacccagacaccggccgcguccuuuucgaagccaagcuccacaagcaaggcuucaucaccgucgcccacaccggcgacaaccccaucguuaugcccccaaacggacacuuccgcuucgaagccugggucaaccaguucuacucccucgcacccgucggcacaggcaacggccgccgccguauccaauaa

SEQ ID NO: 37817 - RNA, 1623 nt, Artificial Sequence
  derived and/or modified sequence opt11 from VP1__Norovirus_and/or_Norovirus-like__KT962982
augaaaauggcuuccaacgacgcagcucccuccaacgacggagcagccggcuuaguccccgaaaucaacaccgaaacucucccccucgaacccgucgccggcgccgcaauagcugcccccgucaccggacaaaacaacaucaucgauccauggauucgaaacaacuucguccaagcccccaacggggaauuuacagucagcccaagaaacuccccaggagaaauccucaugaaccucgaacuaggccccgaccucaaccccuaccuagcccaccuaagccgcauguacaacggcuacgccgguggagucgaaguccaaguacuccucgccggcaacgccuucaccgcaggcaagaucuuauucgcagccgucccacccaacuuccccgucgacaugcuaucccccgcucaaauaacuaugcucccccaccuaaucguagacguacgaacccuagaacccaucaugauaccccucccagacguaagaaaugucuucuaccacuucaacaaccagccugcuccccgaaugcgccucgucgccaugcuauacacaccccuacgcucaaacggcuccggcgacgacgucuucaccgucucaugccgaguccucaccagacccacuccagauuucgaguucaccuaccucguaccacccucaguagaaucaaaaaccaaacccuucacccuccccauacuuacaaucggugaacucaccaauucacgcuuccccgcccccauugaccaacucuacacuucuccaaacgccgacgucguaguccaaccacaaaacggcagaugcaccuuagacggagaacuccaaggcacaacacaacuccucaccacagccauaugcuccuacaaaggcaccacauccaacccuaccuccgacuacugggacgaccaccuacuacaccuuguccacccaaacggagccaccuacgaccccaccgaagacguacccgccccauucggaacacaagacuuccgcggaauccucuacggaguauuaacacaaaacacacaaaacccacgagacgaagugucaaacucacgcggaaucuacauauccuccaccucugacaaauucacccccaaacucggcacgauuggccuccaccaaguacaaggcgacaccgcaagcaaccagcaaucuaaguucacccccgucggcaucgccguaaaccaaaacacccccuucaaacaaugggaacuuccaaacuacuccggcgcccuaacucucaacacaaaccucgcccccgccguaggccccaacuuccccggcgaacaaauccuauuuuuccgaucgaaugucccuuccguacaaggcaaccaccccacccaagaaauagacugcuuaaucccacaagaaugggucucacacuuuuaccaagaauccgcuccaucacaaucagacgucgcccucguacgcuacguaaaccccgacaccggccgcacaaucuucgaagcaaaacuacaccgccaaggcuuuaucacaaucgccgccaccggcuccaacccaguaguaguaccucccaacggcuacuuccguuucgacuccugggucaaccaauucuacgcccuagcgcccaugggcaccggaaacggacggcgccgagcacaauaa

SEQ ID NO: 37818 - RNA, 1623 nt, Artificial Sequence
  derived and/or modified sequence opt11 from VP1__Norovirus_and/or_Norovirus-like__KX079488
augaaaauggccucaaacgacgccgccccauccaacgacggcgcagccggccucguccccgaaauaaacaccgaaacacucccccucgaacccguagccggugcugccauagccgccccaguaaccggacaaaacaacaucaucgaccccuggauacgcaacaacuucguccaagcacccaauggcgaauuuaccgucucaccacgcaacagccccggagaaaucuuaaugaaccucgaacucggccccgacuuaaauccauaccuagcccaccucucccgaauguacaacggcuacgcaggcggaguagaaguccaaguacuccucgccggcaaugccuucacugccggcaaaauccucuucgccgccguaccaccgaacuucccaguagacaugcucucccccgcccaaauaaccaugcuuccucaccucauagucgauguccgcacucucgaacccaucaugaucccccucccagauguacgcaacgucuucuaccacuucaacaaccaacccgccccacgcaugcgucucgucgccaugcuauacacuccccuccgcucaaauggcuccggcgacgacguuuucaccguauccugccgcguccuuacccguccgacccccgacuucgaguucaccuaccuugucccaccuucagucgaaucaaaaaccaaaccauucacccuccccauccuaaccaucggggagcucaccaacucccgcuucccagcccccaucgaccaacuguacaccucaccaaacgccgacguagucguccaaccccagaacggacgcugcacccuagacggagaacuacaaggcaccacucaacuacucaccaccgccaucugcuccuaccguggaaccacauccaaccccacauccgacuacugggacgaccaucugcuccaccucguccaccccaacggcgcaaccuacgaccccaccgaagauguccccgcccccuucggcacucaagacuuccgaggcauccucuacggcguucucacccaaaacacucaaaacccccgcgaugaagucucaaacuccagaggaaucuacaucuccuccaccuccgacaaauucaccccgaaauuaggaacuaucggucuacaccaaguacaaggcgacaccgcuuccaaccaacaauccaaauucacccccguuggcaucgcagucaaccaaaacacccccuucaaacaaugggaacucccaaacuauucuggcgcccucacccuaaacaccaaucucgcccccgcagucggcccuaacuucccuggugaacaaauacuauucuuccgcucaaacguccccuccgugcaagggaaccacccaacccaagaaaucgacugccucaucccucaagaaugggucucacacuucuaucaagaauccgccccgucucaauccgacgucgcccuaguccgcuacguaaaccccgacaccggacgaaccauauucgaagccaaacuccaccgccaaggcuucauaacaaucgccgccaccggcucaaaccccgucguagucccaccaaacgguuacuucagauucgacuccugggucaaccaauucuacgcccucgcacccaugggcaccggcaacggacgccgcagagcccaauaa

SEQ ID NO: 37819 - RNA, 1623 nt, Artificial Sequence
  derived and/or modified sequence opt11 from VP1__Norovirus_and/or_Norovirus-like__KR921938
augaaaauggcauccaacgaugcagcccccuccaacgacggcgcagccggacucgucccagaaaucaacaccgaaacacuaccccuagaacccguagccggcgcagccaucgccgcccccgucaccggccaaaacaacaucaucgaccccuggauccgcaauaacuucgugcaagcccccaacggcgaguucaccgucucaccccgaaacucccccggagaaauccucaugaaccucgaacuaggccccgaccucaaccccuaccucgcacaucuauccagaauguauaacggcuacgccggcggcguagaaguacaaguccuccuugccgguaacgcuuucacagccggcaaaauuuuauucgcagccgucccacccaacuuccccgucgacaugcucucccccgcccaaaucaccaugcucccccaccucaucgucgauguccgaacccuagaaccgaucaugaucccccuucccgacguccgcaacgucuucuaccacuucaacaaccaacccgccccacgcaugaggcuaguugccaugcucuauacgccacuccgcucaaacggaucaggagacgacgucuucacagucuccugccgcguccucacccgcccaacccccgacuucgaguucaccuaccucguacccccaucagucgaaucaaaaacaaaacccuuuaccuuacccauacucaccaucggcgaacucaccaauucacgcuucccugcccccauagaccaacuauauaccucccccaacgccgacgucguaguccaaccccaaaacggaagaugcacacucgacggcgaacuccagggcaccacccaacuccucacaaccgccaucugcuccuaucgcggcaccaccuccaacccuacauccgacuacugggacgaccaccuacuccaccuaguucaccccaacggcgcaacauacgaccccaccgaagacguccccgcccccuucgguacacaagacuuccgcggaauccucuacggaguccuuacccaaaacacccagaacccccgagaugaaguauccaacucccguggcauauacaucucuuccaccucugacaaauucacacccaaacuagguaccaucggccuccaccaaguacaaggcgacaccgcuuccaaccagcaaucaaaauucacccccgucggaaucgcuguaaaccaaaacacaccauucaagcagugggaacuacccaacuacucaggagccuuaacacucaacacaaaucuggcccccgcaguaggcccaaacuuccccggcgaacaaauucucuucuuccgcagcaauguccccaguguccagggcaaucauccaacacaagaaaucgacugccucauaccacaagaauggaucucacacuuuuaccaagaaucagccccaucccaauccgacguagcccuaguucgauacgucaaccccgacacaggcagaacuaucuucgaagccaaacuccaucgccaaggcuuuaucacuaucgcagcaaccggcucgaaccccguagucguucccccaaacggauauuuccgcuucgacuccuggguaaaccaauucuacgcacuagcaccaaugggaacaggcaauggacgccgccgcgcucaauaa

SEQ ID NO: 37820 - RNA, 1623 nt, Artificial Sequence
  derived and/or modified sequence opt11 from VP1__Norovirus_and/or_Norovirus-like__KR921940
augaaaauggcuuccaacgacgccgcccccucaaacgacggagccgcaggucuuguccccgaaauaaacaccgaaaccuuaccacucgaacccgucgcaggagccgcaaucgccgcaccuguaaccggccaaaacaacaucaucgauccauggauacgcaacaacuuuguacaagcccccaauggcgaguucaccgucucaccccgaaacuccccaggagaaauccugaugaaccucgaacugggaccggaccucaaccccuaccuagcccaccuaucccgcauguacaacggauacgccggcggcguagaaguccaaguccuucuagccgguaacgccuucaccgccgguaaaauccucuucgcagccgucccaccuaacuuccccgucgacaugcucucccccgcccaaaucacaaugcucccucaccuuaucguagacguccgcacucucgaacccaucaugaucccccuccccgauguccgcaacguauucuaccacuucaacaaccaacccgcuccccgcaugcgccucgucgccaugcucuacacgccccucagaucaaacggcucaggcgacgacgucuucaccgucucaugucgcgugcuaacacgacccacaccugacuucgaguucacauaccucguuccacccuccgucgaaucuaaaacaaaacccuucacacuacccauccucaccauaggagaacucaccaacucacgcuuccccgccccaauagaccaacucuacaccucuccaaacgccgacguagucguccaaccccagaacggccgcugcacacucgacggugaacuccaaggaaccacucagcuacucaccaccgcaaucuguuccuaccgcggcacaaccuccaaccccacuucugacuacugggacgaccaccuccuccaccuaguacaccccaauggagccacguacgacccuaccgaagacguccccgcaccuuucggcacacaagacuuccgcggaauccuauauggaguccucacccaaaacacccaaaacccccgcgacgaaguaagcaacucccgaggaauuuacaucuccucaaccagcgacaaauuuacccccaaacucggcaccaucggccuccaccaaguccaaggcgacaccgccucuaaccaacaauccaaauucacccccgucggcaucgcaguaaaccaaaacacccccuucaaacaaugggaacuacccaacuacucuggagcacucacccuuaauaccaaccucgcccccgccguuggcccaaacuuccccggagaacaaauacucuucuuccguucaaacguccccuccguacaaggcaaccacccaacacaagaaaucgacugccuaaucccccaggaaugggucucacacuucuaccaagaauccgcccccucccaauccgacgucgcacucguccgauacgucaaccccgacaccggccguaccacauucgaagccaaacuacaccgucaaggcuucaucacaaucgccgccacgggaagcaaccccguaguagucccacccaacggcuacuuccgcuucgauuccugggucaaucaauucuacgcucucgcacccaugggaaccggcaacggacgucgacgagcccaauaa

SEQ ID NO: 37821 - RNA, 1623 nt, Artificial Sequence
  derived and/or modified sequence opt11 from VP1__Norovirus_and/or_Norovirus-like__DQ358209
augaaaauggccuccaacgaugcugcccccuccaacgauggcgcugccggucucguucccgaaauaaacaaugaagucaugccccucgaacccgucgccggcgccucccucgcaacacccguuguuggccaacaaaacauaaucgacccauggauccgcaacaacuucguacaagccccagccggagaauuuacagucaguccccgcaacuccccaggcgaaauccugcucgaccuugaacucggcccagaacucaaccccuaucucgcacaccucgcacgcauguacaacggccacgcaggcggaauggaaguccaaaucgucuuagcaggaaacgcauucaccgccggaaagaucgucuucgccgccauacccccgggcuucccauacgaaaauuuaucucccagccaaaucaccaugugcccucacgucaucaucgacguacgccaacucgaacccguccuacuccuaaugccagacaucaaaaacaauuucuuccacuacaaccaagggaacgacccgaagcuacgucucgucgcgaugcuuuacacaccccuaagagcaaacaacucuggagacgauguauucaccguauccugccgaguccucaccaagcccagccccgacuucgaauuuaccuuccuagucccacccaccgucgaauccaagacaaaacaauucacccuacccauccucaaaaucucugaaaugaccaacagccgcuucccagugcccgucgaaaugauguauaccgcccgcaaugaaaaccagguaguccagccccaaaacggccgcgucacucucgacggagaacuccucggcaccacuccccuccuagccgucaacaucugcaaauucaaaggugaagucaucgccaaaaacggcgacguacgcuccuacagaauggacauggaaaucaccaauaccgacggcacgcccauagaccccaccgaagacacucccggccccaucggcucccccgacuuccaaggcauacuauucggagucgccucacaacgcaacaaaaacgaacaaaaucccgccacccgcgcacaagaagucaacauuaacaccggcggcgaccaauacgccccaaaacuugcccaagucaaguucuucucugaaucccaagacuucgaaguccaccagcccaccgucuucaccccugucggagucgcaggcgacccaucccaccccuuccgucaauggacacuccccagauacgggggacaccuaaccaacaacauccaccucgcacccgccgucgcaccacucuucccgggcgaacaaauacucuucuucagaucacaaauccccucuagcggaggucacgaacucggcuacauggacugccuuguaccccaagaauggguccaacacuucuaucaagaagcagcuaccgcccaauccgaagucgcccucaucagauucaucaaccccgacaccggccgcguccucuucgaagccaaacuacacaaacaaggauucauaaccgucgcacacaccggcgacaacccaaucguaaugccacccaacggauacuuccgcuucgaagccugggucaaucaauucuacucccucgcucccgucggcacaggcaacggccgacgaagaguacaauaa

SEQ ID NO: 37822 - RNA, 1623 nt, Artificial Sequence
  derived and/or modified sequence opt11 from VP1__Norovirus_and/or_Norovirus-like__KP784694
augaaaauggcauccuccgacgcaaaccccuccgacggcucugccgccaaccuggucccagaaguaaacaaugaaguaauggcucuugaacccgucgucggcgcagccaucgccgccccggucgccggacaacaaaauguaauagaccccuggauacgcaauaacuucguccaagccccuggcggugaguucacaguuuccccacgcaacgcccccggagaaauucuaugguccgcuccucuuggccccgaccuaaaccccuaccucucccacuuagcccgcauguacaacggcuacgcugggggcuucgaaguccaagucaucuuagcaggaaaugcauucacagcaggcaagauaaucuucgccgccgacccacccaacuuccccaccgaaggacuuucgcccagccaagucacgauguucccccacauaaucguggacguccgccagcuagaacccguccucaucccccuccccgacguacguaacaacuucuaucacuacaaccaaagcaaugaccccaccaucaaacucaucgccaugcucuacacaccccuccgcgccaacaacgccggcgacgacgucuuuacagucuccugccgaguuuuaacucgccccagcccagacuucgacuucaucuuccuuguuccacccaccgucgaaucacgcaccaagcccuucucaguaccaauucucaccguagaagaaaugaccaacucccgcuuucccauuccccuagaaaaacuuuucacagggcccucuuccgccuucgucguccaaccccaaaacggccgaugcaccaccgacgggguccuccucggcaccacccaacucucaccgguaaacaucugcaccuuccgcggagacgucacccacaucgccggcucucacaacuacacaaugaaccucgccacccaaaacuggaacucuuacgaccccaccgaagaaauacccgccccacucggcaccccagacuucgucggcaaaauccaagguguccucacccaaaccaccaaaaccgacggauccacccgcucgcacaaagcaacaguauacaccggcucagccgacuucgcccccaaacuuggaagaguccaauucgaaacagacaccaacaacgauuucgaaaccaaccaaaauaccaaguucacacccgucggcgucauccaaaacggcgaaacggcucaccgcaacgaaccccaacaguggguccuucccucauacucaggccgcaacacgcccaacguccaccucgcccccgcaguugccccaaccuuuccuggcgaacaacuucucuucuuucgcucaaccaugccagguugcuccggcuaccccaacauggaccucgacugcuuacucccccaagaauggguucaauacuucuaccaagaagccgcccccgcccaauccgauguagcacuccuccgcuucguaaaccccgacaccggccggguccucuucgaaugcaaacuccauaaauccgguuacgucaccgucgcacacaccggcucacacgaccucgugaucccgcccaacggcuacuuccgcuucgacucaugggucaaccaauuuuacacgcuagcccccaugggcaacggaacgggccgccgccgugccaccuaa

SEQ ID NO: 37823 - RNA, 1623 nt, Artificial Sequence
  derived and/or modified sequence opt11 from VP1__Norovirus_and/or_Norovirus-like__KX354064
augaaaauggcauccuccgaugcaaaccccucagacggaagcgccgcaaaccuuguccccgaagucaacaaugaagucauggcacucgaaccaguagucggcgcagccaucgccgcaccagucgcaggccaacaaaacgucauagacccuuggaucagaaacaacuucguacaggcccccggcggcgaauuuacuguuucuccccgcaacgcccccggcgaaauccucugguccgcaccccucggacccgaccucaaucccuaccuaucccaccucgcccgaauguacaacggauacgcaggcggcuucgaaguccaagucauccuagccggcaacgccuucaccgccggcaaaguuaucuucgcagccgucccaccuaauuuccccaccgaaggucucucgcccucccaaguuacaauguucccccauauugucgucgacguccgacaacuagaaccaguccuaauuccccucccagacguccgcaacaacuucuaccacuacaaccagucaaacgaccccaccaucaaacuuaucgccaugcuguacacaccccuacgcgcaaacaacgccggugacgacguuuucaccgugucaugccgcguccucacacggcccucccccgacuucgacuucaucuuccucguacccccuaccgucgaaucccgcacaaaacccuucuccguccccgucuuaaccguagaagaaaugacuaacucucgcuuucccauuccccucgaaaaacuauuuaccggccccucauccgcauucguuguacaaccacaaaacggccgcugcaccacugacggcguccuucucggaaccacacaacucagucccgucaacauaugcaccuuccguggcgauguaacucacaucaccggaucccgaaacuacaccaugaaccucgcaucacagaacuggaacaauuaugaccccaccgaagaaauuccugcaccacuaggaaccccagacuucgucggcaaaauccaaggaguccuaacacaaaccacacgcacagacggaucgacaagaggacacaaagccaccguauacaccggaucagcugacuucgcccccaaacucggccgaguacaauucgaaaccgauaccgaccacgacuucgaagccaaucaaaacacuaaauucacccccgucggcgucauucaagacggcuccacaacccaccgcaacgaaccccaacaauggguccuccccucauauuccggucgcaacacccauaacguccaccuagcaccagcaguagcacccacauucccaggcgaacaacuccuauucuuccgaucaaccaugccagguugcucaggauaccccaacauggaccuagacugccuacucccacaagaauggguucaauauuucuaccaagaagccgcccccgcccaaucagacguugcccuccuccgcuucgucaaccccgacaccggccgcguccuauucgaaugcaaacuccacaaauccggauacgucacagucgcccauaccggacaacacgacuuagucauacccccaaacggauacuuccgauucgacuccugggucaaccaauucuacacccuagcccccaugggaaacggcaccggccgcagacgcgccauguaa

SEQ ID NO: 37824 - RNA, 1623 nt, Artificial Sequence
  derived and/or modified sequence opt11 from VP1__Norovirus_and/or_Norovirus-like__LC177658
augaaaauggcauccagcgacgccaaccccuccgacgguuccgcugccaaccucgucccagaagucaacaacgaagucauggcccucgaaccagucgucggagccgccaucgccgcccccguagccggccaacaaaacgucaucgacccauggauccgaaauaacuuuguccaagcccccggaggagaguucaccguaucaccccgcaacgcccccggagaaauccuauggucagcaccccuaggccccgaucucaaccccuaccucucccaccuagcccgaauguacaacggcuacgccggcggauucgaaguccaaguuauacucgccggcaaugccuuuaccgccggcaaaguaaucuucgccgccguuccacccaacuucccaacugaaggccucucccccucccaagucacaauguucccccacauugucguagacguccgacaauuagaacccguccuaaucccacuaccggacguacgaaacaauuucuaccauuacaaccaauccaaugaccccaccaucaaacucaucgccaugcucuacacaccacuccgcgccaauaacgcaggagacgacguuuucacugucuccugccgcguacucacccgccccucacccgacuucgacuucaucuuccucgucccacccaccgucgaaucccgcaccaaacccuucuccguccccguacuaacugucgaagaaaugaccaacucccgcuuccccaucccccucgaaaaacuauucacaggcccguccuccgcauucgucguacaaccccaaaauggaagaugcaccaccgaugguguccuccucggcacaacacagcucucccccguaaacaucugcaccuuccgcggggacgucacccacauaaccggaucacgaaacuacaccaugaaccucgcaucccaaaacuggaacaauuacgaccccaccgaagaaauccccgccccgcucggugccccugacuucguaggcaaaauccaaggcaugcucacccaaaccacacgcgccgacggauccacacgcggccacaaagccaccguuuacacaggcucugccgauuucgccccaaaacucggacguguacaauucgagacagacacugaccacgauuucgaagcuaaucaaaacacaaaauucaccccgguaggugucauccaagauggaggaaccacccaccguaacgaaccccaacaauggguccuaccuuccuacuccggacgcaacacccacaacguucaccucgcacccgccguagcaccaaccuuccccggcgaacaacuccucuucuuccgaucaaccaugccuggaugcuccggcuacccaaacauggaccucgacugccuccuuccacaagaauggguccaauacuucuaucaagaggccgcccccgcacaauccgacguugcccucuuacgauucgucaaucccgacaccggccguguccuuuucgaauguaaacuacauaaaucaggcuacguaaccguagcccacacaggccaacacgaucucgucaucccacccaacggcuacuuccgcuucgacuccugggucaaucaauuuuacacccuagcccccaugggaaacggcgccggccgacgacgagucgccuaa

SEQ ID NO: 37825 - RNA, 1623 nt, Artificial Sequence
  derived and/or modified sequence opt11 from VP1__Norovirus_and/or_Norovirus-like__KX514232
augaagauggcguccaaugaugcaaacccaagcgaugggagcgccgccaaccucguccccgaagucaacaacgaaguaauggcccuagaacccguugucggcgcagccaucgcggcucccgucgccggccaacaaaacgucaucgacccauggauacgcaacaacuucguccaagccccaggaggugaauuuacaguaucaccccgaaacgcccccggcgaaauccuaugguccgcaccccuaggcccagaccuaaaccccuaccucucucaccucgcacgcauguacaacggcuacgccggugguuucgaaguccaggucauacuagcaggaaacgccuucaccgcaggcaaaauaaucuucgcagccguacccccaaacuucccuaccgaaggccuaagccccucccaagucaccauguucccccauaucaucgucgacguccgccaacucgagccaguacucaucccccucccagacguccgaaacaacuucuaccacuacaaccaauccaacgacucaaccaucaaacucaucgccaugcucuauacaccacuuagagccaacaacgcaggagacgacguguucacaguauccugcagaguccuuacacgacccucccccgacuucgacuucaucuuccucgucccacccaccgucgaaucacgcucaaaacccuucuccguccccguacuaaccguagaagagaugacaaacucccgcuucccugccacccuagacaaacucuucaccggccccucaucgaccuucgucguccaaccccaaaacggucguugcaugauugacggcguacuacucgguacuacacaacucuccccagucaacaucugcaccuuccguggcgacgucacccacccucgagauucacccauauacaccaugaaccucgccuccccaaacuggaauaacuacgaccccaccgaagaaauacccgcuccucucggcaccccagacuucguaggaaaaauccaaggaaugcuaacacaaaccaccaaaggcgaaggcucaacacgcggacaccgagcaacagucuacgucggcucugccaacuacgccccuaaacuaggccgaguccaauucgaaaccgacacuacaaacgaccuugacgcccaccaaaacaccaaauucaccccaguagguguuguacagggaggcgaaucaccgcaacgcuccgaaccucaacaauggguacuccccuccuacagcggccgcgacacacccaacguacaccucgcccccgcagucgcccccaccuucccaggcgaacaacuucucuucuuuagaucgacuauaccaggcugcggcggccaccccaacaugaaccuagacugucuauuaccccaagaauggguccaacacuuuuaccaagaagcagcccccgcccaauccgacguagcccuccuccgcuucgucaaucccgacaccucacgaguccucuucgaaugcaaacuccacaagagcggcuacgucaccguagcucacaccggccaacacgaucuugucaucccacccaacggauacuuccgauucgacuccugggucaaccaauucuacaccuuagcaccuaugggcaacggcacaggccgaaaaagagccucauag

SEQ ID NO: 37826 - RNA, 1623 nt, Artificial Sequence
  derived and/or modified sequence opt11 from VP1__Norovirus_and/or_Norovirus-like__LC145787
augaaaauggccagcaacgacgccgcuccauccacagacggcgccgcaggucucguaccugaaucuaacaacgaaguaauggcccucgaacccguugccggcgcugcccucgccgcccccguuaccggccaaaccaacaucaucgacccauggauuagagcaaacuucguccaagcaccaaacggcgaguucaccgucucaccccgcaacgcgcccggcgaaguauuacucucccucgaacucggcccagaacuuaaccccuacuuagcccaccuagcccgcauguacaacggauaugccggcggaauggaaguccaaguaaugcucgccggcaacgccuucacagcaggaaaacuuguuuucgcagccgucccuccccauuuccccguggaaaaccucucaccccaacaaauaaccauguucccacacguaauaauagacguacgaacccucgaacccguccuccucccucuaccagacguccgcaacaacuucuuccacuacaaccaaaaagacgaccccaaaaugcgcaucgucgcaaugcuauauaccccacucagauccaacggauccggcgacgacgucuucaccgucuccugccguguccucacccgacccucccccgacuuugacuucaccuauuuaguacccccaaccgucgaauccaaaaccaaaccauucacacuacccauccucacccucggcgaacuuuccaacucgcgcuuccccgucuccaucgaccaaauguacaccucccccaacgagguaauaucaguccaaugccagaacggacgcugcacacucgacggagaacuccaaggaaccacccaauugcaagucucaggcauuugcgccuucaaaggcgaagucacggcccaccuacacgacaacgaccaucucuacaacgucacuaucacaaaccuaaacgggucucccuucgauccaagcgaagacgucccagcaccccucggcguccccgacuuccaaggccgagucuucggcaucauaucccaaagagacaaacacaacucaccuggccacaaugaacccgcuaaccgaggccacgacgcggucguaccaaccuacacagcccaauacaccccaaaacuaggccaaauccaaauaggcacuuggcaaaccgacgaccucacaguaaaccaacccguaaaauucacacccgucggacucaacgacaccgagcacuuuaaccaauggguaguaccacgcuacgccggagcccucaaucugaacaccaaccucgcaccaucagucgcacccgucuuccccggcgaacgacuuuuauucuuccgcuccuacgucccccuaaagggcggauacggcaaccccgccauagacugccuccuaccccaagaauggguccaacacuucuaccaagaagccgcuccauccauguccgaagucgcccucguacgauacaucaacccggacacaggcagagcacucuucgaagccaaacuccaccgcgcaggcuucaugacagucucauccaacaccuccgccccugucgucguccccgcuaacggcuacuuccgauucgacuccugggucaaccaauucuacucccuagcacccaugggcaccggaaacggccgcagacgauaa

SEQ ID NO: 37827 - RNA, 1623 nt, Artificial Sequence
  derived and/or modified sequence opt11 from VP1__Norovirus_and/or_Norovirus-like__KT962983
augaaaauggccuccaaugaugcagcacccucaaccgacggcgccgcaggccuaguaccugaauccaacacugaagucauggcccucgaacccgucgccggcgccgcccucgccgcccccgucacaggccaaaccaauaucaucgacccauggauacgcgcaaacuuuguccaagcccccaauggagaauuuacagucucgccacgcaacgccccaggcgaaguacuccuaaaccuugaacuaggccccgaacucaaccccuaccucgcccaccucgcacgcauguacaacggcuacgccggcggcauggaaguacaaguaaugcucgcaggcaacgccuucaccgccgguaagcuagucuucgccgcagucccaccccacuuccccgucgaaaacuuaucuccccaacaaaucaccauguucccacauguuauaaucgacguacgaacccucgaacccguucugcucccccuaccagacguacgcaauaacuucuuucacuauaaccaaaaagacgaccccaaaaugcgcaucgucgccaugcucuacaccccacuucgcuccaacggcuccggcgacgacguguucacagucuccugccgaguccuaacccgccccagccccgacuuugacuucacauaccucgucccacccacagucgaaucaaaaacuaaacccuucacccuccccauacucacacuaggagaacugagcaacagccgcuuccccguaucaaucgaccaaauguacacaagccccaacgaagucaucuccguacaaugccaaaacggccgcugcacccuugacggugaacuccaaggcaccacacaacuacaagucuccggaauaugcgcauucaaaggagaagucaccgcccaucuccacgacaaugaccaccucuacaacauaaccaucaccaaccuuaacggcucacccuucgacccaucggaagauauucccgcaccccugggagucccugacuuccaaggccgugucuucgguaucauaucucaacgagacaagcacaacucucccggacacaacgaacccgccaaccgcggccacgacgcagucgucccuacauacaccgcucaauacacccccaaacucggccaaauccaaaucggcaccuggcaaaccgaugaccucaccguaaaccaacccguaaaauuuacucccgucggccucaacgacaccgaacacuuuaaccaaugggucgucccccgauacgcuggagcccucaaccucaacaccaaccuagcaccaucggucgcccccgucuucccuggcgaacgccuacuuuucuuccgaucauacaucccccucaaaggaggcuacggaaaccccgccaucgacugccuacucccacaagaauggguacaacacuucuaccaagaagcagcaccauccaugagcgaagucgcgcuaguccgcuacaucaauccagauaccggucgugcacuauucgaagcaaaacuccaccgcgccggcuucaugaccgucuccuccaacacauccgccccagucgucguacccgccaacggcuacuuccgcuuugacuccuggguaaaccaguucuacucacuagccccuaugggcacuggcaacggacgacgccgcuaa

SEQ ID NO: 37828 - RNA, 1623 nt, Artificial Sequence
  derived and/or modified sequence opt11 from VP1__Norovirus_and/or_Norovirus-like__AB629946
augaaaauggccuccaacgacgcagccccgucuaccgacggagccgcuggccucgucccugaaucaaacaacgaagugauggcccuagaaccugucgccggagcugcccuagcagcacccgucacaggccaaacuaacaucaucgacccauggauccgcgcaaacuucguacaagcccccaacggugaguucaccguuuccccacgcaacgcccccggcgaaguccuccucucccucgaacuuggccccgaacuaaacccauaccucgcacaccuagcacguauguacaacggauacgcaggaggcauggaaguccaagucaugcuagccgguaaugcauucacagcuggaaaacuugucuucgccgcggucccaccccacuuccccgucgaaaaccuauccccucaacaaauaaccauguucccacacguuauaaucgacguacgcacacuugaacccguacuccucccacuacccgacguccguaauaacuucuuccacuacaaucaaaaagacgaccccaaaaugcgcauagucgccaugcucuacaccccacuacgcuccaacggcuccggcgacgacguauucaccgucuccugccgcguccucacccgccccucaccagauuucgacuuuacuuaccucgucccacccaccguagaauccaaaaccaaacccuucacccuccccauucucacccucggcgaacuaucgaacucccgcuucacagucucaaucgaccaaauguacacaucccucaacgaaguuaucuccguccagugucaaaacggccggugcacacuugacggcgaacuacgcggcacaacacaauuacaaguuuccggaaucugcgccuucaagggcgaagucacagcacacguccacgacaacgaccaucuauacaaugucaccaucacaaaccucaacggcucccccuucgaccccuccgaagacguaccagcaccccucggcguccccgacuuccaaggaagagucuuugguaucaucucccaaagagacaaacacaacucccccggccacaaugaacccgcaaaccgcggccaugacgcaguaguaccaaccuauaccgcccaauacacccccaaauuaggacaaauacaaaucggcaccuggcaaaccgacgaccucacagucaaccaaccagucaaguucacgcccgucggccucaacgacaccgaacacuucaaccagugggucguaccccgcuaugccggcgcccucaaccuaaacaccaaccucgccccauccgucgccccggucuuucccggcgaacgccuacucuucuucagauccuacguaccccuaaaaggcgguuacggcaaccccgcaaucgacugccuccucccccaggaauggguacaacacuucuaccaagaagccgcaccaucuauguccgaaguugcacuuguccgcuacauuaaccccgacaccggccgcgcacuguucgaagccaaacuccaucgcgcaggcuucaugacaguauccuccaacaccucagccccagucgucguaccagccaacggcuacuuccgguucgacucaugggucaaucaauucuacucacuagcccccaugggcaccggaaacggccgccguagguaa

SEQ ID NO: 37829 - RNA, 1623 nt, Artificial Sequence
  derived and/or modified sequence opt11 from VP1__Norovirus_and/or_Norovirus-like__AB809993
augaagauggccuccaacgacgccgcgccauccaacgacggagccgccucacucguaccagaagccaucaacgaaacuaugccccucgaaccugucgccggcgccuccaucgccgccccugucgcuggacaaacaaacaucaucgaccccuggaucagaaccaacuucguccaagccccaaacggcgaauuuaccgucucacccaggaacucucccggagaaauccuccuaaaccuagaacugggcccagaccuaaaccccuaccuugcucaccucucccgaauguacaacggauacgccggcggcgucgaaguccaaguccuccucgcaggaaacgccuucacagccggcaaaauccucuucgccgccaucccacccaacuuccccgucgacaugaucucccccgcacaaauaaccaugcuaccccaccuaauagucgacguucgcacccucgaaccaaucaugauaccccuucccgacguccguaauguauucuaucacuucaacaaccaaccccaaccccgaaugcgacucguagccaugcuguacacaccacuacgcucgaacggcuccggagacgacguauucacaguaagcugccguguccucacgcgcccaacacccgauuuugaguucauauaccuaguuccacccucaguagaauccaaaacaaaacccuuuacacuccccauccuaacuauaucagaacugaccaacucccgauucccaauccccaucgaacaacuauauaccgccccaaacgaaaacaauguaguccaaugccaaaacggcagaugcacccucgacggagaacuccaaggcacuacccaacuccucagcucagcuguaugcagcuaccgcggacgcacagucgcuaacuccggcgacaacugggaccaaaaccuccuacagcuaaccuacccuucaggcgccucauacgaccccaccgacgaagucccagcaccccuaggcacgcaagacuucucaggcauacuuuacggcguccucacacaagacaacguaagcgaaggaaccggcgaagccaaaaacgccaaaggaguuuacauauccacaacaagcggaaaauucaccccgaaaaucggaagcauaggccuccacuccaucaccgaaaacguccacccaaaccaacaaucacgauucacgcccgugggagucgcccaaaacgaaaacaccccuuuccaacaauggguacuuccacacuaugccggcgcccuggcccugaacacaaaccucgcccccgcggucgcccccacauuccccggugaacaacuacuauuuuuccgcucacgcguaccaugcguccaaggacuacgaggacaggacgcauucaucgacugccuccucccacaagaaugggucaaccacuucuaccaagaagcagccccaucccaagccgaugucgcacucauccgcuacgucaacccagacacaggucgcacacucuucgaagccaaacuccaccgauccggcuucaucacagucucccacaccggagccuacccccucgucgucccacccaacggccacuuccgcuuugacuccuggguaaaccaguucuacucacuugcccccaugggaacaggcaacggcagacgacgcuaa

SEQ ID NO: 37830 - RNA, 1623 nt, Artificial Sequence
  derived and/or modified sequence opt11 from VP1__Norovirus_and/or_Norovirus-like__JQ743330
augaugauggccucaaaagacgccccacccaacauggauggcacguccggcgcgggacagcuaguccccgaagccaacacagccgaacccaucuccauggaaccagucgccggcgcagccaccgccgccgccaccgccggacaaguaaauaugaucgaccccuggaucaugaacaacuacguccaagcaccacaaggcgaauuuacaaucucgccuaacaacacccccggagacauccuauucgaccuccaacucggaccacaccucaauccguuccucucccaccucgcccaaauguacaacggaugggucggaaacaugaagguaaaaguucuccucgccggaaacgcuuucacagccggcaaaauaaucaucagcugcauacccccaggguuugccgcacaaaacaucagcaucgcucaagccaccauguucccacacguaauagcggacguccgaguccucgaacccaucgaaguaccccucgaagacguacgaaacgucuuauuccacaacaacgacaacacacccacaaugcgccuaguaugcaugcucuacacaccccuucgcgcauccggcagcuccuccgguaccgacccauucgucauagccggucgaguacuaaccugccccucaccagacuucucauuccucuuccucguaccacccaacgucgaacagaaaaccaaacccuucuccguacccaaccucccccuaaacacucuaucaaacucccgcguccccucacucauccgaucaaugauggucucacgagaucacggccaaaugguccaauuccagaauggucgcgucacccuagacggccaacuccaagguaccaccccuacauccgccucucaacucuguaaaauacgcggaucagucuuccacgccaacggcgguaacggauacaaccucaccgaacucgacggaucaccauaccacgcauucgaauccccagcccccauaggauuccccgacuuaggugaaugcgacuggcacauggaagccuccccaaccacccaauucgacacaggcgaugucaucaaacaaauuaacgucaaacaggaagccgcuuuugcgccccaucuagguaccauccaagccgacggacucuccgacguauccgucaacaccaacaugauagcaaaacuuggcugggucagccccgucucagacggccaccgcggcuccguagaccccugggucaucccccgcuauggcucaacccuaacugaagccgcccagcucgcaccacccauauauccucccggauucggagaagccaucgucuucuucauguccgacuuccccaucgcccacggcgcaaacggccucucaguccccugcaccaucccccaagaguucguaacgcacuucgucaacgaacaagcccccacucgcggagaagccgcccuacuccacuaccucgaccccgacacacacagaaaccucggcgaguucaaacuuuaccccgaaggcuucaugaccugcguucccaacaguucaggaacaggcccccaaacccuccccaucaacggagucuucgccuucgugucgugggucucccguuucuaccaacucaaaccagucggaacggccggacccgcccgacggcuauaa

SEQ ID NO: 37831 - RNA, 1623 nt, Artificial Sequence
  derived and/or modified sequence opt11 from VP1__Norovirus_and/or_Norovirus-like__AF439267
augaugauggccucaaaagacgccccuaccaacauggacggaaccuccggcgccggccaacugguccccgaagccaacaccgccgaacccaucucaauggaaccuguagccggcgccgccacugccgcagccacagccggccaagucaacaugaucgaccccuggauaaugaacaacuacgugcaagcaccccaaggagaguucaccauaucccccaacaauacccccggagacauccucuucgaccugcaacuaggaccccaccuaaacccauuccucucccaccuagcacaaauguacaacggauggguuggaaauaugaaagucaaaguccuccuagcuggaaacgcuuucaccgcaggaaaaauaaucaucucaugcauaccacccggcuucgccgcacaaaacaucagcaucgcccaagcaaccauguucccccauguuauugccgacguacgaguacuagaacccaucgaagucccccuugaagaugucagaaacguccucuuucacaacaacgacaacacccccaccaugcgucuagucugcaugcuuuacacaccccuccgcgccuccggaagcuccuccggaaccgaccccuucgucaucgccggccgcguccuaaccugcccauccccagacuucuccuuucucuuccucguaccacccaacgucgaacagaaaaccaaacccuucucaguccccaaccucccgcucaacacccuauccaacucccgcguccccucccuaaucaaaagcaugauggucucucgcgaccacggccaaaugguccaauuccaaaacggacgcgucacgcucgacggucaacugcaaggcacaacccccaccuccgccucccaacuaugcaagauccgcggcucagucuuccacgccaacggaggaaacggauacaaccuaaccgaacucgacggaucucccuaccacgccuucgagucccccgcgcccgucggauucccagaccuuggcgaaugcgauuggcacauggaagccuccccaaccacccaauucaauaccggcgacgucaucaagcaaaucaacgucaaacaagaaucugcauucgccccacaccuaggcaccauccaagcagacggacuauccgacguaagcgucaacaccaacaugauagcaaaacuuggcugggucucaccugucagcgacggccacaaaggcgacguagaccccuggguuaucccucgcuacggguccacccucacagaagccgcccaacucgcaccacccaucuacccgcccggcuucggagaagccauaguauucuucaugucagauuuccccaucgcccacggcacgaacggacuuuccguacccugcaccaucccccaagaguucgucacccacuucgucaaugaacaagcccccacacgcggcgaagccgcccuccuccacuaccuagacccagacacucacagaaaccucggagaguucaaacuuuacccagacggauucaugacaugcguucccaauucaucgggcaccggcccccaaacccuacccaucaacggcguauucgucuucguauccugggucagccgauucuaccaacucaaacccgucggaacagcuggcccugcacguagacuuuag

SEQ ID NO: 37832 - RNA, 1623 nt, Artificial Sequence
  derived and/or modified sequence opt11 from VP1__Norovirus_and/or_Norovirus-like__EF547393
augaugauggcaucaaaaggcgcucccaccaacauggacggcaccucuggcgccggccagcucgucccagaagccaacacagcagaaccaaucuccauggaacccgucgcaggagccgccacugcagccgccacagccgggcaagucaauaugauagaccccuggauaaugaacaacuacguacaagccccacaaggagaauucaccauaagcccaaauaacacaccaggggauauccuauucgaucugcaacuaggcccccaccucaaucccuuccucagccaccucgcccaaauguacaacggcuggguaggcaacaugaaagucaaaguucuccuagccggcaacgccuucaccgccggaaaaauaaucaucuccugcaucccacccggcuucgucgcccaaaacauaucaauugcccaagcaacuauguucccacacguaaucgccgacguacgaguccucgaacccaucgaagucccccucgaagacguacgcaacguccucuuccacaauaacgacaacaccccgaccaugcgccucguuugcaugcucuacaccccucuucgcgcaucuggaucauccuccggcaccgaccccuucgucaucgccggcagaguccucaccugcccaucccccgacuucucauuccucuuccucgucccccccaacgucgaacagaaaacaaaacccuucucaguccccaaccucccccuaaacacccucagcaacucccgcguacccucacuaaucaaaucuaugauggucucacgcgaccacggacaaaugguccaauuccaaaauggccgagucacacucgacggccaacuccaaggaaccacaccaacauccgcaucacaacuaugcaaaauccgcgguucagucuuccacgcuaacggcggcaacggauacaaccuaaccgaacuagacggcucaccauaccacgccuucgaaucccccgcccccauugguuuccccgaccucggagaaugcgauuggcacauggaagcaucccccaccacccaauucaacaccggugacgucaucaaacaaaucaacguuaaacaagaauccgccuucgccccacaccucggaaccauccaggccgacggccucuccgacgucagcgugaacaccaacaugauagccaaacucgagugggucuccccagucuccgacggccacaagggcgacguagacccuuggguuauuccacgcuacggaucaacccucacagaagccgcccaacucgcccccccuaucuacccccccggauucggcgaagccaucgucuucuucauguccgacuuccccauugcacauggcaccaacggacucuccguucccugcaccaucccccaagaauucgucacccacuucgucaacgaacaagcccccacccgcggcgaagcugccuuacuccacuacuuagaccccgacacucaccgaaaccuaggcgaauucaagcuauacccagacggauucaugaccuguguucccaacuccuccggcacaggcccccaaacccuucccaucaacggcgucuuuguauucgucuccugggucagccgcuucuaccaacucaaacccgucggaacagcaggacccgcacgacgucucuaa

SEQ ID NO: 37833 - RNA, 1623 nt, Artificial Sequence
  derived and/or modified sequence opt11 from VP1__Norovirus_and/or_Norovirus-like__AF145709
augaugauggccuccaaagacgcgcccccaaacauggacgguacgucaggggccggccaacuaauaccagaagccaacacugccgaacccaucagcauggaacccgucgccggugcagccaccgccgccgccacugcaggacaaguaaacaugaucgaccccuggaucaugaacaacuacguucaagccccucaaggagaauuuacuaucucacccaacaacacccccggcgacauccucuucgaccuccaacuaggaccgcaccuaaaccccuuccuaucccaccucgcacaaauguacaacggcugggucggaaacaugaagaugaaaguccuccucgcaggcaacgccuucaccgccggcaaaaucaucauauccugcaucccacccggauucgcagcccagaacauauccaucgcucaagccacaauguucccccacgucaucgccgacguccgcguccucgaacccauagaagucccccucgaagacguacgaaacguccucuuccacaacaacgacaacacacccacaaugcgacucgucugcaugcuauacacaccccuucgugcuuccggaucauccucuggcacugaccccuucguaaucgccggccgaguccucacaugcccaucccccgacuucucauuccuauuucuugucccacccaacgucgaacagaaaacaaaacccuucuccguccccaaccucccccucaacacacucuccaauagccgcguacccucacucaucaaaucaaugauggucucacgcgaccacggacaaaugguccaauuccaaaacggacgaguaacauuagacggccaacuacaaggcaccacccccacuuccgcgucacaacucugcaagauccgcggcucggucuuccacgcaaacgguggaaacgguuacaaccucaccgcuuuagacggaucaccuuaccacgcuuucgaaucccccgccccuauaggauuccccgaccuaggcgaaugcgacuggcacauggaagcauccccuacuacccaauucgacaccggcgacguaaucaaacaaaucaacgucaaacaagaauccgccuucgcaccccaccuuggcacaauacaggccgacggucucucagacguguccgucaauaccaauaugaucgccaaacuaggcuggguaucacccgucuccgacggccaucgugggaacguugaccccuggguaauaccccgcuacggcucuacucugaccgaagccgcccaacuagcacccccaaucuacccucccgguuucggcgaagccaucgucuucuucauguccgauuuuuccaucgcucacggcaccaacggucucuccgucccaugcaccauuccacaagaguucgucacacacuucguuaacgaacaggcaccuacacguggcgaagccgcccuucuccacuaccuagaccccgacacacaccgcaaccucggcgaguucaaacuuuaccccgaaggcuucaugaccugcgugcccaacucauccgguacuggcccccaaacccuccccaucaacggagucuucguauucgucuccugggucucucgcuucuaccaacucaaacccgucggaacagccggccccgcacgccgccucuaa

SEQ ID NO: 37834 - RNA, 1623 nt, Artificial Sequence
  derived and/or modified sequence opt11 from VP1__Norovirus_and/or_Norovirus-like__FJ711163
augaugauggcauccaaagacgccccaaccaacauggacggaacuuccggagcuggacaacucguucccgaagccaacacagcagaacccaucuccauggaaccuguagccggcgccgccaccgcagcugccacagcaggacaagucaacaugaucgaccccuggaucaugaacaacuacguccaagcaccccaaggugaguucacuaucucccccaauaacacucccggcgacguccuauucgaccuccaacuaggaccccacuuaaacccauuccucucccaccucgcccaaauguacaacggcugggucggcaacaugaaagucaaaguacuacuagccggcaacgccuucaccgcaggcaaaauaauuaucucuugcauacccccaggauucgcagcacaaaacuucuccaucgcccaagcaaccauguucccccacgucaucgccgaugugcgcguacuagaaccaaucgaagucccccucgaagauguccgcaacguccucuuccacaacaacgacaacaccccgacaaugcgacuugucugcaugcuauacacaccccuccgcgccuccggcucauccucgggcaccgaccccuucgucaucgcaggacgcguacuaaccugccccucacccgacuucuccuuccucuuccucgucccaccaaacgucgaacagaaaaccaaaccauucucagucccaaaccuaccccuaaacacccuaucuaacucccgagucccuucauuaauaaaaucaaugaugaucucacgagaccacgggcaaaugguucaauuccaaaacggacgaguaaccuuggacggacaacuccaagggacaacccccaccagugcaucacaacuuugcaaaauacgcggauccguauuccacgccaacggcggcaacggcuacaaccuuaccgaacuggacggcagccccuaccacgccuuugaauccccagcacccaucggauuccccgacuuaggagaaugcgacuggcacauggaagccagccccaucacucaauuugacacaggcgacguaauaaaacaaaucaacgucaagcaagaaucugccuucgcaccccaccucgguacaguccaagcugauggucucuccgacgucuccgccaacacaaacaugaucgcuaaacuaggaugggucucacccgucuccgacggccaccgcuccgacgucgacccuuggguaaucccacgcuacggauccacacucaccgaagcugcacaacuagccccaccaauuuacccacccggauucggagaagcaauugucuucuucauguccgacuuccccauugcccacggaaccaacggccucuccguccccugcaccauuccccaagaauuugucacccacuucgucaacgaacaagccccuacccgaggcgaagccgcccuccuacacuaccuagaccccgacacccaccguaaucuaggcgaguucaaacuauacccugacggcuucaugaccugcguacccaacuccuccggaaccggcccccaaacccuccccaucaauggcguauucgucuuugucuccugggucucacgauucuaccaacucaaacccgucggcaccgccggccccgcgcgcagacucuaa

SEQ ID NO: 37835 - RNA, 1623 nt, Artificial Sequence
  derived and/or modified sequence opt11 from VP1__Norovirus_and/or_Norovirus-like__FJ711164
augaugauggccucgaaagacgccccaacaaacauggacggcaccuccggagccgggcagcuaguccccgaagccaacaccgcggaaccaauaucaauggaacccgucgcaggcgcagcaaccgccgccgcaaccgcuggacaagucaacaugaucgaccccuggaucaugaacaacuacguacaagcaccccaaggagaauuuaccaucucacccaacaacacccccggagacguccuauucgaccuccaacucggcccccaccucaaccccuuccuaucccaccucgcccaaauguacaacggauggguuggaaacaugaaagucaaaguccuccuagccggcaacgccuucaccgccggaaaaaucaucaucucuuguauaccacccggcuucgucgcacaaaacuucuccaucgcacaagccaccauguucccccacguaaucgccgacguacgcguccucgaacccaucgaagucccacuagaagacguacgcaacguccucuuccauaacaacgacaacacccccacaaugcgacucgucugcauguuauacacuccccuccgcgcaggcggcagcuccucuggcaccgaccccuucgucaucgccggccgagugcucacuugcccaucacccgauuucuccuuccucuuccucguacccccgaacgucgaacagaaaacaaaaccauucuccguccccaaccucccacucaacacccuaucgaacucccgagucccaucccucaucaaaucaaugaugaucucacgcgaucacggacaaaugguacaauuucaaaacggccgcgucacccucgacggacaacuacaaggcaccaccccaaccuccgccucccaacucugcaaaauucgaggcuccgucuuccacgccaacggcggaaacggcuacaaccucaccgaacucgacgggucucccuaccacgccuucgaaucgcccgcucccaucggauuccccgaccuuggggaaugcgacuggcacauggaagcauccccuaccacgcaauuugacaccggcgacgucauaaaacaaauaaacguuaaacaagaauccgccuucgccccacaccuaggcaccguccaagcugacggacucuccgacgucucagcaaacaccaacaugauagccaaacucggcugggucucccccguuucugacggccaucgauccgacguagacccaugggucauaccgcgcuacggcucuacccucaccgaagccgcucaauuagccccacccauauacccacccggcuucggcgaagccaucgucuucuucaugucugauuuccccaucgcacauggcacaaacggacucuccguacccugcacgaucccccaagaauuugucacacacuucguaaacgaacaagccccaacccgaggcgaagccgcacuacuccacuaccucgacccugacacccaccgcaaccucggcgaguucaaacucuaucccgacggcuucaugaccugugucccaaacaguucaggaaccggcccccaaacauuacccauaaacggcgucuucguauucgucagcugggucucccgcuucuaucaacucaaaccagucggcacagccggccccgcccgacgccuauaa

SEQ ID NO: 37836 - RNA, 1623 nt, Artificial Sequence
  derived and/or modified sequence opt11 from VP1__Norovirus_and/or_Norovirus-like__AF414405
augaugauggccucaaaagacgccccacccaacauggacggcacauccggcgccggacagcucguccccgaagcaaacacagccgaacccauauccauggaaccagucgcaggcgccgccacugccgccgccaccgccggccaagucaacaugauagacccauggaucaugaacaacuacguccaagccccucaaggcgaauuuaccaucucccccaacaacaccccaggcgacauccuauucgaccuucaacucggcccccaccucaaccccuuccuaucucaccuagcccaaauguacaacggcugggucggcaacaugaaaguaaaaguccuguuagccggcaacgccuucaccgcuggaaaaaucauaaucuccuguauaccacccggcuucgcagcccaaaacauauccauagcucaagccacaauguucccccacguuaucgccgacguccgaguccuugaacccaucgaaguaccccucgaagacguccgcaacguccuuuuccacaacaacgacaacaccccaaccaugcgccucgucugcaugcucuacaccccacuccgagcaagcggaucuucguccggcaccgacccuuucgucaucgccggccgcguccuaaccugucccucacccgacuucucuuuccucuuccucguucccccuaacgucgaacagaaaacaaaaccuuucucgguacccaaccucccccucaacacccuuuccaacucccgcguccccucacucaucaaauccaugauggucucccgagaucacggccaaaugguccaauuccaaaauggcagaguaacacucgacggccaacuccaaggcacuacucccaccuccgccucccaacucugcaaaauccguggcuccgucuuccacgcgaacggcggcaacggcuacaaccucaccgaacuagacggcucccccuaccacgccuuugaauccccagccccuauaggcuuccccgaccucggagaaugugacuggcacauggaagccagcccaacaacacaauuugacacaggugacguaaucaaacaaaucaacguaaaacaagaauccgccuucgcaccccaccuaggcaccauacaggccggcggccuuucagacguauccgucaacaccaauaugauugccaaacucggcuggguaagccccgucuccgacggccaucgaggcaaugucgacccaugggucaucccacgcuacggcuccacccuuacugaagccgcccaacucgccccacccaucuaucccccuggauucggagaagcaaucguuuucuucauguccgacuucccaaucgcacacggcaccaacggucucucaguacccuucaccaucccgcaagaguucgucacacacuucgucaaugaacaagcaccuacacgcggcgaagccgcccuacucuacuaccuagacccagacacacaccggaaccuaggcgaguucaaacuauacccagaaggcuucaugaccugcguacccaacucaagcggcaccggcccucaaacccuacccaucaauggcgucuuuguguucgucuccugggucuccagauucuaccaacucaaacccgucggcaccgcgggccccgcgagacgccucuag

SEQ ID NO: 37837 - RNA, 1623 nt, Artificial Sequence
  derived and/or modified sequence opt11 from VP1__Norovirus_and/or_Norovirus-like__AB022679
augaugauggccuccaaagacgcuacccccuccgccgacggcgcaacaggcgccgggcaacucguccccgaagucaacacggccgacccaauacccaucgaccccguagccggcucuucuacagcccuagcuacugcaggacaagucaaccucaucgacccauggauaaucaacaacuucguccaagcaccccaaggggaauucacaauaucccccaacaauacacccggagacguacuauuugaucuccaacucggaccacaccuaaaccccuuccucucacaucucucccaaauguacaacggaugggucggcaacaugcgcguucgagucguauuagcaggcaacgccuucaccgccggcaaagucaucauaugcugcguaccccccggcuuccaaucucgcacacuauccaucgcacaagccacccucuucccccauguuaucgcagacguccgaacccucgacccaguugaaguuccccuugaagacguacgcaacguccuauaccacaacaaugacacccaacccaccaugcgccuccucuguaugcucuacaccccacuccguaccggaggcgccucagguggaacagacucauucguugucgccggccgaguguuaaccugucccggccccgacuucaacuuccucuuccuugucccacccacaguagaacagaaaacacgacccuucacuguacccaacauuccccucaaauaccucagcaacucccgcauaccaaaccccaucgaaggaaugucacuaucccccgaccaaacccaaaacguacaauuccaaaacggccgaugcacaaucgauggccaaccucucggcacaacaccuguauccguuucacaacuaugcaaauuccgaggucgcauaacauccggacaacgcgugcuaaaccuuaccgaacucgacggcucccccuucaugggcuucggcgccccugccccagccggcuucccagaccucggcagcugugauuggcacaucgaaaugucaaagauacccaacuccucaacccaaaacaaccccaucgugacaaacuccgucaaaccgaacucccaacaauucguaccacaccuauccuccaucacccuugacgaaaacgucucauccgguggcgacuauaucggcaccauccaauggaccagccccccuucagacuccggcggcgccaacaccaacuucuggaaaaucccugacuacggcucaucacucgccgaagccucucaacucgcgcccgccgucuaccccccugguuucaacgaagucaucguuuacuucauggccagcauccccggccccaaccagucuggcucccccaaccuggucccaugccuccucccucaagaauacaucacccacuucauuuccgaacaagccccaauccaaggugaagcagcacuccuucacuacgucgaccccgacaccaaccgaaaucucggugaauucaaacucuauccaggcggauaccucaccugcguacccaacuccuccuccacagguccccaacaacucccucuugacggaguauucgucuucgccucuuggguaucccgcuucuaccaacuuaaaccugucggcaccgccggccccgcacgcggccgccuauga

SEQ ID NO: 37838 - RNA, 1623 nt, Artificial Sequence
  derived and/or modified sequence opt11 from VP1__Norovirus_and/or_Norovirus-like__AF414403
augaugauggcauccaaagaugccccacccaacauggacggcacauccggcgcuggacaacucguccccgaagccaacacagccgaacccaucucaauggaacccguagccggagcagcaaccgcagccgccaccgccggacaagucaacaugauagaccccuggaucaugaacaacuacguccaagccccacaaggcgaauuuacaaucucucccaacaacacccccggcgacauccuauucgaccuacaacuuggcccccacuuaaaccccuuucucucccaccuagcccaaauguacaacggcugggucggcaauaugaaagucaaagugcuucucgccggcaaugcauucacagccggcaaaaucauaauauccuguaucccacccggcuucgcagcccaaaacauuuccaucgcccaagccacaauguucccccacgucaucgccgauguaagaguccucgaacccaucgaagucccccuagaagacguacguaacguccucuuccacaacaacgacaacacucccaccaugcgccuagucugcaugcucuacacaccccuccgcgccucaggcuccucauccggcaccgauccguucguaaucgccggccgaguccuaaccugcccuuccccagacuucucccuccucuuccucgucccuccaaacgucgaacagaaaacaaaaccauuuuccgucccaaaccuccccuuaaacacccucuccaacucccgcguacccucccucauaaaaucaaugaugguaucacgcgaccacggccaaaugguccaauuccaaaacggacgcgucgcccucgauggccaacuccaaggcacaacccccacauccgcaucccaacucugcaaaauccgcggaucuguuuuccacgccaacggaggaaacggcuacaaccccacugaacucgacggcuccccauaccacgccuucgaaucucccgcacccaucggcuuccccgaccuuggcgaaugcgacuggcacauggaagcaucccccaccacccaauucgacaccggcgacgucaucaaacaaauaaacgucaaacaagaauccgccuucgcaccccaccucggcacaauccaagccgacggccucagcgacguaucaguaaauaccaacaugaucgccaaacucggaugggucucccccgucuccgacggacaccgcggcaacgucgacccaugggucauaccccgcuauggcucaacacucaccgaagccgcccaacuggcuccacccaucuaucccccagguuucggcgaagccaucguguuuuucauguccgacuucccuaucgcccacggaaccaacggccucagcgucccuugcaccaucccccaagaguucguuacucacuucgugaacgaacaagccccaacccgaggcgaagccgcacuccuccacuaccucgaucccgacacccacagaaaccucggcgaguucaaacucuacccagaaggcuucaugacgugcguccccaacucuuccggcacaggcccccaaacccuccccauaaacggcguauucgucuucgucucuuggguuucccgcuucuaccaacucaaacccgucgggaccgcuggacccgccagaagacuauaa

SEQ ID NO: 37839 - RNA, 1623 nt, Artificial Sequence
  derived and/or modified sequence opt11 from VP1__Norovirus_and/or_Norovirus-like__LC101821
augaugauggcaucuaaagacgcugccccuucagcugacggugcaaccggcgcuggccaacucguaccugaagucaacaccgccgacccaaucccuaucgaccccguugcaggcucauccacugcgcucgcgacagccggccaagucaaccuaauagaccccuggauaaucaacaacuucguucaagccccacaaggagaauuuaccaucuccccuaacaacaccccuggagacguccuauucgaucuccaacucggcccccaccuuaaccccuuccucucccaccuuucccaaauguacaacggaugggucggcaacaugcgaguccgcgucguccuagccggcaacgccuucaccgcaggaaaagucaucaucugcugcgucccucccggauuccaaucccgcacccucuccaucgcacaagcaacacuauucccccacgucauagccgacguccgcacccucgaccccguagaaguaccccuagaagauguacgcaacguucucuaccacaacaacgacacucaacccaccaugcgccuacuuugcaugcucuacacuccccuacgaaccggcggcgccuccggcggaacagacuccuucgucguagccggcagaguccucacaugucccggacccgauuucaauuuccucuuccucguaccgcccaccgucgaacaaaagacaagaccuuucaccgucccaaacaucccccuaaaauaccuauccaauucccgcaucccuaaccccaucgaaggcaugucucuaucccccgaccaaacccaaaacguccaauuccaaaacggacgaugcacuauagacggccaaccacuuggcaccacccccgucuccguuucccaacuuugcaaauuucgaggccgcaucacaagcggacaaaaaguacucaaccuaacagaacucgacggcucccccuuuauggcuuucgccgcccccgcacccgucggcuucccggaccuaggauccugcgacuggcacaucgaaauguccaaaauccccaacuccucuacccaauccaaccccaucguugucaacucuguuaaacccaacucccaacaauucguaccccaucucuccuccauaacccuugacgacaaugucucuucaggcggcgacuacaucggcacaauccaauggaccuccccaccuuccggcuccggaggagccaauacuaacuucuggaaaauucccgacuacggcuccucacucgccgaagccagccaacuagcacccgccgucuacccgccuggauucaacgaagucaucguauacuuuauggccucaauaccgggcccaaaccaauccggcuccccaaaccucguccccugccuccuaccccaagaauacaucacucauuuuaucuccgaacaagcaccaauccaaggcgaagccgcccuccuacacuacguagaccccgacaccaaccgcaaccuaggcgaauuuaaacucuaccccgguggauaccuuaccugcguuccuaauuccuccucaacaggcccacagcaacucccacucgacggagucuucgucuucgccuccugggucucccgauucuaccagcucaaacccgucggaaccgcaggccccgccagaggccgacucuga

SEQ ID NO: 37840 - RNA, 1623 nt, Artificial Sequence
  derived and/or modified sequence opt11 from VP1__Norovirus_and/or_Norovirus-like__AY038598
augaugauggccucaaaagacgcaccacccaacauggacggcacuucaggcgccggccagcuaguccccgaagccaacaccgccgaaccaaucuccauggaacccguugccggagccgccacugccgccgccaccgcaggccaaguaaacaugauagaccccuggaucauggacaacuacguacaagcaccccaaggagaauuuaccaucucucccaacaacacccccggcgacauccuauucgacuuacaacugggaccacaccuaaacccguuccucucucaccucgcccaaauguacaacggcuggguaggcaacaugaaaguuaaagucuuguuagccggcaacgccuucacggccggaaaaauaauuaucuccugcauacccccaggguucgccgcccaaaacaucucuaucgcccaagccaccauguucccccacgucaucgccgacguccgcguccucgaucccaucgaaguuccauuggaagacgucggcaacguccucuuccacaacaacggcgacaccccaaccaugcgcuuagucuguaugcuguacacuccccuccgcgccagcggcuccucaucagguaccgaccccuucgucaucgccggacacguccucacaugccccuccccugacuucuccuuccuauuccucgguccucccaacgucgaacagaaaaccaaacccuucucaguccccaaccuaccccucaacacccucuccaacucccgcguuccuagccucaucagaucaaugauggucucccgcgaccacggccaaauggugcaauuccaaaacgggcgagucacacucgacggccaacuccaaggcaccacccccacgagcgccagccaacucugcaagauccgcggcucaguauuccacgccaacggcggcaacggcuacacccucaccgaacucgauggcuccccauaucacgcauucgaaucacccgcccccaucggcuuccccgaucuaggcgaaugcgacuggcacauggaagccucacccacaacacaauucgauacgggugacgucauaaaacaaaucaacguaaaacaagaagccgcauucgcaccucaccucggcaccauacaagccgacggccuaucagacgucucagucaacacaaauaugaucgcgaaacuaggcugggucucacccgcauccgacggccaccgcggaaacgucgaccccuggguaauaccaagauacgguucgacccucaccgaagcagcacaacuggccccacccaucuacccgcccggcuucggagaagccaucgucuucuuuauguccgacuuccccauagcccacggcgcuaacggccucucaguaccaugcaccaucccacaagaauuuguuacccacuucguuaacgaacaagcuccgacacgcggcgaagcagccuuacuccacuaccucgacccagacacacaccgaaaccuaggcgaguucaaacucuacccagaagguuucaugacaugcgugccaaacucaucaggcacaggcccacaaacacucccaaucaacggagucuucgucuucguaagcugggucucccgcuucuaccaacuaaagcccgucggcaccgccggacccgcgcgcucacucuag

SEQ ID NO: 37841 - RNA, 1623 nt, Artificial Sequence
  derived and/or modified sequence opt11 from VP1__Norovirus_and/or_Norovirus-like__KJ196292
augaugauggccuccaaagacgccccaacaaacauggacggcaccagcggcgccggucaacucgucccagaagccaacacagccgaacccauuuccauggaaccuguagcaggcgccgccaccgccgccgcaacagcaggccaaguaaacaugauugaccccuggaucaugaauaacuacguccaagccccucaaggcgaguucaccaucucccccaacaacacuccgggcgacauacucuucgaccuccaacuaggcccccaccucaacccauuccuaucacaccucgcccaaauguacaauggcugggucggaaacaugaaagucaaaguacuccuagcaggcaacgccuucaccgccggaaaaaucaucauaucaugcaucccacccggguucguugcucaaaacgucuccaucgcccaagccacaauguucccccacgucauagcugacguacgaguccucgaacccauagaagucccccucgaagacguccguaacguccucuuccacaacaacgauaacacaccaacaaugcgccucgucugcaugcuauacacuccacuccgugcaucugguuccucauccggcaccgaccccuucgugaucgccggccgcgucuuaaccugccccagccccgacuucagcuuccucuuccucguaccaccgaacgucgaacaaaagacuaaacccuucucagucccgaaccucccccuuaacacucucuccaacucccgaguacccucccucaucaaauccaugaugguuucccgagaccacggccaaaugguacaauuccaaaacggacgcgucacccucgacgggcaacuccaaggcacgacccccaccuccgccucccaacucugcaaaauccgcggaagcguuuuucacgccaacggcggcaacggauacaaccucaccgaacucgacggcucacccuaccaugccuucgaaucucccgcacccaucggauuccccgaccucggggaaugcgacuggcacauggaagccucucccaccacgcaauucaacaccggcgacguaaucaaacaaaucaacgucaaacaagaauccgccuucgccccacaucuagguaccauccaagcagauggacuaucugacgucuccgucaacaccaacaugauagccaaacucggaugggucucaccaguaucagacggccacaaaggcgacgucgacccaugggucaucccccgauacggcuccacccucaccgaagcagcccaacuagccccacccauauacccacccggauucggagaagcuaucgucuucuucauguccgacuuucccaucgcccacgguaccaacggacuauccguacccugcaccaucccccaagaguucgucacacacuucgucaacgaacaagcucccacccgcggcgaagccgcccuucuccacuaccuagaccccgacacccaccgcaaccuaggcgaguucaaacucuaccccgacggauucaugaccugcguccccaacagcuccggcacaggcccacaaacccuacccauaaacggcgucuucgucuucguuucauggguaucacguuucuaccaacucaaacccguaggcaccgcuggccccgcaagacgccucuaa

SEQ ID NO: 37842 - RNA, 1623 nt, Artificial Sequence
  derived and/or modified sequence opt11 from VP1__Norovirus_and/or_Norovirus-like__JQ743331
augaugauggcauccaaagacgccacacccucugcagauggagccacaggcgccggccaacucguacccgaaguaaacacagcagaccccauucccaucgaucccgucgccggcagcucgacagcccucgccaccgccggacaagucaaccucaucgacccuuggaucaucaacaacuucguacaagcuccccaaggagaauucaccauuucuccaaacaacaccccgggcgacguccucuucgaucuccaacucggcccacaccuuaaccccuuccucucacaccucucccaaauguacaacggaugggucggcaauaugcgcguacgagucguccucgcaggcaacgccuucacagcaggaaaagucauaaucugcugcgugccccccggauuccaaucccgcacacucucuaucgcccaagcaacccuauucccucacgucauagcagauguacgcacucucgaccccguagaaguaccccuggaagacguucguaacguucuauaccacaacaacgacacccaaccaacaaugcgacugcuaugcaugcuguauacaccccuccguacaggcggcgcauccggcggaaccgacuccuucguugucgccggacgcguccuaaccugccccggccccgauuucaacuuccucuuccuaguccccccaaccgucgaacaaaaaacacgacccuucaccguacccaacaucccucucaaauaccucucaaacucccgcaucccgaacccaauagaagguaugucacucucccccgaccaaacccaaaauguccaauuucagaauggacgcugcacaaucgacggccaaccucucgggaccacccccgucagcguaucacaacucuguaaguuccgcggccgaaucaccucuggccaaaagguccucaaccugaccgaacuagacggcucucccuucauggccuucgccgcccccgccccugccggcuuccccgaccucggcucgugcgacuggcacaucgaaauguccaaaaucccaaacuccuccacccaaucgaacccaaucguagucaacuccgucaaaccuaacagccaacaauucgucccacaccucucaucaauuacacucgacgacaaugucucuuccggaggcgacuauaucggcaccauccaauggaccuccccacccuccgacuccggcggagccaauacaaauuucuggaaaauaccugacuacggaucaucccuugccgaagccucgcaacucgcccccgcagucuacccacccggcuucaaugaaguaaucgucuacuucauggcuagcauacccggccccaaccaaagcggcucuccaaaucucgucccaugccuccucccccaagaauauauuacccauuucaucuccgaacaggcccccauccaaggcgaagcagcccuccuccacuacguagauccugacaccaaccgcaaccuuggcgaauucaaacucuacccaggaggcuaccucaccuguguccccaacuccucauccacaggcccacagcaacucccccucgacggagucuucguauucgcauccugggucucccgcuucuaccaacuaaaacccgucggcaccgccggccccgcacgcggccgccuguaa

SEQ ID NO: 37843 - RNA, 1623 nt, Artificial Sequence
  derived and/or modified sequence opt11 from VP1__Norovirus_and/or_Norovirus-like__EF547394
augaugauggccucgaaagacgcaacaccuagugcagacggagccaccggcgccggccaacucgucccugaaguaaacaccgcagaccccauccccauagacccagucgccggcuccuccacagcucuggcaaccgcaggccaagugaaucucaucgaccccuggauuaucaacaacuucguccaagccccacaaggagaauuuacuaucucccccaacaacacacccggcgacguccuauucgacuuacaacucggcccucaccucaacccauuccuuucucaccucucacaaauguacaauggcugggucggcaacaugcgcguacgugucguccucgcaggaaaugccuucaccgccggcaaagucaucauaugcugcguucccccaggcuuccaaucccgcacacuaucuaucgcacaagcaacucucuucccacacgucaucgcagacguacgcacacucgaccccgucgaaguaccccucgaagacguucgcaacguccucuaccacaacaacgacacccaacccaccaugagacuacucugcaugcuuuacaccccacuacgaaccggaggcgccuccggcggcaccgacuccuucguagucgccggccgcguccuaaccuguccaggacccgacuucaacuuucucuuccucguaccucccaccguagaacaaaagacacgucccuucaccguccccaacaucccccucaaauaccucucaaacucacgcauaccaaaccccaucgaaggaaugucacuuucccccgaccaaacccaaaacguccaauuucaaaacgggaggugcaccauugauggccaaccacucggcaccaccccaguauccgucucccaacucugcaaauuccgcggacgcauaaccucuggacaaaaaguacuaaaucucacugaacucgacggcucaccuuucauggcuuucgccgcaccagcucccgccggauucccagaccucggcucgugcgacuggcacauugaagucucaaaaauaccuaacuccuccacucaaucaaacccaaucgucgucaauucaguuaaacccaacucccaacaauucgucccccaccucucuucuaucacucuagacgacaaugucuccagcggcggcgacuacaucggaaccauucaauggacuuccccgcccucagacuccggcggcgccaacaccaacuuuuggaaaauccccgacuacggauccucccucgcugaagccucccaacucgcacccgccgucuacccacccggcuucaacgaagucauugucuacuucauggccuccauucccggccccaaccaaucaggcucccccaaccuuguaccaugccuccuaccccaggaauacauaacacacuucauauccgaacaggcacccauccaaggggaagcagcgcuacuacacuacgucgaccccgacaccaaccgcaaccuaggcgaauuuaaacuauaccccggaggauaccucacuugcguaccuaauucuuccuccacuggaccccaacaacucccucucgacggcguauucgucuucgccuccugggucucccguuucuaccaacucaagcccguagguaccgccggaccugcccgcggucgccuauag

SEQ ID NO: 37844 - RNA, 1623 nt, Artificial Sequence
  derived and/or modified sequence opt11 from VP1__Norovirus_and/or_Norovirus-like__AF394960
augaugauggcuagcaaagacgccacaccauccgcugacggcgccaccggcgccggccagcucguccccgaaguaaacacagcaggcccuauccccaucgaccccgucgccggcuccuccaccgcccucgcgaccgccggccaagucaaccuaaucgacccauggaucauuaacaacuuuguacaagcaccccaaggugaauuuaccauaagucccaacaacacccccggcgacguccuauucgaccuccaacuuggcccccaccucaaucccuuccugucccaccuaucacaaauguacaacgggugggucggcaacaugcgaguacgcguaguacucgccggcaacgccuucacugcaggaaaagucauaauaugcugcguacccccuggcuuccaaucucgcacacuaaguauugcccaagccacccucuucccacacguuauagccgacguccgcacccuagaccccgucgaaguaccccuagaagauguccgaaacguccuuuaccacaauaacgacacccaacccacuaugcgacuccucugcaugcucuacacaccccuccguaccggcggugccuccgguggaaccgacuccuucguagucgccggccgcguacucaccuguccaggacccgacuucaacuuucuauuccucguacccccaaccgucgaacagaaaacacgaccguucaccguccccaacauuccacucaaauaccuauccaacucccgcauccccaacccuaucgaaggcaugucacuaucccccgaucaaacccaaaacguacaauuccaaaacggccgcuguaccauagacggacaaccccucgguaccacccccguuucugucucacaacucugcaaauuccgcggccgcaucaccuccggacagaaaguccucaaccucaccgaauuagauggaucccccuuuauggccuucgcagcccccgcccccgcaggcuuccccgaccucggcucaugcgacuggcacauagaaauguccaagauccccaacuccuccacccaauccaaccccaucgucguaaacagcgucaaacccaauagccaacaauucgucccacaccucucuucaauuacacucgacgacaacgucucauccggcggcgauuacaucgguaccauccaauggaccuccccucccuccgacuccggaggcgccaauaccaacuucuggaaaauccccgacuacggaucaucccucgccgaagccagccaacuggcccccgccguguacccacccggcuucaacgaagucaucgucuacuuuauggcgucaaucccaggaccgaaccaauccggcucccccaaccucguccccugccuucucccccaagaauacaucacacacuuuaucuccgaacaagcccccauccaaggagaagccgcccuacuccauuauguagacccugacaccaaccguaaccuaggugaauuuaaacuuuaccccgggggcuaccuaacuugcguccccaacuccuccuccaccggaccacaacaacuuccucucgacggcguuuucgucuucgcauccugggucucuagauucuaccaacugaaacccguaggaaccgccggacccgcccguggacgccucuaa

SEQ ID NO: 37845 - RNA, 1623 nt, Artificial Sequence
  derived and/or modified sequence opt11 from VP1__Norovirus_and/or_Norovirus-like__AJ277616
augaugauggcauccaaagacgccacaccauccgcugauggcgccaccggugccggucagcuaguacccgaagucaacaccgcggacccuauacccaucgaccccgucgccggcucauccacugcacucgcuaccgccggccaagucaaccucaucgaccccuggaucaucaacaacuucguccaagcaccccaaggcgaauuuaccauuuccccaaauaacacccccggagacguccuuuucgaccuccaacucggcccacaccucaaucccuuccuaucccaccucagccaaauguacaauggauggguuggcaacaugcgcguccgagucguacucgcaggaaacgccuucaccgcuggaaaagucauuaucugcugcguucccccaggauuucaaucccgcacccuuucuauugcccaagccacccucuucccucacgucaucgcugacguccgcacccuugaccccguugaagucccccucgaagacguccguaacguacucuaccacaacaacgacacccaaccaaccaugcgccuacuauguaugcucuacaccccacuacguacuggcggcgcaucaggaggcaccgacuccuucgucguagcgggccggguccucacaugccccggcccagacuucaacuuccuuuuucucguucccccaacagucgaacagaaaacucgacccuucaccgucccaaauaucccccuaaaauaccuaagcaacagucgcaucccaaacccuaucgaaggcaugucucucuccccagaccaaacccaaaacguccaauuccaaaacggccgaugcacgauugacggccaaccacucggcaccacccccgucuccguaucccaauuaugcaaauucaggggccgcaucaccuccggccaaaaaguccuaaaccucaccaaacuugacggcucccccuucauggcauucgccgcccccgcuccagccggauucccaaaccucggcuccugcgauuggcacaucgaaaugucaaaaauccccaacuccucgacccaaagcaaccccaucguugucaacucagucaaacccaacucucaacaauucguaccacacuuauccucaaucacccucgacgaaaauguuuccucuggcggugacuacaucggcaccauacaauggacaucuccacccagcgacucaggcggcgccaacaccaacuucuggaaaauccccgacuacgguucaucucuagccgaagccucccaacuagccccagccguauacccucucgucuucaacgaaguaaucgucuacuucauggccugcauccgcggccccaaccaaugcggaucucccaaccuggucccaugccucucaccccaagaauacauaacccauuucauauccgagcaagccccaauucaaggcgaagccgcucuccuccacuacguagaccccgacacaaaccgcaaccuaggcgaguucaagcuauaccccggcggcuaccuuaccugcgucccaaacuccuccuccacgggcccucaacaacuaccccuagacggcgucuucgucuucgccuccuggguuucccgauucuaccaacucaaacccgucggaaccgccggucccgcccgaggccgccuauaa

SEQ ID NO: 37846 - RNA, 1623 nt, Artificial Sequence
  derived and/or modified sequence opt11 from VP1__Norovirus_and/or_Norovirus-like__GQ413970
augaugauggccucaaaagacgcaacccccucagccgacggcgccacuggcgccggccaacucgucccagaagucaacaccgcagacccgaucccaaucgacccagucgcuggaucuucaaccgcccuagcaaccgccggacaagucaaccucaucgacccauggauaauaaacaacuucguacaagcuccccaaggugaguucaccaucucccccaacaacacccccggcgauguccuauucgaccuccaacuaggcccgcaccucaacccauuccuaucacacuuaucccaaauguacaacggcugggucggaaacaugcgcguacgcgucguacucgccggcaacgcauucaccgcaggcaaagucauuaucugcugcgucccacccggcuuccaaucccgaacucucuccauagcccaagccacccuuuucccccacguaaucgcugacguaagaacccuagaucccguugaaguaccccuagaagauguccgcaacgugcucuaccacaacaacgacacccaacccaccaugcgucuccucugcaugcucuacacaccccuacgcaccgguggugccuccggaggcacagacuccuucguaguagccggacgcguacucacaugccccggcccagacuucaacuuccucuuccucgucccacccaccgucgaacagaaaacccggcccuucaccguccccaacaucccccucaaauaccucucaaacucccgaauccccaaccccauagaaggaaugucacucagccccgaccaaacccagaacguucaauuccaaaauggccgcugcacaaucgauggccagccccuuggcacgacccccgucucggucucccaacucugcaaauuccgaggucgcauaacauccgggcaacgaguccuaaaccuaaccgaauuagacggcucaccauucauggccuucgccgccccugccccagccggauuccccgaccucggcuccugcgauuggcacaucgaaauguccaaaauacccaacagcuccacacaaaacaaucccaucgucgucaacucaguuaaacccaacucccagcaauucgucccacauuuauccuccaucacccucgaugacaacgucucaagcggaggcgacuacauugguacaauacaauggaccuccccacccuccgacucgggaggugccaacaccaacuucuggaaaauccccgacuacggauccucacucgccgaagccagccaacuagcccccgccguauauccucccggcuucaacgaagucauuguuuacuucauggccuccauucccggccccaaccaguccggcagccccaaccucguacccugccuacucccccaagaauacauaacccacuuuaucuccgaacaagcucccauccaaggagaagccgcucuccuccacuacguagacccugacacaaaccggaaccucggugaguucaagcucuaucccggaggauaccuaaccugcguccccaacuccuccuccaccggaccccaacaacucccacucgauggcgucuucguauucgcuuccuggguaucacguuucuaccaacucaagccugucggcacugccggacccgccagaggcagacucuaa

SEQ ID NO: 37847 - RNA, 1623 nt, Artificial Sequence
  derived and/or modified sequence opt11 from VP1__Norovirus_and/or_Norovirus-like__KT732281
augaugauggcauccaaagacgccacccccucggccgacggugccaccggcgccggccaacucguaccagaggucaauacagcagaccccauccccaucgaccccguagccggguccuccaccgcccuugcaacagccggacaaguaaaccuaaucgacccauggaucaucaacaacuuuguccaagcaccacaaggcgaguucaccauaucucccaacaacacaccaggcgauguacucuucgaccuccaacuaggaccccacuuaaacccauucuuaucacaccucucccaaauguauaacggcugggucggaaauaugcgaguccgcgucguccucgccggcaacgccuucacugcgggaaaagucauuaucugcugcguuccacccggcuuccaaucacgcacucucucgaucgcccaggccacccuauucccccacgucaucgccgacguucgaacccucgauccagucgaaguaccccucgaagacguucgcaacguccucuaccacaacaacgacacccagcccacaaugcgccuacucugcaugcuuuacaccccgcuccgaacaggcggcgcaucaggcggaacagacucauucgucguagcaggccguguccuaaccugccccggccccgacuucaacuuccucuuccuagucccacccaccgucgaacagaaaacccgucccuucaccguccccaacauuccccucaaauaccucagcaacucccgcauaccaaaccccaucgaaggcaugagccucagcccagaccaaacacaaaacguccaauuucaaaacggccgaugcacgaucgacggccaaccccucggaacaacucccgucuccguaucacaacucugcaaguuccguggucgaaucaccuccggacaaaaaguccuaaaccucaccgaacucgauggauccccauucauggccuucgccgcccccgcucccgccggauuccccgaccucggcuccugcgacuggcacauagaaguaagcaaaaucccuaacucauccacacaaggcaaccccauagucguuaacuccgucaaacccaacagccaacaauucguaccccaccucuccagcaucacccucgaugauaacguguccucaggcggcgauuacaucggcaccauccaauggacauccccacccagcgacucaggcggagccaacaccaacuucuggaaaauacccgacuacggcuccucucuagccgaagcaucccaacucgcuccagcagucuacccacccggcuuuaacgaagucaucgucuacuucauggccuccauccccggcccaaaccaaagcggcuccccaaaccucguccccugccuacucccacaagaauacaucacccacuucauauccgaacaagcaccaauccaaggcgaagccgcauuauuacauuaugucgacccagacacaaaccgcaaccucggcgaauuuaaacuauaccccggaggauaucuuaccugcguucccaacagcuccucuaccggcccccaacaacuaccccuugacggcgucuucguauucgccuccuggguaucacgauucuaccaacucaaacccguugguacagccggacccgcaagaggccgacucuga

SEQ ID NO: 37848 - RNA, 1623 nt, Artificial Sequence
  derived and/or modified sequence opt11 from VP1__Norovirus_and/or_Norovirus-like__AF414404
augaugauggccuccaaagacgcaacccccuccgccgacggcgcuacaggugccggccaacucguccccgaagucaacaccgcugaccccaucccaaucgaccccguagccggcuccuccaccgcccuugccaccgcuggacgagucaaccuaauagacccauggauuauaaauaacuucguucaagcaccccaaggcgaauuuaccauuagccccaacaacaccccuggcgacguacucuucgaccuacaacuaggcccccaccuuaaccccuuccucucacaccucucccaaauguacaacggcugggucggcaacaugcgcguccgcgucgucuuagccggaaacgccuucacugccggcaaggucaucaucugcugcguacccccaggauuccagucacguacacuuucaaucgcccaggccacccuauucccccacgucaucgcagacguccgcacccucgaccccgucgaagucccccuugaagacguccgaaacguucuccaucauaacaaugacacccaaccuaccaugcguuuacuaugcaugcucuacacaccccuacgcaccggcggcgcuucuggaggcacagacuccuuuguagucuccggccgaguccucacaugcccaggacccgauuucaacuuccucuuccucguacccccaacagucgaacagaaaaccagacccuucacaguccccaacaucccacucaaaugccuaucaaacucccgaaucccaaacccaauagaagggaugucacucucaccugaccaaacacaaaacguccaauuucaaaacggccgaugcaccaucgacggacaaccccuagggaccacacccgucuccgucucccaacucuguaaauuccggggucgcaucacauccggccaaggcguccucaaccucaccgaacuagacggcucacccuucauggcauucgccgcacccgcacccgccggauuccccgaccucggaucaugugacuggcacauagaaaugucaaaaauacccaacucuucaacccaaaacaacccaaucgucguaaacuccgucaaaccuaacucccaacaauucgucccccaucucucaucaauaacccuugacgaaaacgucucaucaggaggcgacuacaucggcacgauccaauggaccuccccacccuccgacuccggaggcgcaaacaccaacuucuggaaaaucccggacuacggcagcucccuggcagaagcaucccaacucgcaccagcagucuacccucccggauucaacgaagucauagucuacuucauggccuccauacccggcccgaaccaaucuggaucacccaacuuagucccuugccuacuaccacaagaauacauaacccacuucauauccgaacaagcaccaauccaaggugaagcagcccuacuccacuacguagaucccgauacaaaccgaaaccuaggcgaguucaaauuguaccccggcggcuaccuaaccugcguccccaacuccagcuccaccggcccccaacaacucccacuugacggcgucuucgucuucgccuccugggucucucgauucuaccaacucaaaccagucggcaccgcuggccccgcccgaggccguuuauaa

SEQ ID NO: 37849 - RNA, 1623 nt, Artificial Sequence
  derived and/or modified sequence opt11 from VP1__Norovirus_and/or_Norovirus-like__AF414402
augaugauggccucaaaagaugccacccccucagcggacggcgccacaggugcaggccaacucguacccgaagucaacaccgccgacccaauccccaucgacccugucgccggcagcucaaccgcccucgcaacagcaggccagguuaaccucauugacccauggaucaucaacaacuucguccaggcaccccaaggcgaguucaccauaucccccaauaacacaccaggagacguccucuucgaccuacaacuaggaccucacuuaaaccccuuccucucgcaccuaagccaaauguacaacggcugggucggcaacaugcgcgucagagucguacucgcaggcaacgcauucacagccggcaaagucauaaucugccgaguucccccaggcuuccaaucccgaacccucuccaucgcccaagccacacuuuucccccacgucauugccgacguccgcacgcucgaccccgucgaagucccccuagaagacguccgcaacguccuauaccacaacaacgacacccaacccacaaugagacuccuuugcaugcucuacaccccacuacguaccggcggcgccagcggcggcacagacucuuucgucguagucggccgcguacuuaccugccccggccccgacuuuaacuuccucuuccucgucccucccaccgucgaacaaaagacccgccccuucaccgcucccaacaucccccucaaauaccucuccaauagccgcauccccaaccccauugaaggaaugucccucuccccugaccaaacacaaaacguccaauuccaaaacggccggugcaccauagacggccaaccccucggcgcaacccccgucucaguaucccagcucugcaaauuccggggccgcauuacuuccggacaacgcgcacucaaccuuaccgaacucgacggcucacccuucauggcauucgccgcucccgccccagccggcuucccugaccucggcuccugcgacuggcauaucgagaugucaaaaaucccaaacuccucgacacaaaacaaccccaucguagucaauucagucaaacccaauucucaacaauucguaccucaccuccccuccaucacccuagaugaaaacgucuccuccggcggcgacuauauaggaaccauucaauggacaucaccacccucagacuccggaggggccaacacaaacuucuggaaaauccccgacuacggauccucccucgccgaagccucacaacuagccccagcagucuacccacccggcuucaacgaagucaucgucuacuucauggccuccauucccggucccaaccaaucaggaucucccaaccucguccccugccuccugccccaagaguacaucacucauuucauauccgaacaagcccccauacaaggagaagccgcccuucuccacuauguagacccagauacaaaccguaacuuaggcgaauuuaaacuuuaccccggcggcuaccucacaugcguccccaacuccucauccaccgguccccaacagcucccacucgacggcgucuucguauucgccuccugggucucccgcuucuaccaacuaaaacccgucggcaccgccggccccgcacgaggucgacuauaa

SEQ ID NO: 37850 - RNA, 1623 nt, Artificial Sequence
  derived and/or modified sequence opt11 from VP1__Norovirus_and/or_Norovirus-like__AJ313030
augaugauggcuuccaaagacgccacacccucagcagacggcgcacuaggagccggacaacucguuccagaagucaacacagcugaccccauccccaucgacccugucgccggguccucaacugcgcucgccacagcaggacaagucaaucuaaucgacccauggaucaucaauaacuucguacaagcuccccaaggagaauuuacaauaucccccaacaacacccccggagacguccucuucgacuuacaacuaggcccacaccucaacccauuccucucacaccuaucacaaauguacaacggcuggguaggcaauaugcgaguccgaguaguccucgcaggcaacgccuucaccgcaggcaaagucaucaucuguugcguuccacccggauuccaaucccgcacccuaucaaucgcccaagcaacacucuucccccacguuaucgcagacguccgcacacucgaccccgucgaagucccccuagaagacgucagaaacguccuuuaccacaacaacgacacccaacccacaaugagacuccucuguaugcucuacaccccacuacgcaccggcggcgccuccggaggcaccgacuccuucguagucgccggccgaguccuaaccugccccggccccgacuucaacuuccucuuccuagucccgcccaccguugaacagaaaacacgacccuucacaguccccaacauaccacuuaaauaccuauccaacucccgcauucccaacccaauagaaggcaugucccuaucacccgaccaaacacaaaacguccaauuccaauccggacgaugcacaauagacggacaaccauuaggcaccaccccagucucaguaucacaacuaugcaaauuccgaggcagaaucaccuccggccaaaaaguccuaaaccuaacaggccucgacggcuccccauucauggcguucgcugcccccgccccagccggauucccugaccucggcuccugcgauuggcacaucgaaauguccaaaauacccaacuccucaacccaaaacaacccaaucgucaucaacucagucaaacccaacucccaacaauucgucccccaccucagcagcauuacccuagacgaaaacguacuuuccggcggcgacuacaucggaacuauccaauggaccucaccaccaucagacuccggcggugccaacacaaacuucuggaagaucccagacuacggcuccucccucgccgaagccucccaacucgcccccgccguguacccacccggcuucaacgaagucaucgucuacuucauggcuuccauccccggaccaaaccaauccgguuccccaaaccuagucccaugccuccucccccaagaauacaucacacacuucaucucagaacaagccccaauccaaggagaagccgcccuacuccacuacguagacccagauaccaaccgcaaccuuggagaguucaaacucuaccccgguggcuaccuaaccugcguccccaacuccuccucuacugguccacaacaacuuccccucgacggcguauucgucuucgcaagcugggucucccgcuucuaccaacucaaacccgucggcacccgaggccccgcccgcggccgccucuaa

SEQ ID NO: 37851 - RNA, 1623 nt, Artificial Sequence
  derived and/or modified sequence opt11 from VP1__Norovirus_and/or_Norovirus-like__KM036381
augaugauggcauccaaagacgcuacccccuccgccgacggcgccaccggcgccggccaacuuguccccgaagugaacaccgcagacccuauccccaucgaccccgucgccggauccuccacagcacucgcaacagcaggccaagucaaucucauagacccguggaucauaaacaacuucguucaagcaccccaaggcgaauuuaccauaucccccaacaacaccccgggcgacguccuauucgaccuacaacucgguccccaccuuaacccguuccucucccaccucagccaaauguacaacggcuggguaggcaacaugagaguacgcgucguccucgccggcaacgcuuucaccgcagguaaaguaaucaucugcugcguuccacccggcuuccaaucacgcacccucuccauagcccaagccacccucuucccccacguuauagcugacguccgcacucucgaccccgucgaagucccccuugaagacguccgcaacguucucuaccacaacaacgacacccaacccaccaugcgccuccucugcaugcucuacacaccccuccgcaccggaggagcauccggcggcaccgacuccuucgucgucgcaggccgaguccucaccuguccuggccccgacuucaacuuccucuuccucgucccgcccaccgucgaacagaaaacccgaccauucaccguacccaauaucccacucaaauaccuuuccaacucccgaauccccaaccccaucgaaggcaugucacucuccccagaccaaacccaaaacguacaauuccaaaacggcagaugcacaaucgacggucaacccuuaggcaccacaccagucagcgucucccagcucugcaaauuccgcggccgaaucaccaguggacaaaaaguccuaaaccucacagaacuagacggaucccccuucauggcuuucgcagcucccgccccugccggcuucccagaccuaggcuccugcgacuggcauaucgaaauguccaaaauccccaauucaucaacagaaucaaaccccaucgucgucaacuccgucaaacccaauucucaacaguucgucccccaccuuuccucaaucacuuuagacgacaacguuuccucaggaggcgauuauaucggcaccauccaauggacaucaccucccuccgacuccggaggagccaacaccaacuucuggaaaauccccaacuacggauccucccucgcggaagccucacaacuagcccccgccguguacccuccgggauucaaugaaguaauagucuauuuuauggccuccauccccggccccaaucaauccggauccccaaacuuaguucccugccuacuaccccaagaauacauaacccacuucauauccgaacaagcccccauccaaggggaagcugcacuacuucacuauguugaccccgacacuaaccgaaaccucggagaguucaaacuauacccaggcggcuaccuaaccugcguccccaacuccuccuccaccggcccacaacagcucccccuagauggcguauucguauuugccuccugggucucucgcuucuaccaacuuaaaccagucggaaccgccggacccgcccguggacgauuauga

SEQ ID NO: 37852 - RNA, 1623 nt, Artificial Sequence
  derived and/or modified sequence opt11 from VP1__Norovirus_and/or_Norovirus-like__LN854563
augaugauggccuccaaagacgccaccccgucagccgacggagcuaccggcgccggacagcuaguacccgaagucaacaccgcagaccccauacccaucgaccccguagccgggucaucaaccgcccucgccaccgcugggcaagugaaccucaucgaccccuggaucauaaauaacuucguccaagccccacaaggcgaauuuacaaucucccccaacaacacccccggugacguccucuucgaucuacaacucggcccacaccucaacccauuccuuucccaccucucccagauguacaaugguuggguaggcaacaugcgcguccgcgucguccucgccgguaacgccuucaccgccggcaaagucaucaucugcugcgucccacccggcuuccaaucacgaacacucuccauugcccaagcgacccuauucccccacguaauagccgacguccgcacucucgaucccgucgaagucccccucgaagacguccgcaacgugcucuaccauaacaacgacacccaacccaccaugcgccuacuaugcaugcuguacaccccacugcgcaccgguggcgccuccggcggcaccgacucauucgucgucgcuggccgcguccucacaugccccggcccagacuucaauuuccuauucuuaguacccccuaccgucgaacagaaaaccagacccuucaccgucccaaacauuccccucaaauaccucucaaacucccgaauacccaacccaaucgaaggcaugucccucucucccgaccaaacacaaaauguccaauuccaaaacggcagaugcaccaucgacggccaaccccuuggcacaacccccgucucagucucccaacucugcaaauuccgcggccgaauaacaagcggacaacgaguccuaaaccuuaccgaacucgacggcuccccuuucauggccuuugcggcucccgcacccgcaggauuccccgaucuuggcuccugcgacuggcauaucgaaauguccaaaauacccaauucauccacccaaaacaacccaauaguagucaacucuguaaaacccaacucacaacaauucgucccacaccucucuucuauaacacuugacgacaucguuucauccggcggcgacuacaucggcaccauccaauggaccuccccacccuccgacucaggcggugccaacaccaacuucuggaaaauacccgacuacggcucaucguuaucugaagcuagccaacucgcaccagccgucuacccacccggauucaacgaagucaucgucuacuucauggcaucaauccccggacccaaccaauccggaucaccaaaccugguacccugccuacuaccacaagaauauaucacccacuucaucucugaacaggcaccaauacaaggcgaagcagcccuacuccacuacguagaccccgacacuaaccgaaaccuaggagaguucaaacucuacccaggaggcuaccucacaugcguaccuaacucuuccagcaccggcccccaacaacucccccucgacggcgucuucguauucgccucaugggucucacgguucuaccaacucaaacccgucggcaccgccggacccgcccgcggccgacucuaa

SEQ ID NO: 37853 - RNA, 1623 nt, Artificial Sequence
  derived and/or modified sequence opt11 from VP1__Norovirus_and/or_Norovirus-like__AB042808
augaugauggcuucuaaagacgccacccccuccgcagacggcgcaaccggcgccggacaacugguccccgaagucaacaccgccgacccuauccccaucgaccccguagccggaucauccaccgcacucgccacagccggacaaguaaaccucauagaccccuggauuaucaacaacuucguccaagcuccccaaggugaguucaccaucuccccaaacaacaccccuggagacguccucuucgaccuccaauuaggcccucaccuuaaccccuuccucucccaccucucacaaauguacaacggcuggguaggcaacaugcgcguccgcgucguacucgccggcaacgccuucaccgcaggcaaaguaaucauauguugcguaccacccggcuuccaaucccgcacccuauccaucgcucaagcuacucuauucccccacgucauagccgacgugcgaacucuagacccaguugaaguaccacuugaagacguccguaacguccucuaccacaacaacgacacccaaccaaccaugcgccuccucugcaugcucuacaccccgcuccgaacaggcggcgcaucaggagguacagauucauucgucgucgccggacgcguacuaaccugccccggacccgacuuuaacuuccucuuccuagucccuccuaccgucgaacaaaagacccgaccauucaccguacccaacauaccucuaaaauaccuuagcaacucccgcaucccuaaccccaucgaaggcaugagucucucucccgaccaaacccaaaacguccaauuccaaaacggccgaugcaccauagacgggcaaccacucggaaccaccccaguauccgucucccaacucugcaaauuccgcggacguauaacguccggccaacgaguccucaaccucacggaacuugacgguagcccauuuauggccuucgccgcacccgcacccgccgguuuccccgaccucgguucaugcgacuggcacaucgaaaugucuaaaauccccaacagcuccacccaaaacaaccccauagucacaaacucugucaaacccaauucacaacaauucgucccccaccucuccuccaucacccucgacgaaaacgucuccucagguggcgacuacauaggcaccauucaguggacguccccucccuccgacuccgguggcgccaauaccaacuucuggaaaauacccgauuacggcuccucacuugccgaagccucacaacucgcacccgccguuuaucccccaggcuucaacgaagucaucgucuacuucauggccuccauccccgguccuaaccaaucuggcuccccuaaccuaguccccugccuacucccccaagaauacauaacccacuucauauccgaacaagcccccauucaaggcgaagccgcccuccuccacuacgucgaucccgacaccaaccgaaaccucggcgaguucaaacuauacccugggggcuaccucacaugcgucccaaauuccuccucaacaggcccccaacaacucccccucgacggcguuuucguauucgccucuuggguaucccgcuuuuaccaacucaaacccguuggcacagcuggcccagcccgcggacgccuauaa

SEQ ID NO: 37854 - RNA, 1623 nt, Artificial Sequence
  derived and/or modified sequence opt11 from VP1__Norovirus_and/or_Norovirus-like__EU004679
augcggauguccgacggcgccgcucccaaggcaaacggcucugaagcauccggucaagaucuaguccccacugccauagaacaagccguucccauccaaccagucgccggcagcgcccucgcagcccccgccgccggucaaaucaaccaaaucgaccccuggaucuuccaaaacuucguacaaugcccacuaggcgaguucuccauaagcccccguaacacacccggcgaaauccuuuucgaccucgcccuaggcccaggacucaacccauaucucgcccaccuauccgcuauguacaccgguuggguaggcaacauggaaguacaacucguacucgcaggaaacgccuucaccgcaggcaaaguagucguagcccucguaccuccauacuuccccaagggcucccuuaccaccgcacaaauaaccugcuuuccacauguuaugugugacguccgcacucucgaaccaauccaacuuccccuccuagaugucagacgcguucucuggcacgcuacacaagaccaggaagaguccaugcggcucgucugcaugcucuacaccccucuucgcaccaacucccccggcgacgaaucauucguagucucaggacgacuacuuucaaaacccgccgccgacuucaacuucgucuaccucacacccccaaucgaacgcacaauauaccgaaugguagaccucccgguacuccaaccccgcuuaugcacccacgcccgcuggcccgcuccaaucuacggccuccuagucgaccccucacuacccuccaacccucaauggcaaaacggacguguccacgucgacggaacccuccucggcacaaccccagucuccgguagcugggucuccugcuucgcagccgaggccgccuacgaauuucaauccggaacuggagaagucgcuaccuucacccucaucgaacaagacggauccgccuacguacccggcgaccgcgcagccccucucggauaccccgacuucuccggccaacucgaaaucgaaguacaaaccgaaaccaccaaaaccggagacaaacuaaaaguuacaaccuucgaaaugauacucggaccaaccacaaacgucgaccaggccccauaccagggcaaaguuuaugccucccucgcagucgccgcaucccucgaccucguagacggcagaguaagggccguaccgcgcucuaucuacggcuuccaagacgucauccccgaauacaacgacggccuacucguaccucucgccccaccaaucggacccuuccuccccggagaaauccuccuccgauuccgcaccuacaugcgacaacucgacaccgcagacgccgcagcagaagcaaucgacugcgcccucccacaagaauuuauaucuugguuugccuccaacgccuucaccguacaagccgacgcacuucuacuccgcuaccgcaacacccugaccggccaacuccuauucgaauguaaacuauacuccgaaggcuacaucgcccucucauacuccggaucugccccacugaccuuccccaccgacggauucuucgaagucguaucguggguuccacgccuauuccaacuugccuccgucggcucucugaccaccggccgcacccuaaaauaa

SEQ ID NO: 37855 - RNA, 1623 nt, Artificial Sequence
  derived and/or modified sequence opt11 from VP1__Norovirus_and/or_Norovirus-like__EU004678
augcgcauguccgacggcgccgcaccaaaagccaacgggagcgaagcaucuggacaagaccucguccccaccgcugucgagcaagccguacccauucaaccaguugcuggcucagcacucgcugcccccgccgcuggacaaaucaaccaaauagacccauggaucuuccaaaauuuuguccaaugcccccucggcgaauuuuccaucagcccccgaaacacccccggagaaauccuauucgaccuagcacuaggaccaggccugaaucccuaccucgcucaccucagcgcaauguacacuggcugggugggcaacauggaaguccagcuaguacucgccggaaacgcuuucacagccggcaaagucguagucgcccucguaccacccuacuuccccaagggaucccuaaccaccgcacaaaucaccuguuucccccacgucaugugcgacguccgcacccuugaacccauccaacucccccuacuagacguaaggcgaguccucuggcacgccacacaagaccaagaagaguccaugcgccucgucugcaugcucuacacuccccuacgcaccaacucucccggagacgaauccuucgucguauccggccgucuucucaguaaaccagccgccgacuucaacuucguuuaucucacacccccaaucgaacgcaccaucuaccgcaugguagauuuacccguucuccaaccacgccugugcacccacgcucgauggcccgcccccaucuacggccuccuagucgacccaucccucccuucaaacccccaauggcaaaacggacgaguacacgucgacggaacccuccucggcacaacccccguguccggcuccuggguauccugcuucgccgcagaggccgcauacgaguuccaaucaggcaccggagaagucgccaccuucacccucaucgaacaagacggcuccgcauacguccccggagaccgcgccgcaccccuaggauauccugacuucucaggccaacuagaaauugaaguccaaacagaaaccaccaaaacaggcgacaagcucaaagucaccaccuucgaaaugauccucggcccaacaacaaacgucgaccaagcccccuaccaaggccgcguauacgccucccuaaccgccgucgccucacucgaucuaguugauggacgaguacgagccguacccagauccauuuacggauuccaagacguuauccccgaauacaacgacggccuccuaguaccacucgccccacccaucggccccuuccucccaggcgaaguccuacuccgcuuucgcaccuacaugcgccaacuagacacagccgacgccgcagccgaagcaauagacugcgcacucccacaggaguucauauccugguucgcaagcaacgccuucaccguccaaucagacgcccuccuucuccgcuaccgcaacacccucaccgggcagcuccuauuugaauguaaauuauauucagaaggauacaucgcacuaucauacuccggcucaggcccacucacauucccaaccgacggauucuucgaaguagucuccuggguaccacgacucuuccaacuagccuccgucggcucccuaaccaccggaaggacccugaaauag

SEQ ID NO: 37856 - RNA, 1623 nt, Artificial Sequence
  derived and/or modified sequence opt11 from VP1__Norovirus_and/or_Norovirus-like__AB281085
augaaaauggccucuaacgacgcagcacccuccacagacggagccgccgggcucgucccagaauccaacaaugaaguuauggcccuagagcccguagccggcgcagcccuagccgcaccagucaccggucaaaccaauaucaucgacccauggauccgcgccaauuucguacaagcccccaacggugaguucaccguuucuccccgaaacgcccccggcgaagugcuccuaaaccuagaacuaggccccgaacuaaacccauaccuagcccaccucgcccgcauguacaacggcuacgccggcggcauggaaguccaaguaaugcucgccggcaacgccuuuacagccggcaaacuugucuucgccgccguaccaccccacuuccccgucgaaaaccucucgccccaacaaauaacaauguuuccucacgucaucaucgacguccgcacccucgaaccaguccuccucccgcuccccgacgucagaaacaacuucuuucacuacaaucaaaaagacgaccccaaaaugcgcaucgucgcaaugcuauacaccccacuacgauccaacggauccggugacgacguauucaccgucuccugccguguccuaacccggcccucaccugacuucgacuucaccuaccuagucccacccacaguagaaucaaaaaccaaaccauucacccuucccauccucacacuaggagaacucucaaacucccgauucccaguaucaaucgaucaaauguacacaucccccaacgaagugaucucaguccaaugccaaaacggccgcugcacccuagacggcgaacuacaaggcacaacucagcuccaagucucuggcaucugcgccuucaaaggugaaguaaccgcccaccuccacgacaacgaccaccucuacaacguuacgaucacaaaccucaacggcucccccuucgaccccucagaagacaucccugcaccacucggaguucccgacuuccagggccgagucuucgguguaaucucacaacgcgacaaacacaucgccuccggccauaacgaaccugccaaccgcggacacgacgccgucgucccgacauacacugcacaauacaccccaaaacucggccaaauacaaauaggcaccuggcaaaccgacgaccucacugugaaccagccugucaaauucacccccguuggccucaacgacaccgaccacuucaaccaauggguugucccccgcuacgccggugcccuuaaccucaacaccaaccuagcacccuccgucgcacccguauucccuggugaacgccuccuuuucuuccguuccuacaucccacuuaaaggaggauacggaaaccccgccaucgacugccuacuuccccaagaauggguacaacacuucuaccaagaauccgccccaucuauguccgaagucgcccuuguccgcuacaucaaccccgacaccggccgcgcacucuucgaagccaaacuacaccgcgccggcuucaugaccgucucuucaaauaccuccgcaccagucgucguccccgccaacggcuauuuccgcuucgacucgugggucaaucaauucuacagccucgcuccaaugggcaccggcaacggccgucgcagauaa

SEQ ID NO: 37857 - RNA, 1623 nt, Artificial Sequence
  derived and/or modified sequence opt11 from VP1__Norovirus_and/or_Norovirus-like__AB662868
augaaaauggcauccaacgacgccgcccccuccaccgauggagccgcaggccucguacccgaaucaaacaacgagguuauggcccucgaacccguagccggagcagcccucgccgccccggucaccggccaaacuaacaucauagaccccuggauucgcgccaacuucguccaagcccccaacggagaguuuacagucucaccccgcaacuccccaggcgaaguccuccuaaaucucgaacucggccccgaacuaaaccccuaccuagcacaccucgcacguauguacaacggcuacgccggcgguauggaaguccaaguaaugcucgccggcaacgccuucaccgcugguaaacucgucuucgcagccgucccaccccauuuccccgucgaaaaccucuccccacaacaaauuaccauguucccgcacguaauaaucgacguccgcacucuugagccaguccuccuaccacuccccgacguccguaacaacuucuuccacuacaaucaaaaagacgaccccaaaaugcgaaucguugccaugcucuacacaccccuucgcuccaacggcagcggagacgacguuuucaccgucuccugccgcguacuaacucgcccaagccccgacuucgacuucaccuaccuuguuccaccaacagucgaauccaaaaccaaacccuucacacugcccauccucacucuuggcgaacucuccaacucgcgcuuccccguaucaaucgaccaaauguacacuucccccaacgaagucauaucaguccaaugccaaaacggucguugcacccuagacggcgaacuacaaggcacaacccaacuacaggucuccggcaucugcgccuucaaaggcgaagugaccgcccaccuacacgacaaugaacaccuauauaacguaacuauaaucaaccuaaacggcucccccuucgaccccuccgaagacaucccggcaccccucgguguccccgacuuccaaggcagagucuucggcguaaucucacagcgugacaaacacaacacccccggccacaacgaaccagccaaccgcgcccacgacgcgguaguuccaaccuacacagcacaauacacccccaaacuuggccaaauccaaaucggcaccuggcaaaccgaugaccucacaaacaaccaacccgucaaauucacccccgucggacucaacgacaccgaacacuucgaccaauggguaguaccacgcuacgccggcgcccucaaccuaaacaccaaccuugcuccuucaguagcccccguuuuccccggcgaacgccuccucuucuuccgcuccuacaucccucucaagggaggcuacggcacaccagcaaucgauugcuuacuaccucaagaauggguccaacacuucuaccaggaagccgcccccuccauguccgaaguagccuuaguccgcuacaucaacccagacaccggccgugcacucuucgaagccaaacuccaccgcgcaggcuucaugaccguuuccuccaacaccuccgcaccgguuguuguccccgcaaacggcuacuuccgcuucgacaguugggucaaccaauucuacagccucgcccccaugggcacuggcaauggccgccggcgauaa

SEQ ID NO: 37858 - RNA, 1623 nt, Artificial Sequence
  derived and/or modified sequence opt11 from VP1__Norovirus_and/or_Norovirus-like__AB662861
augaaaauggccuccaacgacgccguccccagcaccgacggagccgccggacuugucccagaaucaaacaacgaagucauggcccuugaacccgucgccggagccgcccucgccgcgcccguaacgggucaaacaaauauaaucgaccccuggauacgagcaaacuucguccaagcccccaacggcgaguucacugucuccccacgaaacucacccggagaaguccuccucaacuuagaacucggacccgagcucaacccauaccucgcucaccucgcaagaauguacaacggauacgcaggcggaauggaaguccaagucaugcuagcaggcaacgccuucacagcuggaaagcuaguauucgcagccguaccaccccacuuucccgucgaaaaucuaucaccccaacaaaucacgauguuuccccacgucaucaucgacgucagaacccuagaacccguccuccucccccuccccgacguccgaaacaacuuuuuccacuacaaccaaaaagacgaccccaaaaugcgcaucgucgccaugcucuacacaccccuacgcuccaacggcucaggcgacgacgucuucaccgucuccugccgcguacucacccgcccaucuccagacuucgacuucaccuaccuaguaccacccaccgucgaauccaaaaccaaacccuucacccuacccauacucacacuuggcgaacuauccaacucccgcuucccaguaucgauagaccaaauguacaccucuccaaacgaagucaucucaguccaaugccagaacggaagaugcacccucgauggcgaacuacaggguaccacccaacuccaaguaagcgggauaugcgccuucaaaggagaagucacagcccaccuucaugacaacgaacaccuauacaacgucaccaucaccaaccucaacggaucccccuucgaccccucagaagacaucccugcgccccucggcgucccugacuuccaaggccgaguguuuggcgucaucucccaacgcgacaaacacaacacccccggacacaaugaacccgccaacagagcccacgacgccgucguacccaccuacacagcccaauacacucccaaacucggucaaguccaaauuggcaccuggcaaacagacgaucuaaccgacaaccaaccaguaaaauucaccccagucggacucaacgacaccgaacacuucaaccaguggguugucccacgcuacgcaggcgcacucaaccucaacacaaaccucgcccccagcgucgccccagucuuccccggcgaacgccuacuuuucuuccgcuccuacaucccccucaaaggcggauacggcaccccagccaucgacugucuccucccccaagaauggguccagcacuucuaccaagaagccgcuccauccaugucagaagucgcccuaguccgcuacauuaaccccgacacaggccgcgcacuauucgaagccaaacuccaccgagccggauucaugacagucuccagcaacacauccgcaccagucgugguaccagcaaacggcuacuuccgcuucgacucgugggucaaccaauucuacucacucgcaccaaugggcacaggcaacggcagacgacgauaa

SEQ ID NO: 37859 - RNA, 1623 nt, Artificial Sequence
  derived and/or modified sequence opt11 from VP1__Norovirus_and/or_Norovirus-like__LC145791
augaaaauggcuuccaacgacgucgcacccucgaccgacggagcugccggacucgucccggaaucaaacaacgaggucauggcccucgaacccgucgcaggcgccgcacuagcagcccccgucaccggccaaacaaacaucauagacccauggauaagagcuaacuucguacaagcaccaaacggcgaguucacaguaucccccagaaacucacccggagaaguacuccucaacuuagaacucggccccgaacucaacccauaccucgcccacuuagcccgcauguacaacggcuacgcaggaggaauggaaguccagguaaugcuagccgguaacgccuuuaccgcagguaaacucgucuucgccgcagugccaccccacuuccccguggaaaaccucucaccccagcaaauuaccauguucccccacgucaucaucgacguccgcacacuugaacccguacuccucccccuacccgacguacgaaacaacuucuuccacuacaaucaaaaagacgacccuaaaaugcgcauugucgcaaugcuauauaccccucuccguuccaauggcuccggcgacgacgucuucacagucuccugccguguacuuacuaggcccucccccgacuuugacuuuacuuaccuugucccacccaccguagaaucaaagaccaaacccuucacucuccccauccucacccucggcgaacucucaaacucccgguuccccgucuccauagaccaaauguacaccuccccaaacgaaguaaucucaguccaaugccaaaacggccgcugcacacucgacggagaacuccaaggcaccacccaacuacaaguaucaggcaucugcgccuucaaaggcgaaguaaccgcccaucuccacgacaacgaccaccucuacaacguuacaauaaccaaccucaauggaucaccuuucgaccccuccgaagacauacccgcccccuuaggaguucccgacuuccaaggccgagucuucggcguuaucagccaacgagacaaacacaacacaccaggccacaacgagcccgccaaccgcgcacaugacgcagucguacccacauauacugcccaauacacgccgaaacuaggccagauccaaaucggcaccuggcaaaccgacgaccugaccgucaaucaacccguuaaauucacccccgucgggcucaacgacaccgaccacuucaaccaaugggucguaccccgcuaugccggcgcacuaaaccucaacaccaaccucgccccaucagucgcuccagucuuucccggcgaacgccuacuauucuucagaagcuacauaccccuuaaaggcggcuacggaaccccagcaaucgacugccuccucccccaagaauggguccagcacuucuaccaagaagccgccccauccauguccgaaguugcccuaguccgcuacaucaacccugacaccggcagagcacucuucgaagccaaacuucaccgcgccggauuuaugaccgucuccagcaacacaucagcaccaguagucguacccgcaaacggcuacuuccgcuucgacucaugggucaaccaauucuacucccuagcacccaugggaaccggcaacggacgacgacguuaa

SEQ ID NO: 37860 - RNA, 1623 nt, Artificial Sequence
  derived and/or modified sequence opt11 from VP1__Norovirus_and/or_Norovirus-like__LC145790
augaaaauggccucaaacgacgccgcaccuucgacagacggcgccgcaggucucguccccgaguccaauaacgaagucauggcccuagaacccgucgccggggccgcacucgcagcacccgucacuggucaaaccaacaucauagaccccuggaucagagccaauuucguucaagcacccaacggcgaguucacuguaagcccacgaaacucacccggagaaguccuccuaaaccuagaacucgguccagaacuaaacccuuaucucgcacaccucgcacgaauguacaacggcuaugcaggaggcauggaaguacaagucaugcucgccgggaacgcuuucaccgccggcaaacucgucuucgcagccguacccccucacuucccagucgaaaaccuguccccacaacagauuacgauguucccacacgucauaaucgacguccgcacacuagagcccguacuccucccccuccccgauguccgcaacaacuuuuuccacuacaaccaaaaagacgaccccaagaugagaaucgucgccaugcucuacaccccacuccgaagcaacggauccggcgacgaugucuucacagucucaugccgcguacuaacucgccccuccccagauuucgacuucaccuaccucgucccacccacuguagagagcaaaaccaaaccauucacccuccccauccucacacuaggagaacucucaaacucgagauuccccgucucaaucgaccaaauguacaccucucccaaugaaguaauauccguccaaugccaaaacggacgaugcacccucgacggugaacuccaaggcaccacccaacuccaagucuccggcaucugcgcuuucaaaggcgaaguaacagcccaccuccacgacaacgaccaccuauacaacgucaccaucaccaaucucaacggaagccccuucgacccuuccgaagacauccccgcaccccuaggcguaccagacuuccaaggacggguauucggugucaucucccaacgcgacaaacacaacacccccggacauaacgaaccugccaacagagcccacgacgccgucguucccaccuacacggcccaauacacccccaaacucggccaaauacaaaucggcacguggcaaacagacgaccuaacagucaaccaacccgucaaauucacccccgucggccucaacgacacagaccacuucaaccaaugggucguaccccgcuacgcaggcgcccuaaacuuaaacacaaaccuugcucccucagucgcucccguauuccccggcgaacgccuacucuucuuccgcuccuacauuccccucaaaggcggguacggcacucccgccauagacugccuccucccccaagaauggguccaacacuucuaccaagaagccgccccaucaaugagcgaaguagcacucguccgcuauaucaacccugacaccggccgcgcccucuucgaagccaaacugcaccgcgccggcuucaugacagucuccuccaacaccuccgcccccgucgucgucccagcaaacggcuacuuccgcuucgacucaugggucaaccaauucuacucccucgccccaaugggcacgggcaacggccgucgccgcuaa

SEQ ID NO: 37861 - RNA, 1623 nt, Artificial Sequence
  derived and/or modified sequence opt11 from VP1__Norovirus_and/or_Norovirus-like__LC145793
augaaaauggccucaaaugacgccgccccaucaaccgacggugcagccggccucguccccgaaucuaacaacgaaguaauggcccucgaacccguagcaggagucgcccuagccgccccuguaacaggccaaaccaacaucaucgauccauggauccgcgccaacuucguccaggcccccaacggcgaguucaccgucucaccacgcaacucccccggcgaaguccuccuaaaucuagaacuaggccccgaacucaaccccuaccuagcucaccuagcucgcauguacaacggauacgcggguggcauggaaguacaagucaugcucgccggcaacgccuuuacagccggcaagcuagucuucgccgccguaccaccccacuuccccgucgaaaaccuauccccucaacaaaucaccauguucccccacgucaucaucgacgucagaacacucgaaccaguccuacuaccacuccccgacgucagaaacaacuucuuccacuacaaccaaaaagacgaccccaaaaugcgaauaguagccaugcuauacaccccucucagauccaacggcucgggcgacgacguauuuacagucuccugccgcguccucacccgcccaucgcccgacuucgacuuuaccuaccucgucccacccacggucgaaucaaaaacuaaacccuucacccuccccauacucacccucggcgaauuauccaacucccgauuccccgucucaaucgaccaaauguacaccucccccaacgaagucaucuccguccaaugccaaaacggccgcugcacccucgacggagaacuccaaggaaccacacaacuccaagucucuggcauaugugcauucgaaggcgaaguaaccgcccaccuacaugacaaugaccaccuuuacaacgucaccauaaccaaccuuaacggcucccccuucgaccccucagaagacauccccgcaccccucgguguacccgauuuccaaggaagggucuucggagucaucucacaacgagacaaacauaacacacccggacauaacgaaccggccaaucgugcacacgaugccgucguucccaccuacaccgcccaauacacucccaaacucggccaaauccagauaggaacauggcaaaccgacgaccucaccguaaaccaacccgucaaauucacacccgucggccucaacgacacagaccacuuuaaccaauggguugucccacgcuacgcuggagccuuaaaccucaacaccaaccuugccccuucugucgcccccguauuccccggagaaagacuacucuucuuccgaaguuacaucccccuaaaagguggcuacggaacacccgcaaucgacugccuucuuccccaagaauggguacagcacuucuaucaagaagccgccccaucaaugucugaaguugcacucguacgcuacauaaaccccgacaccggccgcgccuuauucgaagccaaacuacaucgcgccggcuucaugacagucuccagcaacaccuccgccccagucgucguuccagccaacggcuacuuccgcuucgacuccugggucaaccaauucuacucccucgccccuaugggaacagguaacggccgccgccgcuaa

SEQ ID NO: 37862 - RNA, 1623 nt, Artificial Sequence
  derived and/or modified sequence opt11 from VP1__Norovirus_and/or_Norovirus-like__LC145792
augaaaauggcauccaaugacgcagcccccuccaccgacggcgccgccggacucguacccgaaagcaacaacgaagucauggcccucgaaccagucgcgggcgccgcacuugccgcacccgucaccgggcaaaccaacauaauugaccccuggauacgagcuaacuuugugcaagcaccuaacggcgaguucaccgucuccccaagaaacucacccggcgaaguccuccucaaccucgaacuuggccccgaacuaaacccauaccucgcccaccucgcacguauguacaacggcuacgccggaggaauggaaguacaaguaaugcuagccggcaacgccuucaccgccggaaagcuagucuucgccgccguaccaccccacuuccccgucgaaaaccuaucuccacaacaaaucacuauguucccccacgucaucaucgacguucgcacccuggaacccgucuuacucccucuccccgacguccgcaacaacuucuuccauuacaaccaaaaagacgacccaaaaaugcgaaucgucgcuaugcucuauacuccccuccgcuccaacggcuccggcgacgaugucuucaccguaagcugcagaguccucacccgaccaucacccgacuucgacuucaccuaccucgucccacccaccgucgaauccaaaaccaaacccuucacccuccccauccucacucucggagaacuaucuaacucuagauuuccuguauccaucgaccaaauguacacaucacccaacgaagucaucucaguccaaugccaaaacggccgaugcacccucgacggagaacuacaaggcacaacacagcuucaagucagcgguaucugcgccuucaaaggagaaguaacagcccaccuacacgacaacgaccaccucuacaacgucacaaucaccaaccucaacggcuccccuuucgaccccuccgaggacaucccagcaccccuaggcguccccgacuuccaaggcagggucuucggugucaucucucaacgcgacaaacacaauaccccaggccacaaugaacccgccaaccgagcccacgaugccgucguacccaccuacaccgcccaauacacccccaagcucggccaaauccaaauaggcacauggcaaaccgacgaccucaccgucaaccaaccagucaaauucacacccguuggccuaaaugacaccgaucacuucaaccaauggguacuaccccgcuacgccggagcccucaaccuaaauaccaaccuagcucccuccguagcccccguauucccaggcgaacgacuccucuucuuccgaagcuauauaccccucaaagggggauacggaacccccgcaaucgacugccuucuaccccaagaauggguccaacacuucuaccaagaggccgccccauccauguccgaagucgcacucguccgcuacaucaaccccgacacagggcgugcccucuucgaggcaaaacuccacagagcaggcuucaugaccgucuccucaaacaccucagcccccgucgucguacccgcaaacggcuacuuccgauucgacuccugggucaaccaauucuacagccucgccccgaugggcaccgggaacggccgacgucgauaa

SEQ ID NO: 37863 - RNA, 1623 nt, Artificial Sequence
  derived and/or modified sequence opt11 from VP1__Norovirus_and/or_Norovirus-like__LC145797
augaaaauggccuccaacgacgccgccccaucaacagauggcgccgccggccuaguacccgaauccaacaacgaaguaauggcccucgaacccguagcgggcgucgccuuagcugcacccgucacaggccaaaccaacauaaucgacccuuggauucgagccaacuucguccccgcacccaauggcgaguucacugucucaccccgcaacagccccggugaaguccugcuuaaccucgaacuuggacccgaacuaaaccccuaccucgcacaucucgcacgcauguauaacggauacgccggaggcauggaaguucagguaaugcuagccgggaacgcauucaccgcaggcaagcuaguuuucgcugcaguuccuccccacuuucccguugaaaaccucucaccccaacagaucaccauguucccccacgucaucaucgacguccgcacacucgaaccaguacuucucccccucccugacguacgcaacaacuucuuccacuacaaccaaaaagacgacccaaaaaugcgcaucgucgccaugcucuauacaccccuccgguccaauggcuccggcgacgacgucuucaccguaucuugccgcguccucaccagaccuuccccagacuucgacuucaccuaccucgucccacccacugucgaauccaaaacaaagcuauucacccucccaauccucacccucggcgagcuauccaauucccguuucccaguuagcaucgaucaaauguacaccucacccaacgaggucauaaguguccaaugccaaaauggccgcugcacucucgacggcgaacugcaaggcaccacccaacuccaagucucugguaucugcgccuucaaaggcgaagucaccgcccaccuccaugacaacgaccaccuauacaacguaacuaucacaaaccuaaacggcucacccuucgacccuuccgaagacauaccagccccacuaggagucccagacuuccaaggacgcguuuucggaguaauaucacaacgcgacaagcacaacaucucaggccacaacgaaccagccaaccgcgcccacgacgccguagucccaaccuacaccgcccaauacacucccaaacuaggucaaauccaaaucggcaccuggcaaacagaugaccuuaccguaaaccaacccgucaaauucacaccagucggacucaacgacacagaccacuucaaucaauggguaguacccagauacgcaggagcccuaaaccucaacaccaaccuagcccccuccgucgcccccguauuccccggcgaacgucuccucuucuuccgauccuacaucccccucaaaggcggcuacggcaccccagcaauagacugccuacuuccacaggaauggguacaacacuucuaccaagaagccgcaccuucuaugucagagguagcccuaguacgguacauuaaccccgacaccggccgugcccucuucgaagccaaacuucaccgcgcuggcuucaugaccguauccucuaacaccucagcccccguagucguccccgccaacgguuacuuccgcuucgacuccugggucaaucaauucuauucccuagcccccaugggcaccgggaacggccgcagacgcuaa

SEQ ID NO: 37864 - RNA, 1623 nt, Artificial Sequence
  derived and/or modified sequence opt11 from VP1__Norovirus_and/or_Norovirus-like__LC145808
augaaaauggccuccaacgacgccgccccaucaacagacggcgccgcaggccuaguaccagaaagcaacaacgaaguaauggcccucgaaccugucgccggagccgcccuagccgccccagucacaggccaaaccaacaucaucgaccccuggauccgcgcaaauuucguacaagcccccaauggcgaauuuaccgucagccccagaaacucccccggcgaaguacuccuaaaucucgaacuaggaccagaacuaaacccauaccuugcacaccuagcacgcauguacaacggcuacgccggcggcauggagguacaaguaaugcucgccggcaacgccuuuacugccggcaaauuagucuucgccgcagucccuccccauuuucccgucgaaaaccuaagcccccaacaaaucaccauguucccccacguaaucaucgacguccgcacccucgagcccguccuacuuccccucccugacguacguaacaauuucuuccacuacaaccaaaaagaugaucccaaaaugcgaaucgucgccaugcuauacacuccccuccgcuccaacgguuccggcgacgacgucuucaccgucuccugccgcguccucacccgcccaucccccgacuucgacuuuaccuaucucgucccacccaccguugaauccaaaacuaaacccuucaccuuacccauacucacccuaggcgaacucuccaacucccgcuuccccgucuccaucgaccaaauguacacaucucccaaugaggucaucuccguccaaugccaaaacggccgcuguacccucgacggugaacuccaaggcaccacccaacuccaaguaagcggcauaugcgccuucaaaggcgaagucaccgcacaccuacacgacaacgaccaccucuacaauguaaccauaaccaaccuuaacgguagcccauucgaccccagcgaagacauacccgcaccccucggcguacccgacuuucaaggccgugucuucggcguaauaucccaacgcgacaagcauaacgcccccggccacaacgaacccgccaaccgagcccacgacgccgucgugccaaccuacacugcccaauacaccccaaaacuaggacaaauacaaaucggaacauggcaaaccgacgaccucacagucaaccaacccgucaaauucacgccagucggccucaacgacaccgaccacuucaaccaauggguagucccccgauacgcaggcgcccucaaccucaacaccaaccucgccccgucagucgccccggucuuccccggagaacgacuccuguucuuccgaucauacauaccccuaaaaggcgguuacggcaccccagccauagacugccuucucccccaagaauggguacagcacuucuaccaagaagccgcccccuccaugucugaagucgcccuaguacgguacaucaaucccgacaccggccgcgcacuauucgaagccaaacuucaccgcgcaggauucaugaccgucucaucaaacaccucagccccagucguaguccccgcaaacggauacuuccgcuucgacuccuggguaaaccaauucuacucccucgcaccaaugggcaccggaaacggccgacgucgcuaa

SEQ ID NO: 37865 - RNA, 1623 nt, Artificial Sequence
  derived and/or modified sequence opt11 from VP1__Norovirus_and/or_Norovirus-like__LC145801
augaaaauggcauccaacgacgcugcacccagcacugacggcgcagcuggccucguaccagaauccacgaacgaagucauggcccucgaacccguugcuggcgccgcccuagccgcccccgucaccggacaaacuaacaucaucgaucccuggauccgcgcaaacuucguccaagccccaaacggcgaguucaccgucucaccccgcaacucccccggcgaaguauuacuaaaccucgaacucggccccgaacucaacccauaccuagcacaccuagcccguauguacaacggcuaugcaggcggcauggaaguccaagucaugcuugccggcaacgccuucaccgcuggcaagcucgucuucgccgcaguaccaccccacuucccugucgaaaaucucucaccccaacaaaucaccauguucccccacgucaucaucgacguucgcacccucgaacccguucuacuaccacuuccagacguccgcaacaacuucuuccacuacaaccaaaaagacgaccccaaaaugcgcaucgucgccaugcuauacacuccccuacgcuccaacggauccggagacgacgucuucaccguuuccugccgaguccugacccgaccuucacccgacuucgacuucacauaucuaguuccacccaccgucgaaucaaaaacaaaaccuuucacacuccccauccuaacccuaggcgaacucucaaacucucgauuccccguauccauagaccaaauguauaccuccccuaacgaaguuaucagcguacaaugccaaaacggacgcugcacccuugacggcgaacuacaaggcaccacccaacuccaggucuccggaaucugcgccuucaaaggcgaagucaccgcccaccuacacgacaaugaccacuuauacaacguaaccauaaccaaccuaaacggcucccccuucgacccaucagaagacauccccgcaccccucggcgcacccgacuuccaaggccgcgucuucggcguaaucucccaaagagauaaacacaacacccccggacacaacgaacccgccaacagagcccacgacgccgucguccccaccuauacugcccaauacaccccaaaacuaggccaaauccaaaucgggacauggcaaaccgacgaccucaccgucaaccaaccugucaaguucaccccagucggccucaacgacaccgaccacuucaaccaaugggucguaccccgcuacgcaggcgcccucaaccucaacaccaaccucgcaccaucagucgccccaguauuccccggggaacgccuacucuucuuccgcuccuacaucccccuaaaaggcggcuacggaacgcccgccaucgacugccuucuaccccaagaguggguccaacacuucuaccaagaagcugccccaucaaugucagaaguagcccuagucagauacauaaaccccgacaccggacgcgcacuauucgaagcaaaacuacaccgagccggauucaugacaguauccagcaacaccagugcacccgucgucguaccagcgaacggguacuuccgcuucgacucaugggucaaccaauucuacucccuagccccaaugggcacgggaaacggccgccgccgauga

SEQ ID NO: 37866 - RNA, 1623 nt, Artificial Sequence
  derived and/or modified sequence opt11 from VP1__Norovirus_and/or_Norovirus-like__AB662884
augaaaauggccuccaacgacgccgccccauccacagacggcgccgcgggacucguaccagagucgaacaacgaaguaauggcacucgaacccgucgcuggcgccgcacuagccgcccccguaacaggccaaaccaacaucaucgaccccuggauccgcgccaacuucguccaggcacccaacggcgaguucaccgucucaccccgcaacucccccggugaaguccuacucaaccucgaacuaggccccgaacuaaacccguaccuagcccaccucgcccggauguacaacgguuaugcuggcggaauggaaguccaaguaaugcucgccggcaacgccuucaccgccggcaaacucgucuucgcagccgucccaccccacuuccccgucgaaaaucucucuccccaacaaauuaccauguuuccccacguaauuauagacguucgcacacuugagccuguccuacucccccuaccagacguacgcaacaacuucuuccacuacaaccaaaaagacgacccaaaaaugcgaaucgucgccaugcucuacaccccacuccgcuccaacggauccggagacgacgucuucacggucucaugccgaguccucaccagaccaucccccgauuuugacuucaccuaccucgucccaccuaccgucgaauccaaaaccaaacccuucacccuaccaauccucacucucggcgaacuauccaacucacgcuuccccguauccaucgaccagauguacaccucacccaacgaagucauauccguccagugucaaaacggccgcugcacccucgacggugaacuccaaggcaccacccaacuccaaguaagcggcaucugcgcuuucaagggcgaagucaccgcucaccuacacgacaacgaccaucucuacaacgucacaauaaccaaucuuaacggcucacccuucgaccccucagaagacauccccgcuccccuaggcguucccgacuuccaaggccgcgucuucggcgucaucucacaacgugacaaacauaacacccccggccacaacgaacccgccaaccgcgcccacgacgcaguaguacccaccuacaccgcacaguacaccccaaaacucggccaaauccaaaucggaaccuggcaaaccgacgaucucaccgucaaccagccaguuaacuucacacccguaggacuaucggauacugaccacuucaaccaaugggucguccccagauacgcaggcgcccuuaaccucaacaccaaccucgcaccauccgucgcccccguuuucccuggagaaagacuccuauucuuccgaucauacauaccccuaaaaggaggcuacggaacgccagccauagacugccuccucccgcaagaauggguccaacacuucuaccaagaagccgcccccuccaugucagaaguagcccucguucgcuacauaaaccccgacaccgggcgcgcccucuucgaagccaaacuacaccgcgccggauucaugaccgucuccuccaacaccuccgccccaguagucgucccagccaacggauacuuucgauucgacucaugggucaaccaauucuacucacuagcccccaugggcaccgguaacggacgacgccgcuaa

SEQ ID NO: 37867 - RNA, 1623 nt, Artificial Sequence
  derived and/or modified sequence opt11 from VP1__Norovirus_and/or_Norovirus-like__LC145802
augaaaauggcuuccaacgacgccgcaccuagcacagacggcgcagccggccuaguccccgaaagcaacaacgaaguaauggcccuagaacccguagcaggagccgcccuagccgcccccgucaccgggcaaaccaacaucauugaccccuggauccgcgcuaacuuuguccaagcccccaacggagaauuuacagucuccccacgcaacagccccggcgaaguacuccuaaaccuagaacuaggccccgaacuaaaccccuaccucgcacaccuagcaagaauguacaauggccacgccggcgguauggaaguccaaguaaugcuagccggaaacgccuucaccgccggcaagcucguuuucgccgcagucccaccccacuuccccgucgaaaaccucucaccacaacaaaucacuauguucccucacgucauaaucgacguucgcacacuagaacccguccuccucccacuaccagacguccgcaacaacuucuuccacuacaaccaaaaagacgauccaaaaaugcgaauaguagccaugcucuacacaccccuccgauccaacggaucaggcgacgacguauucaccgucuccugcagaguccucacucgcccaagcccggacuucgaauuuacauaccucgucccacccacuguugaaucaaaaacuaaaccauuuacacuuccuauacuaacccuaggagaacuauccaacagccgcuuccccgucuccaucgaccaaauguacaccucgcccaacgaagucaucuccguccaaugccagaacgguagauguacauuagacggagaacuccaaggcacaacacaauuacaagcaucaggaaucugcgcauucaaaggcgaaguuaccgcucaccuccacgacaacgaccaccucuacaacgucacuaucacaaaccuaaacggcagcccauucgacccauccgaagacauacccgcuccccucggcguccccgacuuucaaggccgcguauucggcgugauaagccaacgcgacaaacacaacgcccccggccacaacgaacccgccaaccgcgcccacgacgccgucguccccaccuacacagcccaauacacaccaaaacucggccagauacagaucggaaccuggcaaacagacgaccucaccgucaaccaaccugucaaauucacccccgucggacucaacgacaccgaucacuucgaccaaugggucgucccccgauacgccggcgcccucaaccuuaacacaaaccucgccccuucaguugcucccguauuccccggagaacgucuccuauucuuucgcuccuacaucccccuaaaaggcggcuacggcaccccagccauagacugccuacucccccaagaauggguccaacauuucuaucaagaagccgcccccuccauguccgaagucgcccuaguccgcuacaucaaccccgauaccggccgagcccucuucgaagcaaaacuacaccgcgccggcuucaugacaguuuccuccaacaccucugcccccgucgucguaccagccaacggcuauuuccguuucgacucauggguaaaccaauucuacucccuugcccccaugggcaccggaaacggacgacgccgcuaa

SEQ ID NO: 37868 - RNA, 1623 nt, Artificial Sequence
  derived and/or modified sequence opt11 from VP1__Norovirus_and/or_Norovirus-like__AB662897
augaaaauggcauccaacgacgcugcucccagcaccgauggcgccgccggccuaguacccgaauccaacaacgaaguaauggcccuagaacccgucgcgggcgcagcccuugccgcccccguaacgggccaaacuaacaucaucgacccauggauacgagcgaacuucguccaagcaccaaauggcgaauuuaccgucagcccccgcaacucgcccggagaaguacuccucaaccucgaacuaggccccgaacucaacccauaccucgcccaccuagcccgaauguacaacggauacgccgguggcauggaaguacaagucaugcuggccgguaaugcauuuacagccggcaaacucguauucgcugcaguaccaccccacuuccccgucgaaaaccucucuccucaacagaucaccauguucccccacgucaucauagauguccgcacccucgaacccguccuacucccccuccccgacguacgcaacaacuucuuccacuacaaccaaaaagaugauccaaaaaugcgcaucgucgccaugcucuacaccccgcuccgaaguaacggaucgggcgacgacguauuuaccguuuccugccgcguccugacacgacccuccccagacuucgacuucaccuaccucgucccaccaaccguagaauccaaaacaaaaccauuuacacuucccauccucacccucggagaacucuccaacucccgcuucccaguauccauagaccaaauguauaccuccccaaaugagguuaucagcguacaaugccaaaacgguaggugcacccucgacggcgaacuccaaggcacuacacaacuacaagucaguggaaucugcgccuucaaaggugaagucaccgcacaccuccacgauaacgaccaccucuacaacguaaccaucaccaaccucaacgguucacccuucgaccccucggaagacauccccgcaccccucggcguccccgacuuccaaggcagaguauucgguguuaucucacaacgagacaaacacaauacccccggccauaacgaacccgccaaccgcgcccacgacgcuguaguccccacuuacaccgcacaauacacccccaaacucggccaaauccaaaucggcaccuggcaaaccgacgaccucaccgucaaccagcccgucaaauucacccccgucggacucaacgacacagaccacuucaaccaaugggucguaccccgauacgcaggcgccuuaaaccucaacacuaaccuagccccaucaguagcaccagucuucccaggcgaacgucuccucuucuuucgcucuuacaucccacuaaaaggcggcuacggcaccucagccaucgacugccuccuaccccaagaauggguccaacacuucuaccaggaagccgccccaucuaugagcgaaguagcgcuaguccgcuacaucaaucccgauacaggccgagcccuuuucgaagccaaacuccaccgugccggcuucaugaccgucucaucaaacaccucagcccccguugucguccccgccaauggcuacuuccguuuugacuccugggucaaccaauucuacucccuagcacccaugggcaccggaaacggacgacgccgcuaa

SEQ ID NO: 37869 - RNA, 1623 nt, Artificial Sequence
  derived and/or modified sequence opt11 from VP1__Norovirus_and/or_Norovirus-like__AB662899
augaaaauggcguccaacgacgcagcaccauccaccgacggagccgcuggccuaguccccgaauccaauaaugaagucauggcacucgaacccgucgcuggugcagcccucgcagccccagucacgggacagaccaauaucaucgacccuuggauccgcgccaacuucguccaagcccccaacggggaguucacugucucaccccgaaacuccccaggugaaguccuacucaaccuagaacuuggaccggaacuaaaccccuaccucgcccaccucgcccguauguauaacggauacgcaggaggcauggaaguacaagucaugcucgcaggcaacgccuucaccgccggcaaacucgucuucgccgccgucccaccccacuuccccgucgaaaaucuaucaccccaacaaauaacaauguucccccacguaauaauagacguacgcacacuagaacccguccuucuaccccucccagacguacguaacaacuucuuucauuacaaccaaaaagacgaccccaaaaugcgcaucguagcaaugcucuacacaccccucagauccaacggcucuggcgacgacgucuucacagucuccugccgcguccucacacgccccucucccgacuucgacuucaccuaccucguaccaccaaccguagaaucaaaaacaaaacccuuuacccuaccuauccuaacacucggagaacucagcaacucccgauuccccgucuccauugaccaaauguacaccucuccaaacgaagugaucucuguccaaugccaaaacgggcgcugcacccuagauggcgaacuccaaggcacaacccaacuacaagucuccgguaucugcgcauucaaaggcgaaguaaccgcccaccuccacgacaaugaccaccucuacaacgucaccaucaccaaccuaaauggcuccccauuugaccccuccgaagacauacccgcaccccucggaguccccgacuuccaaggccgcgucuucggcgucauaagccaacgcgacaagcacaacacccccggacacaaugaacccgccaaccgcgcccacgacgccgucgucccuaccuacacagcccaauacacacccaaacuaggccaaauacaaaucggaaccuggcaaaccgacgaccucacuguuaaccaacccgucaacuucacacccguaggccuaaacgacacugaccacuucaaccaauggguaguuccccgcuacgccggagcccucaaccuaaacaccaaccuagcccccuccguagccccaguuuuccccggcgaaagacuacucuucuuccgauccuacaucccccucaagggcggcuauggcacccccgcaaucgacugccuacuaccccaagaauggguccaacacuucuaccaagaagccgcccccucaaugucagaagucgcacucguccgauacaucaaccccgacaccgguagagcacucuucgaagccaaacuccaccgcgccggguucaugaccgucagcuccaacaccucagcacccguuguagucccagccaacggcuacuucagauuugacuccugggucaaccaauuuuacucacuagcaccaaugggcaccgguaacggccgccgccgauaa

SEQ ID NO: 37870 - RNA, 1623 nt, Artificial Sequence
  derived and/or modified sequence opt11 from VP1__Norovirus_and/or_Norovirus-like__AB662894
augaaaauggccuccaacgacgccgcacccagcaccgacggagcagcaggccucguccccgaaucuaacaacgaagucauggcacucgaacccgucgcuggagccgcccuagccgcccccgugacuggacaaacaaacaucaucgacccuuggauccgcgcaaacuucguacaagcccccaacggcgaguucaccguaagcccccgcaacucgccaggcgaaguccuacucaaccucgaacuaggacccgaacucaaccccuacuuagcccaucucgcccgaauguacaacggcuacgcaggcggaauggaaguccaaguaaugcuagcuggcaacgccuucacagccgguaagcuagucuucgccgccgucccaccccacuuccccguagaaaaccuauccccacaacaaaucaccauguucccucacgucaucauagacguacgcacauuagaacccguacuacuaccccuacccgacguccgcaacaacuucuuucacuacaaccagaaagacgaccccaaaaugcgaauugucgccaugcuauacacaccccuacgcuccaacggcuccggagacgacgucuuuaccgucucaugccgcguccuaacacgucccagccccgacuucgacuucaccuaccuaguaccacccacagucgaauccaaaaccaaacccuucacacuccccauccucacccuaggagaacuaucgaacucacguuuuccaguuuccauagaccaaauguauaccucacccaacgaagucaucucuguccaaugccaaaacggccgaugcacauuagacggagaacuccagggcacaacccaacuacaagucucaggaaucugcgccuucaaaggagaagucaccgcccaccuccacgacaacgaccaccucuacaacguaacaauaaccaaucucaacgguagccccuucgaccccucugaagacauccccgccccucuuggcgucccagacuuccaaggccgaguuuuuggagucauaucccaacgagauaaacauaauacccccggccacaacgaacccgccaacagagcccacgacgccgucgucccaacauacaccgcacaauacacccccaaacucggacaaauacaaaucggaaccuggcaaaccgacgaccuuaccgucaaccaaccagccaauuucacacccgucggccucucagacaccgaccacuuuaaccaaugggucgucccccgcuacgcaggcgcccugaaccucaacaccaaccuugcccccuccguagcccccguuuuccccggagaaagacuccucuucuuccgcuccuacauccccuuaaaagguggcuacggcacccccgccauagacugccuccuaccccaagaauggguccaacacuucuaccaagaagccgcccccuccauguccgaagucgcccugguccgcuacaucaaucccgacaccggccgcgcccucuucgaagccaaacuccaccgcgccggcuucaugacagucucauccaauaccucagcccccgucgucgugcccgcaaacggauacuuucgguuugacuccuggguaaaccaguucuacucucuagcccccaugggcaccggcaauggcagacgccgcuaa

SEQ ID NO: 37871 - RNA, 1623 nt, Artificial Sequence
  derived and/or modified sequence opt11 from VP1__Norovirus_and/or_Norovirus-like__LC145803
augaaaauggccagcaacgacgcagcccccuccaccgacggugccgccggccuuguaccggaauccaacaacgaagucauggcccuagaacccguugccggcgcagcacuagcggcccccgucaccggacagacgaacauuaucgacccuuggauacgagcuaacuuuguacaagcccccaacggcgaguucaccguaucucccagaaauucccccggagaaguccuacuuaaccucgaacuuggccccgaacucaaccccuaccucgcccaccucgcacgaauguacaacggcuacgccggcggcauggaaguccaaguaaugcuagccggcaacgccuucacagccggaaaacucgucuucgccgccgucccaccccacuuccccgucgaaaaccucuccccucaacaaaucaccauguucccacacgucaucaucgacguccgcacacucgaacccguccuacucccacuccccgacgucagaaacaacuucuuccacuacaaccagaaagacgaccccaaaaugcgaaucgucgcaaugcuauacacaccccuccgauccaacggaagcggcgacgacgucuucaccgucucaugccgaguccucacccgcccauccccagacuucgacuucacauaccucgucccacccaccguagaaucaaaaacaaaacccuucacucuccccauccugacccucggcgaacucuccaauucucguuuccccguauccaucgaccaaauguacaccucccccaacgaagucaucuccguacaaugccaaaacggacgcugcacacuagacggugaacuccaaggaacaacccaacuccaggucuccggcaucugcgccuucaaaggcgaagucacagcccaccuccacgacaacgaccaccucuacaacgucaccauaaccaaccuaaacggauccuccuucgaccccucagaagacaucccagccccucuaggcauccccgacuuccaaggucgagucuucggcgucauuucccaacgcgacaaacacaacacccccggucauaacgaacccgccaaccgcgcccacgacgccguaguccccacuuacacagcucaauacaccccuaaacucggacaaauucaaaucggcacauggcaaacugacgaccuaacaguaaaucaaccaguaaaauucacccccguaggccucaaugacaccgaccacuucaaccaauggguagucccuagauacgcaggagcacuaaaccuuaacaccaaccuagcccccucugucgccccaguauuucccggcgaacgccuauuguucuuccgcucauacaucccacucaaaggaggcuauggcacccccgccauagacugccuccuaccccaagaauggguccaacacuucuaccaagaagcagcucccucuaugucggaaguagcccuaguccgauacaucaaccccgacaccggacgggcccucuuugaagccaaacuacaccgcgccggcuuuaugacgguauccucuaacaccucagcccccguaguagucccagccaacggauacuuccguuucgacuccugggucaaccaauucuacagccucgcccccaugggaacaggcaauggccgccgccgauaa

SEQ ID NO: 37872 - RNA, 1623 nt, Artificial Sequence
  derived and/or modified sequence opt11 from VP1__Norovirus_and/or_Norovirus-like__AB662889
augaaaauggccucaaacgacgcagcccccuccacagacggggccgccggccuaguucccgaauccaauaacgaaguuauggcccucgaacccgucgcaggagccgcccuagccgcaccagucacuggacaaacuaacaucaucgaccccuggauacgggccaacuucguccaagcaccaaacggcgaguucacagucagcccacgcaacucaccuggcgaaguccuccugaaccucgaacucggcccagaacucaacccauaccucgcccaccuagcacgcauguacaacggcuacgccggcggcauggaaguccaaguuaugcuggccggcaacgccuucacagccggcaaacucgucuucgcagcaguaccgccccacuuccccgucgaaaaccucucaccccaacagauaaccauguucccccacgucaucauagacguacgcacacuugaacccguccuccucccccuccccgacguccgcaacaauuucuuccacuauaaccaaaaagacgaccccaaaaugagaauagucgcaaugcuauacacaccccuccgcuccaauggcuccggugacgacgucuucaccguaucuugccgcguccucacccgccccucacccgacuucgacuucaccuaccuuguaccacccaccguagaauccaaaaccaaaucauucacccuccccauccuaacccuaggagaacucucaaacucacgcuucccugucucaauagaucaaauguacaccucccccaacgaaguuaucucaguacaaugccagaauggccgcugcacccucgacggcgaacuccaaggaaccacccaacugcaaguauccggcaucugcgcauucaaaggcgaaguaaccgcccaccuacacgacaacgaucaccuauacaauguuacaauaaccaaccucaauggaucacccuucgaccccucagaagacauccccgcuccacucggcguucccgauuuccaaggccgcguuuucggcguaauaucucaacgagacaaacacaacacccccggccacaacgaacccgccaaccgcgcccacgacgccgucguacccaccuacaccgcccaauacacccccaaacucggucaaauacaaaucggcaccuggcaaacagacgaccucaccgucaaccaacccguaaauuucaccccagucggacucuccgacacagaccacuucaaccaauggguagucccacguuaugccggcgcccuaaaccucaacaccaacuuggcuccauccgucgcccccguuuucccgggcgaaagacuccuauucuuccgcucuuacaucccccucaaagguggauaugguaccccggccaucgauugccuccuuccgcaagaauggguacaacacuucuaucaagaagccgccccauccaugucugaagucgcacucguacgauacauaaacccggacaccggccgcgcccucuucgaagccaaacuucaccgagccggauucaugacuguuagcucaaacaccucagcccccgucguaguuccugccaacggcuacuuccgauucgacagcugggucaaccaauucuacucccucgcccccaugggcaccggcaacggccgccgccgcuaa

SEQ ID NO: 37873 - RNA, 1623 nt, Artificial Sequence
  derived and/or modified sequence opt11 from VP1__Norovirus_and/or_Norovirus-like__AB662876
augaaaauggccuccaacgacgcagcacccucuaccgacggcgcugcuggacucguccccgaauccaacaacgagguaauggcacucgaaccagucgcaggcgccgcccuagcagcccccgucaccggccaaacuaacaucaucgacccauggauccgggcaaacuuuguccaagcuccaaacggcgaguucaccgucucuccacgcaacucccccggcgaaguccuccuaaaccucgaacucggcccugaauuaaacccauaccuugcacaccuagcacgcauguacaacggauacgcuggcggcauggaaguccaaguaaugcucgccggaaacgccuucaccgccggaaaacuggucuucgcagcaguacccccacacuuccccgucgaaaacuuaucaccacaacaaauaacaauguucccacacgucaucaucgacguccgcacccucgaaccaguccuccucccccuacccgacguccgcaauaacuuuuuccacuacaaccaaaaagacgacccaaaaaugcgcauaguugcaaugcuauacacuccccuacgcucuaacggcuccggagacgacgucuucaccguauccugccgcguucuaacccgccccuccccagacuucgacuuuaccuaccucguuccuccaaccgucgaauccaagaccaaaccauucacgcuacccauccuaaccuuaggagaacucuccaacucacgcuuccccgucuccaucgaccaaauguacaccucccccaacgaagucaucuccguccaaugccaaaacggccgcugcacacucgacggcgaacuccaaggaacaacacaacuacaggugagcggcaucugcgcauucaaaggcgaaguuaccgcacaccuacacgacaaugaccaccucuacaacguuaccaucaccaaccucaacgguuccccauucgaccccuccgaagacauccccgcaccucucggaguccccgacuuccaaggccgcgucuucggcgucauaucccaacgcgacaaacacaacaccccaggccacaaugaaccagcuaaccgcgcacaugacgcagucgucccaacauacaccgcccaauacacgccaaaacuuggacaaauacaaaucggaaccuggcaaaccgacgaccucaccgucaaucaaccaguaaacuucaccccagccggacucucugacacugaccauuucaaccaauggguagucccccgauaugccggagcacucaaccugaacaccaaccuagcuccuuccguagcccccgucuucccaggcgaacgacuccucuucuucagauccuacaucccacucaaaggcgguuacggcacaccagccaucgacugucuacucccacaagaauggguccaacacuucuaccaagaagccgcccccagcauguccgaagucgcacucgucagauacaucaaccccgacaccggacgcgcccuauucgaagcaaaacuccaccgagcaggcuucaugaccgucuccuccaacaccucugcucccgucguagucccagcaaauggcuacuuccgcuucgacucaugggucaaccaauucuacucccucgcaccaauggguacaggaaauggccgccgccgcuaa

SEQ ID NO: 37874 - RNA, 1620 nt, Artificial Sequence
  derived and/or modified sequence opt11 from VP1__Norovirus_and/or_Norovirus-like__KU555841
augaaaauggccucaaacgacgcugcuccuuccaacgacggagcagccggccucguccccgaaggcaauaacgaaacacucccccucgaacccguugccggcgcagccauagcagcccccguaacaggccaaaacaacaucauagaccccuggauccgcacaaacuucguccaagccccaaacggggaauuuaccgucucaccccgcaacucccccggagaaauccuacucaaccucgaacucggcccagaccugaacccauaucucgcccaccucucccgcauguacaacggcuacgccggaggcgucgaaguacaaguacuccucgcaggaaacgccuucacugcagguaaaauccucuucgcagcuguacccccaaacuuccccgucgaguuccucuccccagcccaaaucaccaugcucccccaccucauagucgacguccguacacucgaacccaucaugaucccccuaccagauguccgaaacaccuucuuccacuacuccaaccaacccaacucccgcaugcgccuaguagcaaugcuuuacacuccccuucgaucaaacggcuccggggacgacguauucaccguuagcugccgaguucucacccgccccaccccugacuucgaauuuaccuaucucguaccacccuccgucgaaucuaaaaccaaaccuuucucucuuccuauacuaacccucuccgaacucaccaacucaagauucccagucccaauagacucccuuuucaccgcccaaaacaacguccuacagguccagugucaaaacggccgcugcacccucgacggcgaacuucagggcacaacacagcuccuccccuccgguaucugcgccuuccgaggccgagucaccgcccagauaaaccaacgcgacagauggcacaugcaacuccaaaaucucaacggaaccaccuacgacccuaccgacgacgucccugcaccccucggcacucccgacuucaaaggaguagucuucggcauggucucccagcguaacgucggcucugacgcccccggcagcacacgagcacaacaagccuggguaucaacuuacucaccccaauucguccccaaauuaggcucagucaaccugcgcaucucugacaacgacgacuuccaauuccaacccaccaaauucacccccgucggcgucaacgacgacgacggccacccauuccggcaaugggaacugcccaacuacuccggcgaacuuacacucaacaugaaccuagcaccacccgucgcccccaacuuccccggcgaacagcuucuauucuuccgguccuuuguccccugcuccggcggauacaaccaaggcaucauagacugccucaucccccaagaauggauccaacacuucuaccaagaaucagcccccucccaauccgacguugcacucauucgcuacgucaaucccgacaccggaagaacccucuucgaagcaaaacuccaccgguccggcuacauaaccgucgcacacagcggcgacuacccccuugucguuccagcaaacggccacuuccgcuucgacucaugggucaaccaauuuuauagccuagcacccauggguaccgguaacggacgacgccgcgcccaauaa

SEQ ID NO: 37875 - RNA, 1620 nt, Artificial Sequence
  derived and/or modified sequence opt11 from VP1__Norovirus_and/or_Norovirus-like__GQ856468
augaaaauggccucaaacgacgccgcacccuccaaugacggcgccacaggccuagucccugaaauaaacaccgaaacucucccccucgaacccgucgccggcgcugccaucgccgcccccgucaccggacaaaauaacauaaucgaccccuggauacgcaacaacuucguccaagcacccaacggcgaguucacagucucccccagaaacucaccaggcgaaauacuaaugaaccuagaacugggccccgaccucaaccccuaccuagcucaccuaucccgaauguacaacggcuacgccggaggcgucgaaguccaaguccuccucgccggaaaugccuucaccgcuggcaaaauucuauuugccgccgucccacccaacuuccccgucgauaugcucucacccgcccaaaucaccaugcucccacacuuaauagucgacguccgaacccuagagcccauaaugauccccuuaccagacguccgcaacgucuucuaccacuucaacaaucaacccgcaccccgcaugcgccuaguagccaugcuauacaccccacuacgcuccaacggcuccggagacgacguauucacuguuucauguagaguacuaacccggcccacaccagacuucgaguucacuuaccuaguacccccauccgucgaauccaaaacaaaacccuucacacuccccauacucaccauaggcgagcucacaaacucucguuuuccagccccuaucgaccaacucuacaccucccccaacgcagacaucgucguccaaccccaaaauggccgcugcacccucgacggcgaacuacaagguacaacccaacuccucacuaccgcaaucuguucauaccgggguaugacauccaaccccacaucagacuacugggacgaccaccuacuacaccuaguccacccaaacggagcaaccuacgacccaacagaagacguacccgcucccuucggcacacaagacuuccgcgguauccucuacgggaugcucacccagaacccucgcacuucaggagacgaagccgcaaacucacacgguaucuacauauccagcaccuccgaaaaauuuaccccuaaacuuggaaccaucggccuccaccaaguccaaggucgacacucccaacaccaacaauccaaauucacccccgucggcauugccgucaacggcaacacccccuuccgccaaugggaacucccuaacuacuccggugcccuaaccuugaacaccaaccuugcucccgccgucggcccaaacuuccccggagaacaaaucuuauucuuccgcuccaacgucccuuccguccaaggaggccagccaaucgaaaucgacugccucauuccccaagaaugggucucucacuucuaccaagaaucagcucccucccagagcgacguagcccuaguaagauacguaaacccagauaccggucgcacuauauuugaagccaaacuccaccgccaaggcuucaucaccaucgccgccaccggauccaaccccgucguagucccucccaacggcuacuuccgcuucgacuccugggucaaccaauuuuacgcacucgcccccaugggaaccgguaacggcagacgccgcguccaguag

SEQ ID NO: 37876 - RNA, 1620 nt, Artificial Sequence
  derived and/or modified sequence opt11 from VP1__Norovirus_and/or_Norovirus-like__AB684681
augaaaauggccuccaacgacgccgcuccauccaacgacggagccgcaggccucguccccgaaggcaacaacgaaacccucccccuagaaccaguagccggcgccgccaucgcugcucccgucaccggccagaacaacauaaucgacccauggauccgcaccaacuucguccaggcacccaacggcgaauuuaccgucucaccccgcaacucacccggcgaaauccuccucaaccucgaacucggacccgaccucaaccccuaucuagcacaccugucccguauguauaacggcuacgccggaggaguagaaguacaaguccuccuagccggcaacgccuucaccgccggcaaaauacuuuucgcagccguacccccuaacuuccccgucgaguuccuuucacccgcacaaauaaccaugcucccacaccuuaucgucgacgucagaaccuuggaacccauaaugaucccacuuccagacguucgcaacaccuucuuccacuacaacaaccaacccgccaaccgcaugcggcuagucgccaugcucuacacaccccuccggucgaacggcuccggugaugacgucuucaccgucucuugcagaguccuuacccgccccaccccggacuucgaguucaccuaccucgucccacccucagucgaaucaaaaaccaaacccuucucucuacccauccuuacccucuccgaacucacaaacucacgauucccugcaccaaucgacucccuuuucaccgcacaaaacaacguccuucaaguucagugccaaaauggacgaugcacacuugacggcgaacuccaaggcaccacccaacuccuccccacaggcaucugcgccuuccgcggacgcguaacugccgaaaccgacaaccccgacaaauggcacaugcaacuccaaaaccuaaacggcacaacguacgaccccacagacgacguccccgccccacuaggaaccccugacuuccgcggccuccucuucggcguagccucccagcgcaacgucggcaacgaugcccccggcucuacacgugcccacgaaguaguaaucuccaccacuucuccccaauucgucccaaaacuuggcucaaucaacuuccgcucaaccuccgaagacuuccgaaccggccaacccacccgauuuaccccagucggcaucaacgacgaagacaaccacccuuucaaccagugggaacuucccgacuacucaggccgccucacacuaaacaugaaccucgcgcccccagucgcccccaacuuucccggcgaacaacuacuauuuuuccgcuccaacguccccugcuccggcggcuauaaccaaggaauaaucgacugccucauaccccaagaauggauccaacacuucuaccaagaauccgccccaucacaauccgaagucgcccuaauccgcuacgucaaucccgacacaggccgcacccuguucgaagcaaaacuacauagaacaggcuacaucacagucgcccacuccggcgacuacccucuaguaguccccgcaaauggauacuuccgcuucgacucaugggucaaccaauucuauucccucgcccccaugggaaccggaaacggccgccgccgagcacaguaa

SEQ ID NO: 37877 - RNA, 1620 nt, Artificial Sequence
  derived and/or modified sequence opt11 from VP1__Norovirus_and/or_Norovirus-like__AB809988
augaaaauggcuuccaacgacgcagcgcccuccaaugacggcgcagccucccucgucccagaagcaaucaacgaaaccaugccacuagaacccgucgcuggcgcauccaucgccgcaccugucgccggccaaacuaacaucaucgaccccuggauccgcaccaacuucgugcaagccccaaacggcgaguucaccgucucaccccggaacagccccggcgaaauccuacucaaccuagaacucggaccugaccuuaaucccuaccuagcccaucucucccgcauguacaacggcuacgccggcggagucgaaguacaaguccuccucgcaggcaaugccuuuaccgccggcaagauccucuucgcagccauaccacccaacuuccccgucgacaugauaucccccgcccaaauaacaaugcucccccaccuuaucgucgacguccgcacccucgaacccaucaugaucccccuccccgacguccgcaacguauucuaccacuucaacaaccaaccccaaccacgcaugcgacuuguagccaugcuauacacaccucuccgcuccaacggcuccggcgacgacguauucaccguauccugccgcguccucacccgcccaacucccgacuucgaguucaucuaccucgucccucccucaguagaauccaagacuaaacccuuuacacuacccaucuuaaccaucucagaacuuaccaacucacgcuuccccauccccaucgaacaacuauacaccgcccccaacgaaaacaacgucguccaaugccaaaauggacgcugcacacucgacggcgaacuccaaggcaccacccaacuacuuucaucggcagucugcagcuaccgcggccgcaccgucgcaaacagcggagacaacugggaccaaaaccuacuccaacuaaccuaccccuccggagcauccuacgaccccaccgacgaaguccccgcaccccuaggcacccaagacuucucaggcauccucuacgguguucugacacaagauaacguuuccgaaggcacgggcgaagccaagaacgccaaaggaguauacaucuccaccacaucuggcaaauucacccccaaaaucggcuccauaggccuacacuccaucacagaaaauguccaccccaaccaacaaucccgcuucacacccgucggugucgcacaaaacgaaaacaccccauuccaacaauggguacucccucauuacgccggggccuuagcccucaacaccaaccucgcccccgccgucgccccaacauucccaggcgaacaacuacucuucuuccgaucccgcguccccugcguucaaggccucagaggccaagacgcuuucaucgacugccuccucccccaagaaugggucaaucacuucuaccaagaggccgccccaucccaagccgacguugcacucauacgcuacgucaacccagacaccggacguacccucuucgaagccaagcuccaccgcucaggauucauaaccgucucacacaccggcgcuuacccccucguuguaccacccaacggacacuuccgcuucgacucaugggucaaccaauucuacucccuagcccccaugggcacaggaaacggucgaagauaa

SEQ ID NO: 37878 - RNA, 1620 nt, Artificial Sequence
  derived and/or modified sequence opt11 from VP1__Norovirus_and/or_Norovirus-like__AB810011
augaaaauggccucgaacgacgccgcacccagcaacgacggagcugccucccuaguacccgaagccauaaacgaaacuaugccccucgaaccagucgcaggagccuccauagccgcucccgucgccggacaaacaaacaucaucgaccccuggauccgaaccaauuucguacaagcccccaacggcgaauuuaccgucucaccccgcaacuccccaggcgaaauacuacuaaaccucgaacucggaccugaccucaaccccuaucuagcacaccucucacgaauguacaacggcuacgcaggcggcgucgaaguacaaguucuucuagcaggcaacgccuucacagccggcaagauccuauucgccgccaucccacccaacuuccccguagacaugaucucccccgcccaaauaaccaugcucccccaccuaaucgucgacguccgcacccucgaaccaaucaugauuccccuccccgacguccgcaacgucuuuuaccacuucaacaaccaaccccaaccccgaaugagacucgucgccaugcuauacaccccacuacguucaaacggauccggcgacgacgucuucacuguauccugccgcguccucacccgaccaacacccgacuucgaguucaucuaccucgucccacccucagucgaaucaaaaacgaaacccuucacacuacccauccuaaccaucucagaacucacaaacucccgauuccccauacccaucgaacaacuauacacagccccaaacgaaaacaacguaguccaaugccaaaacggccgcugcacccuggacggagaacuacaaggcacaacccaacuccucuccuccgccguauguuccuaccgaggacgaacuguugcaaaccgcggcgacaauugggaccagaaccuccuccaacucacauaucccucaggggccuccuacgaccccaccgacgaaguccccgcaccacucggaacccaagacuucuccggcauccucuacggaguccucacacaggacaacgucucagaaggcacuggagaagccaaaaacgccaaaggcgucuacauaucaaccaccuccggcaaauucacucccaaaauaggcuccauaggccuucauuccaucaccgaaaauguccaccccaaccaacaaucccgcuucacacccguaggcgucgcucaaaacgaaaacaccccauuccaacaauggguccuaccacacuaugcaggcgcacucgcgcucaacacaaaccucgcccccgcagucgcccccacuuucccaggggaacaacuccuauuuuuccgaucccgggucccaugcguccaaggccuccgcggacaagacgcauucaucgacugccuucucccacaagaaugggucaaccacuucuaccaagaagcagcucccucccaagccgacgucgcccuaauccgcuacgucaacccagacaccggucgcacccuauuugaagccaaacuucacagauccggcuucaucacggucucccacacaggagccuacccccuaguugucccucccaacggccauuuccgcuucgacuccugggucaaccaauucuacucccuagcgcccaugggcacaggaaacggccgccgauaa

SEQ ID NO: 37879 - RNA, 1620 nt, Artificial Sequence
  derived and/or modified sequence opt11 from VP1__Norovirus_and/or_Norovirus-like__AB809994
augaaaauggccuccaacgacgccgcccccagcaacgacggugccgcuucccucguucccgaggcuaucaaugaaacaaugccacuagaaccagucgcaggcgccucuauagccgcaccaguagcgggacaaaccaacauuaucgacccauggauccguaccaacuucguccaggccccuaacggagaguucaccgucucaccacgaaauagccccggugaaauccuccucaaccucgaacuaggacccgaccuaaaccccuaccucgcgcaccucucaagaauguacaacgguuacgcaggcggcgucgaaguccaaguccuccuugccggcaacgccuucaccgcaggcaaaauccuauucgccgccauacccccaaacuuccccgucgacaugaucuccccagcccaaaucaccaugcuuccucaccucaucgucgacguacgcacccucgaacccaucaugaucccccucccagacguccgaaacguauuuuaccacuucaacaaccaaccccaaccccgaaugcgccuagucgcuaugcuuuacacaccccuuagauccaacggcucaggugacgacgucuucaccgucucuugcagaguccucacccgcccgaccccagauuucgaguucaucuaucucgucccuccuuccgucgaauccaaaaccaaacccuucacacuccccauccucacaaucagcgaacuuacaaacucucgauuccccauaccaaucgaacagcuguacaccgcacccaacgaaaacaacgucguccaaugccaaaaugggcgcugcacccucgacggcgaacuccaaggaacaacucaacuacucuccuccgccgucugcucauaccgcggccguacugucgccaacuccggugacaacugggaccaaaacuugcuacaacucacauaccccuccggugcaucuuacgacccaaccgacgaaguccccgcaccccucggcacucaagacuucuccggcauacuauacggcguccuaacacaagacaacgucuccgaaggcaccggcgaagccaaaaacgccaaaggcguauacauaucgaccacauccggcaaauucacccccaaaauuggcucaaucggacuccacuccauaaccgaaaacguccacccaaaccaacaauccagauucacucccguaggcgucgcgcaaaacgaaaacacccccuuccaacaauggguccucccccacuacgccggagcccucgcccuaaacaccaaccuagcccccgccgucgccccaaccuucccuggcgaacagcuccuauucuuccgcucucgaguacccugcguccaaggacuacaaagacaagacgccuucaucgacugccuacugccccaagaaugggucaaccacuucuaccaggaagccgccccaucccaagccgaugucgcccucauccgcuacgucaaccccgacacaggaagaacucucuucgaagccaaacugcaccgcucuggauucauaacaguaucccacaccggcgccuacccacuuguuguuccacccaacggacacuuccgcuucgauagcugggucaaccaauuuuacucacucgcccccaugggcaccggcaacggccgccgcuaa

SEQ ID NO: 37880 - RNA, 1620 nt, Artificial Sequence
  derived and/or modified sequence opt11 from VP1__Norovirus_and/or_Norovirus-like__KX767083
augaaaauggcaucauccgacgcaaaccccagcgauggcucagccgcaaacuuaguacccgaaguaaacaaugaaguaauggcccucgaacccgucgucggcgcagccauagcagcccccgucgccggacaacaaaacgucaucgaccccuggaucagaaacaacuucguccaagcccccggaggagaguucacaguaucaccccgcaacgccccaggagaaauccucugguccgcaccccucggccccgaccuaaacccauaccucucacaccucgcccgcauguacaacggauacgccggcggcuucgaaguccaagucauccuugccggcaaugccuuuacggcgggcaaagucaucuuugccgccguacccccuaacuucccaacagaaggccucucccccucccaggucaccauguucccucacaucguagucgacguccgacaacucgaacccguccuuauuccccucccagacguccgcaacaacuucuaccacuacaaccaguccaaugacccaacaauaaaacucauagccaugcucuacacaccccuccgcgcaaacaacgcaggagacgacguauucaccgucuccugccgcguccucacccgcccaagccccgacuucgacuucauauuccucguacccccuacaguagaaucacgcacaaaacccuucuccauaccaguccuuacuguagaagaaaugaccaacuccagauuccccauaccccucgaaaaacuauucaccggccccucuucagccuuugucguacaaccucagaacggaagaugcaccaccgacggcguccuccucgggaccacacaacuuucccccgucaacaucuguaccuuccgcggcgacguaacacacaucacgggaucacauaacuacacaaugaacuuagccucccaaaacuggaacuccuacgaccccacagaagaaaucccagcuccccucggcaccccugacuucgucggcaaaauccaaggcguauuaacacaaaccacccgcgccgacgguagcacccgaggccacaaggccacugucuacaccggcuccgcagauuucgcaccgaaacucggacgcguucaauucggcaccgacaccuccaacgacuucgaagccaaccagaauaccaaauucacgcccguaggcgucauucaagacggcgacacaacccauagaaacgaaccccaacaauggguccuacccuccuacucuggaagaaacacccacaacguccaccuugcacccgcugucgccccaacauucccaggcgaacaacuacuuuucuuccgcuccaccaugccaggcugcuccggcuaccccaacauggaccuagauugccugcucccccaagaauggguccaacacuucuaccaagaagccgccccagcacaaucagacguugcccuccuucgcuucguaaaccccgacaccggcagaguucuuuucgaaugcaaacuccauaaacccggguacgucaccgucgcccacacaggacaacacgaccucguaauuccacccaacggauacuuccgcuucgacuccugggucaaccaauucuacacacucgcccccaugggaaacggcacaggccgucgacgaguauaa

SEQ ID NO: 37881 - RNA, 1620 nt, Artificial Sequence
  derived and/or modified sequence opt11 from VP1__Norovirus_and/or_Norovirus-like__LN854565
augaaaauggcauccaacgacgcaaaccccuccgacggauccgcugccaauuuaguccccgaagucaauaacgaagucauggcccuagaacccgucgucggagcggcaauagccgcucccgucgccggccaacaaaacaucaucgacccauggauccgaaacaacuucguccaagcccccggaggagaauuuacugucucgccccgcaacgccccaggagaaauccucugguccgcaccccucgguccagaccuaaaccccuaccucucccaccucgcccguauguacaacggauacgccggcggcuucgaaguacaaguuauccuagccggcaaugccuucacugccggcaaaaucaucuucgcagccguaccucccaacuuccccaccgaaggccucucccccucacaaguuaccauguucccacacaucaucgucgacguaagacaacucgaaccaguccucauuccacuccccgacgucagaaacaacuucuaccacuacaaccaauccaacgacucaacaauaaaacuaauagccaugcucuacacaccccuccgcgccaauaaugccggcgacgacgucuucaccgucuccugccgaguucucacacgccccucccccgauuucgacuucaucuuucuggucccacccacugucgaaucccggaccaaacccuucaccauacccauccucaccgucgaagaaaugacaaacucccgauuccccaucccccuugaaaaauuauacaccggacccucauccgccuucgucguacaaccacaaaacggacgcugcaccacagacgggguacuccucggcaccacgcaacucuccccaguaaacauaugcaccuuccgcggcgacgucaccaacauccaagggucccauaccuacacuaugaaccucgccucccuaaacuggaacaauuacgacccaaccgaagaaacccccgcaccccucggcacucccgacuuugucggcaaaauacaggguguuuuaacccaaacuaccaaaggccaaggcucaacccgaggacacaaagccacagucuacaccggcucggccucuuucacccccaagcucggaucaguacaauuccgcaccgacacacaaaacgacuucgucacccaccaaaacacuaaauuuacccccguaggcgucauccaggacggugacaccacacaccgcaacgaaccccaacaauggguccuccccaacuacuccggagugaacacccacaacguccaucucgccccagccgucgcccccaccauccccggcgaacaacuccucuucuuucgcuccuccaugcccggaugcucuggcuacccaaacauggaccucgacugccugguaccacaagaauggguccaacacuucuaccaagaggccgcacccgcccucucagacgucgcccuacuccgcuuugucaacccagacaccggacgcguacucuucgaaugcaagcuacacaagagcggcuaugucacaguagcacacacuggucaccacgaccuagugaucccucccaacggcuacuucagauucgacuccuggguuaaccaauucuacacacuagcccccaugggaaacggaacaggccgccgucgcgucuag

SEQ ID NO: 37882 - RNA, 1620 nt, Artificial Sequence
  derived and/or modified sequence opt11 from VP1__Norovirus_and/or_Norovirus-like__KX354071
augaaaauggcauccaacgacgcuaaccccuccgacggauccgccgcuaaucucgucccagaagucaacaacgaaguaauggcccuagaaccaguugucggcgcagccauugccgcccccgucgcaggccaacaaaauguuaucgacccauggauccgaaacaauuucguccaggcccccggcggcgaguucaccgucuccccacgcaacgcccccggagaaauccucugguccgcaccucucggccccgaccuaaaccccuaccucucacaccuagcacgcauguacaacggauacgccggcggcuucgaaguccaagucauacucgcaggcaacgccuucacagccggcaaaauuauauucgccgccguaccacccaauuuccccaccgaaggccucucacccucccaagugacaauguucccacauaucaucgucgacguccgccaacuagaacccguccucaucccacuuccagacguaagaaacaacuucuaccacuacaaccaauccaacgacuccaccaucaaacuuaucgccaugcuguacacaccccuacgugccaacaacgccggagacgacgucuucaccguuuccugcagaguucuaacccgucccucccccgacuucgacuucaucuuccucguaccacccaccguagaaucacgcaccaaacccuucaccguaccaauccucaccgucgaagaaaugacaaacucacgcuucccuauaccccuagaaaaauuauucacaggacccuccuccgcauucgucguccaaccacaaaacggucgcugcacgacagacggcguacuacuuggcaccacccaacucucacccgucaacaucuguaccuuccgcggugacgucacacacaucgcaggcagccgcgacuacaccaugaaccucgcaucccucaacuggaacaacuacgaccccacagaagaaaucccagcaccccuuggcacucccgacuucgucggcaaaauccaaggagucuugacccaaacaacaaaaggcgauggauccacacgcggccacaaagccacugucuauaccggcucugccccauuuacccccaaacuuggcuccgugcaguucuccaccgacaccgaaaacgacuucgaaacucaccaaaacaccaaauucaccccagucggcguaauccaaaacggaucaaccacccaccguaaugaaccccaacaauggguccucccaucuuacuccggccguaacguccaaaacguccaccuugcccccgccgucgccccaaccuuccccggggaacaacuacuauucuuccgaucaaccaugcccggcugcucaggcuacccaaauauggaccuagacugccuccuuccacaagaauggguacaacacuuuuaccaagaagccgcacccgcgcaaucagauguagcccuacuccgauucguaaaucccgacacgggccgaguccuauucgaauguaagcuccacaaauccggcuauguuacaguagcccacaccggccaacacgaccuagucaucccacccaauggcuauuuccgcuucgacucuugggucaaccaauucuacacccucgcccccaugggaaauggcaccggucgucggcgcguauaa

SEQ ID NO: 37883 - RNA, 1620 nt, Artificial Sequence
  derived and/or modified sequence opt11 from VP1__Norovirus_and/or_Norovirus-like__AB933688
augaaaauggccuccaacgacgccaaccccucagacggcuccgccgccaaccuaguccccgaaguaaacaaugaagucauggcacucgaacccgucgucggagcagccaucgcggcccccgucgccggccaacaaaacgucaucgauccauggauccgaaacaacuuuguccaggcacccggaggcgaguucaccgucucaccccgaaacgcuccgggcgaaauccuauggucggcaccccuaggccccgaucuuaacccuuaccucucacaccucgcucgaauguauaacggauacgcaggcggcuucgaaguucaagucauacucgccggcaacgccuucaccgcaggcaaaauaaucuucgcagcuguuccuccaaacuuccccacagaaggacucucccccucccaaguaaccauguucccucacaucauaguugacguucgccaacucgaacccguccucaucccucuccccgacguccgaaacaauuucuaccacuacaaccaaucaaacgacucaaccaucaaacucaucgccaugcucuacacuccccuccgcgccaacaacgccggcgaagacgucuucaccgucucuugccgcguccucacacgccccucccccgacuucgacuucauuuuccucgucccuccuaccgucgaaucccgaaccaaacccuucaccgucccaauccuaaccguugaagaaaugaccaauucccgcuucccaauaccccucgaaaaacucuucaccggacccuccuccgccuucgucguccaaccccagaacggccgcugcacuacagacggcguccuccucggcaccacacaacucucacccgucaauauaugcacauuccgcggugacguaacccacauagcaggcagccgcgacuacaccaugaaucucgccucccucaacuggaacaacuacgaccccaccgaagaaauacccgcaccccucggaacccccgacuucgucggcaaaauccaaggaaugcucacucaaaccaccaaaggcgacgguuccacccguggccacaaagcgaccgucuacacaggcuccgccccuuucacucccaaacucggcucaguucgcuucuccaccgacaccgaaaacgacuuugaaauucaccagaauaccaaauuuacccccguaggcguaauccaagacggaucaaccacacaccgaaacgaaccccaacaauggguccuucccucauacuccggucgcgacgcccacaacguccaccucgccccagccgucgcucccacauuucccggagaacaacuccucuucuuccgcucuaccaugcccggcugcucaggauaccccaacauggaccuagacugccuccucccacaagaauggguacagcacuucuaccaagaagccgccccugcucaauccgacguagccuuacuacgcuucguaaaccccgacaccggccguguccucuucgaaugcaaacuacacaaauccggcuacgucaccgucgcccacacaggccaacacgaccuagucauuccucccaacgguuacuuccgcuucgacuccuggguaaaccaauuuuacacacuagcacccaugggcaacggaaccggccggcgccgagucuaa

SEQ ID NO: 37884 - RNA, 1620 nt, Artificial Sequence
  derived and/or modified sequence opt11 from VP1__Norovirus_and/or_Norovirus-like__GQ845337
augaaaauggccuccaacgacgcuaacccauccgacggaagcgccgcaaaccucgucccugaagucaauaacgaagucauggcccuugaacccgucgucggugccgccaucgccgcccccgucgccggccaacaaaacgucaucgacccguggauccgaaacaacuucguccaagcaccaggaggagaguucaccguaucaccacgcaacgcuccaggcgaaauccucugguccgccccacuaggccccgaucucaaccccuaccuaagccaccuagcacguauguacaacggcuacgccggaggcuucgaaguccaggugauacuagccgggaacgccuucaccgcaggcaaaauaauauuugccgcagucccacccaacuuccccaccgaaggccuaucccccucacaaguuacgauguucccgcacaucaucgucgacguacgccaacucgaacccguacuaaucccacugcccgacguccgcaacaacuucuaccauuacaaccaauccaacgacuccacaaucaaacucaucgcaaugcucuacacgccccuucgagccaacaaugccggagaagacgucuucacagucagcugccgcguccuuacccgaccuuccccagacuucgacuucaucuuccucgucccucccacagucgaaucccgaacuaagcccuucaccguaccuaucuuaaccguagaagaaaugaccaacagccgguucccaaucccccuagaaaaacuauucaccggccccucauccgccuucgucguacaaccccaaaacggccgaugcaccaccgacggaguccuccuaggcaccacccaauuaucccccguaaacauauguaccuuccgaggcgacguaacacacaucgcuggcucccgcaacuacacuaugaaccuagcuucccucaacuggaacaacuaugaccccaccgaagaaauccccgcaccccucggcacccccgacuucgucggcaaaauccaaggaguucuaacccaaacaaccaaaggcgacggauccacccgcggccacaaagccaccguuuacaccggcucagcacccuucacucccaaacuaggauccguacaauucagcaccgacaccgaaaacgacuucgaagcccaccaaaauaccaaguucacaccggucggagucauccaagacgguggcacaacacaccgcaaugaaccucaacaauggguacuccccuccuacucaggccgcaacguccccaacguacaccuagccccagcggucgcccccacauucccgggagaacaacuacuauucuuccgcuccacuaugcccgguugcuccggcuaccccaacauggaucuagacugccuccucccccaagaauggguacaacacuuuuaccaagaagccgcuccugcccaaagcgacguagcccuccuucgcuucgucaacccagacaccggcagaguccucuucgagugcaaacuccacaaauccggcuacgucaccguggcccacaccggccaacacgaccucgucauacccucaaacggcuacuuccgcuuugacuccuggguaaaccaauucuacaccuuagccccaaugggcaacggcacaggccgacgacgcgucuaa

SEQ ID NO: 37885 - RNA, 1620 nt, Artificial Sequence
  derived and/or modified sequence opt11 from VP1__Norovirus_and/or_Norovirus-like__JX155747
augaagauggcauccaacgacgcaaacccuagcgacggcucagccgccaaccuaguccccgaagucaacaacgaagucauggcucucgaaccagucgucggcgccgccaucgcugcccccgucgcaggucaacaaaacgucaucgaccccuggauccgcaacaacuucguacaagcacccggcggcgaguucacaguaucccccagaaacgcccccggcgaaauccucuggucugccccacucggucccgaccuaaaccccuaccucucccaccucgcucgaauguauaacgguuaugcaggcggcuucgaaguucaaguaauccucgcaggaaacgccuucacagcuggcaaaaucaucuucgcugccgucccucccaacuuccccaccgaaggacuaucacccucccaaguaaccauguucccucacaucauagucgacguccgccaauuagaacccguacuaauaccacucccugacguacgcaacaacuucuaccacuacaaccaauccaaugacuccacaaucaaacuaaucgccaugcuauacacuccccuccgcgccaacaacgccggugaagacguauucaccgucuccugccgcguccucacaagaccuuccccugacuucgauuucauauuccucgucccucccaccgucgaauccagaacuaaacccuuuaccguccccauccucacuguagaagaaaugacaaacucccgauuccccaucccccucgaaaaacucuucaccggccccuccuccgcauucgucguacagccccaaaacggacgauguacaaccgacgguguccuccuaggaaccacccaacuguccccagucaacauaugcacauuuagaggagacgucacccacauagcaggcuccagaaacuacaccaugaaccucgcaucauugaacuggaacaacuacgaccccacagaagaaauccccgcaccccuaggcacccccgacuuugucggaaaaauacaaggcguccucacccaaaccaccaaaggugacgguagcacccgcggccacaaagccacuguuuacacaggauccgcgccauucaccccaaaauuaggcucaguccaauucagcaccgacaccgaaaacgacuucgaaacccaccagaacacaaaauucacacccguuggcguaauccaagacgguggcaccacccaccgcaacgaaccacaacaauggguccucccauccuacucaggacgcaacguacaaaacguccaccucgcacccgccgucgcaccaaccuuccccggagaacagcuucuauucuuucgcuccaccaugccuggaugcuccggcuaucccaauauggaccucgacugccuacuaccccaagaauggguacaacacuucuaccaggaagccgcccccgcccaaucagaugucgcccuacuccgcuucgucaaccccgacaccggacguguccucuucgaaugcaaacuccacaaauccggcuacgugaccguagcacacacaggccaacacgaccucguaauacccccaaacggcuacuuccgcuucgacuccugggucaaccaauucuacacccuagcccccaugggaaacggcacuggaagacgccgcgucuga

SEQ ID NO: 37886 - RNA, 1620 nt, Artificial Sequence
  derived and/or modified sequence opt11 from VP1__Norovirus_and/or_Norovirus-like__JX155737
augaaaauggccuccaacgacgcuaacccauccgacggaagcgccgcaaaccucgucccagaaguaaacaacgaaguaauggcccucgaacccgucguuggcgccgccaucgcugccccaguagccggccaacaaaacgugaucgacccguggauacgcaacaacuucguccaggcccccggcggagaguucaccguaagcccacgaaacgcccccggcgaaauacucuggagcgcgccccucggccccgaccucaaccccuaccugucucaccuagcccguauguacaacggauacgcuggcggcuucgaaguccaaguaauacuagcgggcaacgccuucacagccggcaaaauaaucuucgccgccgucccacccaacuuccccaccgaaggccucucccccucccaagucaccauguucccccacauaaucguagacguccgccaacucgaacccguccuaaucccucuccccgacguacgaaacaacuucuaccacuacaaccaauccaacgacuccaccauaaaauuaaucgccaugcucuacacuccccuacgcgccaacaacgccggcgaagacgucuucaccguaucaugccgcguccuaacccgaccuuccccagacuucgacuucauauuccuaguaccucccaccguagaauccagaaccaaacccuucacgguccccauccucacaguugaagaaaugaccaacagccgauuucccauaccacucgaaaaacucuucaccggcccgucauccgcauucgugguccaaccacagaacggccgcugcacuacagacggcguccuccugggcacaacccagcucuccccaguuaacaucugcaccuuucgcggcgacgucacccacauagcaggaucccgcaauuacacaaugaaccuagcaucacucaacuggaacaacuacgaccccacagaagaaauaccugcuccccucggcaccccagacuucguaggaaaaauccaaggcguccugacgcaaacaaccaaaggagacggauccacacgcggacacaaagccaccgucuacaccggcucagccccauucacacccaaacuuggaucaguacaauucuccacagacacagaaaacgacuucgaaacucaccaaaacaccaaauucaccccugugggugucauccaagacggcggcacgacacaccguaacgaaccccaacaauggguccuccccuccuacucaggccgcaacgucccaaacguccaucucgcccccgccgucgcacccacauuucccggugaacagcuccucuucuucagguccaccaugccaggaugcucuggauaccccaacauggaccuagacugucuccucccccaagaauggguccaacacuucuaucaagaagcagcacccgcacagucagacguugcccuccuccgguucgucaacccagacacaggccgaguacucuucgaauguaaacuacacaaaagcggcuacgucaccgucgcccacacaggccaacacgaccucgucauaccacccaacggcuacuuccgauucgacucaugggucaaucaauucuacacccucgcccccaugggcaacggcaccggccggcggcgagucuag

SEQ ID NO: 37887 - RNA, 1620 nt, Artificial Sequence
  derived and/or modified sequence opt11 from VP1__Norovirus_and/or_Norovirus-like__KX354055
augaaaauggcauccuccgacgccaaucccucggacggcagcgccgccaaccucguccccgaagucaacaacgaagucauggcucucgaacccgucguaggcgcagccaucgcugcgccagucgccggccaacaaaacgucaucgaccccuggauucguaacaacuucguccaagcacccggcggcgaguucacuguaucgccccguaacgcccccggagaaauccuaugguccgcaccccucggaccagaccucaaccccuaccuaucucaccucgcccgcauguacaacgguuacgccggcggauucgaaguucaaguaauccucgccggaaacgccuucacagccgggaaaguaaucuucgcagcaguacccccuaauuuucccacagaaggccucuccccaagccaagucaccauguuuccccacaucgucgucgauguccgucaacuagaacccguccucauucccuuacccgaugucagaaacaacuucuaccacuacaaccaaucgaacgaccccaccaucaaacucauagcaaugcucuauaccccucuccgcgcaaauaacgccggcgaugacguauucacagucaguugucgcguccucacacgaccaucaccggacuucgacuucaucuuucuaguucccccuaccgucgaaucacgaacuaaaccuuucuccguacccguccucaccgucgaagaaaugacaaauucacgcuuccccaucccacuugaaaaacuauucaccggcccguccucagccuucgucguacaaccacaaaacggacgcugcacaacugacgguguccuccucggaaccacccagcucucccccgucaacaucugcacauuccgaggugacgucacccacauaaccggcucccacaacuacacaaugaaccucgcaucccaaaacuggaacaacuacgaccccacagaagaaauccccgcaccccuugguacacccgauuucgucgguaaaauccaaggcguccuaacccaaaccacucgcgccgacggcuccacccgcggccacaaagccaccgucuacaccggcuccgccgacuucgcaccaaaacugggccgaguccaauucgagacagacaccaaccacgacuucgaagccaaccaaaacaccaaauucacccccgucggcgucauccaagacggaggcacaacacaccgaaacgaaccacaacaauggguccuccccuccuacucaggccgaaauacacacaaugugcaccucgcccccgccguagcacccaccuucccaggcgaacaacuucucuuuuuccgcuccacaaugcccggcugcuccggcuacccaaacauggaccucgacugccuccuaccccaagaauggguccaacacuucuaccaagaagcagcuccugcccaaucugacgucgcgcuccuccgcuucguaaacccagauaccggccgaguacuuuucgagugcaaacuccacaaauccggcuacgucaccgucgcccacaccggccaacacgaccucguaaucccacccaacggcuacuuccgauucgacuccugggucaaccaauuuuacacacucgcccccaugggcaacggaacuggacgacgccgcgucuaa

SEQ ID NO: 37888 - RNA, 1620 nt, Artificial Sequence
  derived and/or modified sequence opt11 from VP1__Norovirus_and/or_Norovirus-like__KX353957
augaaaauggcguccaaugacgccaaccccagcgacggcagugcugcaaaccuaguccccgaaguaaacaacgaagucauggcccuagagcccguagucggcgccgccaucgcagcgccaguagccgggcaacaaaacgucauagacccauggauucgcaacaacuucguccaagccccaggaggcgaguucaccgucuccccacgcaacgccccuggcgaaauacucugguccgcaccccuuggacccgaccucaaccccuaucucagccaucuggcccgcauguauaauggcuacgccggcggauucgaaguccaaguuauccucgccggaaacgccuucaccgcaggcaaaauaaucuucgcagccgucccacccaacuuccccacugaaggccuaucccccucccaagucaccauguucccccacaucauaguugacguccgacaacuagaaccaguccuaauaccccugccagacguacgaaacaacuuuuaucacuacaaccaaucaaacgacucuaccauaaaacuaaucgcaaugcuauacaccccucuccgagccaacaacgccggagaagacgucuucacaguuuccugccguguacucacacgacccucccccgacuucgacuucaucuuccucgucccacccaccgucgaaucccgcacaaaacccuucaccguccccauacuaacugucgaagaaaugacaaacagccgcuucccaauccccuuagaaaaacucuucaccgguccuuccucagcuuucgucguccagccccagaacggacgcugcaccaccgacggcguucuccuaggcaccacccaacucucucccgucaacaucugcaccuuccgcggcgacgucacccacaucgccggaucccgaaacuacaccaugaaccucgccucucucaacuggaacaauuacgaccccaccgaagaaaucccagcuccccucggaacccccgacuucguuggaaaaauucaaggcguccucacacaaacaacuaaaggcgacggaucaacccgcggccacaaagccaccgucuucaccggauccgcccccuucacacccaaacucggcucaguacaauucucaaccgacacugaaaacgacuucgagacacaccaaaacaccaaauucacccccgucggcgucauucaagacggcggcacaacccaccgaaacgaaccccaacaauggguccuacccucauacuccggacgcaauguccaaaacguucaucucgcccccgccguagcgccaaccuuucccggagaacaauuacucuucuuccgauccaccaugcccggcugcuccggcuacccuaauauggaccucgauugccuacucccccaagaauggguacaacacuucuaucaagaagcagcaccagcccaaucugacgucgcccuacuaagauucgucaaccccgacaccggccgcguacucuucgaaugcaaacuacacaaauccggcuacgucaccgucgcccacacaggacaacacgaccucguaauaccucccaauggcuauuucagauucgacuccugggucaaccaauucuacacccuugcccccaugggcaacgguaccggacguagacgcguauaa

SEQ ID NO: 37889 - RNA, 1620 nt, Artificial Sequence
  derived and/or modified sequence opt11 from VP1__Norovirus_and/or_Norovirus-like__KF509947
augaagauggccucuuccgacgccaaccccagcgacggcuccgcugccaaccuaguccccgaggucaauaacgaagucauggcccucgaacccgucguaggugccgcaaucgccgcaccagucgccggccaacaaaacgucauugaccccuggauacgcaacaauuucguacaagcucccggcggcgaguucaccgucucaccccguaacgcccccggagaaauccucugguccgccccacucggccccgaccuuaacccauaccucucccaccuugcccgcauguacaacggcuaugccggaggauuugaaguccaaguaauccucgccggaaacgcauucaccgccggaaaaauaaucuucgccgcagucccuccgaacuucccaaccgaaggacucuccccuucccaaguaacuauguucccccacaucauaguagacguccgccaacucgaacccguccuuaucccacucccagauguccguaacaacuucuaccacuacaaccaauccaaugaccccacaaucaaauuaauagccaugcuuuacacuccccuacgcgccaauaaugccggcgacgacguuuucaccguauccugccguguccucacacgccccucccccgauuucgacuucaucuuccucgucccucccaccguagaaucccgcacgaaacccuucuccguccccauccucacuguagaagaaaugaccaacucaagauuccccauaccacucgaaaaacucuucacaggcccaagcuccgcauucgucguccagccacaaaacggacgguguaccacagacggcguacuccucggcaccacacaacuuucccccgucaacaucugcaccuuccgaggcgacauaacccacaucacaggaaguagaaacuacacaaugaaccucgcuucucaaaauuggaauaacuacgacccaacagaagaaauuccagcuccccucggaacgcccgacuucguagguaaaauccaaggaguccuaacccaaaccacccgagccgacggcagcacccgcggacacaaagccaucgucuacaccggcucagccgacuucgcacccaaacuuggccgaguccaauucgaaacugacacugaucacgacuucgaagccaaccaaaacacaaaauucacaccggucggcgucacccaagacggcuccaccacccacagaaaugaaccccaacaauggguucuccccuccuacuccggccgcaauacucacaacguccaccucgccccagccgucgcccccaccuucccaggagaacaacuacucuucuuccgcucaacaaugcccgguugcuccggcuacccaaacauggaucucgacugccuucucccacaagaguggguccaauauuucuaccaagaagccgcgcccgcacaauccgacgucgcccuacugcgauucgucaaccccgacaccggccgaguccucuucgaaugcaaacugcacaaaucaggcuaugucacaguagcccauaccggccaacacgaccuagucaucccacccaauggcuacuuccgcuucgacuccugggucaaccaauucuacacacucgcgcccaugggcaacgguaccggccgccgccgagucuaa

SEQ ID NO: 37890 - RNA, 1620 nt, Artificial Sequence
  derived and/or modified sequence opt11 from VP1__Norovirus_and/or_Norovirus-like__AB504326
augaaaauggcauccaacgacgcaaacccaucagauggcucggcugcaaauuugguccccgaagucaacaacgaagucauggcccucgaacccgucgucggcgcugccaucgcugcucccguagcgggccaacaaaacgucaucgacccauggauccgcaauaacuucguccaagcaccaggaggugaguucacugucuccccacgcaacgcccccggcgaaauccuauggucagcaccccuaggccccgaccuaaaccccuaccucucccaccuagcucgaauguacaacggcuacgccggcggcuucgaaguacaaguuauacuugcgggcaacgccuucaccgccggaaaaaucaucuucgccgccgucccaccaaacuucccaaccgaaggcuuauccccaucccaaguaaccauguucccccauauaaucguugacguccgccaacucgaacccguacucauaccccuccccgacguccgcaacaacuucuaccacuacaaccagucaaacgacucaaccauaaaacucauugcaaugcuauacacaccccugagagcaaauaacgccggcgaagaugucuucaccguaucaugccgcguccuaacccgaccauccccagacuuugacuucaucuuccuaguacccccaaccgucgaaucccgcaccaaacccuuuaccguccccauccucacagucgaagaaaugacuaacucccguuuucccaucccccucgaaaaacucuucacaggccccuccagcgccuuugucguccaaccccaaaacggucgaugcaccacagacggcguccuccucggcaccacacaacucuccccagucaacaucugcaccuuccgaggugacguuacacacaucgccggcucccgcaacuacauaaugaaccucgcaucccuaaacuggaacaacuacgaccccacugaagagaucccagcuccccucggcacccccgacuucguaggaaagauccaaggcguccucacacaaaccacuaagggcgacggauccacgcgcggacacaaagccacuguuuacacaggaucugcccccuucaccccaaaacucggcuccguccaguucuccaccgacaccgaaaacgauuucgaaacacaccaaaacacccgcuucaccccagucggaguuauccaagacggcggcaccacacaccgcaacgaaccacaacaauggguccucccauccuacagcggacgcaacguucccaacguccaccucgcccccgccguugcccccacuuuucccggcgaacaacuacucuucuuccgcuccacuaugcccggcugcucugguuacccaaacauggaccucgacugccuacucccacaagaauggguccaacacuucuaccaggaagccgcucccgcccaauccgacgucgcccuccuccgcuucguaaaccccgacacaggccgcguccucuucgaaugcaaacuccauaaaucaggauacgucaccgucgcccacaccggccaacacgaccuuguaauaccacccaacggcuacuuccgauucgacuccuggguaaaccaauucuacacccucgcgcccaugggcaacgguaccggacggcgaagagucuga

SEQ ID NO: 37891 - RNA, 1620 nt, Artificial Sequence
  derived and/or modified sequence opt11 from VP1__Norovirus_and/or_Norovirus-like__KX354056
augaaaauggcuuccagcgacgcuaaucccucagacggauccgccgccaacuuaguccccgaagucaacaacgaagucauggcccucgaaccaguuguaggcgcugccauagcggcccccgucgccggccaacaaaacgucauagacccauggauacgcaacaacuucguccaagccccuggaggcgaguucaccgucuccccacgcaacgcacccggcgaaauccuauggucagccccacuaggacccgaucucaaccccuaccucucucaucucgcccgcauguauaacgguuacgcaggcggcuucgaaguccaagucauacucgccggaaacgcauucaccgccggcaaaguaaucuucgccgccgucccacccaacuuccccaccgaaggccucucgcccucucaaguaaccauguucccccacaucgucgucgacgugagacaacuagaaccaguccuaauaccacuccccgacguccgcaacaauuucuaccacuacaaccagucaaacgacccaaccaucaaacuuaucgcaaugcucuacaccccacuccgagccaauaacgcaggagacgacgucuucaccgucuccugccgcguacuaacacgcccauccccagacuucgacuucaucuuccuagucccaccaaccgucgagucccgcaccaaacccuuuuccguacccauccucaccgucgaagaaaugaccaacucccgcuuccccaucccacucgagaaacuauucaccggccccucauccgcguucgucguccagccacaaaacggacgaugcaccacagacggcguccuccucggcaccacccaacucucccccgucaacauauguaccuuccgcggcgacgucacccacauaacagggucccgcaacuacacgaugaaccucgcaucccaaaacuggaacaauuacgacccaaccgaagagauccccgccccacugggcacuccagauuucguggguaaaauccaaggcguacucacacaaacgacccgcgccgacggcuccacccgaggccacaaagccacggucuacacaggcucagcagacuucgccccaaaacuaggacguguucaauucggaaccgauaccgaccacgacuucgaagccaaccaaaacaccaaauucaccccagugggagucauccaagacgguggcacaacccaccgcaacgaaccacaacaauggguucuacccagcuacuccggacgaaacacccacaacguacaccuagccccagcagucgcaccaaccuuccccggugaacaacuacuauucuuccgcuccaccaugccuggcugcuccgguuauccaaauauggaucuugacugccuucuaccccaggaauggguacaauacuucuaccaagaggcagccccagcccaaucagacguugcucuacuacgauucguuaauccagacaccggccguguccuuuucgaaugcaaacuacacaaacucggcuacguaaccgucgcccacacgggacaacacgaccucguaaucccacccaacggauacuuccgcuucgauuccugggucaaccaauucuacacccuagcacccaugggcaaugguaccggccgccgccgcguuuaa

SEQ ID NO: 37892 - RNA, 1620 nt, Artificial Sequence
  derived and/or modified sequence opt11 from VP1__Norovirus_and/or_Norovirus-like__AB541255
augaaaauggccucgaacgacgccaaccccuccgacggcuccgcagccaaccucguccccgaagucaacaacgaggucauggcacuagaacccgucguaggugcagcaaucgccgccccuguagccggccaacagaacgucaucgaccccuggauccgaaacaacuucguacaagcacccggaggcgaauuuaccgucagcccccgcaaugcccccggagagauccugugguccgccccacucggccccgaccucaacccuuaccucucccaccucgcucgcauguacaacggcuacgcaggaggauuugaaguacaagucaucuuagcaggaaacgcauucaccgccggcaaaaucaucuucgcagcuguaccaccgaacuucccaacagaagggcucucccccucccaaguuaccauguucccccacaucaucgucgacguacgccaacucgagcccguccuaaucccccuccccgacguacgcaacaacuucuaccacuacaaccaaagcaaugacuccaccauaaaacuaaucgccauguuauacacaccccuccgagccaacaacgccggcgaagacgucuucaccguuuccugccgcguccucacccgaccaucccccgacuucgacuuuauuuuccucguucccccaaccgucgaaucacgcacaaaacccuucaccguacccauccucacuguagaagaaaugaccaacucucgauuccccaucccccuagaaaaacucuucaccggccccuccucugccuucgucguucaaccacagaacggccgcuguaccacagacggcguccuccuaggcaccacccaacucagccccgucaacaucugcacauuuagaggcgacgucacccacaucgcaggcucccgaaacuacacaaugaaccucgcaucccucaacuggaacaauuaugaccccaccgaagaaauuccagcaccccuaggaacccccgauuucgucggaaagauccaaggaguacuuacacaaaccaccaagggcgacggcucaacucgaggccacaaagccaccgucuacaccggcucagccccuuucacccccaaacucggcucuguacaauucuccaccgacacagaaaacgacuucgaaacccaccaaaacacacgcuucacacccgucggagucauccaagacggcggcaccacccaucgaaacgagccacaacaguggguacuccccucauacuccggacgcaacguacccaacguccacuuagcccccgccgucgccccgacguuccccggcgaacaacuccucuucuuccgaagcaccaugccagguugcucaggcuaccccaauauggaccucgacugccuccucccacaagaauggguacaacacuucuaccaggaagccgccccagcccaauccgacgucgcacuucuucguuuugucaaccccgacacaggcagaguccuauucgaaugcaaacuccacaaaucuggcuacgucacagucgcccacacaggccaacacgaccuuguuaucccgcccaacggauacuuccgcuucgacuccugggucaaccaauucuacacacuagccccaaugggaaacggcaccggccgccgacgcgucuaa

SEQ ID NO: 37893 - RNA, 1620 nt, Artificial Sequence
  derived and/or modified sequence opt11 from VP1__Norovirus_and/or_Norovirus-like__KP784696
augaaaauggccuccagcgacgccaaccccuccgauggaucagccgccaaccucguccccgaaguuaacaacgaaguaauggcccucgaacccgucgucggcgccgcuaucgccgcccccgucgccggccaacaaaacgucaucgaccccuggauccgcaacaacuucguccaagcucccggaggcgaauuuacagucucaccaagaaacgcuccuggcgaaauccuuugguccgcaccccucggacccgaccucaaccccuaccucucacaccucgcccgcauguacaauggcuacgccggcggcuucgaaguccaaguuauucucgccggaaacgcauucacugccggcaaaguaaucuucgcagccguuccacccaauuuccccaccgaaggacucucccccucccaagucaccauguucccccacauagucgucgacguacgacaacucgaacccguccuuaucccccucccggacguacguaacaacuucuaucacuacaaccaauccaacgacccaacgaucaaacucauugccaugcuauacacaccccuacgcgcaaacaacgcaggcgacgacgucuucaccgucuccugccgcguccuuacccgacccucaccagacuucgacuucauauuccucgucccucccaccguagaaucccgcaccaaacccuucuccguacccguacucaccguagaagaaaugaccaacucccgcuuucccauuccccucgaaaaacucuucaccggaccauccucagcauucgucguccagccacaaaacggccgcugcacuaccgacggcguccuacuaggcaccacccaacucucaccuguaaauaucugcacauucagaggcgacgucacccacaucaccggaucccgaaacuacaccaugaaccucgccucccaaaacuggaacaacuacgacccuacagaagaaauccccgcaccccucggcacccccgauuucgucggagaaauccaaggcguccucacccaaaccacacggacagacggcucaacccgcggucacaaagccaccgucuauaccggaucagccgacuuugcccccaaacucggucgaauacaauucgaaacagacaccgaccacgacuucgaagccaaccaaaauacuaaauucacucccgucgguguuauacaagacggauccaccacccacagaaacgaaccacaacaauggguccuacccuccuauucaggccgcaacacccacaacguccaccucgcccccgccgucgcccccaccuuccccggcgaacaacuacuauucuuucgcuccaccaugcccggcugcuccggcuaccccaacauggaccucgacugccuccucccacaggaauggguccaauacuucuaccaagaagcagcccccucccaaucugacgucgcccuucuacgcuucguuaaccccgacaccggacguguccuauucgaaugcaaacuacacaaauccggcuacgucaccguagcucauacgggacaacacgaccuaguuaucccacccaacggauacuuccgcuucgauuccugggucaaccaauuuuacacccuagcacccaugggcaacggaaccgguagacgccgcgucuaa

SEQ ID NO: 37894 - RNA, 1620 nt, Artificial Sequence
  derived and/or modified sequence opt11 from VP1__Norovirus_and/or_Norovirus-like__KX354042
augaaaauggccuccucugacgccaaccccuccgacgguuccgccgccaaccucguaccagaaguaaacaaugaagucauggcccuggaaccugucgucggagccgcaaucgcggcuccaguagccggacaacaaaacguaaucgaccccuggauacgcaacaacuuuguccaagcccccggaggugaguucaccgucuccccacgcaacgcacccggcgaaauccucuggucagcaccccucgguccagaccucaacccauaccucucacaccucgcccgcauguacaacggcuacgcaggaggcuucgaaguccagguaauccucgcuggcaaugccuucaccgccggaaagaucaucuucgcggccguacccccaaacuuccccacagaaggccuaucucccucccaaguuaccauguucccccacaucaucguagacguacgucaacucgaaccaguacucaucccccuccccgacguacgcaacaacuucuaccacuauaaccaauccaacgacccaacaauaaaacuuaucgccaugcuauacacaccccucagagccaacaacgccggcgacgacgucuucacaguauccugccgcgucuuaacgcgacccuccccagacuucgacuuuaucuuccucguuccucccacaguagaaucccgcaccaagcccuucucagucccaguccucaccgucgaagaaaugaccaacucucgguuccccauuccacuagaaaagcuauucacaggacccuccagcgccuucguaguacaaccacaaaacggccgcuguaccaccgacggcguccuacuagguaccacacaacuuuccuccguaaacaucugcaccuuccgaggcgacguaacccacaucaccggcucacguaacuacaccaugaaccucgccagucaaaacuggaacaacuacgaccccacagaagaaauacccgcgccccuuggaacaccagauuucgucgguaaaauacaaggaaugcucacccaaaccacccgcaccgacggauccacccgaggccacaaagccacagucuacaccggcagcgccgacuucgcccccaaacucgguagaguacaauucgaaacagacaccgaucacgacuucgaagcuaaccaaaacaccaaguucaccccaguaggugucauccaagacggaucaacaacacaccgcaacgaaccccaacaauggguccuucccagcuacuccggccgcaauacacacaacguccaccucgcacccgccgucgccccaaccuuccccggcgaacaacuccucuucuuccgcuccaccaugcccggaugcucuggcuacccuaauauggaccucgacugccuccuaccgcaagaauggguacaauacuucuaccaagaagccgcccccgcacaauccgacguagcacuccuacgcuucguaaacccugacaccggccgcguccucuucgaaugcaaacuccacaaauccggcuacguaacggucgcccacacaggacaacacgaccucgucauaccacccaacggcuacuucagauucgacucuugggucaaucaauucuacacccuugcccccaugggcaauggcacaggccgccgccgcgucuaa

SEQ ID NO: 37895 - RNA, 1620 nt, Artificial Sequence
  derived and/or modified sequence opt11 from VP1__Norovirus_and/or_Norovirus-like__KX354007
augaagauggcaucaucugacgccaacccaucagacggaucagcagccaaccugguacccgaagucaacaacgaagucauggcccucgaacccgucguaggcgccgccaucgccgccccaguagccggacaacaaaauguaaucgacccauggauacgcaacaacuucguccaagcaccaggaggcgaauuuaccgucaguccacgcaacgcaccaggagaaauccugugguccgccccacucggcccagaccucaacccauaccucucccaccuagcccgaauguacaacggcuacgcaggaggauucgaaguacaagucauccucgcaggcaacgccuuuaccgccggcaaagucaucuucgcagccgucccaccaaacuuccccacagaaggccuaucacccucacaagucaccauguucccccacauuguagucgacguucgacaacuagaaccuguccucaucccccuaccagacguacgaaacaauuucuaccacuacaaccaaagcaacgacccaaccauaaaacugauagccaugcucuacacaccccuccgcgcgaacaacgccggcgacgacguguucaccgucucaugccgcguacucacccgacccucucccgacuuugacuucaucuuccucgucccacccaccguugaaucccgcaccaaaccauucucaguccccguacuaaccgucgaagaaaugacuaacucccgcuuccccaucccccucgaaaaacucuuuacagguccauccucggccuucguaguccaaccucaaaacggacgcugcaccaccgacggcguucuccucggcaccacccaacugucacccgucaacaucugcacauuucgaggcgaugucacccacauaacgggcucacgcaacuacacuaugaaccuugccucacaaaacuggaacaacuacgaccccaccgaagaaguaccugcaccacuuggaacacccgacuuuguuggaaagauacaaggcaugcuaacacaaacaaccagaaccgacggcuccacccgcggccacaaagccaccgucuauacagguagcgccgacuucacccccaaacucggaagaauccaauucgaaaccgacacagaccacgacuucgaagccaaccaaaacaccaaauucacaccugucggcgucauccaagacggcuccaccacccaccgaaacgagccccaacaauggguccuucccuccuacagcggucgcaacacacacaacguccaccuagcacccgcagucgccccaacauuccccggcgagcaacuccucuucuuccguagcacuaugccagguugcagcggguauccaaauauggaucucgacugccuccucccacaagaauggguacaauacuucuaccaagaagcagcccccgcccaaucagaugucgcccuacuccgcuucgucaaccccgacaccggccgcguucuauucgaaugcaaacuacacaagucaggauacgucaccguagcccacacuggccaacacgaucucgucaucccucccaacggauacuuccguuucgacuccugggucaaccaauucuauacccucgcccccaugggcaacggcacaggaagacgucgaguuuaa

SEQ ID NO: 37896 - RNA, 1620 nt, Artificial Sequence
  derived and/or modified sequence opt11 from VP1__Norovirus_and/or_Norovirus-like__KT780393
augaaaauggcaucuucagacgccaacccauccgacggauccgccgcaaaccucguaccugaagucaauaacgaaguaauggcacucgaacccgucgucggcgccgcuaucgccgcccccguagcuggccagcaaaacguaaucgaccccuggauucgcaacaacuucguucaagcuccagguggcgaguucacagucuccccacgcaacgcccccggcgaaauccucugguccgccccucucggccccgaccucaacccauaccugucccaccuugcccgcauguacaauggcuacgcaggcggauucgaaguccaagucauccuagcuggaaacgcuuucaccgccggcaaagucauauucgccgccguacccccaaacuucccaaccgaaggccuauccccuucacaagucaccauguucccacacaucgucgucgacguccgucaacuagaaccaguacuuaucccccuccccgacguccgaaauaacuucuaccacuauaaccaauccaacgaccccacaaucaaacucauagccaugcuguacaccccacuccgggccaacaacgcaggagacgacgucuucaccguauccugcagaguccucacacgccccuccccugacuucgacuucauauuccuaguacccccaacagucgaaagccgcaccaaaccauucucaguaccuguccucaccgucgaagaaaugacaaacucucgcuuucccaucccccuggaacgccucuucaccggccccagcuccgccuucgucguacagccccaaaacggccgaugcacaaccgacggcguccuccuuggaaccacccaacuaaccccaguaaacaucugcacauuccgaggugauguuacccacauaaccggcucacggaauuacaccaugaaccucgccucccagaacuggaacaacuacgacccuaccgaagaaauacccgccccacucggcacccccgacuucguuggaaagauacaaggcaugcucacacaaaccacccgcacagacggcuccaccagaggacacaaagcaacggucuacaccggcucagccgauuuugcccccaagcucggccgaguacaauucgaaaccgacaccgaccacgacuucgaagccaaucaaaacaccaaauucacaccaguaggcgucauccaagacgguuccacgacacaccgaaacgaaccccaacaauggguccuccccucauacuccggccgcaauacacacaacguccaccuagccccagccgucgcccccaccuuccccggcgaacaacuccucuucuucagauccaccaugcccggaugcagcggcuaucccaacauggaucucgacugcuuacucccccaagaauggguccagcacuucuaccaagaagcagcccccgcucaaucagacguagcacuccuccguuucguaaaccccgacacaggucgcguccucuucgaaugcaaacuccauaaguccggcuacguaaccgucgcucacacaggccaacaugaccuagucaucccgccaaacggcuacuuccgcuucgacuccugggucaaccaauucuacacacucgcccccaugggaaacggcacaggaaggcgacgaguauaa

SEQ ID NO: 37897 - RNA, 1620 nt, Artificial Sequence
  derived and/or modified sequence opt11 from VP1__Norovirus_and/or_Norovirus-like__KX354043
augaaaauggccucauccgacgccaacccguccgacggauccgcagcuaaccuuguccccgaaguaaacaacgaagucauggcgcuugaaccaguaguaggagccgccaucgcugccccugucgcaggccaacaaaacgucaucgacccauggauccggaauaacuuuguacaagccccaggcggcgaguucacaguuuccccacgaaacgccccuggcgaaauccuauggagcgcaccccucggccccgaccucaacccuuaccucucccaccucgcccgcauguacaacggcuacgccggcggcuucgaaguccaagucauacucgcaggcaacgccuucaccgccggcaaaaucaucuucgccgccgucccacccaacuuccccaccgagggacucucaccaucacaaguaaccauguucccgcacauaauagucgacgugagacaacucgagcccguacucaucccucucccagacguacgcaacaauuucuaccacuacaaccaaagcaacgacucaaccauuaaacuuauagccaugcuauacacaccccuccgcgcaaacaacgccggagacgacguauucaccgucuccugccgagugcuaaccagacccucccccgauuuugacuucaucuucuuagugcccccaaccgucgaaucccgcacaaaaccauucuccguacccguacucaccgucgaagaaaugacgaacucccguuuccccaucccucucgaaaaacucuucaccggacccucuuccgccuucgucguccaaccccaaaacggaagaugcaccacagacggaguccuucugggaacgacucaacuaucaccggucaauauaugcaccuuccgaggcgauguuacccacauaaccggaucaagaaacuacaccaugaaccucgccucccaaaacuggaacaacuacgaccccaccgaagaaauuccagccccacuaggcaccccagacuucguaggcaaaauccaaggcaugcuaacccaaacaacccgaacggacggauccacacgaggccacaaagccaccgucuacacaggcuccgccgacuucgcccccaaacuuggccgcguccaauucgaaaccgauacugaccacgacuucgaagccaaccaaaacaccaaauucaccccagucggcgucauccaagacggaucaaccacccaccgcaacgaaccccaacaauggguucuccccucauacucaggccgcaauacauacaacguccaucucgcacccgccgucgccccaacauuccccggcgaacaacuccucuucuuccgaucaaccaugcccggaugcucuggauacccuaacauggaccucgacugccuccucccccaagaauggguacaacacuucuaccaagaagcagccccugcacaaucagacgucgcccuacuacgcuucgucaacccagacaccggccgcguucucuucgaaugcaaacuccacaaaucgggcuaugucacagucgcccacaccgggcaacaugaucucgucaucccucccaacggauacuucagauucgacagcugggucaaccaauuuuacacacuagcacccaugggcaacggaacaggccgccgaagagucuaa

SEQ ID NO: 37898 - RNA, 1620 nt, Artificial Sequence
  derived and/or modified sequence opt11 from VP1__Norovirus_and/or_Norovirus-like__KX354008
augaaaauggcaucaucggacgccaaccccagcgacggaucagccgccaaccugguaccagaaguuaacaacgaaguaauggcauuagaacccgucgucggggcagcaaucgcagcccccgucgcaggucaacaaaacguaaucgacccauggauacgaaacaacuucguucaagcacccggcggcgaguucaccgucuccccacgcaacgccccgggcgaaauccuaugguccgcgccccucggaccagaccucaaccccuaccuaucucaccucgcccgcauguacaaugguuacgccggcggcuucgaaguacaagucaucuuagccggaaacgccuuuaccgccggcaaagucauauuugcagccgucccucccaacuuccccacugaaggacucucucccucccaagucaccauguucccccacaucguagucgacguccgccaacucgaacccguccucaucccacuccccgacguccgcaacaacuucuaccacuacaaccaguccaacgacccaacaaucaaauuaauagccaugcuauacacaccccuccgcgccaacaaugccggagacgacguauucacagucucaugccguguccuaacccgacccuccccagacuuugacuucaucuuccucguaccacccaccguagaaucccgcaccaaacccuucuccguacccguacuaacagucgaagaaaugaccaacucccgcuuccccaucccccucgaaaaacucuucacagggcccucauccgcauucgucguccaaccccaaaacggccgcugcaccaccgacggcguccuccucggcacaacccaacuaucucccguaaacaucugcacauuccgcggagacguuacccacaucaccggcucccgcaacuacacuaugaaccuugcuucacaaaacuggaacaacuacgaccccacugaagaaguccccgcccccuuagguacccccgacuucguaggaaagauccaagguaugcuaacgcaaaccacaagaacugacggaucaacccgcggacacaaagccaccguauacaccgguagugccgauuucacacccaagcuaggacgcauccaauucgaaaccgacacagaccacgacuucgaggcaaaccaaaacaccaaauucacccccgucggagucauacaggacggaucuacgacacaccgcaacgaaccccaacaauggguccucccauccuacucuggccgaaacacccacaacgugcaccucgcacccgcagucgcccccaccuucccaggagaacagcuccucuucuuccgauccaccaugcccggcugcuccggcuacccaaacauggaccucgacugccuacuaccccaagaauggguccaauauuucuaccaagaagcagcccccgcccaaucagacgucgcccuccuccgcuucgucaacccagacaccggucgcguccucuuugagugcaaacuccacaaaucgggauacguaacagucgccuacacaggacaacacgaucucgucaucccacccaacggcuacuuccguuucgauuccuggguaaaccaauucuacacauuagcacccaugggcaacgguaccggccgucgacgagucuaa

SEQ ID NO: 37899 - RNA, 1620 nt, Artificial Sequence
  derived and/or modified sequence opt11 from VP1__Norovirus_and/or_Norovirus-like__KR904217
augaaaauggccuccucggacgcaaaccccucagacggcucuacagccaaccuugucccugaagucaauaacgaaguaauggcacucgaacccguagucggcgccgcaauagccgcccccguugccggccaacaaaacgucaucgaccccuggauccgaaauaacuucguccaagcccccggaggagaguucaccgucuccccacgcaacgcccccggcgaaauacuuugguccgcuccccucggccccgaccucaaccccuacuuaucacaccucgcccgcauguacaacggcuacgccggagguuucgaaguacaagucauucuagccggaaacgccuuuacagcuggaaaaaucaucuucucggccgucccacccaacuucccuaccgaaggccucuccccgagccaagucacaauguucccucauauaaucgucgacguccgccagcucgaaccaguccuaaucccccucccagacguaagaaacaacuuuuaccacuacaaccaauccaaugacccuaccauaaaacucaucgcaaugcucuacaccccacuccgcgccaacaacgcaggagacgacgucuucaccgucucaugccguguucucacccgccccuccccugauuucgacuuuauuuuccucgucccacccaccgucgaaucccgcaccaaacccuucuccguccccauccucacagucgaagaaaugacaaacucccgcuucccaaucccucuugaaaaacuauuuaccggccccucauccgccuucgucguccaaccacaaaacggacgaugcuccaccgacggagugcuacucggcacaacccaacucucacccguaaacaucugcaccuuccguggcgacguaacccacauagcuggaucacacaacuacaccaugaaccucgccucccaaaacuggucaucauacgacccaacagaagaaaucccugccccucuaggaacccccgacuucgucggcaaaauccagggaguacucacccaaaccacgagauccgauggcuccacgcgcggccacaaagccaccgucuacacuggcagcgcagacuucucaccuaaacuaggccgaguccaauucgccaccgacaccgacaacgacuucguaucaaaccaaaacaccaaauucaccccagucggagugauccaagacggagacaccgcccaccgaaaugaaccccaacaaugggugcuaccaagcuacucaggccgcaacauccacaacguccaccucgcacccgccgucgccccaaccuuccccggcgaacaacuucuguucuuccgcuccaccauaccaggcugcuccggauaccccaauauggaccuugacugccuacuuccccaagaguggguccaauacuucuaccaagaagcagcucccgcccaaucugacgucgcccuccuccgauucgucaauccagacaccggccgcguccucuucgaaugcaaacuucauaagucaggcuacgucacaguugcccacaccggacaacacgaccucguuaucccacccaauggcuacuuccgauucgacagcugggucaaccacuucuacacccucgcucccaugggcaacggaaccggacgccgccgcgucuaa

SEQ ID NO: 37900 - RNA, 1620 nt, Artificial Sequence
  derived and/or modified sequence opt11 from VP1__Norovirus_and/or_Norovirus-like__KJ685412
augaaaauggcaucaucagaugccaaccccuccgacggcagcgccgccaaccucguacccgaagucaacaacgaggucauggcacuugaacccgucgucggcgcagcaaucgccgcacccguugccggacagcaaaacgugaucgacccauggauacgaaacaacuuuguacaggcaccaggcggcgaauuuacagucucuccccgaaacgcaccaggcgaaauccucugguccgcaccacuuggaccagaccucaaucccuaccucucacaccucgcacgaauguacaacggcuacgccggaggcuucgaaguccaagucauccucgccggcaacgccuucacagcuggcaaaguaaucuucgccgccguucccccaaacuuccccacagaaggacuaucgcccucccaagucaccauguucccccacauugucgucgacguccgccaacucgaacccguccuaauuccccuccccgacguccgcaacaacuucuaccacuacaaccaauccaacgacccuaccaucaaacuaaucgccaugcucuauaccccacuccgcgccaacaacgccggagacgacgucuucacaguaucaugccgaguacucacccgccccuccccugacuucgacuuuauauuccucguuccacccacagucgaaucacgcaccaaacccuucuccguccccguacuaacagucgaagaaaugacaaacucccgcuuccccaucccucuagaaaaacucuucaccggccccuccucagcauucgucguccaaccccaaaacggacgcugcacaaccgaugguguccuacuaggcaccacacaacuauccccggucaauauaugcaccuucagaggcgaugucacacacaucaccggcucacacaacuacaccaugaaccuagcaucccaaaacuggaacaacuacgacccgaccgaagaaaucccagcaccccucggcacccccgacuuugucggcaaaauacaaggcguccucacccagaccacccgcaccgacggcucuacccgcggccacaaagccacuguauacaccggcuccgccgacuuugccccaaagcucggacgcguacaguucgccaccgacaccgaccacgacuucgaagccaaccaaaacacaaaauucacccccgucggagucauccaagacggcggcacaacccaccguaacgaaccccaacaauggguacucccauccuacucaggccgcaacacccacaacguucaccuagcccccgccgucgccccuaccuuccccggcgagcaacuccucuucuuccgcuccacaaugccaggcugcucuggcuaccccaauauggaccucgacugccuacucccacaagaauggguccaauauuucuaccaggaggccgccccagcccaaucagacgucgcccuccuacgguucgucaaccccgacaccggacgcguccuauucgaaugcaaacuccacaaaucaggcuacguaaccguagcacacaccggacaacacgaccucgucauacccccaaacggauacuuccgcuucgacucauggguaaaccaauucuacacccuggcccccaugggaaacggcacaggccgacgccgcgucuaa

SEQ ID NO: 37901 - RNA, 1620 nt, Artificial Sequence
  derived and/or modified sequence opt11 from VP1__Norovirus_and/or_Norovirus-like__KF008240
augaaaauggccuccuccgacgccaaccccuccgacgguucagccgcgaaccuugucccagaagucaacaacgaaguaauggcccucgaaccaguagucggcgccgcaaucgcugccccggucgcaggacaacaaaacgucaucgacccauggauccgcaacaacuucguccaagcacccgguggcgaguucaccguaucgccgcgaaacgcacccggugaaauucucuggucagcaccccucggccccgaccuaaacccauaccuaucccaccucgcccguauguacaacggauaugcaggaggauucgagguccaaguaauccuagcaggaaacgcauucaccgccggaaaagucauauucgccgccgucccacccaacuuccccaccgaaggccuaucccccucacaagucacuauguuuccccacauagucgucgacguucgccaacucgaacccguccuaaucccacuaccagacguacgcaacaacuucuaccacuacaaccaauccaacgauccaaccaucaaacuuaucgccaugcucuacacaccacuacgcgcaaacaaugcaggagacgacguauucaccgucucaugccgaguccugacccgacccagccccgacuucgacuucaucuuccuaguacccccgacagucgaaucacgcacaaaaccauucuccgucccaguacuaaccguagaggaaaugaccaacucacgauuccccacaccccuugaaaaacucuucaccggucccuccucagcauucguaguucaaccccagaacgggcgaugcaccaccgacgguguauuacucggcaccacacaacucucccccgucaacauaugcaccuuucgcggugacguaacacacauaacuggcucacgaaacuacaccaugaaccucgccucccaaaacuggaauaauuaugacccaaccgaagaaauacccgcaccccucggaaccccggacuuugucggcaagauccaaggcguccucacacaaacaacacgcaccgacggcuccacacgcgggcacaaagccaccgucuacaccggaucagccgacuucgcccccaaacuaggacgcguccaauucgaaacagacaccgaccacgacuucgaagucaaccagaacacaaaauuuacccccgucggcgucauccaagacggcggcaccacccacagaaacgaaccacaacaauggguccuccccagcuacucaggccgaaacacgcacaacguccaccucgccccagccgucgcacccacuuuucccggcgaacaacucuuauucuuccgcuccacaaugcccggaugcagcggauacccgaacauggaucucgacugccuccuuccccaagaauggguacaauacuucuaccaagaagcggccccagcacaaucggacguugcacuacuacguuucgucaacccagacacuggccggguacuguucgaauguaaacuacacaaauccggauacgucacagucgcacacaccggccaacacgaccuagucaucccgcccaacgguuacuuccgauucgacuccugggucaaucaauucuacacccuggcccccauggggaacggcaccggacgcagacgcgucuaa

SEQ ID NO: 37902 - RNA, 1620 nt, Artificial Sequence
  derived and/or modified sequence opt11 from VP1__Norovirus_and/or_Norovirus-like__KX354125
augaaaauggccuccucagacgccaaccccuccgacgguucagccgcaaaccucguccccgaagccaacaacgaaguaauggcccucgaaccagucgucggcgcugcuauagccgcccccguggccggacaacaaaaugucaucgaccccuggauccgcaacaacuucguacaagcccccggcggcgaguucacaguuuccccgcgaaacgccccaggcgaaauccucugguccgcaccacucggcccagaccucaaccccuacuuaucacaccucgccagaauguauaacggauacgcuggcggcuucgaaguccaagucauacuugcaggcaacgcauucaccgccggcaaaguuaucuucgccgccguacccccaaacuucccaaccgaaggccucucccccucacaagucaccauguuuccucacauagucgucgacguccgccaacucgaaccaguccucaucccccuucccgacguccgcaacaacuucuaccacuacaaccaaucaaaugaucccacaaucaaacuaaucgccaugcuauacacaccgcuccgcgcaaacaaugcaggcgacgacgucuucaccguaucaugccgcguccugacccgccccucuccagacuucgacuucaucuuccucguaccaccaaccguugaaucccgcaccaaacccuucucugucccaguccuuacaguagaagaaaugacaaacucccgcuucccaaucccacucgaaaaacucuucacuggccccuccucagcauuugucguccaaccacaaaacggccgcugcaccacugacggcguacuccucggcacuacacagcuaucccccguuaacaucugcaccuuccgcggugacgucacacacaucaccggcucacgcaacuacaccaugaaccuagccucccaaaauuggaacaacuacgacccaaccgaagaaauaccagcaccccuuggcacacccgacuucgucggaaaaauccaaggcaugcucacacaaacaacccgcgccgacgggagcacccgcggacacaaagccacuguauacaccggaucugccgacuucucccccaaacucggccgaguccaauucgaaaccgacacagaccacgacuucgaagcaaaccaaaacacaaaauucacccccguaggcgucauccaagacggcuccacuacccaccgaaacgaaccacaacaauggguucucccuucauacagcggccgcaacacccacaauguccaccucgcccccgccgucgcaccaaccuuccccggagaacaacuccucuucuuccgauccaccaugcccggauguuccggauacccaaacauggaccucgacugccuccuuccucaagaauggguccaauacuucuaccaagaagccgcacccgcccaauccgacgucgcccuccuucgauucguaaaucccgacaccggacgcguccuauucgaaugcaaacuccacaaaagcggcuacgucacaguagcccacaccggccaacacgaucucgucauacccccgaacggauacuucagauucgacucuugggucaaccaauucuacacccuggcccccaugggaaacggaacaggacgcaaacgagucuaa

SEQ ID NO: 37903 - RNA, 1620 nt, Artificial Sequence
  derived and/or modified sequence opt11 from VP1__Norovirus_and/or_Norovirus-like__KX354094
augaaaauggccuccucugacgccaaccccuccgacgguucugcagccaaccucgucccagaagucaacaacgaagucauggcccuagaacccgucgucggcgcagccauagccgcucccgucgcuggacaacaaaacgucauagaccccuggauacgaaacaacuucgugcaggcacccggaggcgaguucaccgucuccccacgaaacgcgccaggcgaaauucucugguccgccccacucggccccgaccucaaccccuaccugucacaccucgcacgcauguauaacggauacgccgguggcuucgaaguacaagucauccuagccggcaacgccuucaccgccggaaaagucaucuucgcagccgucccacccaacuuccccaccgaaggccucucacccucccaaguuacuauguucccccauaucgucgucgacguccgccaacuagaacccguccuaaucccccuacccgacguaagaaacaacuucuaucacuacaaccaauccaaugaccccaccauaaaacucauagcaaugcucuacacaccccuccgcgccaauaaugcaggcgacgacgucuucaccgucuccugcagaguccuuacacgacccucacccgacuucgacuucaucuuccuaguuccacccacagucgaaucacgaaccaaacccuucagcguccccguccuuaccgucgaagaaaugaccaacucacgcuuccccaucccccucgaaaaacucuucacaggaccuuccucggccuucguuguccaaccccaaaacggccgaugcacaaccgacggcguccuccuagguaccacccaacuaucccccgugaacaucugcacguuccgcggcgacgucacacacauuacggggucacgcaacuacaccaugaaccucgcaucacaaaacuggaacaacuaugaccccaccgaagaaauaccagcuccccucggcacccccgacuucgugggcaaaauccaaggaguacuuacacaaacaacccgcaccgacggcucaacacggggacacaaagccacagucuacaccggcuccgccgauuucgcaccaaaacucggccgcguccaguucgaaaccgacaccgaccacgacuucgaagccaaccaaaacaccaaauucacacccgucggagucauccaagacggcuccaccacacaucggaacgaaccccaacaauggguccuccccucauacucaggccgaaacacccacaacguccaccuugcacccgccguagccccaaccuucccaggagaacaacuacucuucuucagaucaacaaugcccggcugcucaggauacccaaauauggaccuagacugccuccuaccgcaagaauggguacaauauuucuaccaagaagccgcucccgcacaauccgacgucgcccuccuaagauucgucaaccccgacaccggccgcguucuguucgagugcaaacuccacaaauccggauacgucaccgucgcccauaccggccagcacgaccuagucaucccaccaaacggcuacuuccgcuuugauagcuggguaaaucaauucuacacucucgccccuaugggcaacggcacuggccgccgaagagucuaa

SEQ ID NO: 37904 - RNA, 1620 nt, Artificial Sequence
  derived and/or modified sequence opt11 from VP1__Norovirus_and/or_Norovirus-like__KX354058
augaaaauggcaagcuccgacgcuaaccccucagacggaucagcagcaaaccucguccccgaagucaauaacgaagucauggcacucgaacccgucguaggugccgccauagccgcccccgucgcaggccaacaaaacgucauagaccccuggauccgcaacaacuucguccaagcaccuggcggcgaguucaccguuucccccagaaacgcccccggcgaaauucuauggucagcgccgcuaggccccgaccucaaccccuaccuuucccaccucgcacgcauguacaacggguacgccgguggcuucgaaguccaagucauccuagcuggcaacgcauucaccgccggcaaaguaaucuucgccgccguacccccuaacuucccaaccgaaggacucucccccagccaagucacaauguucccacacauagucgucgacguccgccaacucgaacccgugcuaaucccccucccagacguccgcaacaacuucuaccacuacaaccaaagcaacgaccccaccauaaaacucauagcaauguuauauacgccccuacgagccaacaacgccggcgaugacgucuucacaguguccugcagaguacucacccgccccagccccgacuucgacuucaucuuccuagucccacccaccgucgaaucccgcacaaaacccuucucaguccccguccucacaguagaagagaugacaaauagccgcuucccaaucccccuugaaaaacuguucaccggcccuuccucagcauuugucguucaaccucaaaacggccgcugcacaaccgauggcguccuacucggaacaacacaacucucccccgucaauauaugcaccuuccgcggagacgucacacacauagcuggcucccgcaacuacaccaugaaccucgccucccaaaacuggaacaacuacgaucccaccgaagaaauucccgccccacucggcacccccgacuucgucggcaaaauccaaggaaugcucacccaaaccaccagaaccgacggauccacacgaggccacaaagccacaguauacaccggcuccgccgaauuugcccccaaacucggccguguccaauucgaaacugacaccgaccacgacuucgaaaccaaccaaaacaccaaauucacccccguuggcguaauccaagacggcucuaccacacaccgcaaugaaccacaacaauggguccucccuuccuacagcggacgcaacacucacaacguacaccuagccccagccgucgcccccacauucccaggggaacaacuccucuucuuucgcucaaccaugcccggcugcuccggcuaccccaacauggaccucgacugccuccucccccaagaauggguacaauacuucuaccaagaagcagcucccgcccaauccgacguggcccuccuacgauucguaaaccccgauacuggccgaguccuguucgaaugcaagcuccacaagucaggcuaugucaccgucgcacacacuggacaacacgaccuaguaaucccgcccaacggcuacuuccgcuucgacuccuggguaaaccaauucuacacacucgcacccauggguaauggcaccggccgccgccgaguauaa

SEQ ID NO: 37905 - RNA, 1620 nt, Artificial Sequence
  derived and/or modified sequence opt11 from VP1__Norovirus_and/or_Norovirus-like__KX354057
augaagauggcauccuccgacgcaaaccccuccgacggaucagccgccaaucucguccccgaagucaacaacgaaguaauggcccucgaacccgucgucggcgcagcaaucgcugcccccgucgcaggccaacaaaacgucauagaccccuggauccgcaacaacuucguccaggcgcccggaggcgaguucaccguaucaccccgcaacgcccccggagaaauccucuggucagcacccuuaggacccgaccucaauccauaccucucccaccuggcccgcauguacaacggcuacgccggaggcuucgaaguccaagucauccuagccggcaacgccuucaccgccggaaaagucaucuucgccgcagucccacccaacuuccccacagagggacucuccccaucgcaagucaccauguucccccacaucguugucgacgucagacagcucgaacccguccucauaccccucccagacguacgaaacaacuucuaccacuauaaccaauccaacgaccccaccauaaaacucaucgccaugcucuacacaccacuccgcgccaacaaugccggcgacgacgucuuuacaguaucaugccgcguccucacacggcccucccccgauuucgacuucaucuuccuagucccacccacugucgaauccagaaccaaacccuuuucaguccccguccuaaccguagaagaaaugaccaacucccgauuucccauaccccuggaaaaacucuucaccggcccaucauccgccuucgucguccagccccaaaacggucgaugcaccaccgacggcguacucuuagguaccacccaacucucacccgucaacaucuguaccuuucgcggagacguaacacacauuacaggcucccgcaacuacacaaugaaccucgccagccaaaacuggaacaacuacgacccuaccgaagaaaucccagcgccccucggcacccccgacuucguaggcaaaauucaagguaugcuuacccaaaccacccgcaccgacggauccacacgcggacacaaagccaccguauacaccggcuccgccgaguucgccccaaaacuaggacgcguacaauucgaaacagacaccgaccacgacuucgaaaccaaccaaaacaccaaauucacccccguaggcguaauacaagacgguuccaccacccacagaaaugaaccucaacaauggguacuccccuccuacuccggucgcaacacccacaacguacaccucgcccccgcaguugcacccaccuuccccggagaacaacuccucuucuucagauccaccaugcccggaugcuccggcuaccccaacauggaccuugacugccuccuuccccaagaauggguacaauacuucuaccaagaagccgccccugcacaaucagacguugcacuccucagauucgucaacccugacacuggccgcguccucuucgaauguaaacuacacaagaguggcuacgucacagucgcccacacaggacaacacgaccucgucauaccucccaacggauacuucagauucgacucaugggucaaccaauucuacacccuugcucccaugggcaacggcacaggccgacgccgagucuaa

SEQ ID NO: 37906 - RNA, 1620 nt, Artificial Sequence
  derived and/or modified sequence opt11 from VP1__Norovirus_and/or_Norovirus-like__KX354034
augaaaauggcaucaucagacgccaaccccuccgacggcucagccgcaucacuuguacccgaagucaauaaugaagugauggcucuugaaccaguugucggagccgcaaucgcggcccccgucgcaggccaacaaaacguaaucgaccccuggauacgcaacaacuucguucaagcccccggcggcgaguucaccguuuccccucgcaaugccccaggcgaaauccucuggucagcuccccucggccccgaccucaacccauaccucucucaucuugcacguauguacaauggauacgccggaggcuucgaaguacaagucauccucgcuggaaacgcauucacagccggaaaaguaauuuucgcugccgucccucccaacuuccccacugaaggacuaucaccaucccaaguaaccauguucccccacaucguugucgacgucagacaacuagaacccguccucaucccauuacccgacguucguaacaacuucuaccacuauaaccaauccaacgaccccacuaucaagcuaaucgccaugcuauacacaccccuucgagcaaacaaugccggagacgacguauuuaccgucucaugccguguccuaacccgccccuccccagacuucgacuucaucuuccuagucccacccacagucgaaucaagaacgaaacccuucuccguccccguacuaacagucgaagaaaugaccaacucacgcuucccuauaccccuagaaaaacuauucacaggccccuccuccgcguucgucguccagccccaaaacgggcgcugcaccacugacggcguacuacucggcaccacucaacucucccccguaaauaucugcaccuuccgcggcgacgucacccacaucaccggcucaagaaacuacacaaugaaccucgccucccaaaacuggaacaacuacgacccaaccgaagaaauccccgcaccccuagguacccccgacuucgucggaaaaauccaagggguccuaacacaaaccacacgcaccgauggcuccacccgaggccacaaagcaacaguauacaccggauccgccgacuucgccccuaaacucggaagaguccaauucgaaaccgacaccgaccacgacuucgaagcuaaucaaaacaccaaauucacccccguaggaguuauccaagacggcggcaccacccaccgcaaugaaccccaacaauggguucuccccagcuacucuggccgcaauacccacaacguccaccucgcccccgccguagcacccaccuuccccggugaacaacuucuauucuuccgcuccaccaugcccggcugcuccggcuaccccaacauggaucucgacugccuacucccccaagaauggguccaauacuucuaccaagaagcagcacccgcccaaagcgaugucgcccuucuucgcuucgucaaccccgacaccggccguguccuauucgaaugcaaacuccacaaaagcggcuacguaaccguagcccacacaggccaacacgaccuagucauaccacccaacggcuacuucagauucgacuccugggucaaccaauucuacacgcucgcccccaugggcaacggcaccggacgccgccgcguguaa

SEQ ID NO: 37907 - RNA, 1620 nt, Artificial Sequence
  derived and/or modified sequence opt11 from VP1__Norovirus_and/or_Norovirus-like__KX354027
augaaaauggcauccuccgacgcaaaucccucagacggguccgcagcuaaccuuguccccgaagucaacaacgaagucauggcccucgaaccuguagucggcgccgcuaucgcagcccccguugcaggucaacaaaauguuaucgacccauggaucagaaacaacuucguacaagcgcccggaggcgaguucacagucucuccacgcaacgcacccggcgaaauccuauggucagcaccccucggaccagaccuaaacccuuaccucucccaccuugcccgcauguacaacgguuacgcaggcggguucgaaguacaaguaauccucgccgggaacgccuucaccgccggcaaagucauauucgccgccguaccaccuaacuuucccaccgaaggccucucccccucacagguaacaauguucccccacaucguagucgacgugcgccaacuagaacccguacucaucccacucccagacgucagaaacaacuucuaccacuauaaccaauccaacgacccaacuauaaaacucauagcaaugcucuacacuccccuacgcgccaacaacgcuggcgacgacgucuuuacgguauccugccgcguucucacccgccccuccccagacuucgacuucauuuuccuuguacccccaaccgucgaaucacgcaccaaacccuucuccgucccuguacuaaccguugaagaaaugaccaacuccagauuccccaucccccuagaaaaacucuucaccggccccuccucggccuucguaguccaaccccaaaacggccgaugcaccacagauggcguacuacucggcaccacccaacuaucaccaguaaacauuugcaccuucagaggagacguaacccacacaaccggauccagaaacuacaccaugaaccucgccucccaaaacuggaacaacuacgacccuaccgaagaaaucccagcaccccucggcgcccccgacuucgucggaaaaauccaaggcaugcucacccaaaccacccgcgccgacggcuccacgcgaggccacaaagccaccgucuacacaggauccgccgacuucgcaccuaaacugggucgcguccaguucgaaaccgacaccgaccacgacuucgaagcaaaccaaaacacaaaauucacccccguuggagucauccaagacggcuccacaacccaccgaaacgaaccacaacaauggguccugccuuccuacucaggccgaaacacccacaacguccaccucgcccccgccgucgcacccacauuccccggagagcagcuacucuucuuccgaucuacaaugccaggcugcuccgguuaccccaacauggaccucgacugccuccugccacaagaauggguccaauacuucuaccaagaagcagccccagcccaaagcgacgucgcccugcugcgauucgucaaccccgacaccgggagaguacuauucgaaugcaaacuacacaaaucaggcuacgucacggucgcccacaccggccaacacgaccucgucauaccgcccaacggauacuuccgcuuugacucaugggucaaccaauucuacacacucgcccccauggguaacggagcaggccgacgccgagucuaa

SEQ ID NO: 37908 - RNA, 1620 nt, Artificial Sequence
  derived and/or modified sequence opt11 from VP1__Norovirus_and/or_Norovirus-like__KX354025
augaaaauggcauccucugacgcuaaccccuccgauggauccgcagccaaccuaguuccagaagucaacaacgaggucauggcccucgaacccguagucggcgccgcuaucgcagcaccuguagccggccaacaaaacgucauagacccauggauacgaaacaauuucguacaagcccccggcggcgaguucacaguaagcccccgcaacgccccaggcgaaauccuaugguccgcaccccucggacccgaccucaacccuuaccuuucacaccuagcccgcauguacaacggauaugccggaggcuucgaaguacaagucauccuagccggcaacgccuucacagccggcaaagucauauucgcagccgucccacccaacuuccccaccgaaggccucucccccagccaagucaccauguucccucacaucguagucgacguccgacaacucgaaccaguccucauuccccuaccagacguccgaaacaacuucuaccacuauaaccaauccaacgaccccacuauaaaacucauugccaugcucuacacaccccuacgcgccaacaacgccggcgacgacguauucaccguauccugccgcguccucacccgaccuuccccagacuucgacuucauauuucucgucccacccaccgucgaaucacgaacuaaacccuucuccguucccguccugaccgucgaagaaaugaccaacucccgcuuccccaucccccuugaaaaacucuuuaccggccccuccagcgcuuucguaguccagccccagaacggaagaugcacaacagacggaguacuauuaggaacuacccaacucucaccaguaaacaucugcaccuuccgcggcgacguuacccacaucaccggcucacgaaacuacaccaugaaccuggccucccaaaacuggaacaacuaugacccuacugaagaaaucccagcaccccucggcaccccagacuucguaggaaaaauacaaggcguccucacccaaacuacucgcgccgacggcucaacccgcggucacaaagcaaccguauacaccggcuccgcugacuuugccccaaaacucggacgaguccaauucgagaccgauacggaccacgacuucgaggccaaccaaaacaccaaauucaccccaguaggcgucauccaagacggcggcaccacccaccgcaacgaaccacaacaauggguacuacccucauacuccggccgaaacacccacaacguccaccuugcccccgccgucgcccccaccuucccuggggaacaacuacucuucuucagauccaccaugcccggaugcucaggcuacccaaacauggaucuugacugccuucuaccccaagaauggguccaauacuucuaccaagaagcagcgcccgcacaauccgaugucgcacuccuccgcuucgucaaccccgacaccggccgcguccucuucgaaugcaagcuacacaaauccggauacgucacugucgcacacacaggccaacacgaccucguaaucccacccaacggauacuuccgauucgacuccuggguaaaucaauucuacacccucgcacccaugggcaacggcaccggucgccgacgcgucuaa

SEQ ID NO: 37909 - RNA, 1620 nt, Artificial Sequence
  derived and/or modified sequence opt11 from VP1__Norovirus_and/or_Norovirus-like__KJ685406
augaaaauggcuucaucugacgccaaccccuccgacggauccgcggccaaccucguccccgaaguaaacaacgaagucauggccuuagaacccgucgucggagccgccaucgccgccccagucgcaggccaacaaaacgucauagaccccuggauuagaaacaacuucguacaagccccaggcggcgaguucaccgucucaccccgaaacgcacccggcgaaauacucugguccgcaccacucggcccagaccucaauccauacuuaucccaccucgcccgaauguauaacggcuacgccggaggcuucgaaguccaagucauccuagccggaaacgccuucacagccggaaaagucaucuucgccgccgucccaccaaacuuccccacagaaggccugucaccaucucaaguuacaauguucccccacauugucgucgacguccgacaacucgaacccguacucauaccacucccagacguuagaaacaacuucuaccacuauaaccaauccaacgaccccaccaucaaacucaucgcaaugcuuuacaccccacuccgcgcaaacaacgcuggcgacgacgucuuuacaguaucaugccgaguacuaacacguccauccccagacuucgacuuuauauuccucguaccacccaccgucgaaucccgaacuaaacccuucucaguacccguccucacagucgaagaaaugaccaauucacgcuuccccaucccccucgaaaaacucuucaccggccccuccagcgccuucguaguucaaccccaaaacggccguugcaccacagacggaguacuccuaggaacaacccaguugucacccgucaacauuugcacuuuccguggcgacgucacgcacaucaccggauccagaaacuacaccaugaaccuagccucacaaaacuggaacaacuacgaccccaccgaagaaauacccgcaccccuaggaacacccgacuucgucggcaaaauacaaggcguacucacccaaaccacuagaacagacggcucaacacgcggccacaaagccacugucuacacagguuccgccgacuucgcacccaaacuaggccgaguccaauucgaaaccgacacagaccacgacuucgaagcaaaccaaaacaccaaauuuacccccguaggagucauacaagauggaggcaccacccaccgcaaugaaccccaacaauggguccucccuucauacucuggucgcaacacacacaacguucaccuagcacccgcagucgcacccacauuccccggugaacaacuacuauucuuccgaagcaccaugccaggcugcucuggcuaccccaacauggaucuagacugccuucucccccaagaauggguccaauacuucuaccaagaagccgcaccagcacaaucagacgucgcccuccuccgcuucgugaaccccgacaccggccgcguccucuuugaaugcaaacuucacaaauccggcuacguuaccgucgcccacacaggccaacacgaccucgucaucccacccaacggauacuuccgauuugacagcugggucaaccaauucuacacccuugcccccaugggaaacggcaccggacggcgucgaguauaa

SEQ ID NO: 37910 - RNA, 1620 nt, Artificial Sequence
  derived and/or modified sequence opt11 from VP1__Norovirus_and/or_Norovirus-like__KF008241
augaaaauggccucauccgacgcaaaucccucagacgguuccgccgcuaaccucguccccgaagugaacaacgaagucauggcccuagaacccguagucggcgccgccaucgccgccccaguagcuggccaacaaaacguaauagaccccuggaucagaaauaacuucguccaagccccaggcggagaguucaccgucagcccacgcaacgccccaggcgaaauacuaugguccgcuccccucggccccgaccucaaccccuaccuaucccaccucgcccggauguacaacgguuacgccggcggauuugaaguccaagucauccuggccggcaacgccuucaccgccggcaaaguaaucuucgcagccguaccucccaauuuccccacagaaggccuaucccccucccaagucacaauguucccccacauaguagucgacguccgacaacuugagccaguccuaaucccccuaccagacguccgcaacaacuucuaccauuacaaucaauccaacgacccaaccaucaaacucaucgccaugcuauacacacccuuacgagccaacaacgcuggagacgacgucuucacaguauccugcagaguucucacacgccccucaccagauuucgacuucauauuucuaguuccucccacaguagaaucacgaaccaagcccuucucaguccccguccuaaccgucgaagagaugacuaacucccgauucccgauaccccucgaaaaacucuucaccgggcccuccuccgccuucguaguccagccccagaacggacgaugcacaacggacggaguccuccuuggcaccacacaacuauccccugucucuaucugcaccuuccgaggcgacguaacacauaucaccggcucccgcaacuacacaaugaaccucgcaagccaaaacuggaacaacuacgaccccacagaagaaaucccagcuccccuaggcacccccgacuuugucggcaaaauacaaggcaugcuaacccaaaccacgcgcgcagacggcagcacccgcggccacaaagcaaccgucuacacaggcagcgcagacuucgccccaaaacuaggacgcguccaguucgaaacagacacagaccacgacuucgaagccaaccaaaacaccaaauucaccccuguaggcgucauccaagacggaaguaccacccaucgcaacgaaccucaacaauggguacuccccagcuauuccggccgcaacacccacaacguccaccucgcacccgcagucgccccaaccuuccccggcgagcaacuucucuucuuccgcucaaccaugcccggcugcuccggauacccaaauauggaccucgacugccuucucccccaagaauggguccaauacuucuaccaagaagccgccccagcccagucagacguugccuuacuucgcuucguaaaccccgacacaggucggguccuauucgaaugcaaacuccacaaaucaggcuacguaaccguagcacacaccggacaacacgaccucgucaucccacccaacggcuacuuccgauucgacuccugggucaaucaauucuacacacuagcccccauggguaacggcacaggacgacgacgcgucuaa

SEQ ID NO: 37911 - RNA, 1620 nt, Artificial Sequence
  derived and/or modified sequence opt11 from VP1__Norovirus_and/or_Norovirus-like__AB504327
augaaaauggcauccaacgacgccaacccauccgacggcucagccgcaaaccucgucccugaagucaacaacgaagucauggcauuggaaccaguagucggagcagcaauagccgcacccguugccggacaacaaaacgucaucgaccccuggaucaggaacaacuucguacaggcccccggcggcgaguucaccgucuccccacgcuccgcacccggagaaauccucugguccgcaccccucggcccagaccuaaaccccuaccuaagccaccucgcccgaauguauaacggcuacgccggcggauuugaaguacaagucauccucgcuggcaacgccuucaccgcagguaaaauuauuuucgccgccguacccccaaacuucccaaccgaaggccucagccccucacaagucaccauguucccccacauaaucgucgacgucaggcaacucgaacccguccucaucccccuccccgauguccgcaacaacuucuaccacuacaaccaauccaaugacuccaccaucaaacuaaucgccaugcuauacacaccccuacgagccaacaacgcaggcgaagacgucuucaccgucuccugccgcguccucaccaggcccucccccgacuucgacuucauauuccucgucccgcccacagucgaauccagaaccaaacccuucaccguccccauccuaaccgucgaagaaaugaccaacucacgcuuccccaucccccucgaaaaacuuuucacaggucccuccuccgcuuucguuguacaaccucagaacggccguugcacaaccgacgguguccuccucggaaccacccagcucucacccgucaauauaugcaccuuccgcggcgacgucacccacauagcuggaucacgcaacuacacuaugaaccucgcgucccucaacuggaacaauuacgaccccaccgaagaaauaccagccccacuuggaacuccagauuucgucgggaagauacaaggaguccucacccaaaccacaaaaggugacgguuccacccgaggacacaaagcaaccguauacacuggcucugcccccuucacucccaaacucggcuccguucaauuuucaacagacaccgaaaacgauuucgaaacacaccaaaauacccgauucaccccagucggcgucauccaagauggcggaacaacccaccgcaacgaaccccaacaauggguacuaccguccuauucuggccgcaacguacccaacguccaccucgcacccgcuguagcccccacauucccaggagaacaacuccucuucuuccgcucuaccaugccaggaugcucaggauaucccaacauggaccuagacugccuacucccacaagaauggguccaacacuucuaccaagaagccgccccagcccaauccgacgucgcccuacuccgcuucgucaaccccgacacuggccgcguccucuucgaaugcaaauugcauaaauccgguuacgucaccguagcccacaccggacaacacgaccucguuaucccacccaacggauacuuccgcuucgauucauggguaaaccaauucuacacccuagcaccaaugggcaacggaacaggccgccgacgagucuaa

SEQ ID NO: 37912 - RNA, 1620 nt, Artificial Sequence
  derived and/or modified sequence opt11 from VP1__Norovirus_and/or_Norovirus-like__KY424329
augaaaauggccuccuccgacgccaaccccuccgacggcucagccgccaaccucguacccgaggucaacaaugaaguuauggcucucgaaccaguagucggugcugccauagccgcccccguagccggccagcaaaacguaaucgaccccuggauccgcaacaacuuuguucaagccccuggaggcgaguucacaguauccccacgcaacgcccccggcgaaauccuauggucagcaccccucggccccgaccucaacccauaucugucucaccucgcccgcauguacaacggcuaugcaggaggcuucgaaguucaaguaauacucgcgggcaacgccuucacagccggcaaaauaaucuucgcagccguucccccuaacuuccccaccgaaggucucucccccucccaagucacaauguuuccacacauuaucgucgacguccgccaacuggaaccaguccuaaucccgcucccagacguccgaaacaacuucuaccacuacaaccaauccaacgaccccaccauaaaacucauagcaaugcuuuacacaccccuccgcgccaacaacgcaggcgacgacguuuucaccgucucaugccgaguacuaacccguccaucccccgacuucgacuucaucuuucuagucccaccuaccgucgaaucacggacaaagccauuuuccguaccuguccucaccguggaagaaaugaccaacucccgcuuucccauaccacucgaaaaacuauuuaccggccccucaucagccuucguaguccaaccccagaacggacgcugcaccaccgacggcguccuacucgguaccacccaacucagcccagucaauaucugcaacuuccgcggagacgucacccauaucaccggcucacgcaacuacaccaugaacuuagccagucagaacuggaacaauuacgacccgacagaagaaauucccgcaccucuaggaacacccgacuuugucggaaaaauccaaggcaugcucacccaaaccacccgcaccgacggcuccacucgcggccacaaggccacagucuacaccggcuccgccgacuucgcccccaaacucggccgaguccaauucgaaaccgacaccgaccacgauuuugaagccaaccaaaacaccaaauucacacccguaggcguaauccaagacggcucaaccacacaccgaaaugaaccucaacaauggguccucccauccuacuccggccgcaacacccacaacguccaccucgccccugcaguggcccccaccuuucccggcgaacaacuccuguucuuccggucuacaaugccaggcugcuccggauacccaaacauggaccuagacugccuccucccucaagaauggguacaauacuucuaccaagaagcugcacccgcccaaucugacgucgcccuccuucgcuucguaaaccccgacacuggacgaguacuauucgaaugcaaacuccauaaauccggauacgucacagucgcccacaccggccaacacgaccucgucaucccacccaacggcuacuuccgcuucgacuccuggguaaaccaauucuacacucuagcacccaugggaaacggcaccggccgccgacgcgucuaa

SEQ ID NO: 37913 - RNA, 1620 nt, Artificial Sequence
  derived and/or modified sequence opt11 from VP1__Norovirus_and/or_Norovirus-like__KT780389
augaaaauggccucauccgacgcaaaccccucagacggaagcgccgccaaccuuguaccugaaguaaacaacgaaguaauggccuuagaacccgucguaggcgccgcaaucgccgcccccgucgcaggccaacaaaacguuaucgaccccuggauacgcaacaacuucguacaagcaccaggaggcgaguucacaguaagcccccgcaacgcccccggcgaaauccuauggucagccccucucggaccagaccucaacccauaccuaucucaccucgccagaauguacaacggauacgcuggcggcuuugaaguccaaguaauccuugccggcaacgccuucaccgccgguaaggucaucuucgccgccgucccacccaacuuccccacggaaggcuuaucucccagccaagucaccauguucccucacauaguaguagacgucagacaacuagaacccguccucauaccacuccccgacguacgaaacaacuucuaccacuacaaucaauccaacgacccuaccauaaaacucauagcaaugcuauauacaccccuccgagccaacaacgcaggcgacgacgucuucaccguaucaugccgcguccucacccgccccucuccagacuucgacuucaucuuccucgucccacccaccguagaaucacgaaccaaacccuucuccguccccguucuaacugucgaagaaaugaccaacucccgauuccccauuccccucgaaaaacucuucacaggccccuccucugcguucgucguccaaccccaaaacgggaggugcacaacagacggcguccuccuaggaacaacacaacuaagccccgucaauauaugcaccuuccguggagacgucacccauauuacagggucacgcaacuacaccaugaaccucgccucccaaaauuggaacaauuacgaccccacagaagaaauacccgccccacucggcgcaccagacuucgucggcaagauacaaggcgucuuaacacaaacaacccgcgcagacgguuccacccgaggccacaaggccaccgucuacacaggaucagcagacuucgccccaaaacucggccgcguacaauucgaaaccgacacagaccacgacuucgaagcuaaccaaaacaccaaauucacccccgucggcguaauucaagacggauccacaacacaucgcaacgaaccccaacaguggguucuccccucauacucaggccgcaacacucacaacguacaccuugcaccagccgucgcaccaaccuucccaggcgaacaacuccuauucuuccgcucuacaaugcccggcugcucaggauaccccaacauggaccuagacugccuccuaccccaagaauggguccaauacuucuaccaagaagcagcccccgcccaauccgacguagcccuccuacgcuucguaaaccccgacaccggccgaguccucuucgaaugcaaacuacauaaaucgggcuacgugaccgucgcccacaccggccagcacgaccuagucaucccaccaaacggcuacuuccgauucgacuccugggucaaccaauucuauacacucgccccaaugggaaacggcgccggccgcaaacgcguauga

SEQ ID NO: 37914 - RNA, 1620 nt, Artificial Sequence
  derived and/or modified sequence opt11 from VP1__Norovirus_and/or_Norovirus-like__KX354134
augaaaauggccuccucugacgccaacccuagugacggcucagcagcaaaccucguccccgaaguaaacaacgaagucauggcacuagagcccgucgucggcgcagccauagccgcacccguagccggccaacaaaacgucaucgacccauggauacgaaacaacuucguccaagcacccggaggcgaguucaccgucucaccacgcaacgcaccuggagaaauccuauggagcgcuccccucggaccugaccuaaaucccuaccucucccaccucgcacgaauguacaacggcuaugccggcggauucgaaguccaggucauucucgccgguaacgccuucaccgccggcaagaucaucuucgccgccguacccccuaacuuuccuaccgaaggccucaguccaucacaagucaccauguucccacacaucaucgucgauguccgccaacuagaacccguccucaucccccuucccgacguaagaaacaacuucuaccacuacaaucaaucgaacgacuccaccauaaaacucaucgcaaugcuuuacaccccacuccgcgccaacaacgccggcgacgacgucuucaccgucagcugucgcguccuaacacguccauccccugacuuugacuuuauauuccuagucccaccuaccgucgaaucccgaaccaaaccauucuccguccccauccuuacuguagaagaaaugaccaacucccguuucccaaucccccuugaaaaacucuucaccggccccucuuccgcuuucguaguucaaccacaaaacggucgcugcaccaccgacggcguccuccucggcacuacucaacucucaccaguaaacauuuguaccuuccgcggcgacaucacccacaucaccggaucccacaacuacaccaugaaccuagcaucccaaaacuggaacucguacgaccccaccgaagaaauccccgcaccccuuggcaccccagacuucgucggcaaaauccaaggcguccuuacccaaacuacccgugccgauggcuccacacgcggccauaaagccacugucuauaccggcuccgccgacuucgcccccaaacuaggccgcguacaauucgaaaccgacaccaaucacgacuucgaagcuaaccaaaauaccaaauucaccccagucggaguaauccaggacggcuccaccacccaccgcaacgagccacaacaauggguccuccccucauacucaggccguaacacccacaacguccaccuugcccccgcgguagcaccaaccuucccuggcgaacaacuacuauuuuuccgaucaaccaugcccggcugcucaggcuacccaaacauggaccuagacugccuccucccccaagaauggguccaauucuucuaccaagaagccgccccagcccaaucagacgucgcauuacuccgcuucguuaaccccgacaccggucgcguccuuuucgaaugcaaacuacacaaauccgguuacguaaccgucgcccacaccggacaacacgaccucgucaucccgccaaacggauacuuccgauucgacuccugggucaaccaauuuuacacacuagcaccuaugggaaauggcaccggccgccgacgagucuaa

SEQ ID NO: 37915 - RNA, 1620 nt, Artificial Sequence
  derived and/or modified sequence opt11 from VP1__Norovirus_and/or_Norovirus-like__KX354126
augaaaauggccuccuccgacgccaacccauccgacggcucagccgcuaaccuugucccagaagucaacaacgaagucauggcacucgagccugucgucggcgccgccaucgcagcucccguagcaggccaacaaaacgucaucgaccccuggauacgaaacaacuucguccaagccccgggcggugaguucaccgucagcccccgaaacgcccccggcgaaauccuaugguccgcuccccuaggaccagaccugaacccuuaccuaucacaccucgccagaauguacaacggcuacgccggcggauucgaaguccaagucauccucgccggcaacgccuucaccgccggaaaaguuaucuuugcugcggucccaccaaacuucccaaccgaaggacuaucccccucgcaaguaacaauguucccccacauagucguagacgugagacaacucgaacccguacuaauaccccuccccgacguucgaaacaacuucuaccacuacaaccaauccaaugacccaacaauaaaacucaucgcuaugcuauacaccccauuacgcgccaacaacgccggcgacgacgucuucacgguaagcugccgcguccucacucgcccauccccagacuucgacuucaucuuccucgugcccccaacagucgaaucccgaaccaaacccuucuccguccccguucuuacuguugaagagaugaccaacucacgguucccaauccccuuagaaaaacucuuuaccggccccucaagcgcauucguaguacaaccacaaaacggccgcuguacaaccgacggcguccuccucggaaccacucaacucagcccagucaacaucugcacuuuccgcggcgacgucacccacaucaccggaucacgaaacuacaccaugaaccucgccucucaaaacuggaacaacuacgacccgaccgaagaaauccccgcaccccucggcacaccagacuucgucgguaaaauccaaggaauguuaacccaaaccacccgcgccgacggauccaccagaggccacaaagccacugucuacaccggguccgccgacuucuccccgaaacuaggccggguacaguucgaaacagacaccgaccacgauuucgaagcuaaccaaaacaccaaauucacccccgucggugucauccaagacggcuccaccacccaccgcaacgaaccccagcaauggguacuccccuccuauuccggacgcaauacccacaacguacaccucgcccccgccgucgcacccaccuuccccggugaacaacuucucuuuuuccgcuccaccaugcccggaugcuccggcuaccccaacauggaucuugacugccuccuaccccaagaauggguacaguacuucuaccaagaagccgcacccgcacaauccgacgucgcacuccuccgauuugucaaccccgacacaggcagaguccucuuugaaugcaaacuccacaaaucuggauacguaaccguagcccacaccggccaacacgaccuagucaucccacccaacggauacuuccgcuucgacuccuggguaaaccaguucuauacacucgcccccaugggaaacggcaccgggcguaaacgcgucuaa

SEQ ID NO: 37916 - RNA, 1620 nt, Artificial Sequence
  derived and/or modified sequence opt11 from VP1__Norovirus_and/or_Norovirus-like__KR904237
augaaaauggccucaucugacgccaacccuucagacggcuccgccgccaaccuaguacccgaaguaaacaacgaaguuauggcccucgaacccgucgucggggccgccauagccgcccccgucgcagggcaacagaacgucaucgacccauggauccgcgauaacuucguacaagcacccggaggagaguucaccguaucaccccgcaacgccccaggagaaauacuaugguccgcaccccuuggccccgaucucaaccccuaccucucccaucucgcccgcauguacaacggcuacgcaggcggauucgaaguucaaguaauccuagccggcaacgccuucaccgccgguaaagucauauucgccgcagugcccccaaacuuccccaccgaaggacuauccccaucacaagucaccauguucccacacaugauagucgacguaaggcaacucgaacccguccucaucccccuccccgacguccgcaacaauuucuaucacuacaaccagucaaacgaccccacccucaaacuaaucgccaugcucuacacuccccuacgcgccaacaacgccggagacgacguauuuacagucucuugccgcguccucacucgccccuccccugacuuugacuucaucuuccucguacccccaaccgucgaaagccgcaccaaacccuucuccguaccuguccugacagucgaagaaaugacuaacucgcgauuccccauuccccuagaaaaacuauucaccggcccauccuccgcauucguaguccaaccccaaaacggccgcuguacuaccgacggaguccuucucggcaccacccaacuaucaccaguaaacaucugcaccuuccgaggcgacgucacacacaucacaggcucccgcaauuacaccaugaaccuagcaucccaaaacuggaacaacuacgaucccaccgaagaaauccccgcaccccucggcgcccccgacuucgucggcaaaauccaagguaugcucacccaaaccacccgaacugacgguuccacacgaggccacaaagccaccgucuacaccggaucagccgacuucgccccaaaauuaggccgaguacaauucgaaacagacaccgaccacgauuucgaagcgaaucaaaacaccaaauucacaccagucggcgucauccaagacgguucaacaacacaucgcaacgaaccccaacaauggguccuccccucauacucuggacguaacacccacaacguccaucucgcccccgccguagcccccaccuuccccggcgagcaacuucuauucuuccgaucuacaaugccaggcugcucaggcuaccccaacauggaccucgacugccuacucccacaagaauggguacaauacuucuaccaagaagccgcccccgcccaauccgacgucgcccuccuccgcuucgucaaccccgacaccggccgaguccucuucgaaugcaaacuccacaaauccggcuacgucaccguagcacacaccggucagcacgaccucguaauaccucccaacggauacuuccgcuucgacuccuggguaaaccaauucuacacucucgcccccaugggaaacggcaccggacgccgccgcaucuag

SEQ ID NO: 37917 - RNA, 1620 nt, Artificial Sequence
  derived and/or modified sequence opt11 from VP1__Norovirus_and/or_Norovirus-like__KP241911
augaaaauggcauccuccgacgccaaccccucagacgguucagccgccaaccucgucccagaagucaacaacgaagucauggcgcuagaacccguugucggagcagccaucgccgcuccagucgcagggcagcaaaacgucaucgacccauggauccgaaacaacuucguccaagcaccaggaggcgaguucacagucucuccccgcaacgcacccggagaaauucuuugguccgcaccccuaggccccgaccugaaccccuaccucucccaccucgcccgaauguacaauggcuaugccggcggcuucgaaguccaagucauccuagccggcaacgcauucacagccggcaaaguaauuuucgccgcagucccaccaaacuucccuaccgaaggccucuccccuucacaagucacuauguucccccacaucgucgucgacgucagacagcucgaacccguccucaucccucuccccgacguucgaaacaacuucuaccacuacaaccaaucaaacgacccaaccauaaaacucaucgccaugcucuacacaccccuccgcgcaaacaacgcaggcgacgacgucuucaccgucagcugccgaguccucacccgacccucacccgacuucgacuucaucuuccuaguacccccuaccguugaaucccgcaccaaacccuucagcguccccguccucaccguagaagaaaugaccaacucccgcuuccccaucccccucgaaaaacucuucacaggacccuccucagccuucgucguacagccccaaaacggccgaugcaccacagacggcguacucuuaggcaccacucaacuaucccccgucaacauaugcaccuuccgcggcgacguaacacacaucacaggauccagaaacuauaccaugaaccuagccucucaaaacuggaacaauuacgaccccaccgaagaaauaccagcaccccucggcacccccgacuucgucggaaaaauccaaggaaugcucacccaaaccacccgcaccgacggcuccacacgcggccacaaagccaccguauacacaggaucagcagacuucgccccuaaacucggacgcgugcaauucgaaacagacaccgaccaugacuucgaagcaaaccaaaacacuaaauucacaccaguaggugucauccaagacggcucaacaacccaccgcaaugaaccccaacaaugggucuuacccucauacuccggccgaaacacccacaacguccaccucgcccccgccgucgccccaacuuuucccggcgaacaacuucuuuucuuccgcucaaccaugccaggcugcucuggauaccccaacauggaccuagacugccuccuaccacaagaauggguccaauacuucuaccaagaagccgccccagcucaguccgacgucgcccuacuccgauucguuaaccccgacacaggccgaguccucuucgaaugcaagcuccacaaaucuggcuacguaacagucgcccauaccggccaacacgaccuagucaucccacccaacggcuacuuccguuucgacucuugggucaaccaauucuacacccucgcccccaugggcaauggcaccggccgacgcagagucuaa

SEQ ID NO: 37918 - RNA, 1620 nt, Artificial Sequence
  derived and/or modified sequence opt11 from VP1__Norovirus_and/or_Norovirus-like__KJ685411
augaaaauggccuccuccgacgcuaaccccagcgacggcucagccgcuaaccuaguacccgaagucaacaacgaagucauggcacuugaacccgucgucggagcagccauagccgcccccguagccggccaacaaaacguuauagacccauggauccgaaacaacuuuguacaggccccaggcggcgaguucacaguaagcccccgcaacgcucccggcgaaauccucuggucagcaccgcucggucccgaccucaaccccuaccuaucacaccuugcccgaauguacaacggcuaugccggaggcuucgaaguccaaguaauacuagcaggcaacgcguuuaccgccggcaaagucaucuuugccgcaguaccacccaacuuccccaccgaaggucucucccccucacagguuaccauguucccacacauagucguggacguccgccaacucgaacccgugcucaucccacuccccgacguccgcaacaacuucuaccacuacaaccaauccaacgacccgaccauaaagcucaucgcaaugcucuacacaccccugagagccaacaacgccggcgacgacguauucaccguaucuugccgcguccucacccgcccaucccccgacuucgacuucauuuuccuaguucccccaaccgucgaaucacgcaccaaacccuucuccgucccuguccucaccgucgaagaaaugacaaacucacgcuucccaauaccucuugaaaaauuauucaccggcccauccuccgccuuuguaguucaaccacaaaacggccgaugcacaaccgacggcguccuccucggaaccacucaacuuagccccguaaauaucugcaccuucagaggcgacguaacccacaucacaggaucccguaacuacacuaugaaccucgccucccucaacuggaacaacuacgacccaaccgaagaaauaccagcaccccucggcacacccgacuucguaggcaaaauccaaggaaugcucacacaaacaacacgaaccgacggcuccacacgcggccacaaagccacaguuuacaccggcagcgccgacuucgcacccaaacucggccgcguucaauucgaaaccgacacagaccacgacuucgaagccaaccaaaacaccaaauucacccccgucggaguaauccaagacggcucaaccacacaccgaaacgaaccccaacaauggguacuacccagcuacucaggaagaaacacccacaacguacaccucgcccccgccguagccccaaccuuccccggagaacaacuccucuucuuccgcucgaccaugcccggaugcucaggcuaccccaacauggaccuagacugucuauuaccccaagaauggguacaguauuucuaccaagaagccgcaccagcccaauccgacgucgcucuccuuagauucgucaacccagacacgggccgcguccucuucgaaugcaaacuucacaaauccggcuacgucaccgucgcucauaccggccaacacgaccuagucauaccacccaacgguuacuuccgauucgacuccugggucaaccaauucuacacccuagccccaaugggcaacggcacaggccgccgacgcgucuaa

SEQ ID NO: 37919 - RNA, 1620 nt, Artificial Sequence
  derived and/or modified sequence opt11 from VP1__Norovirus_and/or_Norovirus-like__KF008242
augaaaauggccaguucagacgccaaccccagcgacggcuccgcggccaaccucgucccagaagucaacaacgaaguaauggcccuggagcccguugucggcgcagcuaucgccgccccagucgccggacaacaaaacgucaucgacccuuggauccgcaacaacuucguacaagcccccggaggcgaguucacagucucaccccgaaacgcucccggcgaaauccucuggucagccccucuaggacccgaccucaacccguaccucucccaccuugcccgcauguacaacggcuacgccggcgguuucgaaguccaaguaauucucgccgguaacgccuucaccgcaggcaagguaaucuucgccgccguacccccaaacuuccccacggaaggccuaucccccucacaagucacaauguucccccacauaguagucgacguacgccaacucgaaccaguccucaucccccuccccgaugucagaaacaacuucuaccacuacaaccaauccaacgacccaacaaucaaacucaucgccaugcucuacacuccccuccgcgccaacaacgccggggacgauguauucaccgugucaugccgcguccucacccgcccuucaccagacuucgacuucaucuuccucgucccucccacagucgaaucccgcacaaaacccuucucaguccccguccuaaccgucgaagaaaugaccaacucucgcuucccaaucccacuagaaaaacucuucacugguccaagcucagccuucguaguacaaccacaaaacggccgcugcaccaccgacggcguccuccuaggaaccacccaacuaucccccguaaacaucugcaccuuccgcggagacgucacucacaucaccggcucccgcaacuauaccaugaaccuagcaucccaaaacuggaacaacuacgaccccacagaagaaauucccgccccacucggcacuccagacuucgucggcaaaauccaaggcgucuuaacccaaacaaccagaacagacggcuccacucgcggucacaaagcuacaguauacaccggaucagccgacuucgcaccaaaacuaggccgcguucaauucgaaaccgauacugaccacgacuucgaagccaaccagaacaccaaauucacccccgucggcguaauacaagacgguucaaccacccaccgcaacgaaccgcaacaauggguccucccauccuacuccggacguaauacacacaacguccaccuugcacccgcugucgcccccaccuuucccggagaacaacuacucuucuuccgcucuaccaugcccggaugcucuggcuacccaaacauggaucuagacugccucuuaccgcaagaguggguccaauacuucuaccaagaagcagcaccagcccaauccgacgucgcccuacuccguuucgucaacccugacacaggcagaguccucuucgaaugcaaacuccacaaauccggcuacgucaccguugcgcacacaggccaacacgaccucguaauucccccaaacggauacuuucgcuucgacucuuggguaaaccaauucuacacccucgcacccaugggcaacggcaccggcagaaaaagagucuaa

SEQ ID NO: 37920 - RNA, 1620 nt, Artificial Sequence
  derived and/or modified sequence opt11 from VP1__Norovirus_and/or_Norovirus-like__KF060112
augaaaauggccuccucugacgccaaccccuccgacggauccgccgcuaaccuuguccccgaaguuaacaacgaagucauggcccucgaacccguagucggagcagcaauagccgccccaguagccggccaacagaacgucauagaccccuggauccgcaacaacuucguacaagcccccggcggcgaguucacagucucacccagaaacgcuccaggcgaaaucuuauggucagcaccccucggcccagaccucaacccauaucuaucccaccucgcccggauguacaacggcuaugcaggcggcuucgaaguacaaguaauacuagccgguaaugccuucaccgccggaaaaguaaucuucgccgccgucccacccaacuuccccaccgaaggacucucgcccucccaaguaacgauguucccccacaucgucguggacguccgacaacuagaacccguacucauccccuugcccgacguacgcaacaacuucuaccacuacaaccaaucaaacgacccuacaauuaaacuaauagccauguuauacacuccccuaagagcaaacaacgccggcgacgacguauucaccgucuccugcagaguccucacccggcccucacccgacuucgacuucauauuccucgucccgcccaccguugaaucucgaaccaaacccuucagcguccccguccuuaccgucgaagaaaugaccaacucccgcuuccccaucccccucgaaaaacuauucacaggaccguccuccgcauucgucguccagccccaaaacggacgcugcacuacagacggagucuuacucggaaccacacaacuaucgcccguaaacauaugcaccuuccgcggcgacgugacccacaucaccggcagccgcaacuacaccaugaaccuggccucccaaaacuggaauaacuacgaucccaccgaagaaaucccagcaccacucggagcccccgacuucguaggcaaaauccaaggcaugcuaacacagaccacaagaaccgacgggagcaccagaggacacaaagccacagucuacaccggauccgcagacuucgcgcccaaacucggccgcguacaauucgaaaccgacaccgaccacgacuucgaagcuaaucaaaacacaaaauucacaccagucggcguaauccaagacgguucaaccacccaccgaaaugaaccucaacaguggguccuccccucauacagcggccgcaacacccacaauguacaucucgcccccgcgguggcuccaaccuuccccggcgaacaacuccuauucuuccgcuccacaaugcccggaugcuccggcuacccaaacauggaccucgacugccuccuuccucaagaauggguccaauacuucuaccaagaggcugcacccgcccaauccgacgucgcccuucuacgguucgucaacccagauaccggccgcguccucuucgaaugcaaacuccacaaaucuggauacgucacagucgcucacaccggccagcacgaccuagucaucccacccaacggcuacuuccgcuuugacagcugggucaaccaauucuacacacucgcacccaugggcaacggaaccggccgccgaagagucuaa

SEQ ID NO: 37921 - RNA, 1620 nt, Artificial Sequence
  derived and/or modified sequence opt11 from VP1__Norovirus_and/or_Norovirus-like__JX126912
augaaaauggcauccaacgacgcuaacccuuccgauggcaguaccgcaaaccuugugcccgaagucaauaacgaaguaauggcccuagaaccugucgucggggcagcaauagccgccccuguggccggccaacaaaacgucaucgaucccuggauccgaaacaacuuuguccaagcccccggcggcgaguucaccgucagcccccgcaacgcccccggcgaaauacuaugguccgcuccccucggccccgaccuaaaccccuaccucucacauuuagcccgcauguacaacuccuacgccggaggcuuugaaguacaaguaauacuagcgggaaacgcguuuaccgccggcaaaaucaucuucgccgccgucccacccaacuuccccaccgaaggccucucacccucucaaguaacaauguuuccccacaucaucgucgacguccgccaacucgaacccguacucauuccucuacccgacgucagaaacaacuucuaccacuacaaccaauccaacgacccaaccaucaaacuaaucgccaugcucuacacaccccuacgcgccaacaacgcuggcgaagacgucuucaccgucuccugccguguccucaccagaccaagccccgacuucgacuucaucuuccucgucccgccaaccguagaaucacgcaccaaacccuucaccguacccauccucaccgucgaagaaaugaccaacucccgcuucccaaucccccucgaaaaacucuuuaccggccccucaggcgccuucguaguccaaccccagaacggccgaugcaccaccgacggcguccuccuuggcaccacccaacucucccccgucaacauaugcacuuuccgcggagacgucacccacaucgcaggcacacacaacuacaccaugaacuuagccagccaaaacuggaacaacuaugaccccacagaagaaauccccgcucccuuaggcacaccagauuucguagguagaauccaaggcaugcucacacaaaccacacguggugacggcagcacccgcggccacaaagcaaccgucuccaccggagacguccacuucaccccgaaacucggaucuauccaauucaacacagauaccaacaacgauuucgaaaccggccaaaacacuaaauucacaccaguaggcguaauccaagacggcaacggcacccaccaaaacgaaccccaacaguggguacuccccagcuacuccgguagaaccggacacaacguccaccucgcccccgccguagcccccaccuuucccggagaacagcuccuuuucuuccgcuccacaaugcccggauguagcggcuacccaaacaugaaccucgacugccuccucccucaagaauggguucaacacuucuaccaagaagccgcccccgcccaauccgacgucgcucuacuacgcuucguaaaccccgacacuggccgcgugcuauucgaaugcaaacuccacaaaucaggcuacgucaccgucgcccacacaggacagcacgacuuagucauaccgccaaacggcuacuuccgauucgacuccugggucaaucaauucuacacccuagcccccaugggcaauggcaccggccgccgccgagucuaa

SEQ ID NO: 37922 - RNA, 1620 nt, Artificial Sequence
  derived and/or modified sequence opt11 from VP1__Norovirus_and/or_Norovirus-like__KX354143
augaaaauggcauccagcgacgcaaaccccucggauggcuccgcagcaaaucuuguacccgaagucaacaacgaaguaauggcccucgaacccgucguaggagccgccauagccgcgccaguagcaggccagcaaaacgucauagaucccuggauccgcaacaacuucguacaagcacccgguggcgaauuuacagucucaccccgcaacgcccccggcgaaauccucugguccgcuccccucggccccgaccuaaaccccuaucucucccaccucgcccgcauguauaacggcuacgccggcggauucgaaguucaaguaauucucgccggcaacgcauucaccgcgggcaaaaucauauucgccgccgucccacccaacuucccgaccgaaggccucucccccucccaagucacuauguucccgcacaucauagucgacgucagacaacucgaacccguucuaaucccacuuccugacguccgcaacaacuucuaccacuauaaccaaucaaacgacucaacaaucaaacucaucgccaugcucuacacaccccuacgcgccaacaacgcaggcgacgacgucuuuaccgucuccugccgaguccuaacccgccccucacccgacuucgacuucaucuuccuugucccucccaccguggaaucacgcacaaaacccuucucaguaccaguccuaacagucgaagaaaugaccaacucccgcuucccaaucccccuagaaaaacucuucacaggacccuccuccgccuucgucguacaaccacaaaacggacgaugcaccacugacggaguacuccucggcacaacccaacucuccccagucaacaucugcaccuuccggggagacgucacucauaucaccggcucccgcaauuacacaaugaaccuagccucccaaaacuggaacaacuacgacccaacagaagaaaucccagccccauuaggaacaccggacuucgucggaaaaauccaagguaugcucacccaaacaacucgcaccgacggcagcacacgcggccacaaagccauagucuacacuggauccgcagacuuugcacccaaacugggacgaguccaauucgaaaccgacaccgaucacgacuuugaagccaaccaaaacacaaaauucacuccaguaggcgucauacaggacggcucaacuacccaccgcaacgaaccccaacaguggguccuaccuagcuacuccggccgcaacacccacaacguccaccuagcccccgcagucgcccccacauuucccggcgaacaacuacuauucuucagauccaccaugccuggcugcuccggcuacccaaacauggaccuagacugccuccucccacaagaauggguccaauacuucuaccaagaagcugcccccgcacaauccgacgucgcacuccuaagauucgucaacccagacaccggacgaguacuuuucgaauguaagcuccacaaauccggcuacgucaccgucgcccacaccggccagcaugaccuagucaucccucccaauggcuauuuccgguucgauagcugggucaaccaauucuacacccuagcacccaugggcaacggcacaggcagacgcagaguuuaa

SEQ ID NO: 37923 - RNA, 1620 nt, Artificial Sequence
  derived and/or modified sequence opt11 from VP1__Norovirus_and/or_Norovirus-like__KU985164
augaaaauggcuucauccgacgccaaccccuccgacggcuccgcagcaaaccuaguccccgaagucaacaacgaagucauggcacucgaacccguagucggcgccgccaucgccgcacccgucgcgggccaacaaaauguaaucgacccauggaucagaaauaacuucguccaagccccgggcggcgaguucaccguaucaccacgcaacgcacccggcgaaauacuuuggucagcaccccucggcccagaccucaaccccuaccuaucccaccuugcccguauguauaacgguuacgccggcggcuucgaaguccaaguaauccuugccggaaacgccuucacagcaggaaaggucaucuucgccgccguucccccaaacuuccccacagaaggccucucacccucacaagucaccauguuuccacacaucgucgucgacguccgacaacuagaacccguccucauaccacuaccugacguccguaacaacuucuaccacuacaaccaauccaacgaccccaccaucaaacucaucgccaugcuguacacaccccuacgugccaacaaugccggcgacgacguguucacaguauccugccgaguccucacucgaccaucccccgacuucgacuucaucuuccucgucccacccacagucgaaucucgcaccaaacccuuuagcguccccguacucaccgucgaagaaaugacaaacucacgauuccccaucccccuagaaaaacuauuuacaggcccauccucagcauucgucguacaaccacagaacggccgcugcaccaccgacggaguccuacucgguaccacccaacuaucccccguaaacaucugcacauucagaggagauguaacccauauaaccggcucccgcaacuacacaaugaaccucgcuucccaaaacuggaacaacuacgaccccacagaagaaauaccugcaccccucggcgcccccgacuucguaggcaaaauccaaggaauguuaacacaaaccacccgagccgacgguuccacccgcggacacaaagccaccgucuacacuggcagcgcggacuucgcccccaaacucggacgcguacaauucgaaaccgacaccgaccacgacuucgaagccaaccaaaacacaaaauucacccccgucggcgucauccaagacggaagcaccacccaccgcaacgaaccccaacaauggguacucccauccuacuccggccgcaacacccacaacguccaccucgccccggccguagccccaacauuccccggugaacaacuccucuucuuccgauccaccaugcccggcugcucaggcuacccaaauauggaccuugacugccuccuaccccaagaauggguacaauacuucuaccaagaagcagcccccgcgcaguccgacgucgcuuuacuacgcuucgucaaccccgacaccggacgcguucuauucgagugcaaacuccacaaguccggauacguaaccgucgcccacaccggccaacacgaccucgucaucccacccaacggcuauuuccgguucgacucaugggucaaccaauucuacacacuugcacccauggguaacggagccggacgcagacgagucuaa

SEQ ID NO: 37924 - RNA, 1620 nt, Artificial Sequence
  derived and/or modified sequence opt11 from VP1__Norovirus_and/or_Norovirus-like__KX950760
augaaaauggccagcucagacgcaaaccccuccgacggauccgccgccaaccucguccccgaaguaaacaacgaaguaauggcauuagaacccgucgucggugccgcaaucgcagcucccguagccggacaacaaaacgucauagacccuuggauccgcaacaauuucguacaagcccccggaggagaguucaccgucagcccccgaaacgcccccggagaaauccucugguccgcuccucucggccccgaccucaaccccuaccuuucccaccucgcccgaauguauaacggcuacgccggaggcuucgaaguacaaguccuucucgccggcaacgccuucacagccggcaaagucauuuucgccgccgugccaccaaacuuccccaccgaaggccuaucccccucccaagucaccauguucccucacaucgucguagacguccgacaacucgaaccaguacucaucccucuccccgacguacgcaacaacuucuaccacuacaaccaguccaacgacuccacaauuaaacugaucgccauguuauacacaccccuacgcgcgaacaaugcaggcgacgacgucuucaccguaucuuguagaguacucacccgccccucaccagacuucgacuucauuuuccuaguaccacccaccguagaaucccgaacaaaacccuucucuauccccguccuuaccgucgaagaaaugacaaauucacgcuucccaaucccacucgaacgccucuuuaccggcccauccuccgcauucgugguccaaccccagaacggccgcugcaccacagacgguguccuccucggcacaacccaacuaucccccguaaacauuugcaccuuccgcggagacgucacccacaucaccggcucuagaaacuacacaaugaaccucgccucccaaaauuggaacaacuacgacccuacggaagaaauccccgccccgcucggcacccccgacuucgucgggaaaauccaaggaaugcuaacacaaaccacgcgcgccaacggcucaaccagaggccauaaagccaccguauauacaggcuccgcagacuucgcccccaaacucggccgcguacaauuugaaacggacaccucugacgacuucgaaaccucccaaaacaccaaauucacccccgucggcgucauccaagacggcuccaccaccccucgcaacgaaccacaacaguggguccuccccucguacuccggacgcaacacccacaacguacaccuagccccagccgucgcacccacuuuuccaggcgaacaacuacucuucuuccgcuccauuaugcccggaugcucuggcuaucccaacauggaccucgauugccuacuaccccaagaauggguccaacacuucuaccaagaagccgcccccgcccaaucugacguagcccuccuccgauucgucaaccccgacacagguagaguccucuucgaaugcaaacuccacaaaucuggcuaugucaccguagcccacacaggucaacacgaccuagucaucccacccaacggauacuuccgcuucgacuccugggucaaccaauucuauacacucgcccccaugggaaacggaaccggaagacgccgagucuag

SEQ ID NO: 37925 - RNA, 1620 nt, Artificial Sequence
  derived and/or modified sequence opt11 from VP1__Norovirus_and/or_Norovirus-like__KJ685402
augaaaauggccucauccgacgccaacccaagugacggcuccgccgccaaccuaguacccgaaguuaacaacgaagucauggcccucgaaccuguaguaggagcagccaucgccgccccagucgccggccaacagaacgucaucgacccuuggauccguaacaauuucguacaagcacccggaggcgaguucacggucagcccacgaaacgcccccggcgaaauccucugguccgccccacucggcccagaccucaauccuuaccucucacaccuagcacgcauguauaacggcuacgccggcggcuucgaaguccaagucauccucgccggcaacgccuucacagcaggaaaaguaaucuucgcagcagucccacccaauuuccccaccgaaggacuauccccgucacaagucaccauguucccccacaucgucguagacguacgccaacuagaaccuguucuaaucccccucccagacgucagaaauaacuucuaccacuacaaccaauccaacgauccuaccaucaaacucaucgcaaugcuauacacaccccuacgggccaacaacgccggcgacgacgucuucaccgucagcugcagaguccuuacccgccccucccccgacuucgauuucauuuucuuagucccacccaccgucgaaucccgcaccaaacccuucuccguaccaguacuaaccguugaagaaaugacuaacucacgauuccccaucccccuagaaaaacucuucaccggccccuccggagccuucgucguucagccucaaaacggccgaugcacaacagacggcguacuccucggcacaacccaacucuccccaguaaacaucugcaccuuccgcggcgacguaacacacaucaccgguuccagaaacuacaccaugaaccucgccucccaaaacuggaacaacuacgacccuacagaagaaaucccugcuccccucggcaccccagacuucgucggcaaaauccaaggcaugcucacccaaaccacacgaacggacggauccacacgcggccacaaagccacagucuacaccggcucagccgacuucgcucccaaacuaggcagaguccaauucgaaaccgacacagaccacgauuucgaagcaaaccagaacaccaaauucaccccaguaggcgucauccaagauggcuccacaacccaccgcaacgaaccccaacaaugggucuuaccauccuacucaggccgaaacacccauaacguacaccucgcacccgccgucgcucccaccuuuccgggcgaacaacuccuuuucuuccgcuccaccaugcccggauguuccggcuacccuaauauggaccucgacugccuccucccacaagaauggguacaauacuucuaccaagaagccgcaccagcacaauccgacgucgcacuacuccgauucguaaacccagacaccggucgcguacuauucgaaugcaaacuccacaaaucaggauacgucaccguagcucacaccggacaacacgaccucgucauacccccaaacggcuacuuccgcuucgacuccuggguaaaccaauuuuacacccucgcucccauggguaacggcacuggccgaagacgcgucuaa

SEQ ID NO: 37926 - RNA, 1620 nt, Artificial Sequence
  derived and/or modified sequence opt11 from VP1__Norovirus_and/or_Norovirus-like__KF060140
augaaaauggccuccuccgacgcgaaccccuccgacggcucggccgcaaaccucguccccgaagucaauaacgaagucauggcacuagaacccguagucggcgccgccaucgccgcucccgucgccggccaacaaaaugucaucgacccauggauccgaaauaacuucguccaagcccccggaggcgaguucaccgucucaccccggaacgccccaggugaaauccuauggucggccccacuuggaccagaccucaacccauaccucucccaccuagcucgcauguacaacggauacgccggagguuucgaaguccaagucauacucgcaggaaacgccuucacugcuggcaaaaucaucuucgccgccguacccccaaauuuucccaccgaagggcucuccccaucccaagucaccauguucccccacaucauagucgacguccgccaacucgaaccuguccucauaccccuaccagacauccgaaacaacuucuaccacuacaaccaaucaaaugauagcaccaucaaacucauagccaugcucuacacaccccucagagccaacaaugcaggcgacgacgucuucacagucucaugccgaguccucacccgccccucccccgacuucgacuucaucuuccucguaccucccaccguagaaucccgaaccaaacccuucuccguccccguccuaacuguagaagaaaugaccaacucacgauuccccaucccccucgaaaaacuuuuuaccggacccucauccgccuucgucguacaaccucaaaacggccgaugcacaacugacggcguacuccucggaaccacccaauuaagcccugucaauaucugcaccuuucgaggcgacguuacacacaucacuggaucacgcaacuacaccaugaaccucgccucccaaaacuggaauaacuacgaccccacagaagaaauccccgccccacucggcacccccgacuucgucggaaagauccaaggcguccuaacccaaaccacccgcaccgauggauccaccagaggccacaaagccaccgucuacacaggaagcgccgacuucgcuccaaagcucggaagaguucaauucgaaaccgacacagaccacgacuucgaagcaaaccaaaacaccaaauucaccccgguaggaguaauacaagacggcucuacuacccaucgaaacgaaccacaacaauggguccuucccuccuacagcggacgcaacacacacaacgugcaccuagcccccgccguagccccaaccuucccaggcgaacaacuccucuuuuuccguucaacaaugccgggcugcagcggcuaccccaacauggaccucgacugccuucuaccacaagaauggguacaauauuucuaccaagaagcagccccagcucaguccgacguagcccuucuacgcuucguaaacccggacaccggccgaguccuauucgaaugcaaacuacacaaguccggcuacguaaccgucgcacacacaggacaacacgaccucguaaucccacccaacggauacuuccgauucgauuccugggucaaccaauuuuacacgcucgcccccaugggcaacggcaccggccgccgccgcguauaa

SEQ ID NO: 37927 - RNA, 1620 nt, Artificial Sequence
  derived and/or modified sequence opt11 from VP1__Norovirus_and/or_Norovirus-like__KX354132
augaaaauggcuagcucagacgccaaccccuccgacggcuccgccgcaaaccuugucccugaagucaacaacgaagucauggcacucgaaccagucgucggcgccgccauagcagcacccguugccggccaacagaacguaaucgaccccuggauccgaaacaauuucguccaagcaccaggaggagaguucacagucucuccccgcaacgcccccggcgaaauacuaugguccgccccucucggucccgaccuuaauccuuaccucucucaccuugcccgcauguacaacggcuacgccggcgguuucgaaguacaggucauccucgccggcaacgccuucaccgccggaaaaaucaucuucgcagccguuccacccaacuuccccaccgaaggccuaucaccaucacaagucaccauguucccacacauuauagucgauguucgccagcucgaacccguccucauaccacuccccgacguccgcaacaacuucuaucacuacaaccaacucaacgacucaacuaucaaacucauagccaugcucuacacuccccuccgcgccaacaacgccggcgacgacgucuucaccgucuccugccgcguacucacccgacccaguccagauuucgacuucauuuuccucguucccccaacagucgaaucccguacaaaacccuucuccguaccaauacucaccguggaagaaaugacaaacucccgcuuccccauaccccucgaaaaacucuucaccggccccucauccgccuucguuguccaaccccaaaacggccgcugcacuacagacggcguccuacugggaaccacccaacucucaccagucaauaucugcacauucaggggugacaucacacacaccacaggaucacacaacuauacaaugaaccucgccucccaaaacuggaacucauacgaucccaccgaagaaauacccgcuccacucggcaccccagacuucgucggaaagauccaaggcguccucacacaaaccacccgagccgacggcuccacucgcggccacaaggccaccgucuacacuggcucagccgacuucgcacccaaacuaggacgaguacaauucgaaaccgacaccaaccacgauuuugaagccaaccaaaacaccaaguucacccccgucggcgucauacaagacggaggcaccacccaccgcaacgaaccccaacaauggguucucccauccuacuccggccguaacacccacaacguccaccucgcccccgccgucgcccccaccuucccaggcgaacaacuccucuucuucagauccaccaugccgggcugcuccggauaccccaacauggaccuggacugccuccucccacaagaauggguacaguucuucuaccaagaggcagcccccgcacaaucugacgucgcauuacuuagauucgucaacccagacaccggccgaguacucuucgaauguaaacuccacaaaucuggauaugucaccguagcacacaccggccagcacgacuuagucaucccacccaacggcuacuuccgcuucgauuccugggucaaccaauucuacacccucgcccccaugggcaacggaacuggccggcgacgaguauaa

SEQ ID NO: 37928 - RNA, 1620 nt, Artificial Sequence
  derived and/or modified sequence opt11 from VP1__Norovirus_and/or_Norovirus-like__KX354006
augaaaauggccagcucagacgcuaacccuuccgacggcuccgcagccaaccucguacccgaagucaacaacgaagucauggcacucgagcccgucgucggcgcagcaaucgccgcccccgucgcaggacaacaaaacguaaucgacccauggauucguaacaacuucguacaagcacccggaggagaguucaccgucucaccccgcaacgccccaggcgaaauacucugguccgcaccccucggcccggaccuuaaccccuaccucucccaccucgcccgcauguacaacggauacgcuggcggcuucgaaguccaagucauacucgccggaaacgccuucaccgccggaaaagucaucuucgccgccguacccccaaacuucccaaccgaaggccucucaccaucccaagucacaauguucccccacauagucguagacguccgacaacuagaacccguccucaucccacuacccgacguccgaaacaacuucuaccacuacaaccaauccaaugaccccacaaucaaacucaucgccaugcuuuauacaccacuaagagccaacaaugcaggcgacgacguauucaccgucuccugccgcguccucacccgccccagcccagacuucgacuucaucuuccucguucccccaacagucgaaucccgcaccaaacccuucuccgucccaguccucaccgucgaagaaaugaccaacucacgcuucccaaucccccuagaaaaacuauucaccgguccauccuccgccuucgucguccaaccacaaaauggccgcugcaccacugacggcguacuccucggcacuacacaacucucucccgucaacauaugcacuuucagaggcgacguaacucacaucacuggcucccgaaauuacaccaugaaccucgccucccagaacuggaacaacuacgaccccaccgaagaaguucccgcaccccuaggcacacccgacuucguaggcaaaauucaaggaaugcucacacaaaccacccgcaccgacggcucaacaagaggccacaaggccaccgucuacacaggauccgccgacuucacucccaagcucggucgcauucaauucgaaacagauacagaucacgacuucgaagccaaccaaaacacaaaguucacccccgucggcguaauccaggacggcucuacaacccaccgcaacgaaccccagcaauggguccuaccuuccuacuccgguagaaacacccacaacguccaccucgccagcgcaguagcccccacauuccccggcgaacaacuacucuucuuucguucaacaaugcccggcuguuccggcuacccaaauauggaccucgacugccuccuaccccaagaauggguccaauacuucuaucaagaagccgccccugcccagucugacguagcacuacuacgauucguaaaccccgacaccggccguguccuauuugagugcaaauuacacaaaucaggcuauguaaccgucgccuacaccggacaacacgaccucguaaucccacccaacgguuacuucagauuugacuccuggguaaaccaauuuuacacacucgcccccaugggcaacggaaccggcagacgccgaguauga

SEQ ID NO: 37929 - RNA, 1620 nt, Artificial Sequence
  derived and/or modified sequence opt11 from VP1__Norovirus_and/or_Norovirus-like__KX354145
augaaaauggcauccuccgacgccaacccauccgacggauccgccgccaaccuaguccccgaagucaacaaugaaguuauggcccucgaacccguugucggcgccgcuaucgcggcccccguagcuggucaacaaaacgucaucgaccccuggauccgcaacaacuucguacaagcccccggcggcgaguucaccgucuccccaagaaaugccccaggcgaaauccuaugguccgcaccccucggaccagaccucaaccccuaucuuucacaccucgcacgcauguacaaugguuacgccggaggcuucgaaguacaagucauacucgccggcaacgccuucaccgccggcaaaaucaucuucgcagccguaccacccaacuuccccaccgaaggacucucccccucccaaguaaccauguucccccacaucaucgucgacguccgccaacucgaacccguucuaaucccccuccccgauguacgcaacaauuucuaccacuacaaccaauccaacgacuccacaaucaaacugaucgccaugcucuacacaccacuaagagccaacaacgcuggcgacgacgucuucaccgucuccugccgcguacucacacggccauccccagacuucgacuucaucuuccucgucccaccuaccgucgaaucccgcacaaaacccuucucaguaccaguccuaacagucgaagaaaugacaaacucccgcuuccccaucccccuugaaaaacucuucacaggcccguccucggcuuucgucguccaaccacaaaacggccgaugcaccacagacgggguacuccucggaaccacccaacucucccccguaaacaucugcaccuuccggggcgacguuacccacauuacaggcucgcgcaacuacacaaugaaccucgccucccagaacuggaacaacuacgaccccaccgaagaaaucccagcaccccuaggcacaccagacuuugucggaaaaauucaaggcaugcuaacacaaaccacccgaaccgacggaucaacccgaggacacaaagccaccgucuacacaggaucugccgacuucgcaccgaaacucggacggguucaauucgaaaccgacaccgaucacgacuucgaagccaaccaaaacaccaaauucacucccguaggcguaauccaagacggcucaaccacccaccguaacgaaccacaacaauggguucuccccagcuacuccggacgcaacacccacaacguccaccuugcccccgccgucgccccuacauuccccggagagcaacuucuauucuuccgcuccaccaugcccggaugcucuggcuaccccaacauggauuuagauugccuccucccucaagaauggguucaauauuucuaccaagaagcagccccggcccaauccgacgucgcacuccuacgcuucguuaaccccgacaccggccgaguccucuucgaaugcaaacuacacaaauccggcuacgucaccgucgcacacacaggccaacacgaccucguuauucccccuaacgguuacuuccgauucgacuccugggucaaccaauucuacacacucgcccccaugggcaacggaaccggccgccgcagaguauaa

SEQ ID NO: 37930 - RNA, 1620 nt, Artificial Sequence
  derived and/or modified sequence opt11 from VP1__Norovirus_and/or_Norovirus-like__KX354140
augaaaauggccuccucggacgccucccccucagacggcucagccgcuaaccuugugcccgaaguaaacaaugaagucauggcccuagaacccgucgucggcgcagccaucgcagcccccguagcaggccaacagaacguuauagaccccuggauacguaauaauuucguccaagccccaggcggagaguucacuguauccccacguaacgcacccggcgaaauccuuuggucagcuccacuuggccccgacuuaaaccccuaucucucccaucuugcacgcauguacaacggcuacgcaggcgguuucgaaguccaagucauccucgccggcaacgccuucacagcaggcaaaaucaucuucgccgccgucccacccaauuuccccacagaaggcuugucacccucccaagucaccauguuuccccacauaaucguagacgugcgucaacucgaaccaguccuuauaccccucccagacguacgcaacaacuucuaccacuauaaccaauccaaugacucaaccaucaaacuuaucgcaaugcuauacacaccccuccgcgccaacaacgccggcgacgacgucuucacugucuccugccgcguccuuacacgccccuccccugacuucgacuucaucuuccuagucccaccaaccguugaaucccgcacuaaacccuucuccguccccguacucacagucgaagaaaugaccaacuccagauuccccaucccacuggaaaaacuauucaccggcccaagcucagccuucgucguccaaccccaaaacggccguugcaccacugacggcguacuccuuggcaccacucaacuauccccagucaacauaugcacuuuccgcggcgacgugacccacaucacuggcucacgaaacuacaccaugaaccucgccucccaaaacuggaacaauuacgaccccacagaagaaauccccgcaccccucgccacacccgacuucguuggcaaaauccaagguaugcucacacaaaccacccgcaccgacggauccacacgcggacacaaggccaccgucuacaccggcuccgccgacuucgccccaaaacucggucgcguccaauucgaaaccgauaccgaccacgauuucgaagccaaccaaaacacuaaauucacccccgucggcgucauacaagacggcuccacgacacaccgcaacgaaccccaacaauggguccuccccuccuacuccggacgcaacacacacaacguccaccucgcccccgccgucgcccccaccuuucccggcgaacaacuccuauuuuuccgguccaccaugcccggcugcucaggcuacccaaacauggaccucgacugccuccucccccaagaauggguacaauacuucuaccaagaagcagcacccgcccaauccgacguugcccuccuccgcuucguaaacccugacacaggacgcguccucuucgaaugcaaacuccacaaauccggauacgucacugucgcccacaccggccaacacgaccucguaaucccacccaacgguuacuuccgcuuugacuccuggguaaaccaauucuacacccucgcacccaugggcaacggaacuggccgccgacgggucuaa

SEQ ID NO: 37931 - RNA, 1620 nt, Artificial Sequence
  derived and/or modified sequence opt11 from VP1__Norovirus_and/or_Norovirus-like__KX354119
augaaaauggccuccuccgacgccaacccauccgacgguucagcagccaaccuaguacccgaaguuaacaacgaaguuauggcccuugaacccgucguaggcgcggccaucgccgccccagucgcgggccaacaaaacgucauagaccccuggauccgcaacaacuucguacaagcccccgguggcgaguucaccgucucaccacgaaacgcaccaggcgaaauccucugguccgcgccccucggcccugacuuaaacccauaccuuucacaccucgcccgaauguacaacggauacgccggaggcuucgaaguacaaguuauucuagccggcaacgccuucaccgcaggaaaaauaauauucgcugcaguacccccaaacuuccccaccgaaggccuaucccccucacaagucaccauguuuccccacauuaucgucgacguccgacaacuggaacccguacuaauaccgcuccccgacguacgcaacaacuucuaccacuacaaucaaagcaacgacuccaccaucaaacuaaucgcaaugcuauacacgccccugcgcgccaacaacgccggagacgacgucuucaccguauccugccgcguccuaacacgacccucccccgacuucgacuucauuuuccuagucccucccaccgucgaaucacgcaccaaacccuucuccguccccauacucaccguagaagaaaugaccaauucccguuuccccaucccccuagaaaagcuauucaccgguccauccuccgcauucgucguccaaccccaaaacggccgcugcaccaccgacggcguacuacuuggcaccacacaacucagccccgugaacaucugcaccuuccgaggagacaucacccacauuaccggcucccacaacuacaccaugaaccuagcuucucagaacuggaacagcuacgacccaaccgaagaaauccccgcaccacucggcacacccgacuucguaggcaaaauacaaggaguccuaacccaaaccaccagagccgacggguccacacgcggccacaaggccaccgucuacaccggauccgccgacuuugcccccaaacuuggccgcguacaauucgaaacagacacaaaccaugacuucgaagcuaaccaaaacaccaaauucacaccaguaggcgucauccaagacggcggaaccacacaucgcaacgaaccccaacaauggguccucccuuccuacuccggccgcaauacacacaacguacaccucgcccccgcagucgcaccgaccuuccccggcgaacaacuccucuucuuccgauccaccaugcccggcugcuccggauacccuaacauggaccuggacugccuucucccccaagaauggguucaauucuuuuaucaagaagcugcacccgcccaaucagacgucgcccuacuacgauucguaaacccagacaccggccgcguacuuuucgaaugcaaacuccauaaacccggauacgucaccgucgcucacacaggccaacacgaccuagucaucccaccaaacggauacuuccgguucgacucauggguaaaccaauucuacacccucgcucccaugggaaacggcacaggccgacgcagagucuaa

SEQ ID NO: 37932 - RNA, 1620 nt, Artificial Sequence
  derived and/or modified sequence opt11 from VP1__Norovirus_and/or_Norovirus-like__KX354018
augaaaauggccagcucagacgcaaaucccucagauggcucagcagccaaccucguccccgaaguaaacaaugaagucauggcccuagaacccguuguaggagccgcaaucgcugccccagucgcaggccaacaaaacguaauagaccccuggauccgaaacaacuucgugcaagcacccggcggcgaguucaccgucucccccagaaacgccccaggcgaaauccuaugguccgcaccccuaggaccagaccuuaaccccuaccucucgcaccucgcccgaauguacaacggcuacgccggcggauuugaaguccaaguuauccucgccgguaacgccuucaccgccggcaaaauaaucuucgccgccguacccccaaacuuccccacugaaggccuaucccccucccaagucacaauguucccccacaucaucgucgacguccgccaacucgaaccaguccucauaccccuuccagacguccgaaauaacuucuaucacuacaaccaaucuaacgauucaaccaucaaacucaucgcaaugcuauacacaccccuccgcgccaacaacgccggggacgacguguucaccgucagcugcagaguacuaacccgcccuucacccgauuuugacuucaucuuccucgucccucccaccgucgaaucccgcaccaaacccuucucaguccccguccucaccgucgaagaaaugacaaacucgcgauuccccauuccccuugaaaaacuauucaccggccccucaucagccuucgucguccagccccagaacggccgaugcaccaccgacggcguccuccucgguacgacgcaacucucacccgucaacaucugcaccuuccgcggagacguaacccacaucacaggcucacgaaauuacaccaugaaccuagcuucacaaaacuggaacaacuacgacccaacggaagaaaucccagccccucuagguacaccugacuucgucggaaaaauccaaggaaugcucacccaaaccacacgcacugauggauccacccgcggacacaaagccaccguauacacugguucagcugacuucgccccuaaacucggacgcgugcaauucgaaaccgacacugaccacgacuucggcgcaaaucaaaacaccaaauucacacccgugggcgucauucaagacggauccacaacccaccgcaaugaaccccaacaauggguacucccauccuacuccggccgcaauacccacaacguucaccucgccccagccguagcccccacauucccaggcgaacaacuccucuucuuucgcuccaccaugcccggcugcuccggauacccaaauauggaccucgacugucuccucccccaagaauggguccaauacuucuaccaagaagccgcccccgcacaauccgaugucgcccucuuacgauucgucaaccccgacacaggccgcguccucuucgaaugcaaacuccacaaauccggcuacgucaccgucgcccacaccggacaacacgaccucguuaucccacccaacggcuauuuccgcuucgacuccugggucaaccaguucuacacccucgcccccaugggaaacggcacaggucggcgaagagucuga

SEQ ID NO: 37933 - RNA, 1620 nt, Artificial Sequence
  derived and/or modified sequence opt11 from VP1__Norovirus_and/or_Norovirus-like__AB972499
augaaaauggcuuccuccgacgccaacccaucagacgguagcgccgcuaaccucguacccgaagucaacaacgaaguaauggcucuagaacccgucguaggcgccgccauugccgcacccgucgccggccaacaaaacgucaucgaccccuggauacgcaacaacuuuguacaagcccccggcggagaguucacugucucuccccgcaacgccccgggugaaauccucugguccgccccacucggcccagaccucaacccauaccucucccaccuagcccgcauguacaacggcuacgccggcgguuucgaaguccagguuauccucgccggcaacgcuuucaccgcuggcaaagucaucuucgccgcaguaccucccaacuucccaaccgaaggccucucaccaucacaagucacaauguucccacacaucaucgucgacguccgacaacucgaaccuguccuuauaccacuccccgacguccggaacaacuucuaccacuacaaccaaucaaacgacuccaccaucaaacucaucgcaaugcuuuacacaccacuacgcgcgaacaacgccggagacgaugucuuuaccgucuccugucgcguccuaacacgccccagccccgacuucgacuucaucuuccuagucccaccuaccguagaaucccgcaccaaaccauucuccguacccguccucaccgucgaagaaaugacaaacuccagauucccuauuccccucgaaaaacucuucaccggccccuccuccgccuuugucguccaaccccagaacggccgaugcaccacugacggaguacuccucggaacgacccaacucucgccagucaauauaugcacuuuccgaggagacgucacacacauaaccggcucacgcaacuacacuaugaaccuagccucacaaaacuggaacaacuacgaccccaccgaggaaaucccagcucccuuaggcaccccagacuucgucggcaaaauccaaggcaugcucacacaaaccacccgcacugacggcuccacccgaggccauaaagccacagucuacaccggauccgcagacuucgcccccaaacuaggccgcguccaauucgaaaccgacaccgaccacgacuucgaagccaaccaaaacaccaaauucacacccgugggagucauacaagacggcuccaccacucaccgcaacgaaccccaacaauggguccuaccauccuacucaggacgaaacacacacaacguccaccucgccccagccgucgcccccaccuuccccggcgaacaacuacucuucuuccgcagcacuaugcccggaugcucaggcuaccccaacauggaucuggacugccuccucccccaagaaugggugcaauacuucuaccaggaagcagcacccgcccaguccgacgucgcccuccuccgcuucguaaacccugacaccggccgaguacuauucgaaugcaaacuccacaaauccggauacgucacugucgcgcacacuggccaacaugaucucguaauacccccuaacggguacuuccgcuucgacucaugggucaaccaauucuacacacuagcccccaugggcaacggaaccggccgccgccgcgucuaa

SEQ ID NO: 37934 - RNA, 1620 nt, Artificial Sequence
  derived and/or modified sequence opt11 from VP1__Norovirus_and/or_Norovirus-like__KF060142
augaaaauggcgagcucagacgccaaucccuccgauggcuccgcagcuaaccuuguccccgaagucaacaacgaagucauggcucucgaccccgucguaggagccgccauagcagcccccgucgccggccaacaaaaugucaucgaccccuggauccgaaacaacuuuguacaagccccagguggagaguuuaccgucucaccccgcaacgcucccggugaaauacucugguccgcaccccuuggcccugaccucaauccauaccucucccaccucgcccgaauguacaacggcuacgccggaggcuucgaaguccaaguaauacucgcuggcaacgcauucaccgccggcaaaaucauuuucgcagcugucccacccaacuuccccacugaaggacucucccccucccaagucacaauguucccccacauuauagucgacguccgccaacucgaacccguccucaucccccuccccgacguacgcaacaacuucuaccacuacaaccaguccaacgacuccaccauaaaacuaaucgccaugcuauacacaccccuucgagccaacaacgccggagacgacgucuucaccgucuccugccgaguccucacccgacccucccccgacuucgacuucaucuuccucgucccacccacaguugagucccgcaccaaacccuucuccguccccguacucaccgucgaagaaaugacaaacucacgcuuccccauuccccuagaaaaacucuucaccggaccaagcagugccuucguuguacaaccccaaaacggacgcuguaccaccgacggcgucuuacuaggcacaacccaacucucacccgucaacauaugcaccuuccgcggagacgucacacauauaaccggcucccgaaacuauaccaugaaccuagcaucccagaacuggaacaacuaugaccccacugaagaaauccccgcaccacuuggcacacccgacuucguaggaaaaauccagggcaugcucacccaaaccacccgcaccgacggcagcacccgcggccacaaagcaacugucuacacagguucagcagacuucgcccccaaacuaggccggguccaauucgaaaccgauacagaccaugauuucgaagcaaaccaaaacaccaaguucacucccgucggcgucauucaagacggcuccaccacccaccgaaacgaaccccaacaauggguccucccgucauacucaggccgcaacacccacaacguccaccucgccccugcugucgcacccaccuuucccggcgaacaacuacuauucuuccgcucgaccaugcccggcugcucaggauaccccaacauggaccuugacugccuccucccccaagaauggguacaauacuucuaccaagaggccgcccccgcccaauccgacgucgcacuccuccgcuucgucaaccccgacaccggacgcguacuauucgaaugcaaacuucauaaaagcggauacgucaccguagcacacaccggacaacacgaccucgucauacccccgaacggcuauuuccgauucgauucauggguaaaccaauucuacacccucgcaccaaugggcaacggcaccggacgccgccgcgucuaa

SEQ ID NO: 37935 - RNA, 1620 nt, Artificial Sequence
  derived and/or modified sequence opt11 from VP1__Norovirus_and/or_Norovirus-like__KF060138
augaaaauggcaagcucagacgccaaccccagcgacggcagcgcugcaaaccuaguccccgaagucaacaacgaaguaauggcacuagaacccguagugggcgcagccaucgccgcccccgucgccggacaacaaaacgucauagaucccuggauccgcaacaacuucguccaagcaccgggcggcgaauuuaccgucucaccccgaaacgcccccggcgaaauccugugguccgcuccccucggcccugaccucaacccauaccuaucccaccucgcacgcauguacaacgguuacgccggcggcuucgaaguacaagucauacuagcaggcaacgcauucaccgcaggcaaaaucaucuucgccgccgucccaccaaacuuccccaccgaaggccucagccccucucaggucacaauguucccgcacaucaucguagacguccgucaacucgaaccuguccuaaucccccuccccgacguccgcaacaauuucuaccacuacaaucaaucaaaugacuccacgaucaaacucauagccaugcucuauacaccgcuacgugcaaauaacgcaggcgacgacguauucacgguaucaugccgcguacuaacccgacccagccccgacuucgacuucauauuccuaguacccccaacuguagaaucccgcacaaaacccuuuucuguccccguacucacaguagaagaaaugaccaacucccgcuuccccauaccccuagaaaaacucuucaccggcccauccaacgcauucguagugcaaccacaaaacggacgcugcaccaccgacggcguccuucuaggcaccacgcaacuaucacccgucaacauaugcacauuccgcggcgacguaacccauaucacaggcucccgcaacuacaccaugaaccucgccucccaaaacuggaacaacuacgauccaaccgaagaaauccccgcaccucucggcacaccugacuucguaggcaaaauccaaggcaugcucacccaaacaacacgcaccgacggaucaacucgcggccacaaagcaaccguauacaccggcuccgcugacuucgcaccuaaacucggccgaguccaauucgaaacagacaccgaccacgacuucgaagcaaaccaaaacacaaaauuuacacccguaggcgugauacaagacggaucaacgacgcaccgaaacgaaccccaacaauggguccuaccauccuacucaggccgcaacacccacaacgugcaccucgcccccgcagucgccccaaccuuccccggcgaacaacuccucuucuuccgauccacaaugcccggcugcagcggauaccccaacauggaccucgacugucuccucccccaagaauggguucaauacuucuaccaagaagccgccccggcccaauccgacgucgcucuccugcgcuucgucaauccagauaccggcagaguccucuucgaaugcaaacuccacaaaucgggcuacgucaccgucgcccacacuggacaacacgaccucgucaucccacccaacgguuacuuccguuucgacagcugggucaaccaauucuacacacuugcacccaugggaaacggaaccggccgccgccgcgucuga

SEQ ID NO: 37936 - RNA, 1620 nt, Artificial Sequence
  derived and/or modified sequence opt11 from VP1__Norovirus_and/or_Norovirus-like__KP784697
augaaaauggcgucaucugacgccaaccccucagacggcucugccgcuaaccuuguucccgaggucaacaacgaagucauggcccucgaacccgucgucggugcugcaaucgccgcccccgucgcaggucagcaaaacgucaucgacccauggauccgcaacaacuucguucaagcacccggaggcgaguucacagucuccccaagaaacgcccccggcgaaauccucugguccgcaccucucggacccgaucuaaaucccuaucuaucccaccucgcacguauguacaauggcuacgcaggaggcuucgaaguacaagucauccucgccggaaacgccuucaccgcaggcaaagucaucuucgcagccgacccucccaacuuccccaccgaaggccuaucccccucccaaguaacaauguucccacacaugaucguugacguccgccaacuagaaccaguccucaucccccuacccgacguucgcaacaauuucuaccacuacaaccagucaaacgacccgacccucaaacuaaucgcaaugcucuacacccccuuacgugcaaacaacgccggcgacgaugucuucaccguauccugccgcguacucacccgaccgucccccgacuucgacuucauauuucucguaccuccaacagucgaaucccgaaccaaacccuucucuguaccaaucuuaacaguggaagaaaugacaaacucccgcuucccaauaccacucgaaaaacucuucaccggcccaucgagcgccuuuguaguacaaccccaaaacggacgaugcaccaccgacggaguccuacucggcaccacccaacucucccccgucaacaucugcaccuuccgcggcgacaucacccacaucaccggcucccgaaacuacacaaugaaccucgcaucacaaaacuggaacaacuacgaccccacagaagaaauccccgcaccucucgguacccccgacuucguaggaaaaauccaaggcaugcugacccaaaccacacgcaccgauggcagcacccgcggacacaaagccaccgucuacacagguuccgccgacuucgcuccuaaacuuggccgcguacaauucgaaaccgacaccgaccacgacuucgaagccaaccaaaacaccaaauucacccccgucggaguaauacaagauggcuccacaacccaccgcaacgaaccccaacaauggguccuucccuccuacuccggacgcaacacccacaacguacaccucgccccugcagucgcccccaccuuccccggcgaacaacuacucuucuuccgauccacaaugccaggaugcuccggcuaccccaacauggaccuagacugccuccucccucaggaauggguccaauacuuuuaccaagaagcugcacccgcccaauccgacgucgcccuacuacgauucgucaaccccgacaccggccgaguacuauuugaaugcaaacuacacaaauccggauacguaacagucgcccacacaggccaacacgaccugguaaucccaccuaacggcuacuuccgauucgacucaugggugaaccaauucuacacccucgccccaaugggcaacggcaccggucgucgacgcguauag

SEQ ID NO: 37937 - RNA, 1620 nt, Artificial Sequence
  derived and/or modified sequence opt11 from VP1__Norovirus_and/or_Norovirus-like__KF060111
augaaaauggcaucguccgacgccaaccccuccgauggauccgccgcaaaccucguacccgaggucaacaacgaagucauggcacucgaacccguagucggugccgccauagccgcccccguagccggccaacaaaaugucauagaccccuggauacgcaacaauuucguccaagcaccaggcggagaguucaccgucagcccacgaaaugcacccggagaaauccucugguccgcaccccucggacccgaccuuaaccccuaccucucccaccucgccagaauguacaacggcuacgcggguggauucgaaguccaaguaauacucgccggcaacgccuucacagcaggcaaaauaaucuucgccgccgucccacccaacuuucccaccgaaggacuaucaccaucacaagucaccauguucccccacauaauagucgacguccgccaacucgaaccaguacucaucccacuccccgacguccgcaacaacuucuaccacuacaaccaauccaacgacucaaccauaaaacucauugccaugcucuacacaccacuccgcgcuaacaaugcaggagacgacgucuucaccgucagcugccgcguccucacccgccccucccccgacuucgacuucauauuccucgucccucccaccguagaaucccggaccaaaccuuucagcguucccguccucacagucgaagaaaugaccaacucccgauuccccaucccacucgaaaaacucuucaccggccccuccucugcauucguaguccaaccccaaaacggccguugcacaaccgacggcguccuccucggcaccacccagcuaucaccagucaauaucugcacauuccgaggcgaugucacacacauaacagguagccgaaacuacacuaugaaccucgcaucccaaaauuggaacaacuaugaccccacugaggagauuccggccccacucggaaccccagacuucgugggaaaaauucaaggcaugcuaacacaaaccacaagaaccgacgguucaacccgcggacacaaagcgaccgucuacacaggaucagccgacuucgccccaaaacucggccgcguacaauucgaaaccgacacugaccaugacuucgaagcaaaccaaaacaccaaauucacacccguuggagucauccaagacggcgguacaacccaccgcaacgaaccccaacaauggguacuaccauccuacuccggccguaacacacacaacguccaccucgcccccgccguagccccuacuuuuccaggagaacagcuacuauucuuuagaucuaccaugcccggcugcuccgguuacccaaacauggaccucgacugccuccuuccccaggaauggguacaauacuucuaccaagaagcagccccugcacaaucagauguagcccuacuccgcuucgucaacccagacaccggccgcguacuauucgaaugcaaacuacacaaauccggcuacguaaccgucgcacacacuggccaacacgaccuaguaaucccucccaacggcuacuuccgauucgacucuugggugaaccaauucuauacccucgcccccaugggcaacggcaccggccgccgccggguguaa

SEQ ID NO: 37938 - RNA, 1620 nt, Artificial Sequence
  derived and/or modified sequence opt11 from VP1__Norovirus_and/or_Norovirus-like__KF060089
augaaaauggcaucaucugacgccaaccccagcgauggcucagcagcaaaccucguccccgaagucaacaacgaagucauggcacuagaacccgucgugggcgccgccaucgccgccccuguagccggccaacaaaaugucauagacccauggauccgcaauaacuucguccaagccccaggcggcgaguucaccgucucaccccgcaacgcucccggagaaauccugugguccgcaccccuuggcccagaccucaaccccuaccuuucccaccucgcccgcauguacaacggcuacgcaggcggcuucgaaguccaagucauacuagcuggcaacgccuucacagccggaaagguaaucuuugcagccgucccacccaacuucccuacagaaggccucucaccaucccaaguuaccauguucccccacauaguagucgacguccgccagcucgaacccguccucauaccacucccggacgucagaaacaacuuuuaccacuacaaucaauccaacgacuccacaauaaaacuaaucgccaugcuauacacaccccuccgagccaacaacgccggugaugacguauucaccgucuccugccguguacucacacgaccaucccccgacuucgacuuuaucuuccucgucccuccaaccguagaaucacgcaccaaacccuucuccguacccguccuaaccgucgaagaaaugaccaauucacgcuuccccauccccuuagagaagcuauucaccggucccuccuccgccuucguaguccaaccccaaaacggccggugcacaaccgacggaguacuccucggcacaacacagcucucaccagucaacauaugcaccuucagaggcgacguaacacacauaaccggaucccgcaacuacaccaugaaccuagccucccaaaacuggaacaauuacgaccccaccgaagaaaucccagcaccccuaggcacccccgacuucgucgguaaaauccaaggaaugcucacccagaccacacggaccgacggauccaccagaggccacaaagccaccgucuacaccgggucagccgacuucgcacccaaacuaggccgaguacaauucgagaccgacacagaccacgacuucgaagccaaccaaaacacaaaguucaccccagucggagucauccaagacggaucaaccacacaccgcaacgaaccccaacaauggguacuccccucauacaguggccgaaacacccacaacguccaccucgcccccgcuguagcccccaccuuccccggcgaacagcuccuauucuuccgcuccaccaugcccggcugcucaggcuauccaaacauggaccuagacugccuucuaccucaagaauggguccaauacuucuaccaagaagccgcacccgcccaauccgacguagcccuacuccguuucgucaaccccgacacuggccgcguccuauucgaauguaaacuccacaaauccggauacguaaccgucgcccacaccggccaacacgaccuagucauacccccuaacggcuacuuccgcuucgacucuugggucaaccaauuuuacacccuagcaccaaugggcaacgguaccggccgccgacgaguuuaa

SEQ ID NO: 37939 - RNA, 1620 nt, Artificial Sequence
  derived and/or modified sequence opt11 from VP1__Norovirus_and/or_Norovirus-like__KP096333
augaaaauggccucauccgacgccaaccccagcgacggcucaacagcaaaccuaguacccgaaguuaacaaugaaguaauggcccuagaacccgucgucggcgccgcaaucgcggcacccgucgccggacagcaaaacguaaucgacccauggauccgaaacaacuucguccaagccccuggcggagaguucaccgucagcccucgcaacgcccccggagaaauacucuggagcgcaccccucggccccgaccuaaaccccuaccuaucccaccucgcccgcauguacaacggauacgccggcggcuucgaaguccaaguaaucuuagccggaaacgccuucaccgcaggcaaaauaaucuucgcagccguaccacccaacuuccccaccgagggacucucucccucccaaguaaccauguucccccacaucauagucgacguacgucaacuugaacccguucucaucccccucccagacguacgcaacaacuucuaccacuacaaccaaucaaaugaccccacaauaaaacucaucgccaugcuauacacccccuugcgagccaacaacgccggcgacgacguguucacaguaucaugccgaguccucacacgccccucccccgacuucgacuucaucuuccucgucccacccaccguagaaucccgcaccaaacccuucuccguucccguacucaccgucgaagaaaugacgaacucccgcuuccccaucccccuugaaaaacucuucaccggcccaucaucagccuucaucguacaaccccaaaacggccgcugcaccaccgacggcguccuccucggcacaacccaauuaucucccgucaacaucugcaccuuccgcggcgauguaacccacaucucaggaucccguaacuacacaaugaaccucgccucccaaaacuggaacuccuaugaccccaccgaagaaaccccugcaccccucggcaccccugacuucguaggcaaaauacaaggcguccucacacaaaccacccgcaccgacggcuccacccgcggucacaaagccaccgucuacaccggauccgccgacuucucccccaaacuaggccguguccaauuugccaccgacaccgacaacgacuucgucacuaaccaaaacaccaaauucacgcccgucggaguuauccaagacgguucaacaacaccccgaaacgagccccaacaauggguacuaccuucauacucuggccgcaacacccacaacguucaccuagccccagccgucgcacccaccuucccaggagaacaacuuuuauucuuccguagcaccaugccaggcugcuccggcuaccccaacauggaccuugacugccuccuaccccaggaguggguacaauacuucuaucaagaagcagccccagcccaaucagacgucgccuuacuuagauucgucaaccccgacacaggccgcguccucuucgaaugcaaacuacacaaaacaggcuacguuaccgucgcccacacuggccaacacgaccuaguuaucccuccaaacggcuacuuccgcuucgacucuuggguuaaucaauucuacacgcucgcccccauggguaacggcaccggccguagacgagucuaa

SEQ ID NO: 37940 - RNA, 1620 nt, Artificial Sequence
  derived and/or modified sequence opt11 from VP1__Norovirus_and/or_Norovirus-like__KF060153
augaaaauggccuccucagacgcaaacccauccgacggauccgccgcaaaccuaguccccgaagucaacaacgaaguuauggcacucgaaccagucguaggagcagcaauagcagcacccgucgccggccaacaaaacgucaucgaccccuggaucagaaacaacuucguccaagcacccggaggagaguucaccgucucaccccgcaacgcacccggcgaaauccuuugguccgccccacucggaccagaccuaaaccccuaucuaucccaccucgcccguauguacaacggcuacgccgguggcuucgaagucgaagucauccucgccggcaacgcauucacagccgguaaaaucauauucgccgcagucccaccaaacuucccaacagaaggccucuccccaucacaagugaccauguuuccccacaucauaguagacguccgucaacucgagcccguccuaaucccccuccccgacguccgcaacaacuucuaccauuacaaccagucaaacgauucaaccaucaaacuuauagccaugcuauauaccccucuacgcgccaauaacgccggugacgacgucuucacaguaucaugccgaguccucacucgcccauccccagacuucgacuucaucuuccuaguaccuccaaccguagaaucccgcaccaaaccauucagcguccccguacugacugucgaagaaaugaccaacucccgcuuccccauaccccucgaaaaacucuucaccggcccuucaucagcuuucgucguccaaccccaaaacggccgcugcaccacagacggcguccuacucggcacaacccaacucucuccagucaacaucugcaccuuccgcggugacguaacccacauuaccggaucuagaaacuacaccaugaaccucgcaucacaaaacuggaacaacuacgaccccacagaagaaauccccgcgccccuaggcacgccagacuucgucgggaagauccaaggcaugcuaacucaaaccaccagaaccgacggcucaacucgcggccacaaagccaccguuuacacaggcuccgccgacuucgcccccaaacucggccggguccaguuugaaaccgacaccgaccacgacuucgaagcuaaccaaaacacaaaauucacccccguuggcgucauacaagacggauccacaacacaccgaaacgaaccccaacaauggguacuccccuccuacuccggacgcaacacgcacaacguccaccucgcacccgcagucgcccccaccuuccccggcgaacaacuacuuuucuuccgaucaaccaugccaggcugcucaggcuaucccaauauggaccucgacugccuccuuccccaagaauggguacaauacuucuaccaagaagccgcccccgcucaauccgacgucgcccuacuucgauucguuaaccccgacacaggccgaguacuguucgaaugcaaacuacacaaaucaggcuacguaaccgucgcacacacuggccaacacgaucuagucaucccacccaacggauacuuccguuucgacucauggguaaaccaauucuacacccuagccccaaugggcaacggcaccggacgccgcagggucuag

SEQ ID NO: 37941 - RNA, 1620 nt, Artificial Sequence
  derived and/or modified sequence opt11 from VP1__Norovirus_and/or_Norovirus-like__KF060125
augaaaauggccucauccgaugccaaucccuccgacggauccgcagccaaccucguaccugaagucaacaacgaaguuauggcucucgagccagucguaggcgcagcuaucgccgcccccguagccggccaacaaaacguaaucgacccuuggauccgcaauaacuucguccaagcaccuggaggcgaguucacagucucaccccgcaacgccccaggcgaaauccuaugguccgcaccccuggguccagacuuaaaccccuaccuuucccaccucgcccguauguacaacggcuacgcaggagguuuugaagucgaaguaauccucgcuggcaacgccuucaccgcuggcaaaaucaucuucgcagccgucccucccaacuuccccacugaaggccuaucccccucccagguaaccauguucccucacauaauagucgacgucagacaacuagaaccaguccucaucccccuccccgacguccgaaacaacuucuaccacuacaaccaauccaacgacuccacaauaaaacucauagcuaugcuguacacuccacucagagccaauaacgcaggagacgaugucuucacaguauccugccgcguccucacccgcccuucgcccgacuucgacuucaucuuccuagucccaccaacugucgaaucccgcaccaaacccuucuccgucccaguccucacaguagaagaaaugaccaacucuagauuccccauuccacucgaaaaacuauucacaggcccuucauccgccuucgucguacaaccccaaaacggccgaugcaccaccgauggaguccuauuaggcacgacccagcucucacccgucaacaucugcaccuuccgaggcgaugucacccacaucacaggcucccgcaacuacacaaugaaucuagcaucacaaaacuggaacaacuacgaccccaccgaagaaaucccagcaccccucgguacacccgacuucguaggcaaaauacaaggcacccuaacacaaaccacccgcacagacggcucuacacgcggccacaaagccaccguauacaccggcucagccgacuucgccccaaaauuaggucgaguucaauucgaaacagacaccgaccacgauuucgaagcuaaccaaaacacaaaauucacccccguaggagucauccaagacggcagcaccacacaccgaaacgaaccccaacaauggguccuucccuccuacucuggccgcaacacccacaauguccaucuagccccagccgucgccccaaccuuccccggugaacagcuucucuucuuccgcuccaccaugcccggcugcucuggauaccccaacauggaucucgacugccuccucccacaagaauggguccaauacuucuaccaagaagcggccccugcccagucugacgucgcccuucugcgcuucguaaacccagacaccggccgcguacuauucgaaugcaaacuacacaaaucaggcuacgucaccgucgcccacaccggucaacacgaccuggucauucccccaaacggcuacuuccgguucgacucaugggucaaccaauucuacacccuagcaccaaugggcaacggcaccgggcgacgccgcgucuaa

SEQ ID NO: 37942 - RNA, 1620 nt, Artificial Sequence
  derived and/or modified sequence opt11 from VP1__Norovirus_and/or_Norovirus-like__KX354135
augaaaauggcguccucugacgccaaccccuccgauggcuccgcagcaaaccuugucccagagguaaacaacgaaguuauggcacuagaacccgucgucggcgccgccaucgccgccccaguagccggccagcaaaacgucaucgaccccuggauucgcaacaacuucguccaagcacccggaggcgaguucacuguauccccacgcaacgccccaggcgaaauccucuggucagcaccacucggaccagaucucaacccauaccuaucacaccuagcuagaauguacaacggauacgccggcggauucgaaguccaagucauccuugcugguaacgcuuucaccgccggcaaaauaaucuucgccgccguucccccuaacuucccuacugaaggacucucgccaucacaagucacaauguucccacacaucaucgucgacguccgacaacucgaacccguccucauaccacuuccagacguccgcaacaacuucuaccauuacaaucaaucuaacgacuccaccaucaaacucaucgccaugcuauacaccccgcuacgagcgaauaacgcaggcgacgacgucuucaccgucucuugccgcguccuaacccgacccuccccagacuuugacuucaucuuccucgugccgccaaccgucgaaucccgcacaaaaccauucagcguacccauucucaccgucgaagaaaugacuaacucccgcuucccaaucccucucgaaaaacucuuuacaggcccuuccuccgcauucgucguccaaccccaaaacggcagaugcacuacagacggaguacuccucggcaccacccaacuaucccccgucaauauaugcacauuucgcggcgacauuacccacaucacaggcucacacaacuacaccaugaaccucgccucacaaaacuggaacucauacgacccaaccgaagaaauucccgcacccuuaggcacccccgacuucguaggcaaaauacaaggaguccucacucaaaccacccgcgccgacggaucaacacguggccacaaggccacaguauacacaggcagcgccgacuucgcccccaagcuaggacgcguucaauucgaaaccgacaccaaccacgacuucgaagccaaccaaaacaccaaauucacaccaguaggagucauacaagacggcggaacaacccaccgcaacgaaccccaacaauggguccuucccucauacagcggucgaaauacccacaacguccaccuggccccugcaguagccccaaccuuccccggcgagcaacuccuauuccucaaaucaaccaugccaggcugcucaggcuaccccaacauggaccucgacugccuccuuccccaagaauggguccaauucuucuaucaagaagccgcuccagcacaaucggacgucgcccugcuccguuucgucaaccccgacaccggccgcguccucuuugagugcaaacuacacaaauccggcuacgucaccgucgcccacaccggccagcaugaccucgucaucccaccaaacggcuacuucagauuugauucauggguaaaccaauucuacacccucgccccaaugggcaacggcaccggcagacgacgaguauga

SEQ ID NO: 37943 - RNA, 1620 nt, Artificial Sequence
  derived and/or modified sequence opt11 from VP1__Norovirus_and/or_Norovirus-like__KX354045
augaaaauggccucauccgacgcaaacccuagcgacggauccgccgcaaaccuaguacccgacgucaacaacgaagucauggcccuugaaccugucgucggcgccgccaucgcagccccagucgccggacaacaaaacgucaucgacccauggauacguaauaacuucguucaagcacccggcggugaguucaccguaagcccccgcaacgcacccggcgaaauacucugguccgcaccccuuggccccgaccucaaccccuaccucucgcaccuugcccgcauguacaauggauacgcuggcggcuucgaaguccaagucguccuagccggcaacgccuucaccgccggcaagaucaucuucgccgccgucccacccaacuuccccaccgaaggccucucccccucccaagucacaauguucccacacaucaucgucgacguccgccaacuugaacccguccuaauaccccuaccagacguacgcaacaacuuuuaccacuacaaccaguccaacgacuccaccauaaaacucaucgccaugcucuacacuccccuacgcgcaaacaaugcaggcgacgacguauucaccguuucaugccgcguucucacccgccccucgcccgacuucgacuucaucuuccucguaccuccaaccguugagucacgaaccaagcccuucuccguccccguccuaacaguugaagaaaugaccaacagccgcuucccaauaccccucgaaaaacucuucacaggccccuccuccgccuucgugguccaaccacaaaacggccgcugcaccaccgacggaguccuacuaggcacaacccaacucucgcccguaaacauaugcacauuccgcggcgaugucacccacaucaccggaucucgcaacuacacaaugaaccuagcuucccaaaacuggaacaacuacgacccaacagaagagauccccgcgccccucggcacccccgacuucguaggcaagauucaaggaaugcucacacagaccacucgaacagacggcuccacccguggccacaaagccacaguauacacaggcuccgccgacuucgccccaaaacucggccgaguacaauucgaaacagacaccgaccacgacuuugaagccaaucaaaacaccaaauucacucccgucggagucauccaagacgggagcaccacccaccguaacgaaccccaacaauggguacucccuuccuacuccggacgcaacacacacaauguacaccucgcccccgccgucgcacccacauuucccggcgaacaacuacucuucuuucgaucaaccaugccaggcuguuccggcuacccuaacauggaccuugacugccuacucccccaagaguggguccaauacuucuaccaagaggcagcccccgcccaaucagacgucgcacuucuacgcuucgucaaccccgacacaggccgcguacucuucgaaugcaaacuccacaaaagcggguaugucaccgucgcacacaccggacaacacgaccuagucaucccacccaacggauauuuucgcuucgacucauggguaaaccaguucuacacccucgccccgaugggcaacggcaccggacgccgcagagucuaa

SEQ ID NO: 37944 - RNA, 1620 nt, Artificial Sequence
  derived and/or modified sequence opt11 from VP1__Norovirus_and/or_Norovirus-like__LC153121
augaaaauggccuccucagacgccaaccccucugacggcucagcagcuaaccuaguccccgaagucaacaacgaagucauggcccuugaacccgucgucggcgccgcgaucgccgcacccguagcaggacaacaaaacguaauagaccccuggauccgcaacaacuuuguacaagcccccggaggagaauuuaccgucucuccccgaaacgccccaggcgaaauacugugguccgcaccccucggccccgaccuaaacccauaccuuucacaccucgcccgaauguacaacggcuacgcaggcgguuucgaaguccaagucauccucgccgggaacgcauucaccgccggcaaaaucaucuucgcugccgugccacccaacuucccaacagaaggacuaucccccucccaagucaccauguucccccauauaaucgucgacguccgccagcucgaacccguucucauaccccuucccgacguacgcaacaacuucuaccacuacaaccaguccaacgacuccaccauuaaacucauagcaaugcucuacacaccccuccgagccaacaacgccggggacgacguauucaccgucucaugccgcguccucacccguccaagcccagauuucgacuucaucuucuuagucccaccuaccguagaaucccgcaccaaaccauucucagucccagucuuaacagucgaagaaaugacaaacucgcgauuccccauuccacuagaaaaacucuucacaggccccuccucugcguucguaguccaaccccaaaauggccgcugcacaacagacgguguccuccuuggaacaacccaacuaucaccagucaacaucugcaccuuccgaggagacguaauacacaucaccggcucccgcaacuacaccaugaaccucgcaagccaaaacuggaacaauuacgacccaacagaagaaauccccgcaccccucggcaccccagacuucgucggcaaaauacaaggaaugcucacacaaaccaccagaaccgacggaucaacccgaggacacaaagccaccgucuauacaggcucagccgacuucgccccaaaacucggcagaguacaauucgaaaccgacaccgaccacgacuucgaagccaaccagaauaccaaguucacgccuguaggcgucauccaagacgguuccaccacccaccgcaaugaaccccaacaauggguacuaccauccuacagcggucgcaacacccauaacguacaccucgcccccgccguagccccaaccuuccccggcgaacaacuacucuucuucagauccaccaugccaggcugcuccggauaccccaacauggaccucgacugccuccucccacaagaauggguucaauacuucuaccaggaagccgcacccgcacaauccgacguagcccuucuacgguucgucaacccugacaccggacgcguacucuucgaaugcaaauuacauaaaagcggauacgucacagucgcccacacaggccagcacgaccucgucaucccacccaacggcuacuuccgguucgacuccugggucaaccaauucuacacacucgcgcccaugggcaacggaaccgguagacgaagagucuaa

SEQ ID NO: 37945 - RNA, 1620 nt, Artificial Sequence
  derived and/or modified sequence opt11 from VP1__Norovirus_and/or_Norovirus-like__KF668568
augaaaauggccuccuccgacgccaaccccagcgacggcuccgccgccaaccuuguaccagaagucaacaacgaaguaauggcacuagaacccguugucggagcagcaaucgccgcacccgucgccggccaacaaaacgucaucgaccccuggauccgcaacaacuucguccaagcccccggcggcgaguucaccgucucaccccgcaaugccccaggcgaaauccuuugguccgcaccccuuggacccgaccuaaaccccuaccuaucucacuuagcacgcauguacaauggauacgcaggcgguuucgaaguccaggucauacucgccggcaacgccuucaccgcaggcaaagucauauucgccgccaucccucccaacuuccccacagaaggccucucccccucccaaguaaccauguucccccacaucguagucgauguccgacaacuugaaccaguacucaucccacugcccgacguccgcaacaacuucuaccacuacaaccaaagcaacgaccccaccaucaaacuaauagcaaugcuuuacaccccacuucgugcuaacaacgcaggcggcgacguauucaccgucagcugcagaguccucacccgcccaucccccgacuucgacuuuauauuccuaguaccacccaccgucgaaagccgaacaaagcccuuuucaguacccguccuaaccgucgaagaaaugaccaacucccgauucccaauaccccucgaaaaacuuuucacaggccccucauccgccuucgucguccaaccgcaaaacggacgcuguacaaccgacggcguacuucucggcacaacacaacuaucaccaguuaacaucugcacuuuccggggcgacguaacucacaucacuggcucucgaaacuacaccaugaaccucgccucccaaaacuggaacaacuaugaccccacugaagaaauacccgcaccccucggaacacccgacuuugucgguaaaauccaaggcaugcuaacccagaccaccagaaccgacggcuccacacgcggccacaaagcaacagucuacaccggcucagcagacuucgcacccaaacucggacgcguccaauucgaaaccgacacagaccacgacuucgaagccaaccaaauaacaaaauucacacccauuggcguuauacaagacggaagcacaacccaccgcaacgaaccccaacaauggguccuaccauccuacuccgggcgcaacacccacaacguccaucucgcccccgccgucgccccuaccuuccccggagaacaacuucucuucuuccgcuccacaaugcccggaugcuccggcuacccaaacauggaccuagacugccuccucccccaagaauggguucaauauuucuaccaagaagccgcccccgcacaaucagacgucgcccuucuccgcuucgucaaccccgacaccggcagaguccucuucgaaugcaaauuacacaaauccgguuacgucaccgucgcccacaccggccaacacgaccucgucauacccccaaacggauacuuccgcuucgacuccugggucaaccaauucuacacacucgccccaaugggaaacggaaccggacgucgacgagucuaa

SEQ ID NO: 37946 - RNA, 1620 nt, Artificial Sequence
  derived and/or modified sequence opt11 from VP1__Norovirus_and/or_Norovirus-like__KF668567
augaaaauggcaagcucagacgcaaaccccagcgacggcucugccgcaaaucucguccccgaagucaauaaugaaguaauggcccucgaacccgucgucggcgccgccaucgccgcuccagucgccggccaacaaaacguuaucgaccccuggauccgcaacaacuucguccaagcacccggcggcgaguucaccguuucaccccgaaacgcccccggagaaaucuuaugguccgcaccccuaggacccgaccucaacccauaccucucacaccucgccagaauguacaauggcuacgccggaggauucgaaguccaagucauccuagccggaaacgcuuucaccgccggcaaagucaucuucgcagcuguaccacccaacuuccccaccgaaggccucagccccucacaagucacaauguucccccacaucgucguugacguccgccaacuagaacccguacuaaucccccuaccagacguccgcaacaacuuuuaccacuacaaccagucaaacgacccaaccauaaaacucauagccaugcuauacacaccccuucgagccaacaacgccggcgacgacgucuccaccguauccugcagaguacucacccgacccucgccagauuucgauuucaucuuccucgucccacccaccguugaaagccgcaccaaacccuucuccguccccguccucaccguagaagaaaugaccaacucccgcuuccccaucccccuagaaaaacucuuuacaggcccaucaucagccuuugucguucaaccccaaaacggacgaugcacaacagacggcguucuacuaggcacaacacaacucagccccgucaacaucugcacauuccgcggcgacgucacccacauaacuggcucccgaaacuacaccaugaaccuagccucacaaaauuggaacaacuacgaccccaccgaagaaauaccagccccacucggcacacccgacuucgucggaaaaauucaaggaaugcucacccaaaccacacgcaccgacggaucuacacgcggacacaaagccaccguauacacaggcuccgccgauuucgccccaaaacucggccgcguccaauucgaaaccgacacagaccacgacuucgaagcaaaccaaaacacuaaauuuacacccaucggcgucauccaagacggauccaccacucaccgcaacgagccacaacaauggguccuccccuccuacaguggccgcaacacccacaauguccaccuagcacccgccgucgcucccaccuucccaggcgaacaacuacucuuuuuccguuccaccaugccuggaugcucaggauacccuaacauggaccucgacugccuacucccucaagaauggguccaauacuucuaucaagaggcagcuccagcacaaagugacgucgcccuccuccgcuucguaaacccagacacuggacgaguccucuucgaaugcaaacuccacaaaucgggguacgucaccgucgcacacaccggccaacacgaccucgucaucccacccaacggcuauuuccgcuucgacuccuggguaaaucaguucuacacacuagcccccaugggcaacggcaccggccgccgaagagucuaa

SEQ ID NO: 37947 - RNA, 1620 nt, Artificial Sequence
  derived and/or modified sequence opt11 from VP1__Norovirus_and/or_Norovirus-like__KR904210
augaaaauggccucauccgacgccaaccccucagauggaucuacagcaaaccucgucccugaagucaacaacgaaguaauggcccucgaacccgucguuggcgccgccaucgccgcccccgucgccggacaacaaaauguaaucgauccauggauccgaaacaacuucguacaagccccaggcggcgaauuuaccgucuccccaagaaacgcccccggagaaauccucugguccgcaccccuaggacccgaccuaaauccauaccuaucgcaccucgcccgcauguacaacggcuacgcaggcggcuucgaaguacaagucauccucgcaggaaacgcauucacagcuggaaaaaucauauucgcagcuguaccucccaacuuccccacugaaggucucucccccucccaaguaaccauguucccccacaucauaguggacguccgacaacucgagcccguccuaauaccccuccccgacguccgcaacaacuucuaccacuacaaccaauccaacgacuccaccaucaagcucaucgcaaugcucuauacaccccuccgugccaacaacgcuggcgacgacgucuucaccguuucaugccgaguccuaacacgacccuccccagauuucgacuucaucuuccucgucccaccaacuguggaaucucgaaccaagcccuucucaguacccauccucacaguagaagaaaugaccaacucccgcuucccaaucccccuagaaaaacuguuuacaggcccauccuccgccuucgucguccaaccccaaaacggccgcugcaccacggacggaguccuccuggguacaacccaacuuagcccagucaauaucugcaccuuccgaggagacgucacccacauagcaggcucccgcaacuacaccaugaaccucgcaucccagaacuggaacucauacgaccccaccgaggaaauccccgcuccccuagaaacccccgacuucgucggcaaaauacaagggguccuaacacaaacaacccgcaccgacggaucaacacguggccauaaagcuacaguauacacuggcagcgccgacuucuccccaaaauuaggccgcguccaauucgccaccgacaccgacaaugacuucgacuccaaccaaaacaccaaauucacccccguaggcguaauccaagacggcggcaccacacaccgaaacgaaccacaacaauggguccucccuagcuacucaggacgagacauccacaauguccaccuggccccagcagucgcccccaccuuuccaggcgaacagcuacuuuucuuccgcuccacaaugccuggaugcagcggauaccccaacauggaccucgacugccuacuaccccaagaguggguccaauacuucuaccaagaagccgccccagcccaaagcgacguagcacugcuacgcuucgucaacccagacaccggccgaguccuauucgaaugcaaacuccauaaaucaggcuacgucaccgucgcacacacaggccagcacgaccucgucauacccccgaacggcuacuuccgauucgacucauggguaaaccaauucuacacacucgcacccaugggcaacggcaccggacgccgccgcgucuga

SEQ ID NO: 37948 - RNA, 1620 nt, Artificial Sequence
  derived and/or modified sequence opt11 from VP1__Norovirus_and/or_Norovirus-like__JX459907
augaaaauggcauccuccgacgccaaccccucagacggauccgccgccaaccucgucccagaaguaaacaacgaagucauggcacucgaacccguagucggcgccgcuaucgccgcccccgucgccggacaacaaaacguaaucgaccccuggauacggaacaacuucguacaagcccccggcggcgaguucacugucucaccccguaacgcccccggcgaaauccucuggucagcaccccuaggccccgaccucaaucccuaucucucccaccuagcccgcauguacaacggauacgccggaggauuugaaguccaagucauccuggccggcaacgccuucaccgcaggcaaagucauauucgccgccguaccacccaacuuccccacugaaggccucucacccagccaagucaccauguucccccacauaguaguugacguacgccaacuagaaccuguacuaauaccacuacccgacguccgcaacaacuucuaccacuacaaucaauccaaugacucaaccaucaaacugaucgcaaugcuauacacaccccucagagccaacaacgccggcgacgacguauucaccgucagcugccgaguccucacccgccccucacccgauuucgacuucaucuuccuaguaccgcccacaguagaaucccgcaccaaacccuucuccguccccguccuaacuguagaagaaaugaccaacuccagauuccccaucccccucgaaaaacuauucaccggccccuccucagcauucgucguacagccccaaaacggacgcugcacaaccgacggaguacuccuagguacaacccaacucagucccguaaacaucugcacuuuucgcggcgacgucacacauaucacaggcucccgcaacuacacaaugaaccucgcuucccaaaacuggaacaacuacgacccuaccgacgaaauuccagcgccccuaggcaccccggacuucgucggcaagauacaagguaugcucacccaaacgaccagaacagacggcuccacccgcggacacaaagccaccgucuacacaggcagcgccgacuuugcacccaaauuaggccgcguccaauuugaaacugacacugaccacgacuucgaagccaaccaaaacaccaaguucacucccguuggcguaauccaagacggcucaaccacacaccgaaacgaaccccaacaauggguccucccaucguacucuggccgaaacacccacaacguacaccucgcacccgcaguugccccaaccuuccccggagagcaacuacuuuucuuccgcuccacaaugccgggaugcuccggcuacccaaacauggaccucgacugccuccuaccacaagaauggguccaauacuucuaccaagaagccgcacccgcccaaucagacguggcccuucuacgcuucgucaacccagauaccggacgcguccucuucgaaugcaagcuccacaaauccggcuacguaacaguagcccacaccggccaacacgaccuagucauacccccaaacggauacuuccgauucgacagcugggucaaccaauucuacacccucgcacccaugggcaacggaaccggacgcaggcgcguauaa

SEQ ID NO: 37949 - RNA, 1620 nt, Artificial Sequence
  derived and/or modified sequence opt11 from VP1__Norovirus_and/or_Norovirus-like__KF060062
augaaaauggcuucaucagacgccaaccccaccgacggcuccgccgcaaaccuagucccagaagucaacaacgaaguaauggcccucgaaccagucguaggcgccgccaucgcggccccugucgcuggacaacaaaacgucaucgaccccuggauacgcaacaacuucguccaggcacccggcggcgaguucaccgucagccccagaaacgcccccggagaaauacucuggucggcaccccucggucccgaccucaacccguaccuaucucaccuagcccgaauguacaacggcuacgcaggcggauucgaaguccaagucauccuagccggcaacgcauucaccgcuggaaaaaucauauuugccgcaguacccccaaacuuuccuaccgaaggccucucccccucucaagucacaauguucccccacauaauagucgacguccgucaacuagaacccguacucaucccccuucccgacguacguaacaacuucuaccacuacaaccaauccaacgacucaaccaucaaacucauagcaaugcuuuacaccccacuccgcgccaacaaugccggugacgacgucuucacggucuccugucgaguauuaacacgacccucacccgacuucgacuucauuuuccucguacccccaacagucgaaagccgcaccaagcccuucuccguccccguccuaaccgucgaagaaaugaccaacucccgcuuccccauaccccucgaaaaacucuucacaggccccucguccgcuuuugucguacaaccacaaaacggccgcugcacaacagacggcguccuacuuggcaccacccagcucucaccaguuaacauuugcacauuccgcggcgacguaacccauaucaccggcagccgcaacuacaccaugaaccucgccucacaaaacuggaacaacuacgacccaacagaagaaacccccgcaccccuuggcacccccgacuucgucggcaaaauacagggcaugcucacacaaaccacccgaaccgauggcuccaccagaggucacaaagcuaccgucuacaccggaucugcagacuucgcccccaaacucggccgcguacaauucgaaacagacaccgaccacgacuucgaagccaaccaaaacacaaaauucacaccuguaggcgucauccaggacggcuccaccacucaccgcaacgaaccccaacaauggguccuacccucauacuccggccgcaacacccacaacguucaccuagccccagccguagcccccacauucccaggcgaacagcuccucuucuuccgcuccaccaugccggggugcaguggauacccaaacauggaccuagacugccuccuuccacaagaauggguacaauauuucuaccaagaagcagccccagcacaauccgacguagcccuacuacgcuucgucaacccagacaccggucgcguccucuucgaaugcaaacuacacaaaucgggcuacguaaccguugcacacacgggacaacacgaccuagucaucccacccaacggcuacuuucgauuugacuccugggucaaccaauucuacacacucgcccccaugggaaacggcaccggccgucgacgcgucuaa

SEQ ID NO: 37950 - RNA, 1620 nt, Artificial Sequence
  derived and/or modified sequence opt11 from VP1__Norovirus_and/or_Norovirus-like__KF060080
augaaaauggcuucauccgacgccaacccuuccgacggcuccgcagcaaaccucgucccugaagugaacaacgaagucauggcgcucgaacccguagccggcgccgccaucgcggcacccguagcaggccaacaaaacgucaucgaccccuggauccgcaacaacuucguccaagcaccaggaggagaauuuaccgucucuccccgaaacgcccccggcgaaauucucugguccgcaccccuaggaccagaccuaaaccccuaucucagccaccucgcccgcauguacaacggcuacgccggagguuucgaaguccaagucauccuggcaggcaacgccuucaccgccggcaaagucauauucgcagcaguaccacccaacuuccccaccgaaggccucucccccucccaagucaccauguuuccccacaucguagucgacguccgccaacucgaacccguccucauuccccuccccgacguccgcaacaacuucuaccacuacaaccaguccaacgacuccaccauaaaacuuauagcuaugcuauacacaccgcuccgcgccaacaacgcaggagacgaugucuucaccgucucaugccgcguacucacccgaccaagccccgacuucgacuucaucuuccucguacccccaaccgucgaaucucgaaccaaaccuuucuccgucccaguacucacagucgaggaaaugacaaacucccgcuuccccaucccauuagaaaaacuuuuuaccggccccuccucagccuucguaguccaaccccaaaacggccgaugcaccaccgacggcguucucuuaggcaccacccaacuaucaccaguaaacaucuguaccuuuagaggcgacgucacacacaucaccggcucacgcaacuauaccaugaaccuggcaucccaaaauuggaacaacuacgaccccaccgaagaaauccccgcuccccuaggaacaccugacuucguaggcaagauccaaggcaugcuaacccaaaccaccagaaccgacggcucuacccgaggccacaaagccacugucuacaccggcuccgccgacuucgcccccaaacucggccgcguccaguucgaaaccgacaccgaccacgacuucgaagccaaccaaaacaccaaauucacacccgucggcgucauccaggacggcuccaccacccaccgcaacgaaccccaacaauggguacuccccucauacucaggucgcaacacacacaacguacaccuugcccccgccgucgccccaacguuccccggcgaacaauuacuauucuuucgaucaacaaugcccggcugcuccggauauccuaauauggaccuagacugccuccucccucaagaauggguucaauacuucuaccaagaagccgccccugcccaaucagacgucgcacuccuccgauucgucaaccccgacacuggacgaguccuuuucgaauguaaacuacacaaaucaggauaugucaccguugcccacaccggccaacacgaccucgucaucccacccaacggauacuuccguuucgacucuuggguaaaccaauucuacacacucgccccaaugggcaacggcaccggacgucgucgcgucuga

SEQ ID NO: 37951 - RNA, 1620 nt, Artificial Sequence
  derived and/or modified sequence opt11 from VP1__Norovirus_and/or_Norovirus-like__KF378731
augaagauggcuucauccgacgcaaaccccagcgacggaucagcagcaaacuugguccccgaaguaaacaacgaagucauggcgcucgagccagucguaggcgccgccaucgccgccccugucgccggccaacaaaacgucaucgaucccuggaucagaaacaacuucguacaagcacccggcggcgaguucaccguaucuccacggaacgcccccggcgaaauccucugguccgccccacucggcccagaccuuaaccccuaucuuucccacuuagcccgaauguacaacggcuacgccggcggcuucgaaguacaaguuauccucgccggcaacgcauucgccgcaggaaaaauaaucuucgcggccguacccccaaacuuuccuaccgaaggacuaucccccucgcaagucaccauguucccccacauaaucguagacguccgacaacucgaacccguccucaucccccuacccgacguucgcaacaacuucuaccauuacaaccaaucaaacgauagcaccaucaaauuaauugcuaugcucuacacaccucuacgcgccaacaacgcaggcgacgauguauucacagucagcugucgcguccuaacccgccccucgcccgacuuugacuucaucuuccucgucccacccaccguagaaagccgcaccaaacccuucuccgucccaguccucacuguugaagaaaugacuaauucccgcuucccaaucccccuagaaaagcucuuuaccggccccucaucagccuucgucguccaaccacaaaacggaagaugcaccaccgacggcguccucuuaggaaccacccaacugucacccgucaacauaugcacccuacgcggcgacguaacccacauaaccggcucccgcaacuacaccaugaaccucgccucacaaaacuggaacaacuaugaccccaccgaggaaauccccgccccacucggcacccccgacuucguugguaaaauacaaggaaugcuaacccaaaccacccgcacagacggcuccacacgaggauacaaagcaaccgucuauaccggcuccgccgacuucgcccccaaacuuggacgcguccaauucgaaacugacaccgaucacgacuucgaagccaaccaaaacacuaaauucacucccgucggcgucauccaagacggaagcaccacacaccgaaacgaaccccaacaauggguacucccaucauacuccggccgaaacacccauaacguacacuuagccccagcggucgcacccaccuuccccggcgaacaacuccuauuuuuccgcucuacuaugcccggcugcuccggcuacccgaacauggaccucgacugccuacuaccacaagaauggguccaauauuucuaccaagaagccgccccugcccaauccgaugucgcacuccucagauucgucaacccagauacaggccgcguucuauucgaaugcaaacuacauaaauccggcuacguuacugucgcccacacaggacaacacgaccucguaauacccccaaacggauacuuccgcuucgacuccuggguaaaccaauucuacacacucgcccccaugggcaacggcacaggaagacgacgcguauaa

SEQ ID NO: 37952 - RNA, 1620 nt, Artificial Sequence
  derived and/or modified sequence opt11 from VP1__Norovirus_and/or_Norovirus-like__AB933731
augaaaauggccuccagcgacgcaaacccauccgacggauccacugcaaaccucguccccgaaguaaacaacgagguaauggcccucgagcccgucgucggcgcugcaauagccgcaccaguagcuggccaacagaacgucauagaccccuggauccguaauaacuucguacaagcccccggaggcgaauucaccguaagcccccgcaacgccccaggagaaauccuuuggagcgccccccucggcccagaccucaacccauaccugucucaccucgcccgaauguacaacggcuacgcuggaggcuucgaaguacaaguaauccuagccggcaaugcauucaccgccggcaaaauaauauucgccgccguaccaccaaacuucccaacagaaggccucuccccaucccaggucacaauguucccacacaucauaguagacguccgccaacucgaacccguuuuaaucccacuccccgacguacgaaacaacuucuaccacuacaaccaauccaacgacccaacuaucaaacuaaucgcaaugcuauacacaccccuaagagcaaacaaugcaggagacgacgucuucacaguuucgugcagaguucucacccgaccuucucccgacuucgacuucauauuccucguccccccuacugucgaauccagaaccaaacccuucuccguccccguccuaacuguagaagaaaugacaaacuccaaaguaucaccaaucccacuaaaaaaacucuucaccggccccuccucagccuucgucguacaaccccaaaacggccgcugcaccacugacggcguccuccucggcaccacacaacuaucccccgucaacauaugcacauuccgcggcgacguuacacacauuccaggcucccguaacuacaccaugaaccucgccucccaaaacuggaacuccuacgacccaaccgaagaaaucccagccccccucggcaccccagacuucgucggaaaaauccaaggcguccuuacacaaacaacacgaaccaacggcucaacacgcggccacaaagcuaccgucuacaccggauccgccgacuucucccccaaacucggcagaguccaauucgcaaccgacacugacaacgacuucgaaaccaaccaaaacaccaaauucacccccgucggaguaauacaagauggguccaccaccccccgcaacgaaccccagcaauggguacuaccauccuacuccggacgcaacauacacaacguccaccucgcccccgccgucgcccccacauuccccggagaacagcuucucuucuuccggagcaccaugccaggcugcucaggauacccaaauauggaccuugacugccuccucccccaagaauggguacaauacuucuaccaagaggcugcccccgcccaauccgacgucgcccuccuccgcuucguaaaccccgauacaggcagaguccucuuugaaugcaaacuccauaaaucaggcuacgucaccgucgcccauaccggucagcacgaccucgucauccccccgaacggauauuuucgauucgacuccugggucaaccaauucuacacacucgcacccaugggcaacggaacaggccgacgccgcuaa

SEQ ID NO: 37953 - RNA, 1620 nt, Artificial Sequence
  derived and/or modified sequence opt11 from VP1__Norovirus_and/or_Norovirus-like__AB933749
augaaaauggcguccaacgauguaaacccaucugacgguucuaccgccaaccucguucccgaggucaacaacgaagucauggcccucgaaccagucgucggagccgccaucgccgcaccugucgcuggccaacaaaacgucaucgaccccuggauccgcaacaacuucguccaagcacccggcggcgaguucacagucucaccacgcaacgcccccggcgaaauccucuggagcgcaccccucggccccgaccucaaccccuaccucucccaucucgcccgcauguacaacggcuacgccggcggcuucgaaguccaagucauccucgcgggaaacgcauucacugcaguaguccgcauaauauucuccgccguacccccaaacuucccaacugaaggccuaucacccucacaagucaccauguucccccacauaauagucgacgucagacaacuugaacccguacucauuccucuccccgauguccgaaacaacuucuaccacuacaaccaaucaaacgauucuaccaucaaauuaaucgcuaugcucuacacuccccuccgagccaacaacgccggcgacgaugucuuuaccgucucaugccgcguacucacccgcccaucacccgacuucgacuucaucuuccucgucccgcccaccguagaaucacgcaccaaacccuucucgguucccguccuaacaguugaagaaaugacuaacagccgcuucccuaucccccuagaaaaacuauucaccggacccuccucagcauucguaguccaaccccaaaacggccgcugcaccaccgacggcguccugcucgguacaacucaacucucccccgucaacaucugcacuuuccgaggcgaugucacacacauaucuggcucucgcaacuacaccaugaaccuugccucccaaaacuggaacucauacgaccccacggaagagauccccgcaccacucggcacaccagacuucgucggcaaaauacaaggaguucuuacacaaaccacccgaacaaacggcucaacucgaggacauaaagccacagucuacaccggcucugccgacuucuccccaaaacucggccgaguccaauucgccacagacaccgacaacgacuucgaaaccaaccaaaacaccaaauucaccccagucgguguaauccaagacggauccacaacaccccgcaacgaaccccaacaguggguccuccccuccuacuccggccgcaacauccacaacguccaccucgcccccgcaguugccccaaccuucccuggcgaacagcuccuuuucuuucgcucaaccaugcccgguugcuccggauaucccaauauggaccuagauugccuccuaccccaagaauggguccaauacuucuaccaagaagccgcucccgcccaguccgacgucgcacuacuccgcuucgucaaccccgauaccggacgcguccuauucgaaugcaaguuacacaaaucuggcuaugucacagucgcccacaccggccaacacgaccuagucaucccucccaacggcuacuuccgguucgacuccugggucaaccaauucuacacccucgcccccauggggaacggcacuggccgacgacgauga

SEQ ID NO: 37954 - RNA, 1620 nt, Artificial Sequence
  derived and/or modified sequence opt11 from VP1__Norovirus_and/or_Norovirus-like__KC517370
augaaaauggccuccucagacgccaaccccucagacggcuccgccgcaaaccucgucccagaaguaaacaacgaagucauggcccucgaacccguggucggcgccgccaucgcugcaccaguggcuggccaacaaaacguuauagacccauggauacgcaauaacuucguacaagcaccaggcggagaauuuaccgugucuccccgcaacgcacccggcgaaauccucugguccgcuccccuaggccccgaucuaaaccccuaccucucccaccuagcacgaauguacaacggauacgccggaggcuucgaaguacaaguaauccuagcaggcaacgcauucacagcaggaaaagucaucuucgccgccguaccuagcaacuuccccacagaaggacuauccccaucccaagucaccauguucccacacaucaucguugacguccgccaacuagaaccaguacucaucccccuaccagacguccgaaacaauuucuaccacuacaaccaguccaacgauuccaccauaaaacuuaucgccaugcuguacacacuacuuagagccaauaacgccggcgacgacgucuucaccguauccugccgcguccuaacccgcccauccccagauuucgacuucaucuuccugguaccacccaccguagaaucaagaaccaaacccuucucaguccccguacuuacagucgaagaaaugacaaacucccgauuccccaucccacucgaaaaacucuucaccggccccuccagcgccuucgucgugcaaccacaaaacggccguuguacuacugauggcguccuucucggcacaacacaacucucccccgucaacaucugcaccuuccguggcgacgucacccacaucaccggaucucgaaacuacaccaugaaccuagccagucaaaacuggaacaacuacgacccaacagaagaaaucccugcaccccucggaacccccgacuucgucggcaaaauacaaggcaugcuaacccagaccacccgaaccgacgguuccacccgcggacacaaggccaccauguacaccggaucagccgacuucgccccuaaacucggccgaguccaauucgagacugauacugaccacgacuucgaggcaaaccagaacaccaaauucaccccugucggagucauacaagacggcggcaccacccaccgcaacgaaccccaacaauggguacuaccauccuacucaggacgcaacacccacaauguccaccucgcccccgccgucgcaccaacauuccccggcgaacaacuccucuucuuucgccccaccaugccaggcugcucuggauacccuaacauggaccucgaccgacuacucccgcaggaauggguccaauacuucuaucaagaagcugcacccgcccaaucugacguagcccuacuucgcuucguaaaccccgacaccggccgaguccucuucgaaugcaaacuacauaaauccggcuacgucaccguugcacacaccggccaacacgaccucgucaucccucccaacggcuacuuccgauucgacuccuggguaaaccaauucuacacacucgcacccaugggcaacggcaccggccgccgccgagucuaa

SEQ ID NO: 37955 - RNA, 1620 nt, Artificial Sequence
  derived and/or modified sequence opt11 from VP1__Norovirus_and/or_Norovirus-like__EF547396
augaugauggccuccaaagacgcccccaccaacauggacggcaccucaggagcaggccaacuuguccccgaagccaacacagcugaacccaucuccauggacccagucgccggcgccgcaaccgccgucgcaaccgccggacaaaucaacaugaucgaccccuggauaaugucaaacuucguccaagccccacaaggcgaguucacagucucccccaacaauaccccaggcgacguccucuucgaccuccaacucggcccacaacuaaaccccuuccucgcccaccucgcccaaauguacaacggcugggucggcaauaugcgcgucaaaguucuacuagcaggcaaugccuucacagccggcaaaauuauaaucuccugcauaccucccggcuucaccucccaaaacaucuccaucgcccaaaugacuauguucccacacguuaucgccgacguacgcguccuggaacccauagaaguuccacucgaagacguucgaaacguucucuuccacaccaacgacaaccggccaaccaugcgacucgucuguaugcucuacacaccucuccgcgcaaacggcucuuccucaggcaccgaccccuucgucauugcaggccgcguccuuacaugcccagacucaaacuucucauuccucuuccucgucccccccaaugucgaacaaaaaaccaggccguucuccguccccaacaucccacucaacacacucucaaacucccgcgucccuucccucaucaaaucuaugaccaucucucgcgaccaaaaucaaaucauccaguuccaaaauggccgcgugaccuuagacggccaacuacaaggcacaaccccgaccuccgucucccaauuaugcaaaauccgcggcaccaccuaccacgcuacaggaggcaacgguaucaaccuuaccgaacucaacggcgaacccuaccacgccuucgaaucccccgccccaauaggauuccccgaccucggcggcugcgacuggcaccucaccgccacccccacacaagccuucaacgacggcgccaaagucguccgccucaguguaacccaaggagccgccuucgccccucaccucggaaccauucacuacacgacaacugacaccgacuacucucccaacaccucaaucaucugcacacucgacuggcuaucacaaaccaccggacaguccaacgucgaucccuggcaaaucccaaccuacggaucaaccuuaacagaagccgcccaacuagcacccccuaucuucccccccggauucggcgaaacucucgucuucuuccucuccgacuuccccauauccaacggcaaaaacggccuuuccguacccugcacccuaccacaagaauucguaacccauuucgucaacgaacaagcuccaauccgaggagaagccgcccuacuacacuacguagaucccgacacucaccguaaccuaggcgaauucaaacuauaccccgaaggcuucaugaccugcguuccuaacaccucaggaggcggcccccaaacccuccccaucaacggcguauucgucuucgucucaugggucuccagauucuaccaacugaaacccgucggaaccgccggcgccgcccgacgucuguga

SEQ ID NO: 37956 - RNA, 1620 nt, Artificial Sequence
  derived and/or modified sequence opt11 from VP1__Norovirus_and/or_Norovirus-like__JN699047
augaugauggcauccaaagaugcccccaccaacauggacggcacaucaggugccggucaacucguccccgaagcaaacacagccgaaccaaucuccauggauccuguagccggugccgccaccgcagucgccaccgccggccaaaucaauaugaucgacccauggauaaugucaaacuucguccaagcgccacaaggcgaauuuacaguaucaccaaacaacaccccaggcgacguccuuuucgaccuccaacucgggccccaacuuaaccccuuccuugcccaccucgcacaaauguacaacggcugggucggaaacaugcgcgucaaaguucuccuagcaggcaacgccuucaccgccggcaaaaucaucaucagcugcauacccccaggcuucacuucacagaauaucuccaucgcacaaaugaccauguucccccacgucaucgccgacguucgcguacucgaacccaucgaaaucccccuagaagacguccgcaacguccuauuccacacgaacgauaaucgcccuacaaugcgccuagucugcaugcuauacacuccccuccgcgccaacggcucauccucaggcaccgaccccuucgucaucgccggccgaguccuaaccugcccagacuccaauuucucauuccucuuccucgucccaccaaacgucgaacagaaaacccgccccuucuccgucccuaauaucccccuuaacacccucuccaacucccguguccccucccucaucaaauccaugaccaucucccgcgaccaaaaccaaaucauccaauuccaaaacggacgugucacccuagacggccaacuccaaggcacaaccccaaccuccgucucccaacuauguaagauccguggcaccaccuaccacgccacuggcggcaacggcauaaaccuaacugaacucaacggcgaaccauaccaugccuucgaaucccccgcacccaucggcuuccccgaccuaggaggcugcgacuggcaccucaccgcuacccccacacaagccuucaacgacggagccaaaguaguccgucuaucagucacacaaggcgcagccuucgcaccucaccuaggcaccauccacuacacuaccacugaccacgacuaugaccccaacaccucuauuaucugcacccucgauuggcuaucccagacuaccggccaaaacaacguagacccauggcaaauccccacauauggcuccacccuaaccgaagccgcccaacucgcaccuccgaucuuuccacccggcuucggagaaacccucguuuucuuccuuuccgacuuccccaucuccaacggaaagaacggccuauccguccccugcacccucccccaagaauuuguaacccacuucgucaacgaacaagcacccauccgaggagaagcugcccuccuacacuacgucgaccccgacacccaccgcaaccucggcgaguucaaacuuuaccccgaaggcuucaugacaugcguuccaaauaccuccggaggcggcccccaaacccuuccaaucaacggcgucuucgucuucguuagcuggguaucucguuucuaccaacuuaaaccagucggaaccgccggcgccgcccgccgacucuaa

SEQ ID NO: 37957 - RNA, 1620 nt, Artificial Sequence
  derived and/or modified sequence opt11 from VP1__Norovirus_and/or_Norovirus-like__KT781411
augaugauggccucuaaagacgcaccuacaaauauggacggcaccuccggcgccggccagcuugucccagaagccaacaccgcagaaccaaucuccauggaaccagucgcaggcgccgccacagcagccgcuaccgccggccaaguaaacaugauugacccuuggaucaugaauaacuacguacaagccccacaaggagaauuuaccauaucucccaacaacacccccggcgauauucuauucgaccuccaacuaggcccccaccuuaaccccuuccuuucacaccuugcccaaauguauaauggcugggucggcaauaugaaaguaaaaguccuccucgccgggaacgccuucaccgcaggcaaaaucauaauauccugcauaccacccggcuucgccucccaaaacaucuccauugcacaagcgaccauguucccccacgucaucgcagacguccgcguccuagaaccaaucgaaguuccccucgaagacguacgaaacguacuauuucacaacaacgacaacucccccaccaugcgccucgucugcaugcucuacacaccccuucgcgcuucagguucuucauccgguaccgacccauuugucaucgcaggccgcguccuaaccugccccucucccgauuucuccuuucuuuuccucgucccacccaacgucgaacagaaaacaaaacccuuuuccguccccaaucucccucucaacacucucuccaauucccgcgucccaucccucaucaaugcaaugaugaucucccgcgaccacggccaaaugguacaauuccaaaacggccgagucacgcucgacggccaacuccaaggcacuacacccaccucccuaucccaacuuugcaaaauucgcggaaagguauuccucgccagcggcggcaacggccucaaccucaccgaacucgacggcuccgccuaccaugccuucgaaucuccagcccccaucggcuuccccgacaucggcgacugcgacuggcacaugaacgccaccgcgacauccaacuucaccggcuccaacgaugaacaucaaauccuugucaaacaagaaucaaccuucgcuccucacuuaggucacguccaagcugaccaccuucccgaagucgcaaauacagaccuuauggucucauuaucauggaucucccccgucucugaccaacaccgucgcgacgucgaccccugggucauuccccgguacggcucaacccucaccgaagccgcccaacucgccccucccauauacccacccggauucggcgaagcaaucguauucuucauguccgacuuccccguagucucaggcgucaauggcaugcgcauacccugcacccucccccaggaauacgucgcccacuucgucaaugaacaagcaccuacacgcggcgaagccgcccuacuccacuacguagacccugauacacaccgcaaccucggagaguucaaaaucuaccccgaaggauucaugaccugcguccccaacuccuccggcacaggcccacaaacacuccccauaaacgguguguuuaccuucgucagcugggucucacgcuucuaccaacucaaacccgucggcaccgccggccccgcccgccgccucuga

SEQ ID NO: 37958 - RNA, 1620 nt, Artificial Sequence
  derived and/or modified sequence opt11 from VP1__Norovirus_and/or_Norovirus-like__U04469
augaugauggccagcaaagacgccccaacaaacauggacggcaccuccggcgccggccaacucguccccgaagcaaacacagccgaaccaauauccauggaacccguagcaggagccgccaccgcagccgccacugcaggacaagucaacaugaucgacccauggauaaugucaaacuacguacaggccccacaaggcgaauuuaccaucucccccaacaauacacccggugacauucucuucgaccuacaacucggcccacaccuaaaccccuuccucucacaccucgcacaaauguacaacggcuggguaggcaacaugcgagucaaaguccuccucgccgguaacgcauucaccgccggcaaaaucaucauauccugcauucccccuggcuucgccgcacaaaacauuucaauagcgcaagccaccauguucccccacguaaucgccgacgucagaguccucgaacccauagaaguccccuuagaagacgucagaaacguccuauuccacaacaaugacucaagccccaccaugagacuuguaugcauguuauacacaccccuaagagcaucaggcucaucauccggcaccgaccccuucguaaucgccggacggguccuaaccugccccucuccugacuucuccuucuuauuccucguuccucccaacgucgaacaaaagaccaagcccuucagcguacccaaccucccccuaaacacacuauccaacucccgcguccccucccuuaucaacgcaaugaugaucucacgcgaccacggccaaaugguccaauuccaaaauggccgugucacccuagacggccaauuacagggcacaaccccgaccucacucucgcaacuaugcaaaauccggggcaaagucuuccacgcauccgggggcaacggccuaaaccucaccgaacucgacggcucagccuaccaugcauucgaaucccccgcccccaucggcuuccccgacaucggggauugcgacuggcacauguccgccacagcaaccaacaacuucaccggaucauccaacgaauaccaaauccucaucaaacaagaaucagcauucgcaccccaccucgggcacguccaagccgacaaccucagcgccggcgcgaacaccgaccucauaguaucccuguccuggaucuccccuguaucagaucaacacagacaugacguagaccccugggucaucccacgcuacggcucaucccuaaccgaagcugcccaacuugcgcccccuaucuacccacccggcuucggugaagccaucguuuucuucauguccgacuuccccgucgucuccggagucaacggcaugcgcauacccugcacccucccccaagaauacgucgcucacuucgucaacgaacaagcccccacccgaggagaagcugcccuccuucacuacgucgaccccgacacacaccgaaaccuaggcgaguucaaaauguaccccgaaggauucaugacaugugucccaaacuccucaggauccgguccgcagacacuuccaaucaacggcgucuucaccuucguuagcuggguaagccgcuucuaccaacucaaacccguaggcaccgcaggacccgcccgccgccucuaa

SEQ ID NO: 37959 - RNA, 1620 nt, Artificial Sequence
  derived and/or modified sequence opt11 from VP1__Norovirus_and/or_Norovirus-like__JN699049
augaugauggccuccaaagacgcccccacaaacauggacggcacaucaggugccggccaacucguccccgaagcuaauaccgccgaaccaauauccauggaaccaguagcaggcgccgcaaccgccgccgccaccgccggccaaguuaacaugaucgaccccuggaucaugaacaacuacguacaagccccacaaggggaguucaccaucucaccgaacaauaccccuggcgacauccuguucgaucuucaauuaggaccccaccucaaucccuuccuaucccaccucgcccaaauguacaacggauggguaggcaacaugaaggucaaaguccuccuagccggcaacgccuucaccgcuggcaaaauaauuaucagcugcauucccccaggauucgccucucaaaacaucuccaucgcucaagcaaccauguucccucacguaaucgcagacguucgcguacucgaacccaucgaaguaccacucgaagacguccgaaacguacuauuccacaacaacgacaacacuccuaccaugcgacucgucugcaugcuauacacaccccuccgagccuccggcuccagcucaggcaccgaccccuucguuaucgccggucgcguacuaaccugcccauccccagacuucucauuccucuuccucgucccacccaauguagaacagaaaaccaaaccguucucaguacccaaccuuccccucaacgucuuauccaacuccagagucccuagccucaucaaauucaugauggucucucaagaccacggacaaaugguccaauuucaaaacggccguguuacccucgacggccaacuacaaggaaccacccccaccuccgccucccaacucugcaaaaugcgcggcaccgucuaccacgcuuccggcggccaaggccucaaccucaccgaaaucgacggaacucccuaccacgcauucgagucccccgcccccauuggcuucccugaccuaggcgacagcgacuggcacauaaacgccucccccgccaccaccuucaauaccggagaauccguaaagcgccuugacauggaacaaggaucuuccuucgcaccccaccucggcaccguucacuacaccaacgcagacuacgaugccaacacagaccuaauaugcucacuggaguggcucuccccucccucaggaggcacucccaacaaaguaaaccccugggccaucccccgcuauggcuccacccuaaccgaagccgcccaacuagcaccacccauauaucccccaggcuucggagaagccaucguuuucuucauguccgacuuccccaucgccaacggccaagacggccucaaagucccaugcaccaucccucaagaauuuguaacacacuucgucaacgaacaagcuccaacccgcggcgaagcagcccuucuccacuacgucgacccagauacccaccgaaaccucggcgaguucaaacucuacccggaaggauucaugaccugcguccccaauuccuccggcucuggcccccaaacccuccccauaaacggcgucuucaccuucgucucaugggucagccgauucuaccaacugaaacccgucggcaccaccggccccguacgccgccuuuaa

SEQ ID NO: 37960 - RNA, 1620 nt, Artificial Sequence
  derived and/or modified sequence opt11 from VP1__Norovirus_and/or_Norovirus-like__GQ856473
augaugauggcaucaaaagacgcccccacuaacauggacggcacaucaggagccggccaacuugucccugaagccaacaccgcagaacccaucuccauggaacccguugccggcgcagccacggcagcagccacagccggccaggucaacaugaucgacccguggauaaugaacaacuauguccaagcaccccaaggcgaguucacaaucucccccaacaacacccccggagacauacuuuucgaccuccaacuaggcccccacuuaaaccccuuccucucccaccucgcccaaauguauaacggaugggucgguaacaugaaaguaaaaguacuccucgccggaaacgccuuuaccgccgguaaaauaaucauaucguguauacccccaggcuuugccgcccaaaacaucucgauagcccaagccacaauguucccacacgucaucgccgacguacgaguccuagaaccaauagaaguaccccuugaagauguacgcaacguccucuuucacaacaacgauaacucacccacuaugcgacucguaugcaugcucuacacaccccuccgagcaucagggucuuccucaggcaccgaccccuucgucauugcagggcgcguccuaaccugccccucccccgacuuuuccuuccucuuccuuguucccccaaacguagaacagaaaaccaaaccauucucagucccaaaccuaccccucaacacccuuucaaacucacgcguccccagccucaucaacgccaugaugaucagccgagaccacggccaaaugguccaauuccaaaacggacgcgucaccuuagacggccaacuacaagggaccacaccgaccucuuuaucccaacugugcaaaauccgcggcaagguuuuccacgcauccggcggcaacggccuaaaccucaccgaacuagauggcuccgccuaccacgcauucgaaucacccgcccccaucggguuccccgacaucggagaaugcgacuggcacaugaacgccacagccacauccaacuucacuggaagcaaugacgaauaccaaauccucgucaaacaagaauccacauucgccccacaccucggccacguacaagcagauuccuugucagcggacgccaacaccgaccugauggucucucuauccuggauaucacccgucuccgaccaacaccgccgcgacgucgacccuuggguuauaccccgauacggcuccucccuaaccgaagcagcccaacucgcaccacccaucuauccaccaggauucggcgaagcuauagucuucuucaugucugacuuccccgucgucucaggcguaaacggcaugcgcauaccaugcacacucccacaagaauacgucgcccacuucguaaacgaacaagcacccacaagaggagaagcagcccuacuccacuacgucgaccccgauacccaccgaaaucucggugaguucaagauguaccccgaaggauuuaugaccugcguccccaacuccucaggcagcggcccccaaacccuccccaucaacggcguccuuaccuucgucuccugggucucacgauucuaccaacucaaacccgucggcacagcaggacccgccagacgccuuuaa

SEQ ID NO: 37961 - RNA, 1620 nt, Artificial Sequence
  derived and/or modified sequence opt11 from VP1__Norovirus_and/or_Norovirus-like__JN699050
augaugauggccuccaaagacgcaccaaccaacauggacggaacauccggcgccggccaacuuguacccgaagccaacaccgcagaaccaauauccauggaaccaguugcuggagcugccacagcagccgcaaccgcaggccaagucaacaugauagaucccuggauaaugaacaacuacguccaagcaccacaaggugaauuuaccaucagccccaacaacacccccggcgacauccuauucgaccugcaacuaggaccacaccuaaaccccuuccucucgcaccucgcucaaauguacaacggcugggucggcaacaugaaagucaaaguacuucucgccggaaacgcguucaccgccggcaaaaucaucaucuccugcaucccucccgguuucgcaucccaaaacaucucaaucgcccaagccaccauguucccccacguaauagccgacguucggguccucgaaccaaucgaagucccacucgaagauguccgcaacguacuuuuccauaacaacgacaacacacccaccaugcgccucguaugcaugcucuacacccccuuacgcgccucaggaucgucaucuggcacagaccccuucgucaucgccggucgcguccuaaccugccccucccccgacuucucauuccucuucuuaguucccccuaacgucgaacagaaaaccaaaccauucuccguacccaaccucccccucaacguacucucaaacucccgcgucccaucucucaucaaauccaugauggucucccaagaccacggacaaaugguccaauuccaaaacggccgcgugacccucgacggacaacuacaaggcaccacacccaccagcgccucucaacucugcaaaaugcgcggaaccgucuaccacgcuucaggcggacaaggucucaaccuuaccgaaaucgauggcacccccuaccacgcauucgaaucacccgccccaauuggauuccccgacaucggcgacuccgacuggcacaucaacgcaucacccgccaccacuuucgacagcggcgaauccaucaaaagacucgacauggaacaaggcuccucauucgccccacaccucggcacaguccacuacaccaacgccgacuaccccgccaacacagaccuuauuugcagccuagaauggcuaagcccaccaucugggggcacccccaauaagguaaacccauggaccaucccccgcuacgguucaacccuaacugaagccgcccaacucgccccucccaucuacccacccgguuucggcgaagccauaguuuucuucaugucagacuucccaaucgcaaacggccaagacgggcucaaaguacccugcaccauaccccaggaauuuguaacacacuucguaaacgaacaagcccccacacgcggagaagcagcccuccuccacuacguagaccccgacacacaccguaaucucggagaguucaaacucuacccagaaggcuucaugaccugcguaccaaacuccucgggauccggcccccaaacgcuccccaucaacggcguauuuaccuucguuuccugggucucccguuucuaccaacuaaaaccagucggaaccaccggaccuguacgacgucuauaa

SEQ ID NO: 37962 - RNA, 1620 nt, Artificial Sequence
  derived and/or modified sequence opt11 from VP1__Norovirus_and/or_Norovirus-like__GQ856472
augaugauggccucaaaagacgcacccaccaacauggacggcaccuccggcgccggacagcuaguacccgaagcaaacacagccgaaccuaucuccauggacccaguggccggagccgcaaccgcugucgcaaccgcaggccaaaucaacaugaucgaccccuggaucauguccaacuuuguccaagcaccccaaggcgaauuuacagucagccccaacaacacccccggcgacguccuauucgaccuccaacucggcccccagcucaauccauuccucgcacaccucgcccaaauguacaacggcugggucggcaacaugaggguaaaaguccuacuagccggcaacgcauucacagcaggcaaaaucaucaucuccugcauaccaccaggcuucaccucccaaaacaucuccauagcccaaaugaccauguucccccacguaauagccgacgugagaguccuagaacccauagaaaucccacucgaagauguccggaacguccuauuccacacuaaugacaaccgcccaacuaugcgacucgucugcauguuauacacgccccuccgcgccaacggcuccuccuccgguacggaccccuucgucaucgcaggacgcguucucaccuguccagauuccaacuucucauuccuauuccucguacccccuaacgucgaacagaaaacccgucccuucucuguccccaacaucccccuuaacacccucucaaacucccgcgucccuagccucaucaaaagcaugaccauaucacgcgaccaaaaccaaaucauacaauuccaaaacggccgggucacccucgacgggcaacuccaaggcacaacccccacauccgucucucaacuaugcaaaauccgcggaaccaccuaccaugccaccggcggcucaggcaucaaccucaccgaauuaaacggcgaacccuaucacgcauucgaaucccccgcaccaauaggcuuccccgacuuaggcggaugcgacuggcaccucacugcaacacccacccaagccuucaacgacggcgccaaaguaguccgacuauccgucacucaaggcgccgccuuugcaccccaccuaggcacgauccacuacaccaccaccgacaccgacuacaaccccaacacuuccaucaucugcacccucgacuggcucucacaaaccaccggucaauccaacgucgaccccuggcaaaucccaaccuauggcuccgcccuaacagaagccgcccaacucgccccacccaucuucccacccggcuucggugaaacucuagucuucuuccuauccgauuuucccauaagcaacgguaaaaacggccuuuccguacccugcacccuaccccaagaguucguuacccacuucgucaacgaacaagcacccauacgcggagaagccgcauuacuccauuacguagacccugacacccaccgaaaucucggcgaguucaaacuauaucccgaaggcuucaugaccugcguacccaacaccuccggcggaggcccucaaacccuccccauuaacggaguauucguauucgucagcugggucucacgauucuaccagcuaaaaccugucggaaccgccggcgccgcacgccgccucuaa

SEQ ID NO: 37963 - RNA, 1620 nt, Artificial Sequence
  derived and/or modified sequence opt11 from VP1__Norovirus_and/or_Norovirus-like__GQ856471
augaugauggccucaaaagacgcccccaccaacauggacggcaccucuggcgcaggccagcuaguacccgaagccaacaccgccgaaccaaucucuauggaccccguugccggcgcagcuaccgccguagccacagccggucaaaucaacaugaucgacccauggauaaugucaaacuucguccaagccccacaaggcgaauuuacugucucccccaacaacacccccggcgacguacucuucgaccuacaacucggcccccaacucaacccuuuccucgcccaccucgcccaaauguacaacggcugggucgguaacaugagagucaaaguccuccuagcaggaaacgcauucaccgccgguaaaauaauaaucuccugcauaccuccaggauucaccucucaaaacaucucaauugcccaaaugacaauguucccacacgucauugcagacguucgcgugcucgaacccaucgaaauaccccuagaagacgugcgaaacguccuauuccauacuaacgacaaccgccccacaaugagacucgucugcaugcuauacacgccccucagagcaaacggaucuuccuccggcaccgaccccuucgucaucgccggacgcguucuaaccuguccagacuccaacuucuccuuccucuuucuaguaccacccaacgucgaacagaaaacacgccccuucucuguccccaacaucccccuaaauacucucuccaacuccagaguccccucucuaaucaaguccaugacaauaucccgcgaccaaaaccaaauaauccaauuccaaaacggccgagucacccucgauggccaacuacaaggcacaaccccaacauccgucucccaacuaugcaaaauaagaggcaccaccuaccacgccacaggcggcuccggaaucaaccucaccgaacucaacggagaaccauaccacgcuuucgaaucccccgcccccauaggauuccccgaccucggcggaugugacuggcaccucaccgccaccccaacccaagccuucaacgacggcgcaaaagugguccgccuuuccguaacccagggcgcggccuucgcuccccaccuaggcacaauccacuacaccaccaccgacaccgacuacaaccccaacacuuccaucaucugcacacuagacuggcuuucacaaaccaccggccaauccaacguagacccauggcaaauccccacauacggcuccacccucaccgaagcagcacaacucgcacccccuaucuucccaccuggcuucggagaaacccuagucuucuuccuauccgacuuccccaucuccaaugguaaaaacggccucuccguccccugcacccucccacaagaguucgucacccauuucguaaaugaacaagccccuauacgcggcgaagcagcccuucuccauuacgccgaccccgacacccaccgcaaccucggcgaguucaaacucuacccggaaggguucaugacaugcguccccaacaccucagguggcggcccacaaacccucccuaucaacggaguuuucgucuucgucucaugggucucacgcuucuaccagcucaaaccagucggaaccgcaggagccgcccgacgacucuaa

SEQ ID NO: 37964 - RNA, 1620 nt, Artificial Sequence
  derived and/or modified sequence opt11 from VP1__Norovirus_and/or_Norovirus-like__JQ911594
augaugauggcguccaaggacgccccaaccaacauggauggcacaucaggagccggccagcuaguacccgaagccaauacagccgaacccauauccauggaccccgucgcaggcgcagccacugcaguagccacugccggccaaaucaacaugaucgacccauggaucauguccaacuuuguccaagccccacaaggagaguucacagucucacccaauaacacccccggcgacguccucuucgaccuccaacucggcccccaacuuaaccccuuccuagcccaccucgcccaaauguacaacggcugggucggaaacaugcgcgucaaagucuugcuagccggcaacgccuucaccgccggcaagaucauuaucuccuguaucccacccggcuucaccucccaaaacaucagcaucgcacaaaugaccauguucccacacguuauugccgacguucgcguucucgaacccauagaaaucccccucgaagacguccgcaacguacuauuccacacaaacgacaaccgacccaccaugcgacuugucugcaugcuuuacaccccacuccgagcaaacggcucauccuccggcacugaccccuucguuaucgcaggccgaguccuuaccugccccgacuccaacuucucauuccucuuccuggucccuccaaacgucgaacagaaaacacgcccauucucaguccccaauaucccacucaacaccuuauccaacagccgcgucccaucucuaaucaaauccaugacuaucucccgcgaccaaaaccagaucauccaauuccaaaacggccgcgucacucucgacggucaacuacaaggcacaacccccaccucugucucacaacucugcaagauccgagguacaaccuaccacgcaacagguggcaacggcaucaaccuaaccgaacuaaauggcgaacccuaccacgccuucgaauccccagcacccaucggauuccccgaccuaggcgguugcgacuggcaucuuaccgccaccccaacccaggcuuucaacgacggagccaaggucguacgccuauccgucacccaaggcgccgccuucgcaccccaccuaggcaccauccacuauaccaccaccgacacagacuacaaucccaacacaucuaucaucugcacacucgacuggcuaagccaaacagcgggccaaucaaacgucgaccccuggcaaauucccaccuacggaucaacccucacagaagccgcgcaacucgcaccacccaucuuuccacccggcuucggcgaaacacucgucuucuuccucuccgacuuccccaucucuaacggcaaaaacggccucuccguacccuguacccuuccccaagaguucgucacccacuucguaaacgaacaagcccccaucagaggggaagcagcccuacuacacuacgucgaccccgacacccaccgaaaccucggcgaguucaagcucuaccccgaaggcuucaugacaugcguccccaacaccuccggcgguggaccccaaacucuccccaucaacggugucuuuguauucgucuccuggguaucccgcuucuaccagcucaagcccgucggcacagcuggcgccgcccgacgccucuaa

SEQ ID NO: 37965 - RNA, 1620 nt, Artificial Sequence
  derived and/or modified sequence opt11 from VP1__Norovirus_and/or_Norovirus-like__GU296356
augaugauggcauccaaagacgcaaccuccaacauggacgguacauccggcgccggccaacucgucccagaaaacaacaacaccuccgaaccaaucaauauggaacccgucgccggcgccguaaccgccgccgccacagccggccaagucaacaugauagauccauggauuaugaacaacuacguacaggcuccccaaggcgaauuuaccaucuccccaaacaacacaccaggcgauauccucuucgaccuccaacucggcccccaccuaaaccccuuccucgcccaccucucacaaauguauaacggcugggucggcaacaugaaaguccgcgucguauuagccggaaaugccuucuccgcaggcaaaaucaucgucuguugcauuccacccggauucagugcccccaacaucagcauugcccaagcaaccauguucccccacguuaucgccgacguccgaguacucgaacccaucgacaucccccuugacgacguccgcaacguacucuuccacaccaacgacaacggcaaccaaaccaugcgccuccuaugcaugcucuacacgccccuccgcucuggcggaaccuccuccggcaccgaccccuuugucaucgccggacgaguacucaccugucccacacccgauuucaacuuccuuuuccucgucccacccaccgucgaacagaaaaccaaacaauucucaguccccaaucucccccucaacgucaugucaaacuccagaguucccucccuacucaaugcaauggucgucucccccgaccaagcacaagucguccaauuccaaaacggucguugcacacuagacggccaaaugcuagggaccaccaccgucuccgccucgugcguagcccgcuuccgaggcaaaaccuuucaagcccccgacgaccgccucggcaucaaccucgccgaaaucucgggcgaaccauaccacgcauucgaaucccccgcaccccucggcuuccccgacuucggagacggagacuggcacgucaccgccaccaaagucgcccccucccaauuagaagcaaacgacccaguugucgucggcaacguccaaccauacaauccccaauucgcaccccaccuaggcacccucgugguugaaaaccccacccccaaccaagucgccaccggcaccgaccuccucuuuaacauuacauggcuaucaaaucgcgccaacaaccgcuucaaccccuggaucaucccaaacuauggcucuacacuaacggaagcugcacaacucgcccccuccaucuucccaccaggcuucggcgaaacaauagucuacuucaacuccaccuuccccgccgucggcgcgaccacacaugccgccauacccugccuacucccucaagaguucgucgcccacuucgucaacgaacaagcccccauccguggagaagcagcccuccuacacuacaucgaccccgacacccaucgcaaccuaggagaguucaaaaucuaccccgaaggcuucguaaccugcguccccaacgucggcggcacgggcccucaaagucuccccaccaacgguaucuucgucuucgucagcugggucucucgcuacuaucaacucaagcccgucgguaccgcauga

SEQ ID NO: 37966 - RNA, 1620 nt, Artificial Sequence
  derived and/or modified sequence opt11 from VP1__Norovirus_and/or_Norovirus-like__KM461693
augaaaauggccagcaacgacgcagcccccuccaacgacggagccgcaaaccucguccccgaagcgaauaacgaaguuauggcacuggaacccgucgucggugccucaauugccgcccccguaguaggucaacaaaacaucauagaccccuggauucgcgaaaacuuuguucaagccccacaaggcgaauuuacaguauccccgcgcaacucccccggcgaaaugcuccucaaccuugaacucggccccgaacucaaccccuaccucucucaccuaagccgcauguacaacggcuacgccggaggaaugcagguccaagucguccucgccggcaacgcauucacagcaggcaaaauuaucuucgcagccgugcccccgcacuuccccguagacaacaucucagccgcccaaaucaccaugugcccacacgucaucgucgacguccgacagcucgaaccaguacuccucccccucccagauauccgaaaccgcuucuuccacuacaaccaagaagacacaccccgcaugcgccuugucgccauguuauacaccccacuacgcgccaacuccggcgaagacgucuucaccgucucaugcagaguccuaacccgccccgcccccgacuucgaguucacguuccucguaccgcccacugucgaauccaaaaccaaacccuuuacccucccaauccuaacccucggagaacuauccaacuccagauucccagccgcgaucgacaugcuuuacacagacccaaacgaaagcaucgucguucaaccccaaaauggccgcugcacccucgauggaacccuacaaggcaccacccaacugguacccacccaaaucugcgccuuccgugguacccucaucucccaaaacgcccgagcugcagaccugacagacagcccacaaagagcccgcaaccacccacuacacguccaagucaaaaaucuggacggaacacaauacgaucccacagacgacauccccgccguacucggcgccauagacuuuaaagggaccgucuucggcgucgcaucccagcgagacgucagcggcacccaagaacaaggccacuacgccacacgcgcucacgaagcccacaucgauaccacggacccgaaauaugcacccaaacucggcaccauacuaaucaaaagcgaauccaccgauuuuacuaccaaccaaccuauacgcuucacuccaguuggcaugggggacaacaacuggcgucaaugggaacucccggacuacucagguucacucacccucaacaugaaccuagccccagccgugucacccagcuuccccggcgaacgcauccucuucuuccgauccaucguccccucugccggaggauacggauccggauacauagauugccuaaucccccaagaauggguccaacacuucuaccaagaagccgcacccagccaauccgccguggccuuaguccgcuacguaaaccccgacacaggccgaaauaucuucgaagccaaauuacaccgcgaaggcuuccucaccgucgccaacucaggcaacaacccaauggguguaccucccaacggauacuuccguuucgaagccugggucaaccaauuuuacacccuagcccccuaa

SEQ ID NO: 37967 - RNA, 1620 nt, Artificial Sequence
  derived and/or modified sequence opt11 from VP1__Norovirus_and/or_Norovirus-like__LC145789
augaaaauggcauccaacgacgcagcucccucaacagacggcgccgccggccucguuccagaaagcaacaacgaaguaauggcccuugaacccgucgccggugcggcccuagccgcaccaguuacaggccaaaccaacaucaucgaccccuggauccgcgccaacuucguccaagcccccaacggagaguucaccgucuccccacgcaauucgcccggagaaguacuccuaaaccuagaacuuggccccgaacucaauccauaccucgcccaccucgcccgaauguacaacggcuacgcuggugguauggaaguccaaguaaugcuagccggcaacgccuucaccgccggaaagcuagucuucgccgccgucccuccccacuucccagucgaaaaccucucaccccaacaaaucaccauguucccacacgucauaaucgacguccguacccucgaacccguacuccucccccuaccagacgucagaaacaacuucuuccauuacaaucaaaaagacgacccuaaaaugcgcauagucgccaugcucuacacaccccuccgcuccaacggauccggcgaugacgucuucaccgucuccugcagaguccuaacccgccccuccccugacuucgacuucaccuaccucgucccucccaccguagaauccaaaacaaaacccuucacccuccccauccuaacccucggcgaacuauccaauuccagauucccaguuuccauugaccaaauguacaccucccccaacgagguaauauccguacaaugccaaaacggucgcugcacacucgacggcgaacuccaaggcaccacccaacuacaaguaucaggaaucugcgcauucaaaggcgaagucaccgcccaccuccacgacaacgaccaccucuacaacguaaccauaaccaaccucaacggaucaccauucgacccguccgaagacaucccugccccacucggaguccccgacuuccaaggacgcgucuucggcgucaucucacaacgagacaaacauaacacacccggccacaacgaacccgccaaccgcgcccacgacgcagucguccccacuuacacagcccaauauacccccaaacuuggucaaauacaaaucggcaccuggcaaaccgaugaccucaccguaaaccaacccgucaaauuuacccccgucggccucaacgacaccgaccacuucaaucaaugggucgucccccgauacgccggcgcccucaaccucaacaccaaccucgcacccucagucgcacccgucuuccccggagaaagacuacucuucuuccgauccuacaucccacuuaagggaggauacggcacccccgccaucgacugccuacucccucaagaauggguacaacacuucuaccaagaagcugcaccaaguauguccgaagucgcccuaguacgcuacauaaacccagacacuggacgagcacuguucgaagcaaaacuacaccgcgcaggcuuuaugaccgucucaucaaacacauccgcaccuguagucguacccgcaaacggcuacuucagauucgacagcuggguaaaccaauucuacucccuagcacccaugggaacuggcaauggacgucgcuaa

SEQ ID NO: 37968 - RNA, 1617 nt, Artificial Sequence
  derived and/or modified sequence opt11 from VP1__Norovirus_and/or_Norovirus-like__KX171417
augaaaauggcaagcaacgacgcggcccccuccaacgacggcgcugcaggccucguacccgaaggcaacaacgaaacacucagccuggaaccaguagccggagcagcaaucgccgcucccgucacgggccaaaacaacauuauugaucccuggauccgcaccaacuucguccaggccccgaacggagaauuuaccgugucaccucgcaauucccccggcgaaauacuucuuaaccucgaacucggacccgaccucaaccccuaccuagcacaccugucacgaauguacaauggcuacgcuggcggagucgaaguccaaguccuccuagcuggcaacgccuucaccgccgguaaaauccucuucgcagccguacccccgaacuucccugucgaauuucucucacccgcgcaaaucaccaugcuuccacaccuuaucgucgacguccgcacucucgaaccaaucaugauuccccuacccgacguccgcaacaccuucuuccacuacaacaaccaaccaaacucccguaugcgccuagucgccauguuauauaccccacuccguuccaacggcucaggcgaugacgucuucaccgucucaugccgaguccuaacccgacccaccccagacuucgaguucacauaccucguaccacccuccgucgaauccaaaaccaaaccuuucucucucccgauccucacauuauccgaacucaccaacucccgauucccagugcccauagacucccucuucacagcccaaaacaacguacuacaaguacaaugccaaaacggacgaugcacacuagacggcgaacuccaaggcacaacgcagcugcuuccuuccggaaucugcgcuuucagaggacgcgucaccgcuaaaaccgaccacuccgacaaauggcacaugcaacuccaaaaccucaacggcaccaccuacgacccaaccgaugacguccccgcaccccucggcacccccgauuucaaaggcgucgucuucggcguagccucacaacgaaacgucggaaaugacgcacccgguucaacacgcgcucacgaagccguuauauccaccuacucaccccaauucguacccaaacucggcuccguaaacuucagauccaacgacgacgacuuccaacuccaacccaccaaauucaccccaguaugcaucaacgacgacgacgaucacccauuccgccaaugggaacuccccgacuacucaggucuacucacccuuaacaugaaccucgccccuccaguggcccccaacuuccccggagaacagcuccucuucuuccgcucauucguccccugcucagggggcuacaaccaaggaaucgucgacugccuaauaccacaagaauggauccaacacuucuaccaagaauccgcccccucccagucagaaguugcccuaauccgauacgucaacccugacaccggacgcacccuauucgaagcuaaacuccaccgcuccggauauaucacugucgcucacucaggcgacuacccccucguaguucccgccaacggauacuuccgcuucgacucuuggguaaaccaauucuacucucucgcaccaaugggcaccggcaacggccggcgccgagcccaauaa

SEQ ID NO: 37969 - RNA, 1617 nt, Artificial Sequence
  derived and/or modified sequence opt11 from VP1__Norovirus_and/or_Norovirus-like__KX171412
augaaaauggccuccaacgacgcagccccauccaacgacggagccgcaggccuaguaccagaaggcaacaacgaaacccucccccucgaacccguagccggggcugcaaucgcugcccccgucaccggccaaaacaacauaaucgaccccuggauccgaaccaacuucguccaggcuccaaacggugaauuuaccgucucaccccgcaacucaccgggcgaaauccuacucaacuuagagcucggccccgaccucaacccuuaucucgcccaccucucccgcauguacaauggcuaugcaggaggcgucgaaguccaaguccuacuagccggaaaugccuucaccgcaggcaaaauccuuuucgccgccguucccccaaacuuccccgucgaguuccucucaccagcacaaaucaccaugcucccccaccuuaucguagacguacgcacccucgaaccgaucaugaucccccuacccgacguccgaaacacguucuuccacuacaacaaccagcccaacucccgcaugcgccucguugccaugcucuacacaccccuccgcucaaacggcuccggagacgacguauucaccguauccugccgcguccucacccgcccaacccccgauuucgaguucaccuaccucguaccacccuccgucgaauccaaaaccaaaccauucucccuaccaauacugacccucucagaacucacgaacucucgcuucccagucccuaucgacucccucuucaccgcccaaaacaacguacuacaaguccaaugccaaaacggucgaugcacccuugacggcgaacuacaaggaaccacucagcuccuccccagcggcauaugcgccuuccgcggccgagucacugcagaaacugaccaccacgauaaauggcauaugcaacuccaaaaccucaacgguaccaccuacgaccccaccgacgacguacccgccccacuaggcacccccgacuucaaaggcgucguuuucggcgucgcgucccaaagaaacguuggaaacgacgcaccaggcucaacacgcgcccacgaagccguaauuuccaccuacucgccccaauucguccccaaacucggcuccgucaauuuccgauccaaugacgacgacuuccaacuccaaccaacaaaauucacucccgucggaaucaaugacgacggugaccaccccuuccgccaaugggaacuuccugacuacuccggccuccucacacuuaacaugaaccucgcgccacccguagcacccaacuuccccggagaacaacucuuauucuucagguccuucguccccugcuccggcggcuacaaccaaggcaucgucgacugccuuaucccacaagaauggauacaacauuucuaucaagaauccgcaccaucacaguccgacgucgcccuaaucagguacguaaaccccgacaccggacgcacacuauucgaagcaaaacuccaccgauccggcuacaucaccgucgcccacuccggagacuacccccuagucgucccagccaacgguuacuuucguuucgacucaugggucaaccaauuuuacucccucgcccccaugggcaccgggaacggacgucgccgcgcacaauaa

SEQ ID NO: 37970 - RNA, 1617 nt, Artificial Sequence
  derived and/or modified sequence opt11 from VP1__Norovirus_and/or_Norovirus-like__KU557839
augaaaauggcauccaacgacgcugcccccucuucagacggcgcagccggccucguaccagaaggcaacaacgaaacccucccacucgaacccguagcuggcgccgccaucgccgccccagucaccggccaaaacaacaucauagaccccuggauacgcaccaacuucguccaagcccccaauggagaauuuacagucagucccagaaacucacccggcgaaauccuccucaaccucgaacucggacccgaccucaaccccuaccucgcccaccucucccgcauguauaacggcuacgccggcggugucgaaguccaaguccuccucgccggcaaugccuucaccgccgggaaaauccuuuucgcagcaguucccccaaacuucccagucgaguuccucuccccagcacaaaucaccaugcucccacaccucaucgucgacguccgcacccuggaacccaucaugaucccccuccccgacguccgcaauacauucuuccacuacaacaaccaacccaacucccgcaugcgacucgucgccaugcuguacacaccccuccgcucuaacggaagcggcgacgacgucuucaccgucuccugucgaguacucacccgacccacaccagacuucgaguucaccuaccugguaccacccucaguugaauccaaaacuaaacccuucucccuccccauccucacacucuccgaacuuaccaacucccgcuuccccguccccauagauucccuauucaccgcccaaaacaacguacuccaaguucaaugccaaaacggucgcuguacccucgacggugaacuccaagguaccacccaauuacuccccuccggaaucugcgccuuccgcggacgcguaaccgccgaaaccgaccaccgagacaaauggcacaugcaauuacagaaucucaacggcacuaccuacgaccccacugacgauguacccgcaccacuaggcaccccagacuuuaaaggcgucgucuucggcgucgccucucaacgcaacgucggcaacgacgcaccaggaucaacccgcgcacaugaagcagucaucuccaccuacucaccccaauucguaccaaaacuuggauccguaaauuuccgcuccaacgacaacgacuuccagcuacagcccaccaaauuuaccccagucgguauaaacgacgacggcgaccacccauuccgccagugggaacucccagacuacucaggauuacucacccugaacaugaaccuagcuccacccgucgcucccaacuuccccggcgaacaacuccuauucuuccgauccuuugucccgugcucaggcggauacaaccaaggcauaguugacugccucaucccccaagaauggauucaacacuucuaccaagaauccgcccccucccaauccgauguagcccuuauccgcuacgucaaccccgacaccggccgcacccuauucgaagcuaaacuccaccgcucaggauacaucaccgucgcccacuccggagacuacccccuagucguaccugccaacggauacuuccgcuucgacuccugggucaaccaauucuacucacuagcacccaugggaacagguaacggacgacgacgcgcccaauaa

SEQ ID NO: 37971 - RNA, 1617 nt, Artificial Sequence
  derived and/or modified sequence opt11 from VP1__Norovirus_and/or_Norovirus-like__KP902564
augaaaauggccucaaacgacgccgccccaucuaaugacggggccgcaggccuaguaccagaaggcaacaacgaaacauuaccacuagaacccgucgcaggcgccgccaucgcagccccagucaccggccaaaacaauaucauagaccccuggauacgcacaaacuucguacaagcuccaaacggcgaauuuacagucagcccccgcaacucccccggagaaaucuuacuaaacuuggaacucggcccagaccucaaccccuaucucgcccaccuauccagaauguauaacggcuaugccggcggcgucgaagugcaaguacuccuagcaggcaacgccuucaccgcaggaaaaauccucuucgccgcaguacccccuaacuuccccgucgaauuucucucccccgcucaaaucaccaugcucccacaccucaucgucgacguccgcacacucgaacccaucaugauuccccucccagacguccgcaacaccuucuuccauuacaacaaucaaccaaacagccgaaugagacucgucgccaugcuauacacaccccuccgcucaaacggcucaggagacgacguuuucaccgucagcugccguguccucacccgcccaaccccagacuucgaguucaccuaccucguaccacccuccgucgaauccaaaaccaaacccuucucccuucccauccuaacccucagcgaacuaacaaacucacgauuccccguacccaucgacucccucuucacugcccagaacaacguacuccaaguacaaugccaaaacggccgcugcacccucgacggagaacuccaaggcacaacccaacuccuaccauccggcaucugcgccuuccgcggacgcguaacagcugaaaccgaucaccgagacaaauggcacaugcaacuucaaaaccuuaacggcacaacuuacgacccaaccgaugacguaccagcaccccucggcacccccgacuucaaaggcguugucuucggcguagccagccaaagaaacguaggcaacgacgcccccgacucaaccagagcacacgaagccgucaucucuaccuacagcccccaguucguccccaaacuaggauccgucaacuuccgauccaacgacaacgauuuccaacuacaacccaccaaauucaccccagucgguaucaacgacgacggcgaccaccccuuccgccaaugggaacuaccagacuauagcggcuuauuaacccucaacaugaaccuagccccuccuguugcucccaacuucccaggcgaacaacuccucuuuuuccgauccuucgugcccugcuccggcggcuacaaccaaggcaucgucgacugccucaucccccaagaauggauccaacacuucuaccaagaauccgcucccucccagucagacgucgcccucauacgcuacguaaaccccgauacaggacgaacccuauucgaagccaagcuacaccgcuccggauacaucacggucgcacacuccggcgacuacccccucgucgucccagccaauggauacuucagauucgacuccugggucaaccaauucuacucucuagcacccaugggcaccggcaauggacgccgucgagcucaauaa

SEQ ID NO: 37972 - RNA, 1617 nt, Artificial Sequence
  derived and/or modified sequence opt11 from VP1__Norovirus_and/or_Norovirus-like__KU587625
augaaaauggccuccaacgacgccgcaccauccaacgacggcgccgccggccucguccccgaaggcaacaacgaaacccuaccccucgaaccugucgccggcgcagccaucgccgcccccgucaccggccaaaacaacaucaucgacccuuggauccgcaccaacuuuguacaagcccccaacggcgaauuuacagucucuccccgcaacuccccaggcgaaauacuacucaaccuagaacuaggcccagaccuaaaccccuaccucgcccaccucucacgcauguacaacggauacgccggcggcgucgaaguccaaguccuccucgcaggaaacgccuucaccgccgguaaaaucuuauucgcggccgucccacccaacuuccccgucgaguuccucucacccgcccaaaucaccaugcucccacacauaaucgucgacguccgcacccucgaacccaucaugaucccccuaccugacguccgaaacacauucuuccacuauaacaaccaaccaaacucccgcaugcgccucgucgcgaugcuuuacacaccccuccgcucuaacggcagcggcgacgacgucuucacgguuagcugcagaguucucacccgcccaacacccgacuucgaguucaccuaccucguucccccuuccgucgaaucgaaaaccaaacccuucucccucccaauccucacccucuccgaacuaaccaacucucgauucccaguccccaucgacucacucuucaccgcacaaaacaacguccuacaaguccaaugccaaaacggaagaugcacacucgacggcgaacuccaaggcaccacccaacuacucccuucaggcauuugcgcauuccgcggccgugucaccgccgaaacagacaaccccgacaaauggcacaugcaacuucaaaaccuaaacggcaccaccuacgauccaaccgacgauguccccgcccccuuagguacccccgacuucaaaggagucgucuucggcgucgccucccaaagaaauguaggcaacgacgcuccugguuccacacgcgcacaugaagccguaauaucaaccuacucaccaaaguucguccccaaacucggauccgucaacuuucgcucuaacgacgacgacuuccaacuccaacccaccagauucaccccaguaggcauaaacgacgacggaaaccacccauuccgucaaugggaacuaccggacuacucaggaguacuaacccuuaacaugaaccuagcaccacccguagcacccaacuuccccggggaacaacuccuccuauuccgauccuucgucccaugcagcggaggcuacaaccaaggcaucauagacugccuuaucccacaagaauggauccaacacuucuaccaagaauccgccccaucacaaucugacgucgcccucauccgauacgucaaccccgacacaggaagaacacuauucgaagccaaacuacaccguucaggcuacaucaccgucgcccacuccggcgacuacccacucgucguccccgccaacggauacuuccgauucgacucauggguuaaccaauucuacucccucgcccccauggguaccggcaacggacgccgucgagcccaauaa

SEQ ID NO: 37973 - RNA, 1617 nt, Artificial Sequence
  derived and/or modified sequence opt11 from VP1__Norovirus_and/or_Norovirus-like__KX171413
augaaaauggccuccaacgacgcagcccccuccaacgauggcgccgccggccuagucccagaaggcaacaacgaaacacuuccccucgaaccgguagccggcgccgccaucgcagcaccggucacaggacaaaacaacaucaucgacccauggauccggaccaacuucguacaagccccaaacggagaauuuaccgucucuccccgcaacuccccaggcgaaauccuccucaaccuagaacucggaccugaccucaaccccuauuuagcacaccuaucccgcauguauaacggcuacgccgguggcguagaaguccaaguccuccuagccggcaacgccuucacagccggaaaaauucuguucgcugccgucccacccaacuucccagucgaguuccucuccccagcccaaaucaccaugcucccccaccucaucgucgacguccgaaccuuagaaccuaucaugaucccacuccccgacguccgcaacacauucuuccacuacaacaaccaacccaacucccgcaugcgucuaguagcuaugcuauacacgccccuacgcuccaacggaagcggggacgauguuuucaccguuuccugccgcguccucacccgcccaaccccagacuucgaguucaccuaccucguuccaccguccgucgaaucaaaaacaaaacccuucucccuaccaauccucacccucucagaacucaccaacucacgauuccccgucccaaucgauucccuauucaccgcacaaaauaacguccuccaaguucaaugccaaaacggacgcugcacccuagacggcgaacuacaaggcaccacccaacuccuccccagcggcaucugcgcauuccgcggccgcgucaccaccgaaaccgaccaccgugacaaauggcacaugcaacuccaaaaccucaacggcaccacauacgaccccaccgacgacgucccagcaccccucggaacaccagacuucaaaggagucgucuucggcgucgccucacaacgcaacgucggcaacgaugcccccggcagcacacgcgcccacgaagccguuauaucaacauacuccccacaauucguacccaaacucggcuccgucaacuuccgauccaacgacgacgacuuccaacuacaacccaccaaauucacacccgucggcaucaaugacgacggcgaccaccccuuccgacaaugggaacuucccgacuacucaggcccuuuaacccucaacaugaaccucgcaccacccgucgcucccaacuuccccggugaacagcuacuuuucuuccgaucauucguucccugcagcggcggcuacaaccaaggaaucgucgacugccucaucccucaagaauggauccaacacuucuaccaagaaucagcucccucacaauccgacgucgcccucauccgcuacguaaacccagacacaggacgaacacucuucgaagcuaaacuccacagauccggcuacauaacuguagcccacucgggagacuacccucucguagucccagcuaacggauacuuccguuucgacuccuggguuaaccaauucuacucucuggcccccauggguacggguaacggccgucgccgcgcccaauag

SEQ ID NO: 37974 - RNA, 1617 nt, Artificial Sequence
  derived and/or modified sequence opt11 from VP1__Norovirus_and/or_Norovirus-like__KP902565
augaaaauggcauccaacgacgccgcccccucaaacgacggugccgccggccucguccccgaaggcaacaacgagacucuuccacuugaacccgucgccggcgccgccauagccgcccccgucacaggccagaacaacauuauagaccccuggauacgcaccaacuucguacaagcaccaaauggcgaguucaccgucagcccccgaaauuccccaggcgaaauacuacucaaccucgaacuaggccccgaccucaacccauaccuagcacaccucucacgcauguacaacggcuacgccggcggagucgaaguccaaguacuacucgcuggcaacgccuucaccgcuggcaaaauccuauucgcagccguuccgcccaacuuccccgucgaauuucucucccccgcccaaaucaccaugcuaccccaccucaucguagauguccgcacacuagaacccauaaugauaccccuccccgauguaagaaacacguucuuccacuauaacaaccaaccaaacaaccgcaugagacuugucgccaugcucuacacuccccuccgaucaaacggcuccggagacgacgucuucacagucuccugccguguccucacccgcccaacccccgacuucgaguucacauaccucguucccccaucuguagaaucaaaaacaaaaccauucucacuacccauccuuacacucuccgaacuaaccaacucgcgauucccaguccccaucgacucccucuucacagcccaaaauaacguccuacaaguucaaugucaaaacggccgcugcacccuugacggugaacuccaaggaacaacacagcuacuccccagcggcauuugcgccuuccgaggccgagucaccgcagaaaccgaccaccgcgacaaguggcacaugcaacuacaaaaccuaaacggcaccaccuacgacccaaccgacgacguacccgcaccccucggcaccccugacuucaagggagucguuuucggagucgccucccagcguaacguaggcaacgacgccccaggcuccacccgcgcacacgaagccgucauauccacuuacagcccccaauucguccccaaacucggaagcgucaacuuccguuccaacgacaacgacuuccaacuacaacccaccaaauucacccccgugggcauaaacgacgacggcgaccaccccuuucgccaaugggaacucccugacuacuccggccuccuaacacucaacaugaaccuugcucccccagucgccccaaauuuccccggagaacaacuccuauucuuccgcagcuucgucccaugcuccggcggauacaaccagggaaucguugauugccucaucccccaagaauggauccaacacuucuaccaagaauccgcccccucccaaucagacgucgcccuaauucgcuaugucaacccugacacaggaagaacucucuucgaagccaagcuacaucgauccggcuacaucaccgucgcacacaguggcgacuacccccuaguagucccagccaacggauacuuccgcuucgacuccuggguaaaccaguucuacucccucgcccccauggguacaggcaacggacgccgccgcgcccaauga

SEQ ID NO: 37975 - RNA, 1617 nt, Artificial Sequence
  derived and/or modified sequence opt11 from VP1__Norovirus_and/or_Norovirus-like__KX171416
augaaaauggccucaaacgacgccgcccccuccaacgacggcgcagccggccuaguccccgaaggcaauaacgaaacucucccccuugaaccagucgccggcgccgcuaucgccgcacccgucacaggucaaaacaacauuauagaucccuggauucgaacuaacuucguacaagcccccaacggcgaguucacagucucaccccgcaauucaccaggcgaaauucuacuuaaccucgaacucggccccgaccuaaaccccuaccuagcccaccucucaagaauguacaacggcuacgccgguggugucgaaguacaaguccuccucgccggcaacgcuuuuaccgcuggcaaaauacuuuucgcagccguaccacccaacuucccugucgaguuccucuccccugcacaaauaaccaugcucccccaccuaaucgucgacguccgcacccucgaaccgaucaugaucccccuccccgacguacgcaacaccuucuuccacuacaacaaucagccaaacaaccgaaugcgccuagucgccaugcuauacacaccccuucgauccaacggauccggcgacgacgucuuuaccgucucaugccgaguccuaacccgccccacccccgacuucgaguucaccuaccucgucccacccucugucgaauccaaaaccaagcccuucucccuccccauccucacccuuucagaacucacaaacucccgcuuccccguccccaucgacucucucuucacagcacaaaacaacguacuacaaguccaaugccaaaacggccguugcacucucgacggcgaacuccaaggcaccacacaauuacuacccucaggaaucugcgcauuucgcggacgcgucacagccgaaaccgaccacagagacaaauggcacaugcaacuacagaaccucaacggaacaacauacgaucccaccgacgacguucccgcaccccucggcacccccgacuucaaaggcguagucuuuggcaucgccucccaacgcaacguuggaaaugacgcacccggcuccacaagagcccacgaagccguaauaucaacauacucaccccaauucgucccuaaacuaggcuccgucaacuuucgauccaacgacaacgacuuccaacuacaacccaccaaauuuaccccagucgguaucaacgacgacggugaccaccccuuccgccaaugggaacuaccagacuauucaggacuacuaacacucaacaugaaucucgccccacccgucgcccccaacuuccccggcgaacaacuccucuucuuccgcucguucguucccuguuccggcggauacaaccaagggaucgucgauugccucauuccccaagaauggauccaacacuuuuaccaagaaucagcccccagccaaucugacgucgcccuaauacgguacgucaaccccgacacaggacgcacacucuucgaagcaaaacuccaccgcucaggauacauaaccgucgcccacucuggcgacuacccccuaguaguccccgccaacggauacuuucgcuucgacuccuggguuaaccaauucuacucccuugcccccaugggcaccggcaacggucgccgccgagcccaguaa

SEQ ID NO: 37976 - RNA, 1617 nt, Artificial Sequence
  derived and/or modified sequence opt11 from VP1__Norovirus_and/or_Norovirus-like__KU561250
augaaaauggccagcaacgacgcagcgcccuccaacgacggagccgccggccucguacccgaaggcaacaacgaaacacucccccuagaaccagucgccggcgccgccaucgccgccccagucaccggacaaaacaacaucaucgaccccuggauacgcacaaauuucguccaagccccuaacggcgaguucaccgucagcccccgaaacucacccggcgaaauacuacucaaccucgaacucggaccagaccugaacccauaccuagcccaccuuucccggauguacaacggcuaugccggagggguagaaguacaaguucuucucgccggaaacgcauucacagcuggcaaaauucucuucgcagccguacccccaaacuuucccguagaguuccucucccccgcacaaaucacaaugcuuccacaccuaaucgucgacguaaggacccuugaacccaucaugaucccccuucccgacguccgcaacacauucuuccacuacaacaaccaacccaauucacgcaugagacucguagccaugcucuacaccccucuccgcuccaacggcuccggcgacgacgucuuuacaguauccugcagaguccuaacccgcccaacgccagacuucgaguucaccuaccuuguuccacccagcguagaaucgaaaacaaaacccuucucauuacccauccucacccucucagaacucacaaacucacgauucccuguccccaucgacucccuauucacagcacaaaacaacguccuccaaguccaaugucaaaacggccgcugcacccucgacggagaacuacaaggaacaacucaacuacuucccucaggcaucugcgcauuccgagggcgcgucacagcagaaaccgaccaccgcgauaaauggcacaugcaacuccaaaaccuuaacggcacaaccuaugaccccaccgacgacguccccgcuccccucggcacaccagacuucaaggguguugucuucggcgucgccucccaacgcaaugucggaaacgacgccccaggauccacccgcgcgcacgaagcagcaaucuccaccuacucuccccaauucguccccaaacuuggcuccgucaacuuccgcuccaacgacaacgauuuucaacuccaacccaccaaauucacacccgucggcaucaacgacgacggcgaucauccauuccgccaaugggaacuccccgacuacuccggccuccuaacccucaacaugaaccucgcaccacccgucgcccccaacuuccccggagaacaacuccuauucuuccgauccuucguaccaugcuccggaggauacaaccaaggaauagucgacugccucaucccccaagaauggauccaacacuucuaccaagaauccgccccuucccaaucagacgucgcccugauccgcuacguaaacccugacaccggucgaacucucuucgaagccaaacuccaucgaucaggauauaucacaguugcccacucaggcgacuacccccucguaguccccgccaauggcuacuucagauucgacucaugggucaaccaauucuacucccucgcccccaugggaaccgguaacggccgccgacgcgcacaauga

SEQ ID NO: 37977 - RNA, 1617 nt, Artificial Sequence
  derived and/or modified sequence opt11 from VP1__Norovirus_and/or_Norovirus-like__KU561251
augaaaauggcauccaacgacgcagcccccagcaacgauggcgccgccggacucguaccugaaggcaacaacgaaacccuucccuuagaacccgucgccggcgccgccauagcugcccccguaaccggccaaaacaacaucaucgacccauggauccgcaccaacuucguccaagcccccaauggcgaauuuaccgucuccccucgcaacuccccuggugaaauccuccucaaccuagaacucggucccgaccucaacccauaccucgcucaccuaucccgcauguacaacggauacgcaggcggcgucgaaguccaaguacuccucgccggaaaugcuuucacagccggcaagauacuuuucgcagcagucccgcccaacuuccccgucgaauuucuuuccccagcgcaaaucaccaugcuaccacacuuaauaguagacguacggacccucgaaccuaucaugauuccccuccccgacguccgcaacaccuucuuccacuacaacaaccaacccaacucucgcaugcgccuaguugccaugcucuacacaccccuacgaucaaacggauccggagaugacguauucaccgucuccugccggguccucacacgcccaacccccgacuucgaguucacguaccucgucccgcccucaguagaauccaagacgaaacccuucucacucccaauccucacccucuccgaacuaacaaacucccgcuuccccguccccaucgacucccucuucaccgcccacaacaacguauugcaaguccaaugucagaacggucgaugcacacucgauggagaacuccaaggaaccacccaacuccuacccuccgggaucugcgccuuccggggccgagucaccgccgaaacagaccaccgcgacaaauggcacaugcaacuccaaaaccuaaacggcaccaccuacgacccaaccgacgacguaccagcaccccucgguacccccgacuucaaaggcgucgucuucggcguagccucccaacgcaacguuggcaacgaugcccccggcucaacccgagcacacgaagccguaaucagcaccuacuccccacaauucguccccaaacucggcucugucaacuuccgcucaaaugacaacgacuuccaacuacaacccacuaaauucacccccgucggcaucaacgacgacggcgaccaccccuuccgccaaugggaacuaccagacuauagcggacuccuuacccucaacaugaaccucgcaccacccgucgcccccaacuuccccggcgaacaacuccucuucuuccgauccuucguacccuguuccggcggcuacaaccaaggcauuguugacugccuaauaccacaggaauggauccaacacuucuaccaagaaucagcccccucacaauccgacguggcccucauccgcuacguaaaccccgacaccggccgaacacuauucgaagccaaacuucaccgcuccgguuacaucaccgucgcacacucaggagacuacccccucguaguccccgcuaacggauacuuccgcuucgacagcuggguaaaccaguucuacucccucgcccccaugggcaccggcaacggccgacgcacagcacaauaa

SEQ ID NO: 37978 - RNA, 1617 nt, Artificial Sequence
  derived and/or modified sequence opt11 from VP1__Norovirus_and/or_Norovirus-like__AB810014
augaaaauggcguccaacgacgccgccccgucaaacgacggcgccgcaucucucguucccgaagcgaucaacgaaaccaugccccucgaacccgucgccggugcaagcaucgcagccccggucgccggccaaaccaacaucaucgacccauggauacgcaccaauuucguccaagcccccaacggcgaguucaccgucucaccccgcaauuccccuggcgaaauccuccuaaaccuagaacucggccccgaucuaaaccccuaccucgcccaccuaucccgaauguacaauggauacgccggcggagucgaaguccaaguacuccucgccggcaacgccuucacagccggaaaaauccucuucgcagccauaccacccaacuuccccguggacaugaucucccccgcccaaaucacaaugcuaccacaccucaucguagacguucgcacccucgaacccaucaugauccccuuacccgaugucagaaacgucuucuaccauuuuaacaaucaaccccaaccacgcaugcgucucgucgccaugcucuacaccccucuacgcuccaacggcuccggagaugacguauuuaccgucagcugccgcguccucacccgccccaccccugacuucgaauuuaucuaccucguucccccauccguggaauccaaaacaaaacccuucacccuucccauccugaccauaucugaacucaccaacucaagauuccccauccccaucgaacaacuauacaccgcacccaacgaaaacaacgucguacagugccaaaacggacggugcacacuagacggcgaacuccaaggaacuacacaacuacucucauccgccgucugcagcuaccgcggccgcaccgucgcaaacuccggcgacaacugggaccaaaaccuacuccaauuaacauacccaagcggcgccuccuacgacccuaccgacgaaguccccgcgccacucgguacccaggacuuccguggcauacucuacggaguccucacacaagacaacguaucggaaggaaccggcgaagccaaaaacgcaaaaggcgucuacaucucaacuacaucgggcaaauucacacccaaaaucggcuccaucggcuuacacuccauuacagaaaacguacauccaaaccaacaauccagauuuaccccaguuggcguagcccaaaacgaaaauaccccauuccaacaauggguccuaccacacuacgcaggcgcccucgcccuaaacaccaacuuagccccagcaguugcccccacauuccccggagagcagcuccucuucuuccguucccguguaccauguguucaagggcucagaggucaagacgcuuucaucgacugccugcuaccacaagaauggguaaaccacuucuaccaagaggcugcacccucacaagccgacguugcccucauccgcuacguaaacccugacacaggccgcacacucuucgaggccaaacuccaucgcuccggcuucaucacaguaucccacaccggcgccuacccacucguagucccucccaacggccacuucagauucgacucuugggucaaccaauucuacucucucgcccccaugggcaccggcaacggucgauaa

SEQ ID NO: 37979 - RNA, 1617 nt, Artificial Sequence
  derived and/or modified sequence opt11 from VP1__Norovirus_and/or_Norovirus-like__AB809985
augaaaauggccuccaacgacgcugccccauccaaugacggugcagccagccucguccccgaagcaaucaacgaaaccaugccauuagaaccagucgccggcgccagcaucgccgcacccgucgccggccaaacuaacaucaucgauccauggauccguaccaacuucguacaagcccccaacggcgaauuuaccgucaguccacgcaacucacccggcgaaauccuccucaaccuagaacucggcccagaccuaaaccccuaccucgcccaccucucacggauguacaauggauacgccggaggugucgagguccaaguucuccucgcgggaaacgccuucaccgccggcaaaauucucuucgccgcuaucccacccaacuuccccguugacaugauuucccccgcacaaaucaccaugcucccccaucuaauaguagacguucgcacacucgaaccuauuaugauacccuuacccgacguccgcaacgucuucuaccacuuuaacaaccaaccccaaccccgaaugcgccuagucgccaugcucuacaccccucugcgcucuaacggauccggagacgacguauucaccgucuccugccgcguacuaacccgcccaaccccagacuucgaguucaucuaccucguaccacccuccgucgaauccaaaaccaaacccuucacccucccaauccucacaaucuccgaacucacaaacucacgcuuccccauacccaucgaacaacucuacaccgcacccaacgaaaacaacguaguccaaugccaaaacggucgaugcacccucgacggcgaacuucaagguaccacccaacuacuaucauccgccgucugcaguuaccgcggccguaccguagccaacucgggagacaacugggaccaaaaccuccuccaacucacauacccauccggcgcauccuaugacccaacagacgaagucccagcaccccuaggaacccaggacuucuccggcauccucuacggagucuuaacucaagacaacgucuccgaaggaaccggugaagcuaaaaacgcuaaaggaguauacauaucgacuacuagcggcaaauucaccccuaagaucggcagcauaggccuccacucaaucaccgaaaacguccaucccaaccaacaaucacgauucacccccguaggcguugcccaaaacgagaacaccccauuccaacaauggguccucccccacuacgccggugcccucgcccugaacacuaaccucgcaccagccguagccccaaccuuccccggcgaacaacuucucuucuuccgcagccgaguccccugcguccaaggacuccgaggccaagacgccuucaucgacugccuacucccccaagaaugggucaaccacuucuaccaagaagcagcacccucacaagcagacguggcacucauacgcuacguaaacccagacacaggccgcacccucuucgaagcaaaacuacaucgauccggcuucaucacaguaucucacaccggagcauacccacuugucguaccacccaacggccacuuccgguucgacuccugggucaaucaauucuacucucuugcccccaugggcaccggcaacggccgauaa

SEQ ID NO: 37980 - RNA, 1617 nt, Artificial Sequence
  derived and/or modified sequence opt11 from VP1__Norovirus_and/or_Norovirus-like__AB810003
augaaaauggccuccaacgacgccgcccccuccaacgacggcgccgccucucuugucccagaagccaucaaugaaaccaugccccuggagcccgucgccggcgcauccaucgcagcucccgucgcaggacaaaccaacauaaucgaccccuggauccgcaccaacuucguccaagcacccaacggugaguucaccgucucgccccgcaacagccccggcgaaauccuccucaaccuugaacucggcccggaccucaacccauaucucgcacaccuaucccguauguacaacggguacgccggaggcguagaaguccaaguccuacuggcaggcaaugccuucaccgccggaaaaauccucuucgccgcaaucccaccuaacuuccccgucgacaugauaucuccagcccaaaucacuaugcuaccacacuuaaucguagacgugcguacucuugaacccaucaugaucccccuccccgacguacgaaacgucuucuaccacuucaacaaucaaccccaaccacgcaugcgccuuguugccaugcucuacacaccccuacgaagcaacggcucaggcgacgacgucuucaccgucucaugccgagucuuaacccgcccuacccccgacuuugaguucaucuaccuaguaccaccaucugucgaauccaaaaccaagccauuuacacuucccauccucacaauaucagaacuaacaaacucacgauuccccauacccauagaacaacuauacacagcacccaacgaaaacaacgucguccaaugccaaaacggccguugcacccuugacggcgaacuccaaggcaccacucaacuucucuccuccgcagucugcuccuaccgaggacgcacagucgccaaccgcggagacaacugggaccaaaaccuccuacaacuaaccuaccccucaggcgcauccuacgacccaacagacgaaguccccgcaccccucgggacccaagacuucagcgguauucucuacggaguccuaacacaagacaacgucucagaaggcaccggcgaagccaaaaacgccaaaggcgucuacaucuccaccaccucuggcaaauucaccccuaaaauaggcucaauaggacuacacuccauaaccgaaaacguucacccaaaccaacaaucccgguuuacucccguuggcgucgcccaaaacgaaaacacaccuuuccaacaauggguacucccacacuacgcgggugcacuugccuuaaacaccaaucuagcacccgccgucgcacccaccuucccaggcgaacaacuacuuuucuuccgcucccguguacccugcguccaaggccuccgcggccaagacgccuucauagacugccuacuaccacaagaaugggucaaccacuucuaucaagaagccgcacccucccaagccgacguagcccuaauccgcuacgucaacccagacaccggccgcacccucuucgaagccaagcuccaccgcucuggcuucaucaccguaucccacacaggcgcuuacccccucgucgugcccccuaacggccacuuccgcuucgacucuugguucaaccaauucuacucccucgcccccaugggcacaggcaacggccgcuaa

SEQ ID NO: 37981 - RNA, 1617 nt, Artificial Sequence
  derived and/or modified sequence opt11 from VP1__Norovirus_and/or_Norovirus-like__AB809975
augaaaauggccagcaacgacgccgcccccuccaacgacggcgccgcaucacucguccccgaagccaucaacgaaaccaugccccucgaacccgucgccggcgccuccaucgccgcccccguagcaggacaaaccaacaucaucgaccccuggauacguaccaauuucguccaagccccaaacggugaauuuaccgucuccccaagaaacucccccggcgaaaucuuacuuaaucucgaacucggucccgaccuaaaccccuaccuugcccaccuaucucgaauguacaacgguuacgccggcggcgucgaaguccaaguccuacucgccggaaacgccuucaccgccgguaagauacuauucgccgccauacccccaaacuucccaguagacaugaucucccccgcccaaaucaccaugcuuccccaccucaucgucgacguccgcacauuagaacccaucaugaucccucucccugacguccgcaacguuuucuaccacuucaacaaucagccucaaccccgcaugcgcuuagucgcaauguuauacacaccccuucgcuccaauggcagcggcgacgacguauucaccgucucaugccgcguucuaacccgucccaccccggacuuugaguucaucuaccuagucccaccuucagucgaaucaaaaacaaaaccauucacacuccccauccucacaaucucugaacucacgaacucccgauucccuauaccaaucgaacaacucuacaccgcaccaaacgaaaacaacguaguccaaugucaaaauggacgcugcacucucgauggagaacuccaaggcacaacacaacuccucuccuccgccgucugcuccuacagaggccgaaccguagcaaacuccggugauaacugggaccaaaaccuacuacaacucuccuauccaagcggcgccuccuacgaccccaccgacgaaguccccgccccacuaggaacacaagacuucuccggaauccuauacggaguccucacccaagacaacgucucagaacgaacaggcgaagccaaaaacgccaaagguauauacaucuccaccaccuccggcaaauucacccccaaaaucggauccaucggccuacacucaauaaccgaaaacgugcacccaaaucaacaaucacgcuucacucccguaggcguugcacaaaacgaaaacaccccauuccaacaauggguccucccccacuacgcuggcgcccucgcccuaaacaccaaccuagcaccagccgucgcuccgaccuuucccggcgaacaacuccuauucuuccgcuccagaguacccugcguucagggccuccaaggccaagacgccuucaucgauugucuccuaccacaagaauggguaaaccacuucuaccaagaagcugcucccucccaagccgacgucgcacucaucagguacgucaaucccgacacuggccguacccuuuuugaggccaagcuacaccgaucaggcuucauaaccguaucacacaccggugccuauccccuugucgucccacccaacggccacuuucguuucgacuccugggucaaccaauucuacucacucgcgcccaugggcacaggcaacggccgauaa

SEQ ID NO: 37982 - RNA, 1617 nt, Artificial Sequence
  derived and/or modified sequence opt11 from VP1__Norovirus_and/or_Norovirus-like__JX401280
augaaaauggccuccucugacgcaaacccauccgacggauccuccgcuaaccucguacccgaagucaacaacgaaguuauggcucucgaaccuguaguaggugccgcaaucgccgcacccgucgccggccaacagaacaucaucgaccccuggauccguaacaacuucguacaagcacccggcggcgaguucacagucuccccacgaaacgccccaggcgaaauccucugguccgccccacuaucccccgaccuaaauccauaccucagucacuuaucccgaauguacaacggcuacgcaggcggcuucgaaguacaaguuauccucgccggcaacgccuucaccgcaggaaaaaucgucuuugccgcagucccucccaacuucccaacagaaggucuaucccccucccaagucaccauguucccccacaucauagucgacguccgccaacucgagccaguacucaucccccuacccgauguccgcaacaacuucuaccacuacaaccaagccaaugacucaacacucaaacucauagccaugcuauacacuccccuccgugcaaacaacgccggagacgacgucuucaccgucucaugccgcguccucaccagacccuccccagacuuugacuucaucuuccucguacccccaaccgucgaaucccgaaccaaacccuucaccguccccguccucaccgucgaagaaaugaccaacucccguuuccccauuccacucgaacgacucuuuacaggaccauccaccgccuucgucguccaaccccaaaacggcagauguaccaccgacggaguccuccuuggcaccacccaacucucugccgucaacaucugcaacuucagaggcgaagucaaucacauagcaggaacccacgacuacaccaugcgccucacuucacaaaacuggaacaauuacgaccccaccgaagaaaucccugcaccccuugguacacccgauuucguuggccgcauacaaggcguccucacccaaacaacaagauccgaugguuccacccgcagccauaaagccaccgucucaaccggauccguccacuucacccccaaacucggcuccguucaauucaccaccgacaccaccaacgaccucaacgccggccaaaacaccaaauuuaccccaguagguguugaacagaccuccggugaccaccagucagaaccacaacaauggacacuccccaacuacuccggcacucccaaccacaacguacaccucgcccccgccguugccccaaccuuccccggcgaacaacuccucuucuuccgaucaacccuuccugggugcggcggcuaccccaacaugaacuuagacugccuccuuccccaagaauggguccuacacuucuaccaagaagccgccccagcccaaucagacguugcccuccuccgcuucgucaaccccgacaccggucgaguacucuucgaaugcaagcuacaucguuccggcuuuauaacaguagcccacucuggcagccaugaccuugucaucccacccaacggcuauuuccgcuucgacuccugggucaaccaauucuacacucucgccccaaugggcaacggcuccggcagacgccgcgucuag

SEQ ID NO: 37983 - RNA, 1617 nt, Artificial Sequence
  derived and/or modified sequence opt11 from VP1__Norovirus_and/or_Norovirus-like__KC962462
augaaaauggcuucauccgaugccaaccccuccgacggcuccgccgcaaaccucguccccgaagucaauaacgaaguaauggcucucgaacccguuguaggagcugcuaucgccgcacccguagccggccaacaaaacgucaucgaccccuggauacggaacaacuucguacaagcacccggcggcgaauuuacugucuccccacgcaacgcacccggagaaauccucuggucagcaccccucggccccgaccucaacccuuaccucucgcaccuagcccgcauguacaacggcuacgccggcggcuucgaaguccaggucauacucgcuggaaacgccuucaccgccggcaaaaucauuuucgccgccguacccccaaacuuccccaccgaaucacucucccccucacaagugaccauguucccgcacaucaucgucgacguacgccagcucgaaccaguccucaucccccuaccagauguccgaaacaacuucuaccacuacaaucaauccaacgauccaacaaucaaacucaucgccaugcucuacacaccccuccgcgcuaauaacgccggcgacgacgucuucaccgucuccugccguguucuuacacgcccauccccagacuucgauuucaucuuccuugucccgccaacaguagaaucccguaccaaacccuucucaguccccauccucaccgucgaagaaaugacaaacucacguuuccccaucccccuagaaaaacucuucaccggacccucauccgcguucgucguccaaccccaaaacggccgcugcaccaucgacgguguacuucuuggcacaacccaacuaucacccgucaacaucugcaccuuccgcggcgaugucacccacauagcuggaacacacaacuacaccaugaaccucgcaacccaaaacuggaacucauacgaccccaccgaagaaaucccagccccacuaggcacacccgacuucguuggcaaaauacagggcguccuaacacaaaccaccaaaaccgacgguuccacccgcggccacaaagccacaguaugcaucggcucagcugacuucgcaccuaaacucggccgaguccaauucgaaaccgacaccaacaacgaucuggaaacuaaccaaaacaccaaauucacuccagucggagucauccaaaacggcgaaaccgcccaccgcaacgaaccccaacaauggguacuacccucuuacuccggcagaaacacccccaacguacaccucgcccccgccguugcacccacauuccccggcgaacaacuccuauucuuccgcucuacuaugcccggcuguuccggcuacccaaacauggaccuagacugccuccuaccacaagaauggguucaguacuucuaccaagaagccgccccagcacaguccgacgucgcccuccuucgcuucgucaaccccgacacaggcaggguccuauucgaaugcaaacuucacaaaucaggcuacgugaccgucgcacacacaggaucucacgaccucgucaucccacccaacggcuacuuucgcuucgacuccugggucaaucaauuuuacacccucgcacccaugggaaacggcaccggccgccgccgauag

SEQ ID NO: 37984 - RNA, 1617 nt, Artificial Sequence
  derived and/or modified sequence opt11 from VP1__Norovirus_and/or_Norovirus-like__KX353974
augaaaauggcaaguaacgacgccaaccccucagacggauccgcagcgaaucuaguccccgaagucaacaacgaagugauggcccucgaacccgucguuggagccgccauagccgcccccguagcaggacaacaaaauguuaucgacccauggauucgcucaaacuuuguccaagcccccggaggagaguucacagucucaccccgaaacgcccccggcgaaauacuaugguccgcaccccuaggucccgaccuaaaccccuaccucagccaccuagcccgcauguacaacggcuacgccggcggcuucgaaguccaagucauucuugccggcaaugccuucaccgcgggcaaaauaaucuucgccgccguuccacccaacuuccccaccgaaggacuguccccaucccaagucaccauguucccacacaucaucgucgacguucgccaacuggaacccguccucauaccccuccccgacguacgcaauaacuucuaccauuacaaccaaucaaacgacuccaccaucaaacucaucgcaauguuauacaccccacuccgagcaaacaacgcuggcgacgacgucuucacggucuccugccgcguccuaacacgacccagccccgacuucgacuucaucuuccucgucccaccuaccgucgaaucucgcaccaaaccuuucaccguacccauccuaacagucgaagaaaugaccaauucccgauuccccaucccccucgaaaaacuauucaccgggcccuccagcgccuucgucguccaaccccaaaacggacgcugcacaacagacgguguccuccucggcaccacgcaauuaagcccuguaaacaucugcaccuuucggggagacgucacucacaucgcaggcucacgcaacuacacaaugaaccuagccucccucaacuggaacaacuacgaccccaccgaagaaauacccgcaccccuuggcacacccgacuucgucggcaaaauccaaggaguccucacacaaaccaccaaaggcgacggcaguacccgcggccacaaagccaccgucuacaccggcagcgccgacuucaccccuaaacucggcucgguccaauucgguacagacaccgaaaacgacuucgaaauacaccaaaacacccgcuuuacccccgucggcguuauccaagacgguuccacaacccaucgaaaugaaccccaacaauggguccuccccucauacucaggacgcuccguccacaacguccaccucgcccccgcaguugcccccaacuuccccggcgaacaacuucuauucuucagaagcacaaugcccggcugcuccggauacccaaauauggaccucgacugccuauuaccccaagaauggguccaacacuucuaccaagaggcugcaccagcccaaagcgacguagcacuucuccgauucgucaacccagacaccggccgaguccucuucgaaugcaaacuacacaaauccggcuacgugaccguagcacacaccggacaacaugaccucgucaucccacccaauggcuacuuccgauuugacuccuggguaaaccaauucuacacccucgcccccaugggcaauggaaccggacgccgccguuaa

SEQ ID NO: 37985 - RNA, 1617 nt, Artificial Sequence
  derived and/or modified sequence opt11 from VP1__Norovirus_and/or_Norovirus-like__KF060122
augaaaauggcauccuccgacgccaauccauccgacggauccgccgccaaccuaguccccgaagucaacaacgaagucauggcccuggaaccggucguaggcgccgccaucgcagcccccguggccggucaacaaaacgucaucgacccauggauacgaaacaacuucguucaagcaccaggcggcgaguucaccgucucuccccgcaacgcucccggcgaaauccuaugguccgcaccccucggccccgaccuuaaccccuaccucucccaccucgcccgaauguacaacggcuaugccggaggauucgaaguccaagucauccuagccggaaaugccuucaccgccggcaagaucaucuucgccgcugucccaccaaacuuccccaccgaaggccucucccccucacaagucaccauguucccucacaucaucgucgacguucgucaacucgaacccguccuuaucccccuacccgacguacgcaacaacuucuaccacuacaaccaauccaacgaucccaccaucaaacucaucgcaaugcucuacacaccacuucgcgccaacaacgccggcgacgacgucuucaccguuuccugccgaguccuaacccgaccaucccccgacuucgacuuuauauuccuuguucccccaaccgucgaaagccgcaccaaacccuucucaguccccguccuaacagucgaagaaaugacaaacucacgauuucccgucccucucgaaaaacucuucaccggcccauccuccgccuucgucguccaaccccaaaacggccguugcaccacagacggaguccuacucggcaccacccaacuaucucccgucaacauaugcacauuccgcggugacguaacacacaucaccggcucacauaauuacaccaugaaccucgcaucccaaaacuggaacucauacgacccaaccgaagaaaucccagcgccccucggaacacccgacuucguuggcaaaauacaaggcgucuuaacccaaacaacccgcgccaacggauccacccgaggccacaaagccaccgucuacacaggcuccgccgacuucgcccccaaacucggccgcguccaguucgccaccgacaccaacaacgacuucgacgcaaaucaaaacaccaaauucacucccguaggagucauccaagacggcgacacagcccaccggaacgaaccacaacaguggguccuacccagcuacucaggacgcaauucccauaacguccaucuugcacccgccguagcccccacauuucccggcgaacaacuccucuucuuccgcuccaccaugcccgguugcucaggauacccaaacauggaccuugacugucuccucccccaagaauggguccaauacuucuaucaagaagccgccccagcacaaucagacguagcacuacuccgcuucguaaacccugauaccggaagaguccuauucgaaugcaaacuccacaaauccggcuaugucaccguagcacacacaggccaacaugaccucguaauucccccaaauggcuacuuccgauucgacuccuggguaaaccaauucuacacucuagcccccaugggcaacggcacgggccgacgacgcuaa

SEQ ID NO: 37986 - RNA, 1617 nt, Artificial Sequence
  derived and/or modified sequence opt11 from VP1__Norovirus_and/or_Norovirus-like__KR904234
augaaaauggcuuccucagacgccaaccccucagacgguuccaccgccaaccucguccccgaagucaacaacgaaguaauggcacucgaacccguagucggugccgccaucgccgcccccgucgccggucagcaaaacgucauagaccccuggauucgcuccaauuuuguacaagcccccggaggagaguucacugucuccccucgaaacgcuccgggagaaauccuauggucagcaccacuaggcccagaucucaaccccuacuuaucccaccuagcaagaauguacaacggcuacgccggcggcuucgaaguccaagugauccucgccggcaacgcauucacggcaggaaaaauaaucuucgcagccgugcccccaaacuuccccacugaaggccucucucccucccaagucacuauguucccacacaucauaguagacguacgacaacucgaaccaguccuaauaccccuccccgacguacgcaacaacuucuaccacuacaaccaaagcaacgacccuaccauaaaacucaucgccaugcuauacacaccccuacgcgcaaacuccgccggagacgacguguucaccguuucaugccgcguccuaacacgaccaucccccgacuucgacuuuaucuuccucguacccccgaccgucgaaucacgcaccaaaccauucuccguacccauccuaaccgucgaagaaaugaccaacucucgauuccccaucccccucgaaaaacuauucacaggcccauccuccgcauucgucguccaaccacaaaacggucgaugcacaaccgacggcguacugcucggcaccacccaacucucaccugucaacaucugcucauuccgcggggacgugacucacaucgcugguucccgcaacuacaccaugaaccucgcaagccagaacuggaacuccuacgaccccaccgaagaaauaccagcaccccuaggaacccccgacuucguagguaaaauccaaggaguucuaacccaaaccacccgaaccgacggauccacccgaggacacagagccacagucuacaccggcagcgccgacuucucaccuaaacucggccgcguccaauucgccaccgacaccgauaacgacuucgucgccaaccaaaacacaaaauucacacccguaggcgucauccaagacggcgacacagcccaccgcaacgaaccacaacaauggguauuaccuuccuacucaggccgcaauauccacaacguccaccuagcccccgccgucgccccaaccuuccccggcgaacaacuccucuuuuuccgcuccaccaugcccggaugcuccggauacccuaacauggaccucgacugccuccucccccaagaauggguccagcacuucuaccaagaagcggcccccgcacaaagcgacgucgcccuccuacgcuucgucaaccccgauaccggacgcguccucuucgaaugcaaacuccacaaguccggauauguaaccguagcccacaccggacaacacgaccucguaauaccucccaacggauacuuccgcuucgacucuugggucaaccaauucuacacccucgcucccauggggaacggcaccggccgcaggcgauaa

SEQ ID NO: 37987 - RNA, 1617 nt, Artificial Sequence
  derived and/or modified sequence opt11 from VP1__Norovirus_and/or_Norovirus-like__KR131769
augaaaauggcauccaacgaugcuaacccauccgacggaucaaccgccaaccuagucccagaaguuaacaacgaaguaauggcucucgaaccaguagucggagccgcuauagccgccccugucgccggacaacaaaacguaaucgaccccuggauacgaaacaacuucguccaggcccccggcggcgaguucacagucuccccacgcaacgcccccggcgaaauucucugguccgcaccccucggcccagacuuaaaccccuaccucucucaccucgcccgaauguacaacggauacgccggaggcuucgaaguucaagucauccucgcaggaaacgcauuuaccgcaggaaaaauaauuuucgcagccguaccacccaacuuccccacagaaggccuaucccccucacaaguuaccauguucccccacaucaucguagacguccgacagcucgaaccuguacucauuccccuucccgacgucagaaacaacuucuaccacuacaaucaaucaaacgacccaacuaucaaacucaucgcaaugcucuacacaccccuccgcgccaacaacgccggcgaugacguguucacaguuucaugccggguccuuacacgcccgucuccagacuucgacuucauauuccucguaccucccaccgucgaaucccgaacaaaacccuucacaguacccauauuaacagucgaagaaaugacgaacucgcgcuuccccauaccccuagaacgacucuacacaggaccaagcuccgccauagucguacaaccacaaaacggacgcuguaccaccgacggaguacuccuuggcaccacacagcuaucagccgucaacaucugcacauuccgcggcgacgucacccacauugcaggcucccgcaacuacacaaugaaccuagccucccaaaacuggaauaacuacgaccccaccgaagaaauacccgcaccccucggcacacccgacuucgucggcaaaauacaaggcaugcuuacccaaaccacccgcuccgacggcucgacccgaggacacaaagccaccguccuaaccgguucagccgacuucgccccaaaacuaggacgcguccaauucgccacagacaccgacaacgacuucgaaucuggacaaaacaccaaauucacccccguaggaguaauccaagacgguuccaccacacaccgcaaugaaccccaacaauggguccuccccaacuacuccggccgaacaggccacaacguccaccucgcuccugcaguagcccccaccuaccccggcgaacaacuccuauucuuccgcucuacaaugcccggaugcuccggguaccccaacauggaccucgacugucuccuuccccaagaauggguacaacacuucuaccaagaagcagcccccgcacaauccgacgucgcccuucugcgcuucguaaacccagacacaggccgaguccucuucgaauguaaacuccacaaauccggcuacgucacagucgcacacaccggccaacacgaccuagucaucccuccaaacggauauuuccgauucgacuccugggucaaccaauucuacacccuagcgcccauggguaacggcaccggccgccgccgcuga

SEQ ID NO: 37988 - RNA, 1617 nt, Artificial Sequence
  derived and/or modified sequence opt11 from VP1__Norovirus_and/or_Norovirus-like__KR131764
augaaaauggcaucaaacgacgccaacccuuccgacggcucuaccgcaaaccuaguacccgaagucaacaacgaagucauggcacuagaacccguggucggugccgcaaucgcugcccccguugcaggacaacaaaacguaauugaccccuggaucagaaacaacuucguccaagcaccuggcggcgaauuuaccgucagcccccgcaacgccccaggcgaaauacuaugguccgcaccccucggaccagaccucaaccccuaccuuucccaccucgcccgcauguacaacggcuacgccggaggauucgaaguacaagucauccucgccggaaacgcauucaccgccgguaaaaucaucuucgccgccgucccgcccaacuuccccaccgaaggccucucucccucccaaguuaccauguucccccacauaaucgucgacguacgacaacuagaacccguccuaaucccccucccagacguccgaaacaacuucuaccacuauaaccaauccaacgacccaacuauaaaacucauagccaugcucuacacaccccuaagagcaaacaacgccggcgacgacgucuucaccgucuccugccguguccucacccgcccuucuccagacuucgacuucaucuuccucgucccucccacagucgaaucccgcaccaaacccuucacuguccccauccucaccgucgaagaaaugacaaacucacgcuuucccauaccccucgaacgccucuacaccggucccucuagcgccuucguaguucaaccccaaaacggccgcugcaccacagacggugucuuacucggaaccacccaacucuccgcggucaacauauguaccuuucgcggcgacgucacacacauagcaucaucucgcaauuacaccaugaaccuagcaagccaaaacuggaacaacuaugacccaaccgaagaaauacccgcaccccuaggaaccccagacuucguaggaaaaauccaaggaaugcucacccaaacaaccaaauccgacggcuccacccgaggccacaaagccacuguccucacaggcucagccgacuucgccccaaaacuaggucgcguacaauucgccaccgacaccgacaacgacuucgaauccggacaaaacacaaaguucacccccgucggcguuauccaagauggcuccaccacacaccgaaacgaaccccaacaauggguacuccccaacuacuccggcagaacgggacacaacguccaccucgcucccgccgucgccccaaccuauccaggcgaacaacuccuuuucuuccguucaaccaugccugguugcucuggauacccaaacauggaccucgacugccugcucccccaagaauggguccaacacuucuaccaagaagccgcucccgcccaaucagacguagcccuacuacgcuucgucaaccccgauaccggccgcguccucuucgaaugcaaauuacauaaauccggauacgucacagucgcacacacuggccaacacgaccucgucaucccacccaacggguacuuccgauucgacuccugggucaaucaauucuacacacucgcccccaugggaaacgguaccggccgccgcagauaa

SEQ ID NO: 37989 - RNA, 1617 nt, Artificial Sequence
  derived and/or modified sequence opt11 from VP1__Norovirus_and/or_Norovirus-like__GU390901
augaaaauggcauccaacgacgcaacacccuccgacggguccacagcuaaccucgucccagaagucaacaacgaaguaauggcccuagaacccgucgucggcgccgccaucgccgcacccgucgccggucaacaaaaugucaucgauccauggaucagaaacaacuucguccaagcccccggaggagaguucacugucagcccacgaaacgcccccggcgaaauccuuuggucagcuccccuaggccccgacuuaaacccuuaccuuucacaccucgcccgaauguacaacggcuacgccggcgguuucgaaguccaaguaauccucgcaggcaacgccuucaccgccggcaaaaucaucuucgccgccguacccccaaacuuccccaccgaaggccucagcccaucccaagucaccauguucccccacaucauagucgacguacgacaacucgaaccaguccuaaucccacuccccgacguccgcaauaacuucuaccacuacaaucaaagcaaugacccuaccaucaaacucaucgccaugcucuacaccccacuacgagccaacaacgccggcgacgacguauucacaguauccugcagaguacucacccgacccucccccgacuuugacuucauauuucuagucccacccacuguugagucccgaacuaaacccuucuccguccccauacuaacagucgaagagaugaccaacucacgcuuccccauaccccuagaaaaacuuuucacuggcccaucauccgcauucgucguccaaccucaaaacggccgaugcacaaccgacggaguacuccucggaaccacccaacucuccccggucaacaucugcaccuuccgcggugacgucacacacauaacaggcuccagaaacuacacaaugaaccuugccacccaaaacuggaacucguacgaccccaccgaagaaauccccgcuccccuaggcacacccgacuucgucggaaaaauccaaggcguucuaacacagacaacccgcgcugacggaagcacccgcggccacaaagccaccguuuacaccggauccgccgacuucucacccaaacucggccgaguccaauucgccaccgacacagauaacgacuucgacgccaaccaaaacacaaaauucacucccguuggaguaauccaagacggcgacaccgcucauagaaacgaaccacaacaauggguccucccaucauauucaggccgaaacucccacaacguacacuuagcacccgccguagccccaaccuuccccggagaacaacuacuauucuuccgcucgaccaugcccggcugcuccggauaccccaacauggaccucgauugccuccuuccucaagaauggguacaauacuucuaccaagaagcagcgcccgcccaauccgacguagcccuacuacguuucgucaaucccgacaccggccgcguccucuucgaauguaaacuccacaaauccggauacgucaccgucgcccacaccggccaacacgaccucgugauacccccaaacggcuauuuccgcuucgacuccugggucaaccaauucuacacccucgcccccaugggcaacgguaccggccgucgccgguaa

SEQ ID NO: 37990 - RNA, 1617 nt, Artificial Sequence
  derived and/or modified sequence opt11 from VP1__Norovirus_and/or_Norovirus-like__EU078408
augaaaauggccucaaacgaugcaucccccucagacgguuccacagccaacuuaguacccgaaguaaacaacgaggucauggcccuugaacccguagucggugcugcuauagccgcacccgucgcuggccaacagaacgucaucgaccccuggauaagaaauaacuucguccaagcaccaggaggcgaguucaccgucucaccccgcaacgcacccggcgaaauccuaugguccgcuccccuaggaccagaccucaaccccuaccucucccaccucgccagaauguacaacggcuacgcaggaggcuucgaaguccaggucauccuagccggaaacgccuucaccgcaggcaaaauuauuuucgccgcagucccucccaacuuccccaccgaaggccuaucccccucccaagugaccauguucccccacauuaucgucgacguacgccaacuugaacccguucuuauuccccuacccgacguacgcaacaacuucuaccacuacaaccaguccaacgaucccaccaucaagcucauagccaugcuauacaccccauuaagagccaacaacgccggcgacgacgucuucacugucuccugccgcgugcuaacccgcccauccccagacuucgacuucaucuuccuaguaccacccaccgucgaaucacgaacccgacccuuuacaguccccauccucacagucgaagaaaugaccaauuccagauuccccauaccccuagaaaaacuauucaccggccccucaggagccuucguuguacagccccagaacggccgcuguaccaccgacggcguacuccucgguaccacccaacucucgccgguaaauaucugcaccuuccgcggagacgucacacacauagccggcacccaugacuacacaaugaaccuagcaagccaaaacuggaacaacuacgaccccacagaagaaaucccagcaccucuaggcacaccagacuucguaggcaaaauccaaggcguucucucccaaaccacccgaggcgacggcuccacccgcggccacaaagccaccgucucgaccggcuccgugcacuucaccccaaaacuaggcuccguccaauuuaccaccgacaccaacaacgaccucgaaacaggacaaaacaccaaauucacacccgucggcguaguccaagacggaaacucuacacaccaaaacgaaccccaacaauggguccuacccaacuacuccggccgcacaggccacaauguacaccuagcacccgccgucgccccaaccuuccccggagaacaacuccuauucuuccgcuccaccaugcccggcugcuccggcuacccaaacaugaaccucgacugccuacucccacaagaauggguccaacacuucuaccaagaagccgcccccgcccaauccgacgucgcacuccuucgcuuugucaaccccgauacaggccgcguccuauucgaaugcaaacuacacaaaagcggauacgucacaguagcccauaccggccaacacgaccucguaaucccgcccaacggcuacuucagauucgacuccuggguuaaccaauuuuacacccuugcacccaugggaaacggagcgggccgccgucguuaa

SEQ ID NO: 37991 - RNA, 1617 nt, Artificial Sequence
  derived and/or modified sequence opt11 from VP1__Norovirus_and/or_Norovirus-like__AB933676
augaaaauggccuccaacgacgccaaccccagcgacggcuccgccgcaaaccucguaccagagguaaacaacgaagucauggcacuagaacccguagucggagccgcaaucgcagcaccagucgccggacaacaaaacgucauagaccccuggauccgaaacaacuucguacaggccccaggcggcgaguucacaguuucaccccgcaacgcuccaggcgaaauacucugguccgcgccccucggccccgaccucaaccccuaccucucccaccuugccagaauguacaacggcuacgccggcggcuucgaaguacaaguuauccucgccggcaacgccuucaccgccgguaaaauaauauucgccgcugucccaccaaacuucccaacugaaggccucucccccucccaagucaccauguucccccacauaaucgucgacguccgacaacuugaacccguccucaucccccuaccagacguccgcaacaacuucuaccacuacaaccaauccaacgacucaacaaucaaacucaucgccaugcucuacaccccacuacgggcaaacaacgcaggcgacgacgucuucaccgucucaugcagaguccucacccgccccucccccgacuucgacuucaucuuucucgucccacccaccguagaaucccgcacaaaacccuucaccguccccauucuaaccgucgaagaaaugaccaacuccagauuccccauuccacuagaaaagcuauucaccggccccucguccgcauucgucguccaaccccaaaacggccgcugcacaacagacggcguccuccuaggcacaacccagcuaagccccguauccaucugcaccuuccguggcgacgucacccauaucgcagguucacgugacuacacaaugaaccucgcuucacucaacuggaacaacuacgaccccaccgaagaaauccccgcuccccuaggcacccccgacuucguagggaaaauccaaggagugcugacccaaaccacaaaaggcgacggcucaacccgcggccacaaagccaccguauauacaggaagcgcacccuucacccccaaacucgguucuguccaauucuccaccgacaccgaaaacgacuucgaaacccaccaaaauacaaaauucacacccgucggaguuauacaagacggauccaccgcccaccgcaacgaaccacaacaaugggucuuacccuccuacagcggucgcaacguccaaaacguacaccuagcccccgccguagcacccaccuuccccggggaacaacuacucuucuuuagaucaacuaugcccggaugcuccggauaccccaacauggaccucgacugccuacuuccacaagaguggguacaacacuucuaccaagaagccgcaccagcccaaucagauguagcccuccuacgauuuguaaacccggauacaggccgcguacucuucgaaugcaaacuacacaaaucaggcuacgucaccguagcacacaccggccaacacgaccuagucauucccccaaacggcuacuuccgauucgacagcugggucaaccaauucuacacacucgcccccaugggcaacggcacaggccgccgacgcuaa

SEQ ID NO: 37992 - RNA, 1617 nt, Artificial Sequence
  derived and/or modified sequence opt11 from VP1__Norovirus_and/or_Norovirus-like__KX354082
augaaaauggccuccaacgacgccaaccccuccgacggcucagcagccaaccucgucccagaagucaacaacgaaguaauggcucucgaaccuguagugggagccgcuaucgccgcaccagucgcaggccaacaaaacgucaucgaccccuggauacgcuccaacuucguccaagcccccggcggcgaauuuaccgucagcccccgcaacgcccccggcgaaauacucuggucugccccacucggccccgaccucaacccuuaccuaucacaccucgcccggauguauaacggcuaugcaggaggcuuugaaguucaagucauccucgccggcaacgccuucaccgccgguaaagucaucuucgcagccguuccaccaaauuucccaaccgaaggacucuccccaucccaagucaccauguucccacacaucaucgucgacguacgacaacucgaaccaguacucaucccccuuccagacguccgaaacaacuucuaucacuacaaccaauccaacgacuccaccaucaaacucauagccaugcuguauacuccucuccgcgccaacaacgccggcgaugacgucuucacagucucaugccgcguccucacuagacccucacccgacuucgauuucaucuuccucguacccccaacagucgaauccagaaccaagcccuucacuguaccaaucuuaaccguugaagaaaugaccaacucacgauuccccauaccccucgaaaaacuauucacaggaccuucauccgcauucgucguccaaccccagaauggccgcugcacaacggacggcguccuccucggcacuacucaacucucacccgucaacaucugcaccuuccgcggcgacguaacacacaucgcaggaucucgaaacuacacuaugaaccuagccagucuaaacuggaacaacuacgaccccaccgaagaaauacccgcaccccucggcacacccgacuucgucggcaaaauacaaggcguacucacccaaaccacaaaacgcgacggaagcacccgaggccacaaagccaccgucuauaccggcagcgccgacuuuacccccaaacucggcuccguccaguuugguaccgacacagaaaacgacuucgaaacccaccagaacacccgcuucacucccgucggcgugauccaagacggcuccaccacccaccgcaacgagccacagcaauggguccuaccgucauauuccggacgcaacguacacaacguccaccucgcccccgccgucgcccccaacuuccccggagaacaacuccucuucuuccgauccacgaugccuggcugcuccggcuacccaaacauggaccucgacugccuacuaccacaagaauggguccaacauuucuaccaagaagcagcacccgcccaguccgacgucgcacuacuccguuucgucaacccggacaccggccgcguauuguucgaaugcaaacuacacaaauccggcuacguaaccgucgcccacaccggccaacacgaccuggucauuccgccaaacgguuacuucagauucgauucaugggucaaccaauucuacacccuagcacccaugggcaacggaacaggacgccgccgcuaa

SEQ ID NO: 37993 - RNA, 1617 nt, Artificial Sequence
  derived and/or modified sequence opt11 from VP1__Norovirus_and/or_Norovirus-like__KJ407076
augaaaauggccucaaacgacgccucccccagcgacggcuccaccgccaacuuaguccccgaagucaacaaugaaguaauggcucuugaacccguggucggcgccgccauagcagcaccugucgcaggccaacaaaacgucaucgacccauggauccguaacaacuucguacaagcacccggcggcgaguucaccguuucaccacgcaacgcccccggagaaauccucuggucugcaccccuaggcccugaccuuaaucccuaucuaucucaccuagcucgcauguacaacggcuacgccgggggcuucgaaguccaaguuauacucgccggaaaugccuucaccgcagguaaaauaauauucgccgccgucccaccaaacuuccccaccgaaggccucucccccucccaagucaccauguucccccacauaauagucgacguucgucaacucgaaccaguccuaauaccucuccccgacguccguaacaacuucuaucacuacaaucaauccaacgacagcaccaucaaacuuauagccaugcucuauacaccccuccgcgcaaacaaugccggagacgacguauucaccgucucaugcaggguccucacccguccuuccccagacuucgacuucauauuccucguuccacccaccguagaaucgagaaccaaacccuucaccgucccuauccucacagucgaagaaauguccaacucacgcuucccuaucccacuugaaaaacucuauaccggccccuccagcgcauucgucguccaaccucaaaacggacgcugcaccaccgacggaguacuccucggcaccacccaacuaucagccguaaacauauguaccuuucgaggugacguaacccacauagccggcucccacgacuacaccaugaaccuagccucacaaaacuggaacaacuacgaccccaccgaagaaaucccagcaccccucggcaccccagacuucguaggcaaaauccaaggcaugcucacucaaaccacccgagaagacggcuccacccgcgcucauaaagccaccgucuccacaggaucaguccacuucacacccaaacuaggcuccguccaauacaccaccgacaccaacaacgacuuccaaacaggccaaaacacuaaauucacccccgucggagucauccaagauggcaacaaccaccaaaacgaaccccaacaauggguccuccccaacuacucaggccguaccggucacaacguacaccuugcccccgcagucgccccaaccuucccaggcgaacaacuacuauucuuccgcuccaccaugccagguugcuccggcuaccccaacaugaaccucgacugccuccucccacaagaauggguccaacacuucuaccaagaagcagccccagcccaauccgacgucgcccuccuccgcuucgucaacccagacaccggccgaguccucuucgaaugcaaacuacacaaauccggcuacgucaccguagcacacaccggaccacaugaccuaguuaucccacccaacgguuauuuccgcuucgauucaugggucaaccaauucuacacccucgcaccaaugggcaacggugccggccgccgacgcgucuaa

SEQ ID NO: 37994 - RNA, 1617 nt, Artificial Sequence
  derived and/or modified sequence opt11 from VP1__Norovirus_and/or_Norovirus-like__JX459636
augaaaauggccagcaacgacgccucccccucagacggcuccgccgccaaccucguacccgaaguaaacaacgagguaauggcccuagaaccagucguaggcgccgccauagccgccccagucgccggacaacaaaacgucaucgauccuuggauccgcaauaacuucguccaagccccaggaggcgaauuuacaguuucaccccguaacgccccaggcgagauacuuugguccgcuccccucggccccgaccucaacccauaccuaucccaccucgcccgaauguacaacggauacgccggcggauucgaaguccaagucauccucgccggcaacgccuucacagccggaaaaauuaucuuugccgccgucccacccaacuucccaacagaaggacucucacccucucaagucaccauguucccccacaucaucgucgacguccgccaacucgaacccguccucauaccccuccccgacguacguaacaacuucuaccacuacaaccaaucaaacgacuccaccaucaaacuaaucgccaugcucuacacgccacuccgcgccaacaacgcaggcgaagacgucuuuaccgucaguugccgcguccucacccgacccagcccagacuucgacuucauauuccuagucccucccaccgucgaaagccgcacaaaacccuucaccgucccaauacucacggucgaagaaaugaccaacucccgcuuccccaucccucucgaaaagcuauucaccggcccauccuccgccuucgucguccaaccacagaacggacgcuguaccaccgauggaguccuccucggcaccacccaacucuccccugucaauaucugcaccuucagaggugacgucacacacauagcaggaucucgugacuacaccaugaaccucgccucacuuaacuggaacaacuacgauccaaccgaagaaauacccgcaccccucggcacuccagacuucgugggaaaaauacaaggcguccuaacccaaaccacaaaaggcgauggcuccacccgcggccauaaagccaccgucuacaccggcuccgcccccuucacacccaaacuuggauccguccaauuuucaacagacaccgaaaacgacuucgagacccaccaaaauaccaaauucaccccaguuggcgucauccaagacggcucaaccacccaccgcaacgaaccccagcaauggguucuccccucauacuccggucgaaauguacaaaacguacaccuagcacccgccguagccccaacauucccaggugaacaacuccuuuucuuccgcuccaccaugccaggcugcuccggcuaccccaacauggaccuagauugccuacucccacaagaauggguacaacacuucuaccaagaagccgcccccgcucaauccgacgucgcacuccuacgauucgucaacccagacacaggccgaguauuauucgagugcaaacuccacaaaucuggcuacgucaccgucgcccauaccggccaacacgaccucgucaucccucccaacggauacuuccguuucgacuccuggguaaaccaauucuacacccucgcacccaugggcaacggaaccggccgacgaagguaa

SEQ ID NO: 37995 - RNA, 1617 nt, Artificial Sequence
  derived and/or modified sequence opt11 from VP1__Norovirus_and/or_Norovirus-like__JX445161
augaaaauggccucuaacgacgccaccccauccgauggcuccacagccaaccuagugccagaagucaauaacgaagucauggcccucgaacccguaguaggcgcagcaaucgccgcaccagucgccggacaacaaaacguaaucgaccccuggauccgaaacaacuucguccaagcccccggcggagaguucaccguuucuccucgcaacgcccccggcgaaauucuauggucagccccuuuaggccccgaccucaaccccuaccugucccaccuagccagaauguacaacggcuacgccggagguuucgaaguccaagucauacuugccggcaacgcauucaccgccggcaaaaucauauucgcagccguucccccaaacuucccaaccgaaggucuuucaccaucccaggucaccauguucccccacauaaucguagacguccgccaacucgaaccaguccucaucccacuccccgauguccgaaacaauuucuaccacuacaaccaaucaaacgacccaacaauaaaauuaaucgccaugcuauacacuccccuucgcgcuaacaacgccggcgacgacguauucaccgucagcugccgcguccuaacccgacccucccccgacuucgacuucaucuuucuagucccacccacgguugaaucccgcaccaaacccuucuccguucccauucucaccguagaagaaaugacaaacucucgcuuccccauaccccuagaaaaacucuucaccggcccaucauccgccuucguaguccaaccccaaaacggcagaugcacuacagacggcguucuccucggaaccacccaacucucacccguaaauauaugcacauuccgcggcgacgucacacacaucacgggcucccgaaacuacaccaugaaccucgcuacacaaaacuggaacuccuacgaccccaccgaagaaauacccgcaccacucggcacccccgacuucguaggcaaaauacaaggcguccucacacaaaccacucgcgcagacggcuccacccguggccauaaagccacaguauacaccggauccgcugacuucgcacccaaacuaggccgcguccaauucgccaccgauaccgacaacgacuucgacgccaaccaaaacacaaaauucacacccgucggcguaauacaggacggugacaccgcccaccguaacgaaccacaacaauggguccuccccuccuacucaggccgcaacucccacaauguccaccucgccccugccguugccccaacuuuucccggcgaacaacucuuauucuuccgcucaacaaugcccggcugcuccggcuacccaaacauggaccucgacugccuacucccccaagaauggguccaauacuucuaucaagaagccgcuccagcccaauccgacgucgcacuccucagauucgucaaucccgauaccggccgcguacucuucgagugcaaacuacacaaaucaggcuacgucaccgucgcccacacaggccaacacgaccucgucauacccccaaacggcuacuuccgauucgacagcugggucaaccaguucuacacccucgcacccaugggaaacggcaccggccggagacguuaa

SEQ ID NO: 37996 - RNA, 1617 nt, Artificial Sequence
  derived and/or modified sequence opt11 from VP1__Norovirus_and/or_Norovirus-like__EU876888
augaaaauggcgucauccgacgcuucaccuagcgacggcuccgcagccaaccuagugcccgaaguaaacaacgaagucauggcacuugaaccaguagucggcgcugcaauagcugccccagucgccggccaacaaaauaucaucgaccccuggauacgaaacaacuucgugcaagcaccaggaggagaguucaccgucucaccacgcaacgcaccaggcgaaauacucuggucagccccacucggcccagaccucaacccauaccuaucccaccucucccgcauguacaacggcuacgccggcggauucgaaguccaagucauacucgccggcaacgccuucaccgcagguaaaguaauauucgccgccguaccaccuaacuucccaaccgaaggacucucacccucccaaguuaccauguucccccacauuauugucgacguccgacaacucgaacccguccucaucccccuacccgacguccguaacaacuucuaccauuauaaccaaaccaacgaccccaccaucaaacuaaucgccaugcuguacacaccacuucgcgccaacaaugccggugacgaugucuucacaguaagcugucgcguccucacccgacccagcccagacuucgacuucaucuuccuaguacccccaacagucgaaucaagaacuaaacccuucacaguaccgauccuuacagucgaagaaaugaccaacucucgcuucccgaucccccucgaacgacucuauaccggccccuccuccgccuucguaguccaaccccagaacggacgcugcaccaccgacggcguacuccucggcacgacccaacucuccgccgucaacaucugcaccuuccgcggcgacgucacacacauagccggauccagaaauuacaccaugaaccucgcaucacaaaacuggaacaacuacgaccccaccgaagaaaucccagccccucuaggcacccccgacuucguugggaagauccaagguaugcucacccagaccacccgcggugacggcuccacacgaggccacaaagcuaccguauacaccggcagcgccgacuucgcacccaaacucggccgcguccaauucgcaaccgacacagauaacgacuuugagucaaaccagaacaccaaauucacccccguaggcguaauccaagacggcaacaccacacaccgcaacgaaccccaacaauggguccuccccggauacuccggcagagacggacacaacguccaccucgcccccgccguagcacccacauacccaggcgaacagcuccuuuucuuccgaucaaccaugccaggcuguucuggcuacccgaauauggaccucgacugccuucuuccacaagaauggguacaacacuucuaccaagaagccgcccccgcccaaucugaaguagcccuccuccgcuucguuaacccugacaccggacgaguccucuucgaaugcaagcuccauaaaucaggcuacgucacagucgcucacacaggccaacacgaucuagucaucccacccaacggauacuuccgcuucgauucaugggucaaccaauucuacacacuagcucccaugggcaacggcgccggccgccgacgguaa

SEQ ID NO: 37997 - RNA, 1617 nt, Artificial Sequence
  derived and/or modified sequence opt11 from VP1__Norovirus_and/or_Norovirus-like__EU839584
augaaaauggccucaaaugacgcaacacccucagacggcucaacagccaacuuaguaccugaaguuaacaacgaaguaauggcucuugaacccguagucggcgccgcuaucgcugcccccgucgccggccaacaaaacgucaucgaccccuggauccgcaacaacuucguucaagcccccggcggagaguucaccgucucaccccgaaacgcccccggggaaauacucugguccgcuccacucggucccgaccuaaaccccuaccuaucucaccuagcccgcauguacaacggcuacgccggaggcuucgaaguacaagucauacucgcaggcaacgccuucaccgcaggaaaaaucauuuucgccgccguaccacccaacuuccccaccgaaggacucucccccucccaagucacaauguucccccacaucaucgucgacguccgacaacucgaacccguacucaucccccuccccgauguaagaaacaacuucuaccacuacaaccaauccaaugaccccaccaucaaacuaaucgccaugcuauacacaccccuccgcgccaacaaugccggagacgacgucuucaccgucuccugccgaguccuaacacgcccaucgccugacuucgacuucaucuuccuagucccuccuaccgucgaaucucgcaccaagcccuucuccguccccauucucaccgucgaagaaaugacaaacucccgcuucccaaucccucuagaaaaacuguucaccggacccucauccgccuucgucguccaaccccagaauggccgaugcaccacagacggcguacuacucggcacaacccaacucagccccguaaacauaugcaccuuccgaggcgacguaacacacauagccggcacccaaaacuacacgaugaauuuagcaucacaaaacuggaacaacuacgacccaacagaagaaauacccgccccgcuaggcacccccgacuucgucggcaaaauccaaggcguccucacccaaaccaccaaacgcgacggcuccacccgcggacacaaagccacugucucaaccggcuccguccacuucacccccaaacucggaucaguccaauuuucuacugacaccucaaacgacuucgaaaucggccaaaacacccguuucacaccagucggcguaguacaggacggauccaccacccaccaaaacgaaccacaacaauggguucuccccaacuacagcggcagagacggccacaacguccaccuagccccggcagucgcaccaaccuuccccggggaacaacuccucuucuuccgcucaacaaugcccggcuguucaggauacccaaacaugaaccucgacugccuacucccccaagaauggguacaacacuucuaucaggaaagcgcccccgcccaauccgacguagcccuccuccgauucgucaacccugacacaggaagggcccuguucgaaugcaagcuacacaaaucgggauauguaaccguagcacauaccggucaacacgaccuugucaucccaccuaacggguacuuccgcuucgacuccugggucaaccaguucuauacccuagccccgaugggcaacggagccggccgccgccgcuaa

SEQ ID NO: 37998 - RNA, 1617 nt, Artificial Sequence
  derived and/or modified sequence opt11 from VP1__Norovirus_and/or_Norovirus-like__KX354090
augaaaauggccuccaacgaugccaaccccuccgacggcucugcugccaaccuuguccccgaaguaaacaacgaagucauggcccuagaacccguagucggggccgccaucgccgcccccgucgccggccaacaaaacguaauagacccauggauacgaucuaacuucguccaagcccccggcggagaguucacagugucccccagaaacgcaccuggugaaauacucuggucagcaccacuaggccccgaccucaaucccuaccucucacaccucgcucgcauguacaauggcuaugccggcggcuucgaaguccaaguaauccuugccggcaacgccuucaccgccggcaaaaucauuuucgccgccguucccccaaacuucccaacugaaggacucuccccaucacaagucaccauguucccacacaucaucgucgacguccgccaacuagaacccguacucaucccccuccccgacgucagaaacaacuucuaccacuacaaccaauccaaugauuccaccaucaaacuaaucgccaugcuguacacaccacuacgagccaacaaugccggcgacgacguuuuuacaguuuccugccgcgucuugacacgccccucacccgacuuugacuucauauuccuaguacccccaaccgucgaaucccgcacaaaaccauucacuguccccauccucaccguagaagaaaugacaaacucacgcuuccccauaccccucgaaaaacucuuuacaggacccuccucagcuuucgucguucaaccccaaaacggccguugcaccaccgacggcguccuucucggaaccacccaauuauccccagucaacaucuguaccuuccgaggcgacguaacccacauagcaggcucccgcaacuauacuaugaaccucgccucccuaaacuggaacaacuacgaccccaccgaagaaaucccugcaccacucggcacucccgacuucguuggaaaaauacaaggcguccucacccaaaccaccaaaggcgaugguucaacccgaggccacaaagcuacagucuacacaggcuccgccgacuucaccccaaaacucggauccguccaauucggcacugacacugaaaacgacuucgaaacccaccaaaacacccgcuucacccccgugggcgucauacaagacggcucgacaacccaccgaaacgaaccccaacaauggguacuacccucguacuccggccgcaacguacacaacguccaccucgcccccgccguagccccaaacuuccccggcgaacaacuccuguucuuccgcuccacuaugcccggcugcuccggcuaccccaauauggaccucgacugccuacuuccccaagaauggguccaacacuucuaccaagaagccgccccagcacaauccgacgucgcacuucuccguuuuguaaaccccgacaccggccgcguccucuucgaauguaaacuccacaaauccggauacguaacagucgcacacaccggucaacacgaccucguaaucccacccaacggcuacuuccgcuucgacuccugggucaaccaauuuuacacccuagcacccaugggcaacggcaccggccgacgccgauaa

SEQ ID NO: 37999 - RNA, 1617 nt, Artificial Sequence
  derived and/or modified sequence opt11 from VP1__Norovirus_and/or_Norovirus-like__KF060124
augaaaauggccucauccgacgccaaccccuccgauggaucagcagccaaccucgucccugaagucaacaacgaggucauggcccucgaacccguagucggagcagccaucgcagcccccguugcaggacaacaaaaugucaucgaccccuggaucagaaacaauuucguccaagcccccggcggagaguucaccgucaguccccgcaacgccccuggcgaaauccucugguccgccccacucggacccgaccuaaaucccuaccuaucccaccuagcccgaauguacaacggauacgcaggcggcuucgaaguccaaguaauccucgcaggcaaugccuucacagccggaaagaucaucuucgccgcaguaccuccaaacuucccuaccgaaggccuuucccccucacaaguaacaauguuuccccacaucaucgucgacguccgccaacuagaaccaguccuaaucccccuacccgacguacgaaacaacuuuuaccauuacaaccaaucaaacgacccaaccaucaaacucauagcuaugcuguauacaccccuccgagcaaacaacgcuggcgacgacgucuuuaccgucuccugcaggguccuuacccgcccaagccccgacuucgacuucauauuccuugucccaccuacaguggaaucccgaacaaaaccuuucucuguaccaguccucacagucgaagaaaugaccaacucacgcuucccaguuccacuagaaaaacucuucacuggccccuccuccgccuucguaguccaaccccaaaacggccgaugcacaacagauggcguccuccucggcaccacacaacucucacccguuaacaucugcacauuucgcggagacgucacacacaucaccggaucgcacaacuauaccaugaaccuagcaucccaaaacuggaacuccuacgaucccacagaagaaauccccgcaccacuaggcacccccgacuucgucggaaaaauccaaggcguccuuacucaaacaacucgcgccgacggcuccacccgcggccacaaagcaaccgucuacacaggcucggcagacuuugcccccaagcucggccgaguucaauucgcaaccgacaccaacaacgacuucgacgccaaccaaaauaccaaauucaccccagucggcgucauacaagacggcgacaccgcccaccgcaacgaaccccagcaauggguccuccccuccuacuccggaagaaacucccacaacgugcacuuagcccccgccguagccccgaccuuccccggcgaacaacuacuauucuuccgaagcacaaugccaggauguuccggcuacccaaacauggacuuagacugccuguuaccccaagaauggguccaauacuucuaccaagaagccgcccccgcucaaagcgacgucgcacuccucagauucgucaacccagacacaggacgaguacuauucgaauguaaacuccacaaaucaggcuacgucaccguagcccacaccggacaacacgaucuagucauacccccaaauggcuauuuccgauucgacuccugggucaaccaauucuacacccuagcccccaugggaaacggaaccggacgacgacgcuag

SEQ ID NO: 38000 - RNA, 1617 nt, Artificial Sequence
  derived and/or modified sequence opt11 from VP1__Norovirus_and/or_Norovirus-like__JX439826
augaaaauggccuccuccgacgccaaccccuccgauggauccgcugccaaccuagucccggaagucaacaaugaagucauggcacuugaaccagucgucggugccgccaucgccgcgcccguagccggucaacaaaaugucaucgacccuuggauccgcaacaauuucguacaagcccccggaggugaauuuaccgucuccccacgcaacgcgcccggcgaaauacuaugguccgcuccccucggccccgaccuaaaccccuaucuaucccaucuagcccgaauguacaacggcuacgccggcggcuuugaaguccaagucauacuggccggaaaugccuucaccgccggcaaaaucauuuucgccgccgucccucccaauuuccccacagaaggacucuccccaucccaaguaaccauguucccacacaucauagucgacguccgacaacucgaacccguacuaauaccacuuccugacguccgcaacaacuucuaccacuacaaccaaagcaaugaccccaccaucaaacucauugcuaugcuauacaccccacuucgcgccaacaacgccggugacgacguuuucaccguauccugccgcguccucacacgucccucccccgauuucgacuucaucuuccugguacccccaacaguugaaucccguacuaaaccauucuccgucccaauucucaccgucgaagagaugaccaacucacgcuucccaauaccacuugaaaaguuauucacaggccccuccuccgcguucgugguacagccucaaaacggccgcugcacuaccgacggaguccuacuuggaacaacccaacuaucccccguuaacauaugcaccuuccgcggcgacgucacacacaucaccggaucccgcaacuacacgaugaaccucgccacucaaaacuggaacucauacgaccccacugaagaaauccccgcuccacucggcacaccagacuucgucggcaaaauacaaggaguccucacccaaaccaccagagcagacggcucaacccgcggccacaaagcuaccgucuacaccggaagcgcagauuucgcccccaagcucggacgaguccaauucgccacagauacugauaacgacuucgacgcuaaccaaaacacaaaauucacacccgucggagucauacaagacggugacaccgcacaccgcaacgaaccccaacaauggguccuaccauccuacuccggcagaaacucccacaacguucaccuagccccagccguagcccccaccuuccccggagaacaacuccuauucuuccgcucaaccaugccaggcugcuccggcuaccccaauauggaccucgacugccuccucccacaagaauggguccaguacuucuaccaagaagccgcacccgcccaaucugacgucgcccuucuccgcuucguaaaccccgacaccggccgcguccucuucgaaugcaaacuacacaaauccggauacgucaccgucgcccauaccggacaacacgaccuaguaauacccccaaacggauacuuccgcuucgacuccuggguaaaccaauucuacacccuggcacccauggguaacggcacaggccgcagacgcuga

SEQ ID NO: 38001 - RNA, 1617 nt, Artificial Sequence
  derived and/or modified sequence opt11 from VP1__Norovirus_and/or_Norovirus-like__JX439815
augaaaauggcaucaaacgacgcaaaccccuccgacggcucaacagcaaaccuuguccccgaagucaacaacgaaguaauggcccucgaacccguagucggcgcagccaucgcugcccccguagcuggccaacaaaacguaauagaccccuggauccgcaacaacuucguccaagcccccggcggugaauuuacaguguccccucgaaaugccccuggagaaauacuguggucagcaccccucggccccgaccucaauccuuaccucucacaccucgcacgcauguacaacgguuacgcuggcgguuucgaaguacaagucauccuagccgguaacgccuucaccgccggcaaaauaaucuucgcugcaguaccacccaacuuccccaccgaaggacuuucacccucacaagucacuauguucccccacauuauaguagacgugcgccaacuagaacccguccucaucccccuccccgacguacguaacaacuucuaccacuacaaccaaucaaacgaccccaccaucaaacucaucgcaaugcuauauacaccacuccgagccaacaacgccggcgacgacgucuucacaguauccugccggguccucacccgccccucacccgacuucgacuucaucuuccuaguaccacccaccgucgaaucccgcaccaaacccuuuuccguucccauccucacaguggaagaaaugacaaacucccgauucccaauaccacucgaaaaacucuucacuggaccauccuccgccuucguaguacaaccacaaaacggacgcugcaccaccgacggcguacuccucggaacuacccaauugagcccagucaacaucuguacauuccgcggcgauguaacucacaucaccggcucuagaaacuacaccaugaaccuugccacacaaaacuggaacuccuacgaccccaccgaagaaaucccagcuccccucggcacccccgacuucgucggaaaaauccaaggcguccucacucagaccacccgcgccgacggcucuacucgcggccacaaagccaccguauacacaggauccgccgacuucgcaccaaaacuaggcagaguacaauucgccaccgacacagacaacgauuucgacgccaaccaaaacaccaaauuuacgcccgucgggguaauacaagacggcgacacagcccaccgcaacgaaccccaacaauggguccuccccuccuacuccggcagaaacucccauaacguccaccucgcccccgccguagcccccaccuucccaggcgaacaacucuuguucuuccgcucaaccaugccaggaugcucggguuaccccaacauggaccucgacugccuacucccccaagaauggguccaauacuuuuaccaagaagccgcccccgcacaauccgacguagcccuccuucgauucgucaaccccgacaccggacgaguacuguucgaaugcaaacuccacaagucuggauacgucaccgucgcccacacgggacaacaugaccuagucaucccucccaacggcuacuuccgcuucgacagcuggguaaaccaauucuacacccuggcccccaugggcaacgguaccggacggagacgauga

SEQ ID NO: 38002 - RNA, 1617 nt, Artificial Sequence
  derived and/or modified sequence opt11 from VP1__Norovirus_and/or_Norovirus-like__KC576912
augaaaauggccucaaacgaugccaaccccuccgacggcucagccgcuaaucuuguacccgaagucaacaacgagguaauggcccucgaaccuguagucggcgcugcuaucgcagcacccgucgccggccaacaaaacgucauugaccccuggaucagaucuaacuuuguucaagcacccggcggcgaguucaccguaucaccccguaacgcaccaggagaaauccuauggucagccccacucggcccagaccuaaacccguaucuaucccaccucgcccgaauguacaaugguuacgccggcggauucgaaguccaaaugauccuagcaggcaacgccuucaccgccggaaaaaucauauucgcagccgucccacccaacuuucccacugaaggccucagccccucccaagucacaauguuuccccacaucauagucgacguccgccaacuagaacccguacuaaucccacucccagacguccgcaacaacuucuaccacuauaaccaaagcaacgacccaacaaucaaacucaucgccaugcucuacacaccacuacgagccaacaacgccggcgacgacgucuucacugugagcugccgcguccucacccgacccagcccagacuucgacuucaucuuucuaguaccacccaccguagaaucacguacaaaacccuucacaguccccguccucaccgucgaagagaugaccaauucaagauuccccaucccccuagaaaaacucuucaccggccccuccucugccuucgucguccaaccccaaaauggcagauguaccaccgacggcguccuccucggcaccacccaacuaucccccguuaauaucugcacauuuaggggagacgucacacacaucgccggcucccgaaacuacaccaugaaucuagccucccucaacuggaauaacuacgacccaaccgaagaaauccccgcaccccuaggcaccccagacuucgucggcaagauacaaggaguccucacccaaaccacaaaaggcgacggcuccacccgcggccacaaagccaccguuuacaccggcuccgccgacuucaccccaaaacucggcucagugcaguuuggcacagauaccgacaaugacuucgaaacacaucaaaacacccgauucacccccguaggcguaauccaagacggugccacuacccaccgcaacgaaccacaacaaugggugcuaccauccuacucaggccgaaacguccauaacguacaccuggcccccgccguagccccuaacuuccccggcgagcaacuccucuucuucagaucuaccaugcccggcugcuccggcuaccccaacauggaccucgacugccuucucccacaagaaugggugcaacacuucuaccaagaagccgcccccgcccaaucugacgucgcacuccuccgcuucgucaacccugacacaggccgaguacucuucgaaugcaaacuacauaaaucaggcuacguaacagucgcacacacaggacaacacgaucuuguaaucccacccaacggcuacuucagauucgacagcugggucaaccaauucuacacccucgcccccauggguaacggcaccggccgaagacgcuaa

SEQ ID NO: 38003 - RNA, 1617 nt, Artificial Sequence
  derived and/or modified sequence opt11 from VP1__Norovirus_and/or_Norovirus-like__GQ845368
augaaaauggcaucauccgacgcaagccccuccgacggcucagccgcaaaccuaguccccgaaguaaacaacgaagucauggcacucgagcccguagucggagccgccaucgccgccccagucgccggucaacaaaacauaaucgaucccuggauacgcaacaacuucguacaagcccccggcggcgaguucacagucucaccccgcaacgcccccggcgaaauacuaugguccgcaccccuuggcccagaccuuaaucccuaccucucccaccucucccggauguacaacggcuacgccggaggcuucgaaguacaaguaauacucgcgggcaacgccuuuaccgccgguaaaguaaucuucgcagccguuccacccaacuuccccacugaaggccuaucccccucccaagucacaauguucccccacaucaucgucgacguacgacaacuugaacccguccucaucccccuccccgauguccgaaacaacuucuaccacuacaaccaaaccaacgacccaaccaucaagcuaaucgcaauguuauauacaccccuccgcgcuaacaacgccggcgacgacgucuucaccgucucaugccgaguccucacccgccccuccccugacuucgauuucaucuuccuagucccacccaccgucgaaucgcguaccaaacccuucacaguacccauccucacaguagaagaaaugaccaacucccgcuucccaaucccccucgaacgcuuauacaccggacccuccuccgccuucguaguucaaccccaaaacggcagaugcaccacagacggcguccuacuaggcacaacacaacuuuccgccgucaacaucugcaccuuccgcggugacgucacccacaucacgggauccagaaacuacacuaugaaccuagcuucccaaaacuggaacaacuacgacccaacagaagaaaucccagcaccccucggaacccccgacuucgucggcaaaauacaaggcaugcugacucaaacuacaagaggcgacggcuccacucgcggccacaaagccacuguguacacuggcucugcugacuucgcccccaaacucggacgcguccaauucgccaccgacaccgauaacgacuucgaaucuaaccaaaacaccaaauucacccccgucggagucauccaagacgggaacaccacacaccaaaaugaaccucaacaauggguccuccccggcuacuccggccgagacggccacaacguacaccucgcccccgccguugcccccaccuaccccggugaacaacuucucuucuuucgcuccacaaugccuggaugcucaggcuaucccaacaugaaccucgacugccuacucccacaagaauggguccaacacuuuuaccaagaagccgcccccgcacaauccgaagucgccuuauuacguuucguuaaccccgacaccggccguguauuauucgaaugcaaacuacacaaauccggcuacguaaccguagcccacacaggccaacacgacuuagucauaccucccaacggcuacuuccguuucgacuccugggucaaucaauucuacacacucgcccccauggguaacggagccggccgccgccguuaa

SEQ ID NO: 38004 - RNA, 1617 nt, Artificial Sequence
  derived and/or modified sequence opt11 from VP1__Norovirus_and/or_Norovirus-like__AB541249
augaaaauggccucgaaugacgccaacccuuccgacggauccgccgccaaccuuguacccgaggucaacaacgaagucauggcccucgaaccaguaguuggagccgccaucgccgcccccgucgccggccaaaccaacgucaucgacccauggauccgaaacaacuucguccaagcccccggcggcgaauuuacagucagcccccgaaacgcacccggcgaaauccuaugguccgcaccacucggacccgaccucaaccccuaccucucccaccucgcccgcauguacaacggauacgccgguggauuugaaguacaagucauacucgcugguaacgcguucaccgcaggaaaaaucaucuucgccgcagucccacccaacuuccccaccgaaggccuaucccccucucaaguuaccauguucccccacaucaucgucgacguccgccaacucgagcccguccucaucccccuaccagacgucagaaacaacuucuaccacuacaaccaauccaacgacucaaccauaaaacuaaucgcuaugcucuacacaccccuucgcgccaacaacgccggagaagacgucuucaccguaagcugucgcguccuaacccgcccaucccccgacuuugacuucauuuuccuagucccucccaccgucgaaagccguaccaaacccuucaccgucccaauccuaacagucgaagaaaugaccaacucccgauuccccaucccucucgaaaaacuauucaccggcccauccggggccuucgucguccagccacaaaacggccgaugcacaacugacggcguacuccucggaacaacgcaacucucacccgucaacaucugcacauuucgcggagauguaacccacauagccggaucacgcgacuacacaaugaaucucgccucccucaacuggaacaacuacgaucccaccgaagaaauaccagcuccccucggcaccccagacuucgucggcaaaauacaaggcguccuuacccaaaccaccaagggugacggcuccacucgaggacacaaagccacagucuacaccggcuccgccccguucacccccaaacucggcuccguacaauucucaaccgacacagaaaacgacuucgaagcccaccaaaacaccaaguucacccccgucggcguaauacaagacgguuccacaacacaccgaaacgaaccgcaacaauggguccuacccuccuacucaggccgaaacguacaaaacguacaccuugccccagccgucgccccaacauuccccggcgaacaacuccuuuucuuccgcuccaccaugccaggcugcuccggcuaccccaacauggacuuggacugccuccucccccaagaauggguccaacacuucuaccaagaggccgccccagcccaaucagacgucgcccuacuccgauucgugaaucccgacaccggucguguucucuucgaaugcaaacuccacaaaucuggcuacguaaccguagcccacaccggccaacacgaccuggucauacccccaaacggcuacuuccgcuucgauagcugggucaaccaauucuacacccucgccccgaugggcaauggaaccggccgucgccguuag

SEQ ID NO: 38005 - RNA, 1617 nt, Artificial Sequence
  derived and/or modified sequence opt11 from VP1__Norovirus_and/or_Norovirus-like__EU078412
augaaaauggcaucaaacgacgcaagccccucagacggcucaaccgccaaccuaguucccgaaguuaacaacgaagucauggccuuagaacccguagucggugccgcaauagccgcccccgucgcaggccaacaaaacgucaucgaucccuggauccgaagcaacuucguacaagcucccggcggagaauuuacaguauccccacgcaacgccccgggcgaaaucuuaugguccgccccgcuuggccccgaccucaacccauaccuaagccaccucgccagaauguacaacggauacgcaggcggcuucgaaguacaaguuauccucgccggcaacgccuuuacagcaggcaaaaucaucuucgccgcagucccucccaacuucccaaccgaaggccugucccccucacaagucaccauguucccccacaucaucguugacguccgccaacucgaacccguccuaaucccacuccccgacguacgcaacaauuucuaucauuacaaccaacucaacgaccccaccaucaaacucaucgcaaugcucuacacaccacuucgcgccaauaacgccggagacgacguauucaccguuagcugccgaguacucacacgccccagccccgauuucgacuucaucuuccuaguacccccaaccgucgaauccagaaccaaacccuucaccguccccauccucacaguagaagaaaugaccaacucacgcuuccccauaccccucgaaaagcucuuuaccggucccuccggagccuucgucguccaaccccaaaacggucgcugcacuaccgacggaguccuccuaggcaccacccaacucucaccugucaauaucugcaccuuccgaggagacguaacucacaucgccggcacucaugacuacaccaugaaccuagccucacaaaacuggaacaacuacgaccccacagaagagauaccugccccacucgggaccccagacuucgucggcaaaauacaaggcguccuaacacaaaccacacgcggagacggauccacccgaggacacaaagccaccgucuccaccggcuccguacacuucacacccaaacucggcucgguacaguucacaaccgacaccaacaacgaucuugaaaccggacaaaacacccgcuucacccccgucggcguaguccaggacggcaacuccacccaccaaaacgaaccacagcaauggguccuccccaacuacuccggccgugccggccacaacguacacuuagcucccgccgucgccccaaccuucccaggagaacaacuacuuuucuuccgaucaaccaugcccgguugcucuggauaccccaacaugaaccucgacugccuauugccccaagaaugggugcaacauuucuaucaagaagccgcacccgcccaauccgacgucgcacuucuucgcuucgugaaucccgacacaggcagaguccucuucgaaugcaaacuccacaaaucaggauacgucacagucgcacacacgggacagcacgaccucgucaucccacccaacgguuacuuccgcuucgacucauggguuaaccaauucuacacccucgcccccaugggcaacggcgcaggccgacgacguuga

SEQ ID NO: 38006 - RNA, 1617 nt, Artificial Sequence
  derived and/or modified sequence opt11 from VP1__Norovirus_and/or_Norovirus-like__AB445395
augaaaauggccuccucugacgccaaccccuccgacggcagcacagccaaccucguccccgaaguaaacaacgaagucauggcccucgaacccgucgucggagcagccauugccgcucccgucgcaggccaacaaaaugucaucgaccccuggauccgcaacaauuucguacaagcaccaggaggcgaauuuacagucucuccccgcaacgcccccggcgaaauucugugguccgcaccccuuggaccugaccucaaccccuaccucucccaccuugcccgcauguacaacggcuacgccggcggauucgaaguccaagucauacucgccggcaacgccuucaccgccgguaaaaucaucuucgccgccgucccacccaacuuccccaccgaaggucucucacccucccaagucaccauguucccccacaucauaguagauguccgccaacucgaacccguccucauaccccuccccgacguccgaaacaauuuuuaccacuacaaccaaucuaacgacccaacaauuaaacucaucgccaugcuauacacaccccuccgagccaacaacgcaggagacgacgucuucaccgucuccugccgaguccucacccgcccauccccagacuucgacuucaucuucuuaguaccacccaccguagaaucccguaccaaacccuucuccgucccaauccuaacagucgaagaaaugacuaacucccgcuucccuaucccccucgaaaagcuauuuaccgguccaucaucagcauucgucguccaaccacaaaacggccgcugcacuaccgauggcguccuccucggcacaacacaacuauccccagucaacaucugcacauuccgcggugacgucacccacaucaccggcucccguaacuacaccaugaaccuagccacccaaaacuggaacuccuacgacccaaccgaagaaauccccgccccacucggcacacccgacuucgucggaaaaauccaaggcguccuuacccaaaccacccgcgcagacggaagcacccgaggccacaaagccaccgucuacaccggcucagccgacuucgcccccaaauuaggcagaguccaauucgccaccgacaccgauaacgacuucgacgccaaccaaaacacaaaauucaccccaguaggcgugauccaagacggagacaccgcccaccgcaaugaaccccaacaauggguacuacccagcuacuccggccguaacaaccacaacguucaccuagcacccgcggucgcccccacauuccccggcgaacaacuccuguucuuccguuccaccaugcccggcugcuccggcuaccccaacauggaccuugacugucuccucccccaagaauggguacaauacuucuaccaagaagccgccccagcacaaucugacgucgcccuacuacgcuucgucaaccccgacaccggccgcguucucuucgaaugcaaacuacacaaauccggcuacgucacuguagcccacacgggccaacacgaucuagucaucccacccaauggcuauuucagauucgacucuugggucaaccaauucuacacacucgcccccaugggcaacggcacaggcaggcgccgauaa

SEQ ID NO: 38007 - RNA, 1617 nt, Artificial Sequence
  derived and/or modified sequence opt11 from VP1__Norovirus_and/or_Norovirus-like__AB933655
augaaaauggccuccaacgacgccaaccccagcgacggcuccgccgccaacuugguccccgaagucaacaacgaagucauggcacuagaacccgucgucggcgccgccaucgccgcacccgucgcuggccagcaaaacgucaucgaccccuggauccgaaacaacuucguccaagcccccggcggcgaguucaccgucucuccccgcaacgcucccggagaaauccucugguccgccccgcucggaccagaccuaaaccccuacuuaucccaccucgcacgaauguacaacggauacgccgguggcuucgaaguccaagucaucuuagcaggcaacgccuuuaccgcaggaaagaucaucuucgcagccguuccacccaacuuccccaccgaaggacuuucccccucccaagucaccauguucccccacaucauagucgacguacgccaacucgaacccguccugauaccacuuccagacguccguaacaacuucuaccauuauaaucagagcaaugacuccaccaucaaacuaauugcgaugcuauacaccccgcuacgcgccaacaacgccggagacgacguguucaccgucuccugcagaguacucacccgacccuccccugacuucgacuucaucuuccucgucccacccaccguugaaucgcgaacuaagcccuucacaguucccaucuuaaccgucgaagaaaugacuaacucacgauucccuaucccccuagaaaaacuguucacaggccccucauccgcauucgucguacaaccccaaaacggccgauguaccacugacggaguccuccucggaacaacccagcucucacccguaaacaucugcaccuuucgaggcgacgucacacauaucgccggcucccgcaacuacacaaugaaccucgcgucucuaaacuggaacaacuacgaccccacagaagaaaucccagccccacuuggcacccccgacuucgucggcaaaauacaaggcguacucacccaaaccaccaaaggagacggcagcacaagaggacacaaagccaccguauacaccggcagcgcugacuucaccccgaaacucggauccguccaauuuggcaccgacacugaaaacgauuucgaaacccaccagaacaccaaauucacaccaguaggaguuauccaagacggaucaacgacucaccgcaacgaaccccaacaauggguccuccccuccuacucuggacgaaacguccacaacguccaccucgccccagccguagccccuaacuucccuggcgaacaacuacuguucuuccggucgacaaugcccggcugcuccggcuaccccaacauggaccuugacugccuccucccacaagaauggguccaacacuucuaccaagaagcagcccccgcgcaauccgacguagcgcuccuccgcuucguaaacccagauaccggcagaguacuauucgaaugcaaacuccacaaaucugguuacgucaccgucgcccacacuggccagcacgaccucgucaucccacccaacggauacuuccgcuucgacucauggguaaaccaauucuacacccucgcccccauggggaacggcaccggccgacgccgcuga

SEQ ID NO: 38008 - RNA, 1617 nt, Artificial Sequence
  derived and/or modified sequence opt11 from VP1__Norovirus_and/or_Norovirus-like__KM245072
augaagauggcaucauccgacgccaaccccagcgacgguuccacagcaaaccucguccccgaaguuaauaacgaaguaauggcacucgaacccguagucggagcagccaucgccgcccccguagccggccaacaaaacgucaucgaccccuggauccguagcaacuucguacaagcccccggcggcgaguucaccgucucccccagaaacgcccccggcgaaauccucugguccgccccgcucggaccagaccucaauccauaccuuucucaccucgcccgcauguauaauggcuacgcuggcggauucgaaguccaagucauccucgcaggcaacgcauucaccgccggaaaaaucauauucgccgccguacccccuaacuuccccacagaaggccucuccccaucccaagucacaauguucccccacaucaucguugacguccgccagcuagaacccguccuaaucccccuaccugacguacguaacaauuuuuaccacuacaaccaaagcaacgaccccaccaucaaacucaucgccaugcuuuacaccccucuccgugcaaacaacgccggcgacgacgucuucacaguuucgugucgcguucuaaccagacccucccccgacuucgacuucaucuuccuaguacccccaacugucgaaucccgcacaaaaccauucucaguccccauacuaaccgucgaagaaaugacuaacucccgauuccccauaccccucgagaaacuauuuaccggacccucuuccgcauucgucguccaaccccaaaacggccgaugcaccaccgacggcguccuccucggcacaacacaacugucgcccguaaacaucugcaccuuucgcggcgacguaacccacauaacuggcucucgcaacuacacaaugaaccucgccacccaaaacuggaacucauacgacccaacagaagaaauacccgccccacucggcacacccgacuuugucggaaaaauacaaggcguacucacccaaaccacccgugccgacggcuccacccgcggucacaaagccaccguauauaccggauccgcagacuucgccccuaaacucggacguguccaauucgccacugacacagacaacgacuucgacgccaaccaaaauaccaaauucacacccguaggcguaauacaagacggcgacacagcccauagaaacgaaccucaacaauggguccucccauccuacagcggccgcaauucucauaacguccaccucgccccagcagucgcaccuacauuucccggcgaacaacuccuauucuuucgcucuacuaugcccggaugcagcggcuaccccaacauggaccuugauugccuccucccucaagaauggguacaauacuucuaccaagaagccgcacccgcccaaucagacgucgcacuacuccgcuucgucaaucccgacaccggacgcguccucuucgaaugcaaacuccacaaauccggcuacguaacagucgcucacaccggccagcacgaccuagucauaccgcccaacggauacuuccgauucgacuccugggucaaccaauuuuacacauuagcacccaugggaaacggcacuggacgccgacgcuaa

SEQ ID NO: 38009 - RNA, 1617 nt, Artificial Sequence
  derived and/or modified sequence opt11 from VP1__Norovirus_and/or_Norovirus-like__AB541282
augaagauggccuccaacgacgccaaccccucagacggaucagcugccaaccucguccccgaaguaaauaacgaagucauggcccuagaacccgucgucggcgcagccauagccgcccccguugccggccagaccaacgucaucgacccuuggauccgcaacaacuucguccaagcccccggaggcgaauuuacugucucaccccgcaacgcaccaggcgaaauccuuugguccgcgccccucggccccgaccuaaauccauaccucucccaucucgcccgcauguauaacggcuaugccgguggauucgaaguacaagucauccucgccggcaacgcauucacagccggcaaaaucauauucgccgcugucccacccaacuuccccaccgaagguuuaucccccucccaaguuaccauguucccccacaucaucgucgacguccgacaacuagaaccuguacucauaccccuaccagacguccguaauaacuucuaccacuacaaccaauccaacgacuccaccaucaaacucaucgcaaugcucuacaccccucuccgcgccaacaacgccggcgacgacgucuucacaguaagcugccgaguccugacacguccaucaccggacuucgacuucaucuuccucguaccgccaaccgucgaaucacgcacaaaacccuucaccguacccauccugacugucgaagaaaugacuaacagccgcuucccuaucccccucgaaaaacucuucaccggcccauccggcgccuucgucguccaaccccaaaacggcagaugcaccaccgacggaguccuccuaggcaccacccaacucucaccugucaauaucugcacuuuccgcggcgacguaacccacauagccggaucgagaaauuacaccaugaaccuagccucucuaaacuggaacaacuacgaccccaccgaagaaaucccagcgccacucggaacccccgacuucgugggcaaaauccaaggcguauuaacgcagacaacgaaaggagacggauccacgcgcggccacaaagccaccgucuacacaggcuccgcccccuucaccccaaaacucggcucuguucaauucuccaccgacaccgaaaacgacuucgaagcccaccaaaauacaaaauucacccccgucggcguaauccaagacggauccacaacccaccgcaaugaaccccaacaauggguccuccccucguacagcggucgaaacguacaaaacguccaccuagcccccgcuguagcaccaaccuucccuggcgaacaacuccucuucuuccgaucuacaaugccaggcugcucaggcuaccccaacauggaccucgacugucuccucccacaagaauggguucaacacuucuaccaagaagccgcacccgcacaaucagacguagccuuacuccgauucgucaacccagacaccggccguguccuuuucgaaugcaagcuacauaaauccgguuacgucaccgucgcccacaccggccagcacgaccucguaaucccacccaacggcuacuuccgauucgacuccuggguaaaccaauucuacacacuugcucccaugggcaacggcaccggcagacgcagauaa

SEQ ID NO: 38010 - RNA, 1617 nt, Artificial Sequence
  derived and/or modified sequence opt11 from VP1__Norovirus_and/or_Norovirus-like__AB541202
augaaaauggccagcuccgacgccaacccaucagacggauccacggccaaccucguccccgaaguaaacaacgaagucauggcccuugaacccgucgucggagccgcaauagccgccccagucgccggccaacaaaacgucaucgauccauggauccgcaacaacuucguccaagcacccggcggcgaguucacaguaucaccccgcaacgccccaggagaaauccuaugguccgcaccccucggacccgaucucaacccauaccucucccaccucgcccguauguacaacggauacgccggcgguuucgaaguacaagucguccuugccggaaacgccuucacagccggcaaaaucaucuucgcggccguuccacccaacuuccccaccgaaggccucucccccucccaaguaaccauguucccacacaucaucgucgacguacggcaauuagagccaguccucaucccccucccugacguucgaaacaacuucuaccacuacaaccaaucgaacgacccaacuaucaaacuuaucgccaugcuauacacaccccuucgcgcaaacaacgccggagacgacguauuuaccgucuccugccgcguccucacucgacccagccccgacuucgacuucaucuuccucgucccaccaaccguugaaucacgcaccaagccuuucuccgucccaauccucaccgucgaagagaugacaaacucccgcuuuccaaucccacuugaaaaacucuucacaggucccagcagcgcauucguaguacaaccccaaaacggccguugcaccaccgacggcguccuccucggcacuacucaacucagccccguaaacaucugcaccuuucgcggcgacgugacccacaucaccggcucacgcaacuacacaaugaaccuagccacucaaaauuggaacuccuacgaccccaccgaagaaauccccgcaccccucggcacacccgacuucgucggcaaaauacaaggaguucucacccaaaccacacgcgccgacgguucaacacgaggccacaaagccacaguauacaccggcucugccgacuucgccccaaaacuuggccgcguccaauucgcaacggacaccgacaacgauuucgacgccaaccaaaacaccaaauucacaccagucggcgucauacaggacggcgacacagcccaccgcaacgaaccgcaacaauggguccucccaucauacucaggucgcaauaaccacaacguacaccucgcacccgccgucgcccccaccuuccccggagaacaacuccuauucuuccgcagcaccaugcccgguugcuccggauacccaaacauggaccuagacugccuauuaccccaagaauggguccaauacuucuaccaagaggccgcacccgcccaaucugacguagccuuacucagauucgucaaccccgacaccggccgaguacuuuucgaaugcaaacuccacaaaucaggcuacgucaccguugcacacaccggccaacacgaccuugucauuccacccaauggcuauuuccgauucgacuccugggucaaccaauucuacacccuagcccccaugggcaacggcaccggacgccgccgcuaa

SEQ ID NO: 38011 - RNA, 1617 nt, Artificial Sequence
  derived and/or modified sequence opt11 from VP1__Norovirus_and/or_Norovirus-like__FJ514242
augaagauggcauccaacgacgcuaaccccagcgacggcucagccgccaaccucguccccgaagucaacaacgaaguuauggcccucgaacccgucgucggcgcagccauagcagccccagucgcaggccaacaaaacgucaucgacccauggauccguaacaacuucguccaagcccccggcggcgaguucaccgucagcccccggaacgcccccggcgaaauccuuuggucagccccacucggaccagaucucaacccuuaccucucacaccuagccagaauguacaacggcuacgcaggcggcuucgaaguacaagucauucuagcuggcaacgccuuuacagccggcaagaucauauucgcagccgucccacccaauuuccccaccgaaggccucucacccucccaaguaaccauguucccacacaucaucguagacguccgacaacucgaaccaguccucauuccccuccccgacguccggaacaacuucuaccacuacaaccaauccaacgaccccaccauaaaacuuaucgcuaugcuauacaccccacuacgugccaacaacgccggggaagacguauucacugucuccugccgcguccucacucgaccuucccccgacuucgacuucaucuuccucgucccacccacaguugaaucacgcaccaaacccuucacuguaccaauccucaccgucgaagaaaugacaaacucccgcuuccccauaccacuagaaaaacuuuuuacaggccccucauccgccuucguaguccaaccccaaaauggccgcugcaccacagacggcguccuccuaggaacaacacaacucucacccguuaacaucugcaccuucagaggcgacgucacccacauugccggcucacguaacuacaccaugaaccucgcuagccucaacuggaauaacuacgaccccaccgaagaaguaccagcuccacucggcacccccgacuucgucggaaaaauacaaggaguccuaacccaaaccaccaagggcgacggcuccacaagaggacacaaagcaaccguuuacacaggcucagcuccuuucacaccaaaacuaggcagcguccaauucucuacagauaccgaaaacgacuucgaaacccaccaaaacaccaaauucaccccaguaggaguaauacaagacggcucaacuacccaccgaaacgaaccacaacaauggguccuaccaucauacuccggccgcaacguacaaaauguacaccucgcccccgcaguagcccccaccuuccccggugaacaacuccuauucuuccgcagcaccaugccuggcugcucaggcuacccaaacauggaccuagacugccuccucccccaggaauggguccaacacuucuaccaagaagccgcccccgcacaauccgacgucgccuuacuccgauucguaaacccagacacaggccgaguucuuuucgaaugcaaacuccacaaauccggcuacguaaccgucgcacacaccggccaacacgaccucgucauaccaccaaacggguacuuccgcuucgacagcugggucaaccaauucuacacacucgcccccaugggcaacggcaccggacgacgccgauaa

SEQ ID NO: 38012 - RNA, 1617 nt, Artificial Sequence
  derived and/or modified sequence opt11 from VP1__Norovirus_and/or_Norovirus-like__KX353976
augaaaauggcaagcaacgacgccaacccaagcgacggaucugccgccaaccuuguaccagaaguuaacaacgaaguaauggcccuagaacccgucgucggagccgcuaucgccgcccccguagcaggucaacaaaacgucauugaucccuggauacgaaacaacuucguccaagcacccggcggcgaguucaccgucucuccccgcaaugccccuggcgaaauccuauggucagccccacucggacccgaccucaaccccuaccuaucccaccucgcccgcauguacaacggcuacgccggcggauucgaaguccaggucauucuagccggaaacgccuuuaccgcaggcaaaguaauuuucgccgccguaccaccaaacuuccccaccgaaggccucucccccucacaagucaccauguucccccacaucaucgucgacguccgccagcuugaacccguccuaaucccacuccccgauauccgcaacaauuucuaccacuacaaccaauccaacgacuccaccaucaaacucauagccaugcucuacacuccacugcgcgcaaacaacgccggcgacgacguauucaccgucagcugccgcguccucacccgacccuccccagacuucgacuucauauuuuuaguacccccaaccgucgaaucucgcacaaaacccuucaccguaccuauccucaccgucgaagaaaugaccaacucccgcuucccaaucccccucgaaaaacucuucaccggccccuccucagccuucgucguccaaccccaaaauggccgcugcaccacagacggcguccuccuagguacaacacaacuaagccccguaaacaucugcacguuucgcggcgacguuacccacaucgcagggucccgcaacuacaccaugaaccucgccagccucaauuggaacaacuacgacccaacagaagaaauccccgcuccacuaggcacuccagacuucguaggcaaaauccaaggcguacucacccaaaccaccaaaggugacggaaguacccggggccacaaagccaccgucuacacaggcagcgccgacuucaccccaaaacucggaagcguccaauucggaacagacacagacaacgacuucgaaacccaccaaaacaccaaauucacccccgucggaguaauacaagacggaucaacaacacaccgcaacgaaccccaacaauggguacuccccuccuacucaggccgcaacguccaaaacguccaccuagccccagccgucgccccaaacuuccccggagaacaacuccucuucuuccgaucaaccaugccaggcugcuccggcuauccgaacauggaucuagacugccuacuaccacaggaaugggugcaacacuucuaucaagaagcagcacccgcccaauccgaugucgcccuccucagauucgucaacccggacacaggccgcguccuauucgaauguaaacuacacaaauccggauacgugacugucgcccacacuggccaacacgaucuagucaucccacccaacggcuacuucagauucgacucaugggucaaccaauucuacacacuagcccccaugggcaacggcaccggacgccggcgcuaa

SEQ ID NO: 38013 - RNA, 1617 nt, Artificial Sequence
  derived and/or modified sequence opt11 from VP1__Norovirus_and/or_Norovirus-like__KX353952
augaaaauggcaagcaacgacgcuaacccuucggacggcuccgccgcaaaccucgucccagaagucaacaacgaaguaauggcucucgagcccguagucggcgccgccaucgcagcaccaguagccggccaacaaaacguuaucgaccccuggauccgcuccaauuucguccaggcccccggcggcgaguucacugucuccccacgaaacgcucccggagaaauucucuggucugcaccccucggccccgaccuaaacccauaccucucacaucuagcccgaauguacaacggcuacgccggcggcuucgaaguccaaguaauacucgccggcaacgccuucaccgccggaaaaauuaucuucgccgccguuccacccaacuuccccaccgaaggcuuaucccccucccaaguaacuauguucccccacaucaucguagacguccgccaacucgaacccguacucaucccccuccccgacguccgaaauaacuuuuaccacuacaaccaauccaaugacucaaccaucaaacuaauagccaugcucuacacaccccuccgcgccaacaacgccggagacgacgucuucaccgucagcugccgcguccuaacucgcccaagcccagacuucgacuucauauuccuuguaccucccaccgucgaaucacgaaccaaacccuucaccguccccauccucaccguagaagaaaugaccaacucuagauuccccauuccccuagaaaaacuauucaccggccccucgagcgccuuuguaguccaaccccaaaacggacgcugcaccaccgacggcguccuacuaggaacaacacaacuaucccccguaaacgucugcacauuccgaggagaugucacccacaucgcaggcucccguaacuacaccaugaaucucgccucccuaaacuggaacaacuacgaucccaccgaagagauaccagccccacucggcacacccgacuuugucggaaagauccaaggcguccuuacccaaacaaccaagggcgacggcuccacucgaggccacaaagccacugucuacacgggauccgcagacuuuacacccaagcucggaaguguucaauucggaaccgacaccgagaacgauuucgaaacccaccaaaacacucgcuucaccccaguaggcgucauccaagacggaucuaccacacaccgcaacgaaccccaacaauggguucuccccucauacucaggcaggaacguacacaacgugcaccuagcccccgccgucgcccccaacuuuccuggagaacaauuacuauucuuccgcuccaccaugcccggcugcucaggcuaucccaauauggaccuagacugccuccucccccaagaauggguccaacacuucuaccaagaagcagcccccgcccagucagacgucgcccuacuccgcuucgucaaccccgacaccggccgaguacucuucgaaugcaaacuccacaaaagcggcuacgucacagucgcacacacaggccaacacgaccuaguaauucccccaaacggcuacuuccgauucgacagcuggguaaaucaauucuacacacucgcccccauggguaacgguacaggccgccgccgauaa

SEQ ID NO: 38014 - RNA, 1617 nt, Artificial Sequence
  derived and/or modified sequence opt11 from VP1__Norovirus_and/or_Norovirus-like__KR131771
augaaaauggcuucaaacgacgcaaaucccucagacggauccaccgcuaaccuagucccagaagucaacaacgaagucauggcccucgaaccaguagucggagcagccauagccgccccaguugccggccaacaaaacgucaucgaccccuggauacgaaauaauuucguccaagcaccaggcggcgaguucacugucucaccccgcaaugcccccggggaaauccucugguccgcaccccucgguccagaccucaacccauacuuaucccaccucgcaaggauguacaacggcuacgcaggaggauucgaaguccaggucauccucgcugguaacgcauucaccgcaggcaaaauuaucuucgccgccguaccacccaacuuucccacagaaggccuauccccaucccagguaacaauguucccccacaucaucgucgacguccgacaacucgaaccaguccuuauccccuuaccagacguccgcaacaacuuuuaucacuacaaccaaucaaacgaccccaccaucaaacucauagccaugcuguacacaccgcuuagagcaaacaacgccggugacgacgucuucaccgucuccugccgcguacuaacccgccccucaccagacuucgacuuuaucuuccuaguaccacccacagucgaaucccgcaccaaaccuuucaccgucccaauacucaccguagaagaaaugaccaauucccgcuucccaauuccccuagaacgccuauacaccggcccauccuccgccuucguaguucaaccccaaaacggacgcugcacaacagacggcguccuacuaggcaccacccaacuauccgccgucaacaucugcaccuuucgcggcgacgucacacacauagccggcucccgaaauuacaccaugaaccucgcuucccagaacuggaacaauuacgaccccaccgaagagauccccgccccacucggaacccccgacuucgucggcaaaauccaaggcaugcucacucaaacuacccgcuccgacggcagcacccgcggccacaaagcaaccguccucacuggcagcgccgacuuugcuccaaaacucggacgagugcaauuugccaccgauaccgacaacgacuucgaaucaggacaaaacaccaaguucacucccguaggcguaauacaagacggcagcacaacccaccgaaacgaaccccaacaauggguccuccccaacuacuccggcagaaccggccacaacguccaccucgcacccgcagucgcuccaaccuaccccggcgaacaacuccuuuucuuccgaucuacaaugccgggcugcucaggauaucccaacauggaccucgacugccuccuaccacaagaauggguccaacacuucuaccaagaagccgccccagcccaauccgacgucgcccuucuccgcuucguuaaccccgacaccggccgaguccucuucgaaugcaaacugcacaaauccggcuacguuaccgucgcccacaccggacaacacgaccuagucauuccacccaacggcuacuucagauucgacuccugggucaaccaauucuacaccuuagcccccaugggaaacggaacaggacgccgccgauaa

SEQ ID NO: 38015 - RNA, 1617 nt, Artificial Sequence
  derived and/or modified sequence opt11 from VP1__Norovirus_and/or_Norovirus-like__AB933729
augaaaauggccuccucagaugccaaccccuccgacggcuccacagcuaaucucguccccgaagucaacaacgaagucauggcgcuagaaccagucguuggagccgccauagcggccccaguagccggccaacaaaacgucaucgaccccuggauucgaaacaacuucguucaagcacccgguggagaguucaccgucuccccacgcaacgcacccggcgaaauacuaugguccgcaccccuaggucccgaccuaaaccccuaccucucacaccucgcaagaauguacaacggauacgccggcggcuucgaaguccaaguaauccucgccgguaacgcauucacagccggcaaaaucaucuucgccgccgucccucccaacuuucccacagaaggccucucgcccucccaagucaccauguucccccacaucauagucgacguccgccaacuugaacccguccucauaccccuccccgacguccgaaacaacuuuuaccauuauaaccaauccaacgaccccacaaucaaacucaucgccaugcuauacacaccccuacgcgcaaacaacgcaggcgacgacguuuucaccgucuccugccgcguucucacucgaccaucaccagacuucgacuucaucuuccucgugcccccaaccgucgaaucacgcacgaaacccuucuccgucccaauccucaccgucgaagaaaugacaaacucacgauuccccaucccccucgaaaaacuauucaccggccccuccucagccuucgucgugcaaccccaaaacggacgcugcaccacugacggcguacuccucggcacaacucaacucuccccuguaaacaucugcaccuucagaggugacguuacccacauaacuggcucccgaaacuacacuaugaaccucgccacccaaaauuggaacuccuacgaccccaccgaagaaauaccugcaccccucggaacacccgacuucguaggaaaaauucaaggcguacuaacacaaaccacccgcgccgacggauccacccggggacacaaagccauagucuacacaggaucagccgacuucgcccccaaacucggacgcguacaauuugcaaccgacacagacaacgacuucggagccaaccaaaacaccaaauucaccccaguaggcgucauccaagacggagacacagcccaccguaacgaaccacaacaauggguccuacccuccuacucuggccgaaacucccauaacgugcacuuagccccugcaguagcacccaccuuccccggcgaacaacuccucuucuuccgauccacaaugcccggcugcuccggcuaccccaacauggaccucgacugccuccuaccccaagaauggguccaauacuucuaccaagaagcagccccagcacaaucugacgucgcccuacuccgcuucgucaaccccgacaccggccgcguucucuuugaaugcaaacuacacaaauccggauacgucaccgucgcccacacaggccaacacgaccucgucauacccccaaacggcuauuuucgauuugauuccuggguaaaucaauucuacacccucgcccccaugggcaacggcaccggccgccgccgcuaa

SEQ ID NO: 38016 - RNA, 1617 nt, Artificial Sequence
  derived and/or modified sequence opt11 from VP1__Norovirus_and/or_Norovirus-like__AB933646
augaaaauggccucaaacgacgcgaaccccuccgacggcuccgcagcuaaccucguccccgaagucaacaacgaagucauggcccuagaaccagucguuggagccgcaaucgcagcccccgucgcuggccaacaaaacgucaucgaccccuggauaagaaacaacuucguccaagcccccggaggagaauuuaccguuuccccucgaaacgcccccggugaaauccucugguccgcccccuuaggccccgacuuaaaucccuaucucucccaccucgcccgcauguacaacggcuacgccgguggauuugagguacagguaauccuugcaggcaacgccuucacagcuggcaaaaucaucuucgccgccguaccucccaacuuccccaccgaaggccucucccccucccaagucacaauguucccccacaucauagucgacguccgacaacucgagcccguccuaauaccccuccccgacguaagaaacaacuucuaccacuacaaccaauccaacgacuccacgaucaaacucauagcaaugcuauacacaccccucagagcuaacaacgccggagaagacgucuuuaccgucucaugccgugugcucacccgccccucccccgacuucgacuucaucuuccuaguaccacccaccguggaauccagaaccaaacccuucaccguccccauccucaccgucgaagaaaugaccaacucucgcuuccccaucccccuagaaaaacucuucacaggccccuccagugcauucgucguccaaccccaaaacggccgaugcaccaccgauggcguccuucucggcacuacccaacucagccccguaaacaucugcaccuuccgcggagacguaacccacauagcaggcucacgugacuacaccaugaaccuagcuucccucaauuggaacaacuacgaccccaccgaggaaauacccgcaccccucggaacaccagacuucgucggaaaaauccagggcguccuaacccaaaccaccaaaggagacggaucaacucgcggccacaaagccacggucuacacaggcagcgcaccauucacccccaaacucggauccguacaauucucaaccgauaccgaaaacgacuucgaaacucaccaaaacaccaaauucacccccguaggugucauacaagacggaggcaccacacaucgcaacgaaccccaacaguggguacucccaucauacuccgggcgcaacgucccaaacguccaccucgccccagccguagcccccaccuuucccggagaacaacuccucuucuuccgcuccacaaugccgggcugcuccggcuaccccaacauggaccucgacugccuccucccacaagaauggguccaacacuucuaccaagaagccgcccccgcccaaucagaaguugccuuacuacgcuucgucaacccugacacgggccgaguccucuucgaaugcaagcuacacaaauccggcuacguaaccguagcccacaccggccaacacgaccucgucaucccacccaacggauacuuccgguucgacuccuggguaaaucaauucuacacccucgcacccauggguaacggaacaggcagacgacgcuaa

SEQ ID NO: 38017 - RNA, 1617 nt, Artificial Sequence
  derived and/or modified sequence opt11 from VP1__Norovirus_and/or_Norovirus-like__JX155742
augaaaauggccucaaacgacgccaaccccucggacggcucagccgcaaaccuaguaccagaggucaacaacgaggucauggcccucgaacccgucguaggcgcagcaauagccgccccugucgccggacagcaaaacgucaucgaccccuggauccgauccaacuucguccaagccccuggcggcgaguucaccguuagcccccgcaacgcccccggcgaaauccuaugguccgcaccccuuggccccgaccucaauccauaccucucacaccuagcccguauguacaacgguuacgcaggaggcuuugaaguacagguaauacucgcuggaaacgccuucaccgcgggcaaaauuaucuucgccgccguucccccaaacuucccaacagaaggccucuccccaucccaaguaaccauguucccacauauaauagucgacguccgacaacuagaaccaguccucaucccccuacccgacguccgcaacaacuucuaccacuacaaccaaucuaacgacuccacaaucaaacuaauagccaugcucuauacaccccuccgcgcaaacaacgcaggagaagacgucuucaccgucuccugccgaguccucacccgacccucaccagacuucgacuucaucuuucuugucccuccaaccgucgaaucacgcaccaaacccuucaccguacccauccuaaccgucgaagaaaugaccaacucccgcuucccuaucccacuggaaaaacuauucaccggccccucuuccgccuucguaguccaaccucaaaacggccggugcaccaccgacggcguucuccucggcaccacccaacucucucccguaaacaucugcaccuuccgaggagacgucacacacaucgccggcucccgaaauuacacuaugaaccuggcaucacuuaauuggaauaacuacgaccccacagaagaaaucccugccccacucggcacacccgacuucguaggcaaaauacaaggaguccuaacccaaacuaccaaaggcgacggaucaacacgcgggcacaaagccaccguauacaccggaucugccccauucacuccaaaacucggcuccguccaauucgggacagacaccgaaaacgacuucgaaacccaccaaaacaccaaauucacacccgucggaguaauacaagacggcggcaccacccaccgaaaugaaccucaacaauggguucucccuucuuacuccggcagaaacguacccaacguacaccuagccccagcagucgcaccaaccuuucccggagaacaacuuuuauuuuucagauccacaaugccaggcugcucaggcuaccccaacauggaccuagacugccuccuuccccaagaauggguccaacacuucuaucaagaagcagcccccgcccaaucugacgucgccuuacuccguuucgucaaccccgacaccggccgaguccucuucgagugcaaacuccacaaaagcggauacguaaccguggcccacaccggccaacacgaccucguaauaccacccaacggauacuuccguuucgacuccugggucaaccaauucuacacacucgcccccaugggcaacggcaccggccgccgacgcuaa

SEQ ID NO: 38018 - RNA, 1617 nt, Artificial Sequence
  derived and/or modified sequence opt11 from VP1__Norovirus_and/or_Norovirus-like__JN400614
augaaaauggcauccaacgacgccaacccuuccgacggcagcgccgcaaaccucguacccgaaguaaacaacgaagucauggcccucgaacccgucgucggcgccgccaucgccgcacccguagccggccaacaaaacgucauagacccauggauccgcaacaacuucguccaagcacccggcggugaguucacagucucaccccgaaacgcccccggcgaaauccucuggucagcaccccugggccccgaccucaaucccuaccuaucacaccuagcccgcauguacaacggauacgccggcggcuuugaaguacaagucauacuagccgguaacgcauucacagccggcaaaauaaucuucgcagccguucccccaaacuuccccaccgaaggucucucccccagccaagucaccauguucccacacaucaucgucgacguaagacaacuagaacccguccucauuccucuccccgacguccguaacaacuuuuaccacuacaaccaaagcaacgacuccacaauaaaacucaucgccaugcucuacacaccccuccgcgcaaacaacgccggagaugacguauuuaccgucuccugccgcguccuaacccgaccaucccccgacuucgacuucaucuuccuaguacccccaaccgucgaaucccguaccaaacccuucaccguucccauacuaaccguugaagaaaugaccaacucccguuucccaaucccccucgaaaaacuauuuacaggacccucaucugccuucgucguacaaccccaaaacggacgaugcacaacagauggcguacuucucggcaccacccaacucuccccuguuaacaucugcacauuccgaggcgacguaacccacauugccggcucucgaaacuacaccaugaaccucgccucccucaacuggaacaacuacgaccccaccgaagaaauccccgcuccccuaggcacucccgacuucguaggaaaaauccaaggcguccucacacaaaccacaaaaggcgacggcuccacccgcggacacaaagccaccgucuacacuggcuccgccuccuucaccccaaaacuaggcuccguccaguucucaaccgacaccgaaaacgacuucgaaacgcaccaaaacacaaaauucacccccgucggaguaauacaagacgggucgaccacccaucgcaacgaaccccaacaauggguacucccaucauacuccggacgaaacguacacaacguacaccucgcacccgccgucgcccccacguuccccggcgaacaacuacucuucuuccgcuccaccaugcccggcugcuccggauacccaaacauggaccuagacugccuacugccacaagaguggguacaacacuucuaccaagaagccgcccccgcccaaucugacgucgcccuacuacgauucgucaacccagauacuggccgaguccucuucgaaugcaaacuacauaaaucaggauacgucacagucgcacacaccggccaacacgaccucguaauaccacccaacggauauuucagauucgacagcuggguaaaccaauucuacacccuagcacccaugggcaacggcacaggccgccgccgcuag

SEQ ID NO: 38019 - RNA, 1617 nt, Artificial Sequence
  derived and/or modified sequence opt11 from VP1__Norovirus_and/or_Norovirus-like__JN400601
augaaaauggccucuaacgacgcaaaccccuccgacggcuccgccgcaaaccucguccccgaaguuaacaaugagguuauggcccuagaacccgucgucggugccgccaucgcagccccugucgccggccaacaaaacguaaucgaccccuggauucgcaacaacuucguccaagcaccaggcggagaguucaccgucucaccccgcaacgccccaggagaaauacucugguccgcacccuuaggaccagauuuaaaccccuaccucucccaccucgcccgcauguacaacggcuacgccggaggauucgaaguucaaguaauccucgccggcaacgccuucaccgccggcaaaaucaucuucgcagcugucccacccaauuuccccaccgaaggccucucacccucacaagucaccauguucccacacaucaucgucgacgugcgccaacuagaacccgugcucauaccccuccccgacguccgaaacaacuuuuaucacuacaaccaauccaaugacucaaccaucaaacucaucgcaaugcucuacacaccacuccgcgccaacaacgccggagaagacgucuucacaguauccugccguguccucacacgaccauccccugacuucgacuucaucuuccuaguacccccuacaguagaaucacgaacaaaaccauucacaguccccauccuaacagucgaagaaaugaccaacucacgcuuccccauaccacuggaaaaacuauucaccggccccuccggcgccuucgucguccagccacaaaacggccgcugcaccaccgacggcguccuccucggaacaacacagcugucccccguaaacauauguaccuuccgcggcgacgucacacacaucgcuggcucacgcgacuacacaaugaaucuagcaucccuaaauuggaacaacuacgacccaaccgaagaaauaccugcaccccucggcacccccgacuuugucggcaaaauccaaggcguccuaacccagaccacaaaagggaacggcucaacuagaggccacaaagcuaccgucuacaccggauccgccccauucacccccaaacucggcuccguccaauucuccaccgacaccgaaaacgacuucgaaacccaccaaaauaccaaauucacccccguuggcguaauccaagacggcucuaccacccaccguaacgaaccccaacaguggguacuucccaguuacuccggucgcaauguucauaacguccaccuagcucccgccgucgccccgacauucccaggagaacaacuccuauucuuccgaucuaccaugcccggcugcucaggauacccaaauauggaccuugacugccucuuaccacaagaguggguacaacauuucuaccaagaagccgcccccgcacaaucagacguagcccugcucagauucgucaaccccgacaccggacgaguccucuucgaaugcaaacuccacaaauccggcuacauaacagucgcacacaccggccaacacgaccucguaaucccaccaaacgguuacuuccgcuucgacagcugggucaaccaguucuacacccucgcccccaugggcaacggcaccggccgucgcagauag

SEQ ID NO: 38020 - RNA, 1617 nt, Artificial Sequence
  derived and/or modified sequence opt11 from VP1__Norovirus_and/or_Norovirus-like__JQ613538
augaaaauggccuccucagacgcaaacccaucugacggcuccaccgcaaaccucgucccagaaguuaacaacgaagucauggcccuagaacccgucgucggagcagccaucgcagccccagucgccggacaacaaaacauaauagaccccuggauccgcaacaacuucguucaagcuccugguggagaauuuaccgucucaccccgcaacgcacccggugaaauccuuuggucagcaccccuaggccccgaccucaaccccuaccugucccaccucgcccguauguacaauggcuacgccggcggcuucgaaguccaagucauccucgccggcaaugcuuucaccgccggaaaaaucgucuucgccgcagucccacccaacuuccccaccgaaggccucucccccucccaaguaacuauguucccccacaucaucguagauguccgucaacucgaacccguacucaucccccuucccgacguccgaaacaacuucuaccacuauaaccaauccaacgacccuaccaucaaacuaauagccaugcucuacaccccacuccgagcaaauaacgccggagacgaugucuucaccguauccugccgcguacucacacgccccucccccgacuucgacuucaucuuccuagucccacccaccgucgaaucacgcaccaaacccuucucuguccccauccuuaccguagaagaaaugaccaacucccgcuuccccaucccccucgaaaaacucuucaccggccccuccuccgcauuuguuguccaaccacagaacggccgcugcaccaccgacggcguccuccucggcaccacccaacucuccccaguaaauaucugcacauucagaggcgacgucacccacaucgccggcucucacaacuacacgaugaaucuagcaucccaaaacuggaacuccuacgacccaacugaagaaauccccgcaccacugggaacccccgauuucguaggaaaaauacaaggcguacucacacaaaccacccguacagacggauccacccgaggccacaaagcgacagucuacaccgguagcgcugaauuuucccccaagcugggacgcauccaauucgcaaccgacacaaacaacgacuucgacgcuaaccaaaauaccaaauucacccccguuggcgucauccaagacggaggcaccacccaccgcaacgaaccccaacaauggguccuccccucauacucgggacgcaacacacacaauguccaucucgccccggccguagcacccaccuuccccggcgaacagcucuuauucuuccgaucaacccuaccagguugcuccggcuaccccaacauggaccucgacugccuacuaccccaggaaugggugcaauauuucuaccaagaagccgccccagcacaaucugacgucgcccuccuucgguucgucaacccagacaccggacgcguacucuucgaaugcaaauuacacaaaucaggcuacgucacggucgcccacacuggucaacacgaccuagucauacccccuaacggauacuuccgcuucgacuccuggguaaaccaauucuacacacuagccccaaugggcaacggcacaggccgacgccgcuaa

SEQ ID NO: 38021 - RNA, 1617 nt, Artificial Sequence
  derived and/or modified sequence opt11 from VP1__Norovirus_and/or_Norovirus-like__HM802543
augaaaauggcauccaaugaugcuaccccauccgacggcagcaccgcaaaccuagucccugaagucaacaacgaggucauggcccucgaaccagucguaggagcagcaaucgcggcccccgucgcaggacaacaaaacguuaucgaccccuggauccguaacaacuucguacaggccccaggcggcgaguucaccgucuccccacgaaacgccccgggagaaauccuuuggucagcaccccuaggacccgaccuaaacccauaccucucacaccuagccagaauguacaacggcuacgcaggcggcuuugaaguacaagucauccucgccggcaacgccuucaccgcaggcaagaucaucuucgcagccguucccccuaacuuccccacagaaggucucucacccucccaggucaccauguucccacacaucaucguagauguccgccaacucgaaccagugcucauaccccuccccgacgucagaaacaacuucuaccacuacaaccaaagcaaugaccccacaauaaaacuaaucgccaugcuauacacaccccuccgagcaaauaacgccggcgacgacgucuucaccguaucaugccgcguccucacccgucccucccccgacuucgacuucaucuuccucgucccacccaccguggaaucucgcaccaaacccuucuccguccccauccucacugucgaagaaaugaccaacucacgcuuccccaucccucucgaaaaacuauucaccggccccuccuccgccuucgucguccaaccucaaaacggccgaugcaccaccgacggcguccuccucggcacaacccaacuaucccccguuaacauaugcacauuccgaggcgacguaacccacauagccggcacucaaaacuacacuaugaaccucgcaucacaaaacuggaacaacuacgaccccacggaagaaaucccagccccacucggcacacccgacuucgucggcaaaauccaaggaguccugacacaaaccacucgccgagauggcucaacacgcggccacaaagcuacaguauccaccggauccgugcacuucacacccaaacuaggcuccguacaguucucuaccgacaccuccaacgacuuugaaacaggucaaaacacccguuucaccccagugggcguaguucaagacggcgacacaacacaccaaaacgaaccccaacaauggguacucccagacuacuccggccgugacucacacaacguacaccuagcccccgccguagcccccaccuuccccggcgaacagcuccucuucuuccgcucuacuaugcccggcugcuccggauaucccaauaugaaccucgacugccuccuaccccaagaauggguacaacacuucuaccaagaaucugccccagcacaauccgacguagcccuccuccgcuucguaaacccagacacaggccggguccucuucgaaugcaaacuccacaaaucuggcuacgucacagucgcccacaccggucaacacgaccuagucaucccucccaacggcuacuucagauuugacucaugggucaaccaauucuacacccuagcccccaugggcaacggagcaggacgucgccgcuga

SEQ ID NO: 38022 - RNA, 1617 nt, Artificial Sequence
  derived and/or modified sequence opt11 from VP1__Norovirus_and/or_Norovirus-like__AB541337
augaaaauggcauccaacgacgcaaaccccuccgacggauccgccgccaaccuagucccugaaguaaacaacgaagucauggcccuggaacccgucgucggcgccgccaucgcggcccccgucgccggucaaaccaacguaauugaccccuggauacgcaauaacuucguucaagcccccggcggcgaguucacagucucaccacgcaacgcacccggcgaaauccucugguccgcaccccucggaccagaccucaacccauaccuaucucaucuugcccgaauguacaacggcuacgccggcggcuucgaaguccaaguaaucuuagcaggcaacgccuucacagccgguaaaaucaucuucgcagccgucccacccaacuuccccaccgaaggccucucccccagccaaguuacaauguucccccacaucaucgucgacguccgacaacuagaaccaguacucaucccccucccagacguacgcaacaacuucuaccacuacaaccaaucaaacgacucaaccaucaaacuaaucgccaugcucuacaccccacuaagagcuaacaacgcaggcgaagacguuuucacaguaucuugccgcguucuaacaagacccucacccgacuucgacuuuauauuccucguacccccaaccgucgaaucccguaccaagcccuucaccguccccauccuaaccgucgaggaaaugacaaacucccgauuccccaucccucucgaaaaacuauucaccggacccagcggcgccuucgucguccaaccccaaaacggacgaugcaccacagacggcguccuccucgguacaacccaacuaucccccgucaacaucugcacuuucagaggcgacgucacccacaucgccggcucaagagacuacaccaugaaccucgcaucacucaacuggaacaacuacgacccgacugaagaaaucccagcaccccucggcacacccgacuuugucggcaaaauccaaggcguacucacucaaacaacaaagggagacggcucuacccgaggccauaaagcaaccguauacaccggcagcgcacccuucacccccaaacucggauccguccaauucuccaccgacaccgaaaacgacuucgaaacccaccaaaauaccaaauucacaccaguaggcgucauccaagacggcggaacaacacaccgaaacgagccacaacaauggguccucccaagcuacuccgggcgcaacguccacaacguacaccucgcccccgccgucgcucccaccuuccccggagaacaacuccucuucuucagauccacgaugcccggcugcagcggauaucccaacauggaccucgacugccuccuaccucaagaauggguucaacacuuuuaccaagaagccgcccccgcccaauccgacguugcacuccuccgcuucgucaaccccgacacaggccgcguccuauucgagugcaaauuacacaaaucuggauacguuacugucgcccacacuggacaacacgaccuagucauaccacccaacggcuacuucagauucgauuccuggguuaaccaauucuacacccucgcacccaugggcaacggcaccggccgccgccgauaa

SEQ ID NO: 38023 - RNA, 1617 nt, Artificial Sequence
  derived and/or modified sequence opt11 from VP1__Norovirus_and/or_Norovirus-like__AB541252
augaagauggccucaaaugacgccaaccccuccgacggcuccgccgccaaccucguaccugaagucaacaacgaagucauggcccucgaaccagucgucggcgccgcaaucgcggcuccagucgccggacaacaaaacgucaucgaccccuggaucagaaacaacuucguacaagcccccggaggcgaguucacaguaagcccccgcaacgcaccuggagaaauccucugguccgcaccccucggcccagaccuuaaccccuaccucucacacuuagccagaauguacaacggauacgcaggcggcuucgaaguacaagucauccucgcagguaacgccuucaccgcagguaaaaucaucuucgcagcugucccacccaacuucccaaccgaaggccuuucuccuucacaagucacaauguucccacacauaauaguagacguccgacaacuagaaccaguccucauaccccucccagacguucgcaacaacuucuaccacuauaaccaaucaaacgacucaaccaucaaacuaaucgccaugcucuacacaccccuccgcgccaacaacgccggcgacgaugucuucaccgucuccugccgcguacucaccaggcccucacccgacuucgacuucaucuuccucgucccacccaccgucgaaucaagaaccaaacccuucaccguccccauccucaccgucgaggaaaugacgaacucccgauuccccauuccacucgaaaaacucuucaccggacccagcucagcauucauaguccaaccccaaaacggacgcugcaccaccgacggcguccuccucggaaccacccaacuuucccccgucaacauauguaccuuccgcggcgacgucacacacaucgcaggaagccgaaacuacacaaugaaccucgccucccucaacuggaacaacuacgacccuacagaagaaauucccgccccacuaggcacacccgauuucguaggcaaaauucaaggaguacuuacacagacaacaaaaggcgacggcucaacccgaggccacaaggccacagucuacaccggcagugccgauuucacccccaaacucggcuccguccaauucggcacagacacagaaaacgacuucgaaacacaccaaaauaccaaauucacuccagucggagucauccaagacggauccaccacacaccgcaacgaaccccaacaauggguacuacccucauacagcggacgcaacguacacaacguccaucuagcaccagccguggcucccaacuuccccggcgaacaacuccuauuuuucagaucaacaaugcccggcugcuccggcuaccccaacauggaccuugacugccuauuaccccaagaaugggugcaacacuucuaucaagaagccgccccagcccaaucagacguugccuuacucagauucgucaaccccgacacuggcagaguacucuucgaaugcaaacuccacaaaucuggcuacguaaccgucgcccacaccggccaacacgaccuagugaucccacccaacggcuauuuccgcuucgacucauggguaaaccaauucuacacauuggcacccaugggcaacgguacaggucgccgccgcuaa

SEQ ID NO: 38024 - RNA, 1617 nt, Artificial Sequence
  derived and/or modified sequence opt11 from VP1__Norovirus_and/or_Norovirus-like__GU270580
augaaaauggcauccaaugacgccacacccuccgacggcucuaccgcaaaccucguccccgaaguaaauaacgaagucauggcccucgaacccguagucggcgccgcaaucgccgccccagucgcaggccagcaaaacgucauagaccccuggauccgcaacaacuucguccaagcaccaggcggcgaguucaccgucucaccgcgcaacgcccccggugaaauacuaugguccgcgccccucggccccgaccuaaacccuuaccucagccaccucgcccgcauguacaacgguuacgcaggcggauucgaaguccaagucauucuagccggcaacgcauucacagcaggcaaaauaaucuucgccgccgucccacccaacuuccccaccgaaggacugucucccucucaggucaccauguucccccauaucauagucgacgucagacaacucgaacccguccuaaucccccucccagacguacgcaacaacuucuaccauuacaaccaaucaaacgacccuacuauaaaacucaucgccauguuauacacaccccuccgagccaacaacgccggugacgaugucuucaccgucuccugccgcguccucacccgccccagucccgacuucgacuucauauuucuagucccacccaccguagaauccagaacaaagcccuucuccguuccaaucuuaaccguggaagaaaugacaaacagccgcuuccccaucccccucgaaaaacuauucacaggccccucaagcgcuuucgucguacaaccccaaaacggccggugcacaacagacgguguccuccugggaaccacucaacuauccccagucaacaucugcaccuuccgcggcgacgucacccacaucgcaggcucccgcaacuacacgaugaaccucgcaacacaaaacuggaacucauacgaccccaccgaagaaauaccagcaccccuuggaaccccugacuucgucggcaaaauacagggcgucuuaacccaaacaacccgagccgacggcuccacgcgagggcacaaagccacagucuacaccggaucugccgauuucuccccaaaacuuggccgaauacaauucgccaccgauaccgacaacgacuucgacgcaaaucaaaacaccaaauucaccccagucggcguaauccaagacggcaacaccgcccaccgaaacgaaccccaacaauggguccuacccuccuacucaggacguaacucccacaacguccaccuagcucccgccgucgcccccacuuucccaggcgaacaacuccuauucuuccguucaaccaugcccggcugcucaggauaccccaacauggaccuagacugucuccucccccaagaauggguccaauacuucuaccaagaggccgcccccgcccaaagcgacgucgcucuacuccgcuucguuaaccccgacaccggacgaguccuauucgaaugcaaacuccacaaaacagguuacguaacagucgcucacaccggccaacacgaccucgucaucccacccaacgguuacuucagauucgacuccugggucaaccaauucuacacacucgccccaaugggcaacggaacaggcagacgcagauaa

SEQ ID NO: 38025 - RNA, 1617 nt, Artificial Sequence
  derived and/or modified sequence opt11 from VP1__Norovirus_and/or_Norovirus-like__EU876882
augaaaauggccucaaacgacgcaaaccccucggauggaagcaccgccaaccuagugccagaagucaacaaugaaguaauggcccucgaacccgucgucggagccgccaucgccgcccccguagccggucaacaaaacgucaucgaccccuggauccgaaacaacuucguucaagcccccggcggugaguucaccguaagcccacguaacgcaccuggcgaaauccucuggagcgcgccccuaggcccagaccuuaaccccuaccucucccaccuagcccgaauguacaacggcuacgccggaggauucgaaguccaagucauccucgccggcaacgcauucaccgccggcaaaauaaucuuugccgcugucccacccaacuucccaaccgaaggccucucacccagccaagucaccauguucccacacaucaucgucgacguccgacaacuagaaccaguccucaucccccucccugacguccgcaacaacuucuaccacuacaaccaaucaaacgacccaaccauaaaacucauugcaaugcucuauacgccccuacgcgcaaacaacgccggagaugacgucuucaccgucuccugucgaguccucacccgccccucaccugacuucgacuucauuuucuuaguacccccaaccguagaaucccgcaccaaaccuuucaccguccccauacucaccgucgaagaaaugaccaacucccgauuccccaucccacuagaacgucucuacaccggccccagcuccgccuucgucguccaaccacagaacggccgcugcaccaccgacggcguccuacucggcaccacccaacuauccgccgucaauaucugcacauuccgaggagacgucacccacauugcuggaucccgaaacuauacuaugaaccucgccucccaaaacuggaacaauuaugaccccaccgaagaaaucccagcaccccucggcacaccugacuucgucggaaaaauucaaggcaugcucacccaaaccacccgaucagacggcuccacucgcggacacaaagccaccguacucaccggcuccgccgacuucgcccccaaacucggccgcguccaauucgccaccgacacagacaacgacuucgaauccggccaaaacaccaaauucacccccgucggagucauccaagacggcuccaccacccaccgaaacgagccacaacaauggguccucccaaacuacagcggccguaccggccacaacguccaccuugcccccgccgucgcuccaaccuaccccggcgaacaacuacucuucuuccgcuccaccaugcccggcugcucaggauauccaaacauggaccucgacugccuccucccccaagaauggguccaacacuucuaucaagaagccgcccccgcccaaucagacguagcccucuuacgauucgucaaccccgacaccggucggguccuuuucgaaugcaaacuccacaaauccggauacgucacagucgcacacaccggccaacaugaccucgucauaccacccaacggauacuuccgcuucgacucauggguaaaccaauucuacacccucgcacccaugggcaauggcgccggacgccggagauaa

SEQ ID NO: 38026 - RNA, 1617 nt, Artificial Sequence
  derived and/or modified sequence opt11 from VP1__Norovirus_and/or_Norovirus-like__AB933649
augaaaauggcaagcaacgacgccaaccccuccgacggcagcgccgcuaacuuaguccccgaagucaacaacgaagucauggcacucgaaccagucgucggagccgccaucgcagcacccgucgcuggucaaaccaacgucaucgacccguggauccguaacaacuucguccaagcccccggcggcgaguucaccguaucaccccgaaaugcccccggcgaaauccuuugguccgcaccccuagggcccgacuuaaacccauaccucucgcaccucgcacgcauguacaacggcuacgccggaggcuucgaaguccaaguaauccuagccggcaacgccuuuaccgcaggcaaaaucauuuucgcagccguucccccaaacuuccccacagaaggacucucucccagucaagucacaauguucccucacaucaucgucgacguacgucaacucgaaccaguacuaaucccccuacccgacguccgaaauaacuucuaccacuacaaccaaagcaacgacucaacuauaaaacucaucgcaaugcuauacacaccacuucgagccaacaacgccggcgaagacgucuucacugucuccugccgcguccucacacgaccauccccagacuucgacuucaucuuccuugugcccccaacagucgaaucacgcaccaaacccuucacaguacccauccucaccgucgaagaaaugacaaacucucgcuuccccaucccccuagaaaaacuauucaccggacccagcggagcauucgucguccaaccucaaaacggccgauguacaaccgacgguguccuccuagguacaacacaacucucccccguaaacauuuguacuuuccgcggcgacgucacccacaucgccggcucaagaaacuacaccaugaaccuagcuagccucaacuggaacaauuacgaccccacggaagaaaucccagcaccccucggaaccccagacuucguaggcaaaauacaaggcguccucacccaaacuaccaaaggcgacgguucgacccgcggacacaaggccaccguuuacaccggcagcgcacccuucacccccaaacucgguuccguccaauucucuaccgacacagagaacgacuucgaagcacaccaaaacaccaaauucacacccgucggcgugauucaagacggcuccaccacccaucgcaacgaaccccaacaauggguccuaccaucauacuccggcggcaacguccaaaacguccaccuugcccccgccgucgccccuacauuccccggagaacaacuccucuucuucagguccacaaugccaggcugcucaggauaccccaacauggaccucgacugccuccuaccacaagaauggguccaacacuucuaucaagaagccgccccugcccaauccgacguugcacuacuccgcuucgucaaccccgacaccggacgcguacucuucgaaugcaaacuccacaaauccggcuacgucaccgucgcucacaccggccaacacgaccucguaauucccccaaacggcuacuuccgcuucgacuccugggucaaccaauucuacacacucgcccccaugggcaacggcacaggcagacgccgcuga

SEQ ID NO: 38027 - RNA, 1617 nt, Artificial Sequence
  derived and/or modified sequence opt11 from VP1__Norovirus_and/or_Norovirus-like__JX439816
augaaaauggccucaucagacgcuaacccaucagacggcucaaccgcgaaccuuguacccgaagucaacaacgaagucauggcacucgaacccguagucggcgcagcaaucgcagccccagucgccggccaacaaaacgucauugaccccuggauucgcaacaacuuuguccaagcucccggaggcgaguucaccgucucaccccgcaacgcuccaggagaaauccuauggagcgcuccccuaggcccugaccucaaccccuaccuaucccaccucgcaagaauguacaacggcuacgcagggggauucgaaguccaagucauccucgcaggcaacgcauucaccgccggaaaaaucaucuucgcagccguaccacccaacuuccccaccgaaggacugucccccucccaaguaaccauguucccccacaucaucgucgacguccgccagcuagaaccaguccuaauccccuuaccagacguacgcaacaacuucuaucacuacaaccaguccaacgacccaacaaucaaacucaucgccaugcucuauacuccccucagagccaacaacgccggagacgauguauucacagucuccugcagaguccucacccgacccucccccgacuuugacuuuauauuccuagucccuccgacaguagaaagccgaacaaaaccauucuccgucccaauacuaaccgucgaagaaaugaccaauucccgcuuccccaucccccuagaaaaacuauucaccgguccuuccuccgccuucgucgugcaaccacaaaacggccgcuguaccaccgacggaguccuacuuggcaccacccaacucucucccguaaacauaugcaccuuccguggcgacgucacccacaucaccggaucccgcaacuacacaaugaaccucgcaacacaaaauuggaacagcuacgauccaaccgaagaaauccccgcaccacucgggacccccgacuucgucggcaaaauccaaggcguccucacccaaaccacacgcgcagacggcucuacacgcggccacaaagccaccguauacaccggcucugcagacuucucccccaaacucggccgcguacaauucgccaccgacaccgacaacgacuucgacgccaaccaaaacaccaaauucaccccaguuggugucauacaagacggagacaccgcccaccgcaacgaaccccaacaauggguacucccuuccuacagcggcagaaacucccauaacguccaccucgcccccgcagucgcacccaccuuccccggagaacaacuucuuuucuucagaucaacaaugccuggaugcuccggcuaccccaacauggaccuagacugccugcucccccaagaguggguucaguacuucuaucaagaagcagccccagcacaaucagacguagcguuacugcgauucguuaaccccgacacaggccgaguacucuucgaaugcaaacuccacaaauccggcuacguaacugucgcccacaccggacaacacgaccuugucauuccaccuaacggauacuuccgcuucgacuccugggucaaccaauucuacacuuuagcccccaugggcaacggcaccggacgacgccgauaa

SEQ ID NO: 38028 - RNA, 1617 nt, Artificial Sequence
  derived and/or modified sequence opt11 from VP1__Norovirus_and/or_Norovirus-like__JX155739
augaaaauggccuccaacgacgccaaccccuccgacggaucagcagccaaccugguccccgaaguaaacaacgaagucauggcacucgaacccgucguaggagcagccaucgcagcacccgucgccggccagcaaaaugucauagacccauggauccgcaacaacuuuguccaagccccaggcggagaguucaccgucuccccucgcaacgcccccggcgaaauacucuggucagccccucuuggcccugaccugaaccccuaccuaucacaccuagccagaauguauaacgguuaugccggcggcuucgaaguccaagucauccuagccggaaacgcguucaccgcaggcaaaaucaucuucgccgccgucccacccaacuuccccaccgaaggacucucccccucacaaguuacuauguuuccccacauaauagucgacguacgccaacuagagcccguacucauaccacuccccgacguccgaaacaacuucuaccacuacaaccaaucaaacgacuccaccaucaaacugaucgcaaugcuuuacacaccacuccgcgccaacaacgcaggcgacgacguuuucacagucucaugccgaguccucaccagaccaucccccgacuucgacuucauauuucucguaccgccaaccgucgaaucacgaacuaaaccguucaccguccccauacugaccguagaagaaaugacaaacucccgcuucccaauaccacucgaaaaacucuucaccggaccaucauccgcauucguuguccaaccucaaaauggaagaugcaccaccgacgguguccuccucggcaccacccaacucuccccaguaaacaucugcaccuuccguggcgacguuacccacaucgccggaucucgcaacuauaccaugaaccucgcaucacuaaacuggaauaacuaugaccccaccgaagagauccccgcuccccuaggaaccccagacuucguaggcaaaauacaaggcguccucacacaaacaaccaaaggagauggcuccacccgagggcacaaagccacaguauacaccggcuccgcacccuucacaccaaaacuagguucgguccaauucagcacagacaccgaaaacgacuucgaaacucaccaaaacaccaaauucaccccaguaggcgucauccaagacgguuccacaacccaucgcaacgaaccucagcaauggguccuccccuccuacucuggccgcaacguccaaaacguacaccucgcccccgccgucgcuccaaccuuccccggcgaacaacuacucuucuuccgcuccaccaugcccggcugcuccggcuacccuaacauggaccucgacugccuccucccccaagaauggguacagcacuuuuaccaagaagcagcccccgcccaaucagacgucgcccuccucagauucguuaaccccgauaccggccgcguacuuuuugaaugcaaacuccacaaaagcggcuauguaacagucgcacacaccggccaacacgaucucguaauacccccaaacggcuacuuccgauucgacuccugggucaaccaauucuacacacuagcccccaugggcaacggcaccggccgccgcagauaa

SEQ ID NO: 38029 - RNA, 1617 nt, Artificial Sequence
  derived and/or modified sequence opt11 from VP1__Norovirus_and/or_Norovirus-like__HQ456338
augaaaauggcaucaaaugacgcaagcccauccgauggcuccgccgcaaaccucguacccgaaguaaauaacgaagucauggcccucgaacccgucgucggcgcagcaaucgccgcccccgucgcaggccagaaaaacgucaucgaccccuggauacgcaacaacuucguccaagcucccggcggcgaguucaccgucuccccacgcaacgcaccaggagaaauacuaugguccgccccucuaggccccgaccuaaaccccuaccuaucccaccuagcccgaauguacaacggauacgcuggcggcuucgaaguccaagucauccuagccggcaacgccuucaccgcaggcaaaaucaucuucgccgccguucccccaaacuuccccaccgaaggccucuccccaagccaagucaccauguucccucacauaaucguugacguaagacaacucgaacccguccuaaucccacuaccugacguacgcaacaauuucuaccacuacaaccaauccaaugacuccacaaucaaacugauagcaaugcuuuacacuccccuacgagcaaacaacgccggagaagauguauucaccgucuccugccgcguccuaacacgcccuucucccgacuucgacuucaucuuccucgugcccccaaccgucgaaucccggaccaaacccuucaccgucccaaucuuaaccgucgaagaaaugacaaacucccgcuuuccaaucccccucgaaaaacuauucacaggcccaagcggagcuuucgucguccaaccacaaaacggccgaugcacaaccgacgguguccuccuugguaccacccaacucuccccaguaaacaucugcacauuccgaggcgacguaacacacaucgcagguagccgcaauuacacaaugaaccuagcagcccucaacuggaauaacuacgaucccaccgaagaaauccccgccccacuaggcacaccagacuuuguaggcaaaauccaaggaguccuaacccagaccaccaaagccgauggaucaacacgaggccacaaggccacagucuacaccggcuccgcagacuucaccccaaaacuaggaucuguacaguucucaaccgacaccgaaaacgauuucgaaacccaccaaaacaccaaauucacccccguuggcgucauccaagacggauccaccacacaccgcaacgaaccccaacaauggguccuccccuccuacucaggccgcaacguacacaacguccaccucgcgccugcagucgccccuacauuccccggcgaacagcuccucuucuuccgaucuaccaugccaggcugcucaggauacccaaacauggaccuugacugccuccucccccaagaauggguccaacacuuuuaucaagaagccgccccggcccaaucagacgucgcccuccuccgauucguuaaccccgauaccggccgcguccuuuucgaaugcaagcuccacaaaucaggcuacgucacagucgcccacacaggacaacaugaccucguaauacccccaaacggcuacuuccgcuucgacucuugggucaaccaauuuuacacauuagcacccaugggcaacggcaccggacgccgucgcuaa

SEQ ID NO: 38030 - RNA, 1617 nt, Artificial Sequence
  derived and/or modified sequence opt11 from VP1__Norovirus_and/or_Norovirus-like__AB541359
augaaaauggcauccaacgacgccaacccgucagacgguucagccgccaaccuuguccccgaagucaacaaugaaguuauggcccucgaacccguaguaggugccgcaaucgccgcuccgguagcaggccaaaccaacgucaucgaucccuggauccgcaacaacuucguacaggccccaggcggcgaguucacaguaucaccccgaaaugcccccggcgaaauccugugguccgcaccccucggaccugaccuaaaccccuacuuaucccaccuugcccgcauguacaacggcuacgcaggcggauucgaaguccaagucaucuuagcaggaaacgcauucaccgcaggcaaaaucauauucgccgccgucccucccaacuuucccaccgaaggccucucccccucccaagucacaauguucccgcacaucauagucgacguaagacaacucgaacccguccuuauaccccucccggacguccgcaacaacuucuaccacuacaaccagagcaacgacuccacaauaaaacuaaucgccauguuauacacuccccuccgcgcgaacaacgccggcgaagacgucuucaccguauccugcagaguccuaacgcgaccaucccccgacuucgacuucaucuuccucgugccacccaccgucgaaagccgcacaaaacccuucaccguacccguccucaccgucgaagaaaugaccaacucacgcuucccaauaccccuagaaaaacuuuucaccggccccucuggcgcuuucguaguccagccccaaaacggacgaugcaccaccgacggcguccuacuaggcaccacacaacugucacccguuaacauaugcaccuuccgcggggacguaacucacaucgccggcucacgcaacuacaccaugaaucuagccucccuaaacuggaacaacuacgaccccaccgaagaaaucccugccccacuaggaaccccugacuucgucggcaaaauccaagggguccucacccaaaccaccaaaggcgacggguccacacgaggucacaaagccaccgucuacaccggcucagcccccuucaccccaaaacuugguuccguccaauuuucgacagacacagaaaacgacuucgaaacccaccaaaacacaaaauucacgccaguaggagucauacaagacggaagcaccacccaccgcaacgaaccccaacaauggguccuccccuccuacuccggccgcaacguacacaacguccacuuagcaccagccgucgcgccaaccuuccccggcgaacaacuccuuuucuuccgcuccacaaugccaggcugcucaggauaccccaauauggacuuagacugccuccuaccccaagaauggguccaacacuucuaccaagaagcagcccccgcacaauccgaagucgcccuccucagauucguaaaccccgacaccggccgcguccucuucgaaugcaaacuccacaagucaggcuacgucaccgucgcacacaccggacaacacgaccucgucaucccacccaacggcuacuuccgcuucgacagcugggucaaccaauucuacacccucgcacccaugggaaacggaaccggacgacgcagauaa

SEQ ID NO: 38031 - RNA, 1617 nt, Artificial Sequence
  derived and/or modified sequence opt11 from VP1__Norovirus_and/or_Norovirus-like__AB541280
augaaaauggcuucuaacgacgcaaaucccuccgauggauccgcugccaaccuaguccccgaagugaacaacgaaguaauggcccucgaaccugucgucggcgccgccaucgcagcccccgucgcaggacaaaccaacguuauagaucccuggauccguaacaacuucguccaagcccccggaggcgaauuuacuguaucgccccgaaacgccccaggcgaaauccucugguccgcagcacucggaccagaucuaaaccccuaccuuagccaccucgcccgcauguacaacggcuacgcuggcggcuucgaaguacaagucauccuagccgguaacgcauucacagccggcaaaaucaucuucgcugccgucccacccaacuuccccaccgaaggccuauccccaucccaagucacaauguucccccacaucaucgucgauguccgccagcucgaacccguccucauaccccuacccgacguucgcaacaacuucuaccacuacaaccaaucaaacgacucaaccauaaaacuuaucgcaaugcucuacacaccccuacgcgcaaacaacgcuggagaagacguauucaccguaucaugccggguccuaacccgccccucccccgacuucgacuucaucuuccucgucccacccacagucgaaagccgcacaaaacccuucaccguccccauccucacagucgaagaaaugaccaacucgagauuccccaucccucucgaaaaacuauucaccggccccucaggcgccuucguuguccaaccccaaaacggccgcugcaccaccgacgguguccuacuggggacuacacaacuuagccccgucaacauaugcacauucagaggcgacguaacccacaucgccggcagccgcaauuacaccaugaaccuagcaucacuaaacuggaacaauuaugaccccaccgaagaaauaccugccccacuuggaacccccgacuucgucggcaaaauccagggaguccuaacccagaccaccaaaggcgauggauccacccgaggccacaaagcaaccgucuauaccggcucagcccccuucacucccaaacuaggauccguccaauucuccacugacaccgaaaacgacuucgaaacccaccagaacaccaaauucacaccaguaggagucauccaagacgguuccacaacccacagaaacgaaccccaacaauggguucuccccucauacuccggacgcaauguacacaacguccaucucgcucccgccgucgcccccaccuuccccggcgaacaacuccucuucuuccgcuccacaaugccaggcugcucuggcuacccgaacauggaccucgacugccuacucccccaagaauggguccaacacuucuaccaggaagccgcacccgcccaauccgacguagcccuacuacgcuucgucaacccugacacaggccgcguucuuuucgaaugcaaacuccacaaauccggauacgugaccgucgcccacacuggccagcacgaccuagucaucccucccaacggcuacuuccgauucgacucaugggugaaccaauucuacacccucgccccuauggguaacggcacaggucgacgcagauag

SEQ ID NO: 38032 - RNA, 1617 nt, Artificial Sequence
  derived and/or modified sequence opt11 from VP1__Norovirus_and/or_Norovirus-like__AB541244
augaagauggccuccaaugacgcaaaccccuccgacggauccgccgcaaaccuaguccccgaagucaacaacgaaggcauggcacucgaacccgucguaggcgccgccauagcagcccccgucgccggccaaaccaacgucauagacccuuggauccgcaacaacuuuguccaagccccaggcggcgaguucaccgucucuccccgaaacgcaccuuccgaaauccucugguccgccucacucggcccagaccuuaacccauaccucucccaccucgcacgaauguacaacggauacgccggcggcuucgaaguccaagucauccucgccgguaacgccuucacagcuggcaaaaucaucuucgccgcuguuccuccaaacuucccaaccgaaggccuaagcccaucacaaguaaccauguucccacacaucaucgucgacguccgacaacucgaacccguccuaaucccccuacccgacgucagaaacaacuuuuaucacuacaaccaauccaacgacuccaccaucaagcucaucgcaaugcucuacacaccacuccgcgcuaauaacgcaggagaagacgucuucaccguauccugccgcguacugacccgcccgucaccagacuucgacuucaucuuccuagucccucccacaguagaaucacgcaccaagccauucaccguucccauccucaccgucgaagaaaugaccaacucacgcuucccaauaccuuuagaaaaacuauucaccggacccucaggugccuucgucguccaaccacagaacggacgaugcacuacagacggcguccuccuaggaaccacccaacuaucacccgucaacaucugcaccuuccgcggagacguuacccauauugccggaucacgaaacuacacaaugaaccucgcaucacuaaacuggaacaauuacgaccccaccgaagaaaucccagccccucucggcaccccggacuucguaggaaaaauacaaggcguacuaacgcaaacaaccaaaggcaacggcucuacucgcggccacaaagccacggucuacaccgguuccgccccguucacuccgaaacucggaucaguacaauuuucuaccgauaccgaaaacgacuucgaaacccaucaaaacaccaaguucacccccguagguguaauacaagacggcagcaccacccaccguaacgaaccccaacaauggguccucccauccuacuccggacgcuccguccacaacguccaccuugcacccgccguugcccccacauuccccggugaacaacuucucuuuuuccgcuccaccaugcccggcugcucaggcuacccaaacauggaccucgacugccuccuaccacaagaauggguccaacacuucuaccaagaggccgccccagcccaaucagacgucgcccuccuccguuucgucaaccccgacaccggccgcguacuauucgaaugcaaacuccacaaauccggauacgucacagucgcacacacuggacaacacgaccucguaaucccacccaacggcuacuucagauucgacuccugggucaaccaauucuauacccucgcccccaugggcaacggaaccggaagaagacgcuag

SEQ ID NO: 38033 - RNA, 1617 nt, Artificial Sequence
  derived and/or modified sequence opt11 from VP1__Norovirus_and/or_Norovirus-like__AB541203
augaagauggcaucaaacgacgcaaaccccuccgacggcuccgccgccaaccuaguaccagaagucaacaaugaagucauggcccuagaacccguagucggcgcagcuaucgcagccccaguagcaggccaaacaaacguaaucgacccauggaucagaaacaacuucguccaagcacccggaggagaguucacagucagcccccgcaacgccccaggagaaauccuaugguccgccccucucggccccgaccucaacccauaccucucccaccuagcacgcauguacaacggauacgcgggcggcuucgaaguacaaguaauccucgccgguaacgcuuucaccgcagguaagaucaucuucgcagcagucccacccaacuuccccacagaaggacucucucccucccaagucacaauguucccucacaucaucgucgacgucagacaacuagaacccguacugauaccccuccccgacguccgaaacaauuucuaccacuacaaccaaucuaacgacagcacuaucaaacucaucgccaugcucuacacaccccuccgcgcaaacaacgccggggaagacgucuuuaccgucagcugccgcguccucacccgcccaagccccgauuucgacuucaucuuucucgucccucccaccguugaaucccgcacuaagcccuucaccguccccaucuuaaccgucgaagaaaugaccaacucccgcuucccgaucccacuagaaaaacucuucacaggccccuccggagcauucgucguccaaccccaaaacggccgcugcaccaccgacggaguacuccuaggcaccacccaacucucccccguaaacaucugcacuuuucgcggcgacguuacccacaucgucggcucucguaacuacaccaugaaccucgcuucacuaaacuggaacaacuacgaccccaccgaagaaaucccugccccacuaggcaccccagacuucgucggaaaaauccagggcguccuaacccagaccacaaaaggcgacgguuccacacgcggacacaaagccacugucuacaccgggucagcucccuucacccccaaacucggauccguccaauucuccaccgacaccgaaaacgacuucgaagcacaccaaaacaccaaauucacucccgucggagucauccaagacggcucuacaacccaccggaacgaaccccaacaauggguauuaccaagcuacucuggacgcaauguccaaaauguccaccuagccccagccgucgccccuaccuuuccuggagaacaacuacucuucuuccgcuccaccaugccaggaugcuccggcuacccaaauauggaccucgacugccuacuuccacaagaauggguccaacacuucuaccaagaagcagcaccagcccaauccgacgucgccuuacuaagauuugucaaccccgacacaggccguguacucuucgaaugcaaacuccacaaaucuggcuacguuaccgucgcccacacaggccaacacgaccucgucauacccccaaacgguuacuucagauucgacucaugggucaaccaauucuacacccucgcucccaugggcaacggcaccggccgccgucgauaa

SEQ ID NO: 38034 - RNA, 1617 nt, Artificial Sequence
  derived and/or modified sequence opt11 from VP1__Norovirus_and/or_Norovirus-like__GQ850882
augaaaauggcauccaacgacgccaaccccuccgacggauccaccgccaaucuaguccccgaaguaaacaaugaagucauggcccucgaaccaguaguuggcgccgcgauagcugcccccgucgccggccaacaaaacgucauagacccauggauacgaaacaauuucguccaagcuccaggcggagaguucaccguaucuccccgaaacgcuccaggcgaaauccuauggucagcgccccucggcccugaccucaacccauaccuaucucacuuagcccgaauguacaacggcuaugccggggguuucgaaguccaagucauacucgccggaaacgccuucaccgcaggaaaaauaauauucgcagcaguuccaccuaacuuccccacagaaggccuaucucccucacaaguaacaauguucccccacaucaucgucgacguccgccaacuagaacccguacucauaccacuccccgacguccguaacaacuuuuaccacuacaaccaaagcaacgacccaacuauuaaauuaaucgcaaugcucuacacaccacuccgcgcaaacaacgccggcgacgacguauucaccguaucaugccgcguccuuacccgccccucacccgacuuugacuucaucuuucucguacccccaaccguggaaucacgcaccaaacccuucaccgucccaauccucaccgucgaagaaaugaccaauucccgcuucccuauuccacucgaacgccuauacacaggaccaagcuccgccuucgucgugcaaccacaaaacggccgaugcaccacugacggaguacuccucggcaccacucagcucuccgcagucaacaucugcaccuuccgaggcgacgucacccauaucgccggaucacgcaacuacaccaugaaccucgcuucacagaacuggaacaacuacgacccaaccgaagaaauccccgcaccccucggcacacccgacuucgucggcaaaauccaaggaaugcucacccaaacaaccagauccgacggcuccacccguggucauaaagccaccgucuucaccggauccgccgacuucgcccccaaacuaggacgcguccaauucgccacagacacagacaaugacuucgaauccggucagaacacuaaauucaccccaguuggcgucauccaagacgguuccacuacccaucgcaacgaaccacaacaauggguccuccccaacuauucaggucgcaccggucacaacguccaccucgcccccgccgucgccccaaccuacccaggcgaacaacuccucuucuuccgauccaccaugccaggcugcuccggcuaccccaacauggaccuagacugccuccucccacaagaauggguccaacacuucuaccaagaagccgccccagcccagucagacgucgcccuacucagauucgucaaucccgacacaggccgcguacucuucgaaugcaaacuacacaaauccggcuacguaaccgucgcccauaccggccaacaugaccuagucaucccacccaacggcuacuuccgcuucgacuccuggguaaaucaauucuacacccucgcacccaugggcaacggcacaggucgacgccgguaa

SEQ ID NO: 38035 - RNA, 1617 nt, Artificial Sequence
  derived and/or modified sequence opt11 from VP1__Norovirus_and/or_Norovirus-like__KR131772
augaaaauggcuuccaacgaugccacgcccuccgacggcucaaccgccaaccucguccccgaagucaacaacgaagucauggcacucgaaccugucgucggcgcugccaucgcugccccagucgccggacagcaaaacguaaucgaccccuggauccgaaauaacuucguccaggccccaggcggcgaguucaccguaucaccccgaaacgcaccaggcgaaauccucugguccgcaccccucggcccugaccucaaccccuaccuaucucaccuagcccgaauguacaacggcuacgccgguggcuucgaaguacaaguaauacuagccggaaacgccuucaccgcaggcaaaaucauuuuugcugccguuccacccaacuuccccacagaaggccuaucccccucacaagucaccauguucccacacauaaucguagacguccgccaacuagaacccgugcucauaccccuaccagauguccgcaacaacuucuaccacuacaaccaauccaacgacccaacuaucaaacuuaucgcaaugcucuacacgccccugcgcgcaaauaacgcaggagacgaugucuucaccgucucaugccgugugcuaacccgacccucccccgacuuugacuucaucuuccuagucccacccaccgucgaaucacgcaccaagcccuucuccguucccauccucaccguagaagagaugaccaacucgcgauuccccauuccccucgaaaagcuguucaccggcccauccuccgcauucguaguccaaccacaaaacggccgaugcacaacagacggcguccuccucggaacuacccagcucuccccaguaaacaucugcaccuuccgaggcgacgucacccacaucaccggcucccgcaacuacaccaugaaccucgccacacaaaacuggaacuccuacgaccccacugaggaaaucccagcacccuuaggaacccccgacuucgucggaaaaauccaaggaguccucacucaaaccacccgcgccgacggcuccacccgcggccacaaagccaccgucuacaccggcucagccgacuucgcacccaaacugggucgaguccaauucgcuaccgacacagacaacgacuucgacgccaaccaaaacaccaaauucacgcccguaggagucauucaagacggaaacaccgcucaccgcaaugaaccccaacaauggguacucccaucauacuccggacgcaacucacacaacguacaccucgccccagccgucgcaccaacauuccccggagaacaacuccucuucuucagguccacaaugccaggcugcucuggauaccccaauauggaccuagacugccuccucccccaagaauggguacaauacuucuaccaagaggccgcaccagcccaaucagaugucgcccuacuucgauucgucaaccccgacaccggccgcguccucuucgaaugcaaacuacauaaauccggcuacguaacggucgcacacacaggacaacacgaccuagucauaccaccuaauggcuacuuccgcuucgacuccuggguuaaccaauucuacacucucgccccaaugggaaacggcaccggacgccgcagauaa

SEQ ID NO: 38036 - RNA, 1617 nt, Artificial Sequence
  derived and/or modified sequence opt11 from VP1__Norovirus_and/or_Norovirus-like__KR904215
augaaaauggcaaguuccgacgccaaccccuccgauggcucagccgcuaaccuaguccccgaaguuaacaacgaggucauggcacuagaacccgucgucggcgccgccauagccgcacccgucgccggacaacaaaacgucauugaccccuggauccgcaacaacuucguccaagcccccggaggugaguucaccguuucuccccgcaacgcccccggcgaaauccuuugguccgccccucucggcccagaccucaaccccuaccucucccaccuggcccgaauguacaacggauacgccgguggcuucgaaguccaaguaauucuagccggcaacgccuucacugccggaaagaucaucuucgccgccgucccacccaacuuccccacagaaggucuaucccccucucaaguuaccauguucccccacauuaucgucgacguacgccaacucgaacccguccuaaucccccuccccgacguccguaacaacuuuuaccacuacaaccaauccaacgacccaacuauaaaacucaucgccaugcuuuacacaccccuacgcgcaaacaacgccggcgacgacgucuucaccgucucaugccgcguccuaacccguccaucacccgacuucgacuucaucuuccucguuccucccaccgucgaauccagaacaaaacccuucuccguacccauacucacaguagaagaaaugaccaacucccgcuuccccauaccacucgaaaaacucuucaccggccccuccucagccuucgucguacaaccccaaaacggccgcugcacaaccgacggcguacuccuaggaaccacucaacuaaguccaguaaacaucugcacuuuccgcggcgacguaacccacaccacaggcucccauaacuacaccaugaaccucgcaacacaaaacugguccagcuacgacccaaccgaagaaaucccggccccacucggcacccccgacuucgucggcaaaauccaagguguacuaacccaaacuacaaaaaccgacgguucgacccgcggccacaaagccacaguuuacacaggcuccgccgauuucgcacccaaacucggacgaguccaguuugccaccgacaccgacaacgacuucgaagcaaaucaaaacaccaaauucacccccgucggcgucauccaagacggcaacaccgcacaucgcaacgaaccacaacaauggguccuacccuccuacucaggccgcaacacacacaacguucaccucgcacccgccguugccccaaccuucccuggcgaacaacuccuguucuuccgcuccaccaugcccggcugcuccggcuaccccaacauggaccuugacugccuacuuccccaagaauggguccaauacuuuuaccaagaggcugcaccagcucaauccgacguagcccuacuccguuucgucaaccccgacacaggccgaguucucuucgaaugcaaacuucauaagucaggcuacguaacugucgcacauaccggaccgcaugaccucgucaucccacccaacgguuacuuccgcuucgacuccugggucaaccaauucuacacccuugcccccaugggaaacggaaccggccgcagacgauaa

SEQ ID NO: 38037 - RNA, 1617 nt, Artificial Sequence
  derived and/or modified sequence opt11 from VP1__Norovirus_and/or_Norovirus-like__AB933715
augaaaauggcgagcaacgacgccaaccccucagacggcucagcagcaaaccucguacccgaagucaacaacgaaguuauggcacucgaacccgucguaggcgccgccaucgcugcacccgucgcaggacaacagaacguaauagacccauggauacgcaacaacuucguccaagccccaggcggcgaguucaccgucucccccagaaacgcccccggcgaaauucucuggucagcgccccuuggacccgaccuuaacccguaccucucacaccuagccagaauguacaacggcuacgcuggcgguuuugaaguacaagucauccucgccggcaacgccuucacagccggaaaaauuaucuuugccgccguaccucccaacuuccccaccgaaggccucucaccaucccaagucaccauguucccucacauaaucguagacguccgccaacucgaacccguccuaauaccccuccccgacguccgcaacaacuucuaccacuacaaccaauccaacgacucgaccauaaaacuaauagcaaugcuauacacaccccugcgcgccaacaacgccggagaagacgucuuuaccgucuccugccgcguccuaacccgccccucccccgacuucgacuuuauuuuccuaguaccucccaccgucgaaucucguacaaaacccuucaccguacccauccuuaccgucgaagaaaugaccaacucucgcuuucccauaccacuagaaaaacuauucaccggacccuccuccgcuuucgucguccaaccccaaaacggccgcugcacuaccgacggcguccuucucggaacaacccaacuaucccccgucaacauuugcacauuccggggcgacgucacacacauagccggaucucgcaacuacaccaugaaucucgccucacuaaacuggaacaacuacgaucccaccgaagaaauccccgccccacucggcaccccagacuucgucggaaaaauacaaggcguacucacccaaacaaccaaaggugacggaucuacccgaggacacaaagccacagucuacacaggcuccgcacccuucacccccaaacucggauccguccaguucggcaccgacaccgaaaacgacuucgaaacccaccaaaacacuaaauuuacccccgucggcguaauacaagacggcggcacaacacaccgaaacgaaccccaacaguggguacuccccagcuacucuggaagaaacguccccaacguacaucucgcacccgccgucgcccccaccuuccccggcgaacaacuccucuucuuccgcuccacaaugcccggaugcuccggcuacccaaacauggaccuugacugccugcucccucaagaauggguucaacauuucuaccaagaagcugcccccgcucaaucagacguagcccuacuccgcuucgugaauccagauaccggccgcguccucuucgaaugcaaacuccacaaauccggcuacgucacagucgcccacaccggccaacacgaccuagucaucccacccaacggcuacuuccgauuugauucuugggucaaccaauucuacacacuagcccccaugggcaacggcacaggucgacgccgcuaa

SEQ ID NO: 38038 - RNA, 1617 nt, Artificial Sequence
  derived and/or modified sequence opt11 from VP1__Norovirus_and/or_Norovirus-like__AB933695
augaaaauggcauccaaugacgccaacccaucagacggaucugccgccaaccuaguccccgaaguuaacaacgaaguaauggcccuugaaccaguugucggagccgccaucgccgcccccguugccggccaacaaaacgucaucgaccccuggauccgcaacaacuucguccaggccccaggcggcgaguucacagucucaccccgcaacgcuccaggagaaauccucugguccgcuccccuaggccccgaccugaacccauaccucucccaccucgcacguauguacaacggcuacgccgguggcuucgaaguacaagucauccuugccggaaacgcauucaccgccggaaaaauaaucuucgcagccguaccaccaaacuucccaaucgaaggacucucccccucucaagucaccauguucccucacauaauugucgacguccgacaacucgaacccguccucauuccccuccccgacguccgcaacaacuucuaccauuacaaccaauccaacgacuccaccauaaaacuaaucgcuaugcucuacaccccucuccgugccaacaacgcuggcgaagacguguucaccgucuccugccguguccuaacccgcccaucaccagacuucgacuucauauuucuugucccacccacuguagaaagccgcaccaaacccuucacaguccccauacuuaccgucgaagaaaugaccaacucccgauucccaauaccccucgaaaaacuuuuuaccggcccgucaucugccuucgucguccaaccccaaaacggacgaugcacaacagacggcguacuccucggcacuacccaacucucccccguaaacauuuguacauuccgcggagacguuacacacaucgccggaucacacaacuacacaaugucccucgccucccucaacuggaacaacuacgacccaaccgaagaaauccccgcaccccucggcacccccgacuucgucggcaagauccaaggcguacucacccaaaccacuaaaggcgacggcucgacacgcgggcacaaagccacggucuacaccgguuccgccccauucacccccaaacucggcuccguccaauucucaacagauaccgaaaacgacuucgaaacacaccaaaacaccaaguucacccccgucggcguuauacaagacggcggaacaacucaccgcaacgaaccccaacaauggguccucccuucauacuccggccguaacguccccaacgugcaccucgcacccgccgucgcccccaccuucccuggcgaacaacuucucuucuuccguucuaccaugcccggcugcuccggauaucccaacauggaccucgacugccuccucccccaagaauggguacaacacuucuaccaagaagccgcaccggcccaaucugacguagcccuccuuagauuuguuaaccccgacacaggucgcguccuguucgaaugcaaacuccacaaauccggauacguuaccgucgcccauacaggccaacacgaccuagucaucccucccaacggcuacuuccguuucgacuccugggucaaucaauuuuacacccucgcacccauggguaacggcacuggucgccgacgcuaa

SEQ ID NO: 38039 - RNA, 1617 nt, Artificial Sequence
  derived and/or modified sequence opt11 from VP1__Norovirus_and/or_Norovirus-like__AB933681
augaaaauggccuccaacgacgccaaccccuccgacggcucagcagcuaaccuaguucccgaagucaacaacgaaguaauggccuuagaacccgucguaggcgcagcaauagcagcccccgucgcaggccagcaaaacguaaucgaccccuggauacgcaacaacuucguccaagcacccggaggcgaauuuaccguaucaccucguaacgcacccggagaaauccucuggucagcaccacucggacccgaccucaaccccuaucugucccaccucgcacgcauguacaacgguuacgcaggcggcuucgaaguccaagucauacucgccggcaacgccuucaccgccgguaaaaucaucuucgccgccgucccucccaacuuccccaccgaaggacucuccccaucacaaguaaccauguucccccacaucaucgucgacgugcgccaacucgaacccguacucauaccacuucccgacguccgcaacaacuucuaccacuacaaccaaucgaacgacuccaccaucaaacucaucgcuaugcuauacacaccacuucgugcaaacaaugccggcgaagacgucuucaccgucuccugccgcguccucacccgccccagcccagacuucgacuucauauuccuagucccgcccaccguggaaucccgcacaaaacccuucacugucccaauccucaccgucgaagaaaugacaaauucccgcuucccuauuccccuugaaaaacucuucacaggacccuccuccgccuucgucguccaaccgcaaaacggccgcugcaccaccgacggcguacuacuggggaccacccaacucagccccgucaacaucuguaccuuccguggcgacgucacacacaucgccggcucucgcgacuacacaaugaaccucgccucacuaaacuggaacaacuacgaccccaccgaagaaauccccgcaccucucggaaccccugacuucguaggcaaaauacaaggcguccucacccaaaccaccaaaggagacggcucaacucgaggacacaaagccaccgucuacaccggcucagccccauucacucccaagcuaggguccguccaauucuccaccgacaccgaaaacgacuucgaaacacaccaaaaugccaaauucacucccgucggcgucauccaagauggcuccacaacccaccgcaacgaaccacaacaauggguccucccauccuacagcggccgcaacguccccaacguacaccucgcuccugcagucgcccccaccuuuccaggcgaacaacuccucuucuuccgcagcaccaugccuggaugcuccggcuacccgaacauggaucucgacugucuucucccccaagaauggguccaacacuucuaccaagaagccgcccccgcccaauccgacgucgcccuacuacgcuuugucaacccagacaccggacgcguccucuucgaaugcaagcuacacaaauccggcuaugucacuguagcccacaccggccaacacgaccuaguaauacccccaaacggauauuuccgcuucgacagcugggucaaccaauucuacacgcuagcacccaugggcaacgguaccggacgccgccguuaa

SEQ ID NO: 38040 - RNA, 1617 nt, Artificial Sequence
  derived and/or modified sequence opt11 from VP1__Norovirus_and/or_Norovirus-like__AB933675
augaaaauggcaagcaacgacgcaaacccauccgacggcucagccgccaaccuuguccccgaagucaacaacgaaguuauggccuuagaaccagucgucggcgccgcaaucgccgcacccguugcaggccaacaaaacguaaucgacccauggauccguaacaacuucguccaagcccccggaggagaauuuacagucucccccagaaacgccccaggagaaauacucuggucagccccacuaggaccggaccucaaccccuaccucucccaccuugcccgaauguacaacggauacgcaggcggcuucgaaguacaaguaauccuugcaggcaacgccuucacagccggaaagaucauauucgccgcaguacccccaaauuucccaacagaaggacuaucaccaucccaagucaccauguucccacauaucaucgucgaugucagacaacucgagccaguccucaucccccucccagacguccgcaacaauuucuaucacuacaaccaauccaacgacuccaccauaaaacucaucgcuaugcuuuacacaccccugcgagccaacaaugcaggcgaagacguauucaccguauccugccgcguacuaacccgucccucccccgacuucgacuucauuuuccuuguaccgcccaccguagaaucccgcacuaaacccuucaccguacccguccucacgguagaagaaaugacaaacuccagauucccaauuccccuagaaaaacucuucaccggcccaucauccgccuucguaguccaaccacagaacggacgcuguaccaccgacggaguacuccucggaaccacccagcuaucccccgucaacaucugcacauuccgcggcgacgucacacacaucgccaauucacacaacuacacaaugaaccucgcuucccucaacuggaacaacuaugacccaacagaagaaauccccgccccacuaggaacuccagacuucgucggcaaaauacaaggcguacuuacacaaaccaccaaaggcgacggcagcacccgaggacacaaagccaccgucuacaccggauccgcccccuucacccccaagcucggcucuguccaguucuccaccgacaccgaaaacgacuucgaaacccaccaaaacacuaaauucacccccgucggcgucauccaagacggcggcaccacacaccgcaacgaaccacaacaauggguacuuccgucauacucaggucgaaacguccaaaacguccaccucgcccccgccguugccccaaccuuccccggagaacagcuccuguucuuccgcucaacaaugccaggaugcucaggcuacccgaacauggaccuagacugccuccuaccucaagaauggguccaacacuucuaccaagaagccgcgccagcacaaagcgacgucgcccuccuccgcuucgucaaccccgacacaggacgcguccucuucgaauguaaacugcacaaauccggcuacguaacaguagcccacaccggacaacacgaccuaguaaucccacccaacggauauuucagauucgacagcugggucaaccaauucuacacacucgcccccaugggcaacggcaccggcagacgccguuaa

SEQ ID NO: 38041 - RNA, 1617 nt, Artificial Sequence
  derived and/or modified sequence opt11 from VP1__Norovirus_and/or_Norovirus-like__AB933652
augaaaauggccuccaacgacgcuaacccauccgacggauccgccgcuaaccucguacccgaaguuaacaaugaagucauggcccucgaacccguugucggcgcagccaucgccgcacccguagccggacaacaaaacguaaucgacccauggauccgaaacaacuucguacaagcacccggcggagaguucaccguaucaccccgcaaugcccccggcgaaauccuauggucagcaccccucggacccgaucuaaaucccuaccuuucucaccuugcaagaauguacaacggcuacgccggaggcuucgaaguacagguaauucucgccggcaacgcauucacagcaggcaaaaucaucuucgccgccguacccccuaacuuccccaccgaaggacucucccccucccaagucacuauguuuccccacaucaucguagacguccgccaacuggaaccaguccuaaucccgcugcccgauguccgcaacaacuucuaccacuauaaccaauccaacgacuccaccauaaaacucauagcgaugcuauacacaccccuccgcgcaaacaacgcuggcgaagaugucuucaccgucuccugccgcguucugacccgacccuccccagacuucgacuuuaucuuccuaguaccgcccaccguugaaucccgaaccaaacccuucacaguacccauccucaccgucgaagaaaugaccaauucccgauuccccaucccccucgaaaaacuauucaccggacccuccagcaccuucguaguccaaccccaaaacggccgaugcaccacugacggcguucuacugggaaccacccaacuaagccccgucaacaucugcaccuucagaggcgacgucacccacaucgcaggcucacgcaacuacacaaugaaccucgcgucccucaacuggaauaacuacgacccaaccgaagagauccccgcaccccucggaacccccgacuucgucggaaaaauacaaggcguacucacacaaaccaccaaaggagacggcagcacaagaggccacaaagccacugucuacaccggcucagccccauucacccccaaacucggaucaguacaauucggaaccgacaccgagaacgacuucgaaacacaccaaaauacaaaauucacacccguuggcgucauccaagacggaggaacgacacaccgaaacgaaccucaacaauggguacuaccaucauacucaggaagaaauguacccaacguacaccucgcccccgcagucgcccccaccuucccaggcgaacaacuccuguucuuccgcuccacaaugccugggugcuccggauaccccaauauggaccucgacugccuacucccucaagaauggguacaacacuucuaccaagaagccgcacccgcacaauccgacguugcccuccuacguuucguaaaccccgacaccggccgagugcucuuugaaugcaaacuccacaaauccggcuacgucaccgucgcccacaccggccaacacgaccuagucauaccuccaaacggcuacuuccgcuuugacagcugggucaaccaauucuacacacucgcccccaugggcaacggaacaggccgccgaagauaa

SEQ ID NO: 38042 - RNA, 1617 nt, Artificial Sequence
  derived and/or modified sequence opt11 from VP1__Norovirus_and/or_Norovirus-like__KF429762
augaaaauggccuccaacgacgccaacccgagcgacgguucagccgccaaccucguaccggaaguaaacaacgaagucauggcacucgaacccgucguaggcgcagcaaucgccgcccccguagccggucaacaaaacgucauugaccccuggauucgaaacaauuucguacaagcccccggaggcgaauuuaccguaucaccccgcaacgccccuggcgaaauccucugguccgccccacucggcccagaccuaaacccauaccucucccaccucgcccgaauguacaacggcuacgcgggcggauucgaaguccaaguaauccucgccggcaacgcauucaccgcaggcaaaaucaucuucgccgcagucccucccaauuuccccaccgaaggacuaucacccucccaggucaccauguucccacacaucaucgucgacguacgccagcucgaaccuguacucauccccuuacccgacguccgaaacaacuucuaccacuacaaccaguccaacgacucuacaaucaaacucaucgccaugcucuacacaccccuuagagcuaacaacgccggcgacgauguuuuuaccguauccugccgcguacucacccggccaucccccgacuucgacuucaucuuccucguaccacccaccgucgaaucucgaaccaaacccuucucaguacccauacuaaccgucgaagaaaugaccaacucccgauuucccauaccccucgagaaacuguucaccggaccaucuuccaccuucgucguacaaccccagaacggacgcugcaccaccgacggcguccuacucggcacuacacaacucucccccguaaacaucugcaccuuccgaggcgacguuacccacaucaccggaucacguaacuacacaaugaaccucgccucacaaaacuggaacucguacgaccccaccgaagaaauccccgcaccccucggaacccccgacuucguaggcaaaauacaagguguccucacccaaacuaccagaacagacggaucaacccgaggccacaaagccaccgucuacacaggcuccgccgauuucucaccaaaacucggccgcguacaauucgccaccgacacagacaacgacuucgacgccaaccaaaacaccaaauuuaccccugucggcgucauacaagacggcggcaccacccacagaaaugagccccaacaauggguacuacccucauacagcggccgcaacacccacaacguucaccuagcccccgccgucgcaccaaccuuccccggcgaacaacuccucuucuuccggucuacaaugccaggcugcuccggauaccccaacauggaccuugacugccuacuuccccaagaauggguccaacacuucuaccaagaagcagcgccagcccaauccgauguagcacuacuucguuucgucaacccagacaccggccgcguccucuucgaaugcaaacuucacaaauccggauaugucaccguagcccacaccggacaacacgaccucgucaucccacccaacggauauuuccgcuucgacucaugggucaaccaauucuacacacuagccccaaugggcaauggcaccggacgccgccgcuaa

SEQ ID NO: 38043 - RNA, 1617 nt, Artificial Sequence
  derived and/or modified sequence opt11 from VP1__Norovirus_and/or_Norovirus-like__JX644027
augaaaauggcauccaacgacgccaaccccucagacgguuccgccgcuaaccuuguccccgaggucaacaacgaaguaauggcacucgaacccguaguaggcgccgccaucgccgcccccgucgccggccaacagaauguaaucgacccauggauaagaaacaauuucguccaagcccccggcggcgaguucaccguaucuccccgaaaugcccccggcgaaauacuauggucagcaccccuaggcccagaccucaaccccuaccucucccaucucgcccgaauguacaacggcuacgccgggggcuucgaaguccaagucauacucgccgguaacgccuucacagccggcaaaaucauuuucgccgcagucccaccaaacuuccccacggaaggacucuccccuagccaaguaaccauguucccccacaucaucguagacguccgccaacucgaacccguacucaucccccuccccgacguccgcaacaacuucuaccacuacaaccaaucaaacgacuccaccaucaaacuaaucgccaugcucuacacuccccuccgagccaacaacgcuggugaggacgucuucaccgucagcugccgcguccucacccgaccaagccccgacuuugacuucaucuuccucgucccacccaccguagaauccaaaacaaaacccuucaccgucccaauacugacaguagaagaaaugacuaacucccgcuucccuaucccccuagaaaaacuauucaccggucccuccagcgccuucgucguucaaccccaaaacggaagaugcaccacagauggaguccuccucgggaccacccaacugucuccugucaacauaugcaccuuccgcggcgacguaacccauaucgccggaucacgcaacuacacaaugaaccucgcuucccucaacuggaacaacuacgacccaacagaagaaauccccgcaccgcuaggcacacccgacuucguagguaaaauccaagggguccucacacaaaccaccaaaggcgacggcucaacccgcggacauaaggcuacagucuacaccggaucugcccccuucacucccaaacucgggagcguccaauucucuaccgacaccgaaaacgacuucgaaacccaccaaaacaccaaauucacccccgucggcgucauccaagacggcucaacaacgcaccgcaacgaaccccaacaguggguccucccuucauauuccggccgaaacgcccaaaacguccaccucgcccccgccgucgccccaacauuccccggugaacaacuccucuucuuccguuccacaaugcccggcuguuccggcuaccccaacauggaccuagacugccuccucccacaagaauggguccaacacuucuaccaagaagcagccccagcccaaucagacgucgcacuucuccgcuucgucaacccugacaccggacgcguccuguucgaaugcaaacuccacaaaucaggcuacgucaccguagcccacaccggacaacacgaccuaguuauaccucccaacggcuauuuccgcuucgacuccuggguaaaccaauuuuacacccucgcacccaugggaaacggcacuggaaggcggcgauaa

SEQ ID NO: 38044 - RNA, 1617 nt, Artificial Sequence
  derived and/or modified sequence opt11 from VP1__Norovirus_and/or_Norovirus-like__JN400617
augaaaauggcaagcaaugacgcaucucccagcgacggcuccgccgccaaucuaguacccgaagucaacaacgaaguuauggcccuugaaccagucgucggcgccgccaucgccgcaccaguagccggacaacaaaacgucauagacccuuggauccgcaauaacuucguucaagccccaggcggagaguucaccgucuccccacgcaacgcccccggcgaaauccucuggucugcuccccucggcccagaccucaacccauaccuuucccaccucgcccgcauguacaacggcuacgccggcggcuuugaaguccaggucauccuugccggaaacgcuuucaccgcagguaaaaucaucuuugcagccguacccccaaacuucccaacagaaggucucucacccucccaagucaccauguuuccacauaucaucguagacguccgccaacucgaacccguccuaaucccacucccagacguccgcaauaacuucuaccacuauaaccaauccaaugacuccacaaucaaacucaucgcaaugcucuacacaccccuccgagccaacaacgcaggcgaagacgucuucaccguauccugccgaguacucacccgccccagccccgacuucgacuucauauuccucguaccucccaccguugaaucacgcaccaaaccauucaccgucccaauccucaccguagaagaaaugaccaauucacgcuuccccaucccccuagaaaaacuauucaccgggcccucaggcgccuuugucguccaaccccaaaacggccgaugcaccacagacggaguacuucuaggcaccacacaacuauccccggucaacauaugcaccuuccgcggcgacguaacacacauagcgggcagccgcaacuauacaaugaaccuagcagcccuaaacuggaacaacuacgaucccaccgaagaaauccccgccccacucggaacccccgacuucgucggcaaaauccaaggaguacuaacccaaacaaccaaagccgacggcuccacaagaggccacaaagccaccguauacaccgguucagccgacuucacccccaaacuuggcagcguccaauucucuacugacaccgaaaacgacuucgaaacccaccaaaacacaaaguucacacccguuggcguaauccaagacggcagcaccacccaucgcaacgaaccacaacaauggguccuacccuccuacuccggucgcaacguucaaaacguccaccucgcaccagccguggcacccaccuuccccggcgaacaacuccucuucuuucgauccaccaugccuggaugcuccggauacccaaacauggaccuagacugccuacuuccccaagaauggguccaacacuucuaccaagaagccgcaccagcacaauccgacguagcccuacuccgauucgucaaccccgacaccggacgcguccuauucgaaugcaagcuccacaaaucagguuaugucacugucgcccacaccggccaacacgaccucgugauaccacccaacggauauuuucgcuucgacucgugggucaaccaauucuacacccucgcaccaaugggcaacgguacaggccgccgucgcuga

SEQ ID NO: 38045 - RNA, 1617 nt, Artificial Sequence
  derived and/or modified sequence opt11 from VP1__Norovirus_and/or_Norovirus-like__JQ613519
augaagauggccuccaacgacgcaucccccuccgacggcuccgcagccaaccuaguaccagaagucaacaacgaaguaauggcccuagaaccaguagucggcgccgccaucgcagcacccgucgccggccaacaaaacgucauagaccccuggauacgcaacaacuucguccaagcccccgguggcgaguucaccgucuccccacgaaacgcccccggagaaauucuaugguccgcaccccuuggcccagaccugaaccccuaccucucacaccucgcccgcauguacaacggauacgcgggaggcuucgaaguccagguuauacucgcaggaaacgccuucacagcaggcaaaaucaucuucgcagccguuccacccaacuuccccacagaaggacucucccccucccaagucacaauguucccacacaucaucguugacguacgacaacucgaacccguccucaucccccuccccgacguccgaaacaacuucuaccacuacaaccaaucuaacgacagcaccaucaagcuaaucgccaugcuauacacaccccuccgagccaacaacgccggugaagauguauucaccguaucuugccgcguccucaccagacccuccccagacuucgacuucaucuuccuagucccacccaccguagaaucccgcaccaaacccuucacaguccccauccucaccguugaagaaaugaccaacucccgcuuccccaucccccucgaaaaacucuucacuggccccuccggagcguucgucguucaaccccaaaacggacggugcaccaccgauggcguccuucucggcaccacacaacucucacccgucaacaucugcaccuuccggggcgacgucacccauauagccggcucccguaacuacaccaugaacuuagcagcccucaacuggaauaacuacgaccccaccgaagaaauacccgcaccccuaggcaccccagacuucgucggcaagauccaaggcguacucacccaaaccaccaaagccgacggcucgacacgcggccacaaagcgaccguauacaccggcagcgccgacuucacaccuaaacucggcucaguacaauucuccacugacaccgaaaaugacuucgaaacccaucaaaacaccaaauucaccccugucggcguaauacaggacggcaacaccacacaccggaacgaaccacaacaaugggucuuaccaagcuacucaggacgcaacguccacaacguacaccuagccccagcaguagcucccaccuuuccaggcgagcagcuccuauuuuuccgguccaccaugccaggcugcucaggguacccaaauauggaccuggauugccuccuaccccaagaauggguccaacacuucuaccaagaagccgcaccagcacaauccgaugucgcacuccuacgauucgugaauccugacaccggccgcguucucuucgaaugcaaacuacacaaauccggauacguuacugucgcccacaccggacaacacgaccuugucauacccccaaacggcuacuuccgauucgacucaugggucaaccaauucuacacccuugcccccaugggcaacggcaccggccgccgccgcuaa

SEQ ID NO: 38046 - RNA, 1617 nt, Artificial Sequence
  derived and/or modified sequence opt11 from VP1__Norovirus_and/or_Norovirus-like__HQ456341
augaaaauggccucauccgacgccaaccccucagacggaagcacagcuaaccugguccccgaagucaacaacgaagucauggcucucgaaccagucguuggcgcagccauagccgcccccgucgccggucaacaaaacguaaucgacccguggauccgcuccaacuucguccaagccccagggggugaguucacaguguccccucgcaacgcccccggagaaaucuuauggucagcaccccucggacccgaccuaaaccccuaccuuucacaccuagcccgcauguacaacggcuacgccggcggcuucgaaguccaagucauccucgcaggaaacgccuucaccgccggaaaaauaaucuucgccgccgucccucccaacuucccuaccgaaggacucucacccucacaagucacaauguucccccacaucaucgucgacguacgucaacuugaaccaguccucauaccccuacccgacgucagaaauaacuucuaccacuacaaccaauccaacgacccaacuauaaaacuuaucgcaaugcucuauacuccacuccgagccaauaacgccggcgacgacguauucaccgucagcugccgcguucuaacgagaccaucccccgacuuugacuucaucuuccuuguuccacccaccgucgaaucacguaccaagcccuucuccguccccauccuaaccgucgaagaaaugaccaacuccagauuccccauaccccucgaaaagcuauucaccggccccagcuccgccuucgucguccaaccccaaaacggccgcugcacaacugacggcguauuccucggcacuacccaacuaucacccgucaacaucugcacauuccgcggcgacguaacccacaucaccggaucccgaaacuacaccaugaaccuugcaacccagaacuggaacucauacgaccccaccgaagaaauacccgccccacucggaaccccagacuuugucggcaaaauccaaggcguauuaacccagaccacacgcgccgacggcucuacccgcggccacaaagcaacggucuacaccgguucagccgacuucgcacccaaacuuggccgcguccaauucgcaaccgacaccgacaaugacuucgacgccaaccaaaauaccaaguucacccccgucggagucauacaagacggcgacaccgcccaccgcaacgaaccacaacaauggguccuucccagcuacuccggcagaaacagccauaacguccaccucgcgcccgccgucgccccaacauucccuggagaacaacuccucuucuuccgauccaccaugccuggcugcuccggauaucccaacauggaccuagacugccuacucccccaagaauggguacaauacuucuaccaagaagccgcaccagcacaauccgacguggcccuacuuagauucgucaacccagacaccggucgaguccuauucgaaugcaaacuacauaaaagcggcuacguaacaguagcccacaccggacagcacgaccuaguaaucccgcccaacggcuacuuccgauuugacagcugggucaaccaauuuuacacucuggccccaaugggcaacggcaccggcagacggcgcuaa

SEQ ID NO: 38047 - RNA, 1617 nt, Artificial Sequence
  derived and/or modified sequence opt11 from VP1__Norovirus_and/or_Norovirus-like__HM802540
augaaaauggcaagcaacgacgccacccccuccgacggcucuaccgccaaccucguccccgaaguaaacaacgaaguaauggcccucgaaccuguaguaggagccgccaucgccgccccagucgccggacaacaaaacgucaucgacccuuggauucgaaacaacuucguucaagcccccggcggcgaguucaccgucaguccccgaaacgcucccggugaaauacucuggucagcaccacucggccccgaccucaacccauaucuaucccaccucgcucgaauguacaacggcuaugccggcgguuucgaaguucaagucauacucgccggcaacgcauucaccgcaggaaaaaucauuuucgccgccguacccccaaacuuccccaccgaaggacucucucccucccaggucacaauguucccacacauaaucgucgacguccgacaacucgaacccguccuaaucccacuccccgacguccgaaacaacuucuaccacuacaaccaaucaaacgaccccaccaucaaauuaaucgcaauguuauacacaccccuccgcgcaaacaacgcaggagacgacgucuuuaccgucagcugccgcguccucacccgcccaagccccgacuucgacuucaucuuucucgucccacccacuguugaaucacgaacaaaacccuucuccguucccauccucaccgucgaggaaaugaccaacucccgauucccaaucccccuugaaaaacuauucaccggacccucuuccgcauucgucguccaaccacaaaacggccgcugcaccaccgacggcguccuccucggcaccacccaacucagccccguuaacauuugcaccuucagaggugacgucacucacaucgcuggcacacaaaacuacacuaugaaccucgccagccaaaauuggaacaacuacgaccccacagaagaaauacccgcaccccuaggcacaccugacuucguaggcaaaauucaaggaguccucacacaaacaacccgccgcgacggauccacccgcggacacaaagccacaguauccacuggcagcguccacuuuacccccaaacucggcucaguccaacucucaaccgacacaucaaacgauuucgagacuggccaaaacacccgauucacccccguaggcgucguccaagacggcuccacaacccaucaaaacgaaccccaacaauggguucuacccgacuacucaggccgcgacucacacaacguccaccucgccccagccgucgcaccuaccuuccccggcgaacaacuccucuucuuccgcuccacaaugcccgguugcuccggauaccccaacaugaaccucgacugccuccucccccaagaauggguccaacacuucuaucaagaaagcgccccagcacaguccgacgucgcccuacuccgauucgucaacccggacacaggacgagucuuauucgagugcaaacuacacaaauccggcuauguaaccgucgcccauacaggacaacacgaccucgucaucccacccaacggcuacuuccgcuucgauucauggguaaaucaauuuuacacacucgcccccaugggaaacggcgccggccgccgacgcuag

SEQ ID NO: 38048 - RNA, 1617 nt, Artificial Sequence
  derived and/or modified sequence opt11 from VP1__Norovirus_and/or_Norovirus-like__AB541257
augaaaauggccucaaacgacgcaaaccccucagacggcucugccgcaaaccucguacccgaagucaacaacgaagucauggcccuugagcccguugucggagcugcaaucgccgcccccguagccggccaaaccaacguaaucgaccccuggauccgcaacaauuucguacaagcccccggcggcgaguucaccguaagcccccgcaacgcacccggcgaaaucuuauggucggccccacuaggccccgaccucaaccccuaccucucacaccuagcacgcauguacaauggcuacgcaggaggcuucgaaguacaagucauccuagcagguaacgcauucaccgcaggcaagaucaucuucgccgcaguaccacccaacuuccccacagaagggcucucccccucacaaguaacgauguucccgcacaucauagucgacguccgacaacucgaacccguccuuaucccccuacccgacguccgcaacaauuucuaccacuacaaccaaucaaacgacucaacuaucaaacucaucgccaugcuauacacaccccuccgcgccaacaacgcaggcgaagacgucuucaccguauccugucgcguccucacacgaccaucccccgacuucgacuucaucuuccuggucccacccaccgucgaaucgagaacaaaacccuucaccguccccauccuaaccguagaagaaaugacaaacucccgcuucccaauaccccucgaaaaacucuucaccggaccuucaggcgccuucgucguccaaccccaaaacggccgcugcaccacagacggcguccuccuaggaacaacacaacuaucccccguaaacaucugcaccuuccgaggcgacgucacccacaucgcgggcucucgcaacuacaccaugaacuuagcaagccuuaacuggaacaacuacgaucccaccgaagaaauuccggcgccacuaggcacccccgacuucgugggaaaaauucaaggcguccucacccaaacaacaaaaggcgauggaucaacacguggccacaaggccacagucuacacgggcuccgcaccauucacccccaaacucgguuccguccaauucuccaccgacaccgaaaacgacuucgaagcccaucaaaacaccaaauucacaccagucggaguuauucaagacggcuccaccacacaccgcaacgaaccccaacaauggguccuaccauccuacuccggccgcaacgcucaaaacguccaccucgcuccugccguagcacccacauucccaggagaacagcuccucuucuuucgaucaacuaugccaggaugcucaggcuacccaaauauggaccucgacugccuccucccacaagaauggguccaacauuucuaccaagaagccgcucccgcccaauccgacguagccuuacucagauucguaaacccagacacaggccgcguacucuucgaaugcaaacuccacaaaucaggguacguaaccgucgcgcacaccggccaacacgaccuagucauacccccaaacggcuacuuccgcuucgacuccugggucaaccaauucuacacacuagccccaaugggaaacggaacaggccgccgcagauga

SEQ ID NO: 38049 - RNA, 1617 nt, Artificial Sequence
  derived and/or modified sequence opt11 from VP1__Norovirus_and/or_Norovirus-like__AB541242
augaagauggccagcaacgacgcaucccccucagauggcucugccgccaaccucguccccgaagucaacaacgaagucauggcccuagaacccguggucggcgccgcaaucgcagcacccguagccggccaacagaacgucauugaccccuggauccgaaacaacuucguccaagcacccggcggagaguucaccgucuccccucgcaacgcaccaggagaaauccuuugguccgccucacuaggccccgaccuuaacccauaccuaucccaccuagcccgcauguacaacggauacgccggcggcuucgaaguccaagucauacuagccggcaacgcauucaccgcugggaaaaucaucuuugcagcugucccacccaacuuccccacggaaggauuaagccccucacaaguaaccauguucccccacauaaucgucgacguccgccaacucgaacccguccuaaucccccucccugacguacguaauaauuucuaccacuacaaccaaagcaacgacucaacgaucaaacucaucgccaugcucuauacaccccuccgcgccaacaacgccggggaagacgucuucacagucagcugccgcguccucaccagaccaucccccgacuucgacuucaucuuccucguaccuccgaccguugaaucccguacaaaaccauucaccguaccaauccucaccgucgaagaaaugacaaacucgcgcuuuccaaucccauuggaaaaacuauucaccgggcccuccucagcguucgucguccaaccucaaaacggaagaugcacaaccgacggcguccuccuaggcacuacacaacuuucccccguaaauaucugcaccuuccgcggcgacgucacacacaucgcaggaagccgcaacuacaccaugaaccuagcauccuuaaacuggaacaacuacgacccgaccgaagaaauacccgcaccccuagguacucccgacuucgucggaaaaauccaaggcguccuuacacaaaccaccaaaggcgacggcucaacucgcggacacaaagccacagucuacacaggaucugccccauuuacccccaaacucggaagcguacaauucucaacagacaccgaaaacgacuucgaaacacaccaaaacacaaaguucacccccgucggcgucauccaagacggaggaaccacccaccgcaacgaaccacaacaauggguucucccauccuacuccggucgcaacguccaaaacguccaccucgcaccagccguagcacccaccuucccaggagaacaacuccuauucuuccgcuccaccaugcccggcugcuccggcuaccccaauauggaccucgacugucuacucccacaggaauggguucaacacuucuaccaagaagccgcacccgcccaauccgacguagcacuacucagauucgucaacccugacaccggccgcgucuuauucgaaugcaaacuacacaaaucuggcuacgucacagucgcccacaccggacaacacgaccuugucaucccacccaacggcuacuuccgcuucgacucaugggucaaccaauucuacacccucgcccccaugggcaacggcacaggccgacguagauaa

SEQ ID NO: 38050 - RNA, 1617 nt, Artificial Sequence
  derived and/or modified sequence opt11 from VP1__Norovirus_and/or_Norovirus-like__AB541225
augaaaauggccagcagcgacgccaaccccuccgacggcuccgccgccaaccucguccccgaaguaaacaacgaaguaauggcccuugaacccgucgucggagcagccaucgccgccccaguagccggccaacagaacgucaucgaccccuggauccguaacaacuucguacaagcacccggcggcgaguucaccguaagcccaagaaacgcccccggcgaaauccucuggucugcaccccucggccccgaucucaaccccuaccuuucccaccucgccagaauguacaacggcuacgccggcgguuucgaaguccaagucauccucgcaggcaaugcauucacagccggaaaaaucaucuucgccgcaguacccccaaacuucccaaccgaaggccucucacccucccaagucaccauguucccccacaucauuguagacguccgccaacucgaacccgugcuaaucccccuaccagacguccgaaacaacuucuaccacuacaaccaauccaacgacucaaccauuaagcucaucgccaugcucuacaccccgcuccgagcaaacaacgccggcgaagacgucuucaccgucucuugccgaguccucacacgccccucccccgacuucgacuucaucuuccugguaccacccacugucgaaucccgcacaaaacccuucaccguaccaauacucaccguagaagaaaugaccaauucacgauuccccauccccuuagaaaaacuguucaccggccccucaucagccuucgucguacagccccaaaacggaagaugcaccaccgacggcguccuccucgguaccacccaacucucaccaguaaacaucugcaccuuccgcggcgacgucacccacauagcuggcucccgcgacuacaccaugaaccuagccuccuuaaacuggaacaacuacgaucccacugaagaaaucccagcgccccuaggcacacccgacuucgucggcaagauccaaggaguacucacacaaacaaccaaaggagacggcucaacccgaggccacaaggccacaguauacacaggcuccgcccccuucaccccaaaacucggcucuguacaauucagcacagacaccggagacgacuuccaaacccaccaaaacacaaaauucaccccuguagguguaauccaagacggcggcaccacccacagaaacgaaccccaacaauggguacuccccuccuacuccggcagaaacguaccgaauguacaucucgcaccagcugucgcgccaacuuucccaggcgaacaacuacucuucuuccgaucaaccaugccaggcugcuccggcuaccccaacauggaucucgacugccuccucccccaagaauggguccagcacuucuaccaagaagccgccccggcccaauccgacgucgcccuacuucgauucgucaacccagacaccggccguguccuauucgaaugcaaacuacacaaagcaggcuacgucacagucgcgcacaccggccaacacgaccuagugauacccccaaacggcuauuuccgauucgacuccuggguaaaccaauuuuauacacucgcacccaugggcaacggcaccggccgucgaagauag

SEQ ID NO: 38051 - RNA, 1617 nt, Artificial Sequence
  derived and/or modified sequence opt11 from VP1__Norovirus_and/or_Norovirus-like__AB541190
augaaaauggccucuaacgacgccaacccauccgacggcuccaccgcuaaucucguaccagaaguaaacaacgaaguuauggcgcuagaacccguugucggcgcugccaucgccgccccugucgccggccaacaaaacgucauagaccccuggauccgcaacaacuucguccaagcccccggcggcgaguucacagucagcccccgaaacgcaccuggugaaauccuguggucugccccucucggacccgaccuuaaccccuaccuuucccaccucgcacgcauguacaacggcuaugcugguggauucgaaguacaagucauacucgcaggaaacgcauucaccgccggcaaaaucaucuucgcagccguuccacccaacuuccccaccgaaggucuaucacccucccaagucaccauguucccccacaucauagucgacguacgccaacucgaacccguccucaucccccuccccgacguccgaaacaacuucuaccacuacaaccaaagcaaugaccccaccauaaaacucaucgcaaugcucuacacaccccuccgcgccaacaacgccggggacgaugucuucacggucucaugccgcguucucacccgcccuagccccgacuucgacuucauauuccucguaccacccacuguagaaucucgaacaaaacccuucaccguccccauccucacagucgaagaaaugaccaacagccgcuucccaaucccucucgaaagauuauacaccggccccucauccgcuuucgucguacaaccacaaaacggcagaugcacuacagacggcguacuacuaggaacaacacaacucuccgccguaaacauuugcacuuuccggggcgaugucacucacaucgcgggcucucgcaacuacaccaugaaccucgccucccaaaacuggaacaacuacgacccaaccgaagaaauacccgcaccccuaggcacgcccgacuucguaggcaaaauucaaggaaugcuaacacaaaccacccgcuccgacggaucaacacgcggccacaaggccacuguccucaccggcucagccgacuucgcacccaaacuaggacgcguccaauucgccacagacacagacaacgacuuugaaucaggacaaaauaccaaauucacccccguuggcguaauucaagacgguuccacaacccaccgcaacgaaccccaacaauggguccucccaaacuacucuggacgcaccggacacaacguccaccucgccccagccguagcaccaaccuaccccggugaacaacuccucuucuuccgauccacaaugcccggauguucgggcuaccccaacauggaccuagacugccuacucccccaagaauggguacaacacuucuaccaagaagccgccccugcacaauccgacauggcccuucuucguuucguaaacccagacaccggacgcguccucuucgaaugcaaacuacacaaauccggcuacguuaccguagcccacacaggucaacacgaccuuguaauaccacccaacggauacuuucgauucgauuccugggucaaccaauucuacacccucgcacccaugggcaaugguaccggccgccgccgcuaa

SEQ ID NO: 38052 - RNA, 1617 nt, Artificial Sequence
  derived and/or modified sequence opt11 from VP1__Norovirus_and/or_Norovirus-like__AB492092
augaaaauggcauccaacgacgccaccccauccgacggcuccaccgccaaccucguccccgaagucaacaacgaagucauggcccucgaaccgguagucggcgcugcaauagccgcccccgucgccggacaacaaaacguaaucgacccuuggauacgcaacaauuucguccaagcccccggcggcgaguucacgguaucaccccguaacgcaccaggagaaauccucugguccgcaccucuuggccccgacuuaaaucccuaccugucccacuuagcccgcauguacaauggauacgccggcggauucgaaguccaagucauacucgccggcaaugcauucaccgccggaaaaaucauauucgcagccguaccgccaaacuuccccacagaaggccuaucucccucacaaguaaccauguucccacacaucaucgucgacguacgacaacucgaaccaguccuaauaccccucccagauguacgcaacaauuucuaccacuacaaucaauccaacgacccaaccauuaaacuaaucgccaugcuauacacaccucuccgagcuaacaacgcaggcgacgacgucuucaccgucagcugccgcguucucaccagacccagccccgacuucgacuucauauuccuaguacccccaaccgucgaauccagaaccaaaccauucagcguccccauccucacagucgaagaaaugaccaacucccgauuccccaucccacuagaaaaacuauucaccggacccucaagcgccuucgucguccaaccccaaaacggacgcugcacaaccgacggcguccuacuuggaacaacccaacucucccccgucaauaucugcaccuuccgcggcgacguuacccacauaagcggaucucgcaacuacacgaugaaccucgcaacacaaaacuggaacucauacgaccccacagaagaaauacccgcuccccuaggaacacccgauuuugucggcaaaauacaaggaguacucacccaaaccacucgagcagacggcuccacgcgcggucacaaagccaccguauacaccggaucugccgacuucgcacccaagcucggccgcguacaauucgccaccgacaccgacaacgacuucgaugcuaaccaaaacaccaaauucacacccguaggcguaauccaagaugguaacaccgcccaucgcaacgaaccccaacaauggguccuccccucauauuccggacgcaacucccacaacguccaccuagcccccgcagucgcaccgaccuucccaggggaacaacuccuauucuuccgcuccaccaugcccggcugcucaggcuaccccaacauggaccuggauugccuacucccccaagaauggguacaguacuucuaccaagaagccgcaccagcccaaucugacguggcccuucuccgcuucgucaaccccgacaccggucggguccucuucgaaugcaaacuucacaaaagcggauacgucacaguagcccacacagggcaacacgaucucgucaucccaccaaacggcuauuuccgcuucgacuccugggucaaccaauucuacacccucgcccccaugggaaacggcaccggccggcgacgguaa

SEQ ID NO: 38053 - RNA, 1617 nt, Artificial Sequence
  derived and/or modified sequence opt11 from VP1__Norovirus_and/or_Norovirus-like__EU916956
augaaaauggcauccaacgacgcaaccccauccgacggcuccaccgccaaccuaguccccgaagucaacaacgaaguaauggcccucgaacccgucgucggagccgccaucgccgcacccgucgcaggacaacaaaacgucaucgacccuuggauccgcaacaacuucguacaagccccaggcggugaguucaccguaagcccccgaaacgcccccggggaaauccucugguccgcaccauuaggcccagaccuaaaccccuaccucucacaccuagcccgcauguacaacggcuaugccggaggcuucgaaguacaaguuauccuagccggcaacgccuucaccgccggcaaaaucaucuucgccgcugugccgcccaacuuccccacugaaggccuuucccccucgcaaguaacuauguucccccacaucaucgucgacguccgccagcucgaaccuguacucauaccccuccccgacgucagaaacaacuucuaccacuacaaucaauccaaugacccgaccauuaaacuaaucgccaugcucuacacuccccuccgcgccaacaaugccggcgacgacguauucaccguaucuugccgaguccucacccgcccaucccccgacuucgacuuuauauuucucguuccaccaacagucgaaucccgcacaaaacccuucuccgucccaaucuuaaccguagaagaaaugacuaacucccgcuuccccauaccccucgaaaaacuauucacuggacccucaagcgccuucgucguacaaccccaaaacggccgcugcacaaccgacggcguacuccucggcaccacccaacuuucccccgucaacaucugcacauuccgcggcgacguaacucacaucgccggcacccaaaauuacacaaugaaccucgcaucccaaaacuggaacaacuacgaucccacagaagaaauccccgcaccccucggaacccccgacuucgucggcaaaauccaaggaguccucacccaaaccacacgccgagacggauccacacgcggccacaaagccaccgucuccacuggaagcguccauuucaccccaaaguuaggcuccguccaauucucaaccgacacauccaacgauuucgaaaccggacaaaacaccaaauuuaccccugucggcgugguacaagacgguucaacaacccaccaaaacgaaccccaacaauggguccucccagacuacuccggccgagauagccauaacguacaccuugcccccgcggucgcccccaccuuucccggcgaacagcuacuuuucuuccguuccaccaugcccggcuguuccggcuacccaaacaugaaccucgacugccuccucccccaagaauggguccaacacuucuaccaagaaucugcacccgcacaauccgacgucgcucuacuacgauucgugaaccccgacaccggccgagucuuauucgaaugcaaacuacacaaaucuggcuaugucaccgucgcccacaccggccaacaugaccucguuauacccccaaauggcuacuuccgcuucgacucauggguaaaccaauucuacacccuagcaccgauggggaacggagccggccgacgccgauag

SEQ ID NO: 38054 - RNA, 1617 nt, Artificial Sequence
  derived and/or modified sequence opt11 from VP1__Norovirus_and/or_Norovirus-like__EF126962
augaaaauggccucuaacgacgccaccccauccgacggcuccaccgccaaccuaguccccgaagucaauaacgaagucauggcacucgaacccgucgucggcgccgccaucgccgcccccgucgccggacaacaaaacguaaucgacccguggauccgaaacaacuucguucaagcccccggcggcgaguucaccguaucaccccguaacgcacccggagaaauccucugguccgcuccccugggaccagaccucaaccccuaccuaucacaccucgcccgcauguacaacggcuacgcaggcggcuucgaaguucaaguuauccucgccggaaaugccuucacggccggcaaaauaauuuucgcugcaguacccccaaacuuucccaccgaaggacuaucuccaucucaagucacaauguucccccacaucaucgucgacgucagacaacucgaacccguccucaucccccuccccgacguacgaaacaauuucuaccacuacaaucaaaguaacgaccccaccauacgacugaucgcgaugcucuacacaccccuccgagccaacaacgccggugacgacgucuucaccguauccugccgaguacucacccgccccucucccgacuucgacuucaucuuccucguaccucccaccgucgaaucucgaaccaaacccuucuccguccccauucucacagucgaagaaaugaccaacucucgauuccccaucccgcucgaaaaacucuucacaggcccauccuccgccuucgucguacaaccgcaaaacggacgcugcaccaccgacggcguccuccucggaacaacacaacucucacccguaaacaucugcaccuuccguggcgacguaacacacaucgcaggcacccaaaacuauaccaugaaccuggccagccaaaacuggaacaacuaugaccccaccgaagaaguccccgcaccccucggcaccccagacuuugugggcaaaauacaaggcguccuuacucaaacaacccgcggcgacggaucaacacgcggccacaaggccaccguguccaccggcucaguacacuucacccccaaacuaggcuccguacaauucuccaccgacaccucuaaugacuucgaaaccgggcaaaacacucgauucacacccguaggcgucguccaagacggcucuacaacacaccaaaacgaaccccaacaauggguccuccccgacuacucaggccgcgacaaccacaacguccacuuagcccccgccgucgcacccacauuccccggcgaacaacuccucuucuuccgaucaacaaugcccggaugcucaggcuauccaaacaugaaccucgacugccuacuuccccaagaauggguccaacauuucuaccaagaaucagccccagcacagagcgacgucgcacuccuccgauucgucaacccagacacaggucgcguucuauucgaaugcaaacuccacaaaagcggcuacgucacggucgcccacacaggacaacacgaccuugucaucccacccaauggcuacuucagauucgacucaugggucaaucaauucuacacucucgcccccaugggcaacggcgccggucgccgccguuga

SEQ ID NO: 38055 - RNA, 1617 nt, Artificial Sequence
  derived and/or modified sequence opt11 from VP1__Norovirus_and/or_Norovirus-like__AB663687
augaaaauggccucaaacgacgcaaacccaagcgacggaucagccgccaaccuugucccagaagucaacaacgaaguaauggcccucgaacccgucguaggcgccgccaucgcagcacccguugcuggccaacaaaacgucaucgacccauggauacgcaacaacuucguacaagccccuggcggugaauuuaccguaagcccccgcaacgcacccggcgaaauccuaugguccgcuccccuaggccccgaccucaaucccuaccuaucccaccuagcccgaauguauaacggauacgccgguggauucgaaguccaaguaaucuuagcaggcaacgcauucacagccggcaaaauuaucuucgcagccguacccccaaacuucccaacugaaggccucucccccucccaagucaccauguucccacacauaaucgucgauguacgccaacucgaaccaguccucaucccucugccagacguccgcaacaacuucuaccacuauaaucaaucgaacgacucaaccaucaagcuaaucgcaaugcuauauacuccccuccgcgccaacaacgccggcgacgacguauucaccgucucgugccgaguccuaacccguccaucccccgacuucgacuucauuuuccucgucccacccaccguagaaucccgcaccaaacccuucacuguacccauccucacugucgaagaaaugaccaacucacgcuuccccauaccacuagaaaaacuuuucaccgggcccuccuccgccuucgucguacaaccacaaaacggccgcuguaccaccgacggcguccuucucggcacaacgcaacucagcccagucaacauauguaccuuccgaggugacgucacccacaucgccggaucccgaaauuacaccaugaaccucgccucccucaacuggaacaacuaugaccccacagaagaaaucccagcaccccuaggcacucccgacuucguaggcaaaauucaaggcguccucacacaaaccaccaaaggugacggauccacacgcggccacaaagccacagucuacaccggcucagcagacuucaccccaaaacuaggauccguccaauucggcaccgacaccgaaaacgacuucgaaacacaccaaaacacaaaauucacccccgucggcgucauacaagacggcuccacaacccaccgaaacgaaccccaacaauggguccuacccuccuacuccggccgcaacguucacaacguacaccuagccccugcagucgccccaaauuuccccggcgaacaauuucucuucuuccgcucaaccaugccaggcugcuccggcuaccccaacauggaccucgacugccuccucccccaagaauggguacaacauuucuaccaagaagccgcaccagcccaaagcgacguagcucuccuacgcuucguuaaucccgacaccggacgcguccucuucgaaugcaaacuccacaaauccggcuacguaacagucgcccacaccggccaacacgaccuagucauacccccuaacggcuacuuccgcuucgauagcugggucaaccaauucuacacccucgcuccuaugggaaacgguacaggccgucgucgcuag

SEQ ID NO: 38056 - RNA, 1617 nt, Artificial Sequence
  derived and/or modified sequence opt11 from VP1__Norovirus_and/or_Norovirus-like__AB933759
augaaaauggccucgucggacgcaaaccccuccgacggauccacagccaaucuugucccagaaguuaacaaugaagucauggcacucgaacccgucguaggcgccgccauugcagcccccguggccggacaacaaaacguaaucgaccccuggauccgaaacaacuuuguccaagcacccggaggagaguucaccgucuccccacgcaacgcacccggcgaaauacucuggucagccccacucggcccugaccucaacccauaccucucacaccucgcccgcauguacaauggcuacgccggcggcuuugaaguccaaguaauacuagccgguaacgccuucacagcaggaaaaauaauauuugccgcagucccacccaacuuccccaccgaaggccuaucccccucccaagucacaauguucccccacaucaucguugacguccgccagcucgaaccaguacuuaucccccuccccgacguccgaaacaacuucuaccacuacaaccaauccaacgacccuacaauaaaacucauagcuaugcucuacacaccccugcgcgcaaacaacgcaggcgacgacgucuucaccgucucuugccguguccuaacccgccccuccccagacuuugacuucauauuccucgugcccccaaccgucgaaucccgcaccaagccauucucaguacccauccucaccguagaagaaaugacaaacagccgauuccccauaccacuagaaaaacucuucacaggccccucauccgccuucguaguacagccacagaacggccgaugcacaaccgacggcguucuacucggcaccacccaacucucaccaguaaacaucugcaccuucagaggcgacgucacccauaucacaggcucccgcaacuacaccaugaaucuagccacccaaaacuggaacucauacgacccaaccgaagaaauucccgcacccuuaggcacaccagacuucgucggcaaaauccaaggcguccucacccagaccaccagagcagacggaucaacccgaggacauaaagcaaccgucuacacaggcuccgccgacuucgcccccaaacuuggucgcguucaauucgcaaccgacacagacaaugacuucgacgccaaccaaaauaccaaauucaccccaguaggcgucauccaagacggcgacacagcccauagaaacgaaccacaacaauggguacuccccuccuacuccggccgaaauagccacaacguccaccucgccccggcaguagcaccgaccuuccccggagaacagcuccuuuucuuccgcucaaccaugccaggcugcuccggcuacccaaacauggaccucgacugccuccucccucaagaauggguccaauacuuuuaccaagaggccgcacccgcccaaucagacguagcccuacuucgauucgucaacccagacaccggucgcguccucuucgaaugcaaacuacacaaguccggauacgucaccgucgcccacacuggccaacacgaccuagucauaccacccaacggauacuuccgcuuugauagcugggucaaccaauucuacacacuugcgcccaugggaaacggaaccggccgucgccgcuag

SEQ ID NO: 38057 - RNA, 1617 nt, Artificial Sequence
  derived and/or modified sequence opt11 from VP1__Norovirus_and/or_Norovirus-like__AB933755
augaaaauggcaucuagcgacgccaaccccagcgacggcagcaccgccaaccucgucccagaagucaacaacgaagucauggcacuagaacccgucgucggcgcugccauagcagcccccguugcuggccagcagaacgucaucgaccccuggauccgaaacaacuucguccaagcuccuggcggcgaguucacaguaucaccccgcaaugcccccggcgaaauccucuggucagcaccacucggcccggaccuuaaccccuaccucucgcaccuugcccgcauguacaacggcuacgccgguggauucgaaguccaaguuauccucgccggcaacgccuucaccgccggcaaaaucaucuucucagccguaccaccaaacuuccccacagaaggccugucccccucccagguaaccauguucccccauaucauagucgauguccgacaacuggaacccguccuaaucccccuccccgauguuagaaacaacuucuaccacuacaaccaaucaaacgaccccacaaucaaacucaucgcaaugcuuuacaccccacuacgcgcaaacaacgcgggcgacgacgucuuuacaguaucaugccgaguccucacaagacccuccccagauuucgacuucauauuccuuguaccacccaccgucgaaucacgcacaaaaccauucuccguaccaauccucacaguagaagaaaugaccaacucccgauucccaaucccccucgaaaaacuuuucacaggcccauccucgaccuucgucguccaaccccaaaacggacgaugcacaaccgacggcguacuccucggaaccacccaacucucccccgugaauaucugcaccuuccgcggcgacgucacccacaucaccggcucccacaacuacaccaugaaccuagccucccagaacuggaacuccuacgacccaaccgaagaaauccccgccccacuuggaacccccgacuucgucggaaagauacaaggcguacucacacaaaccacacggacagauggcucgacuagaggccacaaggccaccgucuacacgggauccgccgaguucucaccaaaacuaggacgcguccaguucgcuaccgauaccaacaacgacuucgacgccaaccaaaacacuaaauucaccccagucggagucauccaagacggcggcaccacccaccgaaacgaaccccaacaauggguacuacccuccuauucaggccguaauacccauaacguccaucucgcccccgccguagcacccaccuuccccggagaacaacuccucuucuuccgcagcaccaugccagguugcucaggauaccccaacauggaucuugacugccuccucccacaagaauggguccaacacuucuaccaagaagccgcgcccgcccaaucugacgucgcucuacuacgcuucgucaaccccgacacaggacgcguccuauucgaaugcaaacuacacaaaucuggcuacgucaccgucgcccacaccggccaacacgaccucguaaucccacccaauggcuacuuccgauucgacuccugggucaaccaauucuauacucucgccccaaugggaaacggcaccggacgccgccgcuaa

SEQ ID NO: 38058 - RNA, 1617 nt, Artificial Sequence
  derived and/or modified sequence opt11 from VP1__Norovirus_and/or_Norovirus-like__AB933677
augaaaauggcuuccaacgacgcuaaccccuccgacggcuccgccgccaaccuuguucccgaagucaacaacgaagucauggcccucgaaccagucgucggcgccgccaucgcagccccaguagccggccaacaaaacgucaucgacccuuggauccguaauaacuucguacaagcccccggaggcgaguucaccgucucuccucgaaacgccccuggcgaaauacucuggagcgccccacucgggccggaucucaaccccuaccucucccaucucgcccguauguacaacggcuacgcugguggguucgaaguccagguaauucucgcaggcaacgccuucacagcaggcaaaaucauauucgccgcaguuccucccaauuucccaaucgaaggacuaucacccagccaaguaaccauguucccacacaucaucguagacguccgccaacucgaacccguacucaucccccuccccgacguccgcaacaacuucuaccacuacaaccaauccaacgacuccaccaucaagcuaauagcuaugcuauacacaccccucagagcaaacaacgcaggcgaagacgucuucaccguuuccugcagaguccuaacacgccccuccccugacuucgacuucaucuuccuaguaccacccaccgucgaguccagaacaaaacccuucacaguacccauacucaccgucgaagaaaugaccaauucccguuuucccaucccccucgaaaaacuauucaccggaccauccucagccuucguuguccaaccccaaaacggccgcugcaccaccgacggaguccuccucggaaccacucagcucucacccgucaauaucuguaccuuccgcggcgacguaacacacaucgccagcucccgaaauuacaccaugaaccuagccucccucaacuggaacaacuacgaucccaccgaagaaauccccgcuccacucggcacaccagacuucgucggaaaaauccaaggaguccucacccaaaccaccaaaggcgacgguucaacacguggacauaaagcaaccgucuacaccggcuccgcacccuucaccccaaaacuuggauccguacaauucuccaccgacacugaaaacgacuucgaaacacaccaaaauaccaaauucacccccgucggcguaauacaagacggcgguacuacucaccgcaacgaaccccaacaguggguacucccauccuacuccggacgcaacguuccaaacguccaccuagcacccgccguagcacccaccuucccuggcgagcaguuacuauucuuccgaucaaccaugcccggcugcuccggcuaccccaacauggaccuagauugccuccucccccaagaauggguacaacacuucuaucaagaagccgcacccgcacaauccgaugucgcccuccuacgauucgugaacccagacaccggccgcguccucuucgaaugcaaacuccacaaauccggauacguaaccgucgcccacacuggacaacacgaccucgucauuccacccaauggcuacuuucgauucgacuccugggucaaccaauucuacacccucgcacccaugggaaacggcaccggccgccgaagauaa

SEQ ID NO: 38059 - RNA, 1617 nt, Artificial Sequence
  derived and/or modified sequence opt11 from VP1__Norovirus_and/or_Norovirus-like__AB933650
augaaaauggccucuaacgacgcaaacccuuccgacggcuccgcagcaaaccucguccccgaagucaacaacgaaguaauggcccucgaacccgucgucggcgcugccaucgcagcaccagucgccggccaaacaaacguaauagaccccuggauccgaaacaacuucguucaagcccccggcggggaauuuaccguauccccacguaacgcacccggggaaauucuaugguccgcuccgcugggcccagaccucaaccccuaccuaucucaccucgcccgcauguacaacggauaugccggcggcuucgaaguccaaguaauccucgccggcaacgccuucacagccggcaaaaucaucuuugcagcagucccacccaacuuccccaccgaaggccugucccccucccaagucaccauguuuccccacauaaucguagacguccgccaacuugaacccguccuuaucccccuccccgacguacguaacaacuucuaccacuacaaccaauccaacgacuccaccaucaaauuaaucgccaugcucuacacaccccuccgcgccaacaacgccggcgaagaugucuucaccguauccugccguguccucaccagacccucccccgacuuugacuuuaucuuccuaguaccacccaccgucgaaucacgcacaaaacccuucacaguucccauacuaaccgucgaggaaaugaccaacucacgcuuccccaucccccuggaaaaauuauucaccggccccuccggcgccuucguugugcaaccccaaaacggccguugcaccaccgacggcguccuacuaggcaccacacaacucucaccagucaacaucugcacauuccgcggcgaugucacccacauagccgguucacgcaacuacaccaugaaccuagcaucccuaaacuggaacaacuacgaccccaccgaagaaaucccagcaccccuaggcacacccgacuucgugggcaagauucaaggcguccucacacaaacuaccaaaggcgauggauccacccgaggccacaaagccaccguauacacaggcucagcccccuucaccccaaaacucggaucaguccaauucucgacagacacagaaaaugacuucgaagcccaccaaaacaccaaauucacccccguaggcgugauccaagacggcuccaccacucaccgaaacgaaccccagcaguggguacuucccucauacucuggccgaaacguccagaacguccaccuagcucccgcaguagcccccacuuuccccggcgaacaacuccuguucuuccgcucuacaaugccaggcugcucaggcuaccccaacauggaccuagacugccuucucccacaagaauggguacaacacuucuaccaagaagcugcacccgcucaauccgacguagcacuacuucgcuucgucaacccagacaccggacguguacuauucgaaugcaaacuacacaaauccggauacgucacggucgcacacaccggccaacacgaccuugucaucccacccaacggcuacuuccgcuucgacucauggguaaaccaauucuacacacucgcuccaaugggcaacggcaccggccgacgacgauag

SEQ ID NO: 38060 - RNA, 1617 nt, Artificial Sequence
  derived and/or modified sequence opt11 from VP1__Norovirus_and/or_Norovirus-like__KM245071
augaaaauggccagcaaugacgcaucacccucugacggcuccgccgccaaccucgucccagaagucaacaacgaagucauggcccuagaacccguugucggcgccgccauagccgcccccgucgccggacaacaaaauguaaucgacccauggauccgcaacaacuucguccaagcacccggcggggaauuuaccgucuccccacgcaaugcccccggcgaaauccucuggucugcaccccuaggaccagaccuaaaccccuaccuaucccaccuagcccgcauguacaacggcuaugccggaggcuucgaaguacaaguaauccucgccggcaacgccuucaccgcaggcaagauaaucuucgccgcaguacccccaaacuucccaaccgaaggucucuccccuucccaagucaccauguucccacacauaaucgucgacguccgccagcucgaacccguccuaauaccccucccggacguccgcaacaacuucuaccacuacaaccaaucaaacgacuccacaaucaaacugaucgcaaugcuuuacacaccccuccgagccaauaacgccggugaagacgucuucaccgucagcugccguguacucacacgccccagccccgacuucgacuucaucuuucuggucccuccuaccgucgaaagccggaccaaacccuucaccguccccauacuuaccgucgaagaaaugaccaacucacgcuucccaaucccccucgaaaaacuauucacaggcccuucuggcgccuucgucguccaaccacaaaacggacgcugcaccaccgacgguguacuacuaggcacaacccaacucucacccgucaacaucugcaccuuccgaggugauguaacccacaucgccggcucccggaacuacaccaugaaccuugcugcacucaacuggaacaacuacgacccaaccgaagaaauaccagcaccccucggcacccccgacuucgucggcaaaauccaaggcguacuaacccaaaccaccaaagccgacggauccacucgcggacacaaagccacagucuacaccggcuccgccgacuucaccccuaagcuaggcucuguccaauucucaacugacaccgaaaacgauuucgaaacccaccaaaacaccaaauucacacccgucggcguaauccaagacggcuccaccacucaccgcaacgaaccccaacaauggguccuucccucuuacucuggacgcaacguacauaacguacaccucgcacccgccgucgccccaaccuuccccggcgaacaacuccucuucuuuagaucgaccaugcccggcugcuccggauaccccaacauggaccuagacugccuccuuccacaagaaugggugcaacacuucuaccaagaagccgcccccgcccaauccgacgucgccuuacuucgauucgucaaccccgacacaggaaggguacuauucgagugcaaacuacacaaauccggcuacgucacagucgcccacaccggacaacacgauuuaguuauaccuccaaacggcuacuuccgcuuugacuccugggucaaccaauucuacacccuugcucccaugggaaacggcacaggccgccgcagauga

SEQ ID NO: 38061 - RNA, 1617 nt, Artificial Sequence
  derived and/or modified sequence opt11 from VP1__Norovirus_and/or_Norovirus-like__KF712497
augaagauggccucaucagacgccaaccccucugacggcuccgccgccaaucuuguccccgaagucaacaaugaaguaauggcccucgaacccgucgucggcgcagccaucgccgcuccuguagcaggccaacagaaugucaucgaccccuggaucagauccaacuucguccaagcacccggcggcgaguucacagucagcccccgaaacgccccaggcgaaauccucugguccgccccacuaggucccgaccuuaacccuuaccuuucccacuuagcacgcauguacaacggauacgcuggcggauucgaaguccaagucauccuagccggcaacgcauuuaccgccggcaaaauaauauucgcagccguaccuccaaacuuccccacagaaggacucucacccucccaggucaccauguucccccacaucauaguagacguucgccaacucgaacccguacuuaucccacuccccgacguccgcaacaacuucuaccacuacaaucaaucuaacgacuccacaaucaaacucaucgccaugcucuacacaccccuacgagcgaauaacgccggcgaugacgucuucaccgucuccugccgaguccuaacccgacccucaccugacuucgacuucaucuuccucgucccaccaaccguugaaucccgaaccaagccauucaccguccccauacucaccguagaagaaaugacaaacucucgauucccaaucccccucgaaaaacucuucacaggucccuccucagccuuugucguccaaccccaaaacggucgaugcacuaccgauggcguucuccucggcaccacccaacuuucaccagucaacauaugcacauuccgaggcgacgucacacacaucgccggcucccgcaauuacaccaugaaccucgcaucccucaacugguccaacuacgacccgacagaagaaauccccgcaccccucgguacacccgacuucguaggaaaaauccaaggcguucucacccaaaccaccaagggggacgguuccacacgaggccacaaagccaccgucuauaccggcucagccgacuucacaccaaaguuaggcucaauccaauucgccacagacacugaaaacgacuucgaaacacaccaaaacacacgauucaccccggucggcgucauccaagacggcggcaccacccacagaaaugaaccccaacaauggguacuaccguccuacuccggucgcaacguccacaacguccaccucgccccagccguagccccaaacuucccaggagaacaacuucucuucuuccggucaacuaugcccggcugcuccggcuaccccaacauggaccuugacugccuccucccccaagaauggguccaacacuucuaccaagaagccgcccccgcccaguccgacguugcguuacuccguuucgucaaccccgacacaggucgcguccuauucgaaugcaaacuacacaaauccggcuacgucaccguugcccacaccggacaacacgaccuuguaaucccucccaauggcuacuucagauucgacagcuggguaaaccaauucuacacccucgcccccaugggaaauggaacaggccgcagacgcuaa

SEQ ID NO: 38062 - RNA, 1617 nt, Artificial Sequence
  derived and/or modified sequence opt11 from VP1__Norovirus_and/or_Norovirus-like__KC990829
augaaaauggcaagcaacgacgccaaccccucagauggaagugcagccaaccucguucccgaaguaaacaacgaaguaauggcgcucgaacccgucguaggcgccgcaaucgccgcccccgucgcaggccaacaaaacgucaucgacccuuggauucguaacaacuucguacaggcccccggaggggaguucaccguaagcccucgaaacgccccuggcgaaauccucugguccgcgccccucggacccgaccucaaccccuaccucucccaucuugcccgcauguacaacggcuaugccggcgguuucgaaguacaagucauacuagccggcaacgccuucaccgccggcaaaauaaucuucgcagccgucccuccaaacuuccccaccgaaggccuuucuccaucccaagucacaauguucccccacaucaucgucgacguccgacaacuagaacccguccucaucccccuccccgacguucgcaacaacuucuaucauuauaaccaauccaacgacuccaccaucaaacucaucgccaugcucuacacccccuuacgagcaaacaacgcaggcgacgacguuuucaccgucucaugccguguccucacccgccccucccccgacuuugacuucaucuuccuagucccacccacaguugagucacgaaccaaacccuucacaguacccauacucaccgucgaagagaugacuaacucccgcuuccccauaccacucgaaaaacuauucaccggcccaucauccgccuucguuguccaaccccaaaacggacggugcacaaccgacggcguccuccucggaaccacccaacucuccccagucaacaucugcaccuuccgaggcgaugucacccacaucgcaggaucccgcaacuacacuaugaaccucgccucccucaacuggaauaacuaugaccccaccgaggaaauccccgcuccccucgggaccccagacuucguaggaaaaauccaaggaguacuaacacaaacaaccaaaggcgacggcucaacucgaggacacaaagccaccguauauacuggauccgccgacuucacacccaaauuaggcuccguccaauucgccaccgacaccgaaaacgacuucgagacccaccaaaauaccaaauucaccccuguaggcgucauccaagacggaucaaccacccacagaaacgaaccacaacaauggguccuaccguccuacucuggccgaaacguccacaacguccaccuagcaccagcaguagcacccaacuuccccggcgaacagcuccuauucuuccgcuccacaaugccaggaugcucuggcuaccccaacacagaucucgacugccuacuaccacaagaauggguccaacacuucuaccaagaggccgcccccgcacaaucagacgucgcacuccuccgcuucgucaaccccgacacuggccgcguacucuucgaaugcaaacuacacaaauccggcuacguaaccgucgcucacaccggacaacacgaccucgucaucccucccaacggcuacuuccgcuucgacagcuggguaaaccaauuuuacacccucgcccccaugggaaacggcaccggccgccgccgcuaa

SEQ ID NO: 38063 - RNA, 1617 nt, Artificial Sequence
  derived and/or modified sequence opt11 from VP1__Norovirus_and/or_Norovirus-like__JX439843
augaaaauggcaucuaacgacgccucucccucagaugguuccgcugcuaaccuaguccccgaagucaacaacgaagucauggcccucgaaccagucguaggcgccgccaucgccgcacccgucgcuggacaacaaaacguaaucgacccauggaucagaaacaacuucguccaagcccccggcggcgaauuuacagugucuccacgaaacgccccuggcgaaauccuaugguccgcaccccucggaccagaccucaacccauaccuuucccaccucgcccgaauguacaacggcuacgccggcggcuucgaaguccaagucauccuugccggcaacgccuucaccgccggaaaaaucauuuucgccgcaguucccccuaacuucccaaccgagggccuaucccccucucaagucaccauguucccucacaucaucguagacguccgacaacuagaacccguucucaucccccuccccgacguccgcaacaacuucuaccacuacaaccaauccaacgacucaaccaucaaacucaucgccaugcucuacacgccccuacgcgccaauaaugcuggagaagacguuuucaccgucuccugccgcguccuuacccgacccucccccgacuucgacuucauauuucucguaccacccaccguagaaucccgaaccaaacccuucacagugcccauacucacaguagaagaaaugaccaacagccguuuccccaucccccucgaaaaacucuucaccggccccuccucagccuucgugguucaaccccaaaacggucgcugcacaacagacggaguacuacucggcaccacccaacuaccucccgucaacaucugcacauuccgcggcgacguaacacacaucgcuggaucccgcguauacacaaugaaccucgcaucacucaacuggaacaacuacgacccaaccgaagaaauaccagcaccccucggcaccccagacuucgucggaaaaauccaaggcguucuuacccagacgaccaaagaagacggauccacccgcggacacaaggccaccguauacaccggcuccgcuccuuucacccccaaacuaggauccguccaauucucaaccgacacagaaaaugacuucgaaacucaucaaaacaccaaauucacccccgucggcguaauccaagacggaggaaccacccaucguaacgaaccccaacaauggguacuacccuccuauuccggccgcaacgcccccaacguccaccucgcacccgccguggcaccaacauucccaggcgaacaacuccucuucuucagauccacaaugcccggcugcucaggauacccaaacauggaccucgacugccuccuaccacaagaauggguccaacacuucuaccaagaagcggccccggcccaauccgacguagcucugcuccgcuucguaaaccccgacacaggccgcguccucuucgaaugcaaacuccacaaauccgguuacgucaccguagcccacacaggccaacacgaccucgucauucccccaaacgguuacuuccguuucgacuccugggucaaccaauuuuauacacucgcucccaugggaaacggcacaggucgccgacgauaa

SEQ ID NO: 38064 - RNA, 1617 nt, Artificial Sequence
  derived and/or modified sequence opt11 from VP1__Norovirus_and/or_Norovirus-like__JX439841
augaaaauggccagcaacgacgcuucccccagcgacggcuccgcagccaaccuaguccccgaagucaacaacgaagucauggcccucgaaccagucgucggcgcagccaucgccgcccccguagcaggacaacagaacgucaucgaccccuggauucguaacaacuuuguccaagccccuggcggcgaguucaccgucucaccccgcaacgcucccggugaaauacuaugguccgcaccccuaggccccgaucuuaaccccuaccucucccaccucgcccgaauguacaacggcuacgccggcggcuucgaaguacaagucauacucgccggaaacgccuucaccgccggaaaaaucauauucgccgccgucccucccaacuuccccaccgaaggccuuuccccuucacaaguuaccauguucccacauaucaucguagauguacgacaacucgaaccuguacuuaucccacuucccgacguccgcaacaacuucuaccacuacaaccagucaaacgacuccacaauaaaacuaaucgccauguuauacacaccccuccgagccaacaacgccggcgaagacgucuucaccgucuccugccgaguccucacccguccauccccagacuucgacuucauauuccuagucccucccacagucgaaagucgaaccaaacccuucaccguucccauccucaccgucgaagaaaugaccaacucacgcuuccccaucccccucgaaaaacuauucaccggccccuccuccgcuuucgucguacaaccccaaaacggcagaugcaccaccgacgggguacuacucgguaccacccaacucucacccgucaacaucugcaccuuccgaggagaugucacccacaucgccgguucccgagacuacaccaugaaccucgccucccucaauuggaacaacuacgauccaaccgaagagauacccgcuccccucggcacacccgacuucguuggaaaaauacaaggcguccucacccaaaccacaaaaggcgacggaucuacccgaggccacaaagccacagucuacaccggauccaccccguuuacgcccaaacuaggcucaguccaauuuuccaccgacaccgaaaacgacuucgaaacacaccagaacaccaaauucacccccgucggcguuauacaagauggcgguacaacccaccggaacgaaccccaacaauggguauuaccauccuacucaggccgcaacguccaaaacguccacuuagcccccgcagucgcacccaccuuccccggagaacagcuacuauucuuccgauccaccaugcccggaugcucaggcuacccuaacauggaccucgacugccuccucccccaagaauggguccaacacuucuaccaagaagccgcuccugcacaaucggacguagcccuccuacgcuucgucaacccagacaccggccguguccuauucgaaugcaaacuccacaaaucagguuacgucacagucgcccacacaggccaacacgaccuggucaucccacccaacggauacuuccgauucgacuccuggguaaaccaauucuacacucucgcccccauggguaacggcacaggccgacgcagauga

SEQ ID NO: 38065 - RNA, 1617 nt, Artificial Sequence
  derived and/or modified sequence opt11 from VP1__Norovirus_and/or_Norovirus-like__JX439830
augaaaaugggcucaaacgacgcaaaccccuccgacggauccaccgccaaccuagucccagaagucaacaacgaagucauggcccuagaaccagucgucggcgccgcuauagccgccccagucgccggccaacaaaacgucaucgauccauggauccgcaauaacuucguccaagcuccaggcggagaguucaccguaagcccccgaaaugcccccggagaaauccuuugguccgcaccccucggccccgaccucaacccauaccuaucccaccucgcccguauguacaacggcuacgccggaggcuucgaaguucaagucauacuagccggcaacgccuucaccgccggcaaaauaauauucgccgccguucccccaaacuucccuaccgaaggacucagcccaucucaagucaccauguucccucacaucaucgucgacguccgucaacuugaacccguccucaucccccucccagacguccgcaacaacuucuaccacuacaaucaaucaaacgacccaaccaucaaacuuaucgccaugcucuacaccccacuccgcgccaacaacgccggcgacgacgucuucaccgucagcugccgcguccuaaccagaccauccccugacuucgacuucauauuccucguucccccaacaguagaaucccgaaccaaacccuucucaguccccauacucacaguugaagaaaugaccaauucccgauuccccaucccccuagaaaaauuauucacaggucccucuuccgccuucgucguacaaccccagaacggacgcugcaccaccgacggagugcuccucggcacaacccaacuaucccccgucaacaucuguaccuuccgcggcgacguaacccacauuacaggaagccguaacuacaccaugaaccuugccacccaaaauuggaacuccuaugaccccaccgaagaaaucccagcuccccucggcacacccgauuucguaggcaaaauacagggaguccucacacaaaccacacgagccgacggcucuacccgcggacacaaagccacagucuacaccgguuccgcugacuucgccccaaaacucggccgaguccaauucgccacagacaccgacaacgacuucgacgccaaccaaaauaccaaauucacccccguaggagucauucaagacggcgacaccgcucaccgaaaugaaccacaacaauggguccugccaagcuacuccggcagaaacucacauaacguccaccucgcccccgccgucgcaccaaccuuccccggcgaacaacuacuauucuuccggagcacaaugccuggcugcuccggcuaccccaauauggacuuagacugccuacuuccacaagaauggguccaguacuucuaccaagaagcggccccagcccaaucugacgucgcucuacuccgcuucgucaaucccgacaccggccgcguccucuucgaaugcaaacuccauaaaucaggguacgucacugucgcccacacaggacaacacgaccuuguaauuccacccaacggauacuuccgcuucgacucaugggucaaccaauucuacacccucgcccccaugggaaacggcaccggccgcagacgauaa

SEQ ID NO: 38066 - RNA, 1617 nt, Artificial Sequence
  derived and/or modified sequence opt11 from VP1__Norovirus_and/or_Norovirus-like__JX439828
augaaaauggccuccuccgacgcuaaccccagcgacggcucaacagccaaccucgucccagaggucaacaacgaggucauggcccuagagcccgucguaggcgccgcaaucgccgccccagucgccggccaacaaaacgucaucgaucccuggauccgcaacaacuucguccaagcaccaggaggagaguucaccguaucaccacgcaacgcucccggcgaaauccucuggucagcaccccuaggccccgaccuaaaccccuaccucucacaccuagcccgaauguauaacggcuacgccggcggcuucgaaguacaagucguccucgccggcaacgcuuucacagccggaaaaaucaucuuugccgccguaccaccgaacuuccccacagaaggacucucacccucccaaguuacaauguucccucacaucaucguagacguccgccaacuagaacccguccuaaucccccucccagacguccgcaauaacuucuaccacuacaaccaaucuaacgaucccaccaucaaauuaauagcaaugcucuacaccccacuacgcgcaaacaacgccggcgacgacgucuucaccgucucaugccgcguacucacacgccccagcccugacuucgacuucauuuuccucguacccccgaccguagaaucccgaacaaaacccuucucuguccccauccuuacagucgaagaaaugaccaacucccgcuuccccaucccacuagaaaaacucuucacaggacccuccucagccuucgucguacaaccccaaaacggccgauguaccacagauggcguacuacucggcacgacacaacuaucccccguaaacauaugcaccuuccggggcgacguuacucacauaaccggcucucgcaacuacacaaugaaccuagcaacacaaaacuggaacucauacgaucccaccgaagaaauaccugccccucucggaacaccggacuucgucggcaagauccaaggaguccuaacccaaaccacccgugcugacggcucuacccgaggucacaaagcaacuguuuacacaggaucugcagacuucgcccccaaacuaggccgaguccaauucgccacagacaccgacaaugacuucgacgccaaccagaacaccaaauucacccccgucggagucauacaggacggcgacaccgcccaccgaaacgaaccgcaacaauggguccuacccucauacuccggacgaaacucccacaacguucaccucgcccccgccgucgcaccaacauuccccggcgagcaacuccuuuucuuccgauccaccaugccaggguguuccggcuaccccaacauggaccucgacugccuccuuccacaagaauggguccaauacuucuaucaagaagccgcccccgcgcaaucagacguagcccuccuacgcuucgucaaccccgacacuggcaggguccucuucgaaugcaaacuccacaaaucuggcuacgucaccguugcccacacuggacaacacgacuuaguaauucccccaaacggcuacuuccgauucgacucauggguaaaccaauucuacacucucgcccccaugggcaacggcacaggcagacgcagauaa

SEQ ID NO: 38067 - RNA, 1617 nt, Artificial Sequence
  derived and/or modified sequence opt11 from VP1__Norovirus_and/or_Norovirus-like__JX445153
augaaaauggcauccaacgacgccacacccagcgacggcucaaccgccaaccuaguacccgaaguuaacaacgaagucauggcccucgaaccaguagucggcgccgccauagcugcccccgucgcaggacaacagaacgucaucgacccuuggauccgcaacaacuucguccaagcuccaggaggggaauuuaccguaucuccacgaaacgcccccggggaaauccuaugguccgcuccccucggaccagaccucaaucccuaucucucccacuuagcccgcauguacaacggcuacgccgggggcuucgaaguacaagucauccuugccggcaacgcauucaccgccggaaaaaucaucuucgccgcuguacccccaaacuucccaacagaaggacuaucccccucccaggucaccauguucccccacauaauagucgacgucagacaacucgaacccguccucaucccccuucccgauguacgaaacaacuucuaccacuacaaccaaucaaacgacccaacuaucaaacucauugcaaugcuauacaccccuuuacgcgccaacaacgccggcgacgacguauucaccgucucaugccgcguacuaacacgaccaucacccgacuucgacuucauauuccuaguacccccaaccgucgaaucacgcacuaaaccauucucggucccaauccucaccguagaagaaaugacaaacucacgcuuccccauaccccucgaaaaacucuucacaggcccauccuccgcauucguaguacaaccccaaaacggccgcugcaccaccgacggagugcuccucggcacaacucaacuaucgcccgucaauaucugcaccuuccgcggcgacgucacccacauugccggcacacaaaacuacaccaugaaccucgcaagccaaaacuggaacaacuacgacccuaccgaagaaauccccgcaccccuuggugcccccgauuucgucggaaaaauccaaggaguccuuacccaaacaacacgcggcgacggaagcaccagaggacacaaagccacaguguccacaggcucaguccacuucacacccaaacucgguuccguccaauucucuaccgacacauccaacgaccucgaaaccggacaaaacacccguuucacaccaguaggcguaguacaggacggcagcacuacccaccaaaacgaaccacaacaaugggucuuacccaacuauagcggccgagacucacacaacguccaccucgccccggccguagccccaacguucccuggugaacaacuacucuucuuccgcucaaccaugccuggaugcuccggauacccaaacaugaaccuugacugccuccuaccacaagaauggguccaacacuucuaccaagaauccgcccccgcccaauccgacgucgcccuccuccgcuucguaaaccccgacaccggccgugugcuauucgaaugcaaauuacacaaaucuggauacgucaccguagcccauacaggccaacacgaccucgucaucccacccaacggcuacuuccgguucgacucuuggguaaaccaauucuauacccuugcgcccaugggcaacggcgccggccgcagacgauga

SEQ ID NO: 38068 - RNA, 1617 nt, Artificial Sequence
  derived and/or modified sequence opt11 from VP1__Norovirus_and/or_Norovirus-like__JX155754
augaaaauggccucuaacgacgccaacccauccgacggcuccgccgcaaaccucguccccgaaguaaacaacgaagucauggcccucgaaccagucguaggagcugccaucgcagccccagucgccggccaacagaacguuaucgacccuuggauccgaaacaacuucguccaagcccccggaggagaguucaccguaucaccacgcaacgccccaggcgaaauccuauggucugccccucuuggccccgaccucaaccccuaccuuucccaccucgcccguauguacaauggcuacgccggcggauucgaaguacaggucauccuagccggcaacgccuucaccgccggaaaaaucaucuucgccgcagucccacccaacuuccccaccgaaggccucaguccaucccaaguaaccauguucccccauaucaucgucgacguacgccaacucgaacccguucuaaucccgcucccagacguccgcaacaauuucuaccacuacaaccaguccaacgaucccacgaucaaacuuaucgcaauguuguacacaccccugcgcgccaacaacgccggagaagacgucuucaccguaagcugccguguccuuacccgcccaucaccugacuucgacuucaucuuccucguaccuccaaccguagaaucacgcacaaaaccauucacggucccaauacuaaccgucgaagaaaugacaaacucacgauuuccaauaccccucgaaaaacuauucacaggccccuccucugcauucgucguccaaccccaaaacggccguugcacaacagacggcguacuccuuggcacaacccaacucucacccgucaacauaugcaccuuccgaggagacguuacacacaucgcuggcucucgcaacuacacaaugaaccucgccucccucaacuggaacaacuacgauccuacggaagaaauccccgcgccccucggaacacccgacuucguagguaaaauccaaggcguccuaacccaaacaacaaagggcgacggguccacccgcggucacaaagccaccgucuacaccggcuccgcccccuuuacccccaaacucggauccguccaauucuccaccgacaccgaaaacgacuucgaaacccaccaaaacaccaaauuuacaccaguaggcgucauccaagacggcggaaccacccaccgaaacgaaccacaacaauggguccuacccuccuacuccggacgcgacguucccaacgcacaucucgcucccgcaguagcacccaccuuucccggcgaacaacuccucuucuuccgcuccacgaugccaggcugcucaggauauccaaauauggaccucgacugcuuacucccccaagaauggguccaacacuucuaccaagaagccgccccagcccaaucagaugucgcccuccuacguuucgucaacccugacacgggccgaguccuguucgaaugcaaacuccacaaaagcggauaugucaccgucgcacacaccggucaacaugaccucguaaucccuccaaauggcuacuucagauucgacuccuggguuaaccaauucuacaccuuagcacccaugggaaauggcacaggacgacgucgauaa

SEQ ID NO: 38069 - RNA, 1617 nt, Artificial Sequence
  derived and/or modified sequence opt11 from VP1__Norovirus_and/or_Norovirus-like__JN400608
augaaaauggccucaaacgacgcaaaccccuccgacggcuccgcagccaaccuagucccugagguaaacaacgaagucauggcccucgaacccgucgucggcgccgccaucgccgcaccuguagccggccaacaaaacguaauagaccccuggauccgcaacaacuucguacaagcucccggcggcgaguucaccguaucaccucgcaacgccccaggugaaauacuauggucagcaccccucggcccugaccuaaacccauaccuaucccacuuagcccgcauguacaacggcuacgcaggaggcuucgaaguccaagucauucucgccggaaacgccuucacagccggaaaaauaauauucgccgcaguaccucccaacuucccaacugaaggacucucccccucccaagucaccauguucccccacaucaucgucgacguacgccaacuugaacccguacuaauccccuuacccgauguccgcaacaacuucuaccacuacaaccaauccaacgacuccaccaucaaacuuaucgcuaugcucuacacuccccuacgcgcaaacaacgccggugaagacgucuucaccgucuccugccgcguacucaccagacccagcccagacuuugauuucaucuucuuagucccucccaccgucgaauccagaaccaaacccuucacaguucccauccucacaguagaagaaaugaccaacucccgcuucccaaucccccuugaaaaacucuuuacaggccccuccuccgcauucgucguccaaccccaaaacggucgauguaccaccgacggcguacuccucggcacgacccaacuaucucccguaaacaucugcacauuucgaggugacgucacccacauagccggaucccacaacuacaccaugaaccuagccucccuaaacuggaacaacuaugauccaaccgaagaaauccccgcuccacugggcacccccgacuucguuggcaaaauccaaggcguacucacccaaaccaccaagggagacggauccacccgaggccacaaagcaaccgucuauaccggcuccgcccccuucacccccaaacuaggcagcguucaguucuccacagacaccgaaaacgacuuugaaacccaccaaaacaccaaguucacaccagucggcguaauccaagacggcuccacaacacaccgcaacgaaccccaacaauggguccuccccucuuacucuggcggcaacguccacaacguacaccuagcccccgccgucgcccccaccuucccaggugaacaacuccuuuucuuccgcuccaccaugccaggcugcuccggcuacccaaacauggaccuggacugccuccucccacaggaguggguacaacacuucuaccaagaagccgcacccgcccaaucagacguagcgcuucuucgcuuugucaaccccgacaccggccguguccucuucgaaugcaaacuacacaaauccggcuacgucaccgucgcccacacaggccaacacgaucucgucaucccucccaacggcuacuuccgcuucgacuccugggucaaccaauucuacacccuagcucccaugggcaacggaacaggacgccgccgcuaa

SEQ ID NO: 38070 - RNA, 1617 nt, Artificial Sequence
  derived and/or modified sequence opt11 from VP1__Norovirus_and/or_Norovirus-like__EF187497
augaaaauggcauccucagacgccaaccccuccgacgguucuaccgcuaaccuuguccccgaaguaaacaacgaagucauggcccucgaacccguuguaggagccgcaauugccgcccccgucgccggccaacagaacgucaucgaccccuggauccgaaacaacuucguacaagcccccggcggcgaguucaccgucagcccucgaaacgcccccggagaaauccuaugguccgcaccccuaggccccgacuuaaaccccuaccuaucacaccuagcccgcauguacaacggcuacgccggcggauucgaaguccaaguaauccucgccgggaacgccuucaccgccggcaaaaucgucuucgccgccgucccucccaacuucccaacagaaggucuauccccaagccaagucaccauguucccacacauaaucguugacguaagacaacuagaaccaguccucauaccacuccccgacguaagaaacaauuucuaccacuacaaccaaucaaacgauccaaccauaaaacucaucgccaugcucuacacccccuuacgagccaacaacgcaggcgaagacgucuucaccgucagcugucgaguacucacccgccccucacccgacuucgacuucauauuccucgucccacccacagucgaaucacgcacaaaacccuucucaguccccauacucaccgucgaagaaaugaccaacucccgcuucccaaucccccucgaaaaacucuucacuggccccuccucaacaauagucguccaaccacaaaacggacgaugcaccacagacggcguucuccuaggcacuacccaacugucccccgucaacauaugcaccuuccgaggagacgucacucauaucgcaggcacacaagaauacaccaugaaccucgccucacaaaacuggaacaacuacgaccccaccgaagaaauccccgccccacuaggcacccccgacuucguaggcaaaauccaagguguucuuacacaaacaacccgccgcgacggaucaacucgaggccacaaagccaccgucucaacuggcuccgucaacuucacccccaaacucggacgcauccaauucuccaccgacacauccaacgacuucgaaaccggacagagcacccgcuucacccccgucggagucguccaagauggcuccacaacccaccagaacgaaccccaacaauggguccuaccugacuacucugggcgcgacucacacaacguucaccucgccccagccgucgcacccuccuuccccggcgaacagcuccucuucuuccgauccaccaugccaggcugcucaggauaccccaacaugaaccucgauugccuucuaccccaagaauggguccaacacuucuaccaagaagccgccccggcccaaucggacgucgcccuccuccgauucguaaaccccgacaccggccgcguccucuuugaauguaaacuacacaaaucuggcuauguaaccguagcccacacaggacagcacgaccuaguaauacccccaaacggauacuuucgauucgacuccuggguaaaccaauucuacacacucgccccaauggggaacggaaccggccgccgccguuaa

SEQ ID NO: 38071 - RNA, 1617 nt, Artificial Sequence
  derived and/or modified sequence opt11 from VP1__Norovirus_and/or_Norovirus-like__AB668028
augaaaauggccuccaacgacgccucccccuccgacggcucagcagcaaacuuaguacccgaaguuaacaacgaagucauggcacucgaaccagucgucggagcagccauagcagcccccgucgccggccaacaaaacgucaucgacccauggauccgcaacaacuucguucaagcucccggcggcgaguucaccgucucuccccgcaacgccccuggcgaaauccucugguccgcaccccucgggcccgaccuuaacccauaccugucccaccucgccaggauguacaacggcuacgccggaggcuucgaaguccaagucauccucgccggcaacgccuuuaccgccggcaagauuaucuucgcagccguacccccaaacuuccccacagaaggacucucuccaucccaagucaccauguuuccacacauaauagucgacguccgccaacuugaaccaguccucaucccacuccccgacguccgaaacaacuucuaccacuacaaccaaucaaacgacuccaccauaaaacucaucgcaaugcuauacacaccccuacgggccaacaacgccggagaagacgucuucacagucucaugccgcguacugaccagaccuuccccagacuucgacuucaucuuucucguuccacccacaguagaaucccgcaccaaacccuucacaguacccauacucacagucgaagagaugaccaacucccgcuuccccaucccucucgaaaaacuauucacaggccccagcucagccuucgucguccagccucaaaacgggcgaugcaccaccgacggcguccuccucggcaccacccaacuuuccccaguaaacauauguaccuuccgcggcgacgucacacauaucgcaggaagccgcaacuacaccaugaaccuagcaucccuaaacuggaacaacuacgaccccaccgaggaaaucccagcaccccucggaacccccgacuucgucggcaagauucaaggcguccuuacccaaacuaccaaaggugacggaucaacaagaggccacaaagccaccgucuacacaggcucagcacccuucacaccaaaacucggcuccguucaauucucuaccgacaccgagaaugacuucgaaacucaccaaaacacaaaauucacaccagucggagucauccaagacggauccacaacccaccgaaacgaaccccaacaauggguccuccccagcuacucaggccgcaacguacacaacguccaccucgcccccgccguagcccccaccuuccccggcgaacaacuucuauucuuccgcagcaccaugccaggcugcucaggcuaccccaacauggaccuagacugccuccucccacaagaauggguccaacacuucuaccaagaagccgcccccgcacaauccgacgucgcguuacuccgcuucgucaacccagacaccggccgaguccucuucgaaugcaaacuccacaaaucaggcuacguaacaguagcccacacaggccaacacgaccucgucaucccucccaacggcuacuuccguuucgacuccuggguaaaccaauuuuacacccucgcacccaugggcaacggcaccggccgacgacgauaa

SEQ ID NO: 38072 - RNA, 1617 nt, Artificial Sequence
  derived and/or modified sequence opt11 from VP1__Norovirus_and/or_Norovirus-like__HM802542
augaaaauggcgucaaacgacgccacccccuccgacgguucuaccgccaaccuuguacccgaagucaacaacgaagucauggcccucgaacccguggucggugcagcaaucgccgcccccgucgccggacaacagaaugugaucgaccccuggauacguaacaacuucguacaagcccccggcggcgaguucacagucuccccacgcaacgcccccggagaaauacucugguccgccccacuuggccccgaccuaaaccccuaccucagccaccucgcccguauguacaacggcuacgccggaggauuugaaguccaagucauccucgccggcaacgcauucacagcuggcaaaaucaucuucgcugccgucccacccaacuuucccaccgaaggcuuaucuccaagccaagucaccauguucccccacauuauagucgacguaagacaacucgaaccaguccucaucccacuccccgacgugcgcaauaacuucuaccacuacaaccaaucaaacgaccccacaaucaaacuaaucgcaaugcucuacaccccacugagagcuaacaacgccggugacgaugucuucacagucucgugucgcguccucacucgccccucucccgauuucgacuucauuuuccuagucccuccaacaguagaaucacgcaccaaaccauucucaguccccauacucacaguugaagagaugaccaacucacgcuuccccaucccccucgaaaaacucuucacaggacccuccucagccuucgucguccaaccccaaaacggccgauguacaaccgacggaguccuccuaggcacaacacaacuuucacccgucaacauaugcacauuccgcggagacgucacacacaucgcuggaacucaaaauuacaccaugaaucucgcuucccaaaauuggaacaacuacgaccccacagaagaaaucccagcaccccucggcacccccgacuuugucggccgcauccaaggcguccucacacaaaccacccgucgagacggaucaacucgcggccacaaagccacaguauccacaggauccguccacuuuacacccaagcucgguucaguccaauuuuccacagacaccuccaacgacuucgaaaccggacaaaacacacguuucacccccgucggaguaguccaagacgguuccacaacccaccaaaaugaaccacaacaauggguccuucccgacuacuccgggcgagacucccacaacguccaccucgcacccgccguagcacccacauuucccggcgaacaacuccucuucuuccgcucaaccaugcccggcugcagcggauacccuaauaugaaccucgacugccuccucccacaagaguggguacaacacuucuaccaagaauccgcuccggcacaauccgacgucgcgcuccuacgguucguaaaccccgacaccggccgcguccucuucgaaugcaaacuacacaaaagcggcuacgucacagucgcgcacaccggccaacacgaccucguaaucccacccaacggauacuuccgauucgacuccugggucaaccaauucuacacccucgccccaaugggaaacggugccggccgccgccgcuaa

SEQ ID NO: 38073 - RNA, 1617 nt, Artificial Sequence
  derived and/or modified sequence opt11 from VP1__Norovirus_and/or_Norovirus-like__HQ009513
augaagauggcuuccaacgacgccaacccguccgacggaucaaccgccaaccucguccccgaagucaacaacgaagucauggcacuagaaccagucguaggagccgccaucgccgcaccaguagccggacaacagaacgucaucgacccauggauccgaaacaacuucguccaggcccccggaggcgaguucacaguuucuccacgcaacgcuccaggcgaaaucuuaugguccgcaccccucggaccagaccucaaccccuaccucagccaccuagcccguauguacaacggcuacgccggcggguuugaaguacaaguaauacucgcaggcaacgccuucaccgcaggcaaaauaauauucgccgcggucccuccaaacuuccccaccgaaggccucuccccgucacaagucaccauguuuccccacaucauuguagacguccgccaacucgaacccguccugauaccccuacccgacguccguaacaacuucuaccacuacaaccaauccaaugaccccaccauaaaacuaauagcaaugcuguacaccccacuccgcgcaaacaacgcaggcgacgacgucuucacaguuucuugccgcguacuuacccgacccucccccgacuucgacuucaucuuccuagucccucccacagucgaaucccgcacaaaaccauucuccguuccaauccuaaccgucgaagaaaugacaaacucccgauuccccaucccccuggaaaaacuuuucaccggccccucauccgcauucguaguacagccucaaaacggccgcugcaccaccgacggcguccuacucggcacuacccaacucucccccguaaacaucugcaccuuccgcggcgacgucacccacaucaccggcucacgaaacuacaccaugaaccucgccacccaaaacuggaacucauacgaccccaccgaagaaauaccagcgccccuaggcacacccgacuucgucggaaagauccaaggcguucucacccaaaccacucgagccgacggcucaacccgcgggcacaaagccacugucuacaccggcucagccgacuucgcaccaaaacuaggccgcguccaauucgccaccgacaccgacaacgacuucgacgcaaaucagaauacuaaauucacccccgucggcguaauucaagacggcaacaccgcacaccgcaaugaaccccaacaauggguacuacccuccuacucaggacguaacucccacaacguccaccucgcccccgcagucgcccccaccuuccccggcgagcaacuccucuucuucagaagcaccaugccaggaugcucgggcuaccccaacauggaccucgacugccuucuaccacaagaauggguccaguacuucuaccaagaggccgcccccgcccaauccgacgucgcccuacuacguuucgucaacccagacacuggucgaguacuauucgagugcaaacuacacaaaucagguuaugucaccgucgcacacaccggccaacacgaccucguaaucccgccaaacggcuacuuccguuucgacuccugggucaaccaauucuacacccuagcccccaugggcaacggcaccggccgacgccgcuag

SEQ ID NO: 38074 - RNA, 1617 nt, Artificial Sequence
  derived and/or modified sequence opt11 from VP1__Norovirus_and/or_Norovirus-like__AB541322
augaagauggcaagcucugacgccaaccccuccgacggcucaaccgccaaccucguccccgaaguaaacaacgaagucauggcccucgaacccgucgucggcgccgccaucgccgcuccugucgccggccaacaaaacgucaucgacccauggauacgaaacaacuucguccaagcacccggcggagaauuuacagucucccccagaaaugcaccaggcgaaauuuuaugguccgcaccacucggaccagaccucaacccauaccucucccaccucgcacgaauguacaauggcuacgcaggcggcuucgaaguccaggucauccucgccgguaacgccuucaccgcagguaaaauaaucuucgccgccguacccccgaacuuccccacagaagggcuaucccccucccaagucaccauguucccccacauaauaguagacguccgccaacucgaacccguccucaucccccuccccgacguacgcaacaacuucuaucacuacaaccaguccaacgaccccacaauaaaacucauagccaugcucuacacuccauuacgugcuaacaacgccggugacgacgucuucaccgucuccugccgcgugcucacccgcccaucacccgacuucgacuuuauauuucuaguuccgcccacagucgaaucccgaaccaaacccuucagcguccccauccuuaccgucgaagaaaugacgaacucgcgcuuccccauccccuuagaaaaacucuuuaccggccccucaagcgcauuugucguccaaccccaaaacggccgcugcaccaccgacggcguucuccuaggcaccacccagcucucaccagucaacauuuguacauuccgcggagacgucacacauaucacaggcucgcgaaacuacaccaugaaccucgccacccaaaacuggaacuccuacgaccccaccgaagaaauucccgcaccccuagguacuccagacuucgucggaaaaauccaaggaguccuuacacaaaccaccagagccgacgguuccacccgaggccauaaagccacggucuacacaggcuccgcagacuucgccccaaaacuaggacgcguccaauucgccaccgauaccgacaaugacuuugacgccaaccaaaacacaaaauucaccccagucggcgucauccaagauggggacacagcccaccgcaacgaaccacaacaauggguccucccauccuacagcggucgcaacagccacaauguccaccucgcccccacgguagcaccaacauuccccggcgaacaacuacuauucuuccgcuccaccaugcccggcugcuccggauacccgaacauggaccuagacugccuccucccccaagaauggguucaauacuucuaccaagaagccgcccccgcccaauccgacguugcucuccuucgcuucgucaaccccgacaccggccguguacucuucgaaugcaagcuccacaaauccggauacgucaccguugcccacaccggccaacacgaccucgucaucccacccaacggauacuuccgcuucgacuccugggugaaccaauucuacacccuagcucccaugggcaacggcaccggccgccgccgcuaa

SEQ ID NO: 38075 - RNA, 1617 nt, Artificial Sequence
  derived and/or modified sequence opt11 from VP1__Norovirus_and/or_Norovirus-like__AB541321
augaaaauggccucaaacgacgccaacccuucagacggaucaacggccaaccucgucccugaaguuaacaaugaagucauggcccucgaacccgucgucggcgcagcuaucgccgcccccgucgcaggccaacagaauguaauagacccuuggauccgcaacaacuucguucaagccccaggcggcgaguucaccguauccccacaaaaugcacccucagaaauacucuggucagcaccccuaggaccagaccucaaccccuaccucucacaucuagcucguauguauaacggauacgccggaggauucgaaguccaagucauccucgcaggaaacgccuucaccgcaggcaaaaucaucuucgccgcagucccacccaauuuucccaccgaaggccuaucacccucccaagucacaauguucccccacaucauugucgacguacgacaacucgaacccguccucaucccccuacccgacguccguaacaacuucuaccacuacaaccagagcaacgaccccacaauaaaacucaucgccaugcuauacacuccccucagagccaacaacgccggugaugacguauucaccguuuccugcagaguccuaacaagacccagccccgacuucgacuucaucuuccucguacccccaaccgucgaaucacgcaccaaacccuucacaguccccauccuaacgguagaagaaaugacaaacucccgcuucccaauaccccucgaacgccuauacaccggccccuccuccgccuucgucguccaaccacaaaacggccgaugcaccacagacggcguccuccucggcaccacccaacucagcgcagucaacaucugcaccuuccgcggagacgucacccacauugccggcucgcgaaacuauaccaugaaccucgccucccaaaauuggaacaacuaugaccccaccgaagaaaucccugcaccccuaggcaccccagacuuuguuggaaaaauacagggcaugcuaacccaaacaacccgcuccgauggcucaacccgaggacacaaagccaccguccuaaccggauccgcagacuucgcccccaagcucggccgcguccaauucgcuaccgacaccgacaacgacuucgaaagcggccaaaacacaaaauucacacccgucggaguuauccaagacggaagcaccacacaccguaacgaaccccagcaauggguacuccccaacuacuccggacguacaggccacaacguacaccucgcccccgccgucgcacccacuuacccaggcgaacaacuccuauucuuccgcucuaccaugcccggcuguuccggcuaccccaacauggaccuagacugccuccucccacaagaauggguacaacacuucuaccaagaagccgcaccagcccaaagcgacgucgcacuacuacgcuucgucaaccccgacacaggacgcguacuguucgaaugcaaacuacacaaaucaggcuacgucacagucgcucacaccggacaacacgaccucgucaucccacccaacggcuacuuccgcuuugacucaugggucaaccaauucuacacacucgcucccaugggcaacggcaccggccgacgccgcuaa

SEQ ID NO: 38076 - RNA, 1617 nt, Artificial Sequence
  derived and/or modified sequence opt11 from VP1__Norovirus_and/or_Norovirus-like__AB541253
augaaaauggcguccaacgacgccaacccuuccgacggcucagccgccaaccucgucccugaagucaacaacgagguaauggcccuagaacccgucgucggagcagccauugccgccccuguagccggacaacagaacgugauugacccauggauacguaacaacuucguccaagcucccggcggagaguucacagucucaccacgcaacgccccaggagaaaucuuauggucugcaccccucggacccgaccucaaccccuaccucucacaucuagcccgcauguacaacggcuacgccggcggcuucgaaguacaaguaauccucgccggaaacgcauucacagccggcaaaaucauauucgccgccgucccucccaacuucccaaccgaaggccuuagccccucccaaguaaccauguucccccacauaaucgucgacgucagacagcuagaacccguccuaaucccccuacccgauguccgcaacaacuucuaccacuacaaccaaagcaacgacuccacuaucaaacuuauagccaugcucuacacaccccuacgcgcaaacaacgcaggcgacgacgucuucaccgucuccugccgcguccucacccgcccgucucccgacuucgacuucauauuccucguucccccaaccgucgaaucccgcacaaaacccuucaccguccccauccuaaccgucgaagaaaugacaaacucacgcuuccccaucccacucgaaaaacuauucaccggaccaaguuccgccuucgucguccaaccccaaaauggccgaugcaccacagacggaguccuccucggcacuacacaauuaagccccgucaacauaugcacauuccguggcgaugucacccacaucgcagguucacguaacuacaccaugaaccucgcaucacuaaacuggaacaacuacgaccccacagaagagauacccgccccucucggcaccccagacuuugucggaaaaauccaaggaguccuuacacaaaccacuaaaggcgacggcuccacccgcggccacaaagccaccguauacaccggcucagcccccuuuacacccaaacucggauccguacaguucuccaccgacaccgaaaacgacuucgaaacacaccaaaacacaaaauucacccccgucggcgucauacaagacggaucuaccacccaucgcaacgaaccacaacaauggguccuccccucauacucaggccgcaacguccacaacguacaccucgcaccagcugucgcccccaccuuccccggcgaacaacuccucuucuuccgaucaaccaugcccggaugcucaggcuaccccaacauggaucucgacugccuccucccccaagaauggguacaacauuucuaccaagaagccgcacccgcucaauccgacguagcccuacuccgauucgucaaccccgacacagggcguguccucuucgagugcaaacuccacaaauccggcuacgucaccguagcccacaccggccaacacgaucucgucaucccaccaaacggguacuuccgauucgauuccugggucaaucaauuuuacacccuagcccccaugggcaacgguaccggcagaagacgcuaa

SEQ ID NO: 38077 - RNA, 1617 nt, Artificial Sequence
  derived and/or modified sequence opt11 from VP1__Norovirus_and/or_Norovirus-like__AB541250
augaaaauggcuucaaacgacgccucccccuccgacggcuccgccgcuaaccucguccccgaagucaacaacgaaguaauggcccuugaacccgucgucggcgccgcaaucgcugcccccguagccggccaacaaaauguaaucgaccccuggauccguaacaacuucguccaagcgcccggaggcgaguucaccguuucuccccgcaacgcccccggagaaauccucugguccgcgccauuaggcccagaccucaaccccuaccuaucccaccuagcccguauguacaacggguacgcgggcggcuucgaaguucaagucauccucgccgguaacgccuucaccgcaggcaaaaucauauucgcagccgucccuccaaacuuccccaccgaaggccuauccccuucccaaguuacaauguucccccacauaaucgucgacguccgccaacucgaacccguccucauaccccuccccgacgucagaaacaacuucuaccacuacaaccaaucuaacgacucgaccaucaaacucaucgccaugcucuacaccccacuccgcgccaacaaugccggcgaagacguuuucacugucucuugccgcguucuaacacgacccucccccgacuucgacuucauauuccuuguucccccaaccguagaaucccgaaccaaacccuuuacaguacccauccucaccgucgaagaaaugaccaacucccgcuuccccaucccccucgaaaaacucuucacaggaccuucaagcgcauuuguaguccaaccccaaaacggacgaugcacaaccgacggaguacuccuaggcaccacccaacucucccccguaaauaucugcaccuuccgaggcgacgucacccacaucgcaggcucccgaaacuacaccaugaaccucgcaucccuaaacuggaacaauuacgaccccacagaagaaauccccgcaccccuaggaacacccgacuucgucggcaaaauccaaggcgucuugacccagacaacaaaaggagacggaucaacccgcggacauaaagccacaguauacaccggcuccgcacccuuuaccccaaaacuaggcuccguccaauucuccaccgacacugaaaacgacuucgaaacacaccaagacacuaaauucacccccgucgguguaauccaggacggcggcacaacacaccguaacgagccgcaacaauggguccuccccuccuauucaggccgcaacguccaaaauguacaccucgcccccgccgucgcacccaccuucccuggcgaacaacuccucuucuuccgaucaaccaugccaggcugcucaggcuaccccaacauggaccuagauugccuccucccacaagaaugggugcaacacuucuaccaggaagcugcucccgcccaauccgacgucgcccuacuccguuucgucaacccugacacaggucgaguccucuucgaaugcaaacuacacaaaucgggcuacgucacugucgcacacaccggccaacacgaccucgucaucccacccaacggcuacuucagauucgacagcugggucaaccaauucuacacccuugcccccaugggcaacggcaccggccggcgccgcuaa

SEQ ID NO: 38078 - RNA, 1617 nt, Artificial Sequence
  derived and/or modified sequence opt11 from VP1__Norovirus_and/or_Norovirus-like__AB541211
augaaaauggcauccaacgaugccaaccccuccgacggcucagcugcaaaccuaguuccugaagucaacaacgaaguuauggcccucgagccagucguaggcgccgcaaucgccgccccagucgccggccaacaaaacguaaucgaccccuggauaagaaacaacuuuguccaagcccccggcggcgaauuuaccgucucaccccgaaacgcuccaggcgaaauccucuggucagcaccccuaggccccgaccucaauccauaccucucgcaccucgcccgcauguacaacggcuacgccggggguuucgaaguccaagucauacuggccggaaacgccuucaccgcaggaaagauuaucuucgccgccgucccacccaacuuucccacagaaggccucucacccucacaagucaccauguucccccacauaaucgucgacguacgacaacuagaaccuguccucaucccacuccccgacguccgaaacaacuucuaccauuacaaccaauccaacgacuccaccauaaaacuuaucgcaaugcucuacacaccccuccgagccaacaacgcaggcgaagacgucuucaccgucucuugccgcguccuuacccgccccagccccgacuuugacuucaucuuccucgucccacccaccgucgaaucucgaaccaagcccuucaccguucccauccuaaccguagaagaaaugacaaacucccgcuuccccaucccacuugaaaagcuauuuaccggacccucauccgccuucgugguccaaccccaaaacggacgaugcaccaccgacggcguacuccuaggaaccacccaauuauccccaguaaacaucugcaccuuucgcggcgacgucacacacauagccggcucccgcaacuacaucaugaaucucgccucacucaacuggaauaauuaugaccccacagaagaaaucccagcaccccuaggcacaccagacuucgucggcaaaauccaaggcguacucacccaaaccaccaaaggugacggcucaacacgcggccacaaagccaccguauacaccggaucagcccccuucacccccaaacucgguuccguacaauucuccacggacaccgaaaacgacuucgaaacccaccaaaacaccaaauuuacccccguaggcguaauccaagacggcuccaccacccaccgaaacgaaccccaacaguggguccuacccagcuacuccggccgcaacguucacaacguacaccucgcaccagccgucgcccccacauuccccggcgaacagcuccucuucuuccgcucuaccaugccuggaugcuccggcuacccuaauauggaccucgacugccuccucccacaagaauggguccaacauuuuuaccaagaagccgccccagcccaauccgaugucgcacuauuacgcuucgucaacccagacacaggccgcguacucuuugaaugcaaacuacacaaaucaggauacguaaccgucgcccacaccggccaacacgaccuaguaauacccccaaacggcuacuuccgcuucgacucaugggucaaccaauucuacacacuggcacccaugggcaacgggaccggccgccguagauaa

SEQ ID NO: 38079 - RNA, 1617 nt, Artificial Sequence
  derived and/or modified sequence opt11 from VP1__Norovirus_and/or_Norovirus-like__GQ246797
augaaaauggccucauccgacgccaacccaucagaugguucaacagcuaaccugguucccgaagucaacaacgaaguuauggcacucgaacccguugucggugcagcaaucgcggccccaguagccggccaacaaaacguaauugacccauggauccgcaacaacuucguacaggcccccggcggagaguucaccgucucaccacgaaacgcuccuggcgaaauccuuugguccgcaccucucggcccagaccucaaccccuaccucucccaccucgcccgcauguacaacggcuacgcgggcggcuucgaaguccaaguaauccucgcuggaaacgccuucaccgccggcaaaaucauauucgccgcagucccaccaaacuuccccaccgaaggccucuccccuucacaagucaccauguucccacacaucaucgucgacguccgccagcucgaacccguccuaauaccccuuccagacguccgcaacaacuucuaccacuacaaccaauccaacgaccccacaauaaaacugaucgcaaugcucuacacaccccuacgcgccaacaacgccggagacgacgucuucacagucuccugccgcguccuaacucgccccucccccgacuucgacuucaucuuccucguacccccuacugucgaaucccgcaccaaacccuuuucugucccaauccuaaccgucgaagaaaugaccaacuccagauuccccauaccacuggaaaaacuauucaccggcccauccagcgcauucguaguccaaccccagaacggccgcugcaccacugacggaguccuacuagguacaacacaacucuccccuguaaauaucugcacauuccgaggcgacgucacacacaucgccggaucccgcaacuacacaaugaaucucgcaacccaaaacuggaacucauacgacccgaccgaagagauccccgcaccacuaggaacccccgauuucgucgguaagauucaaggaguccucacccaaacaacucgcgcugacggcuccacccgcggccacaaagcaacagucuacaccggauccgccgacuucgcacccaaacucggcagaguccaauucgcaacagacaccgacaaugacuucgacgccaaccaaaacacaaaauucacccccguuggcgucauccaagacggcgacaccgcacaccgaaaugaaccccaacaauggguccuccccucauacucaggccgcaacucccacaacguccaccuggccccagccgucgccccaacauuccccggcgaacagcuccucuucuucagauccaccaugccaggcugcuccggcuacccaaacauggaccucgacugccuccucccccaagaauggguccaauauuucuaccaagaagccgcuccagcccaauccgacgucgcccuucuaagauucgucaaccccgacaccggacgaguccuauucgaaugcaaacuccacaaaucaggauacguaacaguagcucacacuggccaacaugaccuagugaucccacccaacggcuauuuccgauucgacuccugggucaaccaauucuacacacucgcccccaugggcaacggcaccggccggcgccgcuaa

SEQ ID NO: 38080 - RNA, 1617 nt, Artificial Sequence
  derived and/or modified sequence opt11 from VP1__Norovirus_and/or_Norovirus-like__GQ246794
augaaaauggcuuccuccgacgcaaacccuuccgacggcagcacugccaaccuaguacccgaggucaacaacgaagucauggcacucgaacccgucguuggcgccgccauagcagccccagucgccggccaacaaaacguaaucgaccccuggauccgaaacaacuucguacaagccccaggcggcgaguucaccgucuccccacgcaacgcccccggcgaaauccccuggucggcaccccucggccccgaucucaacccauaccucucccacuuagcccgcauguacaacggcuacgccggaggauucgaaguacaaguaauccuagccggcaacgccuucaccgcaggcaaaaucaucuucgccgcaguacccccaaacuuccccacagaaggcuuaucccccucucaagucacaauguucccccacaucaucgucgacguucgccaacuagaacccguacucaucccucucccagacguacguaacaacuucuaccacuacaaccaaagcaacgaccccaccaucaaauuaauagccaugcuuuacacaccccuacgcgcaaacaacgcaggcgacgacgucuucaccgucuccugccgaguccucacccgccccuccccagauuucgacuucaucuuccucgucccaccaaccgucgaaucccgcacaaaaccauucagcgucccuauccucaccguugaagaaaugaccaacucucgauuucccaucccccucgaaaaacucuucaccggacccuccagcgccuucgucguccaaccacagaacggccgaugcaccaccgacggaguccuccucggaaccacacaacucucaccggucaauauaugcaccuuucgcggagacgucacacacauaaccggcucccgcaacuacacaaugaaccucgccacccaaaacuggaacucauacgaccccaccgaagaaauacccgccccacucggcacaccugacuucgucgguaaaauacaaggaguccucacccaaacuacccgcgccgauggaucuacccgcggccacaaagccacaguauauaccggaucagccgacuucgccccuaaacucggccgcguccaguucgcgaccgacaccgacaacgacuucgacgccaaccaaaacaccaaauucacccccguaggagucauccaagacggagacaccgcacaccgcaacgaaccccaacaauggguacuaccaagcuacucaggccgcaacucccacaacguucaccucgcccccgccguagcacccacauuucccggcgaacaacuacucuucuucagauccaccaugccaggcugcuccggauaccccaauauggaccucgacugccuccucccccaagaauggguccaauacuucuaccaagaagccgcccccgcacaauccgacgucgcacuccuccgauucgucaaccccgacacagggcgaguccucuucgaaugcaaacuccacaaaucuggcuacguaacagucgcccacacuggccaacacgaccucgucaucccacccaacggcuacuuccguuucgacuccugggucaaccaauucuacacacuagcccccaugggcaacggcacaggaagacgccgauaa

SEQ ID NO: 38081 - RNA, 1617 nt, Artificial Sequence
  derived and/or modified sequence opt11 from VP1__Norovirus_and/or_Norovirus-like__EU876884
augaaaauggcuucaaacgacgcaaaccccucugacgguuccaccgcaaaccucguacccgaagucaacagcgaagucauggcacuugaaccagucgucggagccgcaaucgcagcacccgucgcaggccaacaaaacgucauagaccccuggauccgcaacaacuucguccaagcccccggaggcgaauuuaccgucucuccccgcaacgccccaggugaaauccuuugguccgccccacuaggccccgaccucaaccccuaccuaucacaccuagcccgcauguacaacggcuacgccggcggauucgaaguccaaguaauccuagccggcaacgccuucaccgccggcaaaauaaucuucgccgccguaccacccaacuuccccaccgaaggacuaagccccucacaaguaacuauguucccccacauaaucgucgacguucgccaacuugaacccguacuuauaccacuacccgacguucggaacaauuucuaccacuacaaccaauccaaugaccccacaaucaaacucaucgccaugcucuacaccccucuccgagccaacaacgcgggagacgacgucuucacagucuccugucgcguacucacccgccccucaccagacuucgacuucaucuuccucgucccacccaccgucgaaucacgaacaaaacccuucaccguacccauccucaccgucgaagaaaugaccaacuccagauucccuauaccacucgaacgccuauacacagguccaucaucugccuucguaguccaaccccaaaacggacgcugcaccaccgacggcguacuccucgguacaacccaacuuucagccgucaacaucugcacauuccguggcgacguuacucacaucgcaggauccagaaacuauaccaugaaucuugcaagccaaaacuggaacaacuaugacccaacagaagaaauacccgcaccccuuggcacaccagacuucgucgguaaaauucaaggcaugcucacacaaaccacccgcucugacggcuccacacgcggacacaaagccaccguccucaccggcucagccgacuucgcccccaaacuaggccgcguccaauucgccaccgacaccgacaacgacuucgaaucaggacaaaacaccaaauucaccccagucggcgucauacaggaugguuccacaacccaccggaacgaaccccaacaauggguccucccaucauauuccggccgaaccggccacaacguccaccuugccccagccguugcccccacauaccccggcgaacaacuccuauucuuccgcuccacaaugcccggcuguagcggauaucccaacauggaccuugacugccuccucccacaagaauggguacagcacuucuaccaagaagccgccccagcccaauccgacguagcauuacucagauucgucaaccccgacaccggucguguacucuucgaaugcaaacuucacaaaucaggguaugucaccgucgcacacaccggccaacacgaccucguaauaccacccaacggguacuuccguuucgacuccuggguaaaucaguucuacacccucgcccccaugggaaacggagccggccgcagacgcuaa

SEQ ID NO: 38082 - RNA, 1617 nt, Artificial Sequence
  derived and/or modified sequence opt11 from VP1__Norovirus_and/or_Norovirus-like__FJ411170
augaaaauggccuccaacgacgccucccccagcgauggcucgaccgcaaaccucgucccugaagucaacaacgaagucauggcccuugaacccguaguaggugcagccaucgccgccccagucgccggccaacaaaacgucaucgacccuuggauccgcaacaacuucguacaagcccccggaggcgaguucaccguauccccacgcaacgcacccggcgaaauacucugguccgcaccccucggcccagaccuuaaccccuaccucucacaccuggcccgcauguacaacggcuacgccggcggcuucgaaguccaaguaauccucgccggcaacgccuucaccgccggcaaaauuaucuucgcugccguacccccgaauuuccccacagaaggccucucccccucacaagucacaauguucccccacaucaucgucgacguccgacaauuagaaccuguccuaaucccacuccccgauguccgaaauaacuucuaccacuacaaccaauccaaugacccaaccauaaaacucaucgccaugcuauacacuccccuacgcgcgaacaacgccggcgaagacgucuucacagugucaugccgcguccuaacccgacccuccccagacuuugacuucaucuuccucguaccacccaccgucgaaucccgaaccaaacccuucaccgucccaauacucaccgucgaagaaaugacaaacucccguuucccaaucccucuagaaaaacuauucaccggucccucuggugccuucgucguccaaccucaaaacggccgcugcaccaccgacggaguccuccuaggcaccacacaacuaucccccgucaacauaugcaccuuccgaggagacguuacccacaucgcaggaacccacgacuacacaaugaaccuagccucacaaaacuggaacaauuacgaccccaccgaagaaauacccgccccucucggaacccccgacuucguaggcaaaauccaaggaguccucacccaaacuacacgaggcgacggaucaacacgaggccauaaagccacgguauccaccggcuccguacacuucacccccaaacucggcuccguacaauuuacaaccgacaccaacaaugauuucgaaaccggucaaaacaccaaauucacccccguaggcgucguccaagacggcaauagcacccaccaaaacgaaccccaacaauggguacuuccuaacuacuccggccgaaccggccacaacguccaccucgcccccgcagucgcccccacauuccccggcgagcaacuacuauucuucagauccaccaugccagguugcuccggauauccaaauaugaaucucgacugccuccucccucaagaguggguccaacacuucuaccaagaagccgcacccgcccagagcgacgucgcacuacuccgcuuuguaaacccagacaccggacgcguacucuucgaaugcaaacuucacaaaucuggauacguaacugucgcccacaccggccaacaugaccucgucauacccccaaauggcuacuucagauucgauuccugggucaaccaauucuacacacuugcacccaugggcaacggcgccgggagacgucgcuaa

SEQ ID NO: 38083 - RNA, 1617 nt, Artificial Sequence
  derived and/or modified sequence opt11 from VP1__Norovirus_and/or_Norovirus-like__EU839589
augaaaauggccuccaacgacgccaaccccagcgacggcucagcugccaaccuugucccagaaguaaacaacgaaguaauggcacucgaacccguaguaggagcagccaucgccgcaccggucgccggacaacaaaacgucaucgaccccuggauacguaacaacuucguccaagcccccggaggagaguucacagucucaccccgaaacgcccccggagaaauccugugguccgccccgcugggccccgaccucaaccccuaccuaucccaccucgcccgaauguauaacggcuacgccggcggauucgaaguccaggucauacucgccggcaacgccuucacagccggaaaaaucaucuucgccgccgucccucccaacuuccccaccgaaggacucuccccaucccaagucacaauguucccccacauaauaguagacguucgucaacucgaacccguguuaaucccccuucccgacguccgcaacaacuucuaccacuacaaccaauccaacgacaguaccauaaaacucauagcaaugcucuacacuccccuccgcgccaacaacgccggagacgacgucuucaccguauccugccgcguccuuacacgccccagccccgacuucgacuucaucuuccuagucccaccgaccgucgaauccagaaccaaacccuucacaguaccuauccuaacaguagaagagaugacuaacucccgcuuccccaucccacuagaaaaacucuucaccggacccucaggcgccuucguaguccagccccaaaacggacgaugcacuaccgacggaguccuacucggcaccacacagcuguccccaguaaacaucugcacauuucgaggagacguaacccacaucgccggcucgagagauuacaccaugaaccucgccucccucaauuggaacaacuacgacccaacagaagaaauccccgcaccccucggcaccccagauuuuguaggcaaaauccaaggcguccucacacagaccaccaaaggcgacggguccacacguggucacaaggccacagucuacacaggaagcgcucccuucacacccaaacuaggcuccguccaguuccgaaccgauacugaaaacgacuucgaaacccaucaaaacaccaaguucacaccagucggaguaauucaagacggcuccaccacccaccgcaacgaaccucaacaauggguccuccccucauacuccggucgaaauguacacaacguccacuuggcccccgcagucgcucccacauuccccggcgaacaacuucucuucuuccgcuccaccaugccaggcugcucgggcuacccaaauauggaccucgacugccuucuaccacaagaauggguccaacacuucuaccaagaagcagccccagcccaauccgacguagcccuacuccgauucguaaaccccgacacaggccgcguccuauucgagugcaaacuucacaaauccggcuacguaaccgucgcccauaccggccaacacgaccucgucaucccacccaacggcuacuuucgcuucgacagcugggucaaccaauucuauacccuugcccccaugggaaacggcaccggccgccgccgcuaa

SEQ ID NO: 38084 - RNA, 1617 nt, Artificial Sequence
  derived and/or modified sequence opt11 from VP1__Norovirus_and/or_Norovirus-like__KX353961
augaaaauggcuucaucagacgcaaaccccagcgacggcuccacugccaaccuaguccccgaagugaacaacgaagucauggcccucgaacccguaguaggcgccgccaucgccgcccccguagcuggccaacaaaacguaauagaccccuggauccgcaacaacuucguccaagcuccuggcggcgaauuuaccgucucaccccgaaacgcccccggugaaauccucugguccgcaccccucgguccugaccucaacccauaucuuagccaccuggcccgcauguacaacggcuacgccggcgguuucgaaguccaagucauccuagccggcaaugccuucacagccggaaaaaucaucuucgcagcugucccacccaacuuccccacagaaggccucagccccucccaagucaccauguucccacacaucauuguagacguacgucaacucgaacccguacuaauacccuugcccgacguaagaaacaacuucuaccacuauaaucaaucgaacgaccccacgauaaaacuaauagcaaugcuguacacaccccuccgcgccaacaacgccggugaugacgucuucaccguaucaugccgaguacucacccgacccuccccugacuucgacuucauauuccuaguaccacccaccgucgaaucccgcacuaaacccuuuucuguccccauccucaccgucgaagaaaugacgaacuccagauuccccaucccccuagaaaaacucuucacagggcccuccuccaccuucguaguacaaccccagaacggacgcugcaccacagacggcguacuccucggcacaacccaacuaucacccgucaacaucugcacuuuccgaggcgacgucacccacauagccggaucucgaaauuacacaaugaaccucgcaucucaaaacuggaacucuuacgaccccacagaagaaaucccugcaccccucggaacaccagacuucgucggcaaaauacaagguguccuaacccaaacuacccgcaccgacggcagcacccgcggacacaaagccaccgucuacaccggcuccgccgacuucucccccaaacucggccguguccaauucgccaccgacaccgacaacgacuucgaugccaaccaaaacacaaaguucacacccgucggcguaauccaagacggcgacacagcccaccgcaacgaaccccaacaauggguccuccccuccuacuccggccgcaacacacacaacguccaccucgcccccgccguugcccccaccuuuccaggugaacaacuccucuucuuccgaucgacaaugcccggauguuccggcuaucccaacauggaccucgacugccuacucccccaagaaugggugcaguacuuuuaucaagaagccgcccccgcccaaucagacgucgcacuccuccgauucgucaaccccgacaccggccgcguccuauucgaaugcaaacuccauaaauccggcuacgucacagucgcccacacaggacaacacgaccucgucauaccacccaacggauacuuuagauucgacagcuggguaaaccaauucuauacacucgcccccaugggcaacggcacuggccgccgacguuaa

SEQ ID NO: 38085 - RNA, 1617 nt, Artificial Sequence
  derived and/or modified sequence opt11 from VP1__Norovirus_and/or_Norovirus-like__AB933757
augaaaauggccucaagcgaugccaaccccucagacggguccaccgcaaaccuaguaccagaagucaacaacgaaguaauggcccucgaacccgucgucggagccgccaucgccgcgccuguagccggacaacaaaaugucaucgacccauggauccgcaacaacuucguacaagcacccggcggcgaauuuaccgucagcccccgaaacgcccccggagaaauccuaugguccgccccacuaggccccgaccucaaccccuaccucucccaucucgcccgaauguacaacggcuacgcaggcggauucgaaguacaaguaauacuagcaggcaaugccuucaccgcuggaaaaaucauauucuccgcaguucccccuaacuuccccaccgaaggccuauccccaucucaagucaccauguucccccacauaaucguagacguccgccaacucgaacccguacucaucccccucccagauguacgcaacaacuuuuaccacuacaaucaauccaacgaccccacgaucaaacucaucgccaugcucuacacaccccuccgagccaacaacgcaggagacgacgucuucacagucucuugucgcguacuuacacgccccucacccgauuucgacuucaucuuccucgucccaccgacaguagaaucccgaacuaaacccuucucagucccaauccucacagucgaagaaaugaccaacucccgcuucccaaccccgcuagaaaaacuauucacaggaccaucguccaccuucguaguccaaccucaaaacggccguugcacuaccgacggcguucuccucggcaccacacaauuaucaccagucaacauuugcacuuuccgaggcgacguaacacacauaacaggaucccacaacuacacaaugaaccuagccucacaaaacuggaacuccuacgacccgaccgaagaaauccccgcaccacucggaacccccgacuuugucggcaaaauccaaggaguccucacccaaaccacccgcaccgacggcuccacacgcggccacaaagccacagucuacaccgggucagccgaguucucuccgaaacucggccgcguccaaguagcaaccgauacaaacaaugauuucgaugccaaccaaaacaccaaauucaccccagucggcguaauccaagacggcggcaccacccacagaaacgaaccacaacaauggguccuacccuccuacagcggccggaacgcccacaacguccaccucgcccccgccgucgcccccacauucccuggugaacaacuacucuucuuccgcucaacaaugccaggcugcuccggcuaccccaacauggaucucgacugccuacucccccaagaauggguccaacacuucuaccaagaagccgcccccgcccaaucagacguagcccuccuccgauucgucaauccagacaccggccggguacucuucgagugcaagcuccauaaauccggcuacgucaccgucgcacacaccggacaacacgaccucgucaucccacccaacggcuacuuccgcuucgacuccugggucaaccaauucuacacucucgcucccaugggcaacgguaccggccgucgccgcuaa

SEQ ID NO: 38086 - RNA, 1617 nt, Artificial Sequence
  derived and/or modified sequence opt11 from VP1__Norovirus_and/or_Norovirus-like__KM245074
augaagauggccuccaacgacgcuaaccccuccgauggguccgcagccaaccuuguucccgaagucaacaacgaagucauggcucuagaaccaguaguaggcgccgccaucgcagcccccguagccggccaacaaaaugucaucgaccccuggauccgcaacaacuucguccaagcaccagguggagaguucaccgucuccccucgaaacgccccaggcgaaauccucugguccgcaccccuaggccccgaccuaaaccccuaccucucccaccucgcaaggauguauaacggcuacgcaggcggcuucgaaguccaagucauccucgcgggaaaugccuucaccgccggcaaaaucaucuucgcagccgucccacccaacuuccccaccgaaggacucucccccucccaagucaccauguucccccacaucaucguugacguccgccaacucgaacccguccucaucccccuacccgacguacgaaacaacuucuaccacuacaaucaaucaaacgacucaaccaucaaacuaauagcaaugcucuacacuccccuucgcgcaaacaacgccggcgacgacguauucaccgucuccugccgcguacuaacccgaccaucccccgacuucgacuucaucuuccucgucccaccuaccguagaaucccguacaaaacccuucaccguccccauccucaccgucgaagaaaugaccaacucucgauucccaauaccccucgaaaaacuauucaccggccccuccagcgcauucgugguacaaccccaaaacggccgcugcaccaccgacggaguccuacuaggcaccacccaacucagccccgucaacauaugcaccuuccgcggcgauguuacccacaucgccggcucccgcaacuacacuaugaaucucgccucccucaacuggaacaacuacgaccccaccgaagagauccccgccccacuaggaacccccgacuucgucgguaaaauccagggcguccucacccagaccaccaaaggugauggcagcacacguggccacaaagcaaccgucuauacaggcuccgcagacuucaccccaaaacuuggauccguccaauucgccacagacaccgaaaacgacuucgaaacccaccaaaacacaaaauucacacccguagggguuauccaggacgguuccacuacucaucgcaaugaaccccaacaaugggucuugcccucauacuccggccgaaacgugcacaacguccaccucgcuccugcaguagccccaaacuucccaggcgaacaacuacucuucuuccgcuccacaaugcccggaugcuccggauaccccaacauggaccucgacugccuacucccacaagaauggguccaacacuucuaccaagaagccgccccugcacaauccgacgucgcccuccuccgauucgucaaccccgacaccggacgcguccucuuugaaugcaaacuccacaaauccggauacguaacagucgcccacaccggccaacacgaccucgucauuccaccaaauggcuacuucagguucgacuccugggucaaccaauucuacacauuagcccccauggguaacgguaccggccgccgccgauaa

SEQ ID NO: 38087 - RNA, 1617 nt, Artificial Sequence
  derived and/or modified sequence opt11 from VP1__Norovirus_and/or_Norovirus-like__EU921368
augaaaauggccagcaacgacgccaccccauccgacggcucaaccgccaaccuaguccccgaagucaacaacgaagucauggcacucgaaccaguagucggcgccgccaucgccgcccccguagcuggacaacaaaacguaaucgaccccuggauccgaaacaacuucguacaagccccugguggcgaauuuaccgucuccccgcguaacgcccccggagaaauccuuugguccgcaccacuaggaccagaccuaaauccauaccuaucccaccucucacgcauguacaacggauacgccgggggcuucgaaguccaagucauccucgcuggcaacgcauucacagccggcaaaaucaucuucgcugccgucccacccaacuuccccaccgaaggccuaucacccucacaaguaaccauguucccccacaucaucguagauguccgccaacucgaaccaguccuaauuccacuccccgacguucgcaacaacuucuaccacuauaaccaaucaaacgacccgaccauaaaauuaaucgcaaugcuuuacacaccacuacgcgcaaacaacgcaggcgacgacgucuucacuguaagcugcagaguccucacacgccccagcccagauuucgacuucaucuuccucgugccacccaccgucgaaucacgaaccaaacccuucuccguccccauacucacagucgaagaaaugaccaacucccgauuccccaucccccucgaaaagcuauuuacaggccccuccagcgccuucguuguccaaccccaaaacggacgcugcaccaccgacggcguccuccuaggcaccacccaacucagccccgucaauaucugcaccuuccgcggaaacgucaccaacaucgccggcucucaaaccuauaccaugaaccucgcuagccagaacuggaacaacuacgacccaacugaagaaauuccagcaccccucggaacccccgacuucgucggcaaaauucaaggcgucuuaacccaaaccacaaaaggagacggcucaacccgcggccacaaagccacaguauccaccggcuccgcccaauuuacacccaaacucggcucaguccaauucuccacagacaccucuacagacuucgaaaccggccaaaacacccgauucacuccagucggcguuauccaagacggcuccaccacccacaaaaacgaaccccagcaguggguccuccccucauauuccggccgagacucacauaacguccaccucgcccccgccgucgcccccacauuccccggcgaacaaauacucuucuuccgcucuaccaugcccggcuguucuggauauccaaacauggaccucgacugccuccucccacaagaauggguccaacacuuuuaccaggaauccgcccccgcccaauccgacgucgcccuccuccgauucguaaacccagacacuggacgaguacuauucgaaugcaaacuccacaagucaggcuacgucaccguagcacacaccggccagcacgaccuagucauacccccaaacggauacuuccgcuucgacuccugggucaaccaauucuacacacucgcaccaauggguaacggcgccggcagaaggcgcuga

SEQ ID NO: 38088 - RNA, 1617 nt, Artificial Sequence
  derived and/or modified sequence opt11 from VP1__Norovirus_and/or_Norovirus-like__EU921338
augaaaauggccuccaacgacgcaacccccucagacggcuccaccgcaaaccuaguccccgaagugaacaacgaaguaauggcccucgaacccgucguaggugccgcaauugcagcacccgucgcuggccaacaaaacguuauugaccccuggauccgcaacaacuucguucaagcacccggaggggaguuuaccgucucccccagaaacgcuccgggcgaaauacucuggagcgcaccccucggucccgaucucaacccguaccucucacaccuagcgcgaauguacaauggcuacgccggcgguuucgaaguccaaguuauacuagccggcaaugcauucacagccggcaaaauaaucuucgccgccguacccccaaacuucccaaccgagggccuuucucccucccaagucacaauguucccccacaucauagucgacguacgacaacucgaacccguccuaauaccauuacccgauguccgcaacaacuucuaccacuacaaccaauccaacgaccccacaaucaaacucaucgcgaugcuuuacaccccacuacgagcaaacaacgccggugacgacgucuucaccgucuccugccgaguccuaacccgccccucccccgacuucgacuucauauuccucguacccccaaccgucgaaagccgcacaaaacccuucucggugcccauccucacaguagaagaaaugaccaacucaagauucccaaucccgcucgaaaaacucuucaccggccccucauccgcauucguaguccaaccacaaaacggccgcugcacuaccgacggcguucuucucggaaccacccaacuuucucccgucaacaucugcaccuuccgaggcgacgucacccacaucgcaggcacacaaaacuacacaaugaaccucgcuucccaaaacuggaacaacuacgacccaaccgaagaaauacccgcgccccuaggaacccccgacuucgucggcaaaauacaaggcguccuaacccaaaccacccgaggcgacggcuccacccgaggacauaaagcaacagucucaaccggcuccguccacuucacccccaaacuaggcucgguccaauucuccaccgacaccuccaacgacuucgaaacaggucaaaacacccgcuucacccccgucggagucguccaagacggauccaccacucaccaaaacgaaccacaacaauggguccuaccagcauacuccggacgcgacaaccacaauguccaccucgcuccagccgucgccccuacauuccccggcgaacaacuccucuucuuccgauccacaaugcccgggugcucaggcuacccaaacaugaaccucgacugccuacucccccaagaauggguccaacacuucuaccaagaaucagcccccgcccagucugacguugcccuacuacgauucguaaauccugacaccggacgcguccuauucgaaugcaaacuccacaaauccggcuacgucaccguagcccacaccggccaacaugaccucguaaucccacccaauggcuacuuccgauucgacuccugggucaaucaauucuacacucuagcccccaugggcaacggcgccggucgcagacgcuaa

SEQ ID NO: 38089 - RNA, 1617 nt, Artificial Sequence
  derived and/or modified sequence opt11 from VP1__Norovirus_and/or_Norovirus-like__LC005708
augaaaauggccuccaacgacgccucccccuccgacggcucagccgccaaccuaguccccgaaguuaacaacgaggucauggcacucgaaccagucgucggcgccgccauagcugcccccgucgccggccagcaaaacguaaucgacccuuggauacgaaacaacuucguacaagccccaggcggcgaguucacaguaagcccccgcaacgcccccggugaaauccuuugguccgcaccccucggccccgaccucaacccguaccuaucccaucuagcccgcauguacaacggcuacgccggcgguuucgaaguccaagucauccucgccggaaacgcauucaccgcuggaaagaucaucuucgcagccguacccccaaacuuccccacagaaggucuuucccccucccaagucaccauguucccccacaucauagucgacguccgacaacuugaacccguccucauaccccuccccgacguacgcaacaacuucuaucacuacaaccaguccaacgacuccacaaucaagcuaaucgccauguuauacacaccccucagagccaacaacgcaggagaagauguauucaccgucuccugccgaguccucacccgcccaucacccgacuucgacuucaucuuccucguacccccaaccgucgaaucacgcaccaagcccuucaccguccccauccucaccgucgaagaaaugaccaacucucgcuuccccaucccccucgaaaaacuuuucaccggacccuccuccgccuucguuguccaaccccaaaacggccguugcaccaccgacggcguucuccuaggcacuacccaauuaucuccugucaacauuugcacauuccguggugacguaacacacauagcaggcucccggaacuacacaaugaaccucgcgucucucaacuggaacaacuacgaccccacagaagaaaucccagcaccccuagguaccccugacuucgucggaaaaauccaaggcguccucacccaaaccaccaaaggagacggaucaacccgcggccacaaagccaccgucuacaccggcuccgccccauucacaccuaaacuaggcagcgugcaauucucuacagacaccgaaaacgauuucgaaacccaccaaaacaccaaauucacccccgucggcguuauccaagacggcgggaccacccaccgaaacgaaccccaacaauggguccuacccuccuauuccgggcgcaacguacaaaacguacaccucgccccugccguagcccccacguuccccggcgaacaacuacuauucuuccgcuccacaaugcccgguugcuccggauaccccaauauggaccucgacugucucuuaccccaagaauggguacaacacuucuaccaagaagcagcccccgcccaauccgacgucgcccuucuccgcuucguaaaccccgacaccggacgaguccucuucgaaugcaaacuacacaaauccgguuacgucaccgucgcacacaccggacaacacgaucuaguuaucccacccaacggcuacuuccguuucgacuccugggucaaccaguucuauacccuugcccccaugggcaacggcacaggccgacgacgauaa

SEQ ID NO: 38090 - RNA, 1617 nt, Artificial Sequence
  derived and/or modified sequence opt11 from VP1__Norovirus_and/or_Norovirus-like__LC005704
augaaaauggccucuaaugacgcuaaccccuccgacggcuccgccgccaaccuaguuccagaaguaaacaacgaggucauggcucuagaacccgucgucggcgccgcaaucgccgcgcccgucgcaggccaaaccaacgucaucgacccguggauccguaacaacuucguacaagcucccggcggcgaauuuaccgucucaccccgcaaugccccaggcgaaauccucugguccgccccacucggacccgaccucaaccccuaccuaucccaccucgcccgaauguauaacggcuaugcaggcgguuucgaaguccaggucauccucgcaggcaacgccuucaccgccggcaagaucaucuucgcggccguaccacccaacuuccccacagaaggccuaucccccucacaagucacaauguucccccacaucauaguagacguacgucaacucgagcccguccuuaucccccucccagacguucgaaacaacuucuaccacuacaaccaaagcaacgacucaacaauuaaacuaauagccaugcuauacacuccccugcgcgcuaacaacgccggcgaagacgucuucaccguaagcugucgcguccuaacccgccccucccccgauuucgauuucaucuuccucguaccacccaccguggaaucccgcaccaagcccuucaccguccccauacucaccgucgaagaaaugaccaacucccgcuucccaaucccccucgaaaaacuauuuaccggccccagcggagcauucgucguccaaccacaaaacggacgaugcaccaccgacgguguccugcuaggcaccacccaacuauccccagucaacaucugcacauuucgcggcgacgucacccacaucgccggcucccgcaacuacaccaugaacuuagcuucccucaacuggaacaacuacgacccaaccgaagaaaucccagccccauuaggaacccccgacuucgucggcaaaauccaaggcguacucacucaaaccacaaaaggagacggauccacccgcggccacaaagccaccgucuauaccggauccgcccccuucacuccuaaacuaggcucuguucaauuuucgacagacacugaaaacgacuucgaaacucaccaaaacaccaaauucacccccguaggcgucauccaagacggaagcaccacccaccguaacgaaccccaacaaugggugcuccccuccuacuccggacgaaacguucacaacguccaccuugcccccgcaguagccccaaccuuccccggcgaacaacuccucuucuuccgaucuacaaugcccggaugcagcggcuaccccaacauggaucucgacugucugcucccccaagaguggguccaacacuucuaccaagaagcagcccccgcccaaucagacguugcccuccuccgauucgucaacccugacacgggaagaguccuauucgaaugcaaacuccacaaaucaggcuacgucacugucgcccauacaggacaacacgaccucgucaucccacccaacggcuacuuccgcuucgacagcugggucaaccaauucuauacccuagcucccaugggcaacggaacaggaagacgcagauaa

SEQ ID NO: 38091 - RNA, 1617 nt, Artificial Sequence
  derived and/or modified sequence opt11 from VP1__Norovirus_and/or_Norovirus-like__KF429777
augaaaauggcgucauccgaugcaaacccaagcgacggauccgccgcuaaccucguccccgaagucaacaacgaagucauggcacucgaacccgucgucggcgccgccauugccgcacccguagccggccaacaaaacguaauagauccuuggauccgcuccaacuucguacaagcccccggaggagaguucaccgucucaccccgaaaugcaccgggagaaauacucuggucagcgccccuaggccccgaccucaaucccuaccucucccaccucgcccgcauguacaacggcuacgcaggcggauucgaaguccaagugauacucgccggaaacgcauucaccgccggcaaaauaauauucgcagccguaccacccaacuuuccaacagaaggacuauccccaucccaagucaccauguuuccccacaucaucgucgacguccgacaacuagaacccguacuaaucccccuccccgacguucgaaacaacuucuaccacuacaaccaauccaacgacagcaccaucaaacugaucgccaugcuauacacaccccuacgagcuaacaacgccggcgacgacguauucaccguaucuugccgcguccuaacacgcccauccccagacuucgacuucauuuuccucgucccgcccaccgucgaauccagaaccaagcccuucaccguccccauccucacagucgaagaaaugaccaacucccgcuuuccaauaccucucgaaaagcuauucaccggucccagcuccgcauucguaguccaaccccaaaacgggcgcugcacaaccgacggaguccuccucggcaccacccaacucuccccggucaacaucugcacauuuagaggagacgucacucacaucgcaggaucccgcaauuacacaaugaaccuagccucccuaaacuggucaaacuacgaccccaccgaagaaauccccgcaccccuaggcacucccgacuucguaggcaaaauacaagggguccuaacccaaaccacaaaaggcgacgguucaacaagaggccacaaagcuaccgucuauacaggguccgcagauuucaccccaaaacucggcucaguacaauucgcaaccgacacagagaacgacuucgaaacccaccaaaacacgcguuucacccccgugggcguaauccaagacggaggaaccacccaccgcaacgaaccccaacaauggguccuacccuccuacuccggccgcaacguccacaacguacacuuagcccccgccguagcccccaacuuccccggcgaacaacuacucuucuuucgcuccaccaugcccggaugcuccggauaucccaacauggaccucgacugcuuacucccucaagaauggguacaacacuucuaccaagaagccgcaccagcacaaucagacgucgcgcuccuccgauucguaaacccagacacaggccgcguccuauucgaaugcaaacuacacaaaucuggcuacguaacaguagcacauaccggccaacacgaccucguaaucccuccaaacggcuacuuccgcuucgacuccugggucaaccaauucuacacccucgccccuaugggcaauggaaccggccgaagacgcuaa

SEQ ID NO: 38092 - RNA, 1617 nt, Artificial Sequence
  derived and/or modified sequence opt11 from VP1__Norovirus_and/or_Norovirus-like__JX439840
augaaaauggcaucaaacgaugcaucacccagcgacggcucagcagccaaccuagucccugagguaaacaaugaaguaauggcacuugaacccguugucggggccgcaauugccgccccaguugccggucaacaaaacguuaucgaccccuggauccgcaacaacuucguacaagcaccaggcggagaguucaccgucuccccaagaaacgccccaggcgaaauccuuugguccgcaccccucggccccgaccucaauccauaccucucccaucuugcccgcauguacaacggauacgcaggcggcuucgaaguccaagucauccucgccggcaacgcauucacagcgggaaaaaucaucuucgccgcagucccacccaacuuccccaccgaaggacucucccccucucaaguaacaauguucccacacauuaucgucgacguccgacaacucgaaccaguacucaucccccucccugacguacgcaacaacuucuaccacuauaaccaaagcaacgacagcaccaucaaacucaucgcaaugcuauacacgccgcuccgcgccaauaacgccggcgaagacguuuucaccgucuccugccgcguucucacacgccccuccccagacuucgacuucaucuuccucgucccuccaaccguugaaucccgcacaaaacccuucaccguacccauccucaccgucgaagaaaugaccaacucccguuuccccaucccccucgaaaaacuuuucaccggacccucuggcgccuucgucguacaaccccaaaacggaagaugcaccaccgacggcguacuacucggcacaacacaacucucccccguaaacaucugcaccuuccgcggcgacgugacccacauagcaggaucccgcaacuacaccaugaaccucgcaucacuaaacuggaacaacuacgaucccaccgaggaaauucccgcgccccuaggcauaccagacuucguaggcaaaauccaaggcguccucacccaaaccacaaagggcgacggauccacccgaggccacaaagccacggucuacaccggcuccgcccccuucaccccaaaacucggcuccguccaauucucaacugacacagaaaacgacuucgaaacccaccaaaacaccaaauucaccccagucggcguaauccaagacggaggaaccacccaccgcaacgaaccacaacaauggguacuccccuccuacucuggccgcaacguacaaaacguccaccuagcccccgccgucgcaccaaccuuccccggcgaacaacuacucuucuucagauccacuaugcccggcugcuccggcuaccccaacauggaccucgacugccuacucccccaggaauggguccaacacuucuaccaagaagccgccccagcccaaucugauguggcacuccuccgcuucgucaaccccgacacuggcagaguucucuucgaaugcaaacuccacaaauccgguuacgucacagucgcacacaccggccaacacgaccuaguaaucccaccaaacggauacuuccguuucgacucaugggucaaucaauucuacacccucgccccuaugggcaacggcaccggccgucgacgcuaa

SEQ ID NO: 38093 - RNA, 1617 nt, Artificial Sequence
  derived and/or modified sequence opt11 from VP1__Norovirus_and/or_Norovirus-like__JX644026
augaaaauggccuccaacgacgcuaacccauccgauggcucggcagcaaaccucguccccgaagucaacaaugaagucauggcacucgaacccguagucggcgcagccauagccgcacccguagccggacaacaaaacgucaucgaccccuggauucguaacaacuucguccaggccccaggcggcgaguucaccgucuccccucgaaacgcacccggcgaaauacucugguccgcaccccuaggcccagaccuaaaccccuaccuaucccaucucgcccgcauguacaacggcuacgccggcggauucgaaguccaaguaauccucgccggaaacgcuuuuaccgccggaaaaaucauauucgcugcagugcccccaaacuucccaaccgaaggccucucccccucgcaagucaccauguucccccauaucauagucgacguacgccaacucgaaccaguacuuaucccccuacccgacguccgaaacaacuuuuaucacuacaaccaauccaacgacuccacaauaaaacucaucgcgaugcucuacacaccccuacgcgcaaacaacgccggcgaagacgucuuuacuguuucaugccgcguccucacucgaccuuccccagacuucgacuucaucuuccucguacccccuaccguagaaucucgaacaaagcccuuuacagucccuauccucacagucgaagaaaugacaaacucacgcuuccccaucccccuagaaaaacucuucaccggacccucauccgcauucguaguccagccccaaaacggccgcuguaccacagacggcguccuccucggcaccacccaacucucccccgucaacaucugcacauuucgcggcgacgucacccacaucgcuggcucccgcaacuacaccaugaaccuagcaucccucaacuggaacaacuaugacccaaccgaagaaauccccgcccccuuaggcaccccagacuucgucggaaagauccaaggcguccucacccagacgaccaaaggagacggcuccacccgcgggcauaaagcgaccguauacacaggauccgcucccuucacccccaagcucggauccguccaauucagcacggacaccgaaaacgacuuugaaacccaccaaaacaccaaauucacacccgucggaguaauccaagacggcucaacaacccaccgcaacgaaccccagcaauggguccuccccuccuacuccggccgcaaugcacaaaacguccaccucgcucccgccguugcaccuacuuuucccggcgaacaacucuuauuuuuccgaucaacaaugcccggcugcuccggcuaccccaacauggaccucgacugccuucucccccaagaauggguccaacacuucuaccaagaggcagcaccagcacaaucagacguugcacuacuccgcuuugucaacccagacaccggccgcguccuauuugaaugcaaacuacauaaauccggauacgucaccgucgcccacacaggccaacacgaccuugucauacccccgaauggcuacuuccgcuucgacagcuggguaaaccaauucuacacccuagcccccaugggcaacggcaccggccgccgacgcuaa

SEQ ID NO: 38094 - RNA, 1617 nt, Artificial Sequence
  derived and/or modified sequence opt11 from VP1__Norovirus_and/or_Norovirus-like__JX459906
augaaaauggcaucaaaugacgccaaccccuccgacggauccgccgccaaccucguacccgaagucaauaacgaagucauggcacuugaaccaguagucggagcagccaucgccgcaccagucgccggccaacaaaacgucaucgaccccuggauaagaaacaacuucguccaggccccaggcggcgaauuuaccguauccccacggaacgcacccggagaaauccuaugguccgcaccccucggccccgaucucaaucccuaccucucacaccucgcgcgaauguacaacggcuacgccggcggguucgaaguccaaguaauacucgccggcaacgccuucacagcaggcaaaauaaucuucgccgcagucccacccaacuuccccacagaagggcucuccccgucucaagucaccauguucccccauauaaucgucgacguccgccaacuagaaccaguccucauaccccuccccgacguccgcaacaacuucuaccacuacaaccaaagcaacgacuccacaauaaagcuaauagccaugcucuacaccccacuacgcgccaacaacgccggcgaagacgucuucacagucuccugccgaguacuuacccgccccucccccgacuucgacuucaucuuccuuguaccacccacaguagaaucgcgcaccaaacccuucacuguacccauacuaacaguagaagaaaugacaaacucccgcuuccccaucccacuagaaaaacucuucacaggccccucauccgcauucguaguacaaccacaaaacggacgcugcaccacagacggcgucuuacucggaaccacucaacuauccccaguaaacauuugcacauuccgcggagacgucacccacaucgcgggcucccgaaacuacacaaugaaucucgccagccucaacuggaacaacuacgaucccaccgaagaaauacccgccccucucggcacccccgacuucguaggcaaaauacaaggaguucucacccaaaccacuaaaggcgacggaucaacccgcggccacaaagccaccgucuacaccggcuccgcacccuucacaccuaaacuuggcuccguccaauucggcacagacaccgaaaacgacuuugaaacccaccaaaacaccaaauucacccccgucggagucauccaagacggaggcaccacacaccgcaaugaaccacaacaauggguacuccccuccuauucuggucgagauguacccaauguacaccucgccccagccgucgcccccacauuccccggcgaacaacuccuauuuuuccgcucuaccaugccagguugcucaggcuaccccaacauggaccucgacugucuccuaccgcaagaauggguccaacauuuuuaccaagaagccgcgcccgcucaauccgacgucgcccuccuacgcuucguaaaccccgacacaggccgaguccucuucgaaugcaaacuccacaaaucaggcuacgucacagucgcacacacaggccaacacgaccucguaauaccucccaacggauacuuccgcuucgacuccugggucaaccaauucuacacccucgccccuaugggaaacggaaccggccgccgacgauaa

SEQ ID NO: 38095 - RNA, 1617 nt, Artificial Sequence
  derived and/or modified sequence opt11 from VP1__Norovirus_and/or_Norovirus-like__JX459597
augaaaauggccucaaacgacgccacacccucugacggcucaaccgccaaccucguucccgaaguaaauaacgaaguuauggcccucgaacccguugucggcgcagccaucgccgcaccaguugccggacaacaaaacgucaucgaccccuggauccgcaacaacuucguccaagcaccaggaggagaauuuaccguaucccccagaaacgcaccuggcgaaauacucugccacgcaccccucggccccgaucucaacccauaccucucacaccucgcccgcauguacaacggcuacgccggcggguucgaaguucaagucauccucgccggcaacgccuucacagcaggcaaaaucaucuucgcugccgugcccccaaacuuccccaccgaaggacucuccccuucccaagucaccauguucccccacaucauagucgacguuagacaacuagaaccuguccuuaucccccuccccgacguacgcaacaauuucuaccauuacaaccaauccaacgacccaaccaucaaacucaucgcuaugcuauacaccccacuccgcgcuaauaacgccggcgacgacgucuucaccguuucaugccgcguacucacgcgucccucucccgacuucgacuucaucuuccucgucccacccaccgucgaaucccgcaccaaacccuucagcguucccauacucaccguugaagaaaugaccaauucucgcuuuccuaucccacuagaaaaacucuucaccggacccagcucagccuucgucguccaaccccaaaauggccgaugcacaaccgacggcguccuccucggaaccacccaacuuucaccugucaauauaugcaccuuccgaggcgacgucacccacaucgccggaacucaaaacuauaccaugaaccucgcaucgcaaaacuggaauaacuacgaccccacugaagaaaucccugccccacucggcacccccgacuucgucggccgcauccaagguguacucacccagaccacaaggcgcgacggcuccacaagaggacacaaagccacccucucaaccggcuccguccacuucaccccaaaacuagguuccguccaauucucaaccgauaccuccaacgacuuugaaacaggccaaaacacccgcuucacccccgucggaguaguacaagacggcucaacaacucaccaaaacgaaccucaacaauggguccucccuaacuacucuggucgcgacucacacaacguacaccuugcccccgccgucgcccccaccuucccaggcgaacaacuccuuuucuuccggucaaccaugcccggcugcucaggcuaccccaacaugaaccucgacugccuccucccccaagaauggguccaacacuucuaccaagaaucagcccccgcccaaucagacgucgcccuacuacgcuuugucaaccccgacaccggacgaguccucuucgaaugcaaacuacacaaauccggcuacgucacaguagcacacacugggcaacacgaccuagucaucccucccaacggcuacuuccgcuucgauucuuggguaaaucaauucuacacacuagcucccaugggcaacggugccggccggcgucgcuaa

SEQ ID NO: 38096 - RNA, 1617 nt, Artificial Sequence
  derived and/or modified sequence opt11 from VP1__Norovirus_and/or_Norovirus-like__HQ456334
augaaaauggcuuccaaugacgcuuccccaagcgacggcucugcagcgaaccucgucccagaaguaaacaacgaagucauggcacucgaaccuguuguaggcgccgccaucgccgcuccuguugcaggccaacaaaacguuaucgaccccuggauccguaacaacuucguccaagccccaggcggugaguucacaguaagcccacgcaacgcccccggagaaauccucugguccgcaccccucggaccggacuuaaaucccuaccuaucacacuuagcccguauguacaacggcuacgccggcggcuucgaaguccaaguaauacucgccggaaacgccuucacagccggcaaaaucauauucgccgccgucccacccaacuucccaaccgaaggacucagccccucccaagucacaauguuuccccacauaaucguagacguccgucaacucgaacccguccuaaucccccuacccgacguccgcaacaacuuuuaccacuacaaccagucaaacgacuccacuauuaaacuuauagcgaugcuuuacacuccccuccgcgccaacaacgccggagaagauguuuucacaguaucaugccguguccucacccgcccaucacccgacuucgacuucaucuuucuagucccucccacagucgaaucacgaaccaaacccuucaccguaccaauccucacagucgaagaaaugacuaacucacgauucccuaucccacucgaaaagcuauucaccggcccaucaggcgccuucgugguucaaccccaaaacggacgcuguaccaccgacggcguucuccuaggcaccacacaacuaucacccgucaacaucugcacauuccgaggcgacgucacccauauagccggcucccgaaacuacaccaugaaccuagccgcccugaacuggaacaacuacgaucccaccgaagaaauccccgcaccccucggcacccccgacuucgucggaaaaauacaaggcguacucacccaaacaaccaaagcagacggaagcacacguggccacaaagccacagucuacaccggauccgcagacuuuacccccaaacuaggauccguccaauucaauacugacacugaaaacgacuucgaaacacaccaaaacacaaaauucaccccaguaggcgucauccaggacggaagcacaacucaccgaaacgaaccacaacaauggguacuccccucauacuccggccgcaacguccacaacguccaccucgcgcccgcagucgccccaaccuuucccggcgaacaacuacucuucuuccgcuccacaaugcccggcugcucaggauacccaaacauggaccucgacugccuccuaccccaagaauggguucaacacuucuaccaagaagccgcccccgcucaaagcgacgucgcccuccuacgcuucguuaacccugauaccggccgaguucucuucgaaugcaaacuucacaaaucaggauacguaaccgucgcacauacuggccaacacgacuuagucauucccccaaacggcuacuuccgcuucgacuccuggguaaaccaauucuacacccuagcccccaugggcaacgguacaggacgccgccgauaa

SEQ ID NO: 38097 - RNA, 1617 nt, Artificial Sequence
  derived and/or modified sequence opt11 from VP1__Norovirus_and/or_Norovirus-like__HM802553
augaaaauggcauccaaugacgcaucacccucagacggaucugccgccaaccuagucccugaagucaacaacgaagucauggcccuagaaccaguuguaggagccgcaaucgcggcucccguagccggccaacaaaacgucaucgaccccuggauccgaaacaacuucguccaagcccccggcggcgaguucaccguaucuccccguaacgcccccggcgaaauccucugguccgcaccccucggacccgaccucaacccauaccuaucccacuuagcccgaauguacaacggcuacgccggcggcuucgaaguacaaguccuacuagccggaaacgcauucaccgcaggcaagaucaucuucgccgccguuccacccacauuucccacugaaggccucucccccucccaagucaccauguucccccacauaaucgucgacguccgacaauuagaacccguccucauaccccuccccgacguccgcaacaacuucuaccacuacaaccaauccaaugacuccaccaucaaauuagucgccaugcuauauacaccccuccgugccaacaacgcaggcgacgacgucuucaccguuagcugccggguauuaacccgucccagccccgacuucgauuucaucuuucuagucccacccacagucgaaucccgcacaaaacccuucacaguccccaucuuaacaguagaagaaaugacaaacucccgcuuccccaucccccuagaacgccucuucacaggccccuccucagccuucgucguccaaccccaaaacggucgcugcaccaccgacggcguucuccucggaacuacccaacuaucucccgucaacauuugcacuuuccgaggugauguaaccaacauccccggcucccgcacauaccgcaugaaccucgccucacaaaacuggaacaacuacgaccccaccgaagaaauaccagcuccccuaggcacacccgacuucgucggcaaaauccaagguguucuaacccaaaccacuaaaggcgacgguuccacccguggacacaaagccacaguccgaaccggcucagccgacuucaccccaaaacucggcuccguacaauucgccaccgauaccgacaaugacuucguaaccggccaaaacacaagauucacccccguaggaguuauacacgacggaucuucagcacaccgcaacgaaccccaacaauggguccuuccagaauacucaggccgcuccguacacaacguccaccuggcuccagcaguagccccuaccuucccuggugaacaacuccucuucuuccguucaacuaugcccgguuguuccggauacccgaacauggaccucgacugccuccuaccccaagaauggguacaacacuucuaccaagaagccgcaccaagccaauccgacgucgcacuacuacgcuucgucaacccagacaccggcagaguccuuuucgaaugcaaacuccacaaagccggauauguuaccguagcacacacuggccaacacgaccucgucauacccccaaacggauauuuccgcuucgacagcuggguuaaccaguucuauacccuagccccaauggggaacggcgccggccgccgccgauaa

SEQ ID NO: 38098 - RNA, 1617 nt, Artificial Sequence
  derived and/or modified sequence opt11 from VP1__Norovirus_and/or_Norovirus-like__HQ008055
augaaaauggcauccuccgacgccaaccccuccgacggcuccaccgcaaaccucgucccagaagucaacaacgaaguuauggcucucgagccaguuguaggagccgcaauagccgccccugucgccggacaacaaaacgucaucgaccccuggauccgaaacaacuuuguccaagcccccggcggcgaauuuaccgucucuccccgcaacgcuccuggugaaauacucugguccgccccacucggccccgaucucaaccccuaccuaucccaucuagccagaauguacaauggcuacgcaggcggcuucgaaguacaggucauacucgccggaaacgcauucaccgccggaaaaauaaucuucgcagccguucccccgaacuucccaacagagggacucucccccucccaagucaccauguucccacacauaaucguugacguacgccaacuugaacccguacucaucccccucccugauguacgaaacaacuuuuaccacuacaaccaacucaacgaccccaccauaaaauugaucgcuaugcucuacacuccccuccgcgccaacaacgccggagacgacgucuucaccguguccugucguguucuaacccgccccuccccagacuucgacuucaucuuccucguaccaccaaccgucgaaucccgcaccaagccuuucuccguccccauccucaccgucgaagaaaugaccaacucccguuucccaaucccacuagaaaaacuauuuaccggccccuccuccgcauuugucguacagccccaaaauggccgaugcaccaccgacggaguccuccuagguacaacccaacuaucccccgucaacauuugcaccuucagaggcgacguaacacacaucacaggcucacacaacuacaccaugaaccucgcaucccaaaauuggaacuccuaugacccaaccgaagagauccccgccccacucggaacccccgacuucgucgguaaaauccagggcguucuuacacaaaccacacgcgcugacggcuccacccgcggacaccgcgcaaccguauacacuggcagcgcagaguucgcucccaaacucggccgcguccaauucgcaaccgacacugaaaacgacuucgacaccaaccaaaacacaaaauucacccccguaggcgucauccaagacggcaacaccacacaccgcaacgaaccccaacaguggguccuacccagcuacucuggacgcaacucccauaacguacaccucgccccggccguagcacccaccuuucccggagaacagcuccucuucuuucgcucaaccaugcccgguugcuccggcuaucccaaccucgaccucgacugccuccuaccccaagaauggguccaacauuucuaccaagaagccgcccccgcccaaucagacguagcccuucuacgauucgucaaccccgacacgggucgaguacuauuugaaugcaagcuccacaaguccggcuacgucaccguugcccacaccggccagcaugaccucgucaucccacccaacggauacuuccgauucgacuccuggguuaaccaauucuacacccucgcgccuaugggcaacggcaccggccgccguagauaa

SEQ ID NO: 38099 - RNA, 1617 nt, Artificial Sequence
  derived and/or modified sequence opt11 from VP1__Norovirus_and/or_Norovirus-like__AB541360
augaaaauggcauccaacgacgccaaccccagcgacggauccgccgcaaaccuuguccccgagguaaacaacgaagucauggcacucgaaccaguggucggcgccgccaucgcagcacccgucgcaggccaacaaaacgucauagaccccuggauccgcaacaacuucguccaagccccgggcggugaguucacaguaucaccccgaaacgccccuggagaaauccuuugguccgcaccccuaggccccgaccucaaccccuaccuaucacaccucgcccgaauguacaacggauacgccggcggcuucgaaguccaagucauacucgccggcaacgccuuuaccgccggcaaaaucaucuucgcagcaguacccccaaacuuccccaccgagggacuaucccccucacaagucaccauguucccgcacaucauuguagacguacgccagcuagaacccguccucauaccccuucccgacguacgcaacaacuucuaccacuauaaccaaagcaacgacucaacaaucaaacugaucgccaugcucuacaccccucuccgcgccaauaacgccggcgaagacgucuucaccgucucaugccgaguccucacacgccccucaccagacuuugacuucaucuuccuaguacccccuaccgucgaaucccgaacuaaaccauuuacaguaccaauccucaccgucgaagaaaugaccaacucccgcuucccuauccccuuagaaaaacucuucaccggaccaagcucagcauucguuguccaaccacaaaacggacgaugcaccacugauggaguccucuuaggaaccacccaacucucaccaguaaacaucugcaccuuccgaggagacgucacccacaucgccggaucccgaaacuacacgaugaaccuagcuucccuuaacuggaauaacuacgaccccaccgaggaaauccccgcaccccuaggcacuccagacuucguaggaaaaauccaaggcguacucacacaaaccaccaaaggcgauggcuccacgcgcggucacaaagccacagucuacaccggcagcgccccauucacccccaaacucggaagcguccaauucuccaccgacaccgaaaacgacuucgagauacaccaaaacaccaaauuuacucccgucggagucauucaagacggauccacaacacacagaaacgaaccccaacaauggguccucccaucuuacucgggccgaaacguccauaacgugcaccucgcgcccgccguagcccccaccuuucccggagaacaacuucucuucuuccgcuccaccaugcccggaugcuccggcuacccaaacauggaccucgacugccugcucccacaagaauggguccaacacuucuaccaagaagcagcccccgcacaauccgacgucgcacuccuacgauucgucaauccagacaccggccgaguccucuucgaaugcaaacuccacaaauccggauacguaaccguagcauacaccggccaacacgaccucgugaucccucccaacggcuacuuccgauucgacucaugggucaaccaauucuacacacuugcaccaaugggaaacggaacaggccgccgacgauaa

SEQ ID NO: 38100 - RNA, 1617 nt, Artificial Sequence
  derived and/or modified sequence opt11 from VP1__Norovirus_and/or_Norovirus-like__AB541262
augaaaauggccuccaacgacgcuaaccccucggacggaucugccgccaaccuuguccccgaagucaacaaugaagucauggcacucgaacccgucguaggcgcagccauagccgccccaguagccggacaacaaaacgucauagaccccuggauucgaaauaacuucguccaagccccaggcggugaguucaccguaucuccccgcaacgcccccggagaaauccuauggucagcaccccucggacccgaccuaaaccccuaccuaucacaucuugcccgcauguacaauggcuacgcuggaggcuuugaaguccaagucauacuagcuggcaacgccuucaccgcaggaaaaaucaucuucgccgccgucccacccaacuuccccaccgaaggccucucacccagccaagucacaauguuuccccacaucaucgucgacguccgacaacucgaacccguccuaaucccccucccagacguccgcaacaacuucuaccacuacaaccaauccaacgacucaaccaucaaacuuaucgcaaugcucuacacaccccucagagccaacaacgcaggagaagauguauucaccgucagcugccgcguucucacacgacccuccccugacuuugacuucauauuccucgucccucccacagucgaaucucgcacaaaacccuucacaguccccauccucaccgucgaagaaaugacaaacucacgcuucccaauaccccuagaaaaacucuuuaccggccccucaagcgccuucgucguccaaccacaaaacggccgcugcaccacagacggcguccuccucggcacaacacaacuuucccccgucaacaucugcacauuuagaggcgacguaacccacguagcagguucacgaaacuacaucaugaaccucgccucccucaacuggaacaauuacgacccaacagaagaaaucccagcaccccucggaacuccagacuucguaggaaaaauacaaggcguacuaacccaaaccaccaaaggagacggaucaacacgcggccacaaagccacagucuacaccggcuccgcccccuucacccccaaacuaggcuccguccaauucuccaccgacaccgaaaaugacuucgaaacucaucaaaauaccaaauucacccccgucggcguaauacaggacggcagcaccacccaccgcaacgaaccccaacaauggguccuccccuccuacuccggccguaacguacacaacguacaucucgccccugccguagcaccaacauucccaggcgaacaacuccucuuuuuccgaucaaccaugccaggcugcucaggcuaccccaacauggaccucgacugccuccucccacaagaauggguacagcacuucuaccaagaagccgcccccgcacaaucugacgucgcccuucuacgcuucgugaaccccgacaccggucgcguccucuucgaaugcaaacuccacaaaucaggcuacguaacggucgcccauaccggccaacacgaccucguaaucccacccaacggcuacuuccguuucgacuccugggucaaccaauucuacacacuagcccccaugggcaacggaaccggcagacgccgcuga

SEQ ID NO: 38101 - RNA, 1617 nt, Artificial Sequence
  derived and/or modified sequence opt11 from VP1__Norovirus_and/or_Norovirus-like__AB541231
augaaaauggcaucaaacgacgcaaaccccuccgacggcucugcagccaaccuuguccccgaagucaacaaugaaguaauggcccucgaacccgucguuggagccgcaaucgccgcacccguagcaggacaacaaaaugucaucgacccauggauccgcaacaacuucguacaagcuccagguggagaguucaccgucucuccccgaaacgccccaggcgaaauccucugguccgccccucucggccccgaccucaacccguaccuaucccaccucgccagaauguacaacggcuacgccggcggcuucgaaguccaaguaauccucgcaggcaacgcauucacugccggaaaaaucauauucgcagccgucccacccaacuuucccacagaaggacuaucccccucccaagucacaauguucccccacaucauugucgacguucgccaacucgaaccaguccucaucccccuaccagacguccggaacaacuucuaccacuacaaccaauccaacgacuccacuaucaaacuaaucgccaugcucuacacaccccuccgugccaacaacgccggcgaagauguauucaccgucuccugccgaguccucacccgccccucccccgacuucgacuuuaucuuccucgugccacccaccguagaaucccgcaccaaacccuucaccguccccauccucaccguagaagaaaugaccaacucaagauuccccaucccccuagaaaaacuauucaccggacccuccucagcauucgccguccagccucaaaacggccgaugcaccaccgacggcgucuuacuugguaccacccaacucuccccugucaacaucugcaccuuccgcggcgacguaacccacauagcgggcucacgcaacuacacuaugaaccuagcaucccuaaacuggaacaacuacgaccccaccgaagaaauccccgcaccccucggcaccccggacuucgucggcaaaauacaaggaguucuaacccaaacuaccaaaggcgacggcuccacccgcggccacaaagccacagucuacaccggaucggcacccuucacccccaaacuaggcuccguccaauucuccacugacaccgaaaacgacuuugagacccaccaaaacacaaaauucaccccagucggcguaauccaagacggcuccaccacccaccguaacgaaccacaacaaugggugcucccuuccuacuccggcagaaacguccccaacguucaccuugccccagcagucgcucccaccuucccaggcgaacaauuacucuucuucagauccacuaugccaggcugcuccggcuaccccaacauggaccuugacugccuacucccacaagaauggguucagcacuucuaccaagaagccgcgcccgcccaauccgacgucgcacugcuacgauucguaaacccagauaccggccgagucuuauucgagugcaaacuacacaaauccggcuauguuaccgucgcccacacaggacaacacgaccuugucaucccuccaaacggcuacuuccgauucgacuccuggguaaaucaauucuacacccucgccccuaugggaaaugguacaggacgccgccgauaa

SEQ ID NO: 38102 - RNA, 1617 nt, Artificial Sequence
  derived and/or modified sequence opt11 from VP1__Norovirus_and/or_Norovirus-like__GQ246792
augaaaauggcauccucagacgcaaaccccuccgacggcucaaccgcaaaccucgucccagaaguaaacaacgaaguaauggcucuagaaccaguuguuggcgccgcaauagccgcccccgucgccggacaacaaaacgucaucgacccguggauccgaaacaacuucguccaagcccccggcggcgaguucaccguaucaccccgcaacgcccccggggaaauucucugguccgcaccccuaggccccgaccucaacccauaccucucucaccuagcccgaauguacaacggcuacgccggcggcuucgaaguccaagucauccucgccggcaacgccuucacagccggcaaaauaaucuucgccgccguacccccaaacuucccaaccgaaggccucucccccucacaaguaacaauguucccccauaucaucgucgacgugcgacaacucgaaccagucuugaucccccuaccagacgucagaaacaacuucuaccacuacaaccaaucaaacgaccccacuauaaaacuaauagccaugcuauauaccccucucagagccaacaacgccggagacgacguauucacaguuuccugccgcguccucacccgccccucgcccgacuucgacuuuaucuuccuggucccacccaccgucgaaucucgcaccaaacccuucuccgucccuaucuuaaccgucgaagaaaugaccaacucuagauuccccauaccccucgaaaaacucuuuacuggccccucaagugccuucgucguacaaccccaaaacggccgaugcacaaccgacggaguacuccucggcaccacccaacucucccccguuaacauaugcaccuuccgcggcgacguaacccauauaaccggcuccagaaacuacacuaugaaucucgcaacacaaaauuggaacuccuacgaccccaccgaagaaauccccgcaccccucggcacccccgacuucgucggcaaaauccaaggcguacuaacccaaaccacccgagccgacggcucaacccgaggccacaaggccaccgucuacaccgguucagccgacuucacccccaaacuaggccguguccaguucgcgacagacacagacaacgacuucgacgcgaaccaaaacacaaaauucacccccgucggagucauccaagacggaaacaccgcccaucgaaacgaaccccaacaguggguccucccauccuacuccggcagaaacagccacaacguccaccuggccccagccguagcuccuaccuucccaggcgaacaacuccucuucuuccgauccaccaugcccggcugcuccggauaccccaacauggaccucgacugccuacucccucaagaauggguccaauacuuuuaccaagaagcagcccccgcccaauccgacgucgcucuacuccguuucgugaacccagacaccggccgaguacucuucgaaugcaaacuccacaaauccggcuacguaaccguugcacacaccggccaacacgaccuaguaauaccacccaacggcuacuucagauuugacucaugggucaaccaguucuacacccuagcacccaugggcaacgguaccggucgacgucgcuga

SEQ ID NO: 38103 - RNA, 1617 nt, Artificial Sequence
  derived and/or modified sequence opt11 from VP1__Norovirus_and/or_Norovirus-like__AB504329
augaagauggccuccaacgacgcaaaccccuccgacggauccgccgcaaaucucguccccgaagucaacaaugaagucauggcacucgaacccguagucggugccgccauagcagcccccguagccggacaaaccaacgugauugaccccuggauccgcaacaacuuuguacaagccccaggaggcgaguucacagucucaccccgcaacgcccccggcgaaauacucugguccgcaccccucggccccgaccugaaccccuaccuaucccaccucgcccgcauguacaacggauacgccggcggauucgaaguacaagucauccucgccggcaacgccuucaccgccggcaaaaucaucuucgcagccgucccucccaacuuccccaccgaaggccucucacccucacaaguaaccauguucccucacauaauagucgacguccgacagcucgaaccaguacucaucccacuaccagacguucgaaacaacuucuaccacuacaaucaaagcaacgacuccaccaucaaacucauagccaugcuauacacaccccuccgugccaacaacgcaggcgaagacgucuucaccgucuccugcagagugcuaaccagacccucaccagacuucgacuucaucuuccucgucccucccaccguagaaagccgaacuaaacccuucacuguccccauucucacaguagaagaaaugacaaacucaagauuccccaucccccuugaaaaacucuucaccggcccauccggcgccuucgucguccaaccucaaaauggccgcugcaccacagacggaguccuacuuggaaccacacaacuauccccagucaacauaugcaccuuccgaggagacguuacacacauagccggcuccaggaacuauaccaugaaccuagccucccuaaacuggaacaacuacgaccccacugaagaaauaccagcaccccuaggcacacccgacuucgucggcaaaauucaaggaguacucacccaaaccacuaagggcgacgguuccacccgcggucacaaagccaccgucuacaccggcuccgcccccuucacccccaagcuaggcucaguacaauucuccacagacaccgaaaacgauuucgaaacccaccaaaacaccaaauucaccccuguuggaguaauacaagauggcggaaccacacaccgcaacgaaccacaacaauggguccuacccuccuacagcggcagaaacguccacaacguacaccuugcccccgccgucgcaccaacauucccaggagaacaacuacuuuucuuccgauccacaaugcccggaugcuccgguuaccccaacauggaccuugacugcuuacucccccaagaauggguacaacacuuuuaccaagaagccgcccccgcccaauccgacguugcccuccuccgauucgucaaccccgacacuggacgaguccucuucgaaugcaaacuccacaaaucaggcuacgucaccgucgcacacaccggacaacacgaccuagucauuccacccaacggauacuuccguuucgacucaugggucaaucaauucuacacccuagccccgaugggcaacggcacaggacgaagacgcuaa

SEQ ID NO: 38104 - RNA, 1617 nt, Artificial Sequence
  derived and/or modified sequence opt11 from VP1__Norovirus_and/or_Norovirus-like__AB504306
augaaaauggcauccaacgacgcaaacccauccgauggauccaccgccaaccuugucccugaaguaaacaacgaagucauggcccucgaacccgucgucggcgcagcuaucgccgccccagucgccggacaacaaaacgucaucgacccauggauucgcaacaacuucguucaagccccgggcggcgaauuuaccguuucaccacgaaacgcaccgggagaaauccuauggucagcaccccuuggcccagaccuaaaucccuaccuaucacaccucgcaagaauguacaacggauacgcuggcggcuucgaaguacaaguaauccuagccggaaacgccuucacagccggcaaaaucaucuuugcagccgucccacccaacuuccccaccgaaggccuaucaccaucccaagucaccauguucccccacaucaucgucgacguacgccaacucgaacccguccucaucccccuccccgacguccgaaacaacuuuuaccacuauaaccaauccaacgacucaaccaucaaacuaauagccaugcuauauacaccccucagagcuaacaacgcaggagacgacguauuuaccguuucaugccguguccuaaccagaccaucccccgacuucgacuucauauuccugguuccacccaccguagaauccaggacuaaaccauucaccguacccauccucacagucgaagaaauguccaaaucacgcuuccccaucccccucgaaaaacucuacacgggccccucauccgccuucgucguacaaccacaaaauggccgaugcaccaccgacgggguccuccuaggcaccacccaacucuccgugguaaacaucugcacauuucgaggugaugucacccacauagccggaucacacgacuacacaaugaaccucgcaucccaaaacuggaacaacuacgaccccaccgaagaaauccccgcaccccucggcacacccgacuucgucggcaaaauccaaggcaugcuaacccaaaccacacgagaagacggcaguacacgcgcccacaaagccaccguaucaacaggcucaguccacuucacccccaaacucggauccguccaauacacaacagauacgaacaacgacuuucaaaccggccaaaacaccaaauucacucccgucggagucauacaagacggcaauaaucaccaaaacgaaccacaacaauggguacuaccaaauuacucaggacgaacuggccacaacguacaccuagcccccgccguagccccaaccuuccccggcgaacaacuacucuucuuccgcuccaccaugcccggaugcucgggcuaccccaacaugaaccucgacugccuacugccccaagaauggguacaacacuucuaccaagaagcagccccagcccaaagcgacguagcccuccuccgcuucgucaacccagacacaggccgcuuccucuucgaaugcaaacuacacaaaucaggcuauguaacagucgcacauaccggcccccacgaccuugucaucccacccaacggcuacuuccgcuucgacuccugggucaaccaauucuacacccuagcaccaaugggcaacggcgccggacgacgacgcgucuga

SEQ ID NO: 38105 - RNA, 1617 nt, Artificial Sequence
  derived and/or modified sequence opt11 from VP1__Norovirus_and/or_Norovirus-like__GQ303445
augaaaauggccagcuccgacgccaaccccucagacggcucaacugccaaccuugucccagaagucaacaacgaagucauggcacucgagccagucgucggcgccgccaucgccgcccccguagccggccaacaaaacgucauagaccccuggauccgcaacaacuuuguacaagcccccggcggcgaguucacagucucaccacgcaaugcccccggagaaauccucugguccgccccucuaggccccgaccuaaaccccuaccuuucccaccucgcccgcauguacaacggcuacgccggcggcuucgaaguccaagucauccucgccggcaacgcauucacagccggcaaaaucaucuucgcagcuguaccacccaacuucccgaccgaaggccucucccccucccaaguuacuauguucccccacauaaucguggacgugcgacaacuagaaccaguccucaucccccuaccagacguccgaaacaauuucuaccacuacaaccaauccaacgacccgaccauuaaacucaucgcaaugcuuuacaccccacuacgagccaacaacgccggcgaugacgucuucacaguuuccugccgaguccuuacccgcccaucccccgacuucgacuucaucuucuuagucccacccacaguagaaucccgaacaaaacccuucuccguaccaauacucacagucgaagaaaugaccaacucacgauuccccauaccuuuagaaaaacucuucacagguccuuccuccgccuucguaguucagccccaaaacggccgaugcaccaccgacggcguacuucucggcaccacccaacucucacccgucaacaucugcaccuuccgcggcgacgucacacauaucaccggcagcagaaacuacaccaugaaccuagcaacccaaaacuggaacuccuacgaccccacagaagaaauacccgccccacucggcaccccagauuucgucggcaagauccaaggcguccucacccaaaccacccgcgccgacggcuccacacgcggccauaaagcuaccgucuacacuggauccgcagacuucgcacccaaacucggacgcguccaauucgccacagauacagaccacgauuucgacgcaaaccaaaauacaaaauucacaccaguaggcgucauccaagacggagacacagcccaccguaacgaaccacaacaauggguccucccauccuacucaggccguaacucccacaacguacaccucgcccccgccguagcccccacauuucccggcgaacagcuucuuuucuuccgcuccaccaugccuggcuguucaggcuaccccaauauggacuuagauugccuacuaccccaagaauggguccaauacuucuaccaggaggccgcccccgcucaauccgacguagcauuacuucgauucgucaacccagacacaggcagaguacucuucgaaugcaaacuccacaaauccggcuacgucaccgucgcccacacaggacaacacgaccucguaaucccacccaacggauacuuccgcuucgacagcuggguaaaccaguucuacacccuagcacccaugggcaacggcaccggacgccgccgauga

SEQ ID NO: 38106 - RNA, 1617 nt, Artificial Sequence
  derived and/or modified sequence opt11 from VP1__Norovirus_and/or_Norovirus-like__EU839588
augaaaauggcaucaaacgacgccaaccccuccgacggaucugcugcaaaccuaguccccgaagucaacaacgaagucauggcccuugaaccuguggucggcgccgccaucgccgccccugucgccggccaacaaaacgucaucgaccccuggauccgcaacaauuucguccaagcacccggaggagaauuuacagucucgccccgcaacgccccuggcgaaauccucugguccgcuccccucggccccgaucucaacccauaccucucccaccuagcccgcauguacaacggcuacgccggaggauucgaaguucaagucauccucgccggcaacgccuucaccgccggcaaaaucaucuucgccgccguacccccaaacuucccaaccgaaggacucucccccucccaaguaacaauguucccacauaucaucgucgacguacgacagcucgaaccaguccucaucccccuccccgacguccgcaauaacuucuaccacuacaaccaaucuaacgacucaaccauuaagcuaaucgccaugcucuacacaccccuccgagcaaauaacgcaggcgaagacguuuucaccgucuccugccgcguccucacccgcccaucacccgacuucgacuucauauuccucguuccacccaccgucgaaucacgcacaaaacccuucaccguucccauucuagcagucgaagaaaugacaaacucccgcuuccccaucccccucgaaaaacucuucaccggacccuccucugcacucgucguucaaccacaaaacggccgcugcaccaccgacggaguccuccucggaacgacccagcuuuccccaguuaacaucuguacauuccgcggcgacgucacacacaucgcaggcagccguaacuacaccaugaaccuagccucccuaaauuggaacaacuacgaccccacagaagaaauccccgcaccccuaggcaccccugacuucguuggcaaaauccaaggcguacucacacaaaccacaaagggcgacggauccacucgcggacacaaagccaccguauacacaggauccgcccccuucacccccaaacuuggcuccguacaauucggcacagacaccgaaaacgacuuugaaacacaccaaaauaccaaauucacuccagucggcgucauccaagauggcuccaccacacaucgcaacgaaccccaacaauggguccuaccaucauacuccggacgcaacguccacaauguccaccucgccccagccguugcacccacauucccaggcgaacaacuacuauucuuucgaagcaccaugcccggcugcucaggcuacccaaauauggaccuagacugccuacuaccacaagaauggguccaacacuucuaccaagaagccgcccccgcacagucugacgucgcucuacuccgcuuugucaaccccgacaccggccgcguccucuucgaaugcaaacuccacaaaucaggcuacguuacaguugcccacaccggccagcacgaccuagucaucccaccaaacggauauuuccgauucgacucaugggucaaccaauucuacacccucgcacccaugggaaacggcaccggaagacgacguuaa

SEQ ID NO: 38107 - RNA, 1617 nt, Artificial Sequence
  derived and/or modified sequence opt11 from VP1__Norovirus_and/or_Norovirus-like__DQ364459
augaaaauggccuccaacgacgcaucuagcuccgauggauccacagcaaaccuuguacccgaagucaacaacgaagucauggcccuagaaccuguuguaggugccgccauugcugccccagucgccggacaacaaaacgucaucgaccccuggaucagaaacaacuucguacaggcacccggcggcgaguucacugucagcccccgcaacgcccccggcgaaauccucugguccgcaccccucggcccagaccucaacccauaccucucucaccucgccagaauguacaacggcuacgccggaggauucgaaguccaagucauccucgccggaaacgccuucaccgccggaaaaaucaucuucgccgccguaccgcccaacuuccccacagaaggccucucucccucgcaaguaaccauguucccccacaucaucgucgacguaaggcaacuagaaccuguacucauaccccucccagacguccgaaacaacuucuaccacuacaaccaaagcaacgacccaacaauaaaacucaucgccaugcucuacacgccacuccgcgcaaacaacgccggcgacgacgucuucacagucuccugccgaguccuuacccgccccucccccgacuucgacuuuaucuuccucgucccgcccaccguagaaucccgaacuaaacccuucacaguccccauccugaccguagaagaaaugaccaacucacgcuucccaaucccccucgaaaaacucuucaccggccccuccuccgcauucgucgugcaaccccaaaacggccgcugcaccaccgacgguguauuacucggcacaacccaacuaagcccagucaauaucugcacauuccgaggcgacgucacccacaucgccggcacccacgacuacaccaugaaccuagccucacaaaacuggaauaacuacgaccccaccgaagaaauccccgcaccccucggaaccccagacuucgucggcaaaauccaaggcguccuaacccaaacuacuagaggugacggauccacacgcggacacaaagccaccguauccaccggauccguucacuucacuccaaaacucggauccguccaauucacaacagacaccaacaacgacuucgaaacuggccaaaacaccaaauucacaccagucggcgucguacaagauggcaacucuacacaccaaaacgaaccacaacaauggguccuccccaacuacagcggccgaaccggucacaauguccaccucgcccccgccgucgccccaaccuuccccggcgaacaacuccuauucuuccgaucaacuaugccaggauguuccggcuaccccaacaugaaccucgacugccuacucccccaagaauggguucaacacuucuaccaagaagcagcccccgcccaauccgacgucgcccuacuccgauucguaaacccagacacaggacgaguccuauucgaaugcaaacuccacaaauccggguacguuaccguagcacacacaggccaacacgaccucguaaucccacccaacggauauuuccgcuucgacucgugggucaaucaauucuauacacucgcacccaugggaaacggagccggacgccggcgcuaa

SEQ ID NO: 38108 - RNA, 1617 nt, Artificial Sequence
  derived and/or modified sequence opt11 from VP1__Norovirus_and/or_Norovirus-like__KY628449
augaaaauggcauccucagacgcaaauccaucagacggaucagcugccaaccuaguccccgaagucaacaacgaagucauggcccucgaacccguagucggcgcagccaucgcugcaccggucgccggccaacaaaacguaauagaucccuggauacgcaauaacuuuguccaagcaccaggaggagaguucaccguaucuccccgcaacgcccccggcgaaauccuuugguccgcuccccucucaccagaccuaaacccauaccucucccaccuagcccgaauguacaauggcuacgccggcggcuucgaaguccaagucauccucgcuggcaacgcauucaccgcagguaaggucauuuucgccgcugucccacccaacuuccccacagaaggacucucccccucacaaguaaccauguucccccacaucgucgucgacguacgccaacuugaaccaguccucaucccccuccccgacgucagaaacaacuucuaccacuacaaccaaucaaacgauuccacaaucaaacuaaucgcuaugcuauauacaccccuccgcgccaacaaugccggcgacgacgucuucacagucuccugccgcguccucacucgcccuucccccgacuucgauuucaucuuccucgucccacccaccgucgaaucaagaacaaaacccuucuccguccccguacucacagucgaagaaaugaccaacucacgauuucccaucccccucgaaaaacuuuucacaggccccucauccgacuucgccguccaaccucaaaacggccgaugcaccacagacggaguccuccuuggaacaacccagcucucccccgugaacaucugcacauuccgaggugacgucacacacaucaauggcuccucaaacuacaaaaugaaccucgccaaccaaaacuggagcaacuacgaccccacagaagaaauacccgcuccccucggcgcccccgacuucguaggaaaaauccaaggcguacuaacucaaaccacaaaagaagauggcuccacccgcggccacaaggccaccguauacacagguucagccgacuuugcccccaaacucggacguguccaauucgaaacagacaccgaccaugaccucgagaucgaccagaacacgaaauucacacccguaggcgucauccaaaacggcggcacaacacaccgcaaugaaccaaaacaauggaugcucccauccuacucaggccgcaauacccccaacguucaccucgcucccgcagucgcccccacauuccccggcgaacaacuccuauucuuccgauccacuaugcccggaugcucagguuaccccaacauggaccucgacugccuccuuccccaagaauggguacaacacuucuaucaggaagccgccccagcccaaucagacgucgcccuacuccgcuucgucaacccagacacaggucgcguccucuucgaauguaaacuccacaaauccggcuacguuaccguagcccacucuggacaacacgaccuuguagucccacccaacggauacuuccgauucgacuccuggguaaaccaauucuacacccuagcccccaugggcaacggcucaggccgccgccgcuaa

SEQ ID NO: 38109 - RNA, 1617 nt, Artificial Sequence
  derived and/or modified sequence opt11 from VP1__Norovirus_and/or_Norovirus-like__KX371608
augaaaauggccuccaacgacgccaaccccagcgauggaagcgcagccaaccucguacccgaagucaacaaugaagucauggcacucgaacccgucgucggagcagcaaucgcugcccccguagcuggacaacaaaacgucaucgacccauggauccgcucaaacuucguacaagcacccggaggcgaguucaccgucuccccacgaaacgcaccaggcgaaauccucuggucagcuccccuaggacccgaccucaaccccuaccucucucaccuagccagaauguacaacggcuacgcaggcggcuucgagguccaagucauccuugccggcaacgcauucaccgccggaaaaaucaucuucgcagcgguacccccaaacuucccaacugaaggacuaucaccuucccaagucacaauguucccacacauaauagucgacguccggcagcuugaacccguucucauccccuuacccgacguacguaacaacuucuaccacuauaaccaaucaaacgauucaaccaucaagcucauagccaugcuauacacaccccuacgcgcgaacaacgccggagacgacgucuucaccgucuccugcagaguccucacccgccccucccccgacuucgacuucaucuuccuagugcccccaacagucgaaucacguaccaaaccuuucacuguuccaauccuaaccguagaagaaaugacaaacagccgcuuuccaauaccccucgaaaaacuauucaccggccccuccagcgccuucgucguucaaccccagaacggccgaugcaccacggacgguguacuucucggcacaacacaacucucccccguaaacaucugcacuuucagaggcgacgucacccacaucgcaggcucacacaacuacaccaugaaucucgcaagccugaacuggaacaacuacgaccccaccgaagaaauaccagcaccccuaggcacccccgacuucgucggcaaaauccaaggaguucuaacccaaauaaccaaaggugacggauccacccgcggccacaaagccaccgucuacaccgguuccgccgacuucacacccaaacuaggcuccguacaauucgccaccgacaccgaaaacgacuuccaaacccaccaaaauaccagauucacccccguuggcgucauccaagacggcggcaccacccaccaaaacgaaccccaacaauggguacuccccucauauucuggccgcaacguacacaacguccaucucgcccccgcagucgccccaaacuuccccggugaacaacuccuauucuuccgcuccacaaugccaggaugcucaggcuaccccaacauggaucucgacugccuacucccacaagaguggguccaacauuucuaccaagaagccgcucccgcccaauccgacguugcccuccuccgguucgucaacccagacacaggccgcguccucuucgaaugcaaacuucacaaaagcggcuacguaaccgucgcccacaccggccaacaugaccucgucauacccccaaaugguuauuuccgcuucgauuccuggguaaaccaauuuuacacccuagccccaaugggcaacggcaccggccgccgccgauag

SEQ ID NO: 38110 - RNA, 1617 nt, Artificial Sequence
  derived and/or modified sequence opt11 from VP1__Norovirus_and/or_Norovirus-like__KX354089
augaaaauggccuccaacgacgccaaccccuccgacggcucagccgcgucccuaguucccgaagucaauaacgaaguuauggcccucgaaccuguugucggcgcagccaucgccgcccccgucgccggucaacaaaaugucauagaccccuggauccgcaacaacuucguccaagcccccggcggcgaguucaccgucucaccucgaaacgcaccaggagaaauacucugguccgcaccccuaggccccgaccuaaacccuuaccuaucccaccucgcccgcauguacaacggcuacgcuggaggauucgaaguccaaguuauccuugccggaaaugccuucaccgcuggaaaaaucaucuucgccgcagucccacccaacuuucccaccgaaggucucucaccaucucagguaaccauguucccacacaucaucgucgacgucagacaacucgaacccguccucaucccccuccccgacguacgcaacaacuucuaccauuacaaccagucuaacgacucuaccauaaaacuaaucgcaaugcucuacaccccacuucgcgcaaacaacgccggcgaugacguguucaccguuuccugccgcguccucaccaggcccucacccgacuucgacuucaucuuccugguacccccaacaguagaaucucgcaccaaaccauucaccguccccauccuaaccguugaagagaugacuaacucucgcuucccaaucccccucgaaaaacucuucacaggccccuccagcgccuucguaguccaaccccaaaacggccguugcaccaccgacggcguccuccucggaaccacccaacucucccccgucaacaucugcacauuccgaggcgacguaacccacaucgcaggcucccgcaacuacacaaugaaccucgcuucccuuaacuggaacaacuacgaccccaccgaagaaauccccgcaccccucggcacaccagacuucgucggcaaaauccaagggguccucacccaaacaaccaagggcgacggaucuacccgcggacacaaagccaccguauacaccggcuccgcagacuucacucccaaacuuggcuccguccaauucgcuaccgacaccgaaaacgacuucgaaacacaccaaaacaccaaguuuacccccguaggcgucauccaagacggcggcacuacucaccgaaacgaaccucaacaauggguccuacccucauauuccggucgcaacguccacaacguccaccuagccccugccgucgcccccaacuucccaggcgaacaacuacuuuucuuccgcucaaccaugcccggcugcuccggauacccaaacauggaccucgacugccugcuaccccaagaauggguccaacacuucuaccaagaagccgcacccgcccaaucugacgucgcccuacuccgguucguaaacccugacaccggacguguucuauucgaaugcaaacuccacaaauccggcuacguuacgguugcccacaccggccaacacgaccucgucauucccccaaacggcuauuuccgcuucgacuccugggucaaccaauuuuacaccuuagcgccaaugggaaauggcaccggacgacgccgauaa

SEQ ID NO: 38111 - RNA, 1617 nt, Artificial Sequence
  derived and/or modified sequence opt11 from VP1__Norovirus_and/or_Norovirus-like__KX354001
augaaaauggccagcaacgacgcaaaccccucagacggcagcgccgcuaaccucguacccgaaguuaacaacgaagucauggcucuagaaccaguagucggcgccgcaaucgccgcccccgucgccggccaacaaaacgucauagaccccuggauccgcucaaacuucguccaagcccccggcggcgaguucaccgucagcccacgcaacgcccccggagaaauucucugguccgcaccccucggccccgaccuaaacccauaucucucacaccucgcccgcauguacaacggauacgccggaggauucgaaguccaaguaauccuagccggaaacgccuuuaccgccggcaaaauaaucuucgccgcaguacccccaaacuucccaaccgaaggacuaucacccucccaagucaccauguucccccacauaaucguagacguucgccaacucgaacccguacucaucccccucccagacguacgaaacaacuucuaccacuacaaccaaucuaacgacuccaccauaaaacuaauagccaugcucuacacccccuuacgcgcaaacaacgcaggagacgacguauucaccguaagcugcagaguacucacccgcccaagucccgacuuugacuucauauuccuagugcccccaaccgucgaaucccgcaccaaacccuucaccguccccauccucaccguagaagaaaugaccaacucccgcuuccccaucccccuagaaaaacuauucacaggucccucauccgccuucaucgugcaaccccaaaacggccguugcacaaccgacggaguacuacuaggcaccacccaacuuucaccuguaaacaucuguaccuuccggggagacgucacacacauagcgggcucccgaaacuacacaaugaaccucgcuucccucaacuggaacaacuacgacccaaccgaagaaaucccugcaccacuaggaacacccgacuucgucgguaaaauccagggcguccugacccagaccaccaaaggagacggcuccacacgcggacacaaagcaacaguauacacaggcuccgccgacuucaccccaaaacucgggucuguccaauucgcaacagacaccgaaaacgacuucgaaacccaccaaaacacccgcuucacccccgucggagucauccaagacggcggcaccacacaccgcaacgaaccccaacaauggguacuacccuccuauagcggacgaaacguacauaacguccaccucgcccccgcagucgcccccaacuucccuggagagcaacuacucuucuuccgauccaccaugcccggaugcagcggauacccaaacauggaccucgacugccuccuaccgcaagaauggguccaacacuucuaccaagaagccgcaccagcccaauccgacgucgcccuccuccgcuucgucaaccccgacaccggccgcguucuuuucgaauguaaacuccacaaauccggauacgucacagucgcccacacuggacaacacgaccucgucaucccacccaacggcuacuucagauucgacucuugggucaaucaauucuauacccucgcccccaugggcaacgguacaggccgacgacguuag

SEQ ID NO: 38112 - RNA, 1617 nt, Artificial Sequence
  derived and/or modified sequence opt11 from VP1__Norovirus_and/or_Norovirus-like__KX353971
augaaaauggccuccaacgacgccucuccauccgaugguuccaccgcuaaccuaguccccgaaguuaacaacgaaguaauggcccucgaaccagucgucggcgccgccaucgccgccccuguugcaggccaacaaaacgucauagacccuuggaucagaaacaacuucguacaggcaccgggcggcgaguucaccgucaguccccgaaacgccccaggcgaaauucuuugguccgcaccccuaggacccgacuuaaaccccuaccucagccaccucgcccgcauguacaacggcuacgccggcgguuucgaaguccaagugauacuagccggaaacgccuucaccgccggcaaaaucaucuucgccgccgucccacccaacuuucccaccgaaggccuauccccaucccaagucaccauguucccccacauaaucgucgauguaagacaacuugaaccuguccucauaccccuuccagacguucguaacaacuucuaccacuacaaccaaucaaacgaccccaccaucaaacuaaucgccaugcucuacacaccacuccgagcaaacaacgcuggagacgacgucuucaccguaucaugccguguccucacacgccccagucccgacuuugacuucaucuuccucgucccucccaccgucgaaucacgaacaaaacccuucucaguccccguccuuacagucgaagaaaugaccaacucccgauuccccaucccccucgaaaaacucuucaccggcccauccucagcauucgucguucaaccccaaaacggccgaugcaccaccgacggcguccuacuaggcaccacacaacucucccccgucaacaucugcaccuuccgaggugacguaacacacaucaccggcucacgcaauuacaccaugaaucucgccucccaaaacuggaacuccuacgaccccaccgaagaaauccccgcuccacucggcacccccgacuucguaggcaaaauacaaggcguucuaacccaaaccacccgcaccgacggcuccacccgcggucacaaagccaccgucuacaccggcuccgccgacuucucccccaaauuaggaagaguucaauucgccacagacaccgacaacgacuucgaaacaaaccaaaacaccaaauucacccccgucggaguaauacaagauggcggcacuacucaccgcaacgaaccccaacaaugggucuuaccauccuacagcggacguaacacccauaacguucaccuagcacccgccguugccccaaccuuccccggcgaacaacuacucuucuuccgcuccacuaugcccggcugcuccggcuaccccaacauggaccuagacugccuauuaccccaagaauggguccaauacuucuaccaagaagccgcacccgcacaaucagacgucgcccuccuccgguucgucaacccagacacaggcagaguccuauucgaaugcaaacuccacaaauccggcuacguaaccgucgcacacaccggacaacacgacuuagucauaccacccaauggcuacuuccgguucgacucaugggucaaccaauucuacacccucgcccccauggguaacggcaccggccgccgcagauga

SEQ ID NO: 38113 - RNA, 1617 nt, Artificial Sequence
  derived and/or modified sequence opt11 from VP1__Norovirus_and/or_Norovirus-like__KR131766
augaaaauggccagcaacgacgccaacccuuccgacggcucaaccgccaaccucguaccagaagucaacaacgaaguaauggcccucgaacccguagucggugccgcuaucgcggcaccugucgccggccaacagaacgucauugaccccuggauccgaaacaacuucguacaagcccccggcggcgaguucaccgucagcccccgcaacgcgccgggcgaaauccucuggucugccccucuaggccccgaccucaaucccuaucucucccaucuugcacggauguacaacggcuacgccggaggauucgaaguccaggucauccuugccggcaacgcauucaccgccggcaaaauaauuuucgcagccguuccaccgaacuuccccaccgaaggccucagccccucacaaguaacaauguuuccccacaucauaguagacguccgacaacuagaaccaguccucaucccccuccccgacguacgaaacaacuucuaccacuacaaccaaagcaacgacuccacaaucaaacuuauagccaugcuauacacaccacuccgcgccaacaacgccggcgacgauguauucacuguaucuugccgcguccucacccgccccuccccagacuucgacuucaucuuccuagugcccccaacagucgaaucccguacgaaacccuucacaguccccauccucacugucgaagaaaugacaaacucccgcuucccuauaccccuggaacgccucuacaccggacccuccuccgccuucgucguccagccacaaaacggccgaugcacaacugauggaguacuccucgguaccacucaacugucagcagucaacaucugcaccuuccgcggagacgugacccauaucgcgggaucacgcaacuacaccaugaaccuagccucccaaaacuggaacaacuacgaccccacagaagaaauccccgcgccccuaggaacacccgacuucgucggaaaaauucaaggcauguuaacacaaacaacccgcagcgacggcuccacccgcggacacaaggccacaguccuaacaggauccgcagacuucgcccccaaacucggucgcguccaauucgccaccgauaccgacaacgacuuugaaucaggucaaaacaccaaauucaccccagucggcgucauccaagacgguuccacaacccaccgcaacgaaccucaacaauggguccuucccaacuacuccggucgcacaggccacaacguccaucuugccccagccguugcccccaccuaccccggagaacaacuccuauucuuccgaucaaccaugcccggaugcuccggcuaccccaacauggaccucgacugccuccuaccacaagaauggguucaacacuucuaccaagaagccgcaccagcccaaucugacguagcccuacuccgcuucgucaaccccgacaccggccggguccuauucgaaugcaaacuccacaaaucaggcuacgucaccgucgcacacaccggccaacacgaccucgucauuccacccaacggcuacuuccgcuuugacucaugggucaaccaauuuuacacacuagcgccaaugggcaacggcaccggacgccgucguuga

SEQ ID NO: 38114 - RNA, 1617 nt, Artificial Sequence
  derived and/or modified sequence opt11 from VP1__Norovirus_and/or_Norovirus-like__AB663685
augaaaauggcauccaaugaugccaaccccuccgacggcucugccgccaaccucguccccgaagucaauaacgaagucauggcccucgaaccagucgucggggccgccaucgccgccccugucgcuggccaacaaaacgucauugaccccuggauacgaaacaacuucguacaagccccaggcggcgaguucacagucucaccccgcaacgccccaggcgaaauccucugguccgccccacucggccccgaucugaaccccuaccucucacaccucgcccgcauguacaacggcuaugcaggcggcuucgaaguacaagucauccuugccggcaacgccuucaccgcaggcaaaaucauauucgccgccgucccacccaacuuucccacugaaggacucuccccaucccaaguaaccauguucccccacauaauaguagacguacgacaacucgaaccaguacuuauaccccuccccgacguccggaacaacuucuaccacuauaaucaaucuaacgacucuaccaucaaacuaaucgcaaugcuauacacaccccuccgcgccaacaacgccggagacgacgucuuuaccgucuccugcagaguccucacccgcccaucacccgacuucgacuucaucuuucuaguucccccuaccgucgaaucccgcgcgaaacccuucacaguccccauccuaacagucgaggagaugaccaacuccagauucccaaucccacuugaaaaacucuucacuggccccuccagcgccuucgucguccaaccccagaacggucgcugcacuaccgacggcguacuccucggcacaacccaacugucccccgucaacaucugcacauuucgcggcgacguaacccacauagcaggaucacgaaacuacaccaugaaucuagccucccucaacuggaauaacuacgaucccaccgaagaaauccccgccccucuggguacacccgacuucgucggaaaaauccaaggcguccuaacacaaacaaccaaaggugacggcuccacacgcggacacaaagcgaccguuuacacaggcuccgccgacuucaccccaaaacuaggauccguccaauucgguacagacaccgaaaacgacuucgagacccaccaaaacacaaaauucacuccaguaggcgucauccaggacggcggcacaacccaucgcaacgaaccccaacaauggguacuacccuccuacucaggacgcaauguccacaacguccaccuugcccccgccgucgcccccaacuuucccggagaacaacucuuauucuuccgcucaaccaugccaggaugcuccggcuacccuaacauggacuuagacugccucuuaccccaagaauggguccagcacuucuaucaagaagccgcaccagcccaauccgacguagcacuccuccgcuucgucaaccccgacacaggccgcguacucuuugaauguaaacuacacaaauccggcuacgucacagucgcccacaccgggcagcacgaccucgucaucccacccaacggcuauuuccgauucgauucaugggucaaccaguucuacacccucgcccccaugggcaacggcacaggacgccgacgauaa

SEQ ID NO: 38115 - RNA, 1617 nt, Artificial Sequence
  derived and/or modified sequence opt11 from VP1__Norovirus_and/or_Norovirus-like__AB933746
augaaaauggcaucauccgacgccaacccaucagacggcucgacagccaaccucguccccgaagucaacaacgaaguaauggcccucgaacccgucgucggcgcagccaucgcggccccagucgccggccaacaaaacgucauagaccccuggauccgaaacaauuucguccaagcccccggcggcgaguucaccguaucaccccgcaaugcccccggcgaaauccucugguccgcaccacuuggccccgaucuaaaccccuaccucagccaccuagcccgcauguacaacggcuacgcaggaggauucgaaguccaagucauccucgcgggcaacgccuucaccgccggcaaaaucgucuucgccgcggucccucccaacuuccccaccgaaggccucagccccucacaaguaaccauguucccccacauaauagucgaugucagacaacuagaacccguccuaauuccacuuccugacguccgaaacaacuucuaccacuauaaucaaucaaaugaccccacuaucaaacuaauagccaugcucuacacuccacugagagccaacaacgccggcgaugacgucuucacugucuccugccgaguccuaacccggccguccccagacuucgacuucaucuuucuaguacccccaaccgucgaaucccgaaccaaacccuucuccguccccauccucaccgucgaagaaaugacaaacucucgcuuccccaucccccuggaaaaacucuucacaggacccuccucagcauuugucguacagccccagaacggccgcugcaccaccgacggaguccuacucggcaccacccaacuauccccugucaauaucugcacauuccgaggcgacgucacccacaucgcaggcucccacaauuacaccaugaaccucgccucacaaaacuggaacuccuacgaucccaccgaagaaaucccagcaccccuaggcacccccgacuucgucggcaagauccaaggcguccuaacccaaacaacccguaccgacggaucaacacgcggccacaaagccaccgucuacaccggauccgccgaguucucaccaaaacucggcagaguccaauucgccaccgacaccaauaacgacuucgacgccaaucaaaacaccaaauucaccccagucggcgucauccaggacgggggaacuacccaccgcaacgaaccccaacaauggguccuuccaagcuacuccggccgcaacacccacaacguacaccucgcacccgcgguggcaccuacauucccaggagagcaacuccucuucuuccgcuccaccaugccaggcugcuccggauauccaaacauggaccucgacugccuucucccccaagaaugggugcaauacuucuaccaagaggcagcacccgcacaauccgaugucgcucuccugagauucgucaaccccgacacaggccgcguacucuucgaaugcaaacuccacaaauccggcuaugucaccgucgcccacaccggccaacacgaccucgucaucccucccaacggguacuuccgcuucgauuccuggguaaaccaauucuauacccucgccccuaugggcaacggaacuggccgccgccgcuaa

SEQ ID NO: 38116 - RNA, 1617 nt, Artificial Sequence
  derived and/or modified sequence opt11 from VP1__Norovirus_and/or_Norovirus-like__AB933701
augaaaauggccucaaacgacgccaacccaucagacggcuccgccgcaaaccuaguccccgaagucaacaacgaagucauggcccuagaacccgucgucggagccgccaucgccgcacccgucgcaggccaacaaaacguuaucgauccauggauccggaacaacuucguacaagcacccggaggcgaguucaccgucucuccccgcaacgcccccggcgaaauccucugguccgccccacucggcccagaccuaaaccccuaucuaucacaccucgcccgcauguacaacggauacgccggcggauucgaaguacaagucauacucgccggaaacgccuucaccgccggaaaaaucaucuucgcagccgucccacccaacuuccccauagaaggccucucacccucccaagucaccauguucccccacaucaucguggacguacgacaacucgaacccguccucaucccccuacccgacguucgcaacaacuucuaccacuacaaccagucaaacgacagcacuauaaaacucaucgccaugcucuacacaccccuccgcgcuaacaacgccggcgaagacgucuucaccguaucaugccgaguacuaacacgccccagcccagacuucgacuucaucuuccuuguaccaccaaccguggaaucucgcaccaaacccuucacaguaccaauccuuacuguagaagaaaugacaaacucacgauuccccauuccccuugaaaaacucuucacaggccccuccuccgcauucguuguucaaccccaaaacggccgauguacaaccgacgguguccuccuaggcacaacccaacuaucccccgucaacauaugcaccuuucgaggagacgucacccauaucgccggaucacgaaacuauaccaugucccuggccucccucaacuggaacaacuacgaccccaccgaagaaauccccgcaccccuaggcacccccgacuucgucggcaaaauacaaggcguacucacucagaccaccaaaggcgacggcucaacccgaggacacaaagccaccgucuacaccggcagcgcccccuucacccccaaacugggcucaguccaauucucuaccgacacugagaacgacuucgaaacccaccagaacacaaaauucacaccagucggcgucauccaagacgguggcacaacacaccgcaacgaaccucaacaauggguccuacccuccuacaguggccgaaacguccccaacguccaccuugcccccgccgucgcccccacauuccccggcgaacaacuccuauucuuccgcucaacaaugcccggcugcucaggcuaccccaauauggaucuagacugucuccuaccacaggaauggguccaacauuucuaccaagaagcggcucccgcccagucugacguugcacuacuccgauucguaaacccagacacaggaagaguccucuucgaaugcaaacuccacaaaucuggauacgucaccgucgcccacaccggacaacacgaccuagucauacccccaaacggcuacuuccgcuucgacagcugggucaaccaauucuacacccuagcaccuaugggaaacggaaccggacgccgccgcuaa

SEQ ID NO: 38117 - RNA, 1617 nt, Artificial Sequence
  derived and/or modified sequence opt11 from VP1__Norovirus_and/or_Norovirus-like__AB933686
augaaaauggcaagcaacgacgccaaccccuccgacggcucagccgcaaaccucguccccgaaguuaauaacgaagugauggcacucgaaccaguagucggcgccgccaucgccgcaccuguagccggccaacagaacguaaucgacccauggauccgcaacaacuucguccaagcccccggcggagaguucaccgucagcccgcgcaacgcacccggcgaaauccuuugguccgccccucucgggccagaccuuaaccccuaccucucacaccucgcccgaauguauaacggcuacgccgguggcuucgaaguccaaguaauccucgcuggcaacgcauucacagcuggaaaaaucaucuucgcagccgucccacccaacuuccccaucgaaggacuuucacccucacaagucaccauguuuccccacaucaucgucgacguccgccaacuagaaccaguacucaucccccuccccgacguaagaaacaacuucuaccacuauaaccaguccaacgacuccaccaucaaacuaaucgcuaugcuguacacuccacuccgcgccaacaacgccggagaggacgucuuuacaguauccugccgcguacuaacacgccccucuccggacuucgacuucaucuuccuagucccacccaccgucgaaucccgcaccaaacccuucaccguuccaauccuaaccgucgaagaaaugaccaacucccgcuuccccaucccacuugaaaaacuuuucaccgggcccuccucagcauuuguuguucaaccccaaaauggccgaugcaccaccgacggaguccuacucggcaccacucaacuuucccccguaaacauuugcacauuccguggcgacgucacacacauagcaggcucacgaaacuacaccaugaacuuagcaucauuaaacuggaacaacuaugacccaacggaagaaauaccggcaccccucggcacuccggacuucgucggaaaaauacaaggaguccuaacccaaaccaccaaaggcgacggguccacacgcggccacaaggccaccguauauacaggcucagccccuuuuaccccuaaacucggcucaguacaauucuccaccgacaccgaaaaugacuucgagacccaccaaaacaccaaauucacacccgucggcgucauccaagacggaggaaccacccaccgcaacgaaccccaacaauggguccuacccagcuacuccggacgaaacgucccaaacguccaccucgcccccgcaguagcccccaccuucccuggcgaacagcuccuauucuuccguuccaccaugcccggcuguuccggauaccccaacauggaccuugacugccuccucccccaagaauggguacaacacuucuaccaggaagccgcacccgcccaauccgacgucgcccuacuccgcuucgucaaccccgacacuggacgcguccucuucgaaugcaaacuacacaaaucaggcuacgucacagucgcccacaccggccaacaugaccucgucauucccccaaacggauacuuccgcuuugacagcugggucaaccaauucuacacacucgcacccaugggcaaugguaccggccgccgccgcuaa

SEQ ID NO: 38118 - RNA, 1617 nt, Artificial Sequence
  derived and/or modified sequence opt11 from VP1__Norovirus_and/or_Norovirus-like__AB933680
augaaaauggcaucaaacgacgccaaccccucagacggcucagccgccaaccucguccccgaagucaacaacgaaguaauggccuuagaacccguaguaggcgccgcuauagcagcccccgucgcaggccagcaaaacgucaucgaccccuggauucgcaauaacuucguccaagcacccggcggagaguucacuguuagcccccgcaacgcccccggagaaauccucugguccgcaccccucggccccgaccucaaccccuaccucucccaccucgcacgaauguacaacggauacgcgggcggcuucgaaguccaaguaauacuggccggcaacgccuucaccgccggcaaaauaauauucgcagccguacccccaaacuuucccacagaaggacucuccccaucccaagucaccauguuuccccacauaauagucgacguccgccaacucgaacccguacucaucccccuccccgacguccgcaauaacuucuaccacuacaaccaauccaacgacucaacuaucaaacuaauagccaugcucuacacaccccuccgagccaacaacgccggagaagacgucuucaccgucucgugccgcguccucacccgacccucccccgacuucgauuucaucuuucuugucccacccaccgucgaaucccgaacaaaacccuucacaguacccauacucacagucgaagaaaugaccaacucaagauuccccaucccccucgaaaaacucuucacaggacccuccuccgccuucgugguacagccccaaaacggcagaugcacaaccgacggcguccuccuggguacaacccaacucuccccagucaacaucugcaccuucagaggcgauguaacccacauagccggaucccguaacuacacuaugaaucuagccucccucaacuggaacaacuaugaccccaccgaagaaaucccugcaccccuaggcacaccagacuucgucggcaaaauccaaggaguccuaacccaaaccaccaagggagacggcucaacccgaggccacaaagccaccgucuacaccggcuccgcccccuuuacccccaaacucggcagcguacaauuuucaaccgacaccgaaaacgauuucgaaacccaccaaaacacaaaauucaccccagucgggguaauccaagacggcucaacagcccaccgcaacgaaccccaacaauggguauuaccuucauacuccggccguaacguacaaaacguccaccucgcccccgccgucgcacccaccuucccaggagaacaacuacucuucuuucgcucaaccaugcccgggugcuccggcuacccgaacauggaccucgacugucuccuaccccaagaauggguccaacacuucuaccaagaagcggccccagcucaauccgacgucgcacuccuccgcuucgucaaccccgacacuggacgcguccuuuucgaaugcaaacuacauaaaagcggcuacguuaccgucgcccacaccggccaacacgaccuuguuauaccacccaacggcuacuucagauucgacagcugggugaaccaauucuacacccuggcccccaugggcaacggcacagggcgacgccgauaa

SEQ ID NO: 38119 - RNA, 1617 nt, Artificial Sequence
  derived and/or modified sequence opt11 from VP1__Norovirus_and/or_Norovirus-like__AB933672
augaagauggccucaaaugacgccaacccauccgacggcuccgccgccaaccucguaccagaagucaacaaugaaguaauggccuuagaacccgucgucggcgccgcaauagccgcucccguagcgggccaacaaaacgucaucgaccccuggauucgcaacaauuucguacaagcccccggaggagaguucaccgucucaccccgcaacgccccaggcgaaauacuaugguccgcaccccuaggccccgaccuaaaccccuaccuaucccaccuagcccgcauguacaacggcuacgccggaggauucgaaguccaagucauccuugccggaaacgccuucacagccggcaaaaucaucuucgccgccgucccacccaacuuccccaccgaaggccuaucccccagccaagucaccauguucccccacaucaucgucgacgucagacaacucgaacccguccucaucccccuccccgacguucgaaacaacuucuaccacuacaaccaaagcaacgauuccacaauaaaacucauagcaaugcucuacacaccccucagagcaaacaacgccggcgaagacgucuucaccguauccugccgcguccucacgcgacccuccccugacuuugacuucauauuccuaguuccacccaccgucgaaucccgcacaaaaccauucaccgucccaauccucacagucgaagaaaugaccaacucccgauuccccauaccacucgagaaacuuuucaccggaccauccagugcauucgucguucagccccaaaacggucgcugcaccaccgacggcguccuccugggcaccacacaacuaagccccguaaacaucugcacuuuccguggggacgucacccacaucgccggaucucauaacuacaccaugaaccuugccucccucaacuggaacaacuacgaccccaccgaagagauccccgcaccgcucggaacacccgacuucgucggcaaaauccaaggcguacucacccaaacuaccaaaggagacggcuccacccgcggacacaaagcaaccgucuacaccggcucagccccuuucaccccaaaacuaggaucaguacaauucuccaccgacacagaaaacgacuucgaaacccaccaaaacacgaaauucaccccagucggcgucauucaagacggcgguacagcccaccgaaacgaaccccaacaguggguccucccauccuacucaggccgcaacguacaaaacguccaccucgcacccgccgucgccccaacauuuccaggagaacaacuccucuucuuccgcucaaccaugcccggcugcuccggcuaccccaauauggaccucgacugccuucuaccacaagaauggguacaacauuucuaccaagaagccgcucccgcccaauccgacgucgcccuacuacgcuuugucaacccagacaccggacgcguccucuucgaaugcaaacuccauaaauccggauaugucacagucgcccacaccggccagcaugaccucgucauacccccaaacggcuacuucagauucgacucuugggucaaccaauuuuacacccuugccccaaugggcaacggaaccggucgacgccgauaa

SEQ ID NO: 38120 - RNA, 1617 nt, Artificial Sequence
  derived and/or modified sequence opt11 from VP1__Norovirus_and/or_Norovirus-like__AB933664
augaaaauggccaguaacgacgccaccccaucugauggcagcgccgcaaacuuaguacccgaggucaacaacgaagucauggcacuagaacccgucgucggcgcagccauugccgcaccaguagcaggccaacaaaacgucaucgaccccuggauccgaaacaacuucguccaagccccaggaggcgaauuuaccgucucaccccgcaacgcaccaggcgaaauucuauggucagcaccccucggacccgaccucaaccccuaccucagccacuuagccagaauguacaacggcuacgccggaggcuucgaaguccaagucauccuagccggaaacgccuuuaccgccggcaaaaucaucuucgcugccguacccccaaacuucccaaccgaaggccucucccccucacaggucacaauguucccccacauaauaguggacguccgacaacucgaaccuguccucaucccacuacccgacguucgaaacaacuucuaccacuacaaucaaagcaacgacucaacaauaaaacucaucgcaaugcucuacacuccccucagagcaaacaacgccggagaagacguauucacaguaagcugccgcguccuuacacgacccagccccgacuucgacuucaucuuccuuguuccacccacggucgaaagccggacaaaacccuucaccguccccauauuaacagucgaagaaaugacaaauagccguuuuccaaucccacuagaaaaacucuucacaggccccuccuccgcauucguaguccaaccccaaaacggacgcugcaccacagacggcguccuucucgggacaacccaacucagccccgucaacauaugcaccuuccgcggcgacgucacccacauagccggaucgcgaaauuacacaaugaaccucgcaucccucaacuggaacaacuacgacccaaccgaggaaaucccggccccauuaggaacccccgacuucguaggcaaaauccaaggaguucuaacccaaacaacgaaaggugacggcucaacacgcggccacaaagccaccguuuacaccggcucagccccauuuacccccaaacucggcuccguccaauucaacacugacacagagaacgacuucgaaacccaccagaacacaaaauucacccccgucggcgucauccaggacgguuccacgacccauagaaacgaaccccaacaauggguccuuccaucauacuccggccgaaacguccccaacguccaccucgcccccgccgucgcuccaaccuuccccggcgaacaacuccuuuucuuucgcucuacaaugcccggaugcuccggcuaccccaacauggaccuagacugccuccucccccaagaauggguccaacacuuuuaccaagaagcagcccccgcccaaucggacguagcccuccuccgcuucgucaaccccgacacugguagaguccuuuucgaaugcaaacuccacaaauccggauacgucaccguagcccacaccggccaacacgaccucgucauucccccuaacggcuacuuccgcuucgacucaugggucaaccaauucuacacauuagcucccaugggcaacggcacaggccgccgcagguaa

SEQ ID NO: 38121 - RNA, 1617 nt, Artificial Sequence
  derived and/or modified sequence opt11 from VP1__Norovirus_and/or_Norovirus-like__AB933662
augaaaauggccuccaaugacgccaaucccuccgauggcucagccgccaaccucguaccugaagucaacaacgaaguaauggcucucgaacccguugucggagcugcaaucgcugcgcccgucgccggacaacagaacgucaucgaccccuggauacgcaacaauuucguacaagcacccggcggugaguucaccgucucuccccggaaugcccccggagaaauacucugguccgccccacuaggcccagaccucaaccccuaccuaucccaccucgcccgcauguacaacgguuacgcaggcggcuucgaaguacagguaauccuagccggaaacgccuucacugcuggaaagaucauauucgcagcaguucccccaaacuucccuacugaaggacucucccccucccaagucacuauguucccccacaucaucgucgacguccggcaacucgaacccguccucaucccccuccccgacguccgaaacaacuucuaccacuacaaccaauccaacgacucaacaaucaaacucaucgccaugcuauauaccccacuacgagccaacaacgccggagaagacgucuucaccgucucaugccgcguccuaacccgcccaucaccugacuucgacuucauauuccuagucccacccacagucgaaucacguacaaaacccuucaccguacccauccuaaccgucgaagaaaugacaaacucacgcuuccccauaccccuugaaaaacuauucacaggccccuccuccgccuuugucguccaaccccaaaacggucgcugcacgaccgacggcguccuccucggaaccacucaauuaucaccugucaacaucugcaccuuccgcggugaugucacccacaucgccggcucacgaaacuacaccaugaaccucgccucccucaacuggaacaauuacgaccccaccgaagaaauccccgccccucuaggcacaccagacuuuguaggaaaaauccaaggcguccucacucaaacaaccaaaggcgacggauccacccgcggccacaaagcaacagucuacaccggcagugccccauucacacccaaacuaggaucaguacaauucuccaccgacacugaaaacgacuucgaaacccaccaaaacacaaaguucaccccagucggugucauccaggaugguggcaccacacaccgcaacgaaccacaacaauggguccucccguccuacuccggccgaaacguccccaacguucaccuugcccccgcuguagcccccaucuuccccggagagcaacuccucuucuuccgcaguacaaugcccggaugcucaggcuacccaaacauggaccuugacugucuccucccccaagaauggguccaacacuucuaccaagaagccgccccagcacaauccgauguagcacuccuccgauucgucaacccggacaccggccgcgugcuuuucgaaugcaaacuccacaaaucaggauaugucacagucgcacacaccggccaacacgacuuagucauuccucccaacggcuacuuccgauucgacuccugggucaaccaauuuuacacccuagcacccaugggcaacggcaccggccgccgucgcuaa

SEQ ID NO: 38122 - RNA, 1617 nt, Artificial Sequence
  derived and/or modified sequence opt11 from VP1__Norovirus_and/or_Norovirus-like__AB933656
augaaaauggcaagcaacgacgccuccccuuccgacgguuccgccgcuaaccucgucccagaagucaacaaugaagucauggcccucgaacccgucgucggagccgcaaucgcagcuccagucgccggccaacaaaacgucauagacccauggauccgaaacaacuucguccaagcuccuggcggcgaguucacugucagccccagaaacgcccccggcgaaauccucugguccgcuccccuaggcccagaccucaacccauaccuaucccaccuagcccgcauguacaacggcuacgccggaggcuucgaaguccaggucauacuagccggcaacgccuucacagccggcaaaaucaucuucgccgccguacccccaaacuuccccacagaaggacucuccccaagccaagucaccauguucccccacauaauaguugacgucagacaacucgaacccguccucaucccccuccccgacguccguaacaacuucuaccacuacaaccaauccaacgacucaacaaucaaacucaucgccaugcucuacacaccccuucgagccaacaacgcaggagaagacguguucacagucuccugccgaguccuuacccgacccucaccagacuucgacuucaucuuccucgucccacccacaguagaaucacgcacaaaacccuucaccgucccaaucuugaccgucgaagaaaugacaaauucgcgcuucccaauuccccuugaaaaacuauuuaccggccccuccagcgcauucgucguccaaccccaaaacggccgcugcaccaccgacggcguccuccucggcacaacacaacucucccccgucaacaucugcaccuuccgcggcgacgucacucacauugccggcucccgcaacuacaccaugaaccuagcaucucucaacuggaacaacuacgacccaaccgaagaaauacccgccccucucgguacacccgacuucgucggaaaaauucaagggguccucacccaaacuacaaaaggcgacggauccaccagaggccacaaagcaaccguauauacaggcucagcacccuucacacccaaauuaggcuccguccaauucucaaccgacaccgagaacgacuucgaaacccaccaaaacacaaaauucacccccgucggaguuauucaagacgguggcaccacccaccgcaacgaaccccaacaauggguccuccccuccuacaguggcagaaacguacacaacguccaccucgccccagcaguggcccccaccuucccaggcgaacaacuccucuucuucagauccaccaugccaggcugcucuggauacccaaacauggaucuggacugccuacucccccaagaauggguccagcacuucuaucaagaagccgcccccgcccaauccgauguggcccuccuacgcuucgucaacccagacaccggccgcguacucuucgaaugcaaacuccacaaaucgggauacguaacugucgcucacacagggcaacacgaccucgucauucccccaaacggauauuucagauucgacucauggguaaaccaauucuacacccucgcucccaugggaaacggaaccggccgucgccgauaa

SEQ ID NO: 38123 - RNA, 1617 nt, Artificial Sequence
  derived and/or modified sequence opt11 from VP1__Norovirus_and/or_Norovirus-like__EU921340
augaaaauggcuuccagcgacgcaaaccccuccgacggcucaaccgccaaccucguacccgaagucaauaacgaaguaauggcccucgaacccguagucggcgccgcaaucgccgccccaguugcaggccagcaaaacgucauugaccccuggauccgaaacaacuucguccaagcuccaggcggcgaauuuaccgucucaccccgcaacgcaccaggugaaauccucugguccgcaccacuaggaccugaccugaaccccuaccucucccaccuugcccguauguacaacgguuacgcuggaggcuucgagguucaagucauccucgccggcaacgccuucaccgccggcaaaauaaucuucgccgccgucccaccgaauuucccuaccgaaggccucucccccucccaaguaacaauguucccccacauuauagucgacguccgccaacucgaaccuguccuaauaccccuuccugacguccgcaacaacuucuaccacuacaaccagucuaacgacccaaccaucaaacuaaucgccaugcuauauaccccacuucgugccaacaacgcgggcgacgacguauucaccgucucgugccgcguacucacccgccccuccccugacuucgacuuuauauuccucgucccacccaccgucgaaucccgcaccaaacccuucuccgucccaauccucaccgucgaagaaaugacaaacuccagauuccccaucccccuagaaaagcuauucacaggaccuuccucugcauucgucguccagccacaaaacggacgcuguaccaccgacggaguccuccucggcaccacccagcugucacccguaaacaucugcaccuuucgcggcgacgucacacacauagccggcacucaagaauacacaaugaaccuugccucacaaaacuggaauaacuacgacccaacagaagaaauccccgcaccccucgguacccccgacuucgucggaaaaauacaaggcguccucacccaaaccacccgccgcgacgggucaaccagaggacacaaagccaccguuagcaccggauccguacacuucacccccaaacuuggccgcauccaauucuccaccgacaccucaaacgacuucgaaaccggucaaaauacaagauucacccccgucggagucguccaagacgggucaacaacccaccaaaacgaaccacaacaauggguccucccagacuacucuggccgcgacucccauaacguccaccucgcccccgcagucgcucccucuuuccccggagaacaacuccuuuucuuccgcuccacaaugcccggaugcuccggauacccaaacaugaaccucgacugcuuacucccucaagaguggguccaacacuucuaccaagaagcugccccagcacaauccgacgucgcacuccuccgcuucgucaacccagacacuggccgcguccuauucgaaugcaaacuccacaaauccggcuacgucaccgucgcacacacuggacaacacgaccuugucaucccacccaaugguuacuuccgcuuugacucgugggucaaccaguucuacacccucgcccccaugggcaacggcacuggccgccgccgcuaa

SEQ ID NO: 38124 - RNA, 1617 nt, Artificial Sequence
  derived and/or modified sequence opt11 from VP1__Norovirus_and/or_Norovirus-like__KC962453
augaaaauggccagcuccgacgcuaaccccuccgacggcuccacagcuaaucuagucccagaaguuaauaaugaagucauggcacucgaacccgucguaggcgcugccaucgccgcaccaguagccggccagcaaaacguaaucgaccccuggauaagaaacaacuuuguccaagcccccggcggagaguucaccauaucaccccgcaacgccccaggcgaaauccuaugguccgccccucuuggucccgaccuuaacccauacuuaucacaccuagcccgaauguacaacggauacgcaggcggcuucgaaguccaagucauccuagccggcaacgccuucacagcaggcaaagucaucuucgccgcagucccacccaacuuccccacugaaggccuuucucccucacaagucaccauguuuccucacaucgucgucgacguacgccaacucgaaccaguccucauaccccugcccgacguacgaaacaacuucuaccacuacaaccaauccaacgacccaacaaucaaacuaauugcaaugcucuacacaccccuacgagcuaauaacgccggcgacgaugucuucacagucuccugcagaguccuuacccgccccucccccgacuucgacuucaucuuccuaguaccacccaccguagaaucucgaacaaaacccuucuccauccccguccucaccauugaagaaaugacuaacucccgauucccuauaccacuagaaaaacuauucaccggcccaagcuccgcuuucgucguacaaccccaaaacggccgcugcuccaccgacggaguccuccucggcacaacccaacuaucccccgucaacauaugcaccuuucgaggcgacgucacccacauagcaggaucccacaacuacacgaugaaccuugccucacaaaacuggaacuccuaugaccccaccgaagaaauccccgcaccccuagguacccccgacuucgucgggaaaauccaaggcguccuaacccaaacaacucgagcagacggcuccacccgcggccacaaagccaccgugcucaccggcuccgcaaacuuuaccccaaaacuaggcagaauccaauucgcaaccgacaccgacaacgacuucgaaaccaaccagaacacaaaauucacacccguaggcgucauacaagacggcgacacggcacaccgaaacgaaccccaacaauggguccuacccuccuacucaggucgcaacacccacaacguacaccuugcccccgccgucgcccccacauuucccggggaacaauuacuauucuuccguuccaccauacccggaugcuccgguuaccccaacauggaccuugacugccuccucccccaagaauggguccaauucuuuuaccaagaagccgcaccagcccaaucugacguugcacuccuaagauucguaaacccagacacuggccgcguccucuucgaaugcaaacuacacaaaucaggcuacauaaccgucgcccacaccggccagcaugaucuagucauacccccaaacggcuacuuccguuucgacucaugggucaaccaauucuacacccucgcaccuaugggcaacggcacaggccgccgacgcuaa

SEQ ID NO: 38125 - RNA, 1617 nt, Artificial Sequence
  derived and/or modified sequence opt11 from VP1__Norovirus_and/or_Norovirus-like__KF712501
augaaaauggccagcaacgacgccaaccccuccgacggauccgcagcaaaccucgucccagaaguuaacaaugaagucauggcacucgaacccgucgugggcgcagccauagccgcccccguagccggccaacagaacgugaucgauccuuggaucagaaacaacuucguacaagcacccggcggugaguucaccgugucuccccgcaacgcacccggugaaauccucugguccgccccgcucggcccagaccuaaauccauaccucucccaccucgcacgaauguacaacggcuacgccggcggcuucgaaguacaaguuauccuagcgggaaaugcauucacagcaggcaaaauaaucuucgcagcaguacccccuaacuuucccacagaaggacucucucccucacaagucaccauguucccccacaucauagucgacguccgacaacuagagcccguccuaaucccucuacccgacgucagaaacaacuucuaccacuauaaccaaucaaacgacuccacaauaaagcucauagcuauguuauacacaccccuccgugcaaauaacgcuggagacgacguauucaccgucuccugcagaguccuuaccagacccucccccgacuucgacuucaucuuccucgucccacccacaguagaaucccgcaccaaacccuucucuguccccauccucaccguagaagaaaugaccaauucccguuuccccauaccccuugaaaaacucuucacaggucccuccucaacauucguaguccaaccccaaaacggccgcugcacuaccgacggcguacuccucggcaccacccaacuuucccccguaaacaucugcacauuccgaggcgacguaacccacaucacuggcucccguaacuacaccaugaaccucgcgucacagaacuggaacuccuacgaccccacugaagaaauccccgcaccccucggcacccccgacuucguuggaaagauucaagguguccucacacaaaccacgcgaaccgacgggucaacucggggccacaaagccacagucuacaccgguuccgccgacuuuucccccaaacuaggcagaguccaauuugcgacagacaccgacaaugacuucgacaccaaccaaaacaccaaauucacccccgucggcgucauccaagacggcggcaccacacaccgcaacgaaccccaacaauggguccuaccaucauacuccggccgcaacacacacaacguccaccucgcccccgccguggccccaaccuuccccggagaacaacugcuuuucuuccgcagcacaaugccaggcagcuccggcuacccaaacauggaccuugacugucuccuuccacaagaauggguccaauacuucuaccaagaagccgcacccgcacaaucugacguugcccuccuccgcuucgucaaccccgacacaggccgaguccuuuucgaaugcaaacuacacaaaagcggcuacgucaccgucgcacacaccggucaacacgaccucgucaucccacccaacggcuacuuccgauucgacucaugggucaaccaauuuuacacccucgcccccaugggcaacggaacuggcagaagaagauaa

SEQ ID NO: 38126 - RNA, 1617 nt, Artificial Sequence
  derived and/or modified sequence opt11 from VP1__Norovirus_and/or_Norovirus-like__JX459903
augaaaauggcauccuccgacgccaaccccuccgacggcucuaccgcaaaccucguccccgaggucaacaacgaggugauggcacucgaaccagucguaggcgcagccaucgccgcucccgucgccggccaacaaaacgucaucgaccccuggauacgaaacaacuucguccaagccccuggcggugaguucaccguaucacccaggaaugcucccggugaaauccucugguccgcaccccuagggccggaccucaacccauaccuaucacaccucgcccgaauguacaacgguuacgccggaggcuucgaaguccaaguaauccuugcuggcaacgcuuucaccgcaggcaaaaucauauucgccgcagucccacccaacuuccccaccgaagggcucucccccucgcaagucaccauguucccccacaucaucgucgacguucgccaacuagaacccguacucaucccccuccccgacguacgcaacaacuuuuaccacuacaaccaaucaaacgacccaaccaucaaacucaucgccaugcucuacacaccccuacgugccaacaacgccggagacgacgucuuuaccguauccugccguguccugaccagaccuuccccagacuucgacuuuaucuuccucgucccacccaccgucgaauccagaacuaaacccuucagcguacccauacucaccguagaagaaaugaccaacucacgcuuucccaucccgcuagaaaaacucuucaccggccccuccuccgccuucgucguccaaccacaaaacggccgcugcaccacagacggcguccuccuaggcaccacccaacuuucacccgucaacauaugcacuuuccgaggagacgucacccacaucaccggcucacgcaacuacacaaugaaccucgccacccaaaacuggaacuccuacgaccccacagaagagauacccgccccacucggcacaccugacuucguuggaaaaauacaaggcguacucacccaaaccaccagagcggacggauccacacgcggccacaaagccacugucuacaccggaucagccgacuucgccccuaaacucggucggguccaauucgccaccgacaccgaccacgacuucgacgccaaccaaaacacaaaguuuacacccguaggcgucauacaagacggagacacugcccaccgcaacgaaccccaacaauggguccucccaagcuacucaggccgaaacucacacaacguccaccucgcacccaccgucgcccccacauucccaggagaacaacuccuguucuuccguuccaccaugccaggcugcucaggcuacccaaauauggaucuugacugccuccuuccccaagaauggguccaauacuucuaccaagaagccgcgcccgcccaauccgacgucgcucuccuccgauucguaaaccccgacaccggccgaguacucuucgaaugcaaacuccacaaaucaggcuacgucaccgucgcccacacaggccaacacgacuuaguaauaccacccaacggcuacuuccgcuucgacuccugggucaaccaauucuacacccucgcacccaugggcaacggcacgggccgaagacgcuaa

SEQ ID NO: 38127 - RNA, 1617 nt, Artificial Sequence
  derived and/or modified sequence opt11 from VP1__Norovirus_and/or_Norovirus-like__JX459629
augaaaauggccucaaacgacgccaaucccucagauggcuccgccgcaaaccucgucccagaaguuaacaacgaagucauggcucucgaaccgguggucggugccgcaaucgcagccccaguagcaggacagcaaaacgucauagacccuuggauccgcucuaacuucguccaagccccaggcggcgaguucaccguaucaccccgcaacgcccccggagaaauccucuggucagcuccccucggcccagaccuaaaccccuaucucucccaccuugcccguauguacaacggcuacgccgguggcuucgaaguucaagucauccuagccggcaacgccuucaccgccggaaagaucauauucgccgccguaccacccaacuuccccacugaaggccucucccccucacaagucacuauguucccccacaucaucguugacguacgccaacuagaacccguccuaauaccacuccccgacgucagaaacaacuucuaccacuacaaccaguccaacgacuccacaaucaaacuaauagccaugcuuuacacaccccuacgcgccaauaacgccggggaagacgucuucaccgugucaugccgcguccucacgcgcccaagcccagauuucgacuucauauuccuagucccacccacagucgaaucccgaaccaaacccuucaccgucccaauucucaccgucgaagaaaugaccaacucucgcuuccccaucccccuagaaaaacucuucaccggaccauccucagccuucgucguacaaccccaaaacggccgcugcaccacagacgguguccugcucggcaccacacaacucucucccgucaacaucuguaccuuccgcggcgacgucacccacaucgccggcucccguaacuacaccaugaaccuagcaagccuuaacuggaacaacuacgaccccacagaagaaauaccagcaccccucggcacacccgacuucgucgguaaaauccaaggaguccucacccaaaccaccaaaggcgauggcuccacccgcggucacaaagccaccgucuacaccggcuccgcccccuucacaccaaaacuuggcuccguccaauucucuaccgacaccgaaaacgacuucgaaacccaccaaaauaccaaauucacccccgucggcguaauucaagacggcggaacaacccaccgcaacgaaccacaacaauggguccuccccuccuacagcggacgcaauguccccaacguccaccucgcccccgccguagcccccacuuuccccggcgaacagcuccuauucuuccgcuccaccaugcccggaugcucaggcuacccaaacauggaucucgacugccuacucccgcaagaauggguccaacacuuuuaucaagaagccgcccccgcccaauccgacguagcccuccugcgauucguaaaccccgacacaggaagaguccucuucgaaugcaagcuccauaaaagcggcuacgucaccgucgcccacaccggccaacacgaccucguuaucccaccgaacggcuacuuccgcuucgacagcugggucaaccaauucuacacacucgcccccaugggaaacggaaccggccgacgacgauaa

SEQ ID NO: 38128 - RNA, 1617 nt, Artificial Sequence
  derived and/or modified sequence opt11 from VP1__Norovirus_and/or_Norovirus-like__JX445165
augaaaauggccuccucagacgccaaucccucagacggcucaaccgcaaaccuaguacccgaaguaaacaacgaaguuauggcacuagaaccaguagucggcgccgccauagcagcccccgucgcuggucaacaaaacgucaucgaccccuggauacgaaacaacuucguucaagcccccggcggagaauuuacagucaguccccgaaacgcccccggcgaaauacucugguccgcgccccucggcccugaucucaaccccuaccucucccaucuagcccgcauguauaacggcuaugccggcggcuucgaaguccaagucauucucgcaggcaacgcuuucaccgcaggcaaaaucaucuucuccgcagucccacccaacuuccccacagaaggacucucccccucacaaguaaccauguucccccacaucaucguagacgugagacaacuagaacccguccuaaucccccuccccgacguccgcaacaacuucuaccauuacaaccaaagcaacgaccccaccauaaaacucaucgccaugcuauacacuccccuacgcgcaaacaacgccggcgacgacgucuucaccguuucuugccgaguccucaccagaccaucucccgacuucgacuucauauuccucgucccacccaccgucgaaagccgaaccaaaccuuucagcguccccauccucaccgucgaagaaaugacaaacucccgcuucccaauaccucuagaaaaacucuucacuggcccaucaucaaccuucgucguacaaccacaaaacggacgaugcacaacagacggcguccuacuaggcacuacccaacugucccccgucaacaucugcacauuccgcggagauguaacacacaucaccggaucccgcaacuacacaaugaacuuagcaucccaaaacuggaacuccuacgaccccacagaagaaauucccgcaccccucggcacccccgacuucgucggaaaaauccaagguguccucacccaaacuacacgcaccgacggcagcacucgaggucacaaagccaccgucuacaccggcucagccgaguucuccccaaaacucggccguguccaauucgcaaccgacacagacaaugacuucgacgccaaccaaaacaccaaauucacacccgucggcgucauacaagacggcgguacaacucaccgcaacgaaccacaacaauggguccuaccaucauacucuggccgaaacacccacaacguccaccucgcccccgcagucgccccaacuuucccaggcgaacagcuacucuucuuccgcucaacuaugccaggcugcuccggauaccccaauauggaccucgacugccuccucccucaagaauggguccaacacuucuaccaagaagccgcacccgcacaauccgacgucgccuuacuacgauucgucaaccccgacacaggacgaguacuauucgaaugcaagcuccacaaauccggcuacguaaccgucgcucacaccggccaacacgauuuaguuauaccacccaauggcuacuuucgcuucgacuccuggguuaaucaauucuacacccuagcccccaugggcaacggaacaggccgacgacgcuaa

SEQ ID NO: 38129 - RNA, 1617 nt, Artificial Sequence
  derived and/or modified sequence opt11 from VP1__Norovirus_and/or_Norovirus-like__HM635156
augaaaauggccuccucugaugccaacccaucagacggaucuacagccaaccucgucccagaaguaaacaacgaaguaauggcccuugaacccgucgugggugccgcaaucgcggccccagucgcuggucagcaaaacgucaucgaccccuggauacgaaacaacuucguccaagcacccggaggugaguucacagucucaccccgcaacgcccccggagaaauccucuggucagcaccccucggaccagaccuaaauccauaccucucucaccucgcccgcauguacaacggcuacgccggaggauucgaaguacaaguaauucuagccggcaacgccuucaccgccggcaaaaucaucuucgccgcgguuccucccaacuuucccaccgaaggccucucucccucccaagucaccauguucccacacaucaucgucgacguacgccaacucgaacccguccucaucccacuaccugacguccgcaacaacuucuaccauuacaaccaguccaacgacccaaccauaaaacucauagcuaugcuuuacacaccccuccgugccaacaacgccggcgacgaugucuucaccgucucuugccgcguccucaccagacccagcccugacuucgacuucaucuuccuaguaccaccaaccguugaaucucgcaccaagcccuucucaguacccauucucaccgucgaagaaaugaccaacucacgcuuccccaucccccuugaaaaacuauucacaggccccucaucagccuucguaguccagccacaaaacggccgaugcaccauagacggaguccuucucggcacaacccaacuaagcccaguuaacaucugcaccuuccgaggcgacgucacccacaucacuggaucccguaacuacacaaugaaccucgcaacccaaaacuggaacuccuacgaccccacugaagagaucccagcaccccucggcacccccgacuucgucggcaaaauacaaggcguccucacccaaaccaccagagccgacggcuccacacggggccacaaagccaccgucuauaccggauccgccgacuucgccccgaaacucggaagaguccaauucgccaccgacaccgacaacgacuucgacgcaaaccaaaacaccaaauucacucccguaggcgugauacaggacggcaauacagcccaccgcaacgaaccccaacaauggguccuacccuccuacucaggccgcaacucccacaacguccaccuagccccugcagucgcaccaaccuuccccggagaacaacuccuauucuuccgcucaacaaugcccggaugcagcggauacccaaacauggaucucgacugccuacuaccccaagaauggguccaauacuucuaccaggaagcagcccccgcccaaucagacguagcccuccuacguuuuguaaaccccgacaccggccgaguacuauucgaaugcaaacuacacaaaucaggcuacguaacaguagcccacaccggccaacacgaccuaguaauacccccaaacggauacuucagauucgacaguugggucaaccaauucuacacccuugcccccaugggcaacggaacaggccgccgccgcuaa

SEQ ID NO: 38130 - RNA, 1617 nt, Artificial Sequence
  derived and/or modified sequence opt11 from VP1__Norovirus_and/or_Norovirus-like__JQ622197
augaagauggccucaaacgacgccaauccaucagauggcuccgcagcaucccuaguacccgaagucaacaacgaagucauggcacuagaacccguagucggcgccgccaucgccgcccccguagccggccaacaaaacgucaucgaccccuggauccgaaacaacuucguccaagccccaggcggagaguucacugucuccccacggaaugcaccuggggaaauccuauggucagcaccccucggaccugaccucaaccccuaccucucccaccucgcccgcauguacaacggauacgccggagguuucgaaguccaggucauccuagcaggaaacgccuuuacagccggcaaaaucaucuucgcagcuguacccccaaacuuccccacugaaggacucuccccaucacaagucacaauguucccccacaucauaguggacguccggcaacucgaacccguccucaucccucuacccgacguccgaaacaacuucuaccacuauaaccaaucaaacgacuccacaauaaaacucauagcuaugcuauacacuccacuacgagccaacaacgccggagaagacgucuuuaccguauccugccgcguacucacccgccccucacccgacuucgacuucaucuuccuagucccacccacaguagaaucuagaacuaaacccuucaccguacccauccucaccgucgaagaaaugacaaacucccgguuccccauaccccuagagaaacuuuucaccggccccuccucugccuucgugguccaaccccaaaacggccgaugcacaaccgacggcguucuccucggcaccacacaacucagccccgucaacauaugcaccuuccgcggagacguaacccacaucgccggcucccguaacuacaccaugaaccucgcuucccuaaacuggaacaacuacgaccccacugaagaaauccccgcaccccuagguacucccgacuucgucggcaaaauacaaggcguccucacucaaacaaccaaaggcgacggauccacccgcggccauaaagccacugucuacacaggaagcgcucccuucacccccaaacuaggauccguccaauucuccaccgacacugaaaaugacuucgaaacccaccaaaacacuaaauucacucccguaggcgucauccaagacggaagcaccacccaccgcaacgaaccccaacaauggguacuccccuccuacucaggaggcaacguacacaacguccaccucgcccccgccguagcuccaacuuuucccggagaacaacuacuauucuuccgaucuaccaugcccggcugcuccggauacccuaacauggaccucgacugccuccucccccaagaauggguacaacacuucuaccaagaagccgcacccgcccaguccgacguagcccuccuacgcuucgucaaccccgacaccggacgaguacucuucgaaugcaaacuccacaagucagguuacguaacagucgcacacacaggccaacacgaccucgucauacccccaaacgguuacuuccguuucgacuccugggucaaccaguuuuacacccuagccccaaugggaaacggaaccggccgccgccgcuaa

SEQ ID NO: 38131 - RNA, 1617 nt, Artificial Sequence
  derived and/or modified sequence opt11 from VP1__Norovirus_and/or_Norovirus-like__JQ613520
augaaaauggccucaaacgacgccaaccccagcgacgguucagccgccaaccucgucccagaagucaacaacgaagucauggcccuagaaccggucguaggugccgcaauagcagccccagucgcaggccaacaaaacguaauugaccccuggauacgaaacaacuucguccaagcacccggaggcgaguucaccguaucaccacgcaacgcaccaggcgaaauacucugguccgcaccucucggacccgaccuaaaucccuaccucucccaccucgcacgcauguacaauggcuaugccgguggcuucgaaguccaagucauccucgccggcaacgccuucaccgcaggcaaaaucaucuucgccgcagucccacccaacuuccccaccgaaggacucucccccucccaagucaccauguucccccacaucaucguagacguucgccaacuagaacccguccucaucccccuccccgauguacgaaacaacuucuaucacuacaaccaaucaaacgauucaacgaucaaacuuaucgcaaugcucuacaccccacuccgagcgaauaacgccggcgaagacgucuucacugucagcugccguguucucacucgccccucaccugacuucgacuuuauauuccucgucccacccaccguagaaucccgcaccaaacccuucaccguccccauacucaccgucgaagaaaugaccaacucacgguucccuaucccauuagaaaaacucuucacaggccccucuuccgcauucguaguccaaccacaaaacggccgcugcacaaccgauggcguccuccucggcacaacccaacucucacccgucaacaucugcaccuuucgcggcgacgucacacacaucgccggcucucgaaacuacaccaugaaccucgcuucccucaacuggaacaauuacgacccaacagaggaaauccccgcaccccucggaacacccgacuucgucgguaaaauccaaggcguccuaacacaaaccacaaaaggagacggaucaacccgaggccacaaagccaccguauacacaggauccgcacccuucacccccaaguuagguuccguccaauucuccaccgacaccgaaaacgacuuugaaacccaccaaaacaccaaguucaccccagucggcgucauccaagacggcggcaccacccaucgaaacgaaccccaacaauggguccucccauccuacuccggacgaaacgucccuaacguucaccuugcacccgcaguagcuccuaccuucccgggcgaacaacuccucuucuuccgcucaaccaugccugggugcuccggcuaccccaauauggaccucgacugccuucucccacaggaauggguccaacacuucuaccaagaagcagcacccgcucagucggacgucgcccuauuacgcuucgucaacccagauaccggccgaguccucuucgaaugcaaacuccacaaaucgggcuacgucacagucgcccauaccggacaacacgaccucguaauccccucaaacggcuacuucagauucgacagcugggucaaccaauucuacacccuagcccccaugggcaacggcaccggacgacgacgcuaa

SEQ ID NO: 38132 - RNA, 1617 nt, Artificial Sequence
  derived and/or modified sequence opt11 from VP1__Norovirus_and/or_Norovirus-like__HQ456320
augaagauggccuccaacgacgcaacccccucugacggcucuaccgcaaaccuaguacccgaaguaaacaaugaaguaauggcccucgagccugucgucggagcagccaucgcagcccccgucgccggucaacaaaacguaaucgaccccuggauccgcaacaacuucguccaagccccaggaggcgaguucacagucuccccacgcaacgccccuggcgaaauccucuggucagccccacuuggucccgauuuaaaccccuaucuaucacaccuagccagaauguacaacggcuacgcuggcggcuucgaaguccaagucauccuagccggcaacgcauucaccgcaggcaaaaucauauucgcagccguucccccuaacuucccaaccgaagggcucucgcccucgcaagucaccauguucccacacaucaucgucgauguccgccaacuagaaccuguccucaucccccuacccgacgucagaaacaacuucuaucacuacaaccaaucaaacgaccccacaaucaaacuaauagcaaugcucuacacaccccuccgcgccaacaacgccggugacgacguauucaccgucuccugcagaguccucacccgacccucacccgacuucgacuucauuuuccucguaccaccaaccguugaaucccgcaccaaacccuucucaguuccuauccucaccguagaagaaaugaccaacucacgcuuuccaaucccgcuugaaaaacuauucaccggccccucauccgccuucgucguccaaccccaaaacggacgcugcaccacagacggcguacuccucggaaccacacaacuaucacccguaaacauaugcaccuuccgcggugacguaacacacaucgccggaacacaaaacuacaccaugaaccucgcaucccaaaacuggaauaacuacgacccaaccgaagaaauccccgcuccccugggcacacccgacuucgucggaaaaauccagggcguccucacccagacaacacgacgugacggaucaacccguggacacaaggccaccguaucaaccgguuccguccacuucacaccaaaacuaggcucaguucaguucuccacagacaccuccaacgacuucgaaaccggccaaaacacccgcuucacccccguaggcguaguucaagauggauccaccacccaccaaaacgaaccccaacaauggguccuccccaauuacuccggccgagacucccacaacguccaccucgcccccgcagucgcccccacauuccccggagaacaacuacuuuucuuccgcucaacaaugcccggaugcucaggcuaccccaacaugaaccucgacugccuccuaccacaagaauggguacagcacuucuaccaagagagcgcacccgcccaaucagacgucgcccuccuccgcuucgucaacccagacacaggccguguccuauucgaauguaaacuacauaaauccggauacgucacagucgcucacacagggcagcacgacuuagucauaccaccaaacggcuacuuccgauucgacagcugggucaaccaauuuuacacccuagcccccaugggaaauggcgccggccgccgccgcuaa

SEQ ID NO: 38133 - RNA, 1617 nt, Artificial Sequence
  derived and/or modified sequence opt11 from VP1__Norovirus_and/or_Norovirus-like__AB541353
augaaaauggccucuaacgacgccucccccucagacggcuccgcggcuaaccucgucccagaaguaaauaacgaaguaauggcccucgaacccgucgucggcgccgccauagccgcucccguagccggacaacaaaacgucauagaccccuggauacgcaacaacuucguccaagcgcccggcggcgaguucaccgucucuccccgcaacgccccgggcgaaauccuaugguccgcuccccuaggacccgaccuaaaccccuaucuaucccaccucgcccgcauguacaacggcuacgccggcggcuuugaaguccaggucauccucgcuggaaacgcauucacagcaggcaaaauaaucuucgccgcagucccacccaacuuccccaccgaaggccugucccccucccaagucacuauguucccacacaucaucgucgacguccgccaacuagaacccguucucaucccccuccccgacguacgaaacaacuucuaccacuacaaccaaucaaacgacuccaccaucaaacucaucgccaugcucuacacgccccuucgcgcaaauaacgcaggcgaagacguauuuaccgucucaugccgcguacuaacccgcccaucucccgacuucgacuucaucuuccucguuccgcccaccgucgaaucccgcaccaaacccuucaccguccccauacuaaccgucgaagaaaugacaaacucccgcuuccccaucccccuagaaaaacucuucacaggccccuccuccgcauucgucguccaaccccaaaacggccgcuguaccaccgacggcguauuacucggcacuacccaacucucccccgucaacauaugcaccuuccgaggcgacgucacacacaucgcuggcucacguaacuacacgaugaaccucgcaucacuuaacuggaacaacuacgaccccacugaagaaaucccagcaccacuuggcaccccugauuucgucggaaagauccaagguguccucacccaaaccaccaaaggcgacggauccacccgcggccacaaagccaccgucuacacaggauccgcucccuucacacccaaacuaggcuccguacaauucucaacugacacagaaaacgacuucgaaacccaccaaaacaccaaauucaccccaguaggcgucauccaagacggcggcacaacccaccggaaugaaccccaacaauggguacuuccaucauacucaggccgaaauguccccaacguccaccuagcccccgcagucgcaccuaccuuccccggcgaacaacuccuauucuuccgcucuaccaugcccggcugcucaggcuacccuaacauggaucuugacugccuccuuccccaagaauggguccaacacuucuaccaagaagccgcccccgcucaauccgacguagcccuacuccguuucguaaaccccgacacuggacgaguccucuucgaauguaaacuacacaaauccggcuaugucacaguagcccacaccggccagcacgaccucgucaucccacccaacggcuacuuucgcuucgauuccugggucaaccaauucuacacucuugcccccaugggcaacggaacuggccgucgacgauaa

SEQ ID NO: 38134 - RNA, 1617 nt, Artificial Sequence
  derived and/or modified sequence opt11 from VP1__Norovirus_and/or_Norovirus-like__AB541348
augaagauggccuccaacgacgccaaccccagcgacggcucagccgcaaaccucguccccgagguaaacaacgaaguaauggcgcucgaaccagucgucggagccgcaaucgccgcccccguagccggccagcaaaacguaaucgaucccuggaucagaaacaacuucguacaagcacccggcggagaguucacaguuucuccccgcaacgcacccggcgaaauccucuggucagcaccauuaggccccgaccucaacccauacuuaucccaccucgccagaauguacaacggcuacgccggugguuucgaaguccaagucauccuagcgggcaaugccuucaccgccggaaagaucaucuucgcagccguaccacccaacuuccccacugaaggacucucccccucccaagucacaauguucccccacaucaucguggacguccgccaacuagaaccaguacucauaccccuccccgacguccgaaacaacuucuaccacuacaaccaaucaaacgacuccacuauuaaacucaucgcaaugcucuauaccccacuccgagccaacaacgcaggggacgacgucuucacgguaucaugcagaguacuaacccgcccaucacccgacuucgacuuuauauuccuaguucccccuaccgucgaaucacgcacaaaacccuucaccgucccaauccuuacagucgaagaaaugacaaacucccgcuuccccaucccccucgaaaaacucuucacuggccccucuucagcauucgucguacaaccccaaaacggccgaugcacaacagacggcguccuccucggaaccacacaauuaagcccugucaacauaugcacauuccgaggcgacgucacccauaucgccgguucacgcaacuacaccaugaaccucgcaucccuaaacuggaacaacuacgaccccaccgaagagauccccgcuccccucggcacccccgacuucguaggcaaaauccaaggcguucuaacccaaacuacgaaaggagacggaucaacccgcggccauaaagcaacggucuacacaggcuccgccgacuucaccccaaaacucggauccguacaauucgccaccgacaccgaaaacgacuucgaaacacaccaaaacacaaaauucaccccagucggcgucauccaagauggcggaaccacccacagaaacgaaccccaacaaugggugcuaccauccuauagcggacgcaacguccacaacguccaccucgcccccgccgucgccccaaacuuccccggagaacaacuccuauucuuccgauccacaaugcccggaugcucaggcuaucccaacauggaccuagacugccuucuaccccaagaauggguacaacacuucuaccaagaagccgcccccgcccaauccgacguagcccuccugcgauucguuaaccccgacaccggaagaguccuuuucgaaugcaaacuccacaaaucaggauaugucacagucgcccacacaggacaacacgaucuggucauucccccuaacggcuacuuccgcuucgacagcugggucaaccaauucuacacccuugcucccaugggcaacggaaccggccgucgacgcuaa

SEQ ID NO: 38135 - RNA, 1617 nt, Artificial Sequence
  derived and/or modified sequence opt11 from VP1__Norovirus_and/or_Norovirus-like__AB541339
augaaaauggccuccaacgacgcaaaccccucagacggaucagcagccaaccucguacccgaaguaaacaacgaaguaauggcccuggaacccgucgucggagcagccaucgcagcacccgucgcaggacaacagaacgucaucgacccauggauccgcaacaacuucguccaagcccccgguggcgaguucacagucagcccccgcaacgcccccggcgaaauacucugguccgccccacucggccccgaccucaaccccuaccucucacacuuagcccgaauguacaacggauaugccggcggauucgaaguccaaguaauacuagcaggaaacgcuuuuaccgccggcaaaaucaucuucgcagcuguaccuccaaacuuccccacagaaggcuuaucgccaucccaagucacaauguucccccacauaauuguugacguccgccaacuagaacccguucucauaccacuacccgauguccgcaacaacuucuaccacuacaaccaaucaaaugacuccaccauuaaacuaaucgccaugcuauacacaccacuacgugcaaacaacgcgggcgaagacguauucaccgucucuugccgcguccugacccgcccaucccccgacuucgauuucauauuucucguacccccaaccgucgaaucccgaaccaaaccuuucaccguccccauacuaaccguugaagaaaugaccaacucccgauuccccaucccccuugaaaaacucuucacaggccccucaucagccuucguaguccagccucaaaacggccgcuguaccacugacgggguccuccucgguacaacucaacuaagccccgucaacauaugcaccuucagaggcgacgucacccacaucgccggcucccgaaacuacaccaugaaccucgcuagccuaaauuggaauaacuaugacccuacugaagaaauacccgccccacugggaacccccgacuucgucggaaaaauccaaggcguccuaacccaaacaaccaaaggcgacggaagcacucgcggccacaaggccaccgucuacaccgguucagcacccuucacacccaaauuaggauccguccaauucagcaccgacaccgaaaaugauuucgaaacccaccaaaacaccaaauucacccccguaggcgucauccaagacggcaacacgacacaccgcaacgaaccacaacaauggguccuaccaucauacuccggucgaaacguccagaacguacaccucgcacccgcaguagccccaaccuuccccggcgaacaacuccuauucuuccgcuccaccaugcccggcugcuccggauaccccaacauggaucuagacugccuccuaccccaagaauggguacaacacuucuaucaagaagccgcccccgcccaaucugacguagcccuccucagauucgucaacccagacacaggacguguccuauucgaaugcaaacuccacaaaucaggauacgucaccguagcccacaccggacaacacgaccuaguaauucccccaaacggauacuuccgcuucgacuccugggucaaccaauucuacacccucgcccccaugggcaacggcacaggccgacgcagauga

SEQ ID NO: 38136 - RNA, 1617 nt, Artificial Sequence
  derived and/or modified sequence opt11 from VP1__Norovirus_and/or_Norovirus-like__AB541303
augaaaauggccuccaacgacgccucccccuccgacggcagcgcagccaaccuuguacccgaaguaaacaacgaaguaauggcccuagaaccagucgucggcgccgcuaucgccgccccagucgccggccaacaaaacguuaucgacccuuggauccgaaacaacuucguccaagcccccggcggcgaauuuaccguuagcccccgcaacgcccccggcgaaauccuuuggucggcaccccuaggaccagaccuaaaccccuaccucucucaccucgcccgcauguacaacggauacgccggcggcuucgaaguccaggucauccucgccggcaacgcuuucaccgcaggaaaaaucaucuucgcagccguaccacccaacuuccccaccgaaggacuaucccccucacaaguuaccauguucccccacaucaucgucgacguuagacagcucgaaccuguucuaaucccccuccccgacguccgaaacaacuucuaccacuacaaccaauccaacgacucaacuauaaaacucaucgcaaugcuauacacaccccuccgagccaacaaugccggagaagacgucuucaccgucuccugccgaguucucacccgacccucucccgauuucgauuucauuuuccuaguaccacccaccgucgagucacgcaccaaacccuucaccgucccaauccuaaccgucgaagaaaugaccaacucacgcuucccuauuccccuagaaaaacuuuucaccgggcccuccggcgcauucguaguccaaccccaaaacgguagaugcacgacagacggcguccuccucggcaccacacaacucucccccgucaauauuugcaccuuccgcggagacgucacacacaucgcaggaucaagaaacuacaccaugaaccucgccgcccuaaacuggaacaacuacgaccccaccgaagaaauccccgcuccgcuaggcaccccagacuucgucggcaaaauccaaggaguccucacccaaaccacaaaagcagacggaucaacccgaggccacaaagcaaccguuuauaccggcucagcaguauucacccccaaacucggcuccguucaauucucuaccgacacggagaacgacuucgaaacccaccaaaacaccaaauucacccccgucggagucauccaagacggcucaacuacccaccgaaaugaaccccaacaauggguccuaccauccuacagcggccgcaacguccacaacguccaccuagcacccgccgucgccccaaccuuccccggcgaacaacuccucuucuuucgaucaaccaugcccggcugcucaggauaccccaacauggaccucgacugccuccuaccccaagaauggguccaacacuucuaccaagaagccgccccagcccaaucagacgucgcccuccuccgauucgucaaucccgacacaggucgaguccucuucgaaugcaaacuacacaagucagguuacguaacugucgcacacacaggccaacaugaccucgucauaccacccaacggcuauuucagauucgacuccuggguaaaccaauucuauacccuagcccccaugggaaacggaaccggacgccgccgcuaa

SEQ ID NO: 38137 - RNA, 1617 nt, Artificial Sequence
  derived and/or modified sequence opt11 from VP1__Norovirus_and/or_Norovirus-like__GQ246799
augaaaauggcuuccaaugacgccaaccccucugacggaagcgccgcaaaccucguccccgaaauuaacaacgaaguaauggcccuugaaccagucgucggugcagcaaucgccgccccagucgcuggccaacaaaauguuauagaucccuggauccgaaacaacuucguccaagcucccggcggcgaguucacggucuccccucgcaacgcccccggagaaauccuauggucagcaccccucggccccgaucuaaaccccuaccuuucgcaccucgcccgcauguacaacggauacgccggaggauucgaaguccaagucauacccgccgguaacgccuucacugccggcaaaaucaucuucgccgccgugccucccaauuuccccacugaaggucuaucccccucccaagucaccauguucccccacauuaucguagacguccgccaauuagaaccaguccuaauaccccuucccgacguccgcaacaacuucuaccacuacaaccaauccaacgacuccacaauaaaacucauagccaugcucuacaccccacuccgagccaacaaugccggagacgacgucuuuaccguaucaugccgaguccucacacgaccuucacccgacuucgauuucauuuuccucguacccccaaccgucgaaucucggaccaaacccuucaccgucccaauccuaaccgucgaagaaaugaccaacuccagauuccccaucccacuugaaaaacuuuucaccggcccauccuccgcauucgucguccaaccccaaaauggucguugcacaaccgacggaguccuauuagguacaacccaacuuuccccagucaacauuugcaccuuccgcggcgacguaacccauaucgccggcucccgcaacuacaccaugaaccuagcuucccuuaauuggaacaacuacgacccaacagaagaaauuccugcccccuuaggaaccccagacuucguaggcaagauccaaggcguucuaacccaaaccaccaaagaagacgguuccacccgcggccacaaagccaccgucuacaccggauccgcagacuuuaccccaaaacuaggauccguccaauuuggcaccgacaccgaaaacgacuucgagacccaccagaacaccaaauucacuccagucggcguaauccaagacggcagcacaacccaccgaaacgagccccaacaauggguccuccccucauacagcggccgcaacguccacaacguccaccuugcccccgcaguagccccaaacuuuccaggcgaacaacuccucuucuuucgcucuaccaugcccggcugcuccggcuaccccaacauggaccucgacugccuccucccccaagaauggguccaacauuucuaccaagaagcagccccagcccaauccgacguugcccuccuccgauucgucaacccagacaccggccgcguccucuucgaaugcaaacuccacaaaucaggauacgucacagucgcacacaccggccaacacgaccuggucauaccacccaacggcuacuuccgauucgacuccugggucaaccaguucuacacacucgccccuaugggcaacggaacaggccgccgacgauaa

SEQ ID NO: 38138 - RNA, 1617 nt, Artificial Sequence
  derived and/or modified sequence opt11 from VP1__Norovirus_and/or_Norovirus-like__EU876886
augaaaauggccuccucagacgcaaaccccagcgacggcuccaccgcuaaccuaguccccgaaguuaauaacgaagucauggcacuagaacccguagucggugcagccauagccgccccagucgcuggccagcaaaaugucauugacccauggauacgcaacaauuucguccaagccccagguggcgaguucacagucuccccacgcaacgccccaggcgaaauacuaugguccgccccacucggccccgaccucaaccccuaccucucacaccuugcccgaauguacaacggauacgccggcggcuucgaaguccaaguaauccucgccggcaacgccuucaccgcaggcaaaauaaucuucgcugcggucccacccaacuuucccaccgaaggucucucucccucccaaguuacaauguucccccacauuaucgucgacguacgccaacucgaaccaguacucaucccccuucccgacguccgcaacaacuucuaccacuacaaccaauccaacgacccaaccauaaaacucaucgccaugcuauacacaccccuacgcgccaacaacgccggugacgacgucuucaccgucagcugccgcguccuuacccgccccuccccagacuucgacuucaucuuccucguuccacccaccguagaaucccgaacuaagcccuuuuccguacccauacucaccgucgaagaaaugaccaacucacguuucccaauaccacuagaacgacuauucacaggccccuccuccgccuucguuguucaaccccagaauggacgauguaccaccgacggaguacuacucggcacaacacaacucuccuccgucaauaucugcaccuuucgaggcgacgucacgcacauagcuggcacccaagaauacaccaugaaccuagccucucagaacuggaacaacuacgaccccaccgaagaaauacccgccccacucggcacccccgauuucguaggcaaaauccaaggcguccuuacacaaacaacacgccgagacggcagcacccgcggccacaaagccaccgucucaaccggcuccguccacuucacccccaaacuaggccguauacaauucuccacagacaccuccaacgacuucgaaaccggacaaaacacccgguucacccccgucggcgucguacaagacggcuccaccacccaccaaaacgaaccucaacaauggguacuccccaacuauuccggacgagacggccacaacguacaucucgcacccgccgucgcccccuccuuuccaggugaacagcuacucuucuuccgcuccacaaugccaggaugcucagguuacccaaacaugaaccucgacugucuccucccacaagaauggguacaacacuucuaccaagaggcagcaccagcccaauccgacgucgcccuccuccgcuucguaaaccccgacaccggccgcguccucuucgagugcaaacuccacaaaucgggauacguaaccguagcccauaccggccaacacgaccuagucaucccaccuaacggauacuucagauucgacucaugggucaaccaauuuuacacucucgcccccaugggcaacggcacugggcgccgacgauaa

SEQ ID NO: 38139 - RNA, 1617 nt, Artificial Sequence
  derived and/or modified sequence opt11 from VP1__Norovirus_and/or_Norovirus-like__AB385630
augaaaauggccuccaacgacgccaaccccagcgacgguuccgccgccaaccucguccccgaagucaacaacgaagucauggcccucgaaccuguagucggagcagccaucgccgccccaguggccggacaacagaacguaaucgaccccuggauccggaacaacuucguucaagccccuggcggagaauuuaccgucucacccagaaacgcacccggagaaauccucugguccgcaccccuuggccccgaccucaacccuuaccucucccacuuagcccggauguacaauggcuacgccggcggcuucgaaguccaaguaauacucgccggaaacgccuucaccgccggcaaaaucaucuucgccgcagucccacccaauuuccccacagaaggccugucccccucccaaguaaccauguucccccacaucauagucgacguacgccaacuggaacccguccuaaucccacuccccgacguccgcaacaauuucuaccacuacaaccaauccaacgacuccaccaucaaacucauagcaaugcuauacacgccccuccgagcaaacaacgccggcgaagacgucuucaccguuuccugccguguccucacccgccccucccccgacuucgacuucauauuccuaguuccacccaccgucgaaucccggaccaaacccuucacagucccaauccuuaccguagaagaaaugaccaacagccguuucccaaucccccucgaaaaacuuuucaccggacccuccggcgcauucgucguacaaccccaaaacggccgcugcaccaccgacggcguauuauuaggcacaacccaacuuucccccguuaacauauguaccuuccgcggcgacguaacccacaucgccggaagucgcaauuacaccaugaaccucgccucacuuaacuggaacaacuacgacccgaccgaagaaauccccgcuccccucggaacucccgacuucgucggcaaaauccaaggaguccucacccaaaccacaaaagaagacggcucaacccguggccacaaagccacagucuacaccggcucagccccauucacacccaaacuaggauccguacaauucagcacagacaccgaaaacgauuucgaaacccaccagaacaccaaauucacccccguaggagucauccaagacggcuccacaacucaccguaacgaaccucaacaauggguccuccccucuuauucaggccgcaacguccacaacguacaucuugcuccugccguagcccccacauuccccggcgaacaacuccucuucuuccgcuccacaaugccaggaugcucaggcuaccccaacauggaccucgacugccuccugccccaagaauggguccaacacuucuaccaagaagcagcccccgcccaauccgaugucgcccuauugcgauuuguuaaccccgacaccggucgcguccucuucgaaugcaaacuccacaaaucaggguacgucacagucgcccacaccggccaacaugaccucgucaucccacccaacggcuacuuccgcuucgacucuugggucaaccaauucuacacccucgcccccaugggaaacggcacaggccgcagaagauaa

SEQ ID NO: 38140 - RNA, 1617 nt, Artificial Sequence
  derived and/or modified sequence opt11 from VP1__Norovirus_and/or_Norovirus-like__KU182483
augaaaauggcauccaacgacgccaccccauccgacggauccaccgcaaaccucgucccagaagucaacaaugaagucauggcccuugagcccguagucggcgccgccaucgcugcccccgucgccggccaacaaaacgucauagaccccuggauccgcaacaacuucguccaagccccaggcggcgaguucaccgucucaccucgcaacgcccccggcgaaauccucugguccgcuccacucgguccugaccucaaccccuaucucucccaccuugcacgaauguacaacggcuacgcaggaggauucgaaguccaagucauccucgcaggcaacgcauucaccgcgggcaaaaucaucuucgccgccgucccucccaacuuccccaccgaaggacucucacccucccaagucacaauguucccccacaucaucgucgacguacgccaacuagaacccguccucaucccucuccccgacguacgaaauaacuucuaccacuacaaccaaucgaacgaccccaccaucaaacucaucgcaaugcucuacacaccccuccgugcaaacaacgccggagacgacguauucaccgugucaugccgcguccuaacccgccccuccccugacuucgacuucaucuuccucguaccacccaccguagaaucucggacuaaacccuucuccguccccauccucacagucgaagaaaugacaaauucccgauuccccauaccccucgaaaagcuauucacuggccccucaucugccuuugucguccaaccacaaaacggccgcugcacaacugacggcguccuacuaggaacaacacaacuuuccccuguaaacauaugcacauuccgcggcgacgucacacacaucgccggaacucaaaacuacaccaugaaccucgccucccaaaacuggaacaacuacgaccccacugaagaaauccccgccccacucgguacucccgacuuugucggaaaaauccaagguguacucacacaaaccacuagacgggacggcuccacucgcggccacaaagcaaccgucucaaccggcucuguccacuucacccccaaacuaggcucaguccaauucuccaccgacaccucaaaugacuuugaaaccggccaaaacacccguuucaccccagucggaguaguccaagacggcuccaccacacaucaaaacgaaccccaacaauggguucuccccgacuacuccggacgagauucccacaacguccacuuagcacccgccgucgcuccgacguuccccggggaacagcucuuauucuuccgaucaaccaugcccggcugcuccggauaucccaacaugaaccuagacugccuccucccccaagaauggguccaacauuucuaccaagaauccgcccccgcccaaucagacguagcccuccuucgcuucgucaacccggacaccggccgcguacucuucgaaugcaagcuacacaaauccggcuacgucaccgucgcacacaccggccaacacgaucucgucaucccacccaauggcuauuuccgcuuugacuccuggguaaaccaauucuacacccuagcaccaaugggcaauggagcuggacgacgccgcuga

SEQ ID NO: 38141 - RNA, 1617 nt, Artificial Sequence
  derived and/or modified sequence opt11 from VP1__Norovirus_and/or_Norovirus-like__AB665364
augaaaauggcuucaaacgacgccaaccccuccgacgguuccgccgccaaccugguccccgaagucaacaacgaaguaauggcucuagaacccgucgucggcgcggcuaucgccgccccagucgccggccaacaaaacgucaucgaccccuggauccgaaacaacuucguccaagcccccggcggagaguucacaguaagcccccgcaacgcccccggagaaauccucugguccgccccacucggucccgaccuaaaccccuaccucucccaccuagcccgcauguacaacggauacgccgguggcuucgaaguacaagucauccuagccggcaacgccuucaccgcaggcaaaaucaucuucgccgccguacccccuaauuuccccaccgaaggacucucccccucccaagucacaauguucccacacaucauugucgacguaagacaacucgaaccaguacuaauaccccucccagacguucgaaacaacuucuaccacuauaaccaauccaacgacucaaccaucaaacucaucgccaugcucuacaccccauuaagagcaaacaaugccggcgaagacgucuucaccgucagcugccgaguucucacucgcccaucccccgacuucgacuucaucuucuuagucccacccaccgucgaaucccgcaccaagcccuucacggucccgauccuaaccgucgaagaaaugacaaacucccgcuucccaaucccccuagaaaaacuauucaccggccccucaucugcauucguaguucaaccccaaaacggccgaugcacaaccgacggcguccuacuaggcaccacccaacucagcccagucaacauaugcacauuccgaggcgauguuacccacaucgccggcucccgcaacuacacuaugaaccucgcuucccucaacuggaacaacuacgacccaaccgaagaaauccccgcaccccugggcacccccgacuuugucggaaaaauucaaggaguccucacacaaaccaccaaaggcgacggcucaacccgcggccacaaagcuacugucuacaccggcuccgcaccauucacccccaaacucggcuccguacaauucucaaccgacacagaaaacgacuucgaaacccaccaaaacacuaaauucacccccguaggaguuauccaagacggguccaccacacaucgcaacgaaccccaacaauggguucuaccauccuauucaggccgcaacguccagaacguccaccucgcacccgccgucgcccccaccuucccaggugaacaacuccucuucuuccgcuccaccaugccaggcugcuccggcuaccccaacauggaccucgacugccuccucccccaagaauggguacaacauuucuaccaagaagccgccccugcccaguccgacguagcacuucuccguuucguaaaucccgauaccggccgcguucuuuuugaaugcaaacuccacaaaagcggcuacguaaccguugcccacaccggccagcacgaccucguaauuccacccaacggauacuuccgcuucgacuccugggucaaccaauucuauacacuggcccccaugggcaacgguaccggacgaagacguuaa

SEQ ID NO: 38142 - RNA, 1617 nt, Artificial Sequence
  derived and/or modified sequence opt11 from VP1__Norovirus_and/or_Norovirus-like__AB663686
augaagauggccuccaacgacgcaaaccccuccgacggcuccgcagccaaucucguccccgaaguaaauaacgaagucauggcccucgaaccagucguuggcgcagcuaucgccgccccugucgccggccaacaaaacgucauagaccccuggauccgcaacaacuucguccaagcgcccggcggugaguucaccgucucuccccgcaacgcccccggcgaaauacuaugguccgcaccccucggacccgaccucaaccccuaccuuucccaucucgcccgcauguacaacggcuacgccggcggcuuugaaguacaagucauccucgcaggcaacgccuucacagccggcaagaucauuuucgcagccguaccucccaacuuccccaucgaaggccuaucccccucccaggucaccauguucccacacauaauuguggacguacgacagcuugaacccguccuaaucccccucccugacguccgcaacaacuucuaucacuacaaccaaagcaacgacuccaccaucaaacucaucgccaugcuguacacgccacugcgagccaacaacgccggcgacgacguauucaccguuucuugucgaguccucacacguccaucuccagacuucgacuucauauuuuuagucccuccaaccgucgaaucccgaacaaaacccuucaccguacccauccuaaccgucgaagaaaugacuaacucccguuuccccaucccccucgagaaacuauucaccggccccuccucagccuucgucguacaaccacaaaacggccgcugcacuacagacggcguccuccucggaacuacccaacucucccccgucaacaucugcaccuucagaggagacguaacccacaucgcaggcagccgcaacuacaccaugaaucuagccagccucucauggaacaacuaugacccaaccgaggaaaucccagccccucucgguacucccgauuuugucggaaaaauccaaggcguacuaacccaaaccaccaaaggcgauggcuccacccgcggucacaaagccaccgucuacacaggaucagcaccuuucacucccaaacuaggcucaguacaauucucuaccgacacggagaaugacuucgaaacccaccaaaacaccaaauucaccccagucggcgucauccaagauggaggaacaacacaccgcaacgaaccccagcaauggguccugccauccuacuccggccggaacguccccaacguccaccucgcucccgccgucgcccccaccuuccccggagaacaacuccuauucuuccgcucuaccaugccuggcugcuccggcuacccaaacauggaccucgacugcuuacucccccaagaauggguacaacacuucuaccaagaagccgcccccgcacaguccgacgucgcccuccucagauucgucaaccccgacaccggaagaguccuauucgaaugcaaacuacacaaaucaggcuacgucaccguagcccacacuggccaacacgauuuagucaucccgccaaacggcuacuuccgcuucgauucguggguaaaccaauucuacacccuagcccccaugggcaauggaaccggacgacgccgauag

SEQ ID NO: 38143 - RNA, 1617 nt, Artificial Sequence
  derived and/or modified sequence opt11 from VP1__Norovirus_and/or_Norovirus-like__AB933702
augaagauggccagcaaugacgccaacccaucagacggcuccgcagccaaccuugucccugaaguaaacaacgaaguaauggcccucgaaccaguagucggagccgcaaucgccgcaccugucgccggccaacagaacguaauugacccauggauacgcaauaacuucguccaagcacccggcggcgaguucaccgucucaccccggaacgcuccaggcgaaauauuauggagcgccccucucggccccgaucucaacccauaccucucccaccucgcacgcauguacaacggcuacgcaggcggcuucgaaguacaaguaauucucgcgggcaacgccuucacagccggcaaaaucauuuucgccgccgucccaccuaacuuccccaccgaaggccuuucaccaucacaagucaccauguucccccacauaaucguagacguccgacagcucgaacccguccucaucccacuccccgacguccgcaacaacuucuaccacuauaaccaauccaacgacuccacaaucaaacuuaucgccaugcuauacacuccucuccgcgccaacaaugcaggcgaggacgucuucaccgucuccugccgcguccuaacccgccccucccccgacuucgacuuuauuuuccuaguaccacccaccgucgaaucucgcaccaaacccuucacaguacccauccucaccguagaagaaaugaccaacucccgcuuccccaucccacuugaaaaacuauuuaccggccccagcuccgccuucgucguacaaccacaaaacggccgcugcaccaccgacggcguccuccucggcaccacacaacuaucccccgucaacauaugcacauuccgcggcgacgucacccacaucgccggcucccgaaacuacacaaugaacuuagccagccuaaacuggaacaacuacgaccccaccgaagaaauccccgccccgcucggcacccccgacuuugucggaaaaauacaaggcguccucacccaaaccacaaaaggcgacggaucgacacgcggacacaaggccaccgucuacaccggcuccgccccuuucacacccaaacuugguucaguccaauucucgacugacacagaaaacgauuucgaaacccaccaaaacaccaaauucacacccgucggcguaauccaagacggcuccaccacccaccgcaacgaaccccaacaauggguccucccuuccuacucaggacgcaacguaccuaacguucaccucgccccagcugucgcccccacauucccaggagaacaacuccucuucuucagaucgacaaugcccggcuguaguggcuacccuaacauggaccucgacugccuccuuccacaagaauggguccaacacuucuaccaagaagccgcaccagcccaauccgacguagcccuacuacgguucguaaaccccgacacuggccgcguccucuuugaaugcaaacuucacaaauccggauacguaaccgucgcacacacuggacaacacgaccuuguaauacccccaaacggcuacuuccgcuucgacagcuggguaaaccaauucuacacccucgcccccaugggcaacggcaccggccgcagacgcuaa

SEQ ID NO: 38144 - RNA, 1617 nt, Artificial Sequence
  derived and/or modified sequence opt11 from VP1__Norovirus_and/or_Norovirus-like__AB933685
augaagauggcauccaacgacgccaaccccuccgacggcuccgcagccaaccucgucccugaaguaaacaacgaggucauggcucuagaacccguugucggugccgcaaucgcagccccagucgccggccaacaaaacgucaucgaccccuggauccgcaacaacuucguccaagcccccggaggagaguucaccgucucaccccgcaacgcccccggcgaaauacuuugguccgcgccccuaggaccggaccucaaccccuaccucucacaucuagcacgcauguacaacggcuacgcaggcggauuugaaguccaagucauccuagcaggcaacgccuucaccgccggcaagauaaucuucgcugccgucccacccaacuuccccacagaaggccucucacccucccaagucaccauguucccccacauuauagucgacguccgccaacuagaaccuguacuaaucccucucccagacguccgaaacaacuucuaccacuacaaccaaagcaacgacucaacaauaaaacucauagccaugcuauacaccccucugcgcgcaaacaacgcaggcgaagacgucuucaccguaucaugccgaguacucaccagaccuuccccagauuucgacuucauauuccucguaccgccaacuguugaaagccgaaccaaaccauucaccgucccaauacuaaccgucgaagaaaugacaaacucacgcuuucccaucccccucgaaaaacucuucacaggaccuucaagcgcuuucguuguucaaccccaaaacggacgcugcacaacugacggcguucuccucggaaccacccaacuuuccccugucaauaucugcaccuuccgaggagacgucacccacaucgccggcucccgugacuacacuaugaaccuggccucucucaacuggaacaacuacgaccccacagaggaaauacccgcaccccuaggcaccccagacuucgucgguaaaauccaagguaugcuaacccaaaccacaaaaggcgacggcuccacacgcggccacaaagccaccgucuacaccggcuccgcacccuucacccccaaacucggauccguucgcuucucgaccgacaccgaaaacgacuucgaaauccaccaaaacacaaaauucacacccguaggcguuauccaggacggcuccaccacacaccgcaacgaaccacaacaauggguccuaccauccuacuccggccgagaugcccacaauguccaccuagcacccgccguagccccgaccuucccaggcgaacaacuccucuucuuccguuccaccaugcccggaugcucuggcuaccccaacauggaccuagacugccuccucccacaggagugggugcaacacuuuuaccaagaagcagcacccgcccaauccgacgucgcccuacuccgcuucguaaaccccgacaccggccgcguacucuucgaaugcaaacuccauaaauccggauacguaaccguagcccacacaggccaacacgaccucguaauacccccuaacggauacuuccgcuucgacucuugggucaaccaauucuacacacucgccccaauggguaacggcaccgggcgucgccgauaa

SEQ ID NO: 38145 - RNA, 1617 nt, Artificial Sequence
  derived and/or modified sequence opt11 from VP1__Norovirus_and/or_Norovirus-like__AB933645
augaaaauggccucaaacgacgccaccccauccgacggauccgcugcgaaccuaguacccgaaguuaacaacgaagucauggcucuggaacccgucguaggugcagccaucgcagccccuguagcaggacaacaaaauguuaucgaccccuggauccgcaauaacuucguccaagcaccaggcggagaguucacagucagcccccgcaacgcaccuggagaaauccucugguccgcaccccugggcccagaccuaaacccauaccucucccaccucgcccgcauguacaacggcuacgccggcggcuucgaaguacaggucauacucgcaggcaacgcuuucacagcaggcaaaaucaucuucgccgccgucccaccuaacuuccccaccgaaggccucucacccucacaagucacaauguucccacacauaauagucgacguuagacaacucgaacccguccucauaccccucccagauguacgcaacaacuuuuaccacuauaaccaauccaacgacuccaccaucaaacucaucgccaugcuguacacuccccuaagagccaacaacgccggcgaagacguauucaccgucuccugccgcguccuaacccgccccagccccgacuucgacuucauuuuccucgucccacccaccguagaaucccgaaccaaaccauucacuguccccauccuaaccguagaagaaaugaccaauucacgauucccaaucccccuagaaaaacucuucacaggccccuccuccgccuucguaguucaaccccaaaacggccgcugcaccaccgacggaguccuccucggaacaacacaacuaagccccgucaacaucugcacuuucagaggcgacgucacccauaucgccggcucacguaauuacacuaugaaccuagcaucacucaacuggaacaacuacgaucccaccgaagaaauccccgccccacuagguaccccagacuucgucggaaaaauacaaggcguccucacccaaaccacgaagggagacggaucaacacgaggccacaaagcaaccgucuauacaggcuccgccccauucacccccaaacuaggcuccguccaauuuucaaccgauaccgaaaacgacuucgaaacccaccagaacaccaaauucacccccgucgggguuauccaagacggcggaacuacccacagaaacgaaccccaacaauggguccuaccguccuauuccggacgaaacguccccaacguccaccucgcacccgccguugcccccaccuuccccggcgaacaacuccucuucuuccgauccaccaugcccggaugcuccggcuaccccaauauggaccucgacugccuacucccacaagaauggguccaacacuucuaccaagaagccgcccccgcccaauccgacgucgcccuacuacgcuucguaaaccccgacacaggucgaguacuauucgaaugcaaacuccacaaaucuggcuacgucacaguagcccacacaggccaacacgaccucguaaucccaccaaauggcuacuucagauucgacucaugggucaaucaauucuauacccuagcucccaugggcaacggcaccggccgccgccgcuaa

SEQ ID NO: 38146 - RNA, 1617 nt, Artificial Sequence
  derived and/or modified sequence opt11 from VP1__Norovirus_and/or_Norovirus-like__LC005706
augaaaauggccucaaacgacgccaaccccucagacgguucugcagcaaaccucguccccgaagucaacaacgaagucauggcccucgaacccgucguaggagcggcaaucgcagcccccgucgccggccaacaaaacgucaucgaccccuggauccguaacaacuucguccaagcccccggcggcgaguucaccgucucaccccgcaacgcacccggagaaauccucugguccgcaccccucggcccagaccuuaaucccuaccucagccaccuugcccguauguauaacggauacgccggcggcuucgaaguccaagucauccuugccggcaaugccuucaccgccggcaaaaucaucuucgccgccgucccacccaacuuccccacagaagggcucucucccucccaaguaaccauguucccccacaucaucgucgacguucgacaacuagaaccagucuuaauaccccucccugacguccgcaacaacuucuaccacuacaaccaauccaacgacuccaccauaaaacuaaucgccauguuauauacaccccuacgcgccaauaacgccggcgaagacgucuucaccguuuccugccgcguccucacccgcccaucccccgacuucgacuucaucuuccucguacccccaaccgucgaaucccgcaccaaacccuucaccguaccaauccucaccgucgaagaaaugaccaauuccagauuccccaucccacucgaaaaacucuucaccggccccagcuccgccuucguaguccaaccccaaaacggucgcugcacuacggacgggguacuccucggaaccacacaacuuucaccagucaacauuugcacauuccgaggugacgucacucacaucgccggcucccgcaacuacaccaugaaccucgccucccucaauuggaacaacuacgaccccacagaagaaauccccgcaccccuagggacacccgacuucgucgguaaaauccaaggaguccuuacacaaaccacgaaaggcgacggcucaaccagaggccacaaagccaccguuuacaccgguucugcgcccuucacccccaagcucggcucaguacaauucaguaccgacacagaaaacgacuucgaaacccaccaaaacaccaaauucaccccagucggcgucauccaggacggcuccacaacacaccgcaacgaaccccaacaauggguccuaccaagcuauuccggccgaaaugcucacaacguccaccucgcccccgcaguagcucccaccuuccccggcgaacaacuacucuucuuccgcucuaccaugcccggcugcucaggauaccccaacauggaccuggauugccucuuaccccaggaauggguucaacacuucuaccaagaagccgcccccgcccaaucugacgucgcacuacucagauucguuaacccugacacaggccgcguccuauucgaaugcaagcuacauaaguccggcuacguuacagucgcacacacaggccaacaugaccucgucauuccgcccaacggauacuuccgcuucgacuccuggguaaaccaauucuacacucucgcccccaugggcaacgguaccggccgucgccgauaa

SEQ ID NO: 38147 - RNA, 1617 nt, Artificial Sequence
  derived and/or modified sequence opt11 from VP1__Norovirus_and/or_Norovirus-like__KM198562
augaaaauggcaucaaacgacgccaaccccucagacggcucugcagccaaccuaguccccgaaguuaacaacgaggucauggcccucgaacccgucgucggagccgcaaucgccgcaccagucgcaggccaacaaaacgucaucgaccccuggauacgcaacaacuucguccaagccccaggcggcgaguucacgguuucaccccguaaugccccaggagaaauacucuggucagcgccacucggcccagaccuaaacccauaccuaucccaccuagcucgcauguacaacggcuacgccgguggcuucgaaguccaaguaauacuugcuggcaacgcauucaccgcaggcaaaaucaucuucgcagccgucccacccaacuuccccaccgaaggacucucacccucccaaguuaccauguucccccacauaaucgucgacguccgccaacucgagccgguccuaauaccccucccagacguccgcaacaauuuuuaucacuauaaccaauccaacgacucaacaaucaaacucaucgcaauguuauacacgccccuccgcgcaaacaacgcaggcgaagacgucuucaccgucucaugccgcguccuaacccgccccagccccgacuucgacuucaucuuccuagucccucccaccgucgaaucccgcaccaaacccuuuaccguccccauccuaaccgucgaagaaaugaccaacucccgcuuccccaucccccuagaaaagcuauucaccggucccucaggagccuucaucguccaaccccaaaauggccguugcaccaccgacggaguacuucucggaacgacccaacucucacccgucaacaucugcacauuccgcggcgacgucacccacaucgccggcucccgagacuacaccaugaaccucgccucccucaauuggaacaacuacgaccccaccgaggaaauacccgcaccccuaggaaccccagacuucgucggcaaaauccaaggaguccuaacccaaaccaccaagggcgauggcucaacccgcggucacaaagcuaccguuuacaccggcucagcaccauucacaccaaagcucggaucuguacaauucagcaccgacaccgaaaacgacuucgaagcccaccaaaacaccaaauucacccccgucgguguaauccaagauggaggaaccacccaccgaaacgaaccccaacaauggguacuucccagcuauaguggccgcgacguccauaacguacaccuugccccugccgucgcacccaccuuccccggcgaacaacuccucuuuuuccguucaaccaugcccggaugcucaggauaccccaauauggaccuagacugccuucucccccaagaauggguccaacauuucuaccaagaagccgcccccgcacaauccgacguugcccuacucagguucguuaacccagacaccggacgaguacuuuucgaaugcaaacuacacaaauccggcuacgugaccgucgcacacacaggccaacaugaucucguaauacccccaaacggcuacuuccguuucgacuccuggguuaaucaauucuacacucucgccccaaugggcaacggcaccggccgacgccgcuaa

SEQ ID NO: 38148 - RNA, 1617 nt, Artificial Sequence
  derived and/or modified sequence opt11 from VP1__Norovirus_and/or_Norovirus-like__KC409311
augaaaauggccucauccgacgccaaccccucagacggaucaacagccaaccucguccccgaagucaacaacgaagucauggcccuagaacccgucguaggagcugccaucgcagcccccguagccggccaacaaaacgucauagacccauggaucagaaacaacuucguacaagccccgggaggagaauuuacagucuccccucgcaacgcacccggcgaaauccucugguccgccccucuuggccccgacuuaaaccccuaucuaucacaccuagcacgaauguacaacgguuacgcaggcggcuucgaaguccaaguaguacucgccggcaacgcauucacugccggcaaaauaauuuuugccgcagucccaccaaacuucccaaccgaaggccucucccccucacaaguaaccauguucccccauaugaucguagacguucgacaacuagaaccaguccucauacccuuacccgacguccgcaauaacuucuaccacuacaaccaauccaaugaucccacuaucaaacucaucgccaugcuauacacacccuugcgcgccaacaacgcaggcgacgacgucuucaccguauccugcagaguacuaacccgccccucccccgacuucgacuucauauuccucgucccuccgacugucgaaucacgcacaaaacccuucuccguccccauccuaaccgucgaagaaaugacaaacucucgauucccuauaccacuagaaaaacuauucaccggccccucaucagccuucgucguucaaccccaaaacggccgcugcacuaccgacggaguucuacucggcacaacccaacucagccccgucaacaucugcaccuuccgcggcgacguaacccacaucacuggcucccacaacuacaccaugaaccuggccacccaaaacuggaacuccuacgacccuacugaagaaauuccagcaccccucggaaccccagacuucgucggcaaaauccagggcguccuuacccaaaccacccgcgccgacggcuccacccgagggcacaaagccacaguauacaccggcuccgccgacuucgcccccaaacucggccgaguacaauuugccaccgacacaaauaacgaccucggagccaaccagaacaccaaauuuacgccagucggcguuauucaagacggcggcaccgcacaccgcaacgaaccccaacaauggguacuccccucauacuccggucgcaacagccacaacguucaccuagcccccgccgucgcccccacauuucccggcgaacaacuccucuucuuccgcuccaccaugcccggaugcucaggauaccccaacauggaccucgacugccuccuuccgcaagaauggguacaauacuucuaccaagaagcagcccccgcccaaucagauguagcccuacuacgcuuugucaacccagacaccggacgaguacuuuuugaaugcaaacuccacaaauccgguuacgucaccgucgcccacacgggccaacacgaccuagucaucccacccaacgguuacuuccgcuucgacuccugggucaaccaauucuacacccucgcccccaugggcaacggcacaggacgccgccgcuaa

SEQ ID NO: 38149 - RNA, 1617 nt, Artificial Sequence
  derived and/or modified sequence opt11 from VP1__Norovirus_and/or_Norovirus-like__KC409263
augaaaauggccucaaacgacgcuaacccaagcgauggcuccgcagccaaccucguccccgaagucaauaacgaagucauggcccuagaaccagucgucggcgccgccaucgccgcaccaguggcaggacaacaaaacguaaucgacccuuggauccguaacaacuucguccaagcacccggcggcgaguucaccgucucaccccgaaacgcacccggcgaaauccuuuggucagccccacucggccccgacuuaaaccccuaccucucccaccucgcccggauguacaaugguuacgccggcggauucgaaguucaaguaauccucgcuggaaaugcauucacagccggaaaaaucaucuucgcagcuguaccacccaacuuccccacagaaggacuaucccccucccaagucaccauguucccacacauaaucguagacguacgacaacucgaaccuguccuaauaccccuuccagacguccgaaacaacuucuaccacuacaaccaaucuaacgacuccacuaucaaacuaaucgcaaugcucuacacaccccuccgcgccaacaaugcaggagaagauguuuucaccguaucaugucgaguccucacccgccccuccccagacuucgauuucauauuccucgucccacccaccguugaaucccgcaccaagcccuucaccguccccauccucacggucgaagaaaugacuaacuccagauuccccauaccccuagaaaaacuuuucaccggccccuccggcgccuucgucguacaaccacaaaacggccgcugcaccacagacgguguacuccucggcaccacucaacuauccccaguaaauaucugcaccuucagaggcgacgucacucauauagccggaucccgcgacuacaccaugaaucucgccucccucaacuggaacaacuacgaucccacggaagaaauccccgcgccacucggcacccccgacuucgucggcaaaauccaaggcguccucacacaaaccaccaaaggagacggcucaacucgaggccacaaagccaccgucuacacgggcucagccccauucacacccaaacucggcuccguccaauucucaaccgacacagaaaacgacuucgaagcccaccaaaacaccaaauucacaccaguuggagucauccaggacgguggcacaacucaccgcaacgagccucaacaauggguacuacccuccuacuccggacgagacguccacaacguacaccucgcccccgccguagccccaacuuuccccggugaacaacuauuauucuuccgauccacaaugcccggcugcuccggauaccccaacauggaccucgacugccuacucccccaggaauggguacaacacuucuaccaagaagcugcacccgcccaauccgacgucgcccuacuccgauucgucaaccccgacaccggccgcgucuuauucgagugcaaacuccacaaaagcggcuacgucaccgucgcacacaccggacaacaugacuuagucauacccccuaacggcuacuuccgcuucgacuccuggguaaaccaauucuacacacuugcccccaugggcaacggaaccggacgccgcagauaa

SEQ ID NO: 38150 - RNA, 1617 nt, Artificial Sequence
  derived and/or modified sequence opt11 from VP1__Norovirus_and/or_Norovirus-like__JX459900
augaaaauggccuccaacgacgcaaaccccuccgauggcucugccgccaaccucgucccagaagucaacaacgaaguuauggcccucgaacccgucguuggagccgccauagcggcacccgucgcaggccaacaaaacgucaucgaccccuggauccgcaacaacuucguacaagcacccggcggcgaauuuaccgucuccccacgcaacgcccccggcgaaauccuauggagcgcaccccucggcccagaccucaacccauaccuaucccaccucgcccgaauguacaacggauacgccggcggauucgaaguacaggucauacucgccggcaacgccuucaccgcaggaaaaaucauauuugccgccgucccucccaacuuccccacagaaggccucucacccucacaagucaccauguucccccacauaaucgucgacguccgacaacucgaacccgugcuuaucccacuuccagauguacgcaacaacuucuaccacuacaaccaauccaacgacagcacaaucaaacucauagcaaugcucuacacaccccuccgcgccaacaacgccggcgacgacgucuucaccgucaguugccgcguccuaacccgucccucaccugacuucgacuucaucuuccuugucccacccaccgucgaaucccgcaccaaacccuucagcguccccauccucaccgucgaagaaaugaccaacucacgcuucccaaucccccuggaaaaacuauucaccggccccuccagcaccuucgugguccaaccccaaaacggcagaugcaccaccgacggcguccuccucggcacgacacaacucucccccgucaauauuugcacuuuccguggcgacguaacucacaucgccggaucccgcaacuacaccaugaaccucgccucccaaaacuggaacuccuacgaccccacagaagaaauccccgccccucucggaacccccgacuucguuggcaaaauccaaggcguccucacccaaacaacccguaccgauggcuccacccgcggacacaaagcaaccgucuacacuggauccgccgauuucuccccuaaacuaggccgcguacaauucgccaccgacaccgacaacgacuucgacgccaaccaaaauaccaaauucacccccguuggcgugauccaagacggaaacaccgcccaccgcaaugaaccgcaacaauggguacucccauccuacagcggccgcaauacccacaacguccauuuagccccugccguggcacccacauuccccggugaacaacuccuauucuuccgcuccacaaugcccggguguuccggcuaccccaacauggaccuagacugccuccucccccaagaauggguccaauacuucuaccaagaagccgcccccgcccaauccgacgucgcacugcuccgcuucgucaaucccgacacaggacguguacucuucgaaugcaaacuccacaaaucaggauaugugacuguagcccacacaggucaacacgaucuaguaaucccacccaacggcuacuuccgcuucgacuccuggguaaaccaauucuacacccuugcacccaugggcaauggaaccggccgucgacgcuaa

SEQ ID NO: 38151 - RNA, 1617 nt, Artificial Sequence
  derived and/or modified sequence opt11 from VP1__Norovirus_and/or_Norovirus-like__JX459617
augaaaauggccuccaacgacgccaacccaucagacggcuccgccgccaaccugguccccgaagucaacaacgaagucauggcccucgaacccguugucggagccgccauagccgcacccgucgcuggacaacagaacguaaucgacccauggauccgcaacaacuucguacaagcacccggcggcgaguucacagucuccccaagaaacgcaccaggcgaaauccucuggucagccccacucggccccgaccucaauccauaccuaucccaccuagcacgcauguacaacggcuacgcaggcggauucgaaguccaagucauccucgccggaaaugccuucaccgccggcaaaauaaucuucgccgccgucccuccaaacuucccaacugaaggucucucccccucccaagucacuauguucccccacauaaucgucgacguccgacaacucgaacccguacucauuccccuacccgacguccgcaacaacuucuaccacuacaaccaauccaacgacuccaccaucaaacucaucgccaugcucuacaccccacuccgcgccaacaacgccggagaagacgucuucaccgucaguugucgaguucucacacgccccucccccgacuucgacuucaucuuccuuguacccccaaccgucgaaucucggaccaagcccuucaccgucccaauccucaccgucgaagaaaugaccaacucacgcuuccccauaccgcuagaaaaacucuucacaggccccucaucagccuucgucguccaaccacagaacggaagaugcaccaccgacgguguccuucuaggcacaacccaacucucccccgucaacaucugcacauuccgcggugacgucacacacaucgcaggcucacgcaacuacaccaugaaccuugccucccuaaacuggaacaacuacgaccccaccgaagaaauucccgcaccacucggaacccccgauuucgucgggaaaauacaaggcguccuaacccaaacgaccaaaggugacggaucuacccgcggccacaaggccaccgucuacacaggaagugcccccuucacuccgaaacugggauccguacaguucucaaccgauacagaaaacgacuucgaaacccaccaaaacaccaaauucacccccgucggcguaauucaagacggcucuaccacccaccgcaacgaaccccaacaauggguacucccuuccuacuccgggcgaaacguccacaacguccaccucgcacccgccguagcaccaacauuccccggagaacaacuccucuucuuccggucuaccaugccaggaugcaguggcuacccuaauauggaccucgacugcuuacucccacaagaauggguccaacacuucuaccaagaagccgcacccgcccaauccgaugucgcacuccuccgcuucgucaaccccgacaccggacgcguccucuucgaaugcaaacuucacaaauccggcuacgucacagucgcccacacaggacaacacgaccucgucauaccucccaacggcuacuuccgcuucgacuccugggucaaccaauucuacacccuggcuccaaugggcaacgguaccggacgccgccgcuaa

SEQ ID NO: 38152 - RNA, 1617 nt, Artificial Sequence
  derived and/or modified sequence opt11 from VP1__Norovirus_and/or_Norovirus-like__GQ845366
augaaaauggccuccaacgacgcuaaccccucagacggcuccgccgccaaccucguccccgaaguaaacaacgaaguuauggcccucgaacccgucgucggugccgcuauagcagcccccgucgccggacaacaaaacguaaucgaccccuggauccgaaacaacuucguccaggccccaggaggcgaguucaccguaucaccccgcaacgcacccggcgaaauccucugguccgcaccacuaggacccgaccuaaacccauaccugucacaccucgcccgcauguacaacggcuacgccggcggcuucgagguccaagucauccuugccggcaacgccuucacagccggcaaaauaauauucgcagccguuccacccaacuucccgaccgaaggccucucaccaucccaaguaaccauguucccccacaucauaguggauguucgucaacucgaacccguccucauaccccuacccgacguccgcaacaacuucuaccauuauaaccaauccaacgacuccacgaucaaacuaaucgccaugcuauacaccccacuccgcgccaacaacgccggcgaagacguauucaccguauccugccgggugcucacacgcccuucccccgacuucgacuucauauuccucgucccacccaccgucgagucucgcacaaaacccuucaccguccccauauuaacagucgaagaaaugacaaauagccgcuuccccaucccgcuagaaaaacuuuucacaggacccuccucagccuuuguaguccaaccacaaaacggccgaugcaccaccgacggcguccuccucggcaccacccaacucuccccaguaaacaucugcaccuuccgcggugacguuacucacaucgcaggcucccgcaacuacaccaugaaccucgccucacucaacuggaacaacuacgaccccaccgaagaaauccccgcgccccucggcacccccgacuucgucggcaaaauccaaggcguucuaacucaaaccacaaaaggcgauggauccacccgcggccauaaagccaccguauacaccggauccgcccccuucacacccaagcuaggcuccguccaauucagcacagacaccgaaaaugacuucgaaacccaccaaaacacgaaauucaccccagucggagucauucaagacggaggcacaacccaucgaaacgagccccaacaguggguccuuccaaacuacucaggucgcaacguuccaaacguccaccucgcccccgcagucgcucccacguucccuggagaacaacuccucuucuuccgcuccaccaugcccggcugcuccggcuacccuaacauggaccucgacugccuccucccccaagaauggguccaacacuucuaccaggaagccgcuccagcacaguccgacguagcccuccuccgcuucguaaaccccgacaccggacgcguccucuucgaaugcaaacuccacaaaucaggauacguaaccgucgcccauacuggacaacacgaccuagucauacccuccaacggauacuuccgauucgacagcuggguaaaucaauucuacacacuagccccaaugggcaacggaaccggccgccgacgcuaa

SEQ ID NO: 38153 - RNA, 1617 nt, Artificial Sequence
  derived and/or modified sequence opt11 from VP1__Norovirus_and/or_Norovirus-like__GQ845345
augaaaauggcaagcuccgacgcaaaucccucagacggcucgacagcuaaccuagucccagaaguaaacaacgaaguaauggcacucgaacccguaguaggcgccgcaauugcagccccagucgccggucaacagaacgucaucgaccccuggauccguaacaacuucguacaagcccccgguggagaguucaccgucuccccacgaaacgcuccaggcgaaauccuauggucagcaccccuuggcccagacaugaaccccuaccucucccaccucgcccgcauguacaacggcuaugccggaggcuucgaagugcaagucauccucgccggaaacgccuucacagccggcaaaaucaucuuugccgcagucccacccaacuuccccacggaaggccucucacccucccaaguaaccauguucccccacauaaucgucgacguccgccaacucgaaccaguccuaaucccccuccccgacguccgcaacaacuucuaccacuacaaccaaucaaacgaccccacaaucaagcugauagccaugcuuuacacaccccuccgagccaacaacgccggugacgauguuuucaccgugucuugccgcguacucacccgccccucacccgacuucgacuucaucuuccucgucccaccaaccguugaaucuagaaccaaacccuucagcguaccaauacuaacgguagaagaaaugaccaacucacgauuccccauaccccucgaaaaacuauucaccggcccuucuucagccuucgucguccaaccucaaaacggccgcuguaccaccgacggaguccuccuuggcacaacccaacuaucucccguaaacaucuguaccuuucgaggggacgucacccacauagccggcucccgaaacuacaccaugaaccucgcaucccaaaacuggaacuccuacgaccccaccgaagaaauccccgccccacucggaacacccgacuucgucggcaaaauccaaggcguucuaacccaaaccacccgaaccgauggaucaacucgcgggcacaaagcaaccgucuauaccggcucugcugacuucucuccaaaacucggccgcguccaauucgccaccgacacagacaacgacuucguagcgaaccaaaauaccaaauucacccccguaggcgucauccaagauggcaauaccgcccaucgaaacgaaccacaacaauggguccugccauccuacucaggacgcaacacucacaacguacaccucgcccccgcaguagcccccaccuuccccggcgaacaacuccucuucuuccgauccacaaugccaggcugcuccggauaccccaacauggaccuagacugccuccucccccaagaauggguccaauauuuuuaccaagaggccgccccagcccaaucagacguggcacuccuccguuucguaaacccagacacaggucgcguccuauucgaauguaaacuccacaaaucaggcuacgucaccguagcacacaccggacaacacgaccucgucauaccuccaaacggauacuuccgcuucgacuccuggguaaaccaauucuacacccuugcccccaugggcaacggaaccggccgccgccguuaa

SEQ ID NO: 38154 - RNA, 1617 nt, Artificial Sequence
  derived and/or modified sequence opt11 from VP1__Norovirus_and/or_Norovirus-like__GQ845341
augaaaauggccuccaaugacgcaaaccccuccgacggauccgccgccaaccucguacccgaagucaacaaugaagucauggcccucgaacccgucgucggcgccgcuauugccgcccccgucgcaggccaacaaaacgucaucgaccccuggauccgcaauaacuucguccaggcccccgguggcgaguucacagucucaccccgcaacgcccccggcgaaauccucugguccgcaccccuaggccccgaucuuaaccccuaccuaucccaccucgcucgcauguacaacggcuacgcgggcgguuuugaaguccaagucauucuagccggcaacgccuuuacagcuggaaaaaucauauucgcugccgucccgcccaacuuccccacggaaggacuaucucccucccaaguuaccauguucccacacaucaucgucgacguccgccaacuagaacccguccuaauuccccuaccagacguccgaaacaauuucuaccacuacaaccaauccaacgacuccaccaucaaacucaucgcaaugcuuuacacaccccuccgcgcaaacaacgcaggcgacgacgucuucaccguaucaugccgcguccuaacccgccccagcccugacuucgacuucaucuucuuaguucccccuaccgucgaaagccggaccaaacccuucacaguuccaauccucaccgucgaagaaaugacaaacucacgauuccccaucccacuagaaaaacucuucaccggaccuuccggcgcauucgucguccaaccacaaaacggccgcugcacaaccgacggcguccuacucggcaccacccaacuuucccccguaaacaucugcaccuuccgaggggacgucacccacaucgcaggcucacgugacuacacuaugaaccuugcaucucuaaacuggaacaauuacgaccccacagaagaaauccccgccccacuaggaacaccggacuucguaggcaaaauccaaggagucuuaacccaaaccaccgaaggcgacgguuccacccgcggccacaaagcgacaguuuacaccggauccgccccauuuacccccaaacucggcagcguccaauucuccacugacaccgaaaacgacuucgaaacucaccaaaacacuaaauucacccccgucggcgucauacaagacggcucaaccacccaccgcaacgaaccgcaacaauggguccucccaagcuacuccggacgcaacguacacaacguacaccucgccccugccgucgccccaaccuucccaggugaacaacuccucuucuuccgcuccacaaugccaggcugcagcggcuaccccaacauggaccucgacugccuacucccccaagaauggguacagcacuucuaccaagaggccgccccugcacaaucggacguagcccuucuccgcuuugucaaccccgacaccggacgcguccucuucgaaugcaaacuucacaaaucaggcuacgucacaguugcccauacaggccaacacgaccuagucaucccacccaacggauauuucagauucgacuccugggucaaccaauucuacacccucgcccccauggguaacggcaccggccgcagacguuaa

SEQ ID NO: 38155 - RNA, 1617 nt, Artificial Sequence
  derived and/or modified sequence opt11 from VP1__Norovirus_and/or_Norovirus-like__HQ005292
augaaaauggccucauccgacgcaaauccuuccgacggcuccaccgccaaccucguacccgaagucaauaacgaagucauggcacuagaaccaguugucggcgccgccauagcggcaccaguagccggacagcaaaacgugaucgacccauggauucgcaauaacuucguccaagccccagggggagaauuuacaguauccccacgcaacgcccccggcgaaauccuauggucggcuccccuaggacccgaccucaaccccuaccucucccaccucgcacgcauguacaacggcuacgccggcggauucgaaguucaagucauucucgccgguaacgcauucacagccggaaagaucaucuucgccgccgucccacccaacuuccccaccgaaggccucuccccuucccaaguuacaauguuuccucacaucauagucgacguccgccaacucgaacccguacuaauuccccuccccgacguccgaaacaacuucuaccacuacaaccaauccaacgauccaaccaucaaacuaaucgcgaugcuauacacaccacuccgggcuaacaacgccggcgaugacguuuuuaccgucucaugccguguccucacccgaccaucccccgacuucgacuucaucuuccucgucccacccacaguagaaucccgcaccaaacccuucagcguccccauccuuaccguggaagaaaugaccaacucccgcuuccccaucccacucgaaaaacuuuuuacagggcccuccucagccuucgucguacaaccacaaaacggacgaugcaccacagacggcguacuacucggcacaacacaacucagcccagucaacaucuguacauuucgaggcgacguaacacacaucgcuggcucacgcaacuacacaaugaaccuagcaacccaaaacuggaacucuuacgaccccaccgaagaaauaccagcaccacucggcacccccgacuuugucggcaaaauccaaggaguccuaacucaaacuacccgcgccgacggcuccaccagaggucacaaagcaacgguguacacaggauccgccgacuucuccccaaaauuaggcagaguccaauucgcaaccgacaccgacaacgacuucgaugccaaccaaaacaccaaauucacucccgucggagucauacaagacggcaacaccgcacaucgaaacgaaccccaacaauggguucucccauccuacuccggcagaaacagccacaacguccaucucgcccccgccgucgccccaaccuucccaggcgaacaacuacuauucuuucgcuccacaaugcccggcugcuccggcuaccccaacauggaccucgacugccuccucccccaagaauggguacaauacuucuaccaagaagccgccccagcacaauccgacgucgcccuucuucgcuucgucaaccccgacacaggucgcguacuauucgaaugcaaacuacacaaauccggcuacguaaccguugcccauacaggccaacacgauuuagucauacccccuaauggcuauuuccgcuucgacuccugggugaaucaauuuuacacucucgccccaaugggcaacggaacaggaagaagacgcuaa

SEQ ID NO: 38156 - RNA, 1617 nt, Artificial Sequence
  derived and/or modified sequence opt11 from VP1__Norovirus_and/or_Norovirus-like__HQ456321
augaaaauggccaguaacgacgccacccccuccgacggcucuaccgccaacuuaguaccagaaguaaauaaugaagucauggcacucgaacccgucguaggcgccgccaucgccgcacccgucgcaggacaacaaaacgucaucgaucccuggauucgcaacaacuucguccaagcucccggcggcgaauuuaccgucucaccccgaaacgcccccggcgaaauacucugguccgcaccccucggccccgaccucaacccauaccuaucccaccucgcacgcauguacaacggauacgcaggaggcuucgaaguccaagucauccuagcaggcaaugcauucaccgccggcaaaaucaucuucgcagcagucccacccaacuuccccaccgaaggccuaucacccucccaagucacaauguucccccacauaaucgucgacguacgccaacucgaacccgucuuaaucccccucccagacguucgcaacaacuucuaccauuacaaccaaagcaacgaccccaccaucaaacucaucgccaugcucuacaccccacuccgcgcaaacaacgccggagacgacgucuucaccgucucaugccgcguccucacccgaccuucccccgacuucgacuucauauuccucguaccuccuacagucgaaucacgcaccaaaccuuucucaguacccauccuaacaguagaagaaaugaccaacucacgguuccccaucccccuagaaaagcuauucaccggcccaucaucagccuucguuguacaaccccaaaauggacgcugcacaaccgacggaguacugcuugguacgacacaacuaagcccugucaacauaugcacuuucagaggcgacguaacccacaucgccggcacccaaaacuacaccgucaaccucgccucccaaaacuggaacaacuacgaccccaccgaagaaauccccgccccacucggaacgcccgacuuugucgguaaaauccaaggaguacuaacacaaaccacacgucgagacggcagcacucgaggacacaaagccaccgucucaaccggcucaguacacuucacaccaaaacucggauccguccaauuuuccaccgacaccuccaacgacuucgaaaccggucaaaacacccgguucacccccguuggcguaguccaagauggaucaaccacccaccaaaacgaaccccaacaguggguccuccccaacuauuccggccgagacucgcacaacguccaccuggccccugccguagcccccacauuccccggagaacaacuccucuucuuccgaucaaccaugcccggaugcucaggauaucccaacaugaaccuagacugccuccuaccacaagaauggguccaacacuucuaccaagagucagcccccgcccaaagcgauguagcccuccuacgcuucgucaaccccgacaccggccgaguucucuucgaaugcaaacuccacaaauccggcuaugucacggucgcccacaccggccaacacgaccuaguuauacccccaaacgguuacuuccgauucgacucuuggguuaaccaauucuacacccucgcccccaugggcaacggcgcuggccgacgccgauaa

SEQ ID NO: 38157 - RNA, 1617 nt, Artificial Sequence
  derived and/or modified sequence opt11 from VP1__Norovirus_and/or_Norovirus-like__AB541326
augaaaauggcaagcaacgacgcaaaccccucagacggcucugcagccaaccuaguacccgaagucaauaaugaagucauggcccuugaacccgucgucggcgccgcuaucgcagcacccgucgcaggccaacaaaacguaaucgaccccuggauccguaacaacuucguccaagcccccgguggcgaguucaccgucagcccacgcaacgccccaggcgaaauccucuggucagcaccccuuggacccgaccucaaccccuaccuaucacaccucgcccgcauguacaauggauacgcugguggcuucgaaguccaggucauccuugcaggcaacgcauucaccgccggcaaaaucauauucgccgccgucccacccaacuuucccacagaaggacuaucacccucacaaguaaccauguucccucacaucaucguugacguacgccaacuagaacccgugcuaauaccccuucccgacguacgaaacaacuucuaccacuacaaccaauccaacgacuccaccaucaaacucaucgccaugcuauacacaccacuccgagcaaacaaugcaggcgacgacgucuucaccgucagcugccgcguccuuacacgcccaagccccgacuucgauuucauauuucuagucccaccaaccguugaaucacgaacaaagcccuucacaguccccauccuaaccgucgaagaaaugacaaacucccgauuccccauuccccucgaaaaacucuucaccggacccucaucugccuucgucguccaaccacaaaacggcagaugcaccaccgacggaguccuccugggcacuacccaacuaucaccagucaacaucugcaccuuccgaggcgacgugacccacauaaccggcucccguaacuacacaaugaaccucgcaucccuuaacuggaacaacuacgacccuaccgaagaaauccccgccccacuaggcacucccgacuucgucgguaaaauccaaggcguacucacccaaacaaccaaaggcgacggauccacucgcggacacaaagccaccgucuacacaggcuccgccgauuucacccccaaacucggauccguacaauucgccacagacaccgaaaacgacuucgaaacacaccaaaacaccaaauucacccccguaggagucauccaagacggcggcaccacccaucgaaacgagccacagcaauggguccuccccagcuacucuggacgcaauguacacaacguccaccucgcacccgcggucgcccccaacuuccccggagagcaacuccucuucuuccgcagcaccaugccuggcuguucuggcuaucccaacauggaucucgacugccuccucccccaagaauggguccaacacuuuuaccaagaagccgccccugcccaauccgacgucgcccuccuccgauucguaaaccccgacacgggcagaguccucuuugaaugcaaacuccacaaauccggcuacgucacaguagcccacaccggccaacacgaucuagucauaccacccaauggcuacuuccgcuucgacuccugggucaaucaauuuuacacacuugcccccaugggcaacggcaccggacgucgacgcuaa

SEQ ID NO: 38158 - RNA, 1617 nt, Artificial Sequence
  derived and/or modified sequence opt11 from VP1__Norovirus_and/or_Norovirus-like__AB541251
augaaaauggcauccaacgacgcuucccccuccgacgguuccgccgccaaucucguucccgaaguaaacaacgaagucauggcacucgagccgguuguuggagcugcaauagccgcccccgucgccggacaacaaaacgucauagacccauggaucaggaacaacuucguacaagcacccggaggcgaguucacugucagcccccguaacgcaccaggcgaaauccuauggagcgcaccccucggccccgaccucaaccccuaccucucccaccucgcccgcauguacaacggauacgccgguggauucgaaguacaagucauacucgcaggcaacgccuucaccgccggaaaaaucaucuucgccgccguacccccuaacuuccccacagaaggacuaucaccaucacaagugaccauguucccccacauaauagucgacguucgccaauuagaaccaguacucaucccccucccagacguccgaaacaacuucuaucacuacaaccaaucaaacgacuccaccaucaagcucaucgccaugcuuuacacaccccuccgagcaaacaacgccggcgaagauguauucacagucuccugccgaguccuaacucgccccucccccgacuucgacuucauauuccuagucccaccaacugucgaaucacgcacuaaacccuucacaguuccuauucuaacagucgaagaaaugaccaacucacgauuccccaucccccucgaaaaacucuucaccggacccuccucagccuucguuguacaaccccaaaacggacgaugcacaaccgacggcguacuacucggaaccacccaacucucccccguuaacaucugcaccuuccgcggagacgucacccacaucgccggcucccgaaacuacacaaugaaccuugucucccucaacuggaacaacuacgacccaacagaagaaauuccagccccauugggaacacccgacuucgucggaaaaauccaaggcguacucacucaaacaacaaagggugacggauccacccgcggccacaaggccaccgucuacacaggcuccgcacccuuuaccccaaaacuaggauccguccaauucuccacggacaccgaaaacgacuucgaaacccaucaaaacaccaaauucaccccaguaggagucauacaggacggauccacaacccaccgcaacgaaccucaacaauggguccucccuuccuacucaggacgcaacguccacaacguccaccucgcccccgcagucgcaccaaccuuucccggcgaacaacuccucuucuuccgaucaacaaugcccggcugcuccggauaccccaacauggaccuagacugccuccuaccccaagaauggguccaacacuucuaccaagaagccgcacccgcccaaucagacguagcccuccuacgcuucgucaauccagauacaggccgaguccucuucgaaugcaaacuccacaaauccggcuacgucaccguugccuacaccggccaacacgaccucguaauaccucccaauggauacuuccgauucgacuccugggucaaccaauuuuacacacuugcccccaugggcaacggcaccggacgccgaagauaa

SEQ ID NO: 38159 - RNA, 1617 nt, Artificial Sequence
  derived and/or modified sequence opt11 from VP1__Norovirus_and/or_Norovirus-like__AB541241
augaaaauggccuccaacgaugcgaaccccuccgacggcuccgcagcaaaccuaguccccgaggucaacaacgaggucauggcccuagaacccgucguaggagcugcaaucgccgcaccagucgcaggccaacaaaacguaauugacccuuggauucgcaacaacuuuguccaagcccccggcggcgaguucaccgucucaccccgcaacgcccccggcgaaauccucugguccgcaccccucggacccgaucucaaucccuaccucucacaucucgcccgcauguacaacggauacgccggcggcuucgaaguccagguuauccucgccggcaaugccuucaccgcaggcaaaauaauauucgcugccguuccacccaacuuccccaccgaaggucucucccccucccaagucacaauguucccccacaucaucgucgacguacgacagcuggaacccguccuuaucccccuccccgacguccgcaacaacuucuaccacuauaaccaauccaacgauucuacuaucaaacucaucgcaaugcuuuacacuccccuucgcgccaacaacgccggagaagacgucuucaccguaucaugccgaguacuaacccgcccuucacccgacuuugacuucaucuuccucguaccacccaccaucgaaucccgcacuaaacccuucaccgugccuauccucacagucgaagaaaugaccaacucucgauuccccaucccccuugaaaaacucuucaccgguccaucuggcgccuucgucguccaaccccaaaacggccgcugcaccacagacggaguucuacucggaaccacucaacucucccccguaaacaucugcaccuuccgcggcgacguaacacacaucgccggcucccgcgacuacaccaugaaucuagccucacuaaauuggaacaacuacgaccccaccgaagaaauccccgcaccccucggcaccccagacuucguuggcaaaauacaaggaguccuaacccaaaccaccaaaggcgacgguuccacacgaggccacaaagccacagucuacaccggcuccgcacccuucaccccaaaacucggauccguccaauucuccaccgacaccgaaaacgacuucgaaacccaccaaaacaccaaauucacaccagucggcgucauucaagacggcuccaccacccaccgcaacgaaccucaacaauggguccuccccuccuacuccggucgaggcguacacaacguccaccucgcaccagccguugccccuaccuuccccggggaacaacuacucuucuuccgcagcaccaugcccggcugcuccgguuaccccaacauggaucuagacugccuccuuccccaagaauggguucaacacuucuaccaagaagcagcccccgcacaaagcgacguugcucuacuccgcuuugugaacccugacacaggccgcguacucuucgaaugcaaacuccacaaauccggauacgucacagucgcacacacaggccaacacgaucucgucauacccccuaacggauacuuccguuucgacuccugggucaaccaauucuacacccuugcccccaugggcaacggcacaggccggcgccgauaa

SEQ ID NO: 38160 - RNA, 1617 nt, Artificial Sequence
  derived and/or modified sequence opt11 from VP1__Norovirus_and/or_Norovirus-like__AB541216
augaaaauggcauccaacgacgccaaccccuccgacggauccgccgcgaaccucguccccgaagucaacaacgaagucauggcacuugaacccgucgucggagccgccauagcagcacccguagccggucaacaaaauguuauagauccuuggauacgcaacaacuucguacaggcccccggaggcgaguucacugucuccccgcgcaacgcccccggggaaauacucuggucagccccacucggacccgaccuuaaccccuaccucucccaucucgccagaauguacaacggcuacgccggcggcuucgaaguccaagucauucuagcaggcaacgcauuuacugccggcaaaaucaucuucgccgcagucccacccaacuuccccaccgaaggacucucccccucacaaguuaccauguucccgcauauaaucgucgacguccgccaacucgaacccguacuaaucccgcuacccgacguccgcaacaacuuuuaccacuacaaccaauccaacgacucaacaauaaagcuaaucgcuaugcucuacacaccccuaagagcgaacaacgccggugaagacguauucaccguuagcugccgaguccucacccgcccauccccagacuucgacuucaucuucuuagucccucccaccguugagucacgcaccaaacccuucaccguaccgauacucaccguagaagaaaugacaaacucgcgcuuccccaucccccucgaaaaacuauucaccggacccuccuccgccuucguaguccaaccacaaaacggccgcugcaccacugacggcguucuacucggaaccacccaacucuccccagucaacaucugcaccuucagaggcgacgucacacacaucgcaggcucccgcaacuacaccaugaauuuagcaucccuuaacuggaacaacuacgacccaaccgaagaaauaccagcaccccucggcaccccagacuucguaggcaaaauccaaggcgugcuuacacaaacaacuaaaggcgauggaucuacccguggccacaaggccacaguauacaccggcucggcagacuucacccccaaacucggauccgugcaauucuccaccgacaccgaaaacgacuucgagacacaccaaaacaccaaauucacccccgucggaguaauccaggacggcggcaccacccaccguaacgaaccccaacaauggguacuaccaagcuacagcggccgcaacguccacaacguccaucucgccccagcagucgcccccaccuucccaggcgaacaacucuuguucuuucgcucaacuaugccagguugcuccggcuaccccaacauggaccuagacugccuccuuccccaagaauggguccaacacuucuaccaagaagcagccccagcacaaucagacgucgcccuccuccgcuucgucaacccugacaccggccgcguccucuucgaaugcaaacuccacaaaucaggcuacguaaccgucgcccacaccggccagcacgaccucgucaucccucccaauggauacuuccgcuucgacucaugggucaaccaauucuacacccuagcccccaugggcaacggaacuggccgacgccgcuga

SEQ ID NO: 38161 - RNA, 1617 nt, Artificial Sequence
  derived and/or modified sequence opt11 from VP1__Norovirus_and/or_Norovirus-like__EU876885
augaaaauggcaucauccgacgccaacccauccgacggcucaacagccaaccucguccccgaagucaacaacgaagucauggcacucgaacccguagugggcgcugcuaucgccgcacccgucgcaggacaacaaaacguuaucgauccguggauccgcaauaacuucguccaagccccuggaggcgaauuuaccgucucaccccgcaacgcccccggagaaauccuuuggucugcaccccuagggcccgaccucaacccauaccuaucucaucuagcacgcauguacaacgguuacgccggaggauucgaaguccaagucauacuagccggcaacgcuuucaccgccggaaaaaucauauucgcugcaguacccccuaacuuccccaccgaaggccuaucuccaucacaaguaacaauguucccccacaucaucguagacgucagacaacucgaacccguacuuaucccacuccccgacguccgaaacaacuucuaccauuacaaccaauccaaugaccccaccaucaaacucaucgccaugcucuacacuccccuccgcgcaaacaacgccggagacgacguuuucacagucuccugccggguccucaccagacccucccccgauuucgacuucauauuucucgucccgcccacagucgaaucccgaacaaaacccuucucugucccuauacucacaguugaagaaaugacaaacucacgauuccccaucccccucgaacgacucuucacaggacccuccuccgcauucgucguccaaccacaaaacggacgcuguaccaccgacggcguucucuuaggcaccacccaacuauccccagcaaacaucugcacauuccgcggcgacguaacacacauagccggcacacaagaauacaccaugaaccucgccucacaaaacuggaauaauuacgacccaaccgaagaaauccccgcaccacuaggcaccccagacuucgucggcaaaauccaaggaguccucacccaaacgacacgacgagacggaucuacacgcggccacaaagccaccgucucaacaggcagcguccacuucacccccaaacucggccgcauccaauucagcacagacaccuccaacgacuucgaaaccggccaaaacacccgcuucacuccagucggagucguacaagacggcggcaccacucaccaaaacgaaccccaacaauggguccuacccaacuacucaggaagagacggccauaacguccaccucgcaccagccgucgccccauccuucccuggggaacaacuccuauucuuccgcuccaccaugcccggcugcuccggcuauccuaacaugaaccuggacugccuacucccacaagaauggguucaacacuucuaccaagaagcagccccagcccaauccgacgucgcccuacuccgauuugucaacccagacacuggccgaguacuauucgaauguaaacuccacaaauccggcuacgugaccgucgcucacacaggccaacacgaccucgucauacccccaaacggcuauuuccgcuuugacagcuggguaaaccaauucuacacccuagcccccaugggcaacgguacaggacgccgaagauaa

SEQ ID NO: 38162 - RNA, 1617 nt, Artificial Sequence
  derived and/or modified sequence opt11 from VP1__Norovirus_and/or_Norovirus-like__AB447435
augaaaauggccucaaacgacgcaaaccccuccgacggcagcgccgccaaccucguaccugaagucaacaacgaagucauggcacuagaaccggucgucggagcagccaucgcagcaccagucgcaggccaaaccaacgucaucgacccauggauacgcaacaacuucguccaagccccaggaggagaguucacuguaucaccccgaaacgccccaggcgaaauccucugguccgcaccccucggacccgaccuaaacccauaccuaagccacuuagccagaauguacaacgguuacgccggagguuucgaaguacaagucauucucgcaggcaacgccuucacagccggaaaaaucauauucgcagccgucccucccaacuuccccaccgaaggccuaucccccucacaagucacaauguucccccacaucauaguagacguacgacaacuagaacccguccucauaccacuccccgacguccgcaacaacuucuaccacuacaaccaacucaacgacuccaccaucaaauuaaucgcaaugcuuuacaccccucuucgggcuaacaacgccggcgaagacguauucaccguaucaugccgaguccucacccgcccaucccccgauuuugacuucauauuccuuguuccacccacagucgaaucccgcaccaaacccuucaccgucccaauccuaacggucgaagaaaugaccaacucccgcuuccccauaccccucgaaaaauuauucacagguccaucaggcgccuucgucguccaaccacaaaacggccgaugcacuaccgacggcguccuccugggcaccacccaacuauccccaguuaacaucugcaccuuccgcggagacgucacacacauagcaggcucacgcaacuacaccaugaaccuagcuucacucaacuggaacaacuacgaccccaccgaagaaaucccagccccucuaggcacgccugacuucguuggcaagauucaaggcguccuaacccaaaccaccaaaggagacgggagcacccgcggacacaaagccaccgucuacaccggcucugcccccuucacucccaaacucggcuccguacaauucucaaccgacaccgagaacgacuucgaaacccaucaaaacacaaaauucacccccguuggugucauccaagacggcuccaccacacaccgcaacgaaccccaacaauggguccuaccauccuacagcgggcgcaacguacacaacguacaccucgcccccgccgucgcaccaaccuuccccggcgaacaacuccuguucuuucguucuaccaugcccggcugcucaggauaccccaacauggaccucgacugccuacucccucaagaguggguacaacacuucuaccaagaagcagcccccgcacaauccgacguagcacuacuacgauucgucaaccccgacacgggccggguccucuucgaaugcaaacuccacaaauccggcuacgucacagucgcacacaccggacaacacgaccucguuauaccucccaacgguuacuuccgauucgacuccugggucaaccaauucuacacgcucgcucccaugggcaacggcaccggacgccgacgcuag

SEQ ID NO: 38163 - RNA, 1617 nt, Artificial Sequence
  derived and/or modified sequence opt11 from VP1__Norovirus_and/or_Norovirus-like__KX354073
augaaaauggcgucaaacgacgccaacccuucggacggcucagcagccaaccucgucccagaagucaacaacgaagucauggccuuagaaccaguagucggcgccgcaaucgcugcucccguagccggucaacaaaacguaauugaucccuggauccgcaacaacuucguccaagcucccggcggcgaguucaccguauccccacgcaacgcacccggcgaaauccucugguccgccccacuaggcccagaucucaaucccuaccuaucccaccucgccagaauguacaacggauacgcaggcggauucgaaguccaaguaauccucgcaggaaacgccuucacggccggaaaaaucaucuuugcagccguaccacccaacuuucccaccgaaggccuauccccaucccaaguuacaauguucccccacaucauuguagacguccgacaacuagaacccguccuaaucccccuccccgacguccgcaacaacuucuaccacuacaaccaaucaaacgacuccaccaucaaacucaucgccaugcucuacacaccccuccgcgccaacaacgccggcgacgacguauucacggucagcugcagaguccucacccgccccucccccgacuucgacuucaucuuccucguaccaccaacggucgaaucccgcaccaaacccuucacaguaccaauccucacaguugaagaaaugacaaauucccgcuucccaauaccucucgaaaaacuguucaccggacccucuucggccuucgucguccaaccccaaaacggccgcugcacaaccgacggaguacuccuaggcaccacacaacucucacccgucaacauaugcaccuuccgcggagauguuacucacaucgccggcucccgaaacuacacgaugaaccuggcaucccucaacuggaacaacuacgaccccacagaagaaaucccagcuccccucggcacccccgacuucgucggcaaaauacaaggaguccucacccaaaccaccaaaggagacggaucuacccgaggccacaaagccaccgucuacaccggaucagccgacuucacacccaaacuaggcuccguacaauucgccacagacacagaaaacgacuucgaaacacaccaaaacacccgcuucaccccaguaggcgucauucaagacggcucaaccacccaccgaaacgaaccccaacaauggguacuccccuccuacuccggacgcaacguccacaacguccaccuagccccugcaguugcaccaaacuucccaggcgaacaacuccucuucuucagauccacaaugccuggcugcucaggcuaccccaacauggaccucgacugcuuacucccccaagaguggguccaacacuucuaccaagaagcagccccagcucaaucagacgucgccuuacuacgauucgucaaccccgacacuggccgcguccucuuugaaugcaaacuucacaaauccggcuacgucacagucgcacauaccggccaacaugaccucguaaucccaccaaacggauauuuccgcuucgacagcugggucaaccaauucuacacccuagcuccaaugggaaacggcaccgggagacgccgcuaa

SEQ ID NO: 38164 - RNA, 1617 nt, Artificial Sequence
  derived and/or modified sequence opt11 from VP1__Norovirus_and/or_Norovirus-like__KX353981
augaaaauggccuccaacgacgcaaacccaucugacggauccgccgcuaaccucguccccgaaguuaacaacgaagucauggcacuagaacccgucgucggcgccgcaaucgccgcgccaguagccggccaacagaacguaaucgaccccuggauacguaacaauuucguucaagcccccgguggcgaguucaccgugucaccucgaaacgccccaggcgaaauacucugguccgcaccccuaggccccgaccucaaccccuaccucucccaccucgcccgcauguacaacggcuacgcaggcggcuucgaaguacaagucauccucgccggcaacgcuuuuaccgcuggcaaaaucaucuucgccgccgucccucccaacuuucccacagaaggccucucccccucacaagucaccauguucccccacaucaucgucgacguucgacaacucgaacccguucugauaccucuccccgacguccgcaacaacuucuaccacuacaaccaaucaaaugacuccacuaucaaacucaucgcaaugcucuacacgcccuuaagagcaaacaacgcuggagaagacguauuuaccgucuccugccgcguccucacacgacccucccccgacuucgacuucaucuuucucguacccccaacagucgaaucacgcacaaaaccauucaccguuccaauccucaccgucgaagaaaugaccaacucucgauuccccaucccacucgaaaaacucuucacaggcccauccucagcguucguaguucaaccacaaaacgggcgaugcacuaccgacggaguccuccuaggaaccacccaacuaucccccguuaacauaugcaccuuccgcggcgacgucacccacaucgcagguucacguaacuacaccaugaaccuugcaucacucaacuggaacaacuacgaccccaccgaagaaauccccgcaccccuaggcaccccagacuucgucggaaaaauccaaggcguccuaacucaaaccacaaaaggcgacggcucgacucgcggucacaaagccacugucuacacaggcagcgcccccuuuaccccaaaacuagguuccguacaauuuuccaccgacaccgaaaacgacuuugaaacccaccaaaacaccaaauucacucccguaggcgucauacaagacggcggcaccacccaccgaaacgaaccccaacaauggguacuccccucuuacuccggccgcaacguccaaaacgugcaccuagcacccgccgucgcccccaccuucccaggugaacaacuccucuucuuccgcuccacuaugcccgguugcuccggcuauccuaacauggaccuugacugccuccucccccaagaauggguccaacauuucuaccaagaagcagcccccgcccaauccgacgucgcacuccuacgcuucguuaaccccgacaccggacgaguccucuucgagugcaaacuacauaaaucuggauacgucacaguagcccacaccggccaacacgaccuaguaauucccccaaacggcuacuuccgauucgacuccuggguaaaccaauucuacacccucgcccccaugggcaacggcacuggccgccgccgcuga

SEQ ID NO: 38165 - RNA, 1617 nt, Artificial Sequence
  derived and/or modified sequence opt11 from VP1__Norovirus_and/or_Norovirus-like__KU182479
augaaaauggccagcaacgacgccaccccuagcgauggaucaacagccaaccuagucccagaaguuaacaacgaaguaauggcacucgaacccgucgucggcgccgccauagccgcccccguagcaggacaacaaaacgucauagacccauggauccgcaacaacuuuguacaagcacccgggggagaguucacggucagcccccgaaacgccccgggagaaauccucuggucagcaccccucggccccgaccuaaaccccuaccuaucacaccucgcccggauguacaacggauacgccggcggcuucgaaguccaaguaauccucgccggcaaugcauucaccgccggcaaaauaauauucgccgccgucccucccaacuuccccaccgaaggacucucccccucacaagucacaauguucccccauaucaucgucgacguccgccaacucgaacccguccucaucccccuuccagacguccgcaauaacuucuaccauuauaaccaauccaacgaccccacaauaaaacucauagccaugcuguacaccccacuccgagccaacaacgccggggacgacguauucaccgucagcugccgcguccucacacgacccucacccgauuucgacuucaucuuucuagucccacccaccgucgaaucccgcacaaaacccuucuccguccccauccuaaccguagaagaaaugacaaacucccgcuuucccauaccccuagaaaaacucuucaccggucccuccuccgccuucgucgugcaaccacaaaacggucgcugcaccaccgacgggguacuacuuggcacaacacaacucucccccgucaauaucugcacuuuccgaggagacguuacccacaucgcuggcgcacaaaacuacaccaugaaccucgcaucccaaaacuggaacaacuacgacccaaccgaagaaauccccgcaccccuuggaacccccgacuucguuggcaaaauccaaggcguccuaacccaaaccacccgucgcgacgguuccacucgaggccacaaagccacugucucaaccggaagcguccacuucacacccaaacucggcuccguccaauucuccacggauacauccaacgacuucgaaaccggccaaaacacucgauuuacccccgucggaguaguccaagacggcagcacaacccaccaaaacgaaccucaacaauggguacuacccgacuacucaggccgagacucacacaacguucaccuagcccccgccgucgccccaacauucccaggcgaacaacuacuuuucuuccguagcacuaugcccggcugcuccggauaccccaacaugaaccucgacugccuacucccccaagaauggguccaacacuucuaucaagaaucagcccccgcacaauccgacgucgcccuccuccgauucgucaacccggacacaggccgaguccucuucgaaugcaaacuccacaaauccggcuacguaaccgucgcacacacaggccaacacgaccuaguuaucccacccaacggcuacuuccgcuucgacuccugggucaaccaauucuacacccuagcacccaugggcaacggagccggccgccgacgcuaa

SEQ ID NO: 38166 - RNA, 1617 nt, Artificial Sequence
  derived and/or modified sequence opt11 from VP1__Norovirus_and/or_Norovirus-like__KU182478
augaaaauggccucuaacgacgcaaccccuuccgaugguucuacugccaaccucguccccgaaguaaacaacgaaguaauggcccuugagcccgucguaggcgcugccaucgcagcccccgucgccggacagcaaaacguaaucgaccccuggauccguaacaacuuuguucaagccccaggcggcgaguucaccguuucaccccgcaacgccccaggcgaaauccuuugguccgcuccccuaggcccagaccucaacccauaccucucccaccucgcacgcauguacaacggcuacgccggcgguuuugaaguccaagucauccucgcaggcaacgccuucaccgccggcaaaaucaucuucgcagccguucccccaaacuuccccaccgaaggccuaucccccucccaaguaaccauguuuccccacauaauagucgacguacgccaacucgaacccguccucauuccccuccccgacguaagaaacaacuucuaccacuacaaccaauccaacgaccccacaaucaaacuaaucgccaugcuuuacacuccacuacgcgcuaacaacgccggcgacgaugucuucacagucuccugucgcguacuaacccgccccuccccugacuucgacuucauauuccucgucccacccaccguagaauccagaaccaaacccuucucaguccccauccuuaccgucgaagaaaugacaaauucacguuucccuauacccuuagaaaaacuauucaccggucccagcuccgcuuucguaguccaaccccaaaacggucgcugcacaacagacggcguacuccuaggcaccacccaacuaagcccagucaacaucugcacauuucguggcgacguaacccacaucgcuggcacacaaaauuauaccaugaaccuugcaucacaaaacuggaacaacuaugaccccaccgaagaaauccccgccccacucggcacaccagacuucguaggaaaaauccaaggaguacuuacacaaaccaccagaagagacggcuccaccagaggacauaaagccaccgucucaaccgggucagugcacuucacacccaaacucggcuccguacaauucuccacagauaccuccaacgacuuugaaaccggacaaaacacccgauucacucccgucggugucguccaagacggaucaacaacccaccaaaacgaaccccaacaauggguccuacccgacuauucgggacgcgacucccacaacguacaccuugcccccgcagucgcccccacauucccuggugaacaacuccucuucuuccgcucaacuaugcccggcugcuccggauacccaaacaugaaccucgauugccuccucccccaggaauggguccaacacuucuaucaagaaucagcccccgcccaaagcgacgucgcacuucuacgcuucgucaaccccgacacuggacgcguccucuucgaaugcaaacuacacaaaagcggauacgucacaguagcccacacgggacaacacgaccucgucauaccacccaacggauacuuccgauucgacagcuggaucaaccaauucuacacacuugcccccaugggaaacggcgcaggccgccgccgauaa

SEQ ID NO: 38167 - RNA, 1617 nt, Artificial Sequence
  derived and/or modified sequence opt11 from VP1__Norovirus_and/or_Norovirus-like__AB972501
augaaaauggcauccaacgacgcaaaccccuccgacggcuccgcugcaaaccugguaccagaaguaaacaacgaagucauggcucucgagcccguaguaggagccgccaucgccgcucccgucgcaggucaacaaaaugucauagacccauggauacgcaacaacuucguccaagccccgggcggggaguucaccgucucaccacgaaacgcacccggcgaaauccuuuggucagccccucuaggccccgaccuaaaccccuaccucucgcaccuagcacgaauguacaauggcuacgccggcggcuucgaaguccaagucauacuagcuggcaaugccuucacagccggaaaaaucaucuucgcagccguaccacccaacuuccccaccgaaggccuaucccccucccaagucaccauguuuccccacauaaucguagacguacgccaacucgaaccaguucucaucccauuaccagauguccgcaacaacuucuaccacuacaaccaauccaacgacagcacaaucaaacuaaucgccauguuauacacaccccuacgcgcaaacaacgccggcgaagacgucuucaccgucucaugccgcguacucacccgccccagccccgacuucgacuucaucuuccucgucccucccaccgucgaaucccgcaccaaacccuucaccgucccaauccugaccguagaagaaaugaccaacagccgcuuccccauaccauuagaaaaacucuucacuggcccaucaucagcauucgucguucaaccacaaaacggccgcugcacaaccgacggcguccuccucggaacuacacaacucucccccguuaacaucugcaccuuccgaggagacgucacccacaucgcaggcucccgcaauuacacuaugaaucuagccucacuuaacuggaacaacuacgacccaacagaagaaauccccgccccauuaggaacucccgacuucgucggcaaaauacaaggcguucucacccaaaccaccaaaggcgacggaucaacccgcggccacaaagccaccgucuacaccgguucagccccauucaccccaaaacuaggaagcguccaauucggaaccgacacagaaaacgacuucgaaacgcaccaaaacaccaaauucacccccgucggcguaauccaagacggcggaaccacccaccgcaacgaaccacaacaauggguucuaccaucauacagcggccguaacguucccaacguacaccuagccccagcaguagcccccacuuuccccggcgaacaacuccuauucuuucgcuccacgaugcccggaugcagcgguuaccccaacauggaccucgacugccuacucccccaagaauggguccaacacuucuaccaagaagccgcucccgcccaaucagacgucgcacuccuccgcuucguaaaccccgacaccggccgcguccucuucgagugcaaacugcacaaacccggcuacgucaccgucgcccacaccggccaacacgaccucguaaucccaccuaacggcuacuuccgcuucgauucaugggucaaccaauucuacacacuugcacccaugggaaacggcaccggaagacgccgguga

SEQ ID NO: 38168 - RNA, 1617 nt, Artificial Sequence
  derived and/or modified sequence opt11 from VP1__Norovirus_and/or_Norovirus-like__KR904214
augaaaauggcauccagcgacgccaaucccuccguuggaagcgcugcaaaccucguaccggaaguaaacaaugaggucauggcccuagaaccugucguaggagccgccaucgccgcccccgucgccggccaacaaaacguaaucgacccauggauccgcaacaacuucguccaagcccccgggggcgaguucaccgucucaccccgcaacgcgcccggagaaauucucugguccgcaccccuaggacccgacuuaaaccccuaccucagccaccuugcccgaauguacaacggauacgccggaggcuucgaaguccuagucauccucgccggcaacgccuucaccgccggaaaaaucaucuucgccgccguuccacccaacuuucccacagaaggccuuucccccagccaagucaccauguucccccacauuaucgucgacguccgacaacucgaacccguacucauaccccuccccgacguccgaaacaacuucuaccacuauaaccaauccaacgacccaaccaucaaacucaucgccaugcuauacacaccccuacgagccaacaacgccggcgacgacguauucaccguauccugccgaguacucacucgcccaucacccgacuucgauuucaucuuccucgucccaccaaccguagaaucccgaacaaaacccuucuccguuccaauacuaaccgucgaagaaaugacaaacucgcgauucccaaucccccuagaaaaacucuucaccggccccuccucagccuucguuguacaaccccagaacggccgaugcaccaccgacggaguacuccucggaacaacccaacucucccccguuaacauuugcaccuuccgcggcgacguaacccauacaaccgguucacacaacuacacuaugaaccuggccacucaaaauuggaacuccuacgacccaacagaagaaauacccgccccacucggaaccccugacuucgucggcaaaauccaaggcgugcucacucaaacaacaaaaaccgacggcucaaccagaggucacaaagcaaccgucuacaccgguuccgccgacuucgcccccaaacucggacguguccaauucgccaccgacacagacaaugacuucgaagcaaaccaaaacaccaaauuuacccccguaggagucauacaagacggaggcacagcccaccgcaacgaaccacaacaauggguccuacccagcuacucagggcgaaacacucacaacguccaccucgcccccgcagucgcccccaccuuccccggagaacaacuccuauucuuccgcuccaccaugcccgggugcuccggcuaucccaacauggaccucgacugccuauuaccacaagaauggguccaauacuucuaccaagaagcagcacccgcucaaucagacguagcccuccuccgcuucgucaacccugacaccggccgcguacucuucgaaugcaaacuccacaaaucaggcuacgucaccguugcccacacaggaccacacgaucucgucaucccaccaaacggcuacuuucgauucgacuccuggguaaaccaauucuacacccuagcaccaaugggcaacggaaccggccgacgccgauaa

SEQ ID NO: 38169 - RNA, 1617 nt, Artificial Sequence
  derived and/or modified sequence opt11 from VP1__Norovirus_and/or_Norovirus-like__AB933758
augaaaauggccucaucugacgccaaccccucugauggcucaaccgccaaccucguccccgaagucaacaacgaagucauggcccucgaacccgucgucggagccgccauugccgcucccgucgccggccaacaaaacgucaucgacccauggauccgcaacaacuucguucaagcccccggcggcgaguucacagucuccccacguaacgcccccggcgaaauccuauggagcgcaccccuaggcccagaccuaaauccauacuuaagccacuuagcccgcauguacaacggcuacgccggaggcuucgaaguccaagucauccucgccggaaacgccuucaccgccggcaaaaucaucuucgccgccgucccacccaacuucccgacagaaggacuaucacccucacaagucaccauguucccccauaucauagucgacguucgccaacuggaaccaguccugaucccccucccagacguccgcaacaauuucuaccacuacaaccaaucuaacgaccccaccaucaaacucauagcaaugcucuacaccccacuccgagccaacaacgcaggcgacgacgucuucaccgucucaugcagaguacuaacacgccccucccccgacuucgacuucaucuuccucguaccucccaccguggaaucacgaacuaaacccuucuccguccccauacucacaguugaagaaaugaccaacucccgauuucccaucccucucgaaaaacucuucaccggccccagcuccgccuucgucguucaaccucaaaacggacgcugcaccaccgacggcguacuccucggcaccacacaacuaucccccgucaacaucugcacauuccgcggcgauguaacccacauagcgggcucccacaacuacaccaugaaccucgcuucacaaaacuggaacucguacgaccccaccgaagaaauacccgcaccccuaggaaccccagacuucgucgguaaaauccagggcguccucacacaaaccacacggaccgauggcuccacaagaggucacaaagccaccguauacaccggcuccgccgaguucucaccaaaacucggccgcguccaauuugccaccgacaccaacaacgacuucgaugccaaccaaaacacaaaauucacaccagucggcgucauccaagacggaggcaccacccaccgaaacgaaccccaacaauggguccuacccucauacucaggccgaaacacacacaacguacaccuagccccagcagucgcccccaccuucccuggagaacaacuacucuucuucagaagcaccaugccuggaugcucuggcuaccccaacauggaccuagacugccuacucccacaagaauggguacaauacuucuaccaagaagccgccccagcccagagugacguagcccuccuccguuucguaaacccagacaccggccgcguccuauuugaaugcaaacuccacaaaagcgguuaugucaccguagcccacacaggccaacacgaccuugucauaccaccuaacggauacuuccgcuucgacuccugggucaaccaauucuacacccucgcacccaugggcaacggaaccggacgacgucgcuaa

SEQ ID NO: 38170 - RNA, 1617 nt, Artificial Sequence
  derived and/or modified sequence opt11 from VP1__Norovirus_and/or_Norovirus-like__AB933698
augaaaauggccagcaacgacgccaaccccuccgacggcucagccgccaaucuaguacccgaaguaaacaacgaagucauggcccucgaacccgucgucggcgccgccaucgccgccccagucgccggccaacaaaacguuaucgaccccuggauccgcaacaauuucguccaagccccuggcggcgaguucacaguaucaccucgcaacgcaccaggagaaauccucugguccgcgccccucggaccagaccucaaccccuaccuaucccaccucgcccgaauguacaacggcuacgcuggcggcuuugaaguccaaguaauccuagccggaaacgcauuuacugccggcaaaaucaucuucgccgccguaccuccaaacuuucccaccgaaggccuaucccccagccaagucaccauguucccccacauaaucgucgacguucgacaacucgaaccaguacuaaucccccuccccgacguccgaaauaacuucuaucacuacaaucaguccaacgacaguacaauuaaacuaaucgcaaugcucuacacaccccuacgcgcaaauaacgccggcgaagacguauucaccguaagcugccgaguccucacccgacccuccccagacuucgacuuuaucuuccugguacccccuaccgucgaaucccgcaccaaaccauucaccguccccauccuuaccguagaagagaugaccaacucaagauuccccaucccgcuggaaaaacucuucaccggcccaagcggcgcauucguaguacaaccccaaaacggacgcugcaccaccgacggcguucuacucggcaccacccaacucucacccguaaacaucugcaccuuuaagggagauguaacacacauagccggcucccgcaacuacacaaugaaucuagccucccucaacuggaacaacuacgacccgaccgaggaaaucccggcuccccuaggcacccccgacuucguagguaaaauccaaggcguccuuacccaaaccacuaaaggcgacggcucuacgcgcggccacaaagccacgguguacaccggcuccgccccauucacccccaaacucggaucgguacaauuuuccacugacacugaaaacgacuucgaaacccaccaaaacaccaaauucaccccgguaggcgucauccaagacggcggaaccacccaccagaacgagccccaacaauggguccuacccuccuacuccggccgugacguccccaacguccaccucgcccccgccgucgcgcccaccuucccaggcgagcaacuccucuucuuccguuccacuaugcccggcugcucaggcuacccaaauaugaaucuagacugccuccuaccccaagaauggguccaacacuucuaucaggaagcagcccccgcccaauccgacgucgcccuccuacgcuucgucaaccccgacacaggccgaguccuauucgaaugcaaacuucacaaaucagguuacguaacagucgcccacaccggccaacacgaccucguaauacccccuaacggcuacuuccgcuucgacuccugggucaaucaauucuacacccuugcccccaugggcaacggcaccggucgccgccgcuaa

SEQ ID NO: 38171 - RNA, 1617 nt, Artificial Sequence
  derived and/or modified sequence opt11 from VP1__Norovirus_and/or_Norovirus-like__KJ678141
augaagauggccuccucagacgccaacccuucggacggauccgccgcaucccuuguccccgaaguaaauaacgaaguaauggcccucgaaccagucgucggagcagccaucgccgcccccguagcaggacaacaaaacguaaucgaccccuggauccgcaacaacuucguccaagcccccggcggagaguucacagucucaccccgcaacgcaccuggagaaauccuaugguccgccccucuaggcccugaccucaaccccuaccucucccaccucgcacgcauguacaacggauacgccggaggcuucgaaguccaagucauccuugccggcaacgccuucacagccggcaaaguaaucuucgccgccgucccucccaacuuccccaccgaaggccucaguccaucacaagucacgauguucccacacauagucguagacguacgccaacuagaacccguccucaucccccuccccgacguccgcaacaacuucuaccauuacaaucaaagcaacgacccaaccaucaaacuaaucgcaaugcucuacacuccccuucgagcaaauaacgcaggagacgacguuuucaccguaucaugucguguccucacccgccccuccccugacuucgauuucaucuuccucgucccacccaccguagaaucaagaaccaaacccuuuucgguccccguccuaaccguugaagaaaugacaaacucacgauuccccaucccccucgaaaaacucuucacaggaccuuccucagccuucgucguccaaccccaaaacggcagaugcaccaccgacggaguccuccucggcacaacacaacuaagccccgucaacaucugcacuuuccgcggagaugucacccauaucacaggaucacacaacuacaccaugaaccucgcaucacaaaacuggucaaacuacgacccaaccgaagaaauaccggcaccccucggcacccccgacuucgucggcaaaauccaaggcguccucacacaaacaacccgcacuaacggaucaacccgaggucacaaagccacagucuaugccggcuccgccaacuucgcuccuaaacuaggacgaguccaauucgaaacagacacggaccacgaccucgaagcaaaccaaaacaccaaauucaccccagucggaguuauucaagacggcaacaccacccaccgcaacgaaccccagcaauggguuuuacccagcuacuccggccgcucuacaccaaacgugcaccuagccccagcuguagccccaacauucccaggcgaacaauugcuauucuuccgaucaaccaugcccgguugcuccggcuaccccaacauggaccucgacugccuccucccacaagaauggguucaauacuucuaccaagaagcagcccccgcccaaucagacguugcccuccuaagauucguuaacccggacacuggccgcguccuuuucgaaugcaaacuccauaaauccggauacgucaccgucgcacacaccggacaacacgaccuagucauaccacccaacggauacuuccgcuucgacucauggguaaaccaauucuacacacucgcacccaugggcaacggcaccggccgccgaagguaa

SEQ ID NO: 38172 - RNA, 1617 nt, Artificial Sequence
  derived and/or modified sequence opt11 from VP1__Norovirus_and/or_Norovirus-like__EU921347
augaaaauggccuccucagacgccaaccccuccgacggcucaaccgcaaaccucguaccagaagucaacaacgaagucauggcccucgaaccagucgucggcgccgcuaucgcagcacccgucgcuggccaacagaacguuaucgaccccuggauccgaaacaacuucguucaggcccccggaggugaauuuaccgucuccccucguaaugcaccaggcgaaauacucugguccgcaccacuaggccccgaccucaaccccuaccuaucccaccucgcacgcauguacaacggcuacgcaggcggauucgaaguucaaguccugcuugccggaaacgccuucacagccgguaaaauuaucuucgccgccgucccacccaacuuccccaccgaaggucuaucccccagccaagucaccauguucccccacaucaucgucgacguccgucaacuagaaccaguccucauaccccucccugacguaagaaacaacuucuaccacuacaaccaauccaacgaucccaccauaaaacuaaucgcaauguuauacacaccccuccgcgcuaauaacgcgggagacgacgucuucaccgucuccugccgcguccucacccgccccucuccugauuucgacuucaucuuccucguaccgcccaccguagaaucccgaaccaaacccuucuccguaccaauccucacagucgaagaaaugaccaacucucgcuucccaauuccccucgaacgccucuucaccggccccucuuccgcauucgucguccaaccacaaaacggcagaugcacaaccgacggcguccucuuaggaaccacccaacucuccccugucaacaucugcaccuuccgcggagacguaacacacaucgccggcacccaagaauacaccaugaaccucgccucccaaaauuggaacaacuacgacccuaccgaagaaauccccgccccacucgguacacccgacuucguaggaaaaauacaaggcguccuuacccaaaccacacgccgcgacggaucaacucggggccacaaagcaaccgucuccacaggcucaguacacuucacacccaaacuaggccgcauacaauucuccacagauaccuccaacgacuucgaaaccggccaaaacacccguuucacaccugucggcgucguccaagacggagggaccacccaucaaaacgaaccucaacaauggguccucccagacuacagcggcagagacucgcacaacguccaccucgcacccgccguagcgcccuccuuccccggcgaacaacuccuauucuuccgcucaacuaugccaggaugcucaggauaccccaacaugaaccuugacugccuccucccccaagaauggguccagcacuucuaccaagaagccgccccagcacaauccgacgucgcccuuuuacgcuuugucaacccagacaccggacgaguccucuucgaaugcaaacuacacaaauccggcuacgugaccgucgcacauaccggccagcacgaccuagucauuccucccaacggcuauuuccgcuucgacuccugggucaaucaauuuuacacccucgcacccaugggcaacggcacuggacgcagaagauag

SEQ ID NO: 38173 - RNA, 1617 nt, Artificial Sequence
  derived and/or modified sequence opt11 from VP1__Norovirus_and/or_Norovirus-like__JX459628
augaagauggcaagcaacgacgccaacccaagcgacggcuccgcagccaaccuaguccccgaagucaacaacgaaguaauggcccuagaaccuguagucggcgccgccaucgccgcacccguagccggccaacaaaacgucauagacccauggauacgcaacaacuucguacaagcaccaggcggagaguucacuguguccccuagaaacgcgcccggugaaauccugugguccgccccacucggcccugaccucaaccccuaccuaucacaucuugcacgaauguacaacggcuacgcuggcggcuucgaaguccaggucauccuagcaggaaacgcauucaccgccgguaaaauuauauucgccgccguaccacccaacuucccaaccgaaggacucucccccucccaagugaccauguucccccacauaaucgucgacguccgucaacuugaacccguacuuauaccccuccccgacguccggaacaacuucuaccacuacaaccaguccaacgacuccaccauaaaacucauagccaugcuuuacacaccccuacgagccaacaacgcaggagaagacgucuucaccgucucauguagaguccucacccgcccaucacccgacuucgacuucauauuucucgucccaccaacagucgaaucacgaacuaaaccauucaccguccccauacucaccgucgaagaaaugacuaacucacgcuuucccaucccgcucgaaaaacucuucacaggcccuuccggcgcuuucgucguccaaccccaaaacggacgaugcaccaccgacggcguccugcuagguacuacccaacucagccccgucaauaucugcaccuuccgcggagacgucacacacauagcaggaagccgaaacuacacaaugaaccucgccgcacucaacuggaacaacuacgaccccacagaagaaauccccgccccucucgggacacccgacuucgucggcaaaauacaaggaguacucacccagaccaccaaaggcgacggaucaacccgcggccacaaagccacagucuacaccggaucugccgacuucacacccaaacuuggcucuguacaauucucaaccgacacagaaaacgacuucgaaacccaccaaaauacuaaauucacccccgucggaguaauccaagacggcucuacaacacaccggaacgaaccccaacaauggguccuacccagcuacucgggccgcaacguccacaacguacaccuugccccugccgucgcaccaacauucccaggagaacaacuccuauuuuucagaucaaccaugcccggcugcuccggcuaccccaacauggaccucgacugccuccugccacaagaauggguccaacacuucuaccaagaagcugcaccagcacaaucagacguagcccuccuccgcuucgucaaccccgacaccggccgaguccuuuucgaaugcaaacuccacaaauccggcuacguuacaguugcacacacaggucaacacgaccuaguuaucccacccaacgguuacuuccgcuucgacuccugggucaaccaauuuuacacacucgcaccaauggguaacggcaccggccgacgccgauaa

SEQ ID NO: 38174 - RNA, 1617 nt, Artificial Sequence
  derived and/or modified sequence opt11 from VP1__Norovirus_and/or_Norovirus-like__JQ613564
augaagauggcaagcagcgacgccaaccccuccgacggcucaaccgcaaaccuuguacccgaagucaacaacgaagucauggcucucgaacccguagucggcgccgcaauugcugcccccgucgccggccaacaaaauguuaucgaccccuggaucagaaauaacuuuguccaagcacccggaggugaauuuacaguaucuccccgcaacgcaccuggcgaaauccucugguccgccccacucggcccagaccucaaucccuaccuuucccaccucgcccgcauguacaacggauacgccggcggcuucgaaguccaggucauccucgcaggaaacgccuucaccgccggaaaaaucauauucgcugcaguuccacccaacuuccccacugaaggccuauccccaucacaggucaccauguucccccacaucaucguggacguccgacaacucgaaccaguccucaucccccuccccgacguccgaaacaacuucuaccacuacaaccaauccaacgacccaaccauaaaacuuaucgcaaugcucuacaccccacuccgugccaacaacgccggugacgacgucuucacagucucaugcagaguucucacacgacccagccccgacuucgacuucaucuuccucgucccacccacagucgaaucccgaacaaaacccuucuccguucccauccuaaccgucgaagaaaugaccaacucgcgauuccccauaccacuugaaaaacuauuuaccggcccaucauccgccuucgucguccaaccccaaaacggccgaugcaccacagacggcguccuacucggaaccacccaacucucccccgucaacaucugcaccuuccgaggagacgugacccacaccgccggcucccacaacuacaccaugaaccuagcaucccaaaacuggaacucauacgaucccaccgaagaaauccccgcaccucuaggcacccccgacuuugucgguaaaauccaaggcguccuuacccaaaccacccgagcagacggaagcacccgcggccacaaagccaccgucuacacaggcuccgccgaguucucccccaaacuaggaagaguucaauuugccacugacaccgacaacgacuucgacgcaaaccaaaauaccaaauucacacccgucggcgucauccaagacggaggcaccacccaucgcaacgaaccccaacaauggguccuacccucauacuccggacgaaacacccacaacguccaucucgcacccgcaguagcucccaccuucccgggcgaacaauuacucuucuuccgcucaaccaugcccggaugcucaggcuaccccaacauggaccucgacugccuccugccccaagaauggguccaauacuucuaccaagaagcugcucccgcacaaucagacguagcccuccuucgcuucguaaaccccgacaccggcagaguccuauucgaaugcaaacuccacaaauccggcuacguaaccgucgcacacacaggccaacacgaccuugucaucccacccaauggauacuuccgcuucgacucaugggucaaccaauucuacacccuagcgcccaugggaaacggcacaggccgccgccgauga

SEQ ID NO: 38175 - RNA, 1617 nt, Artificial Sequence
  derived and/or modified sequence opt11 from VP1__Norovirus_and/or_Norovirus-like__GQ845332
augaaaauggccuccaacgacgcaaaccccuccaacggcucagccgccaaucucguaccagagguaaacaacgaagucauggcccuugaacccgucgucggagcugcaaucgcagcucccguagccggacaacaaaaugucaucgaccccuggauccgcaacaacuucguccaagcacccggaggcgaguucaccgucucuccccgcaaugcacccggcgaaauccuaugguccgcaccacucggccccgaccuuaaccccuaccucucgcaccucgcacgcauguacaacggcuacgccggaggauucgaaguccaagucauacucgccggcaaugccuucaccgcaggcaaaaucauauucgccgcagucccacccaacuuccccacagaaggccucucacccucccaaguaaccauguucccccauauaauugucgacguccgccaacucgaacccguacucauuccccuccccgacguccgaaacaacuucuaccacuacaaccaaagcaacgacucaacaaucaaauuaauagccaugcuauacacgcccuugcgcgccaacaacgccggcgaagacgucuucacuguuagcugcagaguacucacucgucccagccccgacuucgacuucaucuuccucgucccucccaccgucgaaucacgcacaaaaccauucaccguuccaauccucaccgucgaagaaaugacgaacucacgauucccaaucccccucgaaaaacucuucaccggacccucaagcgccuucgucguccaaccccaaaacggacgcugcaccacagacggcguucuucucgggaccacucaauuauccccaguaaacaucugcacauucagaggcgacguuacucacauagccggcagccgcaacuacacaaugaaccucgccagccuuaacuggaacaacuacgaccccacagaagaaauccccgccccacugggaacccccgacuucgucggaaaaauacaaggaguccucacccagaccacgaaaggagacggcucaacacgcggccacaaggccacugucuacaccggcuccgcccccuucacccccaaacucggcuccguccaauucucgacagacaccgaaaacgacuucgaaacacaccaaaacaccaaauucacacccguaggcguaauccaagacgggggcacaacccaccgcaacgaaccacaacaguggguacuaccaucauacucaggccgcaacgucccaaacguacaccuugcccccgccgucgcucccacauuccccggugaacaacuacucuucuuuagaucaaccaugccaggcugcuccggauaccccaacauggaccuagacugccuacuaccccaagaauggguacaacacuuuuaccaagaagcagcccccgcacaaucagacguagcccuccuccguuucgucaacccugacacaggucgcguacuauucgaaugcaaacuucacaaauccgguuacgucacagucgcgcacaccggccagcacgacuuagucaucccacccaacggcuacuuccgcuuugacucgugggucaaucaauucuacacccucgccccaaugggcaauggcaccggccgacgccgcuag

SEQ ID NO: 38176 - RNA, 1617 nt, Artificial Sequence
  derived and/or modified sequence opt11 from VP1__Norovirus_and/or_Norovirus-like__GQ856461
augaaaauggccuccaacgacgccaacccuuccgacggauccgccgcaaaucuaguacccgaaguaaacaacgaaguaauggcccucgaaccaguagucggugccgcaaucgccgcccccguagccggucaacaaaaugucaucgacccauggaucagaaacaacuucguccaagccccaggcggagaauuuacugucucccccagaaacgcccccggagaaauacuauggucggcaccccucggacccgaucucaaccccuaccucucccaccucgcccgcauguacaacggauacgccggcggcuucgaaguccaagucauacucgccgguaacgccuucacagccggaaaaaucaucuucgccgcagugccucccaacuuucccaccgaaggucuaucccccucccaagucaccauguucccccacauaaucgucgacguacgacaacucgagccaguucucauaccacucccagauguacgcaacaacuucuaccacuacaaccaauccaacgacuccaccaucaagcucaucgcgaugcucuacacgccacuacgcgccaacaaugccggugaagacguauucaccgucuccugccgaguccuuacccgaccaucccccgacuucgacuucauauuucucguaccacccaccguagaaucucgaaccaaacccuucacuguacccauccuaaccguagaagaaaugacaaacucucgcuuccccaucccccuugaaaaacucuucaccggaccauccuccgccuucguaguccaaccccaaaacggacgaugcaccaccgauggcguacuccucggaaccacacaacuaucaccagucaacaucugcaccuuucgcggggacguaacccauaucgcaggcucucgaaacuacaccaugaaccucgccagccucaacuggaacaacuaugaucccacggaagaaauccccgccccgcucggcacacccgauuucaugggaaaaauucaagggguccuaacccaaacaacaaaaggugacggguccacacgcggacauaaggccacaguuuacacaggaucagcgccauucacccccaaacucggcuccguccaauucuccaccgacaccgaaaacgacuucgaaacacaccaaaacaccaaauucacucccguuggcguaauacaagacggcggaaccacacauagaaacgaaccccaacaguggguacuccccagcuacuccggccgcaacgugccaaacguccaccucgcccccgccgucgcccccaccuucccaggcgaacaacuacucuucuuccgcuccaccaugccaggcugcucaggauauccaaacauggaucucgacugccuacucccccaagaauggguucaacacuuuuaccaagaagccgccccggcacaaucagacguagcccuccuccgauucgugaaccccgacaccggcagaguccuauucgaaugcaagcuccacaaaucgggcuacgucacgguagcacacaccggccagcacgaccuugugaucccuccaaauggguauuuccgcuucgacucaugggucaaccaguucuacacacucgcccccaugggcaacggaaccggacgcagacgcuaa

SEQ ID NO: 38177 - RNA, 1617 nt, Artificial Sequence
  derived and/or modified sequence opt11 from VP1__Norovirus_and/or_Norovirus-like__AB541245
augaaaauggccaguaaugacgccaaccccuccgacggcuccgccgccaaccucguccccgaagucaacaacgaagucauggcccucgaacccgucguaggagccgcuaucgccgcccccgucgcuggccaacaaaacgucaucgaccccuggauccgcaacaacuucguccaggcccccggcggagaguucaccgucagcccccgcaacgccccuggcgaaauccuaugguccgcaccacucggccccgaccuaaaccccuaccuuucucacuuagccagaauguacaacggcuacgcuggcggcuucgaaguucaaguuauccucgccggcaacgccuucacagcaggcaaaaucaucuuugcagccguacccccaaacuucccaaccgaaggacucucccccucccaaguaaccauguucccucacaucauaguagacguacgucaacuggaacccguccucaucccccuacccgacguucgcaacaauuucuaccacuacaaccagucaaacgacucuaccaucaaacucaucgcaaugcucuacacaccacuucgcgccaacaacgccggcgaagacguuuucacagucuccugccgaguccucacccggccaagccccgacuucgacuucaucuuccuugucccacccaccgucgaaucccgcacaaaacccuucaccguacccauucuaaccguagaagaaaugaccaacagcagauucccaauaccccucgaaaaacuauucacaggcccauccucagccuucgucguccaaccccaaaacgguagaugcaccacagacggaguacuccuaggaacaacacaacucuccccagucaacaucugcacauucaggggugauaucacccacaucgcaggaucccgcaacuacaccaugaaccuagcaucacuaaacuggaacaauuacgaccccaccgaagaaauccccgcaccccucggaaccccagacuucguaggcaagauccaaggaguccuaacacaaaccaccaaaggcgacggaagcacccgcggacacaaagccaccgucuacacaggcucagcccccuucacaccgaaacucggcuccguccaauucucaacagacaccgaaaacgacuucgaaacacaccaaaacacaaaauucaccccaguaggcguaauacaggacggcucaacgacacaccgcaacgaaccucaacaauggguucuccccuccuacuccggccgcaacgcccacaacguacaccucgcccccgccgucgcucccaccuuccccggcgaacaacuucucuucuuccgcucaacaaugcccggaugcucaggauaccccaacauggaucuugacugccuucucccccaagaauggguucaacacuucuaccaagaagcagcacccgcccaaucagacgucgcccuacucagguucgucaacccugacaccggccgaguccuauucgaaugcaaacuccacaaauccggcuacgucaccguagcacacaccggccaacacgacuuaguaaucccucccaacggauacuuccguuucgacuccugggucaaccaauucuacacccucgcacccaugggaaacggaaccggacgacgccgauaa

SEQ ID NO: 38178 - RNA, 1617 nt, Artificial Sequence
  derived and/or modified sequence opt11 from VP1__Norovirus_and/or_Norovirus-like__AB541229
augaaaauggcuucgaacgacgccaaccccuccgauggaagcgccgccaaccuagucccagaaguaaacaaugaggucauggcccuagaacccguaguaggcgcagcaaucgccgcccccguagccggccaacaaaacgucaucgauccauggauccgcaacaacuucguccaagcccccggcggcgaauuuaccgucagcccacgcaacgcccccggcgaaauccuauggucugcaccccucggacccgaucucaaccccuaccuaucccaccucgcccgaauguacaacggcuacgccggaggcuuugaaguccaagucauucucgcugguaacgccuuuaccgcaggcaaaaucaucuucgccgcugucccucccaacuuccccaccgaaggccuuucacccucccaagucacaauguucccccacaucaucguagauguacgccaacuggaacccguccuaaucccccuacccgacguccggaacaauuucuaccacuacaaccagucaaacgacuccaccaucaaacucauugccaugcuauacaccccacuacgcgcaaacaacgccggcgaagacguauuuaccgucucaugccgcguacucacccgccccuccccagacuucgacuucaucuuucuagucccgccaacagucgaaucucgcacaaaaccguucacagucccaaucuugacagucgaagaaaugacuaacagccgcuucccaaucccccucgagaaacucuucaccggcccauccucagccuucgucguccaaccccagaacggccgaugcaccaccgacggcguacuccucggcacuacccagcucuccccagucaacaucugcaccuuccgcggcgacguuacccacaucgccggcucacgcaacuacaccaugaaccucgccucccuuaacuggaacaauuacgaccccacggaggaaauccccgcaccccuaggaacacccgacuuugucggcaaaauccaaggcguccuaacccaaaccacaaaaggcgacggcuccacccgcggccacaaggcaacaguuuauacuggcuccgcuccauucacccccaaacucggcuccguccaauucagcaccgauaccgaaaacgacuucgaaacccaccaaaacacuaaauucacccccgugggcgucauccaagauggcucuacaacccaccgaaaugaaccccaacaauggguccuuccuuccuacuccggccgcaauguccaaaacguucaucucgcaccagccgucgcccccacuuuccccggagaacaacuccucuucuucagauccacgaugcccggaugcuccggcuaccccaacauggaccucgacugccuccucccacaagaauggguccaacauuucuaccaagaagccgccccagcucaauccgacguagcccuccuacgcuucguaaaccccgacacaggcagaguccuauucgaaugcaaacuacacaaauccggcuacgucaccguagcacacacaggucaacacgaccuugucaucccucccaacggcuacuuccgauucgacuccugggucaaccaauucuacacccuggccccaaugggcaacggagccggccgccgccgcuaa

SEQ ID NO: 38179 - RNA, 1617 nt, Artificial Sequence
  derived and/or modified sequence opt11 from VP1__Norovirus_and/or_Norovirus-like__AB541226
augaaaauggccucaaacgacgcuaaccccagcgacgguucagccgccaaccuuguacccgaagucaacaacgaagucauggcacucgaacccguugucggcgcugccauagcagcaccagucgccggccaacagaacgucaucgaccccuggauacguaacaacuucguccaagcccccggcggcgaguucaccgucucaccucgcaaugcgccuggcgaaauccucugguccgcuccccucggccccgaccuaaauccauaccucucccaccucgcccgaauguauaacggauacgcaggaggcuucgaaguccaaguuauccucgccggcaacgccuucaccgccggcaaaauuaucuucgccgccgucccaccaaacuuccccaccgaaggccucuccccuucccaagucacuauguucccccacauaaucgucgacguaagacaacuagaacccguccuaaucccucuccccgacguccguaacaacuucuaccacuacaaccaguccaacgacagcaccaucaaacucaucgcaaugcucuacacuccacuucgcgccaacaacgccggugaagacguauucaccgucuccugcagaguccucacccgcccauccccagacuucgacuucaucuuccucgucccucccacaguagaaucacgcaccaaacccuucaccguccccauccuuacagucgaagaaaugaccaacuccagauuccccauuccccucgaaaaacucuucacuggccccucauccgcauucguaguccaaccccagaacggccgcugcacaaccgacggcguucuucucggcaccacucaacucucacccgucaacaucugcacguuccgcggcgacgucacacacaucgccggcucuagaaacuacaucaugaaccuagccucccucaacuggaacaacuaugaucccaccgaagaaauccccgcacccuuaggaacccccgacuucguaggcaaaauccaaggcguccucacccaaaccaccaagggcgacggcuccacccgcggccacaaagccacugucuacacaggauccgcacccuucacucccaaauuaggauccguacaauucucaaccgacaccgaaaacgacuucgaaacacaccaaaacacaaaauucacccccgucggcguuauacaagacggcucuacaacccaccgaaacgaaccccaacaauggguccuccccuccuacuccggccgcaacguccacaacguucaccuugcccccgcuguagcuccaacauucccaggugaacaacuccucuucuuucgcucuacuaugcccggcuguuccggcuaccccaacauggaucuagacugucuucuuccccaagaauggguccaacacuucuaucaggaagccgccccagcccaauccgacguagcacuacucagguucguaaaccccgacacaggccgaguccucuucgaaugcaaacuacauaaauccggcuacgucaccgucgcucacaccggccaacacgaucucgucaucccacccaacggguacuuccgauucgacuccuggguuaaccaauucuacacucucacccccaugggaaacggcaccggcagacgccgcuaa

SEQ ID NO: 38180 - RNA, 1617 nt, Artificial Sequence
  derived and/or modified sequence opt11 from VP1__Norovirus_and/or_Norovirus-like__DQ078814
augaaaauggccucaaacgacgccacacccagcgacggcucaaccgccaaucucguccccgaaguaaacaacgaagucauggcacuagaaccagucguaggcgccgccaucgcagccccagucgcaggccaacaaaacgucaucgaccccuggaucagaaacaacuuuguucaagcaccaggcggcgaauuuacagucagcccccgcaacgccccuggcgaaauccucugguccgcaccccucggccccgaccucaaccccuaccucucccaccuagcccgcauguacaacggauacgcaggcggguucgaaguccaagucauccucgcaggaaaugcuuucaccgcagguaagaucaucuucgccgccguacccccgaacuuccccaccgaaguccucucccccucgcaggucacuauguucccccacaucaucgucgacguccgccaacucgaacccguccucauuccucuccccgacgucagaaacaaccucuaccacuacaaccaauccaacgacccaacaauccgccuaaucgccaugcucuacacaccccuacgcgccaacaacgccggcgaugacguauucaccguaucuugccgcguccuuacccgccccagccccgacuucgacuuuauauuccucguaccucccaccguagaaucucgaacaaaacccuucucaguccccauccucaccgucgaagaaaugaccaacucccgauuccccaucccccucgaaaaacucuucaccggacccucauccgcauucguaguccaaccccaaaacggacgcugcacaaccgacggaguccuucuagggaccacacaacuauccccaguaaacaucugcaccuuccgcggagacguaacucacaucgccggcacacaaaauuacacgaugaaccuagcuucacaaaacuggaacaacuacgacccaacagaagaaauccccgcaccccucggcaccccagacuucguuggccgcauccaaggcguacucacccaaaccacacgccgagacggcuccacccggggccacaaagccaccgucuccacaggcuccguacacuuuaccccgaaacuaggcuccguccaauucucuaccgacaccucuaacgacuucgaaaccggucaaaacacaagauucacccccguaggagucguacaagacggaagcacaacacaucaaaaugaaccccagcaauggguccucccagauuacagcggccgagacagccacaacguccacuuagcacccgccgucgcuccaaccuuccccggcgaacagcuccucuucuuccgcuccaccaugccuggcugcucaggcuaccccaacaugaaccuugacugccuccuaccccaagaauggguccaacacuucuaccaagaauccgcacccgcacaauccgacguagcacuccuacgauucgucaacccagacaccggccgcgucuuauucgaaugcaaacuacacaaaucagguuacguaaccguagcccacaccggucaacacgaccuagucauacccccaaacggcuacuuccgauucgacuccugggucaaccaauucuacacccuggccccaauggguaacggcgcaggccgccgucgauaa

SEQ ID NO: 38181 - RNA, 1617 nt, Artificial Sequence
  derived and/or modified sequence opt11 from VP1__Norovirus_and/or_Norovirus-like__EU078416
augaaaauggccuccaacgacgcaaaccccagcgacggcuccgccgccaaucucguccccgagguaaacaacgaagucauggcccucgaaccagucgucggcgcugcaaucgcagcccccgucgccggccaacaaaaugucaucgacccauggauccgcaacaacuucguccaagcacccggaggagaguucaccgucuccccucgaaacgcccccggagaaauccuuuggucugcaccccucggccccgauuuaaaccccuaccuaucacaccucgcccgcauguacaacggauacgccggcggcuucgaaguccaaguaauccuugcaggcaaugccuucacagccggaaaaaucaucuucgcagcaguacccccaaacuucccaaccgaaggccucagccccucccaggugaccauguucccucacauuaucgucgacgucagacaacuagaacccguacucauaccccuccccgacgugcgcaacaacuucuaccacuacaaccaauccaaugacagcacaaucaaacuuaucgccaugcuuuacacuccccucagagccaacaaugcaggagaagacguauucaccgucagcugccgcguacucacacgcccauccccagacuucgacuucauuuuccuugugcccccaaccgucgaaucccgcaccaagcccuucucagucccaauccugacagucgaagaaaugaccaacucccgauuucccaucccccuagaaaaacucuucacugguccaucaagcgcauucguaguacagccacagaacggccgcugcacaacugacggcguccuccuaggcaccacccaacuaucacccgucaacauauguaccuuucgcggcgacgucacacacauagcaggcacacaggaauacacgaugaacuuagcaucccaaaacuggaacaacuacgaccccacagaagaaauacccgcaccgcucggcacuccagacuucgucggaaaaauccaaggcguacucacccaaaccacacgccgcgacggcuccacccgcggccacaaagccaccgucuccaccgggucaguccacuucacacccaaacucggcagaauccaauucuccaccgauaccucaaacgacuucgaaacaggacaaaauaccagauuuacaccaguaggcgucguccaagacggcucaaccacacaccaaaacgaaccccaacaauggguucuccccaacuacucaggacgcgacucacacaacguccaccuagcccccgccgucgcccccuccuuccccggagaacaacucuuauucuuccgauccacuaugccaggauguucaggcuacccuaacauggaccucgacugccuucucccucaagaauggguccaacacuucuaccaggaagccgcccccgcacaaucagaugucgcccuacuccgcuucgucaaccccgacaccggcagaguccuauucgaauguaaacuccacaaaagcggauacgucacagucgcccacacgggccaacacgaccugguaaucccacccaacggcuacuuccgauucgacuccugggucaaccaauucuacacccucgcccccaugggcaacgguacaggccgccgccgauaa

SEQ ID NO: 38182 - RNA, 1617 nt, Artificial Sequence
  derived and/or modified sequence opt11 from VP1__Norovirus_and/or_Norovirus-like__EU839590
augaaaauggccuccaacgacgcaaacccaucaggcggcuccgccgccaaccuggucccggaagucaacaacgaaguaauggcacucgaacccgucgucggcgccgcaauagccgcacccguagccggacaacaaaacgucauagaccccuggauccgaaacaacuucguccaagccccaggcggcgaguucaccguaucuccccgcaacgcucccggagaaauccucuggucagcaccccuaggccccgaccuaaaccccuacuuaucgcaccuugcucgcauguacaacggauacgcaggaggcuucgaaguucaagucauccucgccggaaacgccuucacagcaggaaaaaucauuuucgcugccguuccacccaacuuucccacagaaggacuaucccccucacaggucaccauguucccccacaucauagucgacguacgccaacucgaacccguccucauaccucuacccgacguccguaacaacuucuaccauuacaaccaaucuaacgacuccaccauaaaacucaucgcuaugcuauacaccccacuacgagccaacaacgcaggcgaagacguauucaccgucucaugucgcguacuaacccgacccucccccgacuucgacuucaucuuccucgucccucccacaguagaaucucgcaccaaacccuuuacaguccccauacuaaccgucgaagaaaugacaaacucaagauuccccaucccccuugaaaaacucuucaccggccccuccuccgccuucgucguccagccccaaaacggccguugcaccacugacggcguccugcuaggcaccacacaacucucaccagucaacaucugcaccuuccgcggcgauguaacccacaucgcaggcucgcggaacuacaccaugaaucuagccucccucaacuggaacaacuacgaccccaccgaagaaauccccgcaccccucggcacccccgacuucgucgguaaaauccaaggaguccucacccagaccaccaaaggcgacggauccacccgcggccacaaggccacuguuuacacaggauccgcccccuucacccccaaauuaggcucaguccaguuuucaaccgacaccgaaaacgacuucgaaacucaccaagacaccaaauucacccccgucgguguaauccaagacggcggcaccacacaccgcaacgaaccccaacaauggguccuaccauccuacucaggccgcaacguccagaacguucaccucgcccccgccguagcccccaccuuuccaggcgaacaacuccuauucuuccgcuccaccaugcccggaugcuccggcuaccccaacauggaccuagacugccuucucccacaagaauggguccaacauuucuaccaagaagcagcccccgcccaauccgacgucgcccuacugcgcuucguaaacccagacaccggacguguacucuucgaaugcaaacuacauaaaucuggauacguaaccguagcccacaccggccaacacgaccucgucauaccacccaacggcuacuuccgcuuugacuccugggucaaccaauucuacacacucgcccccaugggcaacggcaccggccgacgacgcuaa

SEQ ID NO: 38183 - RNA, 1617 nt, Artificial Sequence
  derived and/or modified sequence opt11 from VP1__Norovirus_and/or_Norovirus-like__AB294783
augaaaauggcuuccaacgacgcuacaccguccgauggcagcaccgccaaccuggucccagaaguaaacaacgaaguaauggcccucgaaccugucguaggcgccgccaucgccgcccccguagccggccaacaaaacguaauagacccauggauccgcaacaacuuuguccaagcccccggcggugaauuuaccgucucuccccgcaacgcacccggagaaauccucugguccgcaccacuaggcccggaccucaauccauaccucucccaccucgcacguauguacaacggauacgccggcggguucgaaguccaaguaauccuagcuggcaacgccuucacagccgggaaaaucauauuugccgccguaccgcccaacuuucccaccgaaggacuaucccccucucaagucacuauguucccccacauaaucgucgacguccgccaacucgagcccguccuaauuccccuccccgacguccgcaacaacuucuaccacuacaaccaaucaaacgaccccaccaucaaacuaauugccaugcucuacacuccccuaagagcaaacaacgccggcgacgacgucuuuaccgucucuugccgcguacuaacccgaccaagccccgacuucgacuucaucuuccucguaccgcccacagucgaaucacgcacaaaacccuucuccguccccauccuaacaguagaagaaaugacaaacucccgauucccaauuccacuagaaaaacuauucaccggccccucaagcgcauucgucguccaaccccaaaacggacgaugcacaaccgacggcguccuccucggcaccacccaacuauccccugucaacaucugcaccuuucgcggcgacgucacccacaucgcuggaacccaaaacuacaccaugaacuuagcuagccaaaacuggaacaacuacgaccccaccgaagaaauccccgcaccccucggcacaccugacuucgucggcaaaauccaagggguacucacccaaaccaccagaggcgacggaagcacccgcggccacaaagccaccguguccaccggauccguucacuucacccccaaacucggcuccguccaauuuucuaccgacaccucaaacgacuucgaaacuggccaaaacacucgcuucacacccgucggagucguccaagacggcuccaccacccaccaaaacgaaccccaacaauggguccuccccaacuacucuggccgcgacucacacaacguccaccucgcccccgccguugcaccaaccuuccccggcgaacaacuccuuuucuuccgauccacaaugccaggcugcucggguuauccaaacaugaaccucgacugccuccucccccaagaauggguccaacauuucuaccaagagucugcacccgcacaaucugacgucgcccuacuccgguucgucaaccccgacacaggccgcguacuguucgaaugcaaacuacacaaaucaggcuacgucaccgucgcccacaccggccaacaugaccucguaaucccacccaacggcuacuuccguuuugacuccugggucaaccaauucuacacccuagcaccaaugggcaacggagccggaagacgcagauaa

SEQ ID NO: 38184 - RNA, 1617 nt, Artificial Sequence
  derived and/or modified sequence opt11 from VP1__Norovirus_and/or_Norovirus-like__AB303941
augaaaauggccuccaacgacgccacccccuccgacggaucaaccgcaaaccucgucccagaaguaaacaacgaaguaauggcacuagaacccgucguaggcgccgcaauagccgcaccagucgcaggccaacagaacgucaucgaccccuggauccgaaacaauuucguacaagcgcccggcggagaguucacaguuucaccccguaacgcacccggcgaaauccucugguccgcaccccugggccccgaccucaaccccuaucuaucacaccuagcccgaauguacaacggauacgccggaggcuucgaaguccaagucauccucgccgguaacgcauucacagcuggcaaaaucauauuugccgcaguacccccaaacuuccccacagaaggccucucuccuagucaggucacuauguucccccacaucaucgucgacguccgacaacucgaacccguacuuaucccccuaccugacguccgcaacaacuucuaccacuacaaccaauccaacgaccccaccaucaaacucaucgcuaugcucuacacaccccuacgcgcgaacaacgcuggagacgacgucuuuacggucuccugucgcguccucacccgucccuccccugacuucgacuuuaucuuccucgucccaccaaccgucgaaagccgcacaaaacccuucucaguacccauccucaccgucgaagaaaugaccaacuccagauuccccauaccccucgaaaaacuauucaccggccccagcucagccuucgucguccaaccacaaaacggaagaugcacaacugacggaguccuccuaggcacuacccaacucucuccaguaaauauaugcacauuccgaggcgacgucacacacaucgcuggcacacaaaacuacaccaugaaccucgccucccaaaacuggaauaacuacgaccccaccgaggaaauccccgcuccccuuggcacacccgacuucguagguaaaauccaaggcguacuaacccagacaacacgacgugacggcuccacccgaggacacaaagccacagucagcaccgguuccauccacuucacaccaaagcucggcagcguccaauucuccaccgacacuucuaacgacuucgaaacuggccaaaacacacgauucacacccguaggagucguccaagacggcucaaccacacaccaaaacgaaccccaacaauggguccuccccgacuacuccggccgagauucacacaacguccaccucgcccccgcugucgcccccaccuuuccaggcgaacaacuccuguucuuccgaagcaccaugcccggcuguagcggcuacccaaacaugaaccucgacugccuccuaccccaagaauggguccaacacuucuaccaagaauccgcccccgcccaauccgacgucgcacugcuccgcuucgucaacccagacaccggacgaguacuauucgagugcaaacuacacaaaagcggauaugucacagucgcccacaccggccaacacgaccuagucauucccccaaacggcuacuuccgauucgauuccugggucaaucaauucuacacacuagcuccaaugggcaacggcgcaggacgcaggcgauag

SEQ ID NO: 38185 - RNA, 1617 nt, Artificial Sequence
  derived and/or modified sequence opt11 from VP1__Norovirus_and/or_Norovirus-like__EF126961
augaagauggcauccaacgacgcaacccccucggacggaucuaccgccaaccuaguucccgaagucaacaacgaaguuauggcccucgaacccgucgucggcgccgccauagccgcacccgucgcaggccaacaaaacgucaucgacccuuggauccgcaacaacuucguucaagccccugguggcgaguucacagucucuccccgcaacgcaccgggcgaaauccucugguccgcgccccucggcccagacuuaaacccauaccucucccaccucgcccguauguacaacggauacgccggcggcuucgaaguccaaguuauccucgcgggaaacgccuuuaccgcagggaaaauuauauucgccgccgucccucccaauuuccccaccgaaggccuaucgcccucacaagucaccauguucccccacaucaucguugacguccgucaacucgaaccaguccuuauuccccucccagacguccguaacaauuucuaccacuauaaccaaucaaacgaccccaccaucaaacucaucgcaaugcucuacacaccccuccgcgccaacaacgccggcgacgacgucuucacagucuccugcagaguccucacacgaccaucccccgacuucgacuucaucuuccucgucccacccacagucgaaucacgaacaaaacccuucuccguccccaucuuaaccguagaagaaaugaccaauucccgauuccccaucccccucgaaaaacucuucaccggccccuccuccgccuucgucguccaaccccaaaacggacgaugcacaaccgacggcguccuacucgggacgacccaauuaucccccguaaacaucuguaccuuccgcggggacguaacccacaucgccggcacccaaaauuacacuaugaaccucgccucccaaaauuggaacaacuacgaccccaccgaagaaauaccagccccacuaggaacaccagacuucguuggcaaaauccaaggcguccucacccaaaccacaagacgcgacggcuccacccgaggccacaaagcaaccgucuccaccggauccguccacuucacaccaaagcucggcuccguccaauucucgacugacaccuccaacgauuucgaagccggccaaaacacccguuucacacccguaggcgucguccaagacgguucaaccacccaccaaaacgaaccacaacaauggguccuacccgacuacuccggccgugacucccacaacguacaccucgccccagccgucgcccccaccuucccuggcgaacaacuacuauucuuucguagcacuaugccagguugcucaggauaccccaacaugaaccucgacugccuacucccccaagaauggguccaacacuucuaccaagagagcgcucccgcccaauccgacguagcccuacucagauuugucaaccccgacacaggccgcguccuauucgaaugcaagcuacacaaauccggcuacgucaccguugcauacaccggccaacaugaccucgucaucccucccaacggcuacuuccgcuucgacucaugggucaaccaauucuacacccucgcgccuaugggcaacggcgccggacgccgacgcuaa

SEQ ID NO: 38186 - RNA, 1617 nt, Artificial Sequence
  derived and/or modified sequence opt11 from VP1__Norovirus_and/or_Norovirus-like__LC153749
augaaaauggccuccaacgaugccaaccccuccgacggcucagccgccaaccucguacccgaaguuaacaacgaagucauggcacuugaacccgugguaggcgccgcaaucgccgcacccgucgcaggacaacaaaacgucaucgaccccuggauccgcaauaacuucguccaagcccccggaggagaguucaccguaucaccacgcaacgcccccggcgaaauacucuggucagcgccccucggccccgaccuaaaccccuaucucucccaccuagccagaauguacaacggcuacgccggcggcuucgaaguacaagucauccucgccggaaacgcauucaccgcgggaaagaucaucuucgccgccgucccucccaacuuccccaccgaaggacuaucccccucccaaguuacgauguucccccacaucaucguagacguacgccaauuagagcccguacucauuccucuacccgacgucagaaacaacuucuaccacuacaaccaauccaacgacucuaccauaaaacucaucgccaugcuuuacacuccccuccgagccaacaacgccggcgaagacguauucaccguaucaugccgaguacuaacacgaccaucccccgauuucgacuucaucuuccucguacccccaaccgucgaaagccgcaccaaacccuucaccguccccauacucaccgucgaagaaaugaccaacuccagauucccaauuccacuugaaaaacucuucaccggaccaagcucagccuucguaguccaaccucaaaauggacgcugcacaacagacggcguccuccucggcaccacccaacuaagccccgucaauaucugcaccuuccgaggugacguaacccacauagcaggcagccgaaacuacacuaugaaccucgccucccucaacuggaacaacuacgacccuaccgaagaaauacccgcaccccuuggcacacccgacuucgucggaaaaauccaaggcguccucacacaaacaacaaaaggcgacggcucaacccgcggccacaaagccaccgucuacacaggcuccgcccccuucacccccaaacucggcuccguccaauucucuacagacaccgagaacgacuucgaaacccaccaagacaccaaauucacacccguaggcguuauacaagacgggggcaccacccaccgcaacgaaccacaacaauggguacucccaagcuacucaggccgcgacguaccaaacguccaccuagcccccgcgguugcccccacauuucccggcgaacaacucuuauucuuccgcucaaccaugccaggcugcuccggcuacccaaacauggaccucgacugucuacuaccccaagaauggguccaacacuuuuaccaagaagccgccccagcacagucagacguagcccuacuaagauucguaaacccagacaccggccgcguccuguuugaaugcaaauuacacaaauccggcuaugucaccgucgcccacaccggccaacacgaccucgucauaccacccaacgguuacuuccgauucgacagcugggucaaccaauucuacacuuuagcccccaugggcaacggcaccggccgccgacgcuag

SEQ ID NO: 38187 - RNA, 1617 nt, Artificial Sequence
  derived and/or modified sequence opt11 from VP1__Norovirus_and/or_Norovirus-like__KX371610
augaaaauggccucauccgaugcaaaccccuccgacggcuccgccgcaaaccucguacccgaaguaaacaacgaaguaauggcccuagaaccugucgucggcgccgccaucgccgcacccgucgccggccaacaaaacgugaucgaccccuggauccgcaacaacuucguacaagcacccggcggcgaguucaccguuucgccccgaaacgcaccaggagaaauacucugguccgccccacuaggccccgaucucaaccccuaccucucccaucuagcacgcauguacaacgguuacgccggcggcuucgaaguccaagucauacuugcaggaaacgccuucacggcuggaaaaguaaucuuugcagccguacccccaaacuuccccaccgaggguuuaucccccucccaagucacaauguucccacacaucgucgucgacguccgacaacucgaaccaguccuaauaccccuccccgacguccgcaacaacuucuaccacuauaaccaauccaacgauccgaccaucaaacuuaucgcuaugcuauacaccccacuaagagcaaacaaugccggcgacgacgucuucacaguaagcugccgcguccuuacacgacccucccccgacuucgacuuuaucuuccucguaccaccaaccguagaaucccgaaccaaacccuucucugucccaguacucaccgucgaagaaaugacaaacucccgcuuccccaucccccuagaaaaacuuuucaccggcccauccucggccuucgucguccaaccccaaaacggacgcugcaccaccgacggaguacuccuagggaccacccaacucucuccagucaacaucugcaccuuccgcggcgacguaacucacaucaccggcucccgcaacuacaccaugaaccucgccucccaaaauugguccaauuacgaccccaccgaagaaauacccgcaccccucggcacacccgauuucguaggcaaaauccaaggaguccuaacucaaacaacccgaaccgacggcuccacacguggccacaaagccaccguauacaccgguuccgccgacuucgccccaaaacuuggccgcguccaauucggcaccgacaccgaccacgacuucgaagccaaccaauccaccaaauucacaccagucggcguaauccaagacggauccaccacccaccgcaacgaaccccaacaguggguccucccuuccuacucuggaagaaacacccccaacguacaccuugcacccgccgucgccccuaccuuucccggcgaacaacuccuauucuuccggucaacuaugccaggaugcucuggauacccaaauauggaccucgacugccuacucccccaagaguggguccaauacuucuaccaagaagcagccccggcccaauccgacgucgcucuccuccgauucgucaacccugacacuggacgcguccucuucgaaugcaaacuacacaaauccggauacguaaccguagcccacacuggacaacaugaccuagugauacccccaaacggcuacuuccgauucgacuccugggucaaccaauuuuacacccucgcccccaugggcaacggcaccggccgccgacgcuaa

SEQ ID NO: 38188 - RNA, 1617 nt, Artificial Sequence
  derived and/or modified sequence opt11 from VP1__Norovirus_and/or_Norovirus-like__KX354031
augaaaauggccuccucagacgccaaccccuccgacggcucagcagccaaccucguccccgaagucaacaacgaagucauggcccuugaacccgucguuggcgccgcaaucgccgcacccgucgcuggccaacaaaacgucaucgaccccuggaucagaaacaacuucguccaagcccccggcggcgaguucaccguaucaccccgcaacgcccccggcgaaauccuaugguccgccccucuuggacccgaccucaaucccuaucucucccacuuagcacgcauguacaacggcuacgccggcggcuuugaaguucaaguaauccucgcagguaacgccuucacugcuggaaaagucauauuugccgcaguaccacccaacuuccccaccgaaggacucucccccucgcaagucaccauguucccucacaucgucguugacguccgucaacucgaacccguccuaauaccccuucccgacguccgcaacaacuuuuaucacuacaaccaauccaacgacccuaccaucaaacuuaucgccaugcucuacacuccccuacgcgcaaacaacgccggagacgacgucuucaccguaucuugucgaguccuaacacguccaucccccgacuucgacuuuaucuuccucguaccacccaccguagagucccguacgaaaccauucuccguccccguccucaccgucgaagaaaugaccaacucacgcuuucccaucccccucgaaaaacucuucaccggacccuccucagcauucgucguccaaccacaaaacgggcgcugcaccaccgacgguguccuacuaggcaccacccaacuaucccccgucaacauaugcaccuuccguggagacgucacccacaucacuggcucacgcaacuauaccaugaaucuagcaucacaaaacuggaacaacuacgacccaacugaagagaucccugcuccccuaggaacccccgacuucguuggcaaaauccaaggcguacucacacaaacaacccgcaccgacggauccacucgcggacacaaagccaccguauacacaggcuccgcagacuucgcccccaaacucggccguguccaauucggcacagacaccgaccacgacuucgaagccaaccaaaacacaaaauucacccccgucggcgucauccaggacgggucuaccacucaccgcaacgaaccccaacaguggguccuaccauccuacucaggccgcaacacccauaacguccaccuugcccccgcugucgccccaaccuuccccggcgaacaacuacucuucuuucgaucuaccaugccuggcugcucuggcuacccaaacauggaccucgacugcuuacuaccccaagaauggguccaauacuucuaccaagaagccgccccagcucaauccgacgucgcccuucuacgauucguuaaccccgacacuggccgaguccucuucgaaugcaaacuacacaaaucaggcuacgucacugucgcgcacacuggccaacacgaccuagucaucccacccaacggcuacuuccguuucgacagcuggguaaaccaauucuacacgcucgccccaauggguaauggcaccggacgccgccgcuaa

SEQ ID NO: 38189 - RNA, 1617 nt, Artificial Sequence
  derived and/or modified sequence opt11 from VP1__Norovirus_and/or_Norovirus-like__KX353990
augaaaauggccuccaacgacgcaaaccccagcgauggcuccacagcaaaccucguccccgaagucaacaacgaagucauggcccucgaacccguagucggcgccgccaucgccgcacccguagccggucaacaaaacgucaucgaccccuggauacgcaacaacuucguucaagcacccggcggcgaguucacagucagcccccgcaacgcuccuggagaaauccugugguccgcaccccuaggccccgaccucaacccuuaccucucccaccucgcccgcauguauaacggcuacgcgggcggcuucgaaguccaaguuauacucgccggaaacgccuucacggcaggcaaaaucaucuucgccgccgucccacccaacuuccccaccgaaggccuaucccccucccaaguuacaauguucccccacaucaucguagacguacgccaacucgaacccguccucauaccacuacccgacguaagaaauaacuucuaccacuacaaccaaucaaacgacccuacaaucaaacucaucgccaugcucuacacaccccuccgugcaaacaacgcaggcgacgacgucuucaccguaucaugcagaguucucacccggccaucccccgacuucgacuucaucuuccuaguaccacccaccguagaaucccgcaccaaaccuuucuccguacccgucuuaaccgucgaagaaaugacaaacucccgauuccccaucccccuagaaaaacuauucaccggccccuccagcgcauucgucguccaaccccaaaacggacgguguaccaccgacggugucuuacuaggcaccacacagcucucccccgucaacaucuguaccuuccgcggcgacguuacccacauugcgggaucucgcaacuacacaaugaaccuugcgucccaaaacuggaacucuuacgaccccacugaagaaauccccgcuccccuaggcacccccgacuucgucggcaaaauccaaggcguccucacccaaaccacccgaaccgacggauccacacgcggccacaaggccaccguauacaccgguucagcugacuucucaccaaaacuuggccgaguucaauucgccacagacacagacaacgacuucgaaaccaaucaaaacaccaaauuuacacccguaggagucauccaagacggcggcaccacccacagaaacgaaccucaacaauggguccuacccucauauuccggccgaaacacccauaacguccaucuagccccagccgucgccccuacauucccuggagaacaacuccuuuucuuucgguccacuaugcccggcugcucuggauaccccaacauggaucucgacugccuccucccccaggaauggguccaauacuucuaccaggaagcggccccagcccaauccgacguagcccuccuccgcuucgucaacccagacaccggccgcguacucuucgaaugcaaacuccacaaauccggcuacgucacugucgcccauaccggccaacacgaucucgucauaccaccaaacggcuacuuccgcuucgacuccuggguaaaccaauucuacacccucgcacccaugggcaacggaaccggcagacgacgauaa

SEQ ID NO: 38190 - RNA, 1617 nt, Artificial Sequence
  derived and/or modified sequence opt11 from VP1__Norovirus_and/or_Norovirus-like__KX353972
augaaaauggcaucgaacgacgccaauccaucagacggcuccaccgccaaccuagucccggaggucaauaacgaagucauggcccuagaacccgucguaggagcagccauagccgcaccgguagccggucaacaaaacgucauagaucccuggauucgaaacaauuucguccaagcccccggcggcgaguucaccgucucaccccgcaacgcacccggugaaauccucugguccgccccacucggccccgaccuuaacccauaccucucccaccucgcccgaauguauaacggcuacgccggcggcuucgaagugcaaguaauacucgccggaaacgcauucaccgccggcaaaaucaucuucgcagccgucccucccaacuuccccaccgaaggacucucccccagccaagucaccauguucccccacauaaucgucgacguucgccaacucgaacccgucuuaaucccacuuccagacguccgcaacaacuucuaccacuacaaccaauccaacgaccccaccauaaaacucaucgcuaugcuguacacaccccuacgcgcaaacaacgcaggggacgacgucuucaccgucuccugucgcguccucaccagaccuucacccgacuucgacuuuauauuccucgucccacccaccgucgaaucacgcaccaaacccuucuccguaccaguacuaaccgucgaagaaaugacaaacucccgcuuccccaucccucucgaaaaacucuucacaggcccaucguccgcguucguaguacaaccccaaaacggccgaugcaccacugacggaguacuccuuggcacgacccaauuaucacccguaaauaucuguaccuuccgcggcgauguuacucacauaaccggcagccgaaacuacaccaugaaccuggcaucacaaaacuggaacucauacgacccaaccgaagaaauccccgcaccacucggcacccccgacuucgucggcaaaauacaaggcguacucacacaaacaacacgcaccgacggcuccacacgaggacacaaagcaaccgucuacaccgguuccgccgacuucucaccaaaacucggccgcguacaauucgccacugacacagacaacgauuucgaaaccaaccaaaacacaaaauucacacccgucggcgucauacaagacggcggcaccacccaccgcaacgaaccccaacaguggguccuaccauccuacuccggaagaaacacccacaacguacaccuagccccagcagucgcaccaaccuucccuggcgaacaacuauuauucuuccgauccacaaugcccggcugcuccggcuacccuaacauggaccucgauugccuacucccacaagaguggguacaauacuucuaccaagaagccgccccagcccaauccgacguugcucuacuccgcuucgucaacccggacaccggcagaguccuauucgaaugcaaacuacacaagucaggcuacgucaccguagcccacacuggacagcacgaccuagucauaccacccaacggauacuuccgauucgacucuugggucaaccaauucuacacccuagcccccaugggaaacggcacaggccggcgccgauaa

SEQ ID NO: 38191 - RNA, 1617 nt, Artificial Sequence
  derived and/or modified sequence opt11 from VP1__Norovirus_and/or_Norovirus-like__KX353968
augaaaauggccuccaacgacgccaacccaucggauggaucugcagccaaccucguccccgaagucaacaacgaagucauggcccucgaacccgucgucggcgcagcaaucgccgcccccguagccggacaacaaaacguaaucgaccccuggauccgcaacaacuucguccaagcaccaggcggcgaguucaccgucucaccccgcaacgcacccggggaaauccucugguccgcaccccucggccccgaucucaaccccuaccucucccaccucgcccgcauguacaacggcuacgccggcgguuucgaaguacaagucauccucgcagguaacgcauucaccgccggcaaaauaaucuuugcugcggucccacccaacuuccccacagaaggccucucccccucucaagucaccauguucccccauauaaucgucgacguccgccaacucgaacccguccucauaccucuucccgacguccguaauaacuucuaccacuacaaccaauccaacgacucaaccaucaaacuaaucgcaaugcuauacacacccuuacgugccaacaacgccggcgacgacgucuucaccgugucgugccgcgugcucacccgccccucgcccgacuucgacuucaucuuccucgucccaccuaccgucgaaagccgaacuaagcccuuuacuguaccaauccuaaccguagaggaaaugaccaacucacgcuuccccauuccccuagaaaaauuauucacaggccccuccuccgccuucgucguccaaccacaaaacgguagaugcaccaccgacggcguccuacucggcacaacucaacucucgccagucaacauaugcaccuuucguggagacgucacacacaucgcaggaucccgcaacuacaccaugaaccucgccuccuuaaacuggaacaacuacgaccccaccgaagaaauccccgcuccccucggcaccccugacuucgucggcaaaauucaaggcguccucacccagacuaccaaaggcgacgguuccacccgaggacacaaagccacgguuuacaccgguuccgccgacuucaccccuaaacucggcucuguccaguucgccacagacaccgaaaacgacuucgaaacccaccaaaacacccgauucacccccguaggcguaauccaagauggcggcaccacccauagaaacgaaccccaacaauggguccuucccucauacucgggccgaaauauccacaacguacaccucgccccugcagucgcaccaaacuuccccggcgaacaacugcuauucuuccgcuccaccaugccaggcugcucaggcuaccccaacauggaccucgacugccuccuaccccaagaauggguucaacauuucuaucaagaagcugcccccgcccaaucagacguagcacuacuacgauucgucaaccccgauaccggccgaguacuauucgaauguaaacuccacaaaucaggauacgucaccguagcacacacaggccaacacgaccucguaauucccccaaacggauacuucagauucgacagcugggucaaccaauucuacacacucgcccccaugggcaacgguaccggacgccgacgauag

SEQ ID NO: 38192 - RNA, 1617 nt, Artificial Sequence
  derived and/or modified sequence opt11 from VP1__Norovirus_and/or_Norovirus-like__KX353967
augaaaauggccucgaacgacgcaaaccccucagacggauccgccgccaaccucguaccggaagucaacaacgaaguuauggcccuggaacccgucgucggcgcugcgaucgcagcccccguagcaggccaacaaaacgucaucgaccccuggauccgcaacaacuucguccaagcccccggcggcgaguucacagucuccccacgaaacgcccccggcgaaauacucuggagcgcuccccucggcccagaccucaacccauaccuaucccaccuagcccgcauguacaacgguuacgcaggcggcuuugaaguccaaguaauacucgccggcaacgcauucaccgcaggcaaaaucaucuucgcagccguuccacccaacuuccccaccgaaggccuaucacccucccaggucaccauguucccccacauuaucguugacguuagacaacucgaaccaguccucaucccucucccagacguccggaacaacuucuaccacuacaaucaauccaacgacuccacaaucaaacucauagccaugcuauauacaccccuccgagccaacaacgcaggcgacgacgucuucacaguauccugccgcguccucacacgcccaucaccagacuucgacuucaucuuccuagucccgcccaccgucgaaucccgcaccaaaccauucacaguccccauccucaccgucgaagaaaugaccaauagccgauuccccauaccccucgaaaaacuuuucaccggccccucauccgcauucgucguucaaccccaaaacggccgcugcaccaccgacggcguccuccucggcacaacacaacucucccccgucaacaucugcaccuuccgcggcgacguuacccacaucgcaggcucucgcaacuacacuaugaaccucgcaucccucaacuggaacaacuacgacccuaccgaagaaauccccgcaccccucggcacacccgacuucgucggcaaaauacaagguguucugacacaaacaaccaaaggcgacggauccacccgcggccacaaagcaacaguuuacacaggauccgcggacuucacccccaaacuaggcuccguccaauucgccaccgacaccgaaaacgacuucgaaacccaccaaaacacccgcuucacuccaguaggagucauccaagacggaggcaccacccaccggaaugaaccacaacaauggguccucccauccuauagcggcagaaacauacacaacguacacuuagcccccgccgucgcccccaacuuccccggcgaacaacuacuauucuuccgcuccaccaugcccggcugcucaggauaccccaacguagaucucgacugccuccuaccccaagaauggguccaacacuucuaccaggaagccgcccccgcacaaucagaugucgcccuccugcgcuuuguaaacccagacaccggacgaguccuauucgaaugcaaacuacacaaauccgguuacguaaccgucgcccacacaggccagcaugaccucguaaucccaccuaacgguuauuuccgcuucgacucauggguaaaccaauucuacaccuuagccccaaugggcaacggcacaggccgccgaagauaa

SEQ ID NO: 38193 - RNA, 1617 nt, Artificial Sequence
  derived and/or modified sequence opt11 from VP1__Norovirus_and/or_Norovirus-like__KX353966
augaaaauggcuuccaacgacgccaaccccuccgacggcucagcagccaaccucgucccggaagucaacaacgaagucauggcccuagaaccugucgucggcgccgccauagcagcccccgucgccggucaacaaaacguaaucgaccccuggauccgaaacaacuucguccaggcucccggcggagaguucaccgucucaccccgcaacgcaccuggagaaauccucugguccgcaccccucggcccugaccucaacccuuaccuuucacaccucgcccgaauguauaacggauacgccggaggcuucgaaguccaagucauccuugccggcaacgcuuuuacagccggaaagaucaucuucgccgccguucccccaaacuuucccaccgaaggccuauccccuucucaaauaaccauguucccacacauaauugucgacguacgacagcuagaacccguccuaaucccccuccccgacguccgaaauaacuucuaccacuacaaccaguccaacgacuccaccauaaaacuaaucgccaugcuguauacaccccuacgcgccaacaacgccggugacgacgucuucaccguuucuugucguguucuaacacgaccaucacccgacuucgacuucauauuccucgucccacccacaguagaaucccgcaccaaacccuucaccguccccauccucaccguagaagaaaugaccaacucccgcuuccccauaccccucgaacgccucuucacaggaccaucauccgcauucgucguucaaccgcaaaauggccggugcacaacagacggaguccuucucggaaccacccaacuaucaccagucaacaucugcacauuccgcggugacguaaaccacaucgccggcucccgcaacuacaccaugaaccucgcaucacuaaacuggaacaacuacgaccccaccgaagagacccccgcuccccucggaacucccgacuuugucggcaaaauccaaggaguccuaacccaaacuacccgcggcaacggcuccacccgaggccaccgcgccaccgucuacaccggauccgccgauuucacccccaaacuuggacguauccaauucgcaaccgacaccgacaacgacuucgaaacccaccaaaacaccaaguucaccccagugggagucauccaagauggcaacaccacccaccgaaacgaaccccaacaauggguccuacccucauacucaggccgaaacguccagaacguacaccucgcccccgccgucgcccccaacuucccaggcgagcaacuccucuuuuuccgcucuaccaugccaggcugcuccggcuacccaaacauggaccucgacugccuucucccccaggaauggguccaacacuucuaccaagaagcagcaccagcccaauccgacguagcacuccuucgcuucgucaaccccgacaccggccguguccuauucgaaugcaaacuccacaaaucaggcuucguaacuguagcccacaccggccaacacgaccuagucauaccacccaacggcuacuucagauucgacuccuggguaaaccaauucuacacucuagcccccaugggaaaaggcacaggucgccggcgauaa

SEQ ID NO: 38194 - RNA, 1617 nt, Artificial Sequence
  derived and/or modified sequence opt11 from VP1__Norovirus_and/or_Norovirus-like__AB663684
augaaaauggcuucaaacgacgcuaaccccuccgacggcuccgccgccaaccucgucccagaagucaacaacgaaguaauggcacucgaacccguugucggugccgcaauugcggcaccagucgccggccaacaaaacgucaucgaccccuggauccgcaacaacuucguacaagcccccggcggcgaauuuacugucuccccacgaaacgccccgggagaaauccucugguccgcaccccucggcccagaccucaaccccuacuuaucccacuuagcacgcauguacaacggcuacgcaggcggcuucgaaguacaagucauccucgcaggcaacgcauuuaccgccggaaaaauaauauucgcagcuguaccacccaacuuccccaccgaaggucucucccccucgcaagucaccauguucccccacaucaucgucgacguucgccaacucgaaccuguccucaucccccuacccgacguccgaaacaauuucuaucacuacaaccaauccaacgacuccaccauaaaacucaucgccaugcucuacacaccccugcgugccaacaacgccggagaagacgucuucaccgucagcugccgcguccucacccgcccuucuccugacuuugacuucauuuuccucgucccgcccaccgucgaaucacgcaccaaacccuucaccguccccauucucacagucgaagaaaugaccaacucccgcuuccccaucccucuagaaaaacucuuuacuggccccuccucagcuuucgucguccaaccccaaaacggccgcugcaccacagacggcguccuccucggaaccacccaacucagccccgucaacaucugcaccuuccgcggggacgucacacacauagccggcucccgcaacuacacaaugaaccuagcuucccucaacuggaacaacuacgacccaaccgaagaaauccccgccccacucggcacccccgacuucgucggaaaaauccaaggcguccucacccaaacaacaaaaggcgauggcuccacacgcggccacaaagccaccguauacacaggcuccgcucccuucacccccaaacucggcuccguacaauucucaaccgacaccgaaaacgacuucgaaacccaccaaaacaccaaauuuaccccagucggcgucauucaagacgguggcaccacccacagaaacgaaccucaacaauggguccuaccaucauauucaggacgaaacguccccaacguacaccuagccccagccgucgcucccacauuucccggagaacaacuacuguucuuuagaucuaccaugcccgguugcucuggcuaccccaacauggaccucgacugccuccucccacaggaauggguacaacacuucuaccaagaagcagcccccgcacaauccgacguagcccuacuccguuucguuaaucccgacaccggacguguccuuuucgaaugcaaacuucauaaaucaggcuacgucacugucgcccauaccggccagcacgaccucguaaucccucccaacggauacuuccgguucgauuccuggguaaaccaauuuuacacacucgcacccaugggcaacggcaccggccgacgccguuaa

SEQ ID NO: 38195 - RNA, 1617 nt, Artificial Sequence
  derived and/or modified sequence opt11 from VP1__Norovirus_and/or_Norovirus-like__KR904209
augaaaauggccuccuccgacgccaaccccucugauggcuccaccgcaaaccuagucccagaaguaaauaacgaagucauggcauuagagcccgucguaggagccgcaauagccgccccuguugccggccaacaaaacguaaucgaccccuggauccguaacaacuuuguucaagcccccggcggagaguucacagucucaccccgcaacgcucccggcgaaauccucugguccgcaccacuaggacccgaccucaacccuuaccuaucccaccucgcacgaauguacaauggcuacgccggcggcuucgaaguccaaguaauacuagccggcaacgcuuucacugccgguaaaaucaucuucgcagcagucccucccaacuuccccaccgaaggccucucacccucacaggucaccauguucccucacaucauaguugacguccgccaacucgaacccguccucauaccccucccagacguaagaaauaacuucuaccacuacaaccaauccaacgauccaaccaucaaacuaaucgcaaugcucuacacuccccuccgcgccaacaaugccggcgacgacguuuucaccgucucaugccgaguccucacccgucccuccccagauuucgacuucauauuucucguacccccaaccgucgaaucucgaaccaaacccuucucuguccccauccuaaccgucgaagaaaugaccaacucccgauucccaaucccacucgagaagcuauucaccggccccuccucugccuucguaguacaaccccaaaacggccgcuguacaaccgacggcguccuccucggcaccacccaacucucccccguaaacaucugcacuuuccgcggcgacgucacacacaucgccggcucccauaacuacaccaugaaccucgccucccaaaacuggaacuccuacgacccaaccgaagaaauacccgcaccccucggcaccccugacuuugucggcaaaauccaaggcguccuaacacaaaccacaagagccgacggcuccacccgcggucacaaagccacaguauacaccggcucagccgacuucucaccaaaacuugggcgcguccaauucgccaccgacaccaacaaugauuucgacgccaaccaaaacaccaaguucacccccguaggcgucauccaagacggcgaaacugcccaucguaacgaaccccaacaguggguccuucccuccuacuccggccgcaacauacacaacguccaccucgcccccgccgucgcaccaaccuucccaggcgaacaacuucucuucuuccgguccaccaugcccgguugcagcggcuaucccaauauggagcuugacugccucaucccccaagaaugggugcaauacuucuaucaagaagccgcccccgcacaauccgacguagcucuccuccgcuucgucaacccagacaccggccgcguccucuucgaaugcaaacuccacaaauccgguuacgucaccguugcccacaccggacagcaugaucuaguaaucccucccaacggauacuuccgcuucgacucgugggucaaucaauucuacacacucgcacccaugggcaacggcaccggccgucgccgcuaa

SEQ ID NO: 38196 - RNA, 1617 nt, Artificial Sequence
  derived and/or modified sequence opt11 from VP1__Norovirus_and/or_Norovirus-like__AB933716
augaagauggcaucaaaugacgcuaaccccucugacggcucagcagccaaccucgucccagaagucaacaaugaaguaauggcacuagaacccguagucggcgccgcaaucgccgcccccgucgcuggccaacaaaacguuaucgacccuuggauccgcaacaacuucguccaggccccaggcggcgaguucaccgucucgccacgaaacgccccaggggaaaucuuaugguccgccccacuaggccccgaccuaaacccuuaccucucacaccucgcccgcauguacaacggcuacgccggcggcuucgaaguacaagucauccucgcgggcaacgccuucaccgccggcaaaauaauauucgcagccgucccacccaacuuccccacagaaggccucucccccucacaagucaccauguucccccacaucaucgucgacguacgacaacucgagcccguccucaucccgcuccccgacguccgaaacaauuucuaccacuacaaccaaucaaacgacuccaccaucaaacucauugcaaugcucuacacaccccuacgagccaacaacgccggcgaagaugucuucaccguaagcugucgcguucuaacacgccccucccccgacuuugacuuuaucuuucucgucccacccaccguggaaagccgaacaaaaccauucaccgucccaauccucacaguugaagaaaugaccaacucucgauuccccaucccccucgaaaaacucuucaccggacccucaagcgccuucgucguccaaccacagaacggacgaugcaccaccgacggcguacuacuaggaaccacccaacuaagccccguuaacaucugcaccuuccguggcgacguaacccacaucgccgguucccgaaacuacaccaugaaccucgccucuuuaaacuggaacaacuacgauccuaccgaagaaguccccgcaccccucggcaccccugacuucgucggaaaaauccaagggguacuaacccagaccaccaaaggcgacggcuccacgcgaggccacaaagccacagucuacaccggcucggccccauucacacccaaacuaggcuccguccaauuuucaaccgacaccgaaaacgauuucgagacccaccaaaacaccaaauucacgccagucggcguaauccaagacggcuccaccacacaccguaacgaaccccaacaauggguacucccuagcuacuccggacgcgacguccccaacguccaccuagccccagccgucgccccaaccuuccccggagaacagcuccucuucuuccgcuccacgaugccaggcugcuccggcuaccccaacauggaucucgacugccuucucccacaagaauggguccaacacuucuaccaagaggcagcccccgcacaaagcgacguagcucuccuccgauucgucaacccagacacuggacgcguccucuucgaaugcaaacuccauaaauccggcuacgucacaguugcccacacaggccaacacgaccucgucaucccacccaacggauacuuccgcuucgacagcugggugaaccaauucuacacucucgcccccaugggcaacggaaccggccgacgccguuaa

SEQ ID NO: 38197 - RNA, 1617 nt, Artificial Sequence
  derived and/or modified sequence opt11 from VP1__Norovirus_and/or_Norovirus-like__AB933666
augaaaauggcuuccaacgacgcaaaccccagcgacggaucugccgcaaaucugguacccgaagucaacaacgaaguaauggcccucgaacccguugucggcgccgccaucgccgcccccguagccggccagcaaaacguaaucgacccguggauucgcaacaacuucguccaagcucccggaggcgaauuuaccgucuccccacgaaacgcaccaggcgaaauccuauggucggcaccccuaggccccgaucuaaaccccuaccucucacaccuagccagaauguauaacggcuacgccggcggcuucgaaguccaaguaauccucgccggaaacgccuucaccgccggaaaaaucaucuucgccgccgucccacccaacuuccccacagaaggccuaucccccucccaaguaaccauguucccccacaucaucgucgauguacgacagcuagagcccguccucauaccacuccccgacguccgcaacaacuucuaucacuacaaccaauccaacgacagcacaaucaaacuaauugcaauguuauacacaccccuccgcgccaacaacgcuggcgaagacgucuucaccguuuccugccgcguucuaaccagaccauccccugacuucgacuuuauauuucucguucccccuaccguagaaucacgaaccaaaccauucacaguacccauacuaacggucgaagagaugaccaacucccgauucccaaucccccuagaaaaacucuucaccggccccuccagcgccuucgucgugcaaccacagaacggccguugcacaaccgacggaguccuccucggcaccacucaacuauccccagucaacaucugcaccuuccguggagacguaacccacauagcaggcucccgcaacuacaccaugaaccuagcaucacucaacuggaacaacuacgaccccacggaagaaauacccgcaccacucggcaccccagacuucgucggcaaaauccaaggcguacuuacacaaacaaccaaaggagacggaagcacccgcggacacaaagccacagucuauaccggcuccgcaccauucacccccaagcucggcagcguccaauucuccaccgacaccgagaacgauuucgaaacacaccaagauacaaaauucacucccgucggcguuauccaagauggcggcacaacccaccgcaacgaaccacaacaauggguacuccccucauacuccggccgaaacguuccuaacguacaccucgcccccgcagucgcacccaccuuccccggcgaacaacuacuuuucuuccgcucaaccaugcccggcugcucaggcuaucccaacauggaucucgacugccuccuaccccaagaauggguccaacacuuuuaccaagaagcggccccagcccaauccgacgucgccuuacuccgcuucgucaaccccgacaccggccgcguccuauucgaaugcaaacugcacaaauccggauacgucaccguagcacacacaggccaacaugaccuagucaucccacccaacggcuacuuccgcuucgacagcugggucaaccaauucuacacccucgcacccaugggaaacggcaccggccgccgaagauaa

SEQ ID NO: 38198 - RNA, 1617 nt, Artificial Sequence
  derived and/or modified sequence opt11 from VP1__Norovirus_and/or_Norovirus-like__EU921349
augaaaauggcaagcucagacgcaaacccaagcgacggauccaccgccaaccuuguccccgaagucaacaacgaaguaauggcccucgaacccgucgugggcgccgccaucgccgccccggucgcaggccaacaaaacgucaucgaccccuggauccgcaacaacuucguccaagcccccggcggagaguucaccguaagcccccgcaaugcacccggagaaauccuguggucagccccacuaggccccgaccucaaccccuaccuaucacaccucgcccgcauguauaacggcuacgccggaggcuucgaaguacaagucauccucgcaggaaacgccuuuaccgccggaaaaaucaucuucgccgcugucccaccaaauuuucccaccgaaggccuaucccccucccaaguaacuauguucccucacaucaucgucgaugucagacaacuagaacccguccucauaccacuccccgacguccgaaacaacuucuaucauuacaaccaauccaacgacccaaccaucaaacuuaucgcaaugcucuacaccccacuccgcgccaacaacgccggagacgacgucuucaccgucuccugccgcguacucacucgaccuucuccagauuucgacuucaucuuccucguacccccaacagucgaaucacggaccaaaccuuuuucaguccccauacucaccgucgaagaaaugaccaacucccgguuccccauaccccucgaacgccucuucaccggucccucauccgccuucgucguacagccccaaaacggacggugcacaaccgacggaguccuccucggcaccacccaacucuccccagucaacaucugcaccuuccgaggagacguaacccacauugcgggcacacaagaauacaccaugaaucucgcaucccaaaacuggaacaacuacgaccccacggaagaaaucccggcaccacucgguacacccgacuucgucggcaaaauccaaggaguccuaacacaaaccacgcgccgugacggaucaacccgcggacacaaagccacagucagcaccggcagcguccacuuuaccccaaaacucggccgcauccaauucuccaccgauaccuccaacgacuucgaaacaggccaaaauacccgcuucacacccgucggcguaguccaagacggcuccaccacccaccaaaacgaaccccaacaguggguacucccugacuacuccggccgcgacucccacaacguacaccuagcccccgccguugcgcccuccuucccaggcgaacaacuucucuucuuccgauccaccaugcccggcugcucaggcuaucccaacaugaaccucgacugccuacuaccccaagaauggguccaacacuucuaccaagaagccgcccccgcccaaucagacgucgcccuccuccguuucgucaaccccgacacaggccgaguccuauucgagugcaagcuacacaaauccggcuacgucacagucgcucacaccggccaacacgaccuagucauucccccaaauggauacuuccgcuucgacuccugggucaaccaauucuacacccuagcucccaugggcaacggcaccggccgccgucgauag

SEQ ID NO: 38199 - RNA, 1617 nt, Artificial Sequence
  derived and/or modified sequence opt11 from VP1__Norovirus_and/or_Norovirus-like__EU921348
augaaaauggccucaucagacgccaacccaucagacggcucaaccgccaaccucguccccgagguaaacaacgaagucauggcacuugaacccgucgucggcgccgccauagccgcccccguagcaggacaacaaaacgucauagaccccuggauccgcaacaacuuuguccaagccccaggcggcgaguucaccguaucaccucgaaacgccccaggagaaauccucugguccgcaccccugggacccgaccucaacccauaccucucccaccucgcccguauguacaacggcuacgcaggcggauuugaaguccaagucauccucgcaggcaacgcauucaccgccggcaaaaucaucuucgccgcagucccaccaaacuucccuaccgaaggccucuccccaucccaagucaccauguucccccacaucaucgucgacguacgacaacuagaacccguccucaucccacuuccugacguccgaaacaacuucuaccacuacaaccaaucgaacgacccaaccaucaaacuaauagccaugcuauacaccccacuccgcgccaacaacgccggugacgacgucuucaccgucuccugccgcguccuaacccgcccuucccccgauuucgacuucaucuuccucgucccaccgaccguagaaucacgcacaaaacccuucuccguucccauccuaaccguagaagaaaugaccaacucuagauuccccauaccccuagaacgacuauucaccggucccuccuccgccuucgugguacagccacagaacggacgaugcacaacagacggaguccuccucggcaccacccaacuuucaccaguaaacaucugcaccuucagaggcgacguaacccauaucgccggcacacaagaauacaccaugaaccucgccucucaaaacuggaacaacuacgaccccaccgaagaaaucccagcaccccucggcaccccagacuucgucggaaagauccaaggcguacuaacccagaccacccgccgcgacggauccacacgcggccacaaagccaccgucucuaccggcucagucaacuucacacccaaacucggccggauccaauucuccaccgacaccucgaaugacuucgaaaccggacaaaacacccgcuuuacucccguugggguagugcaagacgguagcaccacacaccaaaacgaaccucaacaauggguccuccccgacuacuccggccgagacucacauaacguacaccuagcccccgccguagcccccucauucccaggugaacaacuccucuucuuccguucaacaaugcccggaugcuccggauaccccaacaugaaccuagacugcuuacuaccacaagaauggguccaacauuucuaucaagaagcugccccagcccaauccgacgucgcucuccuccguuucgucaacccggacaccggacgcguccuauucgaauguaaacuacacaaauccggcuacgucaccguagcccacaccggacaacacgaccuagugauacccccaaacggauacuuccgcuucgacucauggguaaaccaauucuacacccuagcccccaugggcaacggaacaggccgccgacgauaa

SEQ ID NO: 38200 - RNA, 1617 nt, Artificial Sequence
  derived and/or modified sequence opt11 from VP1__Norovirus_and/or_Norovirus-like__EU921345
augaaaauggccucuuccgaugccaaccccuccgacggcagcaccgccaaccucgucccagaagucaacaacgaagucauggcccucgaacccgucgucggcgccgcaaucgcagccccaguggcaggccaacaaaacgucaucgauccuuggauccgcaacaacuucguccaagccccuggcggugaguucaccgucuccccacgcaacgcccccggagaaaucuuaugguccgcaccacucggccccgaccucaaccccuaucucucccaccuugcgcgcauguauaacgguuacgccggcgguuucgaaguccaagucauccucgccggcaacgcauucaccgcuggaaaaaucauauuugccgcagucccaccaaacuuccccaccgaaggauuaucccccucccaaguaacaauguucccacacaucaucguagacguacgccaacucgaaccaguccucauacccuugccagacguccgcaacaacuucuaccacuacaaccaaucaaacgaccccaccauuaaacucaucgccaugcucuacacaccccuccgagccaacaaugcuggugacgacguuuucaccguauccugcaggguucuaacacgccccuccccagacuucgacuucaucuuccuaguacccccaacagucgaaucccgcacaaaacccuuuucaguaccuauccucacagucgaagaaaugaccaacucccgcuuccccaucccccucgaacgccuauucaccgguccuucauccgccuucgucguacaaccacaaaacggccgauguaccaccgacggaguacuucucggcacuacccaacuaucacccgucaacaucugcacauucagaggcgacguuacccacaucgccggaacccaagaauacacaaugaaucucgcaucacagaacuggaacaauuacgaccccacagaagaaauucccgcaccccucggcaccccugacuucguuggaaaaauccaagguguccucacucaaaccaccagacgagacggcuccacccgcggccacaaagccaccguauccaccggcuccguacauuucacccccaaacuuggaagaauacaauucuccacagauaccuccaacgacuucgagaccggccaaaacacacguuucacacccgucggugucguccaagacggcuccaccacacaucaaaacgaaccucaacaauggguccuacccgacuacuccgguagagauggacacaauguacaccucgcccccgccgucgcccccucauuccccggcgaacagcuccuguucuuccgcuccaccaugccaggcugcucaggcuaccccaauaugaaccucgacugccuccuaccccaagaauggguccaacacuucuaccaagaagccgccccagcccaaucagacgucgcccuccuccgcuucguuaacccugacaccggacgaguccucuucgagugcaaacuacacaaauccgguuacgucaccguagcacacacaggccagcacgaccucguuauacccccaaacggcuacuuccgcuucgacuccugggugaaccaauucuacacccuugcccccaugggaaacggaacuggccgcagacgauaa

SEQ ID NO: 38201 - RNA, 1617 nt, Artificial Sequence
  derived and/or modified sequence opt11 from VP1__Norovirus_and/or_Norovirus-like__KP698924
augaagauggccuccucagaugcaaaccccucagauggauccgcagccaaccucguaccggaagucaacaacgaagucauggcccucgaaccuguuguaggcgcagccaucgccgcccccgucgccggacaacaaaacguaaucgacccuuggauccgcaacaacuucguccaagcccccggcggagaguucaccgucucaccgcgcaacgcccccggagaaauacucugguccgccccucugggcccagaccuaaaccccuaccuaucccaccucgcccgaauguacaacggauacgcaggaggcuucgaaguacaaguaauccucgccggcaacgccuucaccgcaggcaaagucauauucgccgcagucccucccaacuuccccaccgaaggucuaucccccucccaaguaaccauguucccacacauaguaguagacguccgacaacuagaaccaguacucauaccccuccccgacguccgcaauaacuucuaccauuacaaccaauccaacgaccccaccauaaaacugaucgccaugcuuuacaccccacuccgcgccaacaaugcuggagacgacgucuucaccguuagcugccgaguccuaacccgccccucccccgacuucgacuucaucuuccucgucccacccaccgucgaaucgcguaccaaacccuucuccguucccguccuaacaguagaagaaaugacaaauucccgcuuccccaucccccuagaaaaacucuucaccggccccuccuccgccuucguaguccaaccacaaaacgggcgcuguacaaccgacggcguucuccuugguacaacccaacucuccccagucaauauaugcaccuuccgcggagacguaacccacauaaccggcucccacaacuacaccaugaaccucgcuucccaaaacugguccaacuacgaucccaccgaagaaauucccgcaccacuaggcauccccgacuucgucggcaaaauccaaggaguccucacccaaacaacucgcacugacggaucaacccgcggccacaaagccaccgucuacacaggauccgccgacuucgcacccaaacuaggccgaguccaauucgaaacagacaccaaccacgacuucgaagccaaccaaaacaccaaauuuacccccguaggagucauacaagacggaggaaccacucaccguaacgaaccccaacaauggguccucccuuccuacuccggccgcaauacccccaacguacaccuugccccagccgucgcccccacauuccccggggaacaacuauuauucuuucgcucaacaaugcccggcugcucuggauacccaaacauggaccuggacugccuccucccucaggaauggguccaacacuuuuaccaagaagccgccccagcccaauccgacguagccuuacuccgcuucgucaacccagacacuggucgcguacuuuucgaaugcaaacuccacaaaucagguuaugucacagucgcccacacaggccaacacgaccugguuaucccgcccaacggcuauuuucgcuucgacucaugggucaaccaauucuacacccuagcuccuaugggcaacggcaccggcagacgccgauaa

SEQ ID NO: 38202 - RNA, 1617 nt, Artificial Sequence
  derived and/or modified sequence opt11 from VP1__Norovirus_and/or_Norovirus-like__LC005707
augaaaauggcaagcaacgacgcaucccccucagacggcuccgccgcaaaccuuguaccagaaguuaacaacgaagucauggcucuugaaccugucguuggagccgccauagcggcacccgucgccggccaacaaaacgucaucgacccguggauacgaaacaacuucguacaagccccuggcggagaguucacugucucaccccguaacgcaccaggcgaaauccuuuggagcgccccucuuggccccgaccucaaccccuaccucucacauuuagcccgaauguacaacggauacgccggaggcuucgaaguacaaguaauacucgcaggcaacgccuucaccgcaggcaaaauaaucuucgccgccgucccacccaacuuccccacagaaggacucucccccucccaagucaccauguucccccacauaaucgucgacguucgacaacucgaaccaguccucaucccccucccagacguccgaaacaacuucuaccacuacaaucaauccaacgacagcaccaucaaacucaucgccaugcucuacacaccccuccgagccaacaacgccggcgaagaugucuucacagucuccugcagaguacuaacccgucccuccccagacuucgacuucauauuccuaguaccaccaaccguagaauccagaaccaaacccuucacaguaccuauccucaccgucgaagaaaugacaaacagcagauucccaaucccacucgaaaaacucuucaccggccccuccggcgcauuugucguccaaccacaaaacggacgcugcacaaccgacggcguccuccucggcaccacacaacucucacccgucaacauaugcaccuuucggggcgacgucacgcauauagccggcucccguaacuacaccaugaaccucgcagcccucaacuggaacaacuacgaccccaccgaagaaaucccagcaccccuaggcacacccgacuucguaggaaaaauccaaggcguccucacccaaacaacaaaagccgauggauccacacgaggccacaaagccaccgucuacaccggaagcgccgacuucacacccaaacuugguucaguccaauucuccaccgacaccgaaaacgacuuugaaacccaccaaaacacuaaauucaccccagugggagucauccaggacggcucaaccacgcaccgcaacgaaccccaacaauggguccuccccucauacuccggacgcaacguccacaacguacaccuagcucccgcagucgcccccacauucccaggagaacaacuacucuucuuucgaucaaccaugccuggcugcucaggcuaccccaacauggaccuagacugccuacucccccaagaauggguccaacacuucuaccaagaagcugcaccagcccaauccgacguagcccuccuccgcuucgucaauccagaccaaggacgaguccucuucgaaugcaagcuccauaaaucaggauacguaaccgucgcccacaccggccaacacgaccucgucauuccaccaaacggcuauuuccgauucgacucauggguaaaucaauucuacacccuggcaccgaugggcaacggcacaggccgccgacgauaa

SEQ ID NO: 38203 - RNA, 1617 nt, Artificial Sequence
  derived and/or modified sequence opt11 from VP1__Norovirus_and/or_Norovirus-like__KJ541743
augaaaauggccuccaacgacgcuaacccuucagacggauccgcagccaaucuaguccccgagguaaacaacgaaguaauggcccucgaaccaguagucggagcagcaaucgcagcccccguagccggccaacaaaacgugauagacccuuggauccgcaacaacuucguccaagcccccggcggcgaguucaccgucucaccccgaaacgccccaggugaaauccuaugguccgcaccccuaggcccugaccucaaccccuaccuaucacaccuugcccguauguacaacggcuacgccgggggcuucgaaguucaagucauccucgcaggcaaugccuucaccgcaggcaaaauaaucuucgccgccgucccaccaaacuuccccaccgaaggccuuagccccucucaaguaacaauguucccccacaucaucguagacguccgccaacucgaacccguacucauuccacuccccgacguccgcaacaacuucuaccacuacaaccaauccaacgacuccacaauaaaacucaucgcaaugcucuacacgccccuccgagccaacaacgcaggagaagacgucuucaccgucagcugccggguacuaacccgaccaucuccagacuucgacuucaucuuccucguacccccaaccgucgaaagccgaacaaaaccauucaccguccccauacucaccguagaagaaaugaccaacucccgcuuccccaucccccucgaaaaacuauucacgggacccagcucagccuucguaguacaaccgcaaaauggccgaugcacaacugacggcguccugcuaggcaccacacaacuaucaccagucaacaucugcacauuccgcggcgacguaacccauauagccggaucccgaaacuacacaaugaaccucgccucacuuaauuggaacaacuacgaccccaccgaagaaauccccgcgccccucggcacccccgauuuuguaggaaaaauucaaggaguacuuacgcagaccacaaagggugacggcucaacccgcggccacaaagccaccguauacacagguucagcccccuucacacccaaacucgguucaguucaauucuccaccgacacugaaaaugacuucgaaacccaccaaaacacaaaguucacuccggucggagucauccaggacggagguaccacccaccgcaacgaaccccagcaauggguccuacccuccuacuccggccgaaacguccacaacguccaccuagcccccgccguggccccaaccuuccccggcgaacaacuccucuucuuccgcucuacaaugcccggcugcuccggauacccgaauauggaccuagacugccucuuaccgcaggaauggguccaacauuucuaccaagaagccgcacccgcccaaucagacguagcccuucuucgcuucgucaaccccgauaccggccgcguccucuucgaaugcaaacuccacaaaucaggauacgucaccgucgcccacacaggucaacacgaccucgucaucccacccaacggauacuuccgcuucgacuccuggguaaaccaauucuacacccucgcccccaugggcaacggcaccggccgacgcagauaa

SEQ ID NO: 38204 - RNA, 1617 nt, Artificial Sequence
  derived and/or modified sequence opt11 from VP1__Norovirus_and/or_Norovirus-like__KF177443
augaaaauggccuccuccgacgccaauccaagcgacgguuccgcagccaaccucgucccagaaguaaacaacgaagucauggcccuugaacccgucgucggcgccgccaucgccgcccccgucgccggccaacagaacgucaucgaucccuggaucagaaacaacuucguccaagcccccggcggagaguucaccgucucuccacgaaacgcacccggggaaauacucugguccgccccauuaggccccgaucucaaucccuaccuaucccaccuagcccgaauguacaacggauacgccggcggcuucgaaguccaagucauacuugccggcaacgccuucaccgccggcaaaguaauauucgccgccgucccacccaacuuccccaccgaaggccucuccccaucccaaguaaccauguucccccacaucguuguagacguccgccaacuugaaccaguccucauaccccuacccgacguacgaaacaacuucuaucacuauaaccaaagcaacgaccccaccaucaaacuaaucgccaugcuuuacaccccucuccgagccaacaacgccggcgacgacguuuucacugucucaugccgaguccucacccgcccuucaccagacuucgacuucaucuuccucgucccacccacagucgaaucccgcaccaaacccuucucaguccccguacucacagucgaagaaaugaccaacucccgauuccccaucccccuggagaaauuauucacgggccccuccagcgccuucgugguccaaccucaaaacggccgauguaccaccgacggcguacugcucggaaccacacaacuuucacccgucaacaucugcacuuuccgaggcgacgucacacacaucaccggcucacgaaauuacacuaugaaccucgcaucacaaaacuggaacaacuacgaccccacagaggaaaucccagcacccuuaggcacccccgacuucgucggcaaaauacaaggcguacuaacacaaaccacccguacagacggaucgacccgcggccacaaagccacaguauacacaggcuccgcagacuucgcccccaagcugggacgcguccaauucggcaccgacacagaccacgacuucgaagccaaucagaacaccaaauucacaccaguaggcguuauacaagacggcuccaccacccaucgaaacgaaccccagcaauggguccucccauccuacuccggaaggaacaccccuaauguccacuuagcucccgcagucgcaccuaccuucccuggcgaacaacuccuauucuuccgcuccaccaugcccggaugcuccggcuaccccaacauggaccucgacugccuacuuccucaagaauggguccaauauuucuaucaggaagccgcccccgcccaaucagacguagcacuccuacgcuucgucaaccccgauaccggacgcguccucuucgaauguaaauuacacaaauccggcuacguaaccgucgcacacaccggccaacacgaccuaguaaucccaccuaaugguuacuuccgauucgacuccuggguaaaccaauucuacacccucgcucccaugggaaacggcaccggccgccgccgauaa

SEQ ID NO: 38205 - RNA, 1617 nt, Artificial Sequence
  derived and/or modified sequence opt11 from VP1__Norovirus_and/or_Norovirus-like__JX439842
augaaaauggccucauccgacgccaaccccagcgacggcuccgcagccaaccuuguccccgaagucaacaacgaaguaauggcucuugaacccguaguaggcgcagccaucgccgcaccuguugccggccaacaaaacguaaucgacccauggaucagaaacaacuucguccaagcccccggcggagaguucaccgucagcccacgaaaugcuccuggcgaaaucuuaugguccgcaccccuuggccccgaccucaaucccuaccuaucccaccucgcccgcauguauaacggauacgccggcggauucgaaguccaagucauccucgcgggcaacgccuucacagcugggaaaaucauuuuugccgccguacccccaaacuuccccacagaaggccuaucccccucacaaguaaccauguucccccacauuaucgucgacguccgacaacucgaacccguccucaucccauuaccagacguccgaaacaacuucuaccacuacaaccaauccaacgacucaaccaucaaauugaucgccaugcucuacacaccccuccgcgcgaacaacgccggcgaagauguauucaccgucuccugccgaguccucacccgaccuucccccgacuucgacuucauauuccucguaccucccaccgucgaaucacgaaccaaaccauucaccguucccauucucaccgucgaagaaaugaccaacucccgcuuccccaucccccuagaaaaacuauucacaggacccucuuccgcauucguaguccaaccacaaaacggucgcuguacaaccgacggaguacuccucgggacaacccaacucucacccguaaacaucugcaccuuccgcggcgacgucacccacaucgccggcucacgcguauacacgaugaaccuagcuucucuaaauuggaacaacuaugacccgaccgaagaaaucccugcuccccucggcacccccgacuucgucggcaaaauccaaggcguccuaacccaaaccacaaaagaagacggcagcacacgcggucacaaagccaccgucuacaccggauccgcccccuucacccccaaacucggaucaguccaauucuccacagacaccgaaaacgauuucgaaacccaccagaacaccaaguuuaccccagucggaguaauacaagauggcggaaccacccaccgcaacgaaccccaacaauggguacuccccuccuacuccggccgaaacgccccaaacguccaccuagcccccgccgucgcccccaccuucccaggcgaacaacuccucuucuuccguucaaccaugccaggcugcuccggauaccccaacauggaccuagacugccuccucccacaagaauggguccaacacuucuaccaagaagccgccccagcccaaagcgacguagcucuccuccgcuucgucaaucccgacaccggccgcguccucuucgaaugcaaacuccauaaaucaggcuacgugacagucgcccacaccggccaacaugacuuagucauacccccuaacggcuacuuccgcuucgacuccugggucaaccaauucuacacccucgccccuaugggaaacggaacgggccgcagacgcuaa

SEQ ID NO: 38206 - RNA, 1617 nt, Artificial Sequence
  derived and/or modified sequence opt11 from VP1__Norovirus_and/or_Norovirus-like__HF952135
augaaaauggccuccuccgacgcaaaccccuccgacggcuccaccgccaaccucguccccgaagucaacaacgaaguaauggcccucgaacccguagucggcgcggcaauagcagccccaguugcaggacaacaaaacgucaucgaccccuggauccgaucaaacuucguacaagccccaggaggcgaauuuacaguaucacccagaaacgccccaggcgaaauacucuggucagcaccccuuggcccggaucuaaaccccuaccucucgcaucuugcccgcauguauaacggauacgccggcggcuucgaaguccaagucauccucgccggcaacgcauucacagccggcaaaauuauauucgccgccguaccacccaacuuccccaccgaaggccucucccccucacaagucacuauguucccccacaucaucgucgacguacgacaacucgaacccguccucaucccccuccccgacgugcguaacaacuucuaccacuacaaccaaagcaacgaucccaccaucaaacuaaucgccaugcucuacacaccccuccgagccaauaacgcaggagaugaugucuucacagucuccugccgcgugcucacccguccaucacccgacuucgacuucaucuuccuaguucccccuacagucgaauccagaacaaaacccuucucaguccccguccucacaguagaagaaaugacaaacuccagauuccccaucccccuggaaaaacucuucaccggccccucaucagccuucguaguacaaccccaaaacggccgcugcacaaccgacggcguucuucucggcacaacucaacuaucccccguaaacaucugcacauuuagaggagacguaacacacauaucaggcucacgaaacuauacaaugaaccucgccgcccaaaacuggaacuccuacgaccccaccgaagaaauccccgcaccacuaggcacucccgacuucgucggcaaaauccaaggcguucugacucagaccaccaaaaccaacggaucaacucgcggccacaaagccacgguauauaccggcuccgccgacuucucccccaaacuaggacgcguacaauucgccacagacacagacaacgacuucgaaaccaaccaaaauaccaaauucacacccguaggcgucauucaagacggauccaccacgccccgaaacgaaccccagcaauggguacucccguccuacucgggccgcaacacacacaacguccaccucgccccagcagucgcccccacuuucccaggcgaacaacuccuuuucuuccgcucaacaaugcccgguugcucaggcuaccccaacauggaccuagacugccuccucccccaagaauggguccaauauuucuaucaagaagccgcaccagcccaaucagacgucgcacuccuacgauucgucaaccccgacacaggccgcguacucuucgaaugcaaacuccacaaaucaggcuacgucaccguagcacacacaggccaacacgaucucgucaucccucccaacggcuacuucagauucgacuccuggguuaaccaauuuuacacccucgcccccaugggcaacgggaccggacgccgucgauaa

SEQ ID NO: 38207 - RNA, 1617 nt, Artificial Sequence
  derived and/or modified sequence opt11 from VP1__Norovirus_and/or_Norovirus-like__JX459598
augaagauggccuccaacgacgccacacccucagacggaucaaccgccaaccucguacccgaagucaacaacgaaguaauggcccuagaacccgucgucggcgccgccaucgcagcacccgucgcuggacagcaaaacgucaucgaccccuggauccgcaacaacuucguccaagcccccggcggagaguucacaguuucuccucguaacgcaccgggcgaaauccuguggcacgcaccccucggcccugaccugaaccccuaccuuucccaccucgcccgcauguacaacggauacgccggcggcuucgaaguucaagucauucuagcaggcaacgccuucaccgccggcaaaaucauauucgcugccgucccacccaacuuccccaccgaaggccuaucacccucccaagucaccauguucccccacaucaucgucgacguccgccaacucgaacccguucucauaccccuccccgacguccgaaacaacuucuaccauuacaaccaaucaaacgaccccaccaucaaacuaaucgccaugcuauacacaccccuucgagccaauaacgcaggcgacgacgucuuuacagucuccugucgcguccucacacgccccucccccgacuucgacuucauauuccucgugcccccaacaguagaaucucgcacaaaaccuuucucugucccuauccuaaccguagaagaaaugaccaacucucguuuccccaucccucucgaaaaauuauucaccggccccuccucagccuucgucguccagccccaaaacggccgcugcacuacagacggcguucuccucgguaccacccaacucagccccgucaacaucuguaccuuccgaggagacgugacccacauugcaggcacccaaaacuacacuaugaaccucgccucacagaacuggaacaacuaugaccccaccgaagaaauccccgcuccccuagguacccccgacuucguugguaaaauccaaggcguccuuacccaaacaacccgccgugacggcucaacacguggacacaaagccacagucucaaccggcagcauacacuucacacccaaacucggcuccguccaauucucuaccgacaccucuaaugacuucgaaaccggacaaaacacccgauucacgccagucggcguaguccaagacggcuccacaacccaccaaaacgaaccacaacaauggguacuaccaaauuacuccggccgcgacucccacaauguccaccuagcccccgcugucgccccaaccuuccccggcgaacaacuccucuucuuccguuccaccaugccaggcugcucgggauaccccaacaugaaucuagacugccuccucccacaagaauggguccaacauuucuaccaggaauccgcccccgcccaaucugacguagcacuacuuagauucguuaaccccgacaccggccgaguauuauucgaaugcaaacuccacaaauccgguuacguaaccguugcccacaccggacaacacgaccucgucauaccgcccaacggcuacuucagauucgauuccugggucaaccaauuuuacacccucgcccccaugggcaacggcgccggccgccgucgcuag

SEQ ID NO: 38208 - RNA, 1617 nt, Artificial Sequence
  derived and/or modified sequence opt11 from VP1__Norovirus_and/or_Norovirus-like__JX445162
augaaaauggccuccaacgacgcaaaucccuccgacggcucugcggccaaccucgucccagaaguuaacaacgaaguaauggcauuagaacccgucgucggagccgccaucgccgcccccgucgcuggacaacaaaacguaaucgacccauggauacgcaacaauuucguccaggccccagguggcgaguucaccguaucaccacgcaacgcccccggagaaauacucugguccgcaccccucggcccagaccuaaaccccuaucuaucccaccucgcccgaauguacaacggcuacgccggaggcuucgaaguccaagucauucuggccgguaacgccuucaccgcaggaaaaauaaucuucgcagccguacccccaaacuuccccacagaaggucucucccccucccaagucaccauguucccucacauaaucgucgacguccgacaacucgaaccaguccuaauuccccuccccgacguccgcaacaacuucuaccacuacaaccaaagcaacgacucaaccaucaaacucauagccaugcuauacaccccacuccgcgccaacaacgcaggagaagacguauucaccgugucaugucgcguccuaacccgacccucccccgacuucgacuucauuuuccuagucccacccaccguagaaucacgaaccaagcccuuuacuguccccauccucacagucgaagaaaugaccaauucccgauucccaaucccccuugaaaaacucuucaccggcccuuccuccgccuucguuguucaaccccaaaacggacgaugcacaaccgacggcguccuccucggcacuacacaacucucacccgucaacaucugcacauuccgcggcgacgucacccauaucgccgguucccgcaacuacaccaugaaccuagccagccuaaacuggaauaauuacgacccaaccgaagagauacccgcucccuuagguaccccagacuucguaggcaaaauccaaggaguacuaacccaaacaacaaaaggcgacggcagcacccguggccacaaagccacuguauacaccggauccgcacccuucacccccaaacuaggcuccguccaauucucaacagacaccgaaaacgacuucgaaacccaccaaaacaccaaauuuacaccagucggaguuauacaagacggcggaacaacccacagaaacgaaccacaacaauggguacucccuuccuacagcggccgaaacguacaaaacguucaccucgccccagccgucgcccccacuuucccaggcgaacaacuccucuucuuccggagcacaaugcccggcugcagcggcuaucccaacauggaccucgauugccuacuaccgcaagaauggguccagcacuucuaccaagaagccgcccccgcccagucagacgucgcacuccuccguuucguaaacccagacaccggccgcguccucuuugaaugcaagcuccacaaauccggauacguaaccgucgcacauaccggacaacacgaccucaucauacccccuaacggcuauuuccgauucgacucgugggucaaccaauucuacacccucgcccccaugggaaacggcacaggccgacgacgcuag

SEQ ID NO: 38209 - RNA, 1617 nt, Artificial Sequence
  derived and/or modified sequence opt11 from VP1__Norovirus_and/or_Norovirus-like__JX445154
augaaaauggccucaaacgacgccacccccagcgaugguuccacagcaaaccucguacccgaagucaacaacgaagucauggcccucgaaccagucguaggagccgcaaucgccgccccaguagccggccagcaaaacgugaucgaccccuggauccgcaacaacuucguccaagcccccggcggcgaauuuaccgucucaccccguaacgcccccggcgaaauccucuggagcgcaccccuagguccagacuugaauccauaccucucacaccucgcccgcauguacaacggcuacgccggcggcuucgaaguccaagucauccuugccggcaacgccuuuaccgccggcaaaauaaucuucgccgccguaccacccaacuuccccacagaaggccucucccccucccaagucaccauguucccccacauaaucguugacgucagacaacucgaaccaguauuaauaccccuccccgacguacgcaacaacuucuaccacuacaaccaguccaacgacccaaccaucaaacuaaucgccaugcucuacaccccacuccgcgcaaauaacgccggagacgacgucuucaccgucuccugccgcguccuuacccgaccaagccccgacuucgacuucaucuuucuugucccucccaccguugaaucccgcacaaaacccuuuuccguucccauacucaccguugaagaaaugacuaacucccgcuuccccaucccccuugagaaacucuuuaccggaccauccagcgcauucgucguccaaccccaaaacggccgcugcaccaccgacggcgucuuacuagggacaacccaacucuccccaguaaacaucugcaccuuccgaggcgacguuacccacauagccggcacccaaaacuacaccaugaaccucgccucccagaacuggaacaacuacgaccccacagaagaaauacccgcaccccucggcacccccgacuucgugggcaaaauucaaggaguccucacccagaccacacgccgcgacggcucaacacgaggccacaaagccacagucucaacaggaucaguacacuucaccccgaaacuuggcucaguucaauuuucaaccgacaccucuaacgauuucgaaacaggccaaaacacccgcuucacaccugucggcgucguccaagacggaucuacaacacaucaaaacgaaccccaacaauggguccuccccgauuacuccggacgagacagccacaacguccaccuagcgcccgccguggcacccaccuuccccggagaacaacuacuauucuuccgcucuacaaugccaggaugcuccggcuacccaaauaugaaccucgacugucuccucccacaagaauggguacaacacuucuaccaagaaucagcccccgcccaaagcgacguagcccuccuccgauucgucaaccccgacaccggcagaguucucuuugaaugcaaacuacacaaacccgguuacguuacugucgcccacacuggccaacacgaccuagucauacccccaaacggauacuuccgcuuugacagcugggucaaccaauucuauacccucgcccccaugggcaacggggccggcagacgccgauga

SEQ ID NO: 38210 - RNA, 1617 nt, Artificial Sequence
  derived and/or modified sequence opt11 from VP1__Norovirus_and/or_Norovirus-like__JX155752
augaaaauggccuccaacgacgccaaccccucagacggcucagccgccaaccuugucccagaaguaaacaacgaaguuauggcccucgaacccgucgucggagccgccaucgccgccccggucgccggccaacaaaacgucaucgaccccuggauccgcaacaacuucguacaagcaccaggcggggaauuuacagucagcccacgaaacgcaccaggcgaaauacuaugguccgcaccccucggacccgaccucaacccauaccucucccaccucgcccgcauguauaacggauacgccggcggauucgaaguccaagucauccucgccggcaacgcauucaccgccggcaagaucaucuucgccgcugucccacccaacuuccccaccgaaggccucucgccaucucaaguuacaauguucccccacaucaucgucgacgucagacaacucgaaccugugcucaucccccuaccagacguccgcaacaacuucuaucacuacaaccaaucaaacgacuccaccaucaaacucaucgccaugcuauauacaccccuccgcgccaacaacgccggugaagacguauucaccgucuccugccgaguccucacccgaccaucccccgacuucgacuucaucuuccuagugccaccgacagucgaaucaagaacaaaacccuucacaguucccauacuaaccgucgaagaaaugacaaauucccgauuccccaucccccucgaaaaacucuucaccggccccuccucagccuucguuguccaaccgcaaaauggccgcugcaccacugacggcguccuacucggaaccacccagcucucccccgucaacaucugcacauuccgaggagacgucacacacaucgcaggcucccauaacuacgcaaugaaccucgccucccuaaacuggaacaacuacgaccccacagaagaaauucccgcaccucucggcacccccgacuucguaggaaaaauccaagguguacucacacaaaccacaaaaggugacggcagcacgcgaggccacaaagccaccaucuacacggguuccgccccuuucacaccaaaacuaggcuccguacaauucuccaccgacaccgaaaacgacuucgaaacccaccaaaacaccaaauucacacccgucggcgucauccaagacggcggcaccacccaccguaacgaaccccaacaauggguccuaccuuccuacuccggccgcaacguucccaacguccaccucgcgccagcaguggcaccaaccuucccaggcgaacagcuccucuucuuccgcagcacuaugcccggcugcucuggauaccccaacauggaccucgacugccuacuaccccaggaauggguccaacauuuuuaccaagaagcagcccccgcacagucagauguagcacuucuucgcuucguaaaccccgacacaggcagaguccucuucgaaugcaaacuacauaaaucaggauaucuaaccgucgcacacacgggccaacacgaccuagucaucccacccaacgguuacuuccgauucgacuccuggguaaaccaguucuacacccucgcccccaugggaaacggcaccggccgacgacguuga

SEQ ID NO: 38211 - RNA, 1617 nt, Artificial Sequence
  derived and/or modified sequence opt11 from VP1__Norovirus_and/or_Norovirus-like__HM748971
augaaaauggcaagcaacgacgccucccccucagacggcucagcagccaaccuaguccccgaagucaauaacgaaguaauggcccuagaaccaguugucggcgccgccauagcagccccuguugccggccaacaaaauguaauagaucccuggauccgaaacaacuucguccaagccccagguggcgaguucacagucuccccacgcaacgcccccggcgaaauccuauggagcgcuccccucggaccagaccuuaacccauaccuaucccaccucgccagaauguacaacggcuacgccggaggcuucgaaguccaagucauccuugcgggcaacgccuucacagccggcaaaaucauauucgccgccgucccacccaacuuccccacagaaggccuaucacccucacaagucacaauguucccccacaucaucguagacguccgucaacuugaaccuguccucauaccccuccccgacguccgaaacaacuucuaccauuacaaccagagcaacgacuccaccauuaagcuaaucgcuaugcucuacaccccacuacgagccaacaacgccggagaagacgucuucaccguguccugccgcguccuaacacgccccucucccgacuucgacuucaucuuccucguacccccaacuguagaauccagaaccaaacccuucaccguccccauccuaaccgucgaagaaaugacuaacucccgcuucccaaucccccucgaaaaacuauucaccggccccagcuccgccuucgucguacagccccaaaauggccgcugcaccacagauggcguccuccucggaacaacccaacucucccccgugaacaucuguaccuuccgaggcgacguaacccacaucgccggcucccgcaacuacacaaugaaccucgcuucccuaaacuggaacaacuacgaccccaccgaagaaauacccgcaccccuugggacacccgacuucgucggaaaaauccaagggguccuuacccaaaccaccaagggcgacggaucgacccgcggccacaaagccacaguauacaccggaucagccccauucacccccaaacucggauccgugcaauucuccacagauaccgaaaacgacuucgaaacccaccaaaacacuaaauucacccccgucggagucauccaagauggcggcaccacccaccgcaacgaaccccagcaaugggcccuuccuuccuacuccggccguaacguccaaaacguucaccucgcacccgcugucgcaccaacauuccccggcgagcaacuccucuucuucagauccaccaugcccggaugcucuggcuaucccaacauggaccucgacugccuucucccccaagaauggguccaacacuucuaccaggaggcagcacccgcccaaucugacguugcacucuugcgcuucgucaacccagacaccggccgaguccuauucgaaugcaagcuccacaagagcggcuacgucacaguagcccacaccggacaacacgaucucguaaucccacccaacgguuacuuccgauucgacagcuggguaaaccaauucuacacccucgcacccaugggcaacgggaccggccgacgccgauag

SEQ ID NO: 38212 - RNA, 1617 nt, Artificial Sequence
  derived and/or modified sequence opt11 from VP1__Norovirus_and/or_Norovirus-like__GQ845367
augaaaauggcguccucagacgcaaaccccuccgacggcucaacagccaaccucgugccagaagucaacaacgaagucauggccuuagaacccgucguuggcgcagccaucgccgcccccgucgccggccagcaaaacgucaucgacccauggaucagaaauaacuucguccaagcccccggcggagaauuuaccgucucgccccgcaacgccccaggcgaaauccucuggucagcaccccucggacccgacaugaacccauaccuaucgcaccucgcccgcauguacaacggcuacgccggagguuucgaaguccaagucauacucgcagguaacgccuucaccgcaggaaaaaucaucuucgccgccguaccacccaacuuccccaccgaaggccuaucccccagccaaguaaccauguucccccacaucauagucgacgugcgccaacuagaacccguccucauaccacuccccgacguucgcaacaacuucuaccacuacaaccaaagcaaugaccccacaauaaaacuaaucgccaugcucuacacuccuuuacgagccaacaacgcaggcgaugacgucuuuaccguauccugccguguccucacccgaccaucccccgacuucgacuucaucuuccuagucccacccacaguagaaucacgaaccaaacccuucuccguacccauccucaccgucgaagaaaugaccaacucucguuuccccaucccacuagaaaaacucuucacaggcccuucuucagccuucguaguucaaccccaaaacggaagaugcaccacagacggaguccuccucggaacaacucaacuauccccagucaacauaugcaccuucagaggagacgucacccauauagccggcucccgaaacuacacaaugaaucuagccucccaaaacuggaacucuuacgacccuacggaagaaauaccagcuccccucggcacccccgacuucguaggcaagauucaaggcguacuaacccaaaccacccguaccgacggauccacuagaggacacaaagccacagucuacaccggcuccgcagacuucucccccaaacuagggcggguccaauucgcaaccgauaccgacaacgacuucgacgccaaccaaaacacaaaauucacccccguaggcguaauccaagauggcaauaccgcacaccgaaacgaaccccaacaauggguacuccccuccuacuccggccgcaacacccacaacguccaccucgcccccgcaguugcccccacauucccaggcgaacaacuccuguucuuccgcuccaccaugccagguuguucugguuacccaaauauggaccuugauugccuccucccccaggaauggguccaauacuucuaccaagaagccgcacccgcacagucagacguugcccuccuacgcuucguaaaccccgacacaggcagaguccucuucgaaugcaagcuccauaaauccgguuacgucaccgucgcccacacuggacaacacgaccucguaaucccacccaacggguacuuccgauucgacagcuggguaaaccaauucuacacccuagcccccauggggaacggcaccggacgccgcagauaa

SEQ ID NO: 38213 - RNA, 1617 nt, Artificial Sequence
  derived and/or modified sequence opt11 from VP1__Norovirus_and/or_Norovirus-like__GQ856455
augaaaauggccagcaacgacgccaaccccuccgacggcucugcagccaaccugguccccgaaguaaacaacgaaguaauggcccuagaacccgucgucggagccgccaucgcagcgcccgucgccggacaacaaaacgucaucgaccccuggauccgcaacaacuucguacaagcccccggcggcgaauuuaccgucucuccccgcaacgcccccggcgaaauucucugguccgccccacucggccccgaccuaaaccccuaccuuucucaccucgcccgcauguacaacgguuacgccggcggcuucgaaguacaagucauacuagccggcaacgcauucaccgccggcaaaaucauauucgccgccguuccacccaacuuccccaccgaaggccuaucccccucccaaguaaccauguucccccacaucauagucgacguaagacaacuggaacccguccugaucccccuccccgacguccgaaacaacuucuaucacuacaaccaacccaacgacucaacaauaaaacuuaucgccaugcuauacacaccccuacgagcaaacaacgccggagaagacgucuucaccguauccuguagaguccuaacccgacccucacccgacuucgacuucauuuuccuaguacccccgaccgucgaaagcagaacaaaacccuucacuguccccauacuuaccguagaagaaaugaccaacucccgcuuccccaucccucucgaaaaacuauucacaggccccuccucagcauucgucguacaaccccaaaaugggcgcugcaccaccgacgguguacuacucggaaccacacaacugucgccggucaacauaugcaccuuccgcggcgaugucacccacaucgccgguucacgcaacuacaccaugaaccuagccucccucaacuggaacaacuacgaccccaccgaagaaauacccgccccucucggcacaccagacuucguaggcaaaauccaaggaguccucacccaaacuacaaaaggcgauggauccacccacggccacaaagccaccgucuacacaggaucugcccccuucaccccaaaacucggcucaguacaguucucaacagacaccgaaaaugacuucgaaacccaccaaaacaccaaauucacaccagucggagucauccaggacggcuccaccacccaccgcaacgaaccccaacaguggguacuucccucauauaguggacgcaacguccaaaacguccaccuagccccugccgucgcacccaccuuccccggcgaacaacuacucuuuuuccgcucuacaaugcccggcugcuccgguuaccccaacauggaccuagacugccuacucccucaagaauggguucaacacuucuaccaagaagccgcacccgcccaauccgacgucgcacuucuacgcuucguuaacccagacacaggacgaguccucuucgaauguaaacuccacaaaucaggcuacgucaccgucgcccacaccggacagcacgaucucguuauacccccuaauggcuacuuccgauucgacuccuggguaaaucaguucuacacacuugcccccauggguaacgguacuggccgccgccgcuaa

SEQ ID NO: 38214 - RNA, 1617 nt, Artificial Sequence
  derived and/or modified sequence opt11 from VP1__Norovirus_and/or_Norovirus-like__GQ856447
augaaaauggccuccaaugacgccaaccccuccgacggcuccgccgccaaccucguccccgaaguaaauaacgaagucauggcacucgaacccguagucggugcagcaaucgccgcccccguagccggccaacaaaacgucaucgaccccuggauacgcaauaacuucgugcaagcccccgguggagaguucacagucucuccccgaaacgcccccggcgaaauccuuuggucagccccacucggucccgaccuaaauccuaaccuaucccaccuagcccgcauguacaacggcuacgcuggaggcuucgaaguacaagucauccucgccggcaacgcauucacugccgguaaaauaaucuucgccgcaguacccccuaacuucccaacagaaggucuaucuccaucccaaguaaccauguucccccacaucauagucgacguacgccaacuagaacccguccuaauaccccucccggacguccgaaacaacuucuaccacuacaaccaaagcaacgacucaaccaucaaacucaucgcaaugcuauauacaccccuccgcgcaaacaacgccggcgaggacguauuuaccgucuccugccgaguacucacacgccccucccccgacuucgacuucauauuccucgucccacccacaguugaauccagaaccaagcccuucacaguacccauacuaaccguugaagaaaugacuaacucccgcuucccaauuccccucgaaaaacuauuuaccggacccuccuccgcauucguaguucaaccccaaaacggucgcugcaccaccgacggcguccuccuaggcacaacacaacucucucccgucaacauaugcaccuuccguggcgacgucacccacauagccggcucccgaaacuacacuaugaaccucgccucacucaacuggaacaacuacgaccccaccgaagaaauacccgcaccccucggcacgcccgacuucgugggcaaaauacaaggcguccucacacaaaccaccaagggcgacggcucaaccaggggccacaaagccaccgucuacaccggcucugcccccuucacccccaaauuaggauccguccaauuuuccaccgacacagaaaacgacuucgaaacccaucaaaacacaaaauucacccccgucggcgucauccaggacggaggcaccacccaucgaaacgaaccccaacaauggguccuccccuccuacuccggucgaaacguccagaacguccaccuggcccccgccgucgcacccaccuuccccggcgaacaacuccuauucuuccgcuccaccaugcccggcugcuccggcuaucccaacauggaccucgacugucuccuaccacaagaauggguucagcacuucuaccaggaagccgcccccgcccaauccgacgucgccuugcuccguuucgucaacccagacaccggccguguccuauucgaaugcaagcuacacaaaucaggcuacguaacagucgcccacaccggccaacacgaccuaguuauuccacccaacggcuacuuccguuucgacucuuggguaaaccaauucuacacccuugcgcccaugggcaauggaaccggccgacgccguuaa

SEQ ID NO: 38215 - RNA, 1617 nt, Artificial Sequence
  derived and/or modified sequence opt11 from VP1__Norovirus_and/or_Norovirus-like__AB541318
augaaaauggccucauccgacgccaaccccucagacggcucaaccgcuaaccugguaccagaagucaauaacgaaguuauggcacuugagccugucgucggcgcagcaauagcagcccccgucgccggccaacaaaacgucauagaccccuggauacggaacaacuuuguccaagccccuggaggcgaguucaccgucagcccccgcaaugccccaggcgaaauacucugguccgccccacuaggccccgaccuaaaccccuaucucucucaccucgcccgcauguacaacggcuacgccggcggcuucgaaguccaagucauccuugcuggaaacgcauucaccgccgguaagaucaucuucgccgccguaccacccaacuuccccaccgaaggacucucccccucccaagucaccauguucccccacaucaucguagacguacgacaacuagaacccguacuaaucccacucccagauguccgaaacaacuucuaccacuacaaccaaagcaacgaccccaccauaaaacuaaucgccaugcucuacacaccccuacgcgcaaacaacgcaggcgacgacguauuuaccguaagcugccgcguccuuacacgccccucacccgacuucgacuucaucuuccucgucccgcccaccguugaaucccgcaccaaacccuucagcguccccauccucaccguggaagaaaugaccaacucacguuuccccaucccccuagaaaaacuauucacaggccccucuuccgccuuugucguccaaccccaaaacggacgaugcaccacagacggcguacuacucggcaccacucaacugucccccgucaacauaugcacauuccguggcgacgucacccacaucacagguucccgcaacuacaccaugaaucucgccacccaaaacuggaacucauacgaccccacagaagaaauccccgcaccccuagguacccccgacuucgucggcaaaauucaaggaguacucacccaaacaacccgcgccgauggcuccacaagagggcacaaagccaccgucuacacaggaucagccgauuucgcccccaaacucggacgaguccaauucgccaccgauaccgacaacgacuucgacgcuaaccaaaacaccaaauucaccccagucggcgucauacaagacgggaacaccgcccaccgaaacgaaccccaacaauggguccuccccucauacuccggccgcaacagccauaacguucaccucgcacccgccgucgccccuaccuucccgggagaacaacuccucuucuuccgauccacaaugcccggaugcagcggcuaccccaacauggaccucgacugucuccucccccaagaauggguccaauacuucuaccaagaagcggcacccgcccaauccgacguagcccuucuccgauuugucaaccccgacacaggcagaguccucuucgaaugcaaacuccacaaauccggauaugucaccgucgcucacaccggccaacaugaucucguuaucccgccuaacggcuacuuccgauucgacucauggguuaaccaauucuacacccucgcccccaugggcaacggaacaggccgcagacgcuag

SEQ ID NO: 38216 - RNA, 1617 nt, Artificial Sequence
  derived and/or modified sequence opt11 from VP1__Norovirus_and/or_Norovirus-like__AB541307
augaaaauggccuccaacgacgcaaaccccucagacggcuccgccgcaaaccuaguccccgaaguuaacaacgaaguaauggccuuagaacccguagucggcgcagccauugccgccccagucgcaggucaacaaaacgucauugacccauggauccgaaacaacuucguccaggcccccggcggcgaauuuaccgucagcccccguaacgcccccggcgaaauccucugguccgcaccccucggcccagaccucaaccccuaccucucccaccuagccagaauguacaacggcuacgcaggcgguuucgaaguacaagucauacucgccggcaacgccuucaccgccggaaagaucauuuucgcagccguaccacccaauuuccccacugaaggccucucccccucccaagucacaauguucccccacaucaucguagacguacgccagcuagaacccguccucauaccccuacccgacguuagaaacaacuucuaccauuacaaccaguccaacgacuccaccauaaaacuaaucgccaugcucuacacaccccuacgugccaacaacgccggcgaagacgucuucaccgucucaugccgcgugcucacccgacccucacccgacuucgacuucauuuuccucgucccacccaccgucgaaucucgcaccaagcccuucacaguccccauccucaccgucgaagaaaugacgaacucacgauuccccaucccacuagaaaaacuauucacaggcccauccagcgcuuucguaguucaaccccaaaacggccgcugcaccacagacggaguacuccuuggaacaacccaacucucccccguaaacaucugcaccuuccgaggcgacgucacccacaucgccggcucacguaacuacaccaugaaucuugcuucccuaaacuggaacaacuacgaccccaccgaagaaauuccugcuccccucgguacccccgacuuugucggcaaaauucaagggguccucacccaaaccaccaaaggugacggcucgacacguggccacaaagccaccgucuacaccggcuccgcacccuucaccccaaaacucggcucaguacaauucuccaccgacaccgaaaacgacuucgaaacacaccaaaacacaaaauucacacccgucggcguaauccaggacggcgguaccacacaccgcaacgaaccccaacaauggguccuaccaagcuacuccggccggaauguacccaacguccaccuggcuccagccguugcacccacauucccaggcgaacaacuccucuucuuccgcuccacaaugcccggcugcuccgguuaccccaacauggaccuugacugccuccucccacaagaaugggugcaacauuucuaccaagaagcugcccccgcacaaagcgacgucgcacuccuccguuucgucaacccugacaccggcagaguacuauucgaauguaaacuccacaaaccaggcuacguaaccguagcacacacaggccaacacgaccucguaauccccucaaacggcuacuuccgauucgacucaugggucaaccaauucuacacacucgcucccaugggaaacggcacuggacgacgccgcuga

SEQ ID NO: 38217 - RNA, 1617 nt, Artificial Sequence
  derived and/or modified sequence opt11 from VP1__Norovirus_and/or_Norovirus-like__AB541254
augaaaauggccuccaacgacgccaacccgucagacggaucagcagcaaaucucgucccagagguaaacaacgaagucauggcacucgaacccgucgucggagcagccaucgcugcaccgguagcuggccagcaaaacgucaucgaccccuggauccgaaacaacuucgucaaagccccagguggcgaguucaccgucucaccccgcaacucacccggcgaaauccuauggucagcaccccucggccccgaccucaaucccuaccucucccaccuagccagaauguacaacggcuacgcaggcggcuucgaaguccaaguaauccuagccggcaacgcauucaccgcaggcaaaaucaucuucgccgccgucccucccaacuuccccacugaaggccucucucccucccaaguuaccauguucccacacauaaucgucgacgugcgacaacucgaacccguucucauccccuuaccagacguccgcaacaacuucuaccacuacaaccaaucaaacgacucaaccaucaaacucauagccaugcuuuacacuccccuccgcgccaacaacgccggagacgauguguucacaguaucaugccgaguccucacccgaccaucccccgacuucgacuucauuuuccuuguacccccgaccgucgaaucucgcacaaaacccuucacaguccccauccucaccgucgaagaaaugacaaacucacgcuucccaaucccccuugaaaaacuauucacaggccccucauccgccuucauaguccaaccccaaaacgggcgcugcaccaccgacggcguacuucuaggaaccacacaacugagcccggucaacauaugcaccuucagaggcgacgucacucacauugccgguucacgaaacuacaccaugaaccucgccucccucaacuggaacaauuacgacccaacagaagaagucccugcaccacuagguacccccgacuucguagguaaaauacaaggcguauugacccaaaccaccaaaggagacggcuccacccgcggccacaaggcaacagucuacaccggaagcgcugacuucaccccaaaacuaggauccguccaauuuggcaccgacacagaaaacgauuucgaaacccaccaaaacacaaaauucacccccgucggcgucauccaagacggcucuacaacacaccgcaacgaaccccaacaauggguccuacccuccuacuccggacgcaauguccacaacguucaucuagcccccgccgucgccccaaacuuccccggagaacaacuccuauucuuccgcuccaccaugcccggcugcuccggauacccaaacauggaccucgacugccuccuaccccaagaguggguucaacacuuuuaccaggaagccgcacccgcucaaucagacgucgcccuccuccgauucgucaaucccgacacuggacgcguccucuucgaaugcaaacuccacaaaucaggcuacgucaccguagcacacaccggacaacacgaccucgucauaccgcccaauggcuacuuccgauucgacucaugggucaaucaauucuacacccucgcaccaaugggcaacggcacaggacgccgcagauaa

SEQ ID NO: 38218 - RNA, 1617 nt, Artificial Sequence
  derived and/or modified sequence opt11 from VP1__Norovirus_and/or_Norovirus-like__AB541243
augaaaauggccagcaacgacgccaaccccuccgacggaucagccgccaaccugguacccgaagucaauaacgaagucauggcacucgaacccguagucggugcugcaaucgccgcccccgucgccggccagcaaaacgucaucgacccuuggauaagaaacaacuucguccaagcccccggcggagaauuuaccguaagcccccgcaacgcccccggcgaaauaccauggucagcaccgcuaggacccgaccuaaacccuuaccucucucaucucgcccgcauguacaauggcuacgcaggcggauuugaaguucaagucauccucgcaggcaacgccuucaccgccggcaaaauaaucuucgccgccguucccccgaacuucccaacggaaggccucucacccucccaagucacuauguucccacacaucaucgucgacguccgccaacucgaacccguccucaucccccuaccagacguccguaacaacuuuuaucacuacaaccaaaguaacgacucaacaauuaaacucaucgccaugcucuacaccccacuccgugccaacaacgccggcgaagacguauucacagucuccugccgcgucuuaacccgacccuccccugacuucgacuucaucuuccuagucccacccacaguagaaucacgcaccaaacccuucaccgucccaauccuuaccgucgaagaaaugaccaacucccgguuccccauuccccucgaaaaacuauucaccggccccucaucugcauucgucguacaaccccaaaacggacgcugcaccacagacggcguccuacuaggaaccacacaacuaagcccaguuaacaucugcacauucagaggggacguaacccacaucgcaggcucucgcgacuacaccaugaaccucgcaucccucaacuggaacaacuacgaccccaccgaagaaauccccgcaccucuaggcaccccagacuucgucgggaaaauccaaggaguacuaacccagaccacaaagggugauggcuccacacgcggccacaaagccacugucuacacaggcagcgcccccuuuacccccaaacuuggaucaguccgauucucaaccgauaccgaaaacgacuucgaaacccaucaaaacacaaaauucaccccagugggcguaauccaggacggcuccaccacacaccgcaacgaaccccaacaauggguccucccuuccuacuccggccgcgacguccauaacgugcaccuagcccccgccguagcuccaaccuuucccggagaacaacuccucuucuucagauccaccaugccaggcugcuccggcuaccccaacauggaccucgacugccucuuaccccaagaauggguccaacacuucuaccaagaagcagccccagcccaauccgacgucgcacuacuacgcuucgucaacccugauaccggccgcguccucuucgaaugcaaacuccacaaauccggauaugucacggucgcccacacaggucaacacgaccuagucaucccucccaacggcuacuuccgcuucgacucauggguaaaccaauucuauacccuugcccccaugggcaacggcaccggccgccgacgcuga

SEQ ID NO: 38219 - RNA, 1617 nt, Artificial Sequence
  derived and/or modified sequence opt11 from VP1__Norovirus_and/or_Norovirus-like__AB541232
augaaaauggcaucuaacgacgcaaaccccucagacggcucugccgccaaccucgucccagaagucaacaacgaagucauggcccucgaaccaguagucggcgccgccaucgccgcacccgucgccggacaacaaaacgucaucgaccccuggauccguaauaacuucguccaagcccccggcggcgaauuuacaguaucuccccguaacgcucccggcgaaauccucugguccgccccgcucggcccagaccucaaccccuaucuaucccaccuagcacgcauguacaacggauacgcaggcggauucgaaguccaagugaucuuagcaggaaacgcuuucaccgccggcaaaaucauauucgcagccguuccucccaacuuccccacugaaggccucucccccucacaaguaacuauguucccccacaucaucgucgacguacgccagcucgaacccguacuaaucccccuccccgacguccgcaacaacuucuaccacuacaaccaaucaaaugacuccaccauaaaacucaucgccaugcuauacacaccccuccgagcaaacaacgccggagaagaugucuucacugucuccugccgaguacucacuagaccaucccccgacuucgacuucauauuccucgucccacccacagucgaaagccgaacuaaacccuucaccguccccauccugacaguagaagaaaugacaaacucccgcuuccccauccccuuggaaaaacuauucaccgggcccuccggagccuucguaguccaaccacaaaauggccgauguaccacagacggaguccuacucggcaccacacaacucagcccagucaacaucugcaccuuucgcggggacgucacucacaucgcaggcucacgcgauuacaccaugaaccucgcaucacucaacuggaacaacuacgaccccacugaagaaaucccagccccacucggcaccccagauuucgucggcaaaauacaaggcguacucacucaaaccaccaaaggagaugguucaacccguggacacaaagccacagucuacaccggauccacacccuuuacccccaaacucggcuccguucaauucuccacugacaccgaaaacgacuucgaaacccaccaaaauacaaaauucacacccgucggagucauucaagacggcuccaccacucaccgcaacgaaccucaacaauggguccuccccagcuacuccggacguaacguccaaaauguccacuuagcacccgccgucgcaccuaccuuccccggcgaacaacuccuuuucuuccgcuccaccaugcccggaugcuccggcuacccaaacauggaccucgacugccuccucccacaagaauggguccaacacuucuaccaagaagccgccccagcccaauccgacguagcccuccuucgauucgucaauccagacaccggccgcguccucuucgaaugcaaacuccacaaauccggcuacguuaccgucgcccacaccggacagcacgaccuagucaucccgcccaacggcuacuuccgcuucgacuccugggucaaucaauucuacacccucgcccccaugggcaacggcaccggaagacgacgauaa

SEQ ID NO: 38220 - RNA, 1617 nt, Artificial Sequence
  derived and/or modified sequence opt11 from VP1__Norovirus_and/or_Norovirus-like__GQ246800
augaaaauggccuccaacgaugccaaucccagugacggcagcaccgcaaaccucguccccgaagucaauaacgaaguaauggcucucgaacccguagucggcgccgcaaucgcugcccccgucgccggccaacaaaacgucaucgacccauggauccgcaacaacuuuguacaagcccccggaggcgaauuuaccgucagcccccgcaacgcccccggcgaaauccucuggucugcaccccuagguccagaccucaaucccuaccucagccaccucgccagaauguacaacgguuacgccggcggcuucgaaguacagguaauacucgccggaaacgccuucacagccggcaaaaucaucuuugccgccguaccacccaacuuccccacagaaggccuaucccccucccaagucaccauguucccccacauaaucguagacguccgucaacuagaacccguccucauuccccuccccgacguccgaaacaauuucuaccauuacaaccagucuaacgaccccaccaucaaacuuauagccaugcucuacacaccccuccgagccaauaacgccggugacgacgucuucaccgucuccugccgcguacucacccgacccucccccgacuucgacuucaucuuccccguaccacccaccguagaaucccgcacaaaaccauucaccguccccauccuaaccgucgaagaaaugaccaacucacgcuuuccaaucccacuagaacgucucuacaccgggccuucuucagccuucgucguccaaccucagaacggccgcugcacaaccgacggcguccuucuuggaaccacccaacucuccgccgucaacaucugcaccuuucguggcgacgucacacauaucgcaggcucccgcaacuacaccaugaaccuugccagccagaacuggaauaacuacgaccccacagaagaaaucccagcaccacuaggcaccccagacuucgucgguaaaauucaaggcaugcuuacacagaccacucgcuccgacggcuccacacgaggucacaaagccacaguccuuacaggcuccgccgacuuugcccccaaacuaggccguguacaauucgcaacagacacugacaacgacuucgaaucaggccaaaacacaaaauucacccccgucggcgucauucaagacggauccaccacccaccgaaacgaaccacaacaauggguccuuccaaacuacucaggccgcacaggccacaauguccaccucgcaccagccguugcaccaaccuacccuggcgaacaacuccuauucuuccgcuccaccaugcccggaugcuccggcuaccccaacauggaccucgacugccuacucccccaagaauggguucaacacuucuaccaagaagccgcaccagcacaaucggacgucgcacuccuucgcuucgucaaccccgacaccggacgcguacucuucgaauguaagcuacacaaguccggcuacgucaccgucgcccacaccggccaacaugaccucgucaucccucccaacggauacuuccgcuucgacuccuggguaaaccaauucuacacucucgcacccaugggcaacggcacaggccgccgccgcuaa

SEQ ID NO: 38221 - RNA, 1617 nt, Artificial Sequence
  derived and/or modified sequence opt11 from VP1__Norovirus_and/or_Norovirus-like__GU390900
augaaaauggcaucaaacgacgcaaacccuucagacggcucagccgccaaccuaguccccgaaguuaauaacgaagucauggcccuagaacccgucgucggcgccgccaucgccgccccagucgccggccaacaaaauguaaucgauccauggauccgaaacaacuucguacaagcccccggcggcgaguucacgguuucaccccgcaacgcccccggugaaauccuaugguccgcaccccucggcccagaccuaaacccauaccuaucccaccucgcacgaauguauaacggcuacgccggcggcuucgaaguccaagucauccucgcaggcaacgccuucaccgcuggaaaaaucaucuucgcugccgucccacccaacuuccccaccgagggacucucacccucccaaguaaccauguucccccacauaaucguugauguacgccaacuugaacccguacuuaucccccucccagacguccgaaacaacuucuaccacuacaaccaauccucagacucaacuauaaaacuaaucgcaaugcucuacacaccccuucgcgcaaacaacgccggcgaagaugucuucaccgucucaugccgcguccuaacccgacccucacccgacuucgacuucauauuccuagucccacccaccgucgaaucccgaaccaagcccuucaccguccccauccucaccguugaagaaaugaccaacucccgcuuuccaauaccacucgaaaaacuuuucaccggcccaucaucugcauucgucguucaaccccaaaacggacgaugcaccacugacggcguccuacucgguacaacccaacucucacccgucaacauauguaccuuccgcggugacgucacccacauagccggcucacgaaacuacaccaugaaccucgcaucacucaacuggaacaacuacgacccuaccgaagaaauacccgcuccacuaggcaccccagacuucgucggcaaaauccaaggcguccucacccaaaccacaaaaggagacggcucaacccguggccacaaggccaccguauacaccggcucugcccccuucaccccuaaacucggcuccguucaauucuccacagacaccgaaaacgacuucgaaacccaccaaaauaccaaauucacccccguaggcgucauacaagacggcggaacuacacaccguaacgaaccccaacaauggguacuccccuccuacuccggccgcaacguccagaacguacaccucgcacccgccgucgcacccacauuccccggcgaacaacuccucuucuuccgauccaccaugcccggcugcucuggcuacccaaacauggaccucgacugccuccucccacaagaauggguacaacacuucuaccaagaagccgcaccagcccaauccgacguggcccuuuuacgcuucgucaaucccgacacaggccgcguccucuucgaaugcaaauuacacaaauccggauacgugaccguagcacacaccggccaacacgaccuagucauuccaccaaacggcuacuuccgcuucgacucuugggucaaucaauucuacacacucgccccaauggggaacggaaccggacgccgccgcuaa

SEQ ID NO: 38222 - RNA, 1617 nt, Artificial Sequence
  derived and/or modified sequence opt11 from VP1__Norovirus_and/or_Norovirus-like__AB504328
augaaaauggccucuaacgacgccaaccccuccgacggcucagccgcuaaccuaguaccugaaguaaacaacgaaguaauggcccuagaacccguagucggagcagccaucgccgccccaguagccggacaacaaaacguaaucgaccccuggauacgaaacaacuucguccaagcacccggcggcgaguucacugucucaccacgcaaugccccaggcgaaauacucuggucugcaccccuuggccccgaccuaaacccauaccucucacaccucgcccgaauguacaauggcuacgccggagguuucgaaguccaagucauccuagcgggcaacgccuucaccgcaggcaaaaucauauuugccgccguucccccaaacuuccccacagaaggacucuccccaucccaagucaccauguucccacauauaaucguagacguacgccaacuagaacccguacucauaccccuucccgacguucgaaacaacuucuaccacuacaaccaguccaacgacuccaccauuaaacucaucgccaugcucuacacaccccuacgcgcaaacaacgcaggcgaagaugucuucacagucagcugccgcguacuaacacgacccucccccgacuucgacuucaucuuccuagucccaccaaccguagaaucccguacaaaaccauucaccguccccauccuuaccgucgaagaaaugaccaacucacguuucccaauaccccucgaaaaacucuucaccggacccuccggcgccuucgucguccaaccacaaaacggacgcugcaccacggacggaguacuccucgggaccacacaacucagccccguaaacaucugcacauuccgcggagacgucacccacauagcaggaucacgcaacuauaccaugaaccucaccagcuuaaauuggaacaacuacgacccuaccgaagaaaucccagcuccccucggaaccccagacuuugucggcaaaauccaaggccuccucacccaaacaacaaaaggagacggcuccacacgcggccacaaagccacuguauauacaggaucagcccccuucacaccaaaacucggcucgguucaguucucaacagacaccgaaaaugacuucgaaacccaccaaaauacaaaauucacccccgucggcguaauccaagacggcucaacaacccacagaaacgaaccacaacaauggguccucccauccuauagcggcauaaacguacacaacguccaccucgcacccgcaguggcccccaccuuccccggagaacaacuccucuucuucagaucuaccaugcccggaugcuccggcuaccccaacauggaccucgacugccuacucccacaagaauggguccaacacuucuaccaagaggccgcccccgcacaaucugauguagcccuucuccgcuucguaaaccccgacacaggaagaguccuauucgaaugcaaacuucacaaaucaggcuacguuaccguagcucacacuggccaacacgaccuaguuauaccacccaacgguuacuuccgcuucgacuccugggugaaccaauucuacacccuagcccccaugggcaacggcaccggccgccgccgauga

SEQ ID NO: 38223 - RNA, 1617 nt, Artificial Sequence
  derived and/or modified sequence opt11 from VP1__Norovirus_and/or_Norovirus-like__AB447434
augaaaauggccucaaacgacgccaaccccagugacggcagugccgcuaaccucguacccgaaguuaacaacgaaguaauggcccucgaacccgucguaggcgccgccaucgcugccccagucgccggucaacaaaacgucaucgaccccuggauccgcaacaacuucguccaagcccccgguggcgaguucacaguaucaccccgaaacgcacccggcgaaauacucugguccgccccacuaggcccugaccucaaccccuaccucucacaccuggcucguauguauaauuccuacgcuggcggcuucgaaguccaagucauacucgcagguaacgcauucaccgccgguaaaaucaucuucgcagccguaccacccaacuucccaaccgaaggacuaucacccucucaagucacaauguucccacacaucaucguagacguacgacaguuagaacccguccucaucccccucccugacguucgcaacaacuucuaucacuacaaccaauccaaugacccaaccaucaaacuuaucgccaugcuauacacgccccuccgcgcuaacaacgcaggcgaagacguauucaccgucuccugcagaguccucacacgccccagcccagacuucgacuucauauuccucgugccacccaccguugaauccagaacgaaaccguucacaguccccauccucaccgucgaagaaaugacuaacucacgcuuuccuauaccccucgaaaaacucuucacuggaccuucaggagcuuucgucguccaaccccaaaauggccgcuguaccaccgacggaguacuccuaggaaccacccaacucucccccgucaacauaugcaccuuccgcggagacguaacccacaucgccggcucccgaaacuacacaaugaaucuagcuucccucaacuggaacaacuacgaccccaccgaagaaauccccgcaccccuaggcacccccgacuuugucggcaagauccaaggcguacucacccaaacaaccaaaggcgacggaucuacccgaggccacaaagccaccgucuacacaggcagcgcccccuucacccccaaacucggauccguccaauucucuaccgacaccgaaaacgacuucgaaacccaccaaaacaccaaguucaccccggucggagucauccaagacggauccaccacccaccguaacgaaccccaacaauggguacuccccagcuacagcggcagaaacguccauaacguacaccuagcccccgcaguagcccccacuuucccuggugaacaacuccucuucuuccguucaacaaugccaggcugcucgggauacccaaacauggaccucgacugccuacucccccaggaauggguccaacacuucuaccaagaagccgcccccgcccaaucagacgucgcauuacuccgcuucgucaaucccgacaccggcagaguccucuucgaaugcaaacuccacaaauccggcuacgucacaguagcacacacaggccaacacgaccucguaauaccacccaacggauacuucagguuugacucaugggucaaccaauucuacacacuagcccccaugggcaacggcacaggccgucgacgguaa

SEQ ID NO: 38224 - RNA, 1617 nt, Artificial Sequence
  derived and/or modified sequence opt11 from VP1__Norovirus_and/or_Norovirus-like__EU839591
augaagauggccucaaaugacgccaaccccucagacggcucagccgccaaccucguucccgaagucaacaacgaagucauggcccucgaacccguugucggagccgccaucgcagcccccguagccggccaacagaacgucauagacccauggauccgcaacaacuucguacaagccccaggaggagaguucacuguaucaccccgaaacgcacccggcgaaauccuaugguccgcaccacucggcccggaccucaacccauaccuaucacaccucgcccgaauguacaacggcuacgccgguggcuucgaaguacagguaauccucgccggcaacgcauucacagccgguaaaaucaucuuugcagcgguacccccaaacuucccaaccgaaggccucucaccgucucaagucaccauguucccccacauaauaguagacguccgccaacucgaacccguccuaaucccccugcccgacguucgcaacaacuucuaucacuauaaccaaucgaacgacagcaccauuaaacucaucgcaaugcucuacacaccccucagagcaaacaacgccggagaagauguauucaccguauccugccgcguccuaaccagaccuucacccgacuucgacuucaucuuccuaguaccacccaccgucgaaucccgcaccaaacccuuuaccguccccaucuuaaccguagaagagaugaccaacucccgauuccccaucccccucgaaaaacuauucaccggccccucguccgccuucguuguccaaccacaaaacggaagauguaccacugacggcguacuacucggcaccacccaacucucccccgucaacaucugcacguuccgcggcgacguaacucacaucgccggcucuagaaacuacaccaugaaccucgcaagccuaaauuggaauaacuacgaccccaccgaagagaucccagcaccccucgggacacccgacuucgucggcaaaauccgagguguacuuacccaaaccacaaaaggcgacggaagcacacgcggucacaaggccaccgucuacacaggguccgccccauucacccccaaacuaggaucaguccaguucucuaccgacacugaaaacgacuucgaaacccaccaaaacaccaaauucacccccgucggcgucauccaagauggcggcaccacccaccgcaacgaaccccaacaauggguacuaccauccuacuccggucgcaacgucccaaacguacaccuagcccccgcagucgcaccuaccuuccccggcgaacaacuccucuucuuccgaucaacaaugccaggcugcucaggauacccaaacauggaccuagacugccuacucccacaagaauggguacaacacuucuaccaagaagcugcccccgcccaaucagacguugcacuccuacgcuucgucaaccccgacacgggccgcguccuguucgaaugcaaacuccacaagucaggauauguaaccgucgcccacaccggacaacacgaccuuguuaucccacccaauggcuacuuccgauucgacuccuggguuaaccaauucuacacccucgcccccaugggcaacggcaccggcagacgacguuaa

SEQ ID NO: 38225 - RNA, 1617 nt, Artificial Sequence
  derived and/or modified sequence opt11 from VP1__Norovirus_and/or_Norovirus-like__AB291542
augaagauggccuccaacgacgccaaccccuccgacggguccgccgccaaccucguccccgaagucaauaacgaagucauggcccucgaacccgucgucggggccgccauagccgcuccugucgcgggccaaaccaacguaaucgaccccuggauccgaaacaacuuuguucaagcccccggcggcgaguucaccgucucacccagaaacgcccccggagaaauacuuuggucugcaccacuuggccccgaccuaaaccccuaccuuucccaccuugcccgcauguacaacggccacgccggagguuuugaaguccaaguaauacuugccggcaacgccuucaccgccggaaaaaucauuuucgccgcagucccaccaaacuuccccaccgaaggccucucccccucucaaguuaccauguucccacacaucaucgucgacguccgccaacuagaacccguccugaucccccuucccgacguccgcaacaacuucuaucacuacaaccaauccaacgacuccacgaucaaacucaucgccauguuauacaccccucuccgcgcaaacaacgccggcgaagaugucuucaccgucuccugccgcguacuaacuaggcccucccccgacuucgacuucauauuccuagucccaccuaccgucgagucucgcacaaaacccuucacagucccuauucuaacaguagaagaaaugaccaacucccgcuuccccaucccccuagagaaacuauucaccggacccuccggcgccuuuguaguacaaccgcaaaacggccgcugcaccaccgauggaguccuacucggaacgacccaacuaucccccguaaacaucugcacauuucgcggagacgucacgcacaucgccggcucucguaacuacacaaugaaccuagccucacuuaacuggaacaauuacgauccaacagaagaaauccccgcuccccucggcacccccgacuucguaggcaagauccagggcguacuaacacaaacaaccaaaggcgacggcagcacacgaggacacaaagccacuguguacaccggcagcgcccccuucaccccaaaacuaggcuccguccaauucuccacagacacagaaaacgacuucgaaacacaccaaaacacaaaguucacacccgucggcgucauccaagacggaucaaccacccaccgcaacgagccucaacaguggguccuaccauccuacucaggccgcaacguccacaacguccaccuagccccagccgucgcaccaacauucccaggugaacaacuccuauucuuccgcuccaccaugccaggcuguagcggcuacccuaacauggaccuagauugccuacuuccccaagaauggguacaacacuucuaccaagaagccgcaccagcacaaucugacguagccuuacuacgcuucgucaaccccgacacaggccgcguccuauuugaaugcaaacuccacaaaucaggcuacguuaccguagcucacaccggacagcacgaccuagucauacccccaaacggcuacuuccgcuucgacagcugggucaaccaauucuacacccuagcccccaugggaaacggcaccggccgacgccgauaa

SEQ ID NO: 38226 - RNA, 1617 nt, Artificial Sequence
  derived and/or modified sequence opt11 from VP1__Norovirus_and/or_Norovirus-like__KX354123
augaaaauggccuccuccgacgcaaaccccuccgacggcuccgccgccaaccuaguccccgaaguaaacaacgaagucauggcccucgaacccguagucggcgcagccaucgccgcccccgucgccggccaacaaaacgucaucgaccccuggauccgcaacaacuuuguccaggcacccggaggcgaauuuaccgucucccccagaaacgcacccggcgaaauccucugguccgccccacucggacccgaccucaacccauaccucagccacuuggcccguauguauaauggcuaugcaggaggcuucgaaguacaagucaucuuagccggaaacgcuuucaccgcaggcaaagucaucuuugccgcagugccacccaacuucccaacagaaggccucucccccucccaaguaaccauguuuccccacaucgucgucgacgucagacaacucgaaccaguccuaaucccacucccagacguccgcaacaacuucuaccacuacaaccaauccaacgaccccaccauaaaacucaucgccaugcucuauaccccucuccgcgcaaacaacgccggagacgauguauucacugucuccugccgaguccuuacaagaccaucacccgacuucgacuucauauuccucgucccucccaccgucgaaucccgaaccaaacccuucucugucccaguccucacagucgaagaaaugaccaacucacgcuucccaaucccccucgaacgccucuuuaccggccccuccuccgccuucgucguacaaccacaaaacggccgcugcacaaccgacggaguccuacuuggcaccacgcaacucagccccgucaacauaugcacauuccgcggcgacgucacccacauaaccggcucccacaauuacacaaugaaccuagcaucccaaaacuggaacaacuacgacccaacagaagaaauccccgcaccccuagguacaccagacuucgucgguaagauccaaggaguacugacacaaacgacccgcaccgacgguucaacacgaggccacaaagccacacucuacaccggcucagccgaauuugcccccaaacucggccgcguacaauucgaaaccgacaccaaccacgauuucgaagcaaaccaaaacacaaaauucacccccgucggagucauccaagacggauccaccacacaucgaaacgaaccacaacaauggguccuaccaaccuacuccggucguaacacacacaacguccaccucgcacccgccgucgccccaacauuucccggcgaacaacuccucuucuuccgaucaacuaugcccggcugcuccggcuaccccaacauggaucucgacugucuacugccacaagaauggguccaacacuucuaccaagaagcggcccccgcacaauccgacguugcccuacugcgauucgucaaccccgacaccggacgcgugcuuuucgaaugcaagcuccacaaauccggcuauauaaccguagcucacacaggacaacacgaccucgucaucccacccaacggauacuuccgcuucgacuccuggguaaaccaauucuacacccucgcucccaugggcaacggaaccggccgccgccgcuaa

SEQ ID NO: 38227 - RNA, 1617 nt, Artificial Sequence
  derived and/or modified sequence opt11 from VP1__Norovirus_and/or_Norovirus-like__KX354050
augaaaauggcaucauccgacgccaaccccucagacgguucugcagccaaccucguaccagaagucaacaacgaagucauggcucuagaaccugucgucggcgccgccaucgccgcaccuguagccggacaacaaaacguaaucgaccccuggauacgaaacaacuucguccaagcacccggcggcgaguucaccguuucaccccgcaacgcccccggcgaaauacucugguccgcaccccuaggaccagaccucaacccauaccucucucaccucgcccgcauguacaacggguacgccggcggccuggaaguccaagucauccuagccggaaacgccuucacugcaggaaaaaucaucuucgccgcagucccacccaauuuccccacagaaggacuuagcccaucacagguuacaauguucccacacaucauagucgacguccgccaacuagaaccaguacucaucccccuacccgacguccgcaacaacuucuaccacuacaaucaaagcaacgaccccacaaucaagcucauagccaugcuauacacaccccuccgagccaacaacgccggagacgacguauucaccgucagcugccguguccuaaccagacccucucccgacuucgacuucauauuccucgucccuccaaccgucgaaucccgcaccaaacccuuuucuguacccauccucaccgucgaagaaaugaccaacucucgauucccaaucccccuagaaaaacucuuuacaggcccaucuuccgcauucgucguacaaccacaaaacggaagaugcacaacugacggcguccuucucggaaccacacagcuaagcccaguaaacaucugcacauuccgcggcgacgucacacacauaacaggcucccgcaacuacacuaugaaucucgccucccaaaacuggaacaacuacgaucccacagaagaaauccccgcaccccucggcacacccgacuucguaggcaaaauccaaggagugcucacccaaaccacacgagccgacggcuccacccgcggccacaaagccaccgucuacacaggaagcgccgacuucgcccccaaauuaggacgcguacaauuugaaaccgacaccgaucaugacuucgaagcaaaucaaaacacaaaauucaccccuguaggaguaauacaagauggaggcaccacccaccgcaacgaaccccagcaauggguccuucccuccuacuccggccgcaauacacacaacguccaccuagccccagcagucgccccgaccuuccccggcgaacaacuccuuuucuuccgcucaacuaugccaggaugcuccggcuacccaaacauggaccucgacugccuccucccccaagaguggguccaauacuucuaccaagaagccgcccccgcccaauccgacgucgcccuccuccgcuucgucaaccccgacaccggccgcguccucuucgaaugcaaacuucauaaauccggguacgucacagucgcccacacuggccaacacgaucucguaaucccuccaaacggcuacuuccgcuucgacuccugggucaaccaauucuacacccucgcucccaugggaaauggcaccggacgaagacgcuga

SEQ ID NO: 38228 - RNA, 1617 nt, Artificial Sequence
  derived and/or modified sequence opt11 from VP1__Norovirus_and/or_Norovirus-like__AB933717
augaagauggcuucaaacgacgccaacccuuccgacggauccgcugccaaccuaguacccgaaguaaacaaugaaguaauggcccuagaaccugucguuggugcggccaucgccgccccagucgccggccaacaaaacgucaucgacccauggauccguaacaacuuuguccaagcacccggcggcgaguucaccgucucuccccgaaacgccccaggagaaauacucugguccgcaccccuaggccccgaccuuaacccauaccucucccaccuugcacgaauguacaacggauacgccggcggcuucgaaguucaaguaauucuagccggcaaugccuucaccgcaggcaaaaucauauucgcagccgucccacccaacuuccccaccgaaggccucucccccucccaagucaccauguucccccacaucaucgucgacgucagacaacucgaacccguacuaaucccucuucccgacguccgaaacaacuucuaccacuacaaccaauccaacgacuccacaaucaaacuaaucgccaugcucuacacaccccuccgagccaacaaugccggagaagacgucuucaccgucucaugcagagucuuaacccgcccaucaccagacuucgacuucaucuuucuggucccacccaccguagaaucacgcaccaaacccuucaccguucccauccucaccgucgaggaaaugacuaauucccgauuuccaaucccccuagaaaaacuuuucaccggucccucaucagccuucguaguacaaccccaaaacggucgaugcaccacagacggcguccuacuaggcacuacacaacucucuccaguaaacaucugcaccuuccgcggcgacguaacgcacaucgcuggcucacgaaacuacacaaugaaccucgcuagccucaacuggaacaacuacgaccccaccgaagagauccccgcaccccuaggcaccccugauuucgucggaaaaauccaaggaguacucacacaaaccaccaaaggcgacggcuccacaagaggccacaaagcaacagucuacacaggauccgcucccuucaccccuaaacucggcagcguccaauucucaacugauaccgaaaacgacuucgagacacaccaaaacaccaaauucacccccgucggaguaauccaagacggaggcacaacgcaccgcaacgaaccacaacaauggguacuccccuccuacucaggccgcgacguacccaacguccaccucgccccagccgucgcccccaccuucccaggcgaacaacuccuauucuuccgcucaacaaugcccggaugcuccggcuacccuaauauggaccuagacugccuucuaccccaagaguggguccaacacuucuaccaagaagccgccccagcacaauccgacguugcccuacuccgauucgucaaccccgacaccggccguguccucuucgaauguaaacuacauaaaucuggcuacguaaccgucgcccacaccggacaacacgaccuaguaaucccacccaacggauacuuccgcuucgacuccugggucaaucaauucuacaccuuagcacccaugggaaacgguacaggccgacgacgcuaa

SEQ ID NO: 38229 - RNA, 1617 nt, Artificial Sequence
  derived and/or modified sequence opt11 from VP1__Norovirus_and/or_Norovirus-like__AB933707
augaaaauggccucaagugacgccaaucccuccgacggcucagccgccaaccugguccccgaagucaacaacgaaguuauggcucuugaacccguagucggugccgccauugccgccccagucgcuggccagcaaaacguaaucgaccccuggauccgcaacaacuucguacaagccccaggcggagaauuuaccguaagcccccgcaacgcccccggugaaauccucuggucugccccacuaggcccggaccucaauccauaccucucccaccuagcacgcauguacaacggcuacgccggcggcuucgaaguccaaguaauccuggccggcaacgccuucacagccggcaagauaaucuucgccgccgucccacccaacuuucccaccgaaggacuaucacccucacaagugaccauguucccccacaucaucgucgacguccgacaacucgaacccguccuaaucccccuacccgacguccgcaacaacuucuaccacuacaaccaauccaaugacucaaccauaaaacuaaucgccaugcuauacacaccccuccgcgccaacaacgccggcgaagacguauucaccgucucaugccgaguccucacccgacccucccccgacuucgacuucaucuuccucguucccccaaccgucgaaucccgaaccaaaccauucacaguccccauccuaaccgucgaagaaaugacuaacucacgcuuccccaucccacuagaaaaacucuucacaggcccguccuccgcauucguuguucaaccccaaaacggcagaugcaccacagacggcguacuccuaggaacuacucaacucucccccgucaacaucugcacauuccgcggggacgucacacacaucgccggcagccgugacuacacaaugaaucuagccucccucaacuggaacaacuacgaccccacggaagaaauccccgcaccccuuggcacuccugacuuugucgguaaaauacaaggcaugcucacacaaacaacuaaaggagacggauccacccggggccacaaggccaccgucuauaccggaucagcccccuucaccccuaaacucggaucaguccaauucucuaccgacaccgaaaacgacuucgaaacucaccaaaacaccaaauucacccccguaggcgucauccaagacggauccacaacacaccgcaaugaaccacaacaauggguccucccaucuuacuccggccgcaaugucccaaacguacaucucgcccccgcgguagcccccaccuuccccggcgaacaacuccuauucuuccguuccaccaugccaggcugcucaggcuacccaaacauggaucuugauugcuuacucccccaagaauggguccaacacuuuuaccaagaagccgccccagcccagucugaugucgcccuucuaagauucguaaaccccgacaccggacgagucuuauucgaaugcaaacuacacaaauccggcuacgucacaguagcacacacgggacaacacgaccucgucaucccacccaacggcuacuuccgcuucgacuccugggucaaccaauucuacacccucgcucccaugggaaacggcacaggucgccguagguaa

SEQ ID NO: 38230 - RNA, 1617 nt, Artificial Sequence
  derived and/or modified sequence opt11 from VP1__Norovirus_and/or_Norovirus-like__AB933705
augaaaauggcauccaacgacgcuaacccaucagacggcuccgccgcuaaccucguccccgaagucaacaacgaagucauggcccucgaaccagucguaggugcagccaucgcugcccccgucgcaggccaacaaaacgucaucgaucccuggauccgaaacaacuucguccaagccccaggcggcgaauuuaccgucucaccccgaaacgcacccggcgaaacccuaugguccgcaccccuaggccccgaucucaaccccuaccucucacaccucgcccgcauguacaacggcuacgccgggggcuucgaaguacaagucauccucgccggcaacgccuuuacagcaggaaaaaucaucuucgccgccgucccacccaacuucccaaccgaaggccuuuccccaucacaaguuacaauguucccccacaucauugucgacguacgccaacucgaaccaguccucauaccccuccccgacguacgcaacaacuuuuaccacuacaaccaauccaacgacuccacaaucaaacucauagccaugcucuacacuccucuccgagcuaacaacgccggggaggacgucuucaccgucuccugcagaguccucacucgccccucccccgacuucgacuucaucuuccuuguaccacccacuguagaaucaagaaccaaaccauucacuguacccauccucaccgucgaagaaaugacaaacucccgauucccaaucccccuagaaaaacucuucaccggcccaucuuccgccuucguaguccaaccucaaaacggaagaugcacaaccgacggcguacuacucggcaccacccaacuaucacccguaaauaucugcacauuccgaggcgacgucacccacaucgccggcucccgcaacuacaccaugaaccuagccucacucaacuggaacaauuacgacccuacagaggaaaucccagcuccacuaggaacccccgacuucguuggaaagauccagggcauguuaacacaaacaacuaagggagacgguuccacacgcggccacaaagcaacagucuacaccggcucagcacccuucacccccaaacuaggaucgguccaauucucgaccgacacagaaaacgacuucgaaacccaccaaaauaccaaauucaccccagucggcgucauccaagacggcuccacaacccaccgcaaugagccacaacaauggguacuccccucauacuccggacgcaacgucccaaacguccaucuagcccccgcugucgccccaaccuuccccggcgaacaacuccucuucuuccgauccaccaugcccggcugcuccggcuacccaaacauggaccucgacugccuccucccacaagaauggguucagcacuucuaccaagaggccgcucccgcccagucggacgucgcccuacucagauucgugaaccccgauacaggacgaguccuauucgaaugcaaacuacauaaauccggauacguaacaguagcccacacuggacaacacgacuuaguaauacccccuaacgguuauuuccgcuucgauaguugggucaaccaauucuacacccucgcccccaugggaaauggcaccggccgacgccguuaa

SEQ ID NO: 38231 - RNA, 1617 nt, Artificial Sequence
  derived and/or modified sequence opt11 from VP1__Norovirus_and/or_Norovirus-like__AB933704
augaaaauggcuuccaacgacgccaacccauccgacggaucagccgcaaaccugguccccgaagucaacaacgaagucauggcccucgaaccuguagucggagcagccaucgccgcccccgucgccggccaacaaaacguaauagacccauggaucagaaacaacuucguccaagcccccggcggugaguucacaguauccccacgcaacgccccaggcgaaauucucuggagcgcaccccuaggccccgaccuaaaucccuaccucucccaucucgcccguauguauaacggcuacgccggcggauucgaaguacaagucauccucgccggaaacgcauucaccgccggaaaaauaauauucgccgccguacccccaaacuuccccacagaaggucucucccccucacaagucaccauguucccacauaucauagucgacguccgccagcucgaacccguccuaaucccccucccagacguccggaacaacuucuaccacuacaaccaaucaaaugacuccaccaucaagcucaucgcuaugcuauacacaccccuccgagccaacaacgccggugaagacguauucaccguuuccugcagaguucucacccgccccucccccgacuucgacuucaucuuucucgugcccccaaccgucgaaucccgcaccaaacccuucacugucccuauacucacaguagaagaaaugacaaauucccgcuucccaauaccccucgaaaaacuauucacaggcccaucuagcgcauucguaguccaaccccagaacggccgcugcacuacagacggugucuuacucggcacaacccaacucagcccagucaacaucugcaccuuccgaggcgacgucacacauauagccggaucccgcaacuacaccaugaaccuggccucacucaacuggaacaacuacgaccccacagaagaaauccccgcuccccuagguacccccgacuuuguuggcaaaauccaaggaguccuaacccaaacaaccaaaggcgacggcagcacacgcggucacaaagccaccguguacaccggcagcgccccauucaccccaaaacuaggcucaguacaauucuccaccgacaccgaaaacgacuucgaaacucaccaaaacaccaaguucacaccagucggcguuauccaagacgguggcaccacccaccgcaacgagccacaacaguggguccuccccuccuacucaggccguaacguccccaacguccaccucgcccccgccgucgcccccacuuuccccggcgaacaacuucucuucuuccgauccaccaugccaggaugcuccggauacccaaacauggaccuugacugccuccuaccacaagaauggguucaacacuucuaucaagaagccgcaccagcccaaucagacgucgcacuacuccgauucguaaaccccgacacaggccgcguacuauucgaaugcaaacuccacaaaucuggauacguaacagucgcccacacaggccaauacgaccucgucauucccccuaauggcuacuuccgcuucgacagcuggguaaaccaauucuacacccucgccccaaugggcaauggcaccggccgccgcagauag

SEQ ID NO: 38232 - RNA, 1617 nt, Artificial Sequence
  derived and/or modified sequence opt11 from VP1__Norovirus_and/or_Norovirus-like__AB933699
augaaaauggccuccaacgacgccaacccauccgacggcagcgcggccaaucucgucccagaaguaaacaacgaagugauggcucuugaacccgucguaggugccgccauagccgcccccgucgccggccaacaaaacgucauugaucccuggauacgaaacaacuucguacaagcucccggaggcgaauuuaccguaucgccucgaaacgcccccggcgaaauccucuggagugcaccccuaggcccagaccuuaaccccuacuugucccaccucgcccgcauguacaacggauacgccggagguuucgaaguccaggucauccuagccggcaaugccuucaccgccggaaaaauuauauucgccgccgucccacccaacuuccccaucgaaggccucucacccucccaagucaccauguucccccacaucaucgucgacguucgacaacucgaacccguccucaucccccuccccgacguacgaaacaacuucuaccacuacaaccaacucaaugacuccaccaucaaacugaucgccaugcucuacacaccccuccgagccaacaacgccggugaagaugucuucaccgucuccugccgcguacucacccgccccucccccgacuucgacuucaucuuccucgucccucccaccguugaaucucgcacaaaacccuucaccguccccauacuuaccgucgaagaaaugacuaacucacgcuuccccauaccccucgaaaaacucuucaccggccccucaucagcauucgucguccaaccccaaaacggccgcugcacuacagacggcguacuccucggcacaacgcaacucuccccagucaacaucugcacuuucagaggcgacguaacccacaucgccggcucacgcaacuacacaaugucccucgccucacuaaacuggaauaacuacgaccccaccgaagaaauccccgccccacucggcacucccgacuucgucggaaaaauucaaggcguucucacccaaaccaccaaaggagacggauccacucgcggccacaaagcuacagucuacacaggcuccgcaccauuuacccccaaauuaggauccguacaguucucaaccgacacugaaaacgacuucgaaacacaccaaaacaccaaguucacccccgucggcguaauucaagacggagguacuacacacagaaacgaaccccaacaguggguccucccaagcuauuccggccgaaauguccccaacguccaccucgcuccagccguugcccccaccuuccccggugaacaacuucucuucuuccgcucaacaaugccuggcugcuccggcuaccccaacauggaccuagacugccuccucccccaagaauggguccaacacuucuaccaagaagcugcacccgcccaauccgacgucgcccuacuccguuuugucaaccccgauacgggccguguccuauucgaaugcaaacuacacaaauccggauacgucaccguagcccacacaggccaacacgaccuagucauaccucccaacggcuacuuccgauucgacuccugggucaaccaauucuacacccucgcacccaugggaaacggcaccggccgacgccgauaa

SEQ ID NO: 38233 - RNA, 1617 nt, Artificial Sequence
  derived and/or modified sequence opt11 from VP1__Norovirus_and/or_Norovirus-like__AB933679
augaaaauggcauccaacgacgccaaucccuccgacggcucugccgccaaucucgucccagaaguaaacaacgaagucauggcccucgagccagucgucggagccgcuauagcagcccccguugccggccaacaaaacgucauugaccccuggauucggaacaacuucguccaagcccccgguggcgaguucaccgucucuccucgcaacgcccccggagaaauccucugguccgcuccacuaggaccagaccucaacccauaccucucccaccuagcucgcauguacaacggcuacgccgguggcuucgaaguccaaguaauacuagcaggcaacgccuucacagccggaaaaaucaucuucgccgcuguuccaccgaacuuccccacugaaggacucucaccuucccaggucacaauguucccccacauaauagucgacgucagacaauuagaaccuguacucaucccucuccccgacguccgcaacaacuuuuaucacuauaaccaauccaaugacagcacuauaaagcucaucgcaaugcucuacacuccacuccgagccaacaacgccggcgaagacgucuucacagucuccugccgcguccuaacacgucccucacccgacuucgacuucaucuuccucguaccacccaccguagaaucccgcaccaaacccuuuacaguacccauccucaccguugaagaaaugaccaacucucgcuucccuaucccccuugaaaaacucuuuaccggccccuccucagccuucaucguucaaccacaaaacggacgcugcaccacagacggcguccuccuaggcacaacccagcuauccccuguaaacaucugcacauuccgcggcgacgucacccacaucgcaggcucacgcaacuacaccaugaaccucgccucccuaaauuggaacaacuacgacccaacagaagaaaucccagccccacucggcacccccgacuucgucggcaaaauccaaggcguacucacacaaacaaccaaaggggacgguuccacccgaggccacaaagcaaccguauauaccggcucagcccccuucacccccaaacuuggcucaguccaauucuccaccgacaccgaaaacgauuucgaaacccaccaaaacaccaaauucacuccaguuggcguaauccaggacgguggcacaacccaucgcaacgaaccccaacaauggguucugcccuccuacucaggccgcaacguaccaaacguccaucuugcccccgcugucgcccccaccuucccaggcgaacaacuccucuuuuuccgauccacaaugcccgguugcagcggcuaccccaacauggaccuugacugccuucucccacaagaauggguccaacacuucuaccaagaagccgcuccagcccaguccgacgucgcccuccuccgauucgucaaccccgacaccggccgcguccuguucgagugcaaacuccauaaauccggcuauguaaccgucgcccacaccggacagcacgaccucgucauaccacccaacgguuauuuucgcuuugacucaugggucaaccaauucuacacccuugcucccaugggaaacggcaccggccgccgccgcuga

SEQ ID NO: 38234 - RNA, 1617 nt, Artificial Sequence
  derived and/or modified sequence opt11 from VP1__Norovirus_and/or_Norovirus-like__AB933661
augaaaauggccucaaacgacgcgaacccaucagacggcuccgccgcuaauuuaguaccagaagucaacaacgaagucauggcccucgaaccugucgucggcgcagcaaucgccgccccaguagccggccaacaaaacgucaucgacccuuggauccgcaacaacuucguccaagcaccaggcggagaguucaccgucucacccagaaacgcaccaggcgaaauacuaugguccgaaccacucggcccugaccucaauccauaccucucgcaccucgcacgaauguacaacggauacgccggcgguuucgaaguccaaguuauccucgcaggaaacgccuucacagcgggcaaaauaaucuucgcagcgguaccucccaacuuccccaccgaaggccucucucccucccaaguaaccauguucccccauaucaucgucgacguacgacagcucgaacccguucucauuccccucccagacguucgaaacaauuucuaccacuacaaccaaagcaacgacuccacuauaaaacucaucgcaaugcucuacaccccacuucgcgccaacaacgccggcgaagacgucuucacuguauccugccgaguccuuacccgucccagccccgauuucgacuucauuuuccucguucccccaaccgucgaaucccgcacaaaaccauucacuguccccauacucacagucgaagaaaugacuaacucccgauuccccauaccacucgaaaaauuauucaccggacccuccuccgccuucgucguucaaccccaaaauggacgcuguaccaccgacgggguacuucucggcacaacccaacuuucacccguuaacaucugcaccuuccgcggcgacgucacccacaucgccggcagccgaaacuacacaaugaaccucgccucacucaacuggaacaacuacgaccccaccgaagaaaucccagcaccccuugguaccccagacuucgucggcaaaauccaaggaguccuaacccaaaccaccaagggggauggcucaaccagaggccacaaagcaaccguguacaccggcucagcccccuucacccccaaacuagguucuguccaauucucaaccgacaccgaaaacgacuucgaaacccaccaaaacaccaaauucacacccgucggaguaauacaagacggcggaacuacacaccgaaaugaaccacagcaauggguacucccauccuacucaggccgcaacguacccaacguucaccuagcucccgccgucgccccgacauucccaggugaacaacuacuuuucuuccguucaaccaugcccggaugcuccggcuaccccaauauggaccucgacugccuccucccccaagaauggguacaacacuucuaccaagaagcagcccccgcccaauccgauguagcccuccuccgguucgucaaccccgacacaggccgcguccuauucgaaugcaaacuccacaaauccggcuacguaacaguagcacacaccggccaacaugaccucguaaucccgcccaauggcuacuuccgcuucgacucauggguaaaccaauucuacacacucgcccccaugggcaauggcaccggccggcgccguuaa

SEQ ID NO: 38235 - RNA, 1617 nt, Artificial Sequence
  derived and/or modified sequence opt11 from VP1__Norovirus_and/or_Norovirus-like__KT152148
augaaaauggccuccaacgacgccaacccauccgauggaucugccgccaaucucguccccgaagucaacaacgaaguaauggcacuagaacccguaguaggagccgcgauugccgcucccgucgccggccaacaaaacgucaucgaccccuggauccgcaacaacuucguacaagcccccggcggugaguucaccgucucaccccgaaacgcacccggcgaaauacuaugguccgcaccccucggccccgaccuaaaccccuaccucucccaccucgcccgaauguacaauggauacgccggcgguuucgaaguccaaguuauucucgcaggcaacgccuucaccgcaggcaaaauuaucuucgcugccgugccacccaacuuccccaccgaaggccucucacccucccaagucacaauguucccccacauaaucgucgacguccgucaacuggaacccguccuaaucccacuacccgacguccgcaacaauuucuaccacuacaaccaauccaacgacucuaccaucaaacucauagccaugcucuauaccccacuacgcgccaacaacgccggugaagacguauucaccgucuccugccguguacucacacgacccuccccugauuucgacuucaucuuccucguucccccuaccguugaaucacgcaccaaaccuuuuaccguccccauccucacugucgaagaaaugaccaacucccgguuccccaucccccucgaaaaacucuucaccggucccagcggcgcauucgucguccaaccccaaaacggccgcugcaccaccgacggcguccuccucggcaccacccaacuuuccccgguaaacauaugcaccuucagaggugacguaacccacaucgccggcucacgcaacuacaccaugaaucucgcuucccuaaacuggaacaacuacgaccccaccgaagaaauaccagcaccccucggaaccccugacuucgucggcaaaauacaaggcguccuaacucaaaccaccaaaggagacgguagcacucgcggccauaaagccaccguauacaccggcuccgcccccuucacacccaaacuaggauccguccaguucuccaccgacaccgaaaacgacuuugagacccaccaaaauacuaaauucacccccgucggcguaauccaagacggcuccaccacccaccgcaacgaaccccaacaauggguacuaccuagcuacuccggacgcaauguccacaacguccaccucgccccagccguugcccccaccuuccccggcgaacagcuccuauucuuucgcuccacaaugcccggaugcuccggauaccccaauauggaccucgacugccuccuaccccaagaauggguccaacacuucuaccaggaagccgccccugcccaauccgacgucgcccuccuccgauucgucaaucccgacaccggacguguccuguucgaaugcaaacuccacaaauccggauacguaaccgucgcccacaccggccaacacgaccuugucauacccccaaacggcuacuuccguuucgacuccugggucaaccaauuuuacacucucgcccccaugggaaacggcaccggccgacgccgcuaa

SEQ ID NO: 38236 - RNA, 1617 nt, Artificial Sequence
  derived and/or modified sequence opt11 from VP1__Norovirus_and/or_Norovirus-like__EU921393
augaaaauggccucaaacgaugcaaaccccucagauggauccgccgcaaaccucguaccagaagucucuaacgaaguaauggcccucgaacccguagucggagccgccaucgccgcucccgucgccggacaacaaaaugucaucgacccauggauccgaaacaacuucguucaggcacccggcggugaguucaccgucucaccccguaaugcccccggcgaaauucucugguccgccccacucggccccgaccucaauccauaccucucccaccuugcacgcauguacaacgguuacgccggcggcuucgaaguccaggucauccucgccggcaacgcauucacagccggaaaaaucaucuucgcagcaguacccccaaacuuccccaccgaaggccucuccccaucccaggucaccauguucccacacaucaucgucgacguccgccaacuagaaccuguccuaaucccccuucccgacguccgaaacaacuucuaccacuacaaccaauccaaugacuccaccauuaaacugaucgccaugcucuacacaccccuccgagccaacaacgcaggggaagacgucuuuacagucuccugccgcguccuaacccgacccuccccugacuucgacuuuaucuuccucgucccucccaccgucgaaucccgaaccaaaccauucaccguccccauacuaacuguagaagaaaugacuaacucccgcuuccccaucccccuggaaaaacucuucaccggccccucuggagccuucgucguccaaccccaaaacggccgaugcacaaccgacggcguccuccucgguacaacacaacucucccccgucaacaucugcacauuccgcggagacgucacucacaucgccggcucccauaacuauaccaugaaccucgccucucuuaacuggaacaacuacgaccccaccgaagaaauccccgccccacucggcacccccgacuucgucggcaaaauccaaggaguacucacccaaaccaccaaaggugacggaucaacucgcggccacaaagccaccgucuacacaggauccgccccauucacccccaaacucggcuccguccaauucuccacagauaccgaaaacgacuucgaaacccaucaaaacacaaaauucacacccgucggagucauccaagacggcagcaccacccacagaaacgaaccccaacaguggguccuacccucauacuccggcucuaacguucacaacguccaccucgcccccgccgucgccccaaccuuccccggcgaacaacuacucuuuuuccgaucaaccaugcccgguugcuccggcuaccccaauauggaccuagauugccuucucccacaagaauggguacagcacuucuaccaagaagcagccccagcacaaucagacgucgcacuucuacgcuucgucaacccagacaccggccgaguacucuucgaaugcaaacuacauaaaucuggcuacgucacagucgcacacacuggccagcaugaccucguaauaccacccaauggcuacuucagauucgacucaugggucaaccaauucuacacacucgcccccaugggaaacgguacuggucgacgcagauaa

SEQ ID NO: 38237 - RNA, 1617 nt, Artificial Sequence
  derived and/or modified sequence opt11 from VP1__Norovirus_and/or_Norovirus-like__KM396961
augaagauggccuccuccgacgccaaccccuccgacggcuccgccgccaaccucguccccgaagucaacaacgaagucauggcacuagaacccgucguaggcgcagcaaucgcagcacccgucgccggccaacaaaacguaauagacccuuggauaagaaacaacuuuguacaagcucccggcggcgaguucacaguaucuccacgcaacgcaccaggcgaaauccucuggucagcuccccucggccccgaucucaaccccuaccucucacaccucgcacgaauguacaacggcuacgcagggggcuuugaaguccaagucauacucgcgggcaacgccuucaccgcuggaaaagucaucuucgcagccguaccacccaacuuccccaccgaaggccuuagccccucccaagucacaauguucccccacaucguagucgauguccgacaacucgaaccaguacucaucccacuucccgacguccgcaacaacuucuaccacuacaaccaauccaaugaucccaccauaaaacuaaucgcuaugcucuacacaccccuacgagcaaacaacgccggcgaugacgucuuuacuguaagcugccgaguccugacccgcccaucucccgacuucgacuucaucuuccucguacccccaaccgucgaaucaagaacaaaaccauucuccguccccguccucaccgucgaagaaaugaccaacucccgcuuccccaucccccuagagaaacucuucaccggcccauccuccgccuucgucguccaaccacagaauggccgcugcaccaccgacggcguacuucuaggcaccacccaacuuuccccagucaacaucugcacauuccgcggcgacguaacccacacuaccggaucacacaacuacaccaugaaccucgcaucccaaaacugguccaacuacgacccaacagaagaaauucccgccccacucggcacacccgacuucgucggaaaaauccaaggcguacucacccagaccacacgcaccgacggauccacccgcggacacaaagccaccgucagaaccggcuccgccgacuucgccccaaaacucggccgcguccaauucgagaccgacaccgaccacgacuucgaagccaaccaaaacacgaaauucacacccguaggcgucauucaagauggcuccacgacacaccgaaacgaaccacaacaauggguccucccauccuacucaggccguaacacuccuaacguccaccucgcuccugcagucgcccccaccuuucccggcgaacaacuacuuuucuuccgcucuaccaugcccggcugcuccggcuacccaaacauggaucucgacugccuccuuccacaagaauggguucaacacuucuaccaagaagccgcccccgcacaauccgacgucgcccuacuccgauuugugaaccccgacaccggcagaguccuauucgaaugcaaacuccacaaaucaggauacguaaccguagcacacaccggccaacacgaccuaguaaucccgccuaacggcuacuuccgcuuugacuccuggguuaaccaguucuacacucucgccccaaugggcaacggcacaggccgucgaagauaa

SEQ ID NO: 38238 - RNA, 1617 nt, Artificial Sequence
  derived and/or modified sequence opt11 from VP1__Norovirus_and/or_Norovirus-like__KM198485
augaagauggccuccaacgaugccaacccuuccgacggcucagccgccaaccucgucccagaggucaacaacgaaguaauggcacucgaaccaguagucggcgccgccaucgccgcccccgucgcaggccaacaaaacgucauugacccuuggauccgcaacaacuucguccaagcaccgggcggagaguucacagucagcccccgcaacgcucccggugaaauccucuggagcgcaccccucggcccagaccuaaaccccuaccuaucacaccucgcccgcauguacaacgguuacgccggcggcuucgaaguccaagucauacuagccggcaacgccuucaccgcaggaaaaauaaucuuugcagcaguacccccaaacuuucccacagaaggacucucccccucccaagucaccauguucccacacaucaucguugacguccgccaacuggaacccguccucauaccccugcccgacguccgcaacaauuucuaccacuacaaccaaaccaacgacuccaccauaaaacucaucgcaaugcuuuacacaccacuacgugcaaacaacgcaggcgaagacguauucaccgucuccugucgcguccuaacacgccccagcccagacuucgacuuuaucuuccucgucccacccacuguagaaagccgaaccaaacccuucacaguccccauccuuacugucgaagaaaugaccaacucaagauuccccaucccccucgaaaaacucuuuaccggcccguccuccgccuucgucguccaaccccaaaacggccgcugcacaaccgacggaguccuccucggcaccacccaacuuucccccgucaacaucugcaccuuccgcggcgacguuacacacaucgcuggcucacgcaacuacaccaugaaccucgcuucccuaaacuggaauaacuacgacccgaccgaagagaucccagccccacuagguacccccgacuuugucggcaaaauccaaggcguucuaacacaaaccacaaaaggcgacggcuccacccgcggacacaaagccaccgucuauacaggcagcgccccauuuacccccaaacucggcucuguccaauucuccaccgacaccgaaaacgacuucgaaacccaccaaaauaccaaauucacccccgucggagucauacaagacgguggaacaacucaccgcaacgaaccucaacaauggguccuacccagcuacuccggccgcaacguacacaacguacaccucgcacccgcuguagccccaaccuuccccggcgaacaacuucuauucuuccgcuccaccaugcccggcugcucagguuacccaaacauggaucuagacugccuacuaccucaagaauggguccaacacuucuaccaagaagccgcaccagcacaaucugacgucgcucuccuccgcuucguaaaccccgacacaggucgcguccucuucgaaugcaaacuacacaaauccggcuacguaaccguagcccacaccggccaacacgaccucgucauacccccuaacggcuacuuccgauucgacuccugggucaaccaauucuacacccucgcccccaugggcaacggcaccggccgccgucgcuaa

SEQ ID NO: 38239 - RNA, 1617 nt, Artificial Sequence
  derived and/or modified sequence opt11 from VP1__Norovirus_and/or_Norovirus-like__KF306214
augaagauggcaucaagcgacgcaaacccaucugacggcucagccgcaaaccucguccccgaagucaacaacgaaguaauggcucuugaaccagucgucggcgccgccaucgcagcccccgucgccggccaacaaaacguaaucgacccauggaucagaaacaauuuuguacaagccccaggaggcgaguucaccgucaguccacgaaacgcccccggcgaaauccucuggucagcuccccucggccccgaccucaaccccuaccuaucccaccuagcccgcauguacaauggcuacgccggcggcuucgaaguucaagucauccuagccggaaacgcauucaccgcaggaaaagucaucuucgcagccgucccucccaacuuccccaccgaaggcuuaucacccucgcaagucacaauguuuccacacaucgucgucgacguccgccaacuagaaccaguucuaaucccccuaccagacguaagaaacaacuucuaccacuacaaccaaucuaacgaccccaccaucaaacucauagccaugcucuacacaccccuaagagcaaacaaugccggcgacgacgucuucacagucucaugccgaguccucacccgcccuucccccgacuucgacuuuaucuuucucguucccccuaccgucgaaucccgaaccaaaccuuucucggucccaguacuaaccgucgaagaaaugacaaauucgcgcuucccaaucccccuagagaaacuuuucaccggacccucauccgccuucgucguccaaccccagaacggacgcugcaccaccgacggcguccuacuaggaaccacacaacuaucccccgucaacauauguacauuccgcggcgacgucacacacauaaccggcucccgaaacuacaccaugaaccucgccucacaaaauuggaacaacuacgaccccaccgaagaaaucccggcaccccucggcgcccccgacuucguaggaaaaauccaaggcgucuuaacccaaacaacccgcaccgacggauccacacgcggccacaaggccaccguauacaccggcuccgccgacuucgcaccuaaacuaggacgaguccaauucgagaccgacaccgaucacgacuucgaaguaaaccaaaauaccaaguucaccccaguaggcgucauccaagauggcggaaccacucacagaaacgaaccccaacaauggguccuccccucuuacucaggacgaaacacacccaauguacaccuagcccccgccguggcccccacguuccccggcgaacaacuccuauucuuccgcuccaccaugccaggcugcuccggcuaccccaacauggaccuagacugccuacucccccaagaauggguccaauauuuuuaccaagaagccgccccugcccaauccgacgucgcccuacuacgauuuguuaacccagacacuggacgcguacuuuucgagugcaagcuccacaaauccggcuaugucaccgucgcccacaacggccaacacgaccuagucauacccccaaacggguacuucagauucgacuccugggucaaccaauucuacacccucgcccccaugggcaauggcaccggacgcagacgauga

SEQ ID NO: 38240 - RNA, 1617 nt, Artificial Sequence
  derived and/or modified sequence opt11 from VP1__Norovirus_and/or_Norovirus-like__JX439831
augaaaauggcaucaucggacgccaaccccucagacggcuccacugccaaccucgucccagaaguuaacaacgaagucauggcacucgagcccgucgucggagccgccaucgccgcacccgucgccggccaacaaaacgucauagacccuuggauccgcaacaacuucguucaagcccccggcggcgaguucacaguaucgccucgcaacgcccccggugaaaucuuauggucugcaccacugggccccgaccuaaaucccuaccucucccaccucgcacgcauguauaacggcuacgcaggaggguucgaaguacaagucauacucgcagggaacgccuucacugcagguaaaaucauuuucgccgccguacccccaaacuuccccaccgaaggccucucacccucccaggucaccauguucccucacaucaucgucgacguccgccaacuagaaccaguccucauacccuuaccagacguacgcaacaacuucuaccacuacaaccaauccaacgaccccacuaucaaacucaucgcaaugcuauauacaccccuacgcgccaacaacgcaggcgacgacgucuucacaguauccugccgagucuuaacacgacccagccccgacuucgauuucauauucuuagucccucccacaguagaaucucgaaccaaaccuuucucaguuccaauccucacagucgaagaaaugacaaacucccgauucccuaucccacucgaaaaacucuucaccggaccaucguccgccuucgucguacaaccccaaaacggucgcugcacaauugacgggguacuccuuggaaccacccaacugucccccgugaacaucugcacauucaggggugacguaacacacaucacaggcucccgaaacuacaccaugaaccuggcaacccaaaacuggaacucguacgacccaacagaagaaauccccgccccacuagguacccccgacuucgugggcaaaauacaaggcguccuuacacaaaccacucgcgccgacggauccacccgcggccacaaagcaaccgucuacaccggcagcgccgacuucgccccaaaacucggccgcguucaauucgccaccgacaccgacaacgacuucgacgcaaaccaaaacacaaaauucaccccugucggaguaauucaagacggcaacaccgcacaccgcaacgaaccccaacaauggguccuccccucauacucaggccgcaacucucacaacguccaccucgcacccgcagucgccccaacauuccccggcgaacaauuucucuucuuccgcucaaccaugcccggcuguucuggcuaccccaacauggaucuagauugucuccuaccacaagaauggguccaauacuuuuaccaagaagccgcccccgcacaauccgacgucgcccuauuacguuuugucaaccccgacacaggccggguacucuucgaaugcaaacuccacaaaucuggcuacgucaccguugcccauaccggccaacacgaccuggucaucccaccaaacggauacuuccgcuucgacuccugggucaaccaauucuacacacuagcccccaugggcaacggaaccggacgucgacgauaa

SEQ ID NO: 38241 - RNA, 1617 nt, Artificial Sequence
  derived and/or modified sequence opt11 from VP1__Norovirus_and/or_Norovirus-like__KC409281
augaaaauggccuccaacgacgcaaaccccucagacggcuccgcugcaucccuaguccccgaaguaucaaacgaaguaauggcccuagaacccgucgucggcgcagcaauagccgcccccguugccggccaacaaaacgucaucgaccccuggauccgcaacaacuucguccaagcaccaggcggcgaguucaccgucuccccacgcaacgcuccaggugaaauacucugguccgcaccccucggccccgaccuaaaccccuaccucucacaccuagcccguauguacaacggcuacgccggcggcuucgaaguacaagucauacuagccggcaacgccuucacggccggcaaaaucaucuucgcugccgucccacccaacuuccccaccgaaggccuaucacccucgcagguaacuauguucccccacaucaucguagauguacgucaacuugaacccguacucauaccccucccagacguacgcaacaacuucuaccacuacaaucaaacaaacgaccccacuauaaaacucaucgcaaugcucuacacaccccuccgcgccaacaacgccggcgaagacgucuucaccgugagcugccgcguacucacccgacccuccccagacuucgauuucaucuuccucguaccucccacagucgaaucccgcaccaaacccuuuacaguccccauccucacaguagaagaaaugaccaacucccgcuuccccaucccccuugaaaaacucuucaccggacccuccggcgccuuuguuguccaaccucaaaaugggagaugcaccaccgacggaguacuccuugguacaacccagcuuucacccgucaacaucugcacuuuccgaggagacgucacccacauagcaggaucccgcaacuacaccaugaaccucgccucacuaaacuggaacaacuacgaccccacugaagaaaucccagccccacuaggaacaccagacuuuguuggaaaaauacaaggaguacucacccaaaccaccaagggagacggcuccacccgcggccacaaagccaccgucuacacaggcucagcccccuucacacccaaacucggcucgguccaauuuuccaccgacacagaaaacgacuucgagacccaccaaaacacuaaauucacccccguaggcgucauccaagacggcggaaccacacaccgaaacgaaccccaacaauggguacucccuagcuacuccggccgcgacguccacaacguucaccucgccccagccgucgcccccaccuuccccggcgaacaacuccuauucuuccgaucaacaaugcccggaugcuccggcuauccaaacauggaccucgacugccuacucccccaagaauggguccaacacuuuuaccaagaagcagcuccagcacaaucugauguugcucuacuccgcuucguaaaucccgacaccggacgcguacuauucgaaugcaagcuccacaaaucuggcuacgucaccgucgcccacaccggacaacacgaucucgucaucccacccaacggcuacuuccgcuuugacuccugggucaaccaauucuacacccuugcccccaugggaaacggcaccggacgucgccgauaa

SEQ ID NO: 38242 - RNA, 1617 nt, Artificial Sequence
  derived and/or modified sequence opt11 from VP1__Norovirus_and/or_Norovirus-like__JX459639
augaaaauggcauccaaugacgccaacccaagcgacggaucagcugccaaccuuguccccgaagucaacaacgaaguaauggcccucgaacccgucgucggagcagccaucgcagcccccgucgcaggccaacaaaacgucaucgacccauggauccgcaacaacuucguucaagcccccggcggagaauuuaccguaagcccucgaaacgcccccggcgagauacucuggagcgcaccccuuggcccggaccucaacccauaccucucccaccuugcacgcauguacaauggauacgcuggcggauucgaaguccaggucauccucgccggcaacgccuucaccgccggcaaaaucaucuucgcagccgucccaccaaacuuccccaccgaaggccucucccccucccaaguaaccauguucccccacaucaucgucgacguccgccaacucgaacccguccuaauaccccucccagacguccgaaacaacuucuaucacuacaaccaaaguaacgacuccaccaucaaacucauugccauguuauacacaccccucagggccaacaacgccggagaagacgucuucacagucucuugccgaguccuaacaagacccucccccgacuucgauuucaucuuccucgucccaccaaccgucgaaucccgcacgaaacccuucaccguuccuauccucaccgucgaagaaaugacaaacucacgcuuccccaucccccucgaaaaacucuucaccggaccaucaucagccuucguaguccaaccccaaaacggcagaugcaccaccgacggcguacuacucgggaccacacaacucucaccagucaacaucugcacauuccgcggagacgucacacacaucgccggcucacgcaacuacaccaugaaccucgccucacuaaacuggaauaauuacgacccaacugaagaaauccccgcaccccucggcacccccgacuucgucggaaagauccaaggaaugcucacacaaaccaccaaaggcgacggcucaacccgcggacacaaagccaccguauacaccggcagcgcccccuucaccccgaaauuaggcucgguccaauucucaacagacaccgaaaacgacuucgaaacccaccaaaacaccaaauucacccccguuggcguaauccaagacggcucuaccacccaccggaacgaaccacaacaauggguacuacccuccuacuccggacgcaacguccaaaacgugcaccucgcacccgcaguagccccuaccuucccaggcgagcaacuccucuucuuucgcucaacaaugcccgguugcucgggauaccccaacauggaccuagauugccuccucccucaagaauggguccaacacuucuaccaagaagcagcaccagcacaaucagacguggccuugcuucgauucgucaacccagacacaggccgcguacuauucgagugcaagcuccacaaaucgggauacguuacagucgcucacacaggccaacacgaccuagucauaccucccaacgguuacuucagauucgauagcugggucaaccaguucuacacccucgcccccaugggcaacggaaccggccgccgccgauaa

SEQ ID NO: 38243 - RNA, 1617 nt, Artificial Sequence
  derived and/or modified sequence opt11 from VP1__Norovirus_and/or_Norovirus-like__JX459609
augaaaauggccucaaacgacgcaaacccauccgacggcuccgccgccaaccugguccccgaagucaacaacgaagucauggcccucgaacccguagucggagccgcaaucgccgcccccgucgcuggccaacaaaacgucauagauccuuggauacgcaacaacuucguacaagcccccgggggcgaauuuaccgucuccccacgcaacgcccccggcgaaauucucugguccgcaccccucggaccagaccuaaacccauaccucucacaccucgcccgcauguacaacggcuacgccggaggcuucgaaguccaaguuauccucgccggcaacgccuucaccgcaggaaaaauaaucuucgccgccgucccucccaacuuccccacagaaggccuauccccaucccaagugaccauguucccccacauuaucgucgacguccgccaguuagaaccaguacucauaccccuccccgacgucagaaacaacuucuaccacuacaaccaaagcaacgacuccaccaucaaacuaaucgcaaugcuuuacacaccccuucgcgccaacaaugcuggcgaagacgucuucaccgucucgugccgaguccugacucgacccucccccgacuuugacuucaucuuccucguaccacccaccgucgaaucccgaaccaaacccuucaccguccccauccucaccguagaagaaaugacuaacucacgauuccccaucccacuagaaaaacucuucaccggccccagcggcgccuucgccguccagccacaaaacgggcgauguaccaccgacggcguccuccuaggaaccacccaacucucccccgucaacaucugcaccuucagaggcgacguuacccacaucgcaggcucacguaauuacaccaugaaccuagccucacucaacuggaacaacuacgaucccaccgaagaaauccccgcaccacuaggaacaccugacuucgucggaaagauacaaggcguccucacccaaaccacaaaaggcgacggauccacgcgcggccacaaagccacagucuauacugguucagccccauucacaccaaagcucggaucaguccaauucucuaccgacaccgaaaaugacuuugaaacacaccaaaauacaaaauucacccccguuggaguaauucaagacggcggcaccacacaccgaaacgaaccccaacaauggguccuuccaagcuauuccggacgcaacguacacaacguacaccucgcccccgccgucgcccccaccuuucccggagaacaacuccuguucuuccgauccacaaugccuggcugcucaggcuaccccaauauggaccucgauugccuacucccacaagaauggguccaacacuucuaucaagaagccgccccagcccaauccgacguagcccuacuacguuucgucaaccccgacaccggccggguccuuuucgaaugcaaacuucacaaaucuggcuacgccaccgucgcccacacaggccaacacgaccucgucauacccccuaacggcuacuuccgauucgacucauggguuaaccaauucuacacacuagcaccaauggguaauggaaccggccgccgcagauaa

SEQ ID NO: 38244 - RNA, 1617 nt, Artificial Sequence
  derived and/or modified sequence opt11 from VP1__Norovirus_and/or_Norovirus-like__JN400599
augaaaauggcauccaacgaugccaccccaucagacggcuccaccgccaaccuagucccggaagucaacaaugaagucauggcacucgaaccaguaguaggcgccgccaucgcugcccccguggccggccagcaaaacgucauagaccccuggauccgcaacaacuucguccaagcacccggaggugaguucacagucucccccaggaacgcacccggagaaauccucuggucagccccacuaggccccgaccuaaacccauaccucagccaccuagcccguauguacaacggcuacgccggaggcuucgaaguccaggugauccucgccgguaacgccuucaccgcuggcaaaaucaucuucgcagcaguaccacccaauuucccaacagaaggauugucccccucacaagucacuauguucccccacaucauagucgacguacgccaacucgaacccguccuaauaccccuccccgacguccguaacaacuucuaucauuacaaccaauccaacgaccccaccaucaaacucauugcaaugcucuacacaccccuccgcgccaacaacgccggagacgauguauucaccgucuccugccgcguacuuacccgccccagccccgacuucgacuucaucuuccucgucccacccaccgucgaaagccgaaccaaacccuucucaguccccauccuaaccgucgaagaaaugaccaacucacgcuuccccauaccacucgagaaacucuucacaggccccucuuccgcuuucgucguccaaccacaaaacggccgcugcaccaccgacggcguccuucucggcaccacacaacuuucucccgucaauaucugcaccuuccgcggcgacgucacccacauagcaggcacccaaaacuacacaaugaaucucgcaucacaaaacuggaacaacuacgacccaaccgaagaaauccccgcuccccucggcaccccagacuucgucggaaaaauccaaggcguacuaacccagacuacaucacgcgacggaucaaccagaggccacaaagccacagucuccaccggcagcguacacuucacaccaaaacucggcuccguccaauucuccaccgacaccuccaaugacuucgaaaccggacaaaacacccgguucaccccagucggaguuguccaagacggcagcaccacucaccaaaacgaaccacagcaauggguccucccaaacuacuccggacgugacagccacaacguccaccucgcccccgcagucgcuccaacauuccccggggaacaacuccucuucuuccgcuccaccaugcccggaugcucaggcuacccaaauaugaaccuagacugccuccucccccaagaauggguccaacauuucuaccaagaaagcgcccccgcccaauccgacguugcccuccugcgcuuuguuaaucccgacacaggacgaguccuuuucgaaugcaaacuccacaaacccggcuacgucacugucgcccacaccggacaacacgaccucguaaucccaccuaacggcuacuuccgcuucgacagcuggguuaaucaauucuacacccuagcccccaugggcaacggagcaggaagacgccgcuaa

SEQ ID NO: 38245 - RNA, 1617 nt, Artificial Sequence
  derived and/or modified sequence opt11 from VP1__Norovirus_and/or_Norovirus-like__JQ613539
augaaaauggcaagcucagacgccaacccaagcgacggauccaccgccaaccuaguacccgaagucaacaacgaaguaauggcucuugaacccguggucggcgcugccaucgccgccccagucgccggacaacaaaacgucaucgacccguggauccgcaacaacuucguccaggccccuggcggagaauuuaccgucucuccacgaaaugcccccggagaaauucuauggagcgcaccccucggaccagaccucaaccccuacuuaucucaccuagcccgcauguauaacggauacgccggcggcuucgaaguccaggucauacucgccggcaacgccuucaccgccggaaaaauaauauucgcagccguaccucccaacuuccccaccgaaggacucucacccucacagguaaccauguucccucacaucaucgucgacguacgccaacuagaaccgguccuaauaccccuccccgacguacggaacaacuucuaccacuacaaccaauccaacgaccccaccaucaaacuaaucgccaugcuuuacacaccucuccgagccaacaacgcaggagacgacguauucaccgucuccugccgcguacucacccgucccucccccgacuucgacuucauauuccucgugcccccaaccgucgaaucccgcacuaaacccuucagcguccccauccucaccguggaagaaaugacaaacucgagauucccaauuccccucgaaaaacuauuuaccggccccucauccaccuucguuguccaaccacaaaauggccgaugcacaaccgacggcguucuccuaggcacaacacaacuaagcccagucaacauauguaccuuccgcggcgacgucacccacaucgcaggcucacacaacuacaccaugaaccucgcaagccaaaacuggaacuccuacgaccccaccgaagaaauucccgcaccccucggaacccccgacuucguaggcaaaauacagggaguccuaacccaaaccacgcgaacugacggauccacccgaggccacaaagccaccgucuacaccggcuccgcggaauuuucccccaaacucggacgaguccaauucgccaccgacacuaacaacgacuucgacgcaaaccaaaacacaaaauucacaccuguaggcgucauccaggacggcggcacuacccaccguaacgaaccccaacaauggguccucccauccuacuccggccgaaacacccacaauguccaccucgcccccgcuguagcucccaccuucccaggcgaacaacuccuauucuuccgcucaacgaugcccggcugcucugguuaucccaauauggaccucgacugccucauuccacaggaauggguccaguauuucuaccaagaagccgcccccgcacaaucggacgucgcacuucuccgcuucgucaaccccgacaccggccggguacucuucgaaugcaaacuacacaaauccggcuacgucaccgucgcacacaccgggcaacacgaccuaguaaucccacccaacggcuacuuccgguucgacuccugggucaaccaauucuacacucucgcacccaugggcaacggcaccggccgccgcagauaa

SEQ ID NO: 38246 - RNA, 1617 nt, Artificial Sequence
  derived and/or modified sequence opt11 from VP1__Norovirus_and/or_Norovirus-like__HQ456329
augaaaauggccucaaaugacgcaaaccccuccgacggcuccgccgcaaaccuagucccggaaguaaacaacgaaguaauggcacuggaacccgucgucggcgccgccaucgccgcccccguagccggucagcaaaacgucaucgaccccuggaucagaaacaacuucguccaagcaccaggcggagaguucaccguaucccccagaaacgcccccggugaaauccuuugguccgcaccccucggcccagacuugaaccccuaccuaucacaccucgcccgaauguacaacggauacgcaggcggcuucgaaguccaaguaauccucgcaggcaaugccuuuaccgccggcaaaaucauauucgccgccguucccccgaacuuccccaccgaaggucucucaccaucacaagucaccauguucccccauaucauugucgacguccgccagcucgaacccguccucauaccccuaccugacguacgcaacaauuucuaccacuacaaccaaucaaacgauaguaccauaaaacucaucgccaugcuauacaccccucuacgagccaacaacgcuggcgaagacgucuucacagucucaugccgcguccucacaagacccuccccagacuucgacuucaucuaccuagucccacccacuguugaaucacgcaccaaacccuucaccguccccauccucaccgucgaggaaaugacuaauucacguuuccccauaccccucgaaaaacucuucacaggcccaucuggagccuucguuguucaaccacaaaauggccgcugcaccacagacggaguccuacucggcacuacccaacuauccccagucaacauaugcaccuuccgcggugacgucacccacauagccggaucaagaaauuacacuaugaaccucgccagccuaaacuggaacaacuacgaccccaccgaagaaauacccgcaccccucggcacacccgacuucgucggaaaaauucaagggguacucacccaaaccaccaaaggugacggauccacacgaggccacaaagccacagucuacacuggcggugcccccuucaccccuaaacucggcucaguccaauucuccacagacaccgaaaacgauuucgaaacccaccaaaacaccaaauucacccccgucggcgucauccaagacggcuccacuacccacagaaacgaaccacaacaguggguacuacccuccuauuccggcagaaacguccacaacguucaccuagcccccgccgucgcccccacauuccccggcgaacaacuccuauucuuccgcucuaccaugcccggcugcucaggcuaccccaacauggaccucgauugccuccucccacaagaauggguacaacacuucuaccaagaagccgcaccagcccaaagcgacguagcccuacuacgcuucgucaaccccgacaccggccgcguccucuucgaaugcaaacuccauaaaagcggcuaugucaccgucgcccacacaggccaacacgaccucgucauacccccaaacggauacuuccgauucgacuccugggugaaccaauucuacacccuagcacccaugggaaacggaaccggccgucgcagauaa

SEQ ID NO: 38247 - RNA, 1617 nt, Artificial Sequence
  derived and/or modified sequence opt11 from VP1__Norovirus_and/or_Norovirus-like__HM802536
augaaaauggccucuaacgacgccaaccccuccgacggcucagccgccaaucuaguucccgaagucaacaacgaaguaauggcacucgagcccguagucggcgccgccaucgcugcucccgucgcuggccaacaaaaugucaucgaccccuggauucgcaauaacuucguacaagcccccgguggcgaguucaccgucucuccacgaaaugcacccggagaaauccuuuggagcgcaccccucggccccgaccugaaccccuaucucucucaccuagccagaauguacaacggcuaugccggaggcuucgaaguccaaguaauccuugccggcaacgccuucacagcagguaagauaaucuucgccgccguuccacccaauuucccaaccgaaggccuaucuccuucacaagucacaauguuuccacacauuauugucgacguucgccaacuugaacccguacucauaccacuacccgacguccgcaacaacuucuaucacuacaaucaauccaacgacuccacuaucaaacucauagcaaugcucuauacaccccuacgcgcaaacaacgccggcgaagacgucuucaccguauccugccgcguacucacccgacccucacccgacuucgacuucaucuuccucgucccucccaccgucgaaucucgaaccaaaccauuuacaguccccauccucacagucgaagaaaugaccaacucacgcuuccccauaccccuagaaaaacucuucaccggaccuuccggcgccuucgucguccaaccccaaaacggccgcugcaccaccgacggcguccuccuaggcacaacucaacucuccccugucaacaucugcacuuuccgcggcgacguaacccacaucgccggcucccgcaacuacaccaugaaccuagcaucccuaaacuggaauaacuacgaccccaccgaagaaauccccgcuccccucggcgcccccgacuuugucggaaaaauccaaggcguccuaacccaaacuacuaaaggagacggcuccacccgcggccacaaagccaccgucuacaccgguuccgccccauucacucccaaacugggcucaguccaauuuuccaccgacacagaaaacgacuucgaaacacaccaaaacaccaaauucacccccgucggcguaauccaagacggcuccacaacccaccggaacgaaccccaacaaugggugcucccauccuauuccggccgcaauguccauaacguccaccuagcacccgcugucgcccccacauucccaggcgaacaacuacuuuucuuccgcuccaccaugcccggaugcuccggcuaccccaacauggaccucgacugccuacucccccaagaauggguccaacacuucuaucaagaagccgcacccgcacaaucagacguagcauuacuccgauucguuaacccagacacaggccgaguccuguucgaaugcaaacuacacaaaucaggcuacguaaccguggcacacaccggccaacaugaccucgucauacccccuaacggguacuucagauucgacuccuggguaaaccaauucuacacucuagcccccauggguaacggcacaggucgacgccgauaa

SEQ ID NO: 38248 - RNA, 1617 nt, Artificial Sequence
  derived and/or modified sequence opt11 from VP1__Norovirus_and/or_Norovirus-like__HM802532
augaaaauggccuccaacgacgcaaauccuuccgacggcuccgccgccaaucuaguacccgaagucaacaacgaagucauggcacucgaaccagucgucggagcagccaucgccgcacccgucgccggccaacaaaacguaauagaccccuggauccgcaacaacuucguccaagccccuggcggagaguucaccguaucuccccgaaacgcccccggcgaaauccuaugguccgccccacugggccccgaccucaaucccuaccuaucucaccucgcccgcauguacaacggcuacgcuggcgguuucgaaguacaagucauccuagccggcaaugccuucaccgccggaaaaaucaucuucgccgccguacccccaaacuuccccaccgaaggccucucccccucccaggucaccauguucccccacaucaucgucgacguccgccaacucgaacccguccucaucccccuucccgacguccgcaacaacuucuaccacuacaaccaauccaacgauagcaccauaaaacucaucgcuaugcucuacacuccccuccgugcaaacaacgcuggggaagacgucuucacugucuccugccgcguacucacccgccccucccccgacuucgauuucaucuucuuagucccaccuacuguggaaucccgcaccaaacccuucaccguccccauccuaacugucgaagaaaugacaaacagucgauuccccauaccgcucgaaaaacuauucaccggaccuagcggagcauucgucguccaaccacaaaauggacgcugcacaaccgacggcguccuccucggcaccacacaacucucccccguaaacauauguacauuccguggcgaugucacccacauagccggcucccgaaauuacaccaugucccuagcgucccucaacuggaacaacuaugacccuaccgaagaaauacccgcaccacucggcacccccgacuucgucggcaaaauccaaggaguccucacccagaccacuaaaggcgacggcuccacacgaggccacaaggcaacagucuauacaggaucugcucccuucacccccaaacucggguccguccaauucuccacagacacugaaaacgauuucgaaacacaccaaaacacaaaauucacccccgugggagucauccaagacggauccaccacccaccgaaacgaaccccaacaauggguccucccauccuacuccggaaggaacguccacaauguccaccuagcccccgccguagcaccaacuuuccccggagaacaacuacucuucuuccgcucaacaaugcccggaugcucaggcuacccaaacauggaccuggacugccuccuaccccaagaauggguucaacacuucuaccaagaagcugcuccagcacaauccgacguagcccuccuccgcuucguaaaccccgauacaggacgaguccuuuucgaaugcaaacuccacaaaagcggcuacgucaccgucgcccauaccggacaacaugaccuagucauacccccaaacggcuacuuucgcuucgacuccugggucaaccaauucuacacccuagcccccaugggcaacggcacaggccgccgucgcuaa

SEQ ID NO: 38249 - RNA, 1617 nt, Artificial Sequence
  derived and/or modified sequence opt11 from VP1__Norovirus_and/or_Norovirus-like__AB541341
augaagauggccuccaacgacgccaaccccuccgacgguagcgccgccaaccucgucccugaaguuaacaacgaagucauggcccucgaacccgucgucggcgcagccaucgccgcacccgucgcaggacaacaaaacguaaucgaucccuggauacgaaacaacuuuguccaagccccuggaggcgaguucaccguuucccccagaaacgcccccggagaaauccucuggucggcaccccuaggccccgaccucaaucccuaccucagccaccucgcccgcauguacaacgguuacgccggcggauucgaaguacaaguaauccucgccggcaacgccuucaccgccggcaaaaucauauuugccgccgucccucccaacuuccccaccgaaggccucucacccucccagguuaccauguucccccacaucaucguagaugucagacaauuagaacccguccugauccccuuacccgacguccgaaacaacuucuaucacuacaaccaaucaaacgacucaaccaucaaacucauagccaugcuauacacaccccuccgcgccaacaacgcaggcgaagacgucuuuaccgucuccugccgaguacucacccgacccucucccgacuucgacuucaucuuccucgucccacccaccguugaaucccgcaccaaaccauucaccgucccuauacucaccgucgaagaaaugacuaacuccagauuucccaucccccuugaaaaacucuucacaggccccucgucugccuuuguaguccaaccccaaaacggccgcugcacaacggacggaguacuccucggcacuacccaacuuucaccggucaacaucugcacauuccguggcgacgucacccacaucgccggcucccgcaauuacaccaugaaccuagccucucuaaacuggaacaacuacgaccccacagaagaaaucccggcaccacucggaacccccgacuucgucggaaaaauccaaggcaugcucacacaaacaacaaagggagacggcuccacucgaggucacaaagccaccgucuacaccggcuccgcccccuucacccccaaacuaggaucaguccaauuuucgaccgacaccgaaaacgacuucgaaacccaccaaaacaccaaauucacucccgucggcguuauccaagacggcaacacaacucaccgaaacgaaccccaacaauggguccuccccuccuauuccggacggaacguccaaaacguacaccucgccccagccgucgccccuaccuuccccggcgaacaacuccuauucuuccgcucgaccaugccagguugcuccggcuacccuaacauggaccuugacugccuacucccgcaagaauggguccaacacuuuuaucaagaagccgcccccgcgcaauccgacguagcacuacuacgguucguuaacccagacaccggccgaguucuauucgaaugcaaacuacacaaaucaggcuacguaaccgucgcacacacaggccaacacgaccuagucauaccuccaaacggcuacuuccgauucgacuccugggucaaccaauucuacacccucgcccccaugggaaacggaaccggccgacgucguuaa

SEQ ID NO: 38250 - RNA, 1617 nt, Artificial Sequence
  derived and/or modified sequence opt11 from VP1__Norovirus_and/or_Norovirus-like__AB541264
augaaaauggccuccaacgacgccaacccauccgauggcucagccgccaaccucguaccagagguaaacaacgaagucauggcccuagaacccguagucggcgcagcgaucgccgccccagucgccggccagcaaaacgucaucgaccccuggauacgcaacaacuucguacaagcccccggcggcgaguucaccgucucaccccgcaacgcacccggagaaauccucugguccgcaccccucggccccgaccucaaccccuaccuuucacaccuggcccgaauguacaacgguuacgccggcggauucgaaguacaagucauacucgcaggcaacgccuucacugcagguaaaaucauauucgccgcaguaccacccaauuuccccaccgaaggacucucacccucccaagucacaauguucccccauaucauagucgacguccgacaacucgaacccguccucauacccuuaccagacgucagaaacaacuucuaccacuacaaccaaucaaacgacucuacgauuaaacucaucgcaaugcuauacaccccacuacgcgccaacaaugccggcgaagacguauucaccguauccugccgcguccucacccgccccagccccgacuucgacuucauauuccuugucccacccacagucgaaucccgaacaaaacccuucaccguccccguacuaacagucgaagaaaugaccaacucccgcuuucccaucccccucgaaaaauuauucaccggacccuccucagcauucgucguccaaccccaaaacggccgauguaccacugacgguguacuacucggcacaacacaacuauccccagucaacauaugcaccuuccgaggcgacgucacacacaucgccggcucucgcgacuacaccaugaaucuagcaagccuaaacuggaacaacuacgaccccacugaagaaaucccagcuccccucggaacccccgacuucgucggcaaaauccaaggcguacucacacaaacaacccgaggagacggcuccacacgcggccauaaagccacagucuacaccggaucagccccguucacccccaaauuaggcuccguacaauucagcacagacacagaaaacgacuucgaaacccaccaaaacacaaaauucacaccaguagguguuauacaagacgggggcaccacccaccgcaacgaaccacaacaguggguacuuccaagcuacucaggccgaaacguccccaacguccacuuagcccccgccguagccccaacuuuccccggugaacaacuacuuuucuuccgcucuaccaugcccgguugcucaggauaccccaacauggaccuagacugccuacucccccaagaauggguccaacacuucuaccaagaggcagcaccagcucaaucagacgucgcccuccuccgcuucgucaaccccgacacaggccgcguacuuuucgaaugcaaacuacacaagucuggcuacguaaccgucgcccacaccggccaacacgaccuaguaaucccacccaacggcuacuuccgcuucgacuccuggguuaaccaauuuuauacccucgcccccaugggaaacggcacaggccgccgccgcuaa

SEQ ID NO: 38251 - RNA, 1617 nt, Artificial Sequence
  derived and/or modified sequence opt11 from VP1__Norovirus_and/or_Norovirus-like__AB541236
augaaaauggccuccaacgacgccaaucccuccgacggaucagccgcuaaccuaguccaagaaguuaacaacgaaguuauggcccucgaacccgucgucggugcugccaucgcugccccugucgcaggucaacaaaacgucaucgaccccuggauacguaacaacuucguccaagcgccaggcggggaguucacaguaucgccacgcaacgcccccggcgaaauacuaugguccgcaccccucggaccagaccucaacccuuaccuaucacaccuagcccgcauguauaacggcuacgcaggcggauucgaaguacaaguaauacuagccggcaacgcuuucacagccgguaaaauaauauucgcagccgucccacccaacuuccccacagaaggccuauccccuucccaaguaaccauguucccccacaucaucgucgauguccgccaacucgaaccaguccucauaccccuccccgacguccgcaacaauuucuaccacuacaaccaaucgaaugacuccacuaucaaacucaucgccaugcucuacacuccccuucgcgccaacaacgccggugaagacgucuucaccgucagcugccgugucuuaacucgccccagcccggauuucgauuucaucuuccucgucccaccaaccgucgaaucacgcaccaaacccuucacuguccccauacucaccgucgaagaaaugacaaauucccgcuuccccaucccucucgaaaaacucuucacaggccccuccuccgccuucguugugcaaccccaaaacggccgcugcaccacugacgguguccuccucggaacaacccaacucuccccagucaacauuugcacuuuccgaggcgacguuacccacaucgcaggcucucgcaacuacauaaugaacuuagccucccucaacuggaacaacuacgacccaaccgaagaaaucccugcaccccuaggcacacccgacuucgucggaaaaauccaaggcguacucacccaaaccaccaaaggagacggcuccacccgaggccacaaagccaccguauacaccggcucagcccccuucaccccuaaacucggcucaguccaauucuccaccgacaccgaaaacgacuucgaaacacaccaaaacacaaaauucacacccguaggagucauccaagacggcucgaccacccaccgaaacgaaccacaacaauggguccuacccucuuacagcggcggaaacguccacaacguccaccuagcuccagccgucgcgcccacauuccccggugaacaacuccuauucuuccgcucaaccaugcccgguugcuccggcuacccaaacauggaccucgacugccuucucccucaagaguggguccaacacuucuaccaagaagcagcccccgcccaauccgacgucgcccuucuccgcuucgucaacccagauacaggccggguacuauucgaaugcaagcuccacaaaucuggcuacgucaccguagcacacacaggccaacaugaccuaguaauacccccaaacggauacuuccgcuucgacagcugggucaaccaauuuuacacccucgcccccaugggaaacgguacaggcagacgacguuaa

SEQ ID NO: 38252 - RNA, 1617 nt, Artificial Sequence
  derived and/or modified sequence opt11 from VP1__Norovirus_and/or_Norovirus-like__AB541208
augaagauggcauccaaugacccaucccccuccgacggauccgcugccaaccuaguccccgaaguaaacaacgaaguaauggcgcucgaacccgucgucggcgcggcaauagcggccccagucgccggacaacagaacgucaucgaccccuggauuaggaacaacuucguccaagcacccggaggcgaguucacagucuccccacgcaacgcacccggcgaaauacuaugguccgcaccacuaggacccgaccucaaucccuaccuaagccaccucgccagaauguacaacggcuacgcaggaggcuuugaaguccagguaauccucgccggcaacgcauucaccgcuggcaaaauaauauuugccgccgucccucccaacuuccccacagaagggcugucccccagccaaguaacuauguucccccacaucauagucgacgugcgccaacuagaaccaguccucauaccacuucccgacgucagaaacaacuucuaccacuacaaccaauccaacgacuccacaaucaaacuuaucgccaugcuauacacaccgcuccgcgccaacaacgcaggcgaagacgucuuuacuguauccugccgcguacucacccgacccucaccagacuucgacuucauuuuccuuguaccacccacagucgaauccagaaccaaacccuuuaccgucccgauccucacaguagaagaaaugacaaacucacguuuccccaucccccucgaaaaacuauucacaggcccaucauccgcauucgugguccagccccaaaacggucgcugcacaaccgacggaguacuccucggcaccacccagcucagccccgucaacauauguaccuuccgcggcgacgucacccacaucgccggaucaagaaacuacacuaugaaucucgccucacucaacuggaacaacuacgaucccaccgaagaaauccccgcaccccucggcaccccagacuucgucggcaaaauccaagguguccuaacccaaaccacaaaaggggacggcagcacccguggccacaaagccacagucuacaccggcucagcccccuucacucccaaacucggaucuguccaauucucaaccgacaccgaaaacgacuucgaaacccaucaaaacacgaaauucaccccugucggcgucauucaagacggaggcaccacccaccgaaacgaaccucaacaauggguucucccauccuacucaggccgggacguccagaacguacaccuggcccccgccgucgcaccuaccuuucccggcgaacaacuccucuucuuccgcucuaccaugccaggcugcucaggcuaccccaacauggaccuagacugccuacucccacaagaauggguacaacacuucuaccaagaagccgcccccgcccaaucagacgucgcccuccuacguuucguaaaccccgacacaggccgcguccuauucgagugcaaacuccacaaaucaggauacguuaccgucgcccacaccggccaacaugaccuaguaaucccacccaauggauacuuccgcuucgacuccugggucaaccaauucuacacccucgcccccaugggcaacgguacaggucgccggcgcuaa

SEQ ID NO: 38253 - RNA, 1617 nt, Artificial Sequence
  derived and/or modified sequence opt11 from VP1__Norovirus_and/or_Norovirus-like__EU876890
augaaaauggcauccaacgacgccacccccucagacgguucaaccgccaaccucgucccagaaguuaacaacgaggucauggcacucgaacccguaguaggcgccgccauugccgccccagucgccggccaacaaaacguuaucgacccauggauccgaaacaacuucguccaagcccccggaggcgaguucaccgucucaccccgcaaugcaccaggagaaauccucugguccgcuccccucggccccgaccucaaccccuaccuaucccaccucgcccgaauguacaacgguuacgccggcggauucgaaguccaagucauacuagccggaaacgcauucaccgcuggcaaaaucaucuucgcagccguaccacccaacuuccccaccgaaggccucuccccaucccaagucaccauguucccccacaucaucguugacguccgccaacuugaaccaguccucaucccacuaccugacguacgaaacaacuuuuaccacuacaaccaaagcaacgaccccacuaucaaacucauagcaaugcucuacacaccccuucgcgccaacaacgccggagacgauguguucacaguaagcugccgcgugcucacccgacccucccccgacuuugauuucaucuuccuagucccacccacaguugaaucccgaaccaaacccuucuccguccccauacuaaccgucgaagaaaugacaaacucucgauuucccaucccacuugaaaaacuuuuuacaggucccuccucagcauucguaguacaaccacaaaacggacgcugcaccacagacgguguacuucucggcacaacccaacucucccccgucaacauauguaccuuccgcggagacgucacccacaucgccggcacucaaaacuacacaaugaaccuagcuucccaaaacuggaacaacuacgaccccacagaagaaauacccgccccacucggaacaccagacuucgucggcaaaauccaaggaguccucacucaaacuacucgacgcgacggaucuacccgcgggcauaaagccaccgucuccaccggauccguccauuucaccccuaagcucggcagcguccaauucucaacagacacuuccaacgacuucgaaaccggacaaaacacaagguucacgccagucggcgucguucaagauggauccaccacacaccaaaacgaaccacaacaauggguacuccccgacuacagcggccgcgacucccacaacguccaccuugcaccagccgucgccccaaacuuccccggcgaacaacuacuguucuuucgauccaccaugcccggcugcucuggauaccccaauaugaaccuagacugcuuacucccccaagaauggguucaacacuucuaccaagaauccgcccccgcucaaucagauguagcccuccuacgcuucgucaaccccgacaccggacguguacucuucgaaugcaaacuccacaaaucaggauacguaaccgucgcccacacuggccaacacgaccucgucauaccacccaacgguuacuucagauucgacagcugggucaaccaauucuacacacuugcccccaugggcaacggcgccggccgccgccgcuaa

SEQ ID NO: 38254 - RNA, 1617 nt, Artificial Sequence
  derived and/or modified sequence opt11 from VP1__Norovirus_and/or_Norovirus-like__AB385638
augaaaauggccucuucagacgccaaccccuccgacggcuccacagccaaccucguacccgaaguaaacaacgaagucauggcucuagaacccgucguaggagcugccaucgccgcccccgucgccggucaacaaaaugucaucgaccccuggaucaggaacaacuucguccaagcccccgggggcgaauuuaccgucucaccccgcaacgcccccggcgaaauccuuugguccgcaccccugggacccgaccucaacccauaccuuucucaccuggcucgcauguacaacuccuacgccgggggcuucgaaguccaaguuauccuagccggcaacgccuucaccgccggaaaaaucaucuucgcugccguucccccaaacuuccccaccgaaggccucucacccucccaagucaccauguucccccacaucaucgucgacguccgacaacucgaaccuguacuaauaccccuccccgacguacgaaacaacuucuaccacuauaaccagucaaacgaccccacaaucaaacuaaucgccaugcucuacaccccucuccgcgccaacaaugccggagacgacgucuucaccguaucaugccgcguucucacucgaccaucccccgauuucgacuucauauuccucgucccucccacagucgaaucaagaaccaaacccuucuccguacccauccucacaguagaagaaaugaccaacucccgcuuccccaucccccucgaaaaacuauucacuggcccuuccucggccuucguaguacaaccacaaaacggccgauguacaaccgacgguguccuccucggcacaacacaacuaucccccgucaauaucugcaccuuccgcggcgacgucacccacaucgccaacacucaagaauacaccaugaaccucgccucacaaaauuggaacaacuacgacccaacagaagaaauccccgccccauuaggcacucccgacuucgucggaaaaauccaaggagucuuaacccaaacaacaagacgcgacggcucaacccgaggccacaaagccaccgucuccaccggcuccguccacuucacccccaaacucggacgaauccaauucagcaccgacaccucuaacgacuuugaaaccgggcaaaauacacgcuucaccccagucggagucguucaagacggauccaccacacaccagaacgaaccccaacaauggguccuacccaacuacuccggcggcgacggacacaacguccaccucgccccagccgucgcccccucauucccaggcgaacagcuccucuucuuccgaucaaccaugcccgguugcagcggauaccccaacaugaaccuagacugccuacuaccucaagaauggguacaacauuucuaucaggaagcggccccggcucaaagcgacgucgcacuacuucgcuucguuaaccccgacaccggcagaguccucuucgaaugcaagcuccacaaaucagguuacgucaccgucgcccacacuggacaacacgaccucgucauucccccaaacggcuacuuucgcuucgacucauggguaaaccaauucuauacucucgcuccaauggggaacgguacgggccgaagacgcuaa

SEQ ID NO: 38255 - RNA, 1617 nt, Artificial Sequence
  derived and/or modified sequence opt11 from VP1__Norovirus_and/or_Norovirus-like__AB385635
augaaaauggcuuccaacgaugccaccccuucagacggauccaccgcaaaccucgucccugaaguaaacaacgaagucauggcccuagaacccguaguuggcgccgcaaucgccgcccccgucgcuggccaacaaaacgucaucgacccuuggaucagaaacaacuucguccaggcccccggcggcgaguucaccgucucuccccguaacgccccaggagaaauccucugguccgcaccacucggucccgaccuuaaccccuaccucucucaccucgcccgaauguacaacgguuacgcuggcggcuucgaaguccagguaauccuugcuggcaacgccuucacagccggaaaaaucaucuucgccgccguaccgcccaacuucccaacagaaggccucuccccaucccaagucaccauguucccccauaucauagucgauguccgccaacucgaaccaguacuuaucccccuccccgacguccgcaacaacuucuaccacuacaaccaauccaacgaccccaccauaaaacuaaucgccaugcucuacacaccccuucgugcaaacaaugccggagacgauguauucaccgacagcugccgcgugcucacucgccccucccccgacuucgacuucauuuuucuagucccacccaccgucgaaucccgaaccaaaccauucuccgucccuauacucaccgucgaagaaaugacaaacucgcgcuuccccaucccccucgaaaaacuuuucaccggccccuccuccgccuucgucguccaaccccaaaacggucgcugcacaaccgacggaguccuccucggcaccacccaacucuccccagucaacauaugcacauuccgaggcgacgucacgcacaucgcaggaacccaaaacuacacaaugaaccucgcaucccaaaacuggaacaacuacgacccuaccgaagaaauccccgcuccccuuggaacccccgacuuuguaggaaaaauacaaggcguccucacacagaccacacgucgugacgguucuacccgaggacacaaagccaccguauccaccggcucaguccacuucaccccaaaacucgguucaguccaauucucuaccgacaccuccaaugaccuagaaaccggccaaaacacccgcuucacccccgucggcgucguucaagacgguuccaccacucaccaaaaugaaccccaacaaugggucuuacccgacuacucuggccgcgacucccacaauguccaccucgcaccagcugucgcucccaccuuccccggagaacaacuccucuucuuccgcucaacaaugcccggcuguuccggguacccaaauaugaaccucgacugccuacuuccgcaagaauggguccaacacuucuaccaagaaucagcccccgcccaaagcgacguugcccuccuccgcuucguaaacccugacaccggcagaguacuauucgaaugcaaacuccacaaauccggcuacgucaccguagcacacaccggccaacacgaccucguuauucccccuaacggcuacuuccgcuucgacuccuggguuaaccaauucuacacccuugcucccaugggcaacggcgccggacgccgccgcuga

SEQ ID NO: 38256 - RNA, 1617 nt, Artificial Sequence
  derived and/or modified sequence opt11 from VP1__Norovirus_and/or_Norovirus-like__EU366113
augaaaauggccuccaacgacgcaaaccccucagacggcagcgcagccaacuuaguacccgaagucaacaacgaagucauggcccuugaacccguaguaggggccgccaucgccgccccagucgccggacaacaaaaugucauugaccccuggauccgcaacaacuucguccaagcgcccggaggcgaguucaccguaucaccacgaaacgcccccggcgaaauccuauggucagcuccccuaggucccgaccucaacccguaccucucacaccucgcccgcauguacaacggauacgccggcggcuucgaaguacaagucauccucgccggcaacgccuuuaccgcaggcaaaauaauauucgccgcaguacccccaaacuucccaaccgaaggacucucccccucucaaguaaccauguucccacacauuaucgucgacguccgccaacucgaaccaguacucaucccccuccccgacguccggaacaacuucuaccacuacaaucaaucuaacgacucaaccauaaaacucaucgcaaugcucuacaccccacuccgagccaacaacgccggugaagacgucuucacaguuuccugccgaguacuuacacgccccucgccagacuucgacuuuauauuccucgucccgcccacagucgaaucccgcacaaaacccuucaccguaccaauccucaccgucgaagaaaugaccaacucgcguuuucccaucccccucgaaaaacuauucaccggcccaucaucagccuucguaguacaaccacaaaacggccgcugcaccacagacggcguacuccucggcacaacccaacucagcccagucaacaucugcacauuccgcggcgacgucacacacauugccggcucacgaaacuacacaaugaaucuagcauccuuaaacuggaacaacuacgaccccacagaagaaauccccgcuccccucggaacacccgacuucgucggcaaaauucaaggcguccucacacaaaccaccaaaggagacggcuccacccgcggacacaaagcaacagucuacacaggauccgcccccuucacccccaaacucggauccguccaauccuccaccgacaccgagaaugauuucgaaacccaccaaaacacaaaauucacccccguaggcguaauccaagacggcucaaccacccauagaaaugaaccacaacaauggguccuccccucguacuccggacgcaacguccacaacgugcaccucgccccagcaguugcacccacuuuccccggagaacaacuacucuucuucagaucuacagugccaggcugcuccgguuacccaaacauggaccuagacugccuacucccacaagaauggguacaacacuucuaccaagaggccgcacccgcacaaucugacgucgcccuccuccgcuucgucaacccagacaccggaagaguacuuuucgaaugcaaacuacacaaaucaggauacgucacagucgcccacaccggacaacacgaccucguaaucccuccaaauggcuacuuucgcuuugacuccugggucaaccaauucuacacccucgcacccaugggcaacggcaccggccgccgacgauaa

SEQ ID NO: 38257 - RNA, 1617 nt, Artificial Sequence
  derived and/or modified sequence opt11 from VP1__Norovirus_and/or_Norovirus-like__KX354097
augaaaauggccucaucugacgcaaaucccucggacggcucagccgccaaccucgucccagaagucaacaacgaagucauggcccuagaaccagucgucggcgccgccaucgccgcccccgucgccggacaacaaaacguaaucgacccguggaucagaaacaacuucguacaagcgccaggaggagaguucaccguuucacccagaaacgcccccggagaaauacucuggucagcuccucucggcccugaccucaaccccuaccucucccaccucgcccgcauguacaacggauacgcuggcggauuugaaguccaagucauacuugcuggcaacgccuucaccgccggcaaaguuauauuugccgccgugcccccaaacuuccccacagaaggccuaucaccgucacaaguaaccauguucccacacauuguagucgacgucagacaacuagaacccguacucauaccccucccggacguccgcaacaacuucuaucacuacaaccaauccaacgaccccacaaucaaacuuaucgccaugcuauacaccccucuacgcgccaacaacgcaggcgacgacgucuucacaguauccugccgcguccuaacccgccccucccccgacuucgacuucaucuuccugguuccacccaccgucgaaucccgcaccaagcccuucuccgucccaguacuuaccguugaagaaaugaccaacuccagauucccaauaccccuagaaaaacucuucacaggccccucaucagcauucgucguacagccacaaaacggcagaugcacaaccgacggcguacuucucggcaccacccaacuaucucccgucaacauaugcaccuuccguggcgacgucacacacauaacuggaucacacaacuauaccaugaaccuugccucacaaaacuggaacaacuacgacccaaccgaagaaauccccgcuccccucggaacccccgacuucgucggcaaaauacaaggcguccuuacccaaaccacaaaaaccgacggcuccacacgaggccacaaagccacagucuacaccggcuccgccgacuucgccccuaaacucggccgaguccaguucgagacggacaccaaccacgacuucgaagcaaaccagaacaccaaauuuaccccaguaggagucauucaagacgguuccaccacacaccgaaacgaaccccaacaauggguccuuccaucauacucaggccgaaauacucacaacguccaucucgcccccgccgucgccccaacauuccccggcgaacaacuccuauuuuuccgcuccaccaugcccggcugcuccggcuaccccaacauggaccucgacugccuccuaccccaagaauggguccaauacuucuaccaagaagcagcaccagcccaauccgacguagcucuacuccgcuucgucaacccagacaccggccgcguucucuucgagugcaaacuccacaaaagcgguuacguaacaguagcccacaccggacaacaugaccucgucaucccacccaacggcuacuuccgcuucgacucuuggguuaaucaauuuuauacacuagcccccaugggcaacggcaccgggcgcagacgcuaa

SEQ ID NO: 38258 - RNA, 1617 nt, Artificial Sequence
  derived and/or modified sequence opt11 from VP1__Norovirus_and/or_Norovirus-like__AB933727
augaaaauggccucuaacgacgcaaaccccuccgacggcuccgcagccaaccuuguuccagaagucaacaacgaggucauggcgcuggaacccgucgucggagcugccauagcagcccccgucgcaggccagcaaaacguaaucgaucccuggauccguaacaacuucguccaagcacccggaggcgaguucaccguaucaccccgcaacgccccaggcgaaauccuauggucagccccacucggaccagaccuaaacccauaucuaucccaccuagcccgaauguacaacggguacgccggcggcuucgaaguacaaguaauccuagccggcaacgccuucaccgcaggcaaaauaaucuuugcugcuguacccccaaacuuccccacugaaggccucucccccucccaagucacaauguucccccacaucaucguugacguccgccaacucgaacccguucucaucccccucccagacgucagaaacaacuucuaccacuacaaucaaucaaacgacucaaccaucaaacuaaucgcaaugcucuacacaccccuccgcgccaacaaugccggcgaagauguauucaccgucucaugccgcgugcucacgcgccccuccccggacuucgacuucaucuuccucgucccaccuaccgucgaauccagaaccaaacccuucacaguccccauacuaacagucgaagaaaugaccaacucacgcuucccuauacccuuagaaaaacuauucaccggacccuccuccgccuucgucgugcaaccacaaaacggccgcugcacaaccgacgguguccuucucggcacaacccaacucagccccgucaacauaugcacauuccgcggugacgucacacacauagcaggaucccgcaacuacaccaugaaccucgccucccuaaacuggaacaacuaugacccaaccgaagaaguccccgcaccccuaggcacccccgacuucgucggcaaaauccaaggcguccucacccagaccaccaaaggcgacggcuccacccgcggccacaaagccaccguauacaccgguuccgccccauuuaccccuaaacuuggcuccguccaauucucuaccgacacagaaaacgauuucgaaacgcaccaaaacaccaaauucaccccaguuggcguuauccaagauggcggcacaacccaccgcaacgaaccacaacaauggguucugccauccuacucaggacgcgacgucccaaacguccaccucgccccagccgucgcccccaccuuccccggcgaacaacuccucuuuuuccgcucuacaaugcccggcugcucaggcuacccaaacauggaccucgacugccuccuaccacaagaauggguccaacacuucuaccaagaagccgcacccgcccaguccgacguagcccuacuacgauucgucaacccagacaccggccgugucuuauucgaaugcaaacuccacaaauccggauacgucaccguagcccacacaggccaacacgaccucgugaucccacccaacggcuauuuccgcuucgacuccuggguaaaccaauucuauacacucgcucccaugggcaacggcacaggacgacgccgcuaa

SEQ ID NO: 38259 - RNA, 1617 nt, Artificial Sequence
  derived and/or modified sequence opt11 from VP1__Norovirus_and/or_Norovirus-like__AB933726
augaaaauggcuucaaacgacgccaacccuuccgauggauccgcagcaaaccucguccccgaagucaacaaugaggucauggcccuagaacccguuguaggagccgcaaucgcagcccccgucgccggacaacaaaacgugauugaccccuggauacguaacaacuucguccaagccccaggcggcgaauuuaccgucucuccccgaaacgccccuggcgaaauacucugguccgccccucucggccccgaccuaaacccauaccuaucccaucuagcccgcauguauaacggauacgccggaggauucgaaguucaggucauccucgccggcaacgccuucaccgccggcaaaauaauauuugccgccguaccuccuaacuucccuaccgaaggccucagcccaucccaagucacaauguucccccacaucaucgucgauguccgccaacucgaaccuguccucaucccccucccagacguaagaaauaacuucuaccauuacaaccaaucaaacgacuccacaauaaaacucaucgcuaugcucuacaccccacuccgcgccaacaacgccggagaagaugucuucaccguuuccugccgaguacucacacgucccucccccgacuuugauuuuauauuccucguaccacccacaguagagucaaggaccaaacccuucacugucccaauccuuacagucgaggaaaugacuaacucacgauuccccaucccccuagaaaaacucuucacaggacccuccucagccuucgucguucaaccccaaaacggccggugcaccaccgacggcguacuccuaggcacaacacaacuauccccagucaacaucugcacuuuccgcggagacgucacccacaucgccggcucacgcaacuacaccaugaaucucgccucccuuaacuggaacaacuacgacccaaccgaagaaauaccggcaccccucggcacccccgacuucgucggcaaaauacaaggaaugcuaacccaaaccacaaaaggcgacggcucaaccagaggccacaaagccacggucuacaccggcuccgcuccuuuuaccccuaagcuaggaucaguccaauucucuacagacaccgaaaacgacuucgaaacccaccaaaacacaaaauucacccccguuggcgucauacaagacggaucaacaacccaccgaaacgaaccccaacaauggguucugccauccuacucuggacgcaacguccccaacguccaccucgcccccgccgucgccccaacauucccaggcgaacaacuucucuuuuuccgauccacaaugccaggcugcuccggcuaccccaacauggaucucgacugccuccuaccacaagaauggguccaacacuucuaccaagaagccgccccagcccaguccgacgucgcccuacuccgauucgucaacccagacaccggccgcguccuuuucgaaugcaaacuccacaaauccggcuacguaacagucgcccacacuggccaacacgaccuugucauacccccuaacgguuacuuccgcuucgacuccuggguuaaccaauucuacaccuuagcaccaaugggcaacggcaccggacgccgccgauga

SEQ ID NO: 38260 - RNA, 1617 nt, Artificial Sequence
  derived and/or modified sequence opt11 from VP1__Norovirus_and/or_Norovirus-like__AB933720
augaaaauggccuccucagacgccaaccccuccgacggcuccgccgccaaccuagucccggaagucaauaacgaagucauggcccucgaacccguaguaggagcagccaucgcagcgccagucgccggccagcaaaacgucauagacccauggauccgcaacaauuucguccaagcccccggaggugaauuuacagucucaccccgcaacgcacccggcgaaauccucugguccgcaccccucggccccgaccucaaccccuaccuuucacaccucgcccgcauguacaacggcuacgccggaggauucgaaguccagguaauucucgcaggcaacgcauucacagcaggcaaaauuaucuucgccgccgucccacccaacuuccccaccgaaggucucucccccagccaaguuacaauguucccccacaucaucgucgacguccgccaacuagaacccguccucauaccccuaccugacguccgcaacaacuucuaccacuacaaccaauccaacgacucuaccaucaaacucaucgcaaugcucuacacaccccuccgcgcaaacaacgccggggaggacguuuucacuguauccugccgaguccucacaagacccucccccgacuucgacuucauauuccucguaccacccaccguugaaucacgaaccaaacccuucacuguacccauacucaccgucgaagaaaugacaaacucucgauucccuauaccccuugaaaaacucuucaccggccccucuuccgccuucgucguacaaccccaaaacggcagaugcacaaccgacgguguacuucucggaaccacacagcucuccccagucaauaucugcaccuucagaggagacgucacccacauagcuggcuccagaaacuacaccaugaaccucgccucccuuaacuggaacaacuacgaccccaccgaagaaauccccgcaccccuaggcacacccgauuucgucggcaaaguccaaggcguacucacccaaaccaccaaaggcgacggguccacacgaggccacaaagccaccguauacaccggauccgcaccauucaccccaaaacuggguuccguccaauucucaaccgauaccgaaaacgacuucgagacacaccaaaacaccaaauucacccccgucggcgucauucaagacggaagcaccacccacagaaacgaaccccagcaaugggugcuaccuuccuauuccggacgaaacguaccaaacguccaucucgcaccagccguagcacccacuuuucccggcgaacaacuccucuucuuccgaucaaccaugccagguugcucugguuauccaaacauggaccucgauugucuacuaccccaagaauggguccaacacuucuaccaggaagcggccccagcccaauccgacguugcccugcuccgauucgucaacccugacacaggccgcguccuauucgaaugcaaacuccacaaauccggcuacguuacagucgcccacacuggacaacacgaccucgucauaccacccaacggcuacuuccgauucgacucuuggguaaaccaauucuauacccucgcccccaugggcaacggaaccggccgccgacgcuaa

SEQ ID NO: 38261 - RNA, 1617 nt, Artificial Sequence
  derived and/or modified sequence opt11 from VP1__Norovirus_and/or_Norovirus-like__AB933691
augaaaauggcaucaaacgacgcaaacccaucugauggcuccgccgcaaaccucguuccagaaguaaacaacgaagugauggcccuugaaccagucgucggagccgcuaucgccgccccugucgcaggccaacaaaacgucaucgacccauggaucagaaacaacuucguccaagcccccgguggcgaguucaccguauccccacgcaacgcaccuggcgaaauccuaugguccgcuccccuaggcccagaccucaaccccuaccucucucaccuugcccgcauguacaacggcuacgccggcggcuucgaaguccaagucauccucgccggcaacgccuucaccgccggcaagauaauuuuugccgccguuccucccaacuuccccaccgaaggccuuucacccucccaagucaccauguucccccacaucaucgucgacguucgccaacuugaacccguccucaucccccuccccgacguccgaaauaacuucuaccacuacaaccaaucaaacgacuccacaaucaagcucauagcaaugcuauauacaccccuccgagccaacaacgccggagaagacgucuucaccgucuccugcagaguccucacacgcccaucccccgacuucgacuucaucuuccucgucccaccuaccgucgaaucccgaacaaaaccauucacaguacccauacuaaccguugaagaaaugaccaauucacgcuuccccauuccacucgaaaaacucuucaccggaccaagcucagcauucgucguccaaccccaaaacggacguugcacaacagacggcguccuacucggaaccacacaacuuucacccgucaauauaugcacauuccgcggagacgucacccacaucgcaggcucacgaaacuacaccaugaaccucgccucccucaacuggaacaacuacgaccccaccgaagaaauaccagcaccacuaggcacccccgauuuugucggcaaaauccaaggaaugcuaacccagaccacuaaaggcgacggauccacccgcggacacaaagccacagucuacaccgggucugcccccuucaccccaaaacuuggauccguccaguucucaaccgacaccgaaaacgacuucgaaacacaccaaaacacaaaauucacccccgucggagucauccaagauggcuccacuacacaccgcaacgaaccccaacaauggguacuccccagcuacucaggccgcgacguaccaaacguccaccuugcccccgccguugcccccaccuuccccggcgaacaacuccucuucuuccgaucuaccaugcccggcugcuccggcuauccaaacauggaccucgauugccuacuuccccaagaauggguucaacacuucuaccaagaagccgcccccgcacaaucagacgucgcccuacuacgcuucguaaaccccgauacgggccgaguccucuucgaaugcaaacuccacaaauccggauacgucaccgucgcccacacuggccaacacgaccucguuauacccccaaacgguuacuuccgcuucgacuccugggucaaccaauucuacacccucgcacccaugggcaacggcaccggacgccgccgcuaa

SEQ ID NO: 38262 - RNA, 1617 nt, Artificial Sequence
  derived and/or modified sequence opt11 from VP1__Norovirus_and/or_Norovirus-like__AB933682
augaaaauggccuccaacgacgccaaccccuccgacggcucaaccgccaaccuagucccugaagucaacaacgaagucauggcacuagaacccguaguaggugcagcaaucgccgcaccaguagccggccaacaaaacgucaucgaccccuggauccgaaacaacuucguccaagcccccggcggcgaguucaccgucucaccccgcaacgcccccggagaaauacuaugguccgccccucucggccccgaccuaaacccuuaccuaucacaccucgcacgcauguacaacggcuacgccggcggcuucgaaguccaagugauccucgcaggcaacgccuucaccgcuggcaaaaucauauucgccgccgucccaccaaacuucccaaccgaaggccucucccccucccaagucaccauguuuccccacaucaucgucgacguacggcaacucgaacccguccucaucccccugccggacguccgaaacaacuucuaccacuauaaccaauccaacgacucaacaauuaagcugaucgccaugcuauacacuccccuucgcgccaacaacgcgggcgaagacguauuuaccguaucuugccgcguccucacccgacccucccccgacuucgacuucaucuuccuagucccacccaccguagaaucccgcacaaaacccuucaccguccccauacuuaccgucgaagaaaugacaaacuccagauuccccauuccccuagaaaaauuauucaccggccccucuuccgccuuugucguacaaccccaaaacggacgcuguaccacagacggaguccugcucggcaccacacaacuaucacccgucaacauuugcacauuucgaggcgacguaacacacauagcgggaucccacaacuauacaaugaaccuagccagccucaacuggaacaacuaugaccccacugaagaaauccccgcaccccucgguacccccgauuucguugguaaaauccaaggcguacucacacagaccaccaaaggcgacggcuccacaagaggacacaaagccaccgucuacaccgguuccgcacccuucaccccaaaacucggcagcguacaauucucuacagauaccgaaaacgacuucgaaacccaccaaaacacuaaauuuacucccgucggcgucauacaagacggcggcaccacacaccgcaacgaaccccaacaauggguccuccccagcuacucaggacgcaacguacaaaacguccaccucgcacccgccgucgcccccaccuuccccggugaacaacuccuuuucuucagauccacaaugcccgguugcucaggauacccaaacauggaccuagacugccuccuaccccaagaauggguccaacacuucuaccaagaagcugcaccagcccaauccgacgucgcccuccuacgcuucgucaacccugacaccggacgcguucuauucgaaugcaaacuccauaaauccggcuacgucaccgucgcccacaccggacaacacgaccuagucaucccacccaacggcuacuuccgcuucgacuccugggucaaccaauucuacacccuagcacccauggguaauggcaccggaagacgcagauaa

SEQ ID NO: 38263 - RNA, 1617 nt, Artificial Sequence
  derived and/or modified sequence opt11 from VP1__Norovirus_and/or_Norovirus-like__KM245069
augaaaauggccuccuccgacgcaaacccauccgacggauccaccgccaaccucguaccggaaguuaacaacgaagucauggcacucgaaccaguagucggagcugccaucgcagcccccguagcuggccaacaaaaugucaucgacccauggaucagaaacaacuucguucaagcacccggcggagaguucaccgucagcccccgcaacgcuccuggagaaauccuuuggucugcaccccucggcccagaccucaaccccuaccuuucccaccuagcccgaauguacaacucauacgccggcggcuucgaaguccaagucauccucgccggcaacgccuucaccgccggcaaaauaaucuucgccgccguucccccaaauuucccaaccgaaggacucucacccucacaagucacaauguucccccauaucauugucgacguccgacaacuagaaccaguacucaucccccucccagacguccgcaauaacuucuaccacuacaaccaauccaacgacccuacgauaaaacuaaucgcaauguuauacacaccccuccgugccaacaaugcuggcgacgacgucuucaccguauccugccgcguccucacacgccccuccccggacuuugacuucaucuuccuuguacccccaacagucgaaucucgaacuaaaccauucucgguccccauccucacagucgaagaaaugacuaauuccagauuccccaucccacucgaaaaacucuucaccggaccaucguccgccuucgucguccaaccacaaaacggcagaugcacaaccgacggaguccuucucggcacaacccaacuuuccccuguaaacaucuguacauuccgcggcgacguaacccacaucgccucuacccaagaauacaccaugaaccucgccucccaaaacuggaacaacuaugaccccaccgaagaaauacccgcaccccucggcacucccgacuucgucggcaaaauacaaggcgugcuaacccaaaccacccgccgcgacggcuccacccgcggccacaaagcaacugucucaaccggauccguccacuucaccccaaaacucggccgcauccaauucuccacugacaccuccaaugacuuugaaaccggccaaaacacacgguucacaccaguaggcgucguacaggacgggucaaccacacaccaaaacgagccacaacaauggguacuucccaacuauucuggccgagacucccacaacguacaccucgcccccgcagucgcccccuccuucccuggcgaacaacuacucuucuuccgcucuaccaugccuggaugcuccggcuaccccaacaugaaucuagacugccuucuaccccaagaauggguccaacacuucuaccaagaagccgcccccgcucaaucagacgucgcccuccucagauuuguaaaccccgacaccggccgaguccucuucgaaugcaaacugcacaaauccggcuacguaaccguagcacacacuggccaacacgaccucgucauaccuccaaacggcuacuuccgcuucgacucuuggguaaaccaguucuacacccuagccccaaugggaaacggcaccggccgcagacgcuag

SEQ ID NO: 38264 - RNA, 1617 nt, Artificial Sequence
  derived and/or modified sequence opt11 from VP1__Norovirus_and/or_Norovirus-like__LC005717
augaaaauggccucuaacgacgccaaccccagcgacggauccgcagcuaaccuaguccccgaagucaacaacgaggucauggcccuagaacccgucguuggcgccgccauagccgcccccgucgcaggccaacaaaacgucaucgaucccuggaucaaaaacaacuucguacaagcucccggcggagaguucaccgucagcccccgcaacgcuccaggagaaauccuaugguccgcaccacucggaccagaccucaaccccuaccucucccaccucgcccgcauguacaacggcuacgccggcggcuucgaaguccaagucauccuagcaggcaacgcauuuacagccgguaaaaucauauucgccgccguaccacccaacuuccccaccgaaggccucucccccucccaagucaccauguucccccacauaaucguagauguccgacaacucgaacccguccucauaccacuacccgacguuagaaacaauuucuaucacuacaaccaaucgaaugacuccaccaucaaacucauagccaugcuauacacuccccuacgagcuaacaacgccggcgaagacguauucaccgucucaugccgcguccucacccgacccucccccgacuucgacuucaucuuccuagucccucccaccguugaaucucgcacaaaacccuucaccguacccauccuaaccguagaagaaaugaccaacucccguuuucccauuccccucgaaaaacuauucacaggccccuccggcgccuucgucguccaaccacaaaauggccgaugcaccaccgacggcguccuacuaggcacaacccaacucucacccgucaacauaugcacauuccgaggcgacgucacacacaucgccgguucccgcaacuacacuaugaaucucgccgcccucaacuggaacaacuacgauccaaccgaagaaauccccgcgcccuuaggcacacccgacuucguuggcaagauccaaggcguccucacccaaaccaccaaaggcgacggcuccacccgcggccacaaagcaacagucuacaccggauccgcagacuucacacccaaacuaggcucuguccaauucuccacagacacggaaaacgauuuugaaacacaccaaaacaccaaauucacccccgucggaguuauccaagacggcuccacuacacaccgaaacgaaccucagcaauggguccuccccucuuauuccggccgaaacguacacaacguccaccucgccccagccgucgcaccaaccuuuccaggcgagcagcuacuuuucuuccgauccaccaugcccggaugcuccggauacccuaacauggacuuagacugccuccucccucaagaauggguccaacacuucuaccaagaagcagcccccgcccaauccgacguugcucuccugcgcuucgucaaccccgacaccggccguguacuauucgaaugcaaacuacauaaaucuggauaugucacuguagcacauaccggacaacacgaccuugucauaccucccaacggauacuuccgcuucgacucuuggguaaaccaauuuuacacccuagcccccaugggcaacggcacgggacgacgacgauaa

SEQ ID NO: 38265 - RNA, 1617 nt, Artificial Sequence
  derived and/or modified sequence opt11 from VP1__Norovirus_and/or_Norovirus-like__LC005705
augaagauggccagcaacgacgccaacccuuccgacggaucagccgccaacuuaguccccgaaguaaacaacgaaguaauggcccucgaacccgucgucggggccgcaaucgcagcaccagucgccggccaacaaaacgucaucgaccccuggauacgcaacaacuucguccaagcccccggaggcgaauuuaccguuucaccccgcaacgcccccggcgaaauccucugguccgccccacuaggacccgaccuaaaccccuaucucucgcaccucgcacgcauguacaacggcuaugcuggcggcuucgaaguccaagucauccucgccggcaacgcauucacagccggcaaaaucauauuugccgcugucccacccaacuuccccacagaaggccucucccccagccaagucacaauguucccacacauuaucgucgacguccgacaacucgaaccaguacuaauaccacuucccgacguucgcaacaacuuuuaccacuacaaccagucaaacgauucuacaaucaaacuaaucgccaugcucuacacuccccucagagccaacaacgcuggcgaagacgucuuuaccgucucaugccgcguccucacgcguccaucccccgauuucgauuucauauuccucgucccucccaccguagaaagccgaaccaaacccuucaccguaccaauacucaccguagaggaaaugaccaacucccgcuuccccauccccuuagaaaaacucuucaccggccccuccggcgcauucguaguucaaccccaaaacggcagaugcacaacugacggaguccuacucggcaccacacaacucucccccguaaacaucugcaccuuccgcggcgaugucacccacaucgccgguucacgcaacuacacaaugaaccuagccucccucaacuggaacaacuacgaccccacagaagaaauacccgcuccccuaggcacacccgacuucgucgguaaaauacagggcguccuaacacagaccaccaagggcgacggcuccacccguggacacaaagccacaaucuauaccggcuccgcacccuucacccccaaacuaggcuccguccaauucagcaccgacaccgaaaaugacuucgaaacacaccaaaacaccaaauucaccccaguaggagucauccaagacggcucaacuacccaccgaaacgaaccacaacaauggguccuacccuccuacuccgggcgcaacguccacaacguccaccuagcucccgccgucgcacccaccuuccccggcgagcaacuccuuuucuuccgauccacuaugccaggaugcucaggauacccaaacauggaccuggacugccuccucccacaagaauggguccaacacuucuaccaagaagccgccccagcccaaagcgacgucgcauuacuccgcuucguaaaccccgacacaggaagaguacucuucgaaugcaaacuccacaaaucgggcuacgucaccgucgcgcacaccggccaacacgaccugguuauacccccaaacggcuauuucagauucgacuccugggucaaccaauucuacacacucgcccccaugggcaacggcaccggacgacgacgcuaa

SEQ ID NO: 38266 - RNA, 1617 nt, Artificial Sequence
  derived and/or modified sequence opt11 from VP1__Norovirus_and/or_Norovirus-like__KC894943
augaaaauggcuucaaacgacgccaaccccuccgacggcucagccgcuaaccucgugcccgaaguuaacaacgaagucauggcacucgaaccaguuguuggcgccgcgaucgccgccccagucgcuggccaacaaaauguaauagaccccuggauccgaaacaacuucguccaagccccaggaggagaauuuacagucucuccccgaaacgccccgggcgaaauacucugguccgccccacuaggaccugaccucaaccccuaccucucacaccuggcccgcauguacaacggcuacgccggaggcuucgaaguacaagucauccucgccggaaacgcauucaccgccggaaaaaucauauucgcagcuguaccacccaacuuccccaccgaaggacuaucccccucgcaagucaccauguucccccacaucaucguagacguccgccaacucgaacccguacucaucccacucccagacguacgcaacaacuucuaucacuacaaccaaagcaacgacuccaccaucaaacucaucgccaugcucuacacaccacuccgcgccaacaacgccggcgaagacgucuucaccgucucaugccgcguacucacccgcccaagcccagacuucgacuucaucuuccuagucccacccaccguugaaucccguacuaaaccauucaccgucccaauccucaccgucgaagaaaugacgaacucacgcuucccaaucccccuugaaaaacuauucacaggaccauccuccgccuucguaguacaaccccaaaauggccgcuguaccacagacggcguccuccuaggaaccacacaacuauccccugucaauaucugcaccuuccgcggcgacgucacccacaucgccggcucacgcaauuacaccaugaaccucgcuucacucaacuggaacaacuacgaccccaccgaagaaauuccagcaccucuuggcacacccgacuucgucgguaaaauccaggguguacuaacccaaaccaccaaaggugacggauccacccguggccauaaagccacggucuacaccggaagcgcccccuuuaccccaaaacuaggcucaguacaauucuccaccgacacagaaaacgacuucgaaacccaccaaaacaccaaauucacacccguaggcgucauccaagacggcgguacaacccaccguaacgaaccccaacaauggguccucccuaacuacuccggcucagacguacccaacguccaccuugcacccgccgucgcacccaacuuccccggcgaacaacuacuuuucuuucgcuccaccaugcccggcugcucaggcuaccccaauauggaccucgacugccuccucccccaagaauggguccaacauuucuaucaagaagccgcccccgcccaauccgacgucgcccucuuacgauucgucaaccccgacaccggacguguccuauucgaaugcaaacuccacaaaucuggauacgucacaguagcccacacuggccaacacgaccucguuauaccacccaacggauacuuccgcuucgacagcuggguaaaccaauucuacacucucgcccccaugggaaacggcacaggccgccgacgauaa

SEQ ID NO: 38267 - RNA, 1617 nt, Artificial Sequence
  derived and/or modified sequence opt11 from VP1__Norovirus_and/or_Norovirus-like__KF060023
augaaaauggccuccuccgacgcaaaccccuccgacggaucagcagccaaccucguccccgaaguaaacaacgaagucauggcacucgaaccagucgucggcgccgcaaucgccgcccccguugcaggccaacaaaacguuaucgaucccuggauccgcaacaacuucguacaggcaccaggcggcgaguucaccguaucaccccgaaacgcccccggcgaaauccucuggucagccccacucggacccgaccuaaaccccuaccucucacaccucgcucgcauguacaacggcuacgccggcggauucgaaguccaaguaauccucgcaggcaacgcuuucaccgcaggcaaagucaucuucgccgccgucccacccaacuuucccaccgaaggccuaucucccucccaagucaccauguucccccacaucgucguagacguccgccaacucgaaccuguacucauaccccuccccgacguccgcaacaacuucuaucacuacaaccaauccaacgaccccaccaucaagcucauagccaugcuauacaccccacuccgggccaacaacgccggcgacgacgucuucacagucuccugccgaguacuuacccgccccucacccgauuucgacuuuauauuucuagucccacccacagucgaaucccggaccaaacccuucucaguccccguacuuacaguugaggaaaugacuaacucacgauuccccauaccgcucgaaaaacuuuucaccggcccauccuccgcauucgucguccaaccccaaaacggccgcugcacaacagacggcguccuccucggcaccacccaacuaucccccgucaacaucugcaccuuccgaggcgacguuacgcacaucaccggcucaagaaacuacacuaugaaccuagccucacaaaacuggucaaacuacgaccccaccgaagaaauccccgccccucuaggcacacccgacuucgucggcaaaauacaaggcguccucacccagaccaccagaaccgauggcucuacccgcggucacaaagccacagucuacacaggcuccgccgacuucgcgcccaaacucggccgcguccaguucggcacagacacagaccacgacuucgaagccaaucaaaacaccaaauucacucccguaggcguaauccaagacggaucaacaacacacagaaacgaaccccaacaguggguccucccaucauacucaggacgcaacacacccaacguccaccuagcacccgcaguugccccaaccuuccccggagaacaacuccucuucuuucgaucgaccaugcccggcugcuccggcuaccccaacauggaccucgacugcuuacucccacaagaauggguccaauacuuuuaccaagaagcagcacccgcccaaucagacguagcgcuccuccgauuuguaaaccccgacacuggacgaguccuauucgaaugcaaacuacacaaauccggcuaugucaccguagcccauacagggcaacacgaucuaguaauuccacccaacggauacuuccgcuuugacucauggguaaaccaauucuacacccucgcccccaugggcaauggcaccggacgccgccguuaa

SEQ ID NO: 38268 - RNA, 1617 nt, Artificial Sequence
  derived and/or modified sequence opt11 from VP1__Norovirus_and/or_Norovirus-like__KC409310
augaaaauggccuccaacgacgccaaucccucagauggcuccgccgcuaaccucguccccgaaguguccaacgaagucauggccuuagaacccgucguaggcgccgccaucgcagcccccgucgccggccaacaaaacguuaucgaccccuggauccgcaacaacuucguccaagccccaggaggagaguucaccgucucaccacgcaacgccccuggggaaauccuuugguccgcgcccuuaggaccagaccucaaucccuaccucucacaccuugccagaauguacaacggcuacgccggcggcuucgaaguacaagucauucucgcaggcaacgccuuuaccgcgggaaaaaucaucuucgcagccguacccccuaacuucccaaccgaaggccuauccccaucccaagucacaauguucccccacauaaucgucgacguccgccaacucgagccaguccuaaucccacuacccgacguccgcaacaacuucuaccacuacaaccaaaccaacgaucccaccaucaaacucauagcaaugcuauauaccccacuccgcgccaacaacgcgggcgaagacgucuuuacagucucaugucgcguccucacccgccccagcccagacuucgacuucaucuuccuagucccucccacugucgaaucccgaaccaaacccuucaccguccccauccuuaccgucgaagaaaugaccaacucacgcuucccaauuccccucgagaaacucuucacaggccccuccggcgcguucgucguccaaccccaaaacggccgauguacaaccgauggcguucuucucggcaccacccaacuuagcccuguuaacaucuguacauuucgcggagacgucacacacauagccggcucgcgcaacuacacaaugaaccucgccucucucaacuggaauaacuacgaccccaccgaagaaauaccagcaccccucggcacccccgacuucgucggcaaaauacaaggcguccucacucaaaccacaaaaggcgacgguuccacccgaggccacaaagccacagucuauaccggaagcgcccccuuuacccccaaacucggaucuguacaauucuccaccgacacagaaaaugacuucgaaacacaccagaacacaaaauucaccccaguaggaguaauccaagacggaggaaccacccaccguaacgaaccucaacaauggguccucccaaguuauuccggccgagacguccacaacguacaccuagccccagccgucgcccccacuuuccccggcgaacaacuccuuuucuuccgcucaaccaugccuggcuguuccggauaucccaacauggaccuagacugccuacucccucaggaguggguccaacacuucuaucaagaagccgcaccagcgcaaucugacgucgcacuucuacgauucguaaaccccgacaccggccgcguacuauucgaaugcaaacuccacaaaucaggcuacguaaccguagcccacacaggccagcacgaccucguaaucccacccaacggauacuucagauuugacucuugggucaaucaauucuacacccucgcccccaugggaaacggaacgggcagacgucgauaa

SEQ ID NO: 38269 - RNA, 1617 nt, Artificial Sequence
  derived and/or modified sequence opt11 from VP1__Norovirus_and/or_Norovirus-like__JX989073
augaaaauggccucuaacgacgccaaucccuccgacggaucggccgccaaccuuguccccgaagucaacaacgaagucauggcccucgaacccgucguaggagccgccaucgccgcuccaguagccggacaacaaaacgucaucgacccauggauacgcaauaacuucguccaagcuccaggcggcgaguucaccgucucaccccgcaacgcuccuggagaaauucugugguccgcaccacucggccccgaccucaaccccuaccucucccaccuagcccgcauguacaacggcuaugcaggcggcuucgaaguccagguaauacucgccggcaacgccuuuacagcaggcaagauaaucuucgcugccguacccccaaacuucccaacagaaggacucucuccaagccaaguaacaauguucccacacaucaucguagacguccgccaacuagaacccguccuaauaccacuccccgacguccgcaacaacuucuaccacuacaaccaaucaaaugacuccaccaucaaauuaaucgccaugcucuacacuccccuacgagccaacaacgccggggaagacgucuucaccgucuccugccgagucuuaacccgccccagccccgacuucgacuucaucuuccuaguaccacccaccgucgagucccgaaccaaacccuucacaguccccauacuaaccgucgaagaaaugacaaacagccgcuucccaauaccccucgaaaaacucuucaccggacccucauccgcauuuguaguucaaccacagaacggccgaugcacaaccgacggaguacuccucgggaccacccaacucuccccagucaacauaugcacauuccgcggagacguaacacacaucgcuggaucacgcaacuacacaaugaaucucgccucucucaacuggaacaacuaugacccaacagaagaaaucccagccccacucggcaccccggacuucgucggcaaaauccaaggaaugcucacccaaaccaccaaaggcgauggcuccacgcgcggccacaaagcaacagucuacaccggcuccgccccuuucacccccaaacucggcuccguccaauucuccacagauaccgaaaacgacuucgaaacccaucaaaacaccaaauucacccccgucggcgucauccaagacggauccaccacacaccgcaacgaaccccaacaguggguccuccccagcuacuccggccgcgacauaccaaacguccaccucgcccccgccgucgcuccuaccuuccccggcgagcagcuacuuuucuuccgaucaacaaugcccggaugcuccggauaccccaacauggaccucgacugccuccucccucaagaguggguccaacauuucuaucaagaagccgcccccgcucaauccgacgucgcacuccuucgauucgucaaccccgacacaggccgagucuuguucgaaugcaaacuucacaaaucaggcuacgucaccguagcccauacaggccaacacgaccucgucauuccacccaacggauacuuccgauuugacuccugggucaaccaauuuuacacacuugcccccaugggcaauggcacaggcagacgccgauaa

SEQ ID NO: 38270 - RNA, 1617 nt, Artificial Sequence
  derived and/or modified sequence opt11 from VP1__Norovirus_and/or_Norovirus-like__JX459902
augaaaauggcauccucugacgccaaccccuccgauggauccacagccaaccucguccccgaaguuaacaaugaaguaauggcccuagaacccguaguuggcgccgccaucgccgcacccgucgcaggccaacaaaacguaauagaccccuggauccgaucaaacuucguccaagcaccaggcggcgaguucacaguuuccccacgcaaugcccccggcgaaauccucuggucugccccacucggccccgaccucaacccauaccucucccaccuagcccgcauguacaacggcuacgccggcgguuuugaaguucaaguuaucuuagccggaaacgccuucaccgccggcaaaauuauauucgccgccguaccacccuccuuccccauagaaggccucucccccucccaaguaacaauguucccccacaucauuguggauguacgccaacuagaacccguccucaucccccucccugacguaagaaacaauuucuaccacuacaaccaauccaacgacccuaccaucaaacucauugccaugcuauacaccccucuucgugccaacaacgccggagacgacgucuucaccgucuccugccgcguccucacacgucccuccccugauuucgacuucauuuuccucguacccccaaccguagaaucccgcacaaaaccauuuuccgucccuguccuaaccguugaagaaaugacuaacucccgcuuccccaucccccuagaaaaacucuucaccggccccuccagcgcauucgucguccaaccccagaacggccgaugcaccaccgacggaguccuucucggcaccacccaacuuuccccugucaacaucugcacauuccgcggcaacgucacccacauauccggcucccgcaacuacaccaugaaccucgccucucaaaacuggaacuccuacgaccccacagaagaaaucccagcaccccuaggcacaccagacuuugucgggaagauccaaggcguccucacccaaaccaccaaaaccaacggcuccacccgcggucacaaggccaccgucuacaccggcucagccgacuucucacccaaacucggccggguccaauucgccaccgacaccgacaacgacuucgaaaccaaccaaaauaccaaauucaccccaguaggcguaauccaagacggauccacaaccccgcgcaacgaaccucaacaguggguacucccauccuacuccggaagaaacacccacaacguacaccucgcccccgccgucgcccccaccuuccccggagaacaacuucucuuuuuccgauccaccaugccuggaugcuccggcuacccgaacauggaccuugauugccuccucccccaagaauggguacaauacuucuaccaagaagccgcccccgcacaaucugacgucgcccuccuucgcuucguaaacccagacaccggccgcguccuauucgaaugcaaacuccacaaaucagguuacgucaccgucgcacacaccggccaacacgaccucguuaucccacccaacgguuacuuccgcuucgacucaugggucaaccaauuuuacacccuggcccccaugggaaacgguacgggucgacgacgcuaa

SEQ ID NO: 38271 - RNA, 1617 nt, Artificial Sequence
  derived and/or modified sequence opt11 from VP1__Norovirus_and/or_Norovirus-like__JX459644
augaagauggccuccaacgacgccaaccccagcgauggcuccgccgccaaccuaguacccgaaguuaacaacgaagucauggcacucgaacccguuguaggcgcagccaucgccgcccccguagcaggccaacaaaacgucaucgaccccuggauacgcaauaacuucguccaagccccuggcggagaauuuaccguaucgccacgcaacgcucccggcgaaauccuauggucagcgccacuaggacccgaccucaaucccuaccucucacaccucgcacggauguacaacggcuacgccggcggauucgaaguccaaguuauacuagccggcaaugccuucaccgcaggaaaaaucauauucgccgcagucccuccaaacuuccccacagaaggacucucucccucccaaguaaccauguucccucacauaauagucgacguccgccaacuagaacccguccuaauuccccuccccgacguccgaaacaacuucuaccacuauaaccaaucaaacgacuccaccauuaaacucaucgccaugcuauacacaccccuccgagccaacaacgccggagaagacgucuucaccguaucaugccgaguccuuacccgacccuccccagacuucgacuucaucuuccuagucccaccaaccgucgaaucccguaccaaacccuucaccgucccaauacucaccguugaagaaaugaccaacucccgauuccccaucccacuagaaaaacucuucaccggccccucaggcgcuuucgucguccaaccccaaaauggccgcugcacaaccgacggcguccuacuagggaccacccaacucucaccugucaacaucugcaccuuccgcggcgaugucacgcauaucgcaggaucacgcaacuacacaaugaaccucgccgcacucaauuggaacaacuacgaccccacagaagaaauccccgcaccccuaggcacuccugacuucgucgguaaaauucagggcguccugacacaaaccacaaaaggggacggcucaacccguggccacaaagccaccgucuacacaggcucagccgacuucacacccaaacuaggcagcguccaauucucaaccgacacagaaaacgacuucgaaacucaccaaaacaccaaguucaccccagucggugucauccaagacggaagcaccacacaccgcaacgaaccccaacaauggguacuacccucauacucaggcagaaacguccauaauguccaccuagccccagccguugccccuaccuucccaggcgaacaauuacuauucuucagauccaccaugccaggaugcuccggcuacccaaacaugaaccucgacugccuuauaccccaagaauggguccaacacuuuuaccaagaagccgcccccgcacaauccgacgucgcccuacuacgauucguuaaccccgacacaggaagaguacucuuugaaugcaaacuccacaaauccggcuacgucaccgucgcccacacgggccaacacgaccucguaaucccacccaauggcuacuuccgauucgacuccugggucaaccaauucuacacgcuagccccaaugggaaacggcgcaggccgacgccgauaa

SEQ ID NO: 38272 - RNA, 1617 nt, Artificial Sequence
  derived and/or modified sequence opt11 from VP1__Norovirus_and/or_Norovirus-like__JX459610
augaaaauggcauccaacgacgcccaccccuccgacggauccgccgcaaaccuaguacccgaaguaaacaacgaagucauggcccucgaacccgucgucggcgcagcaauugccgcccccguagcgggacaacaaaaugucaucgacccauggauccgcaacaacuucguccaagccccaggaggcgaauuuaccgucucaccccgaaacgccccaggcgaaauacucugguccgcaccccucggacccgaccugaaccccuaccucucacaccucgcccgcauguacaacggcuacgccggcggcuucgaaguccaagucauccucgccggcaacgccuucaccgcuggcaaaauaauauucgcagcaguacccccuaacuucccaaccgaaggccucucccccucacaagucaccauguucccacacaucauaguagacguacgacagcuugaaccaguacucauaccauuacccgacguacgcaacaacuucuaccacuauaaccaauccaacgacuccacaauaaaacucaucgccaugcucuacacaccccuucgcgccaacaacgcaggagaagacgucuuuaccgucagcugcagaguuuuaacccgucccucuccugacuucgauuucaucuuccucguacccccaacagucgaaucucgcacuaaacccuucaccguacccauccuuaccgucgaagaaaugacuaacucucgcuuccccaucccccucgaaaaacucuucaccggacccucaggcgcauucgucguacaaccgcaaaacggacggugcaccaccgacggcguacuucucggcaccacccaacucucccccguaaacauaugcacauuccgaggcgacgucacucacauagccggcucacggaacuacaccaugaaccucgccucucuuaacuggaccaacuacgaccccacagaagaaaucccagccccucucgggacccccgacuuugucggaaagauccaaggcguccucacccaaaccacaaaaggggacggcucaacaagaggccacaaggcaaccguauacaccggauccgcccccuucacccccaaacucggauccguccaauucuccaccgacaccgaaaacgacuucgaaacacaccaaaacaccaaauucacucccguuggcgucauccaagacgguggcaccacccaccgcaacgaaccccaacaguggguccuucccuccuacucaggccggaacguccacaacguccaccucgcaccagccgucgcacccaccuuccccggcgaacaacuccucuucuuccgcuccaccaugccaggcugcucaggauaccccaacauggaccucgauugccuccuaccacaagaguggguacaacauuucuaccaagaagccgcuccugcacaaucugacgucgcccuacuccguuucguuaacccagacacuggacgcguccucuucgagugcaaacuccacaaauccggcuacguuacaguagcccauacuggccaacacgaccucgugauacccccaaacgguuauuuccgauuugacucaugggucaaccaauucuacacacucgcaccaaugggaaacgguaccggccgccgcagauaa

SEQ ID NO: 38273 - RNA, 1617 nt, Artificial Sequence
  derived and/or modified sequence opt11 from VP1__Norovirus_and/or_Norovirus-like__JX459606
augaaaauggccuccaacgacgccaacccuagcgacggcucagccgccaaccucguacccgaaguaaacaacgaaguaauggcacuagaacccgucgugggcgccgcaaucgccgcaccagucgccggccaacaaaacgucaucgacccauggauccgaaauaacuucguccaagcaccaggcggagaguucaccguaucaccccgcaacgcucccggagaaauccucuggcgcgcccccuuaggccccgaccucaaccccuaccuaucacaccucgccagaauguauaacggcuaugccggaggcuucgaaguccaagucauccuugccggcaacgccuucaccgccggcaaaauaaucuucgcagccgucccacccaacuuccccaccgaaggccucucacccucccaaguaaccauguucccccacauaauaguugacguccgacaacucgaacccguccucaucccucuccccgacguacgcaacaacuucuaccacuacaaccaaucaaacgacucaaccauaaaacuaaucgcaaugcuuuacacgccccuccgagccaacaaugcgggagaagauguauucaccguuucaugccgcguccucacccgccccaguccagacuucgacuucaucuuccuugucccucccaccgucgaaucccgcaccaaacccuucaccguucccauccucaccguagaagaaaugaccaacucccgauuccccauaccccuagaaaaacucuuuacuggccccucaucugccuucgucguccaaccccaaaacggacguugcacgaccgacggcguacuucucggcacaacacaacuaucucccgucaacauaugcaccuuccgcggugacgucacacacaucgcaggcucccgaaacuacacaaugaaucuugccucccucaauuggaacaacuaugacccaaccgaagaagucccagccccacucggcacccccgacuucgucgguaaaauccaaggaguacuuacccaaaccaccaaaggcgacggcucuacgcguggccacaaagcaaccgucuauaccggcuccgcccccuucaccccaaaacucggcucaguccaauucuccacagacaccgaaaacgacuuugaaacccaccaaaacaccaaauucacccccgucggcguaauccaagacggaucaaccacccaccgcaacgaaccccaacaauggguccuuccaucguacuccggccgcaaugugcacaacguucaccuagcacccgccgucgcaccaaccuuccccggcgaacaacuucucuucuuccgauccaccaugccaggcugcuccggcuacccaaacauggaucucgacugccuacucccacaggaauggguccaacacuucuaucaagaagccgcacccgcccaaucagacgucgcccuccuccgcuucgucaacccagacacaggacggguccucuucgaaugcaaacuacacaaaucaggcuacgucaccgucgcacacacaggccaacacgaccucguaauacccccuaacgguuacuuccgauucgauucaugggucaaccaauucuacacccucgccccaaugggaaacggcaccggccgacgccgauaa

SEQ ID NO: 38274 - RNA, 1617 nt, Artificial Sequence
  derived and/or modified sequence opt11 from VP1__Norovirus_and/or_Norovirus-like__JX445159
augaaaauggccuccaacgacgccaaccccagcgacgguuccgccgccaaccucgucccagaaguaaacaacgaagucauggcccuugaaccaguagucggugcagccaucgccgcccccgucgcaggacaacaaaacgucauugacccauggauccgcaacaacuucguccaagccccaggaggcgaguucaccguuucaccacgcaacgcaccaggcgaaauccucugguccgcaccccucggcccagaccucaacccauaccucucacaccuagcaaggauguacaacggcuacgccggcggcuucgaaguccaagucauccuagccggcaacgccuucaccgcaggcaaaaucaucuucgccgccgucccacccaacuuccccacggaaggccuuuccccaucacaaguaacaauguuuccucacauaaucgucgacguccgccaacucgaaccaguacucaucccucucccagacguacgcaacaacuucuaccacuacaaccaaucaaacgacuccacaaucaaauuaaucgcaaugcuauauacgcccuuacgcgcaaacaacgccggcgaagacguuuucaccgucagcugccgcguacucacacgaccgucaccagauuuugacuucauauuccucgucccacccacaguagaaucccgaaccaaacccuucacaguacccauccuaaccgucgaagaaaugaccaacucccgcuuucccaucccccuagaaaaacuauucaccggccccuccucagccuucgucguacaaccccaaaacggccgcugcaccaccgacgguguccuccucggcacaacccaacucucccccguaaacaucugcacauuccgaggcgacgucacccauaucgccggcucccgcaacuacaccaugaaccucgccucucuaaacuggaacaacuacgacccaacagaagaaauacccgcaccacucggcacccccgacuucguagguaaaauacaaggcguccuaacccaaaccaccgaaggggauggauccaccagagggcacaaagcaaccgucuacacagguuccgcacccuucacacccaagcucggauccguccaguucuccacagacaccgaaaacgacuucgaaacucaccaaaacacuaaauucacccccguuggcgucauacaagacggcuccaccacccaccgaaacgaaccucaacaauggguacuaccaagcuacuccggacgcaacguucauaacguccaccuugcccccgccgucgccccaacuuucccuggagaacaacuacucuucuuccgcuccacaaugccgggaugcucaggcuaccccaacauggaccucgacugccuacucccucaagaauggguacaacacuucuaccaagaagccgcacccgcccaauccgacgucgcccuccuccgcuuuguaaaucccgacaccggccgcguccucuucgaaugcaaacuacacaaaucaggcuacguaaccguagcccacaccggccaacacgaccuuguuaucccucccaacggcuacuuccgcuucgacucuugggucaaccaauucuacacacucgcucccaugggcaauggaacuggccgacgacgcuaa

SEQ ID NO: 38275 - RNA, 1617 nt, Artificial Sequence
  derived and/or modified sequence opt11 from VP1__Norovirus_and/or_Norovirus-like__JN400606
augaagauggcaucuaacgacgcaaacccauccgacggcucugcagcaaaccuagucccugaaguaaacaacgaagucauggcccuggagcccgucgugggcgccgccaucgccgcucccgucgcaggccaacaaaacgucauagauccguggauacgcaacaacuucguacaagcccccggaggagaguucaccgucagcccccgcaacgccccuggagaaauacucugguccgcaccacuaggaccagaccuaaacccauaccucagccaccuagcccgcauguacaacggguacgcuggcgguuucgaaguccaaguaauccuagccggaaaugccuucaccgccggcaaaaucauauuugcugccgucccacccaacuuccccacagaaggccucucacccucccaggucaccauguucccccacaucauagucgacguacgccaacucgaacccguccucaucccccuccccgacguucguaacaacuucuaccacuacaaccaguccaacgacuccaccaucaaacucaucgcuaugcucuacacaccccuacgcgcaaacaacgccggagaagacgucuucaccguaucaugccgcguacuaacccgcccauccccggacuucgacuucauauuccucguacccccgaccguagaaucucgaacaaaaccauucaccgucccuauccucaccgucgaagaaaugacaaacucccgcuuccccauuccacuugaaaaacucuucacaggucccuccuccgccuucgucguccaaccccagaacggccgcugcaccaccgacggcguacuccucgguaccacacaacuaucccccgucaauaucugcaccuuccgcggcgacgucacccacauagcaggaucacgcaacuacaccaugaaccucgccucccuaaacuggaacaacuacgacccuaccgaagaaauaccagcuccacuaggcacacccgacuucguaggcaagauccaaggaguccucacacaaaccaccaaaggcgacggcucaacccgaggccacaaagccaccgucuacaccggcggcgcccccuucacacccaaacuuggcuccguccaauucuccaccgacaccgaaaacgacuucgaaacacaccaaaacaccaaguucacaccugucggaguaauccaagacggcucaaccacccaccgcaacgaaccacaacaauggguacuaccgucauacagcggucgaaacguccacaacguacacuuagcccccgccgucgcccccaccuuccccggcgaacaacuucuauucuuccggucaaccaugcccggcugcucaggcuacccaaacauggaccucgauugccuccucccccaagaauggguccaacacuuuuaccaagaagccgcccccgcacaauccgacguagcccuccuccguuucgugaaccccgacaccggccguguccuuuucgaaugcaagcuacacaaauccggcuacgugaccguagcccacaccggccagcacgaccucgucauacccccaaacggauacuuccgcuucgacuccuggguaaaccaauucuacacccucgcucccaugggcaacggcacaggaagacgacgcuaa

SEQ ID NO: 38276 - RNA, 1617 nt, Artificial Sequence
  derived and/or modified sequence opt11 from VP1__Norovirus_and/or_Norovirus-like__JQ613562
augaaaauggccagcaacgacgccaaccccuccgacggcuccgccgccaaccuaguaccagaaguaaacaaugaagucauggcccucgaacccgucgucggcgccgcaaucgccgcccccgucgccggccaacaaaacgucaucgaccccuggauccggaacaacuuuguacaagcaccaggaggcgaauuuacaguuucuccccgaaacgcucccggggaaauccucugguccgcuccccuuggcccggaucucaaccccuaccucucccaccucgcccgcauguacaacggcuacgcaggaggauucgaaguccaagucaucuuagcaggaaacgccuuuaccgcaggaaaaaucaucuucgcagccguucccccaaacuuucccaccgaaggacugucccccucacaagucaccauguucccacacaucaucgucgacguccgacaacuagaacccguccuaauaccccuccccgacguccgcaacaauuucuaccacuacaaccaauccaacgacucuaccaucaaacuuaucgcaaugcucuauacaccccuucgcgccaacaacgcuggcgacgacgucuucaccgucagcugccgcguacuuacccgacccucacccgacuucgacuucaucuuccuagucccaccaacuguagaaucucguaccaaauccuucacaguacccauacuaaccgucgaagaaaugaccaacucucgauuccccauaccucuagaaaaacucuucacuggccccuccucugcauucgucguccaaccccaaaacggcagaugcaccaccgacggcguccuccucggcacaacacaauuaucccccguaaacaucuguaccuuccgcggcgacgucacccauaucgccggcucacguaacuacacaaugaaccucgccucccucaacuggaacaacuaugacccaaccgaagaaauacccgcuccccucggcacaccagacuucgucggcaaaauccaaggcguccucacccaaaccacaaaaggcgacgggucuacucgcggacacaaagcaaccguauacaccggguccgccgacuucacccccaaacucggcagcguccaauucgguaccgacaccgacaacgacuucgaaacucaccaaaacacuaaauucaccccagucgguguaauacaagacggcuccaccacccaccguaacgaaccacaacaauggguccuuccauccuacucaggccgcaacguucacaacguacaccucgcacccgccgucgcccccaacuuccccggcgaacaacuacucuucuuccgcuccaccaugcccggaugcucuggcuaccccaacauggaccucgacugccuccucccccaagaauggguccaacacuucuaucaagaagccgcacccgcccaauccgacgucgcccuucuccgcuucgucaacccagacacuggccgcguccucuucgaaugcaagcuacacaaauccggcuacgucaccguagcccacacuggucaacacgaccucguaaucccucccaacggcuacuuucguuucgacuccuggguaaaucaauucuacacacucgcuccuauggggaacggggccggccgaaaacgcuaa

SEQ ID NO: 38277 - RNA, 1617 nt, Artificial Sequence
  derived and/or modified sequence opt11 from VP1__Norovirus_and/or_Norovirus-like__HQ456343
augaaaauggccuccaacgacgccaaccccucagacggcuccgcagcaaaccucguccccgaagucaacaacgaaguuauggcccucgaacccguagucggcgccgcaauugccgcccccguagcuggacaacaaaacgucaucgacccuuggauccgcaacaacuucguccaggccccuggcggcgaguucaccgucucuccccgcaacgcacccggagaaauacucugguccgcaccccucggccccgaccuaaaucccuaccucucacaccucgcccguauguacaacggcuacgccggaggcuucgaaguccaggucauccuagccggcaacgccuucaccgccggaaaaaucaucuucgccgccguacccccaaacuuccccacugaaggcuuaucacccucccaagucacaauguucccacacauaaucgucgacguccgacaacucgaacccguccugaucccacuccccgacgucagaaacaacuucuaccacuacaaccaauccaacgacuccaccaucaaacuaauagccaugcucuacacaccacuacgcgccaacaacgcaggcgacgacgucuuuaccgucuccugcagaguccuuacucgccccuccccagacuucgacuucaucuuccuggucccacccaccgucgaaucccgcacaaaaccuuucacuguucccauccuaaccgucgaagaaaugacaaacucccguuuccccauaccccuagaaaaacucuucaccggcccaucaagcgccuuuguaguacaaccccagaauggccgcugcacuaccgacggaguccuccucggcacuacacaacuaagcccagucaauaucugcacguuccgcggagacgucacccacauagcagguucacgcaacuacaccaugaaccucgcaagccucaacuggaauaacuacgaccccaccgaagagauacccgccccacucggcacccccgacuucgucggaaaaauccaaggcguacucacccaaaccaccaaaggagacgguucuacccgcggacacaaagcaaccgucuauaccggcuccgcagacuucacacccaaacuaggcucaguccaauucgcaacagacaccgagaacgauuucgaaacacaccaaaacaccaaauucacaccugucggagucauacaagacggcucaacaacucaccgcaacgagccacaacaaugggucccucccagcuacuccggcagaaacguacacaacguucaccucgcccccgcagucgcccccaacuuccccggagaacaacuccuauucuuccguucuaccaugcccggcugcuccggauaccccaauauggaccucgauugccuacucccacaagaauggguacaacacuucuaccaagaagccgccccugcccaauccgacguugcccuacuccgcuucgucaacccugacacaggucgcguccucuucgaaugcaaacuccacaaauccggauacgucaccguagcacauaccggccagcacgaccuugucaucccacccaacggcuacuuccgcuucgacuccugggucaaccaauucuacaccuuagcccccaugggcaacggcacaggccgccgccgcuga

SEQ ID NO: 38278 - RNA, 1617 nt, Artificial Sequence
  derived and/or modified sequence opt11 from VP1__Norovirus_and/or_Norovirus-like__HQ456342
augaaaauggccucguccgacgcaaacccauccgacggcuccacagccaaccucgucccagaggucaacaacgaaguaauggcacucgaacccgucgucggcgccgcgaucgcagcccccguagcaggccaacaaaacgucaucgauccauggauccgaaacaacuucguccaagccccagguggcgaguucaccgucucccccagaaaugccccaggcgaaauccucugguccgcaccccuaggccccgaccucaaccccuaccuaucacaccuagcccgcauguauaacggcuacgccggaggcuucgaaguucaagucauccucgccggaaacgccuuuaccgccggcaaaaucaucuucgcagccguacccccaaacuucccuacagaaggccucucccccucucaagucaccauguucccucacaucauaguugacguccgccaacucgaaccuguccuaauuccauuaccugauguccgaaacaacuucuaccauuacaaccaaucaaaugacccaacaaucaaacuaaucgccaugcucuacacaccccuucgagccaacaacgccggagacgacgucuucaccguauccugcagaguacucacccgccccuccccagacuucgacuucaucuucuuaguaccacccaccgucgaaucccgcacaaaaccauucucaguacccauccucacagucgaagaaaugacuaacucacgcuuccccauuccacuugaaaaguuauuuacaggaccauccucagccuucguuguccaaccucaaaauggccgaugcacaacagacggaguacuacucggcaccacucaacuuucccccgucaacauuugcacauuccgcggugauguuacacacauuaccggcucccgcaacuauaccaugaaccucgcaacccaaaacuggaacucauacgaccccacagaagaaauccccgcuccucuaggaacccccgacuucgucggcaaaauacaagggguccucacacaaaccacacgcgcugacggauccacccgcggccauaaagcaacaguauacacaggcucagcagacuucgcccccaagcucggccgaguccaauucgccaccgacaccgauaacgacuucgaugccaaccaaaacacaaaauucacucccguaggcgucauacaggacggaggcaccgcccaccggaacgaaccccagcaauggguucuccccucguacuccggccguaacucccacaacguacaucucgcccccgcagucgcacccaccuuccccggcgaacaacuccuguucuuccgcuccaccaugccaggcugcucaggcuaccccaacauggaccucgacugccuccucccccaggaauggguccaauacuuuuaccaagaagccgcccccgcacaauccgacgucgcccuccuucgauucguuaaccccgacaccggccgcguccucuucgagugcaaacuacacaaauccggcuacgucaccguugcacacaccggccaacacgaccucgucauacccccaaacggcuacuuucgcuucgauuccugggucaaccaauucuacacacucgcacccauggguaacggcaccggccgccgacgcuaa

SEQ ID NO: 38279 - RNA, 1617 nt, Artificial Sequence
  derived and/or modified sequence opt11 from VP1__Norovirus_and/or_Norovirus-like__HQ456340
augaagauggccucaaacgacgccuccccuuccgacggauccgccgcaaaccuaguacccgaagucaacaacgaaguaauggcccucgaacccguaguuggagccgcuaucgccgcuccaguagccggccaacaaaacgucauagauccauggauacgcaacaauuucguccaagcaccaggaggcgaguucaccgucuccccacggaacgcccccggugaaaucuuauggucagcacccuuaggacccgaccuaaacccauaccuaagccaccucgccagaauguacaacgguuacgccggcggcuucgaaguacaggucauccucgccggaaaugcauucacagcaggaaaaauaaucuucgccgccguacccccaaacuuccccaccgaaggccucuccucaagccaaguaacaauguucccccacaucaucgucgacguacgccaacuugaacccguccuaaucccccuccccgacguccgaaacaacuucuaccacuacaaucaauccuccgacucuaccauaaaacucaucgccaugcucuacacaccccuacgcgccaacaacgcaggagaagacgucuucaccgucucaugccgcguccugacucgccccucccccgacuucgacuucauauuccucguaccacccacaguagaaucccgaaccaaacccuucaccguacccauccuaacugucgaagaaaugaccaacucccgauuccccauaccccuagaaaaacucuucacuggccccuccggagcuuucguaguccagccacaaaacggacgcugcaccacagacggaguacuccucggaacaacccaacucuccccggucaacaucugcaccuuccgcggcgacgucacccacauagcaggcucgagaaacuacaccaugaaccuagccgcucucaacuggaacaacuacgaccccaccgaagaaauccccgccccacuaggaacccccgacuucguaggcaaaauccaaggcguccugacccaaaccacaaaagccgacggauccacccgcggacauaaagccaccgucuacacaggauccgccgacuucacacccaaacuuggcuccguccaauucucaacagacaccgaaaacgacuucgaaacccaucaaaacaccaaauucacccccgucggcgucauccaagacggcucaaccacccacagaaaugaaccccagcaauggguacuaccuagcuacucaggccgcaacguccacaacguccaccuagcacccgccgucgcacccacauuccccggcgaacaacuacuuuucuuccgaucaacuaugcccggcuguuccggcuaccccaacauggaccucgacugccuccucccacaagaauggguacaacacuucuaccaagaagccgcacccgcccaauccgacguugcgcuccuacgauucgucaacccagacaccggccgcguccucuuugagugcaagcuccacaaaucaggauacgucacggucgcccacaccggacaacacgaccuagucaucccacccaauggcuauuuccgcuucgacucaugggucaaccaauucuacacccuagcucccaugggaaauggcacaggccgaagacgcuaa

SEQ ID NO: 38280 - RNA, 1617 nt, Artificial Sequence
  derived and/or modified sequence opt11 from VP1__Norovirus_and/or_Norovirus-like__HQ456326
augaaaauggcauccaacgacgccaaccccuccgacggauccgcagccaaucucguccccgaaguaaacaacgaaguaauggcacucgaaccaguagucggagcagccaucgccgccccagucgccggacaacaaaacguuauagacccauggauccgaaacaacuucguccaagccccuggcggagaguucacagucucuccccgcaacgccccaggagaaauccuaugguccgcaccccuaggccccgaccuaaaccccuaccuuucccaccuagcaagaauguacaacggcuacgcaggaggauucgaaguacaagucauacucgcaggcaacgcauucaccgccggaaaaaucaucuucgcagccguaccacccaacuuccccacagaaggccuuucccccucacaaguaaccauguucccccacaucgucguagacguccgccaacucgaaccaguccuuaucccccucccagacguccgaaauaacuucuaccacuacaaccaaagcaacgauuccaccaucaaacucaucgcaaugcuuuacacuccccuacgcgccaauaacgccggcgaagacgucuucaccguauccugccgagugcuaaccagacccucccccgacuucgacuucaucuuccucgugcccccaaccgucgaaucccgcaccaaacccuucacuguacccauacucacaguugaagaaaugaccaacagccgcuucccaaucccacuggaaaaacucuucaccggccccucuggcgcauucgucguccaaccacaaaacggcagaugcaccacagauggaguacuccuuggcaccacccaacuaucuccggucaacaucugcaccuuccgcggcgacgucacccacauagcaggauccagaaacuacaccaugaaccuugccucacucaacuggaacaacuacgaccccacagaggaaauccccgcaccccuaggcacccccgacuucguaggcaaaauccaaggcguacuaacccaaacaacaaaaggcgacggauccacacgcggccacaaagccacaguuuacaccggcucagccccauuuacccccaaacucggauccguccaauucuccacugacaccgaaaacgauuucgagacccaccagaacaccaaauucacccccgucggaguuauccaagacggcuccacuacacaccgaaaugagccacaacaguggguccuucccucauacucaggccgaaacguccacaacguacaccucgcccccgccgucgcacccaccuuccccggagagcaacuacuauuuuuccgcuccacaaugccaggcuguuccggcuaccccaacauggaccucgacugccuucuuccccaggaauggguccaacacuucuaccaagaagccgcccccgcccaguccgacgucgcauuacuacgcuuugucaaccccgacacaggccgcguccucuucgaauguaaacuucacaaaucgggcuacguuaccgucgcgcacacaggccaacacgaccucguaauacccccuaacggauacuuccguuucgacagcugggucaaucaauucuacacacuagcucccaugggcaacggcacaggccgccguagauaa

SEQ ID NO: 38281 - RNA, 1617 nt, Artificial Sequence
  derived and/or modified sequence opt11 from VP1__Norovirus_and/or_Norovirus-like__HM802527
augaaaauggccuccaacgacgcaaaccccuccgacggauccgccgccaaccucguccccgaaguuaacaacgaagucauggcccuagaaccaguuguaggagccgccaucgccgcccccguagcaggccaacaaaaugucaucgaccccuggauacgaaacaacuucguccaggcccccggcggagaguucacaguuagcccccgcaacgcaccaggcgaaauccucugguccgccccacucggucccgauuuaaacccuuaccucucccaccuagcacgaauguacaacggcuacgccggcgguuucgaaguccaaguaauccucgcaggaaacgccuucaccgcaggaaaaaucaucuucgccgcagucccacccaauuuucccaccgaaggccucucccccucccaaguaacgauguucccccacaucaucgucgacguccgccaacucgaacccguacuuaucccacucccagacguacgaaacaacuucuaucacuacaaccaauccaacgacagcaccauaaaacucaucgcaaugcucuacacaccccuaagagcaaacaacgcaggcgaagacgucuucaccgucucaugccgcguccucacccgaccauccccagacuucgacuucaucuuccucgugccaccaacggucgaaucccgcacaaaacccuucaccgucccaauccucaccgucgaggaaaugacuaacucucgauuccccaucccacucgaaaaauuauucacaggcccaucaggcgcauucgucguccagccccaaaacggacgcugcaccaccgacggaguccuacuaggcaccacccaacuuagccccguaaauaucugcacuuuucgaggcgacguaacacacaucuccggcucacgcaacuacacaaugaacuuggccucacuaaauuggaacaacuacgaccccaccgaagagauccccgcgccccuuggaacaccugacuuugugggaaaaauacaaggcguccuuacccaaacaaccaaaggagacggcuccacaaggggacacaaagccacaguauacaccggaagcgcccccuucacacccaaacuuggaucaguucaauucucaaccgacaccgagaacgacuucgaaacccaccaaaauaccaaguucacccccgugggagucacacaagacggcuccacgacccaccgcaacgaaccacaacaguggguucuucccucauacuccggccgcaacguucacaacguacaccuugcccccgccgucgcaccaacauucccaggagaacaacuccuguucuuccgaucuacaaugcccggcugcucaggauacccgaacauggaccuagacugccuccuaccccaggaguggguccaacacuucuaucaagaagccgcccccgcccaauccgacguagcccuccuccgcuucgucaaccccgacacaggccguguccuguucgagugcaaacuccauaaauccggauacgucaccgucgcccacaccggccaacacgaccuagucaucccaccuaacggcuacuuccgcuucgacuccuggguaaaccaguucuacacccucgcccccaugggaaacggaaccggccgccgccgauaa

SEQ ID NO: 38282 - RNA, 1617 nt, Artificial Sequence
  derived and/or modified sequence opt11 from VP1__Norovirus_and/or_Norovirus-like__GQ856448
augaaaauggccucaaacgacgccaaccccucagacggauccgccgccaaccuaguacccgaaguaaacaacgaagucauggcccucgaacccgucguaggcgccgcaaucgccgcccccgucgcaggccaacaaaaugucaucgacccauggauccgcaacaacuucguccaagcgcccggaggagaguucaccgugucgcccagaaacgcccccggagaaauccucugguccgccccacucggacccgaccuaaaccccuaccuaucacaccuagcucgcauguauaacggcuacgcaggcggcuucgaaguccaaguaauccuagcaggaaacgccuucacagcaggcaaaaucaucuucgccgccguacccccaaauuucccaaccgaaggccucuccccaucccaaguuaccauguucccccacaucauaguagacguaaggcaacuagaacccguccucaucccacuaccagacguccgaaacaacuucuaccacuacaaccaauccaacgauuccaccaucaaacuuaucgccaugcuauacacuccccuacgugccaacaaugcuggcgaagaugucuucacagucagcugccgcguccuaacccgacccucccccgacuucgacuucauauuccuaguacccccaaccgucgaaucucgcaccaaacccuucacaguccccauucucaccgucgaagaaaugaccaacucacgcuuuccaaucccccuagaaaaacucuucaccgguccauccggcgccuuuguaguacaaccccaaaauggacgaugcacaaccgacggcguccucuuaggcaccacucaacucucccccgucaacauaugcaccuuccgcggagacgugacccacaucgccggcucacgcaacuauaccaugaaccucgccucccuaaacuggaacaacuacgacccuaccgaagaaauccccgcaccccucggaacccccgacuucgucggcaaaauccaaggcguacucacacaaaccacaaaaggcgacggcuccacccgcggccacaaagccaccgucuacacaggauccgcccccuuuacccccaaacucggcucaguacaauucuccaccgacaccgaaaaugacuucgaaacacaccagaauacaaaauucacuccaguaggugucauccaagacggaucaaccacacaccgaaacgaaccccaacaauggguccuacccuccuacuccggcagagacguccacaacguccaccucgccccagccgucgccccaaccuuccccggggaacaacuccuuuucuuccgcuccaccaugccuggcugcuccggauaccccaacauggaccucgauugccuacucccccaagaauggguccagcacuucuaccaagaagccgcacccgcccaauccgacgucgcucuccuacgcuucguaaacccagacacaggccgcguacuauucgaaugcaaacuacacaaauccggauacgucacagucgcccauacaggacaacacgaucuagucaucccucccaacggcuacuuccgauucgacuccuggguuaaccaauucuacacccucgcccccaugggaaacggcaccggacguagacgcuaa

SEQ ID NO: 38283 - RNA, 1617 nt, Artificial Sequence
  derived and/or modified sequence opt11 from VP1__Norovirus_and/or_Norovirus-like__AB541347
augaaaauggcuagcaacgacgcaaacccaucagacggcucagccgcaaaccucguacccgaaguaaacaacgaagucauggcccucgaacccgucguuggagccgccaucgccgcacccgucgcaggccaacaaaaugucaucgacccauggauccgcaacaacuucguacaagcccccggcggcgaguucaccgucucuccccgcaacgccccaggcgaaauccucugguccgcaccccucggcccugaccucaaucccuaccucucccaucuagcccgaauguacaauggguacgccggcggcuucgaaguccaagucauccuugcuggcaacgcuuucacagcugguaaaaucaucuucgcagccguaccucccaacuuccccacagaaggucucucccccucacaagucaccauguucccccauaucaucguagauguccgccaacucgaaccuguacuaauaccccucccagacguccgaaacaacuucuaccacuacaaccaaucaaacgacucaaccauaaagcuaaucgccaugcucuacacaccacuccgcgccaacaacgccggagaagacgucuucaccguuagcugccgcguacuaacccgccccucccccgacuucgauuucaucuuccucguucccccgaccgucgaaucccgaacaaaacccuucaccguccccauccucacaguagaagaaaugaccaacucccgcuucccaaucccccuagaaaaacuuuucaccggucccuccggcgccuucgucguacaaccccaaaacggccgcugcaccaccgacggcguccuacucgguaccacacaacuaucacccguaaacaucugcacauuccgcggagacgucacccacauagccggcucuagagauuacacuaugaaccuagccucccucaauuggaacaacuacgacccaacugaagaaaucccagcgccucucggcacacccgacuucgucggcaaaauccaagggguccuaacacaaaccacaaaaggagacggcuccacacguggucacaaagcaaccguauacaccggcucagucccuuucacccccaaacucggcagcguccaauuuuccaccgacacagagaacgacuucgaaacccaucaaaacacaaaauucacccccgucggcguuauccaagacggauccaccacacaccgcaacgaaccccaacaauggguccucccaucguacagcgggagaaacguacacaacguacaccucgcaccagccgucgccccaacauucccaggcgaacaacuacuuuucuuccgcuccaccaugccaggaugcucaggauaccccaacauggaccuagacugccuccucccccaagaauggguacaacacuucuaccaagaagccgcccccgcacaauccgacgucgcccuccuccgguucgucaaccccgacaccggccgcguccucuucgaaugcaaacuccauaaaucaggauacgucaccguagcacacacaggccaacacgacuuaguaauacccccaaacgguuacuuccgcuucgacuccuggguaaaccaauucuacacccuggcaccuaugggcaacggcaccggcagacgccgauaa

SEQ ID NO: 38284 - RNA, 1617 nt, Artificial Sequence
  derived and/or modified sequence opt11 from VP1__Norovirus_and/or_Norovirus-like__AB541298
augaaaauggccuccaaugacgccaaccccucagacgguagcgcagccaaccucgucccagaagucaacaacgaagucauggcacucgaacccgucgucggcgcagcuaucgcagcaccugucgccggccaaacaaacgucaucgaccccuggauucgcaacaacuucguucaagccccagggggcgaguucacaguaucaccccgcaacgcccccggcgaaauccucuggucugccccacuaggccccgaccucaaccccuaccucucacaccucgcacguauguacaacggauacgccggugguuucgaaguacaagucauucucgcaggcaacgcauucacagccggcaaaauaaucuucgccgccgucccaccuaacuucccaaccgaaggccucucacccucacaaguaacaauguucccccacauuauugucgacguccgucaacuagaacccguccucaucccacuaccagauguacgcaacaacuuuuaccacuacaaccaaagcaacgacucaaccaucaaacucauagccaugcuauacacaccgcuccgcgcuaacaaugccggcgaagacgucuucacagucuccugccgaguacuaacccggcccucacccgacuucgacuucaucuuccucacgccaccaacagucgaaucuagaacaaaaccauucaccguccccauacuaaccguagaagaaaugacaaacucccgcuuccccauuccccucgaaaaacuauucaccggaccaucaggagccuucgucguacaaccacaaaacggccgcugcacaacagacgguguacuacucgggaccacacaacugucacccgucaauaucugcacauuucggggcgacgucacacacaucgccggcucucgaaauuacacgaugaaccucgccucacucaacuggaacaauuacgacccaacugaagaaauccccgccccacuuggcacacccgacuucguaggcaaaauccaaggaguccucacacaaacaaccaaaggagaugggucaacaagaggacacaaagccaccguauacaccgggucggcccccuucaccccaaaacuaggcuccguccaauucuccacagacaccgaaaacgacuucgaagcccaccaaaacaccaaauucacccccgucggagucauacaggacggauccacaacccaccgcaacgagccucaacaauggguccuccccucauacucaggccgaaacguacagaacguacaccucgccccagccgucgccccaacauuccccggagagcaacucuuauucuuuagauccaccaugccaggcuguuccggauacccuaacauggaccuagacugccuacucccccaagaauggguacaacacuucuaccaagaagccgcccccgcccaaucugaccucgcccuccuacgauucguaaauccugauacaggccgaguccuguucgaaugcaaacuacacaaauccggcuacgucacugucgcccacaccggucaacacgaccucgucauucccccaaacggcuauuuccgcuucgacuccugggucaaccaauucuacacccucgcacccaugggaaacggcacuggccgccgccgcuaa

SEQ ID NO: 38285 - RNA, 1617 nt, Artificial Sequence
  derived and/or modified sequence opt11 from VP1__Norovirus_and/or_Norovirus-like__AB541270
augaaaauggcaucuaacgacgcaaaccccuccgacggcuccgccgccaaccuaguccccgaaguaaacaacgaaguuauggcccuggaacccguagucggcgccgccaucgcagcccccgucgcaggccaacaaaacguaaucgaccccuggauccgcaacaacuucguccaagcacccggaggagaguucacaguauccccacgcaacgccccaggcgaaauccucuggucagcuccucucggacccgaccuaaaccccuaccuaucacaccucgcacgcauguauaacggcuacgccggcggcuucgaaguccaaguuauccuagccggcaacgccuucaccgccggaaaaauaaucuucgcugcaguacccccaaacuuccccacagaaggacuaucaccaucccaaguuacgauguucccccacaucauagucgacguacgccaacucgaaccaguccuaaucccccucccagacguccgcaacaauuucuaccacuacaaccaauccaacgacucuaccauaaaacucauagccaugcuauacacaccccuacgcgccaacaaugccggcgaagacgucuuuacagucucaugccgcguccuuacaagaccaagcccagacuucgacuucaucuuccucguucccccaaccgucgaaucucgcacaaaaccguucaccguccccauccucaccgucgaagaaaugaccaacucccgauucccaaucccccuagaaaaacucuucaccggacccucaggagccuucgucguccagccucaaaacggccgaugcacaacagacggcguccuucucggcacaacccaacuaagcccagucaacaucugcacuuucagaggugauguuacccacaucgcuggcucccgaaacuacaccaugaaucucgccucccucaacuggaacaacuaugacccaaccgaagaaauccccgcaccacuaggcaccccagacuucgucggcaagauccaaggcguccuaacccaaacaaccaaaggcgacggcucaaccagaggacacaaagcuaccgucuacacaggcuccgcccccuucacucccaaacucggcucaguccaauucucaaccgacaccgaaaacgacuuugaaacccaccaaaauacaaaauucaccccagucggcguaauacaagacggauccacaacccaccgcaacgaaccucaacaauggguucuccccuccuauuccggccgaaacguccacaacguccaccuagcucccgcuguugcccccaccuuccccggagaacaacuccucuucuuccgcuccaccaugcccggcugcuccggcuaccccaacauggaccuugacugccuucucccacaagaauggguacaacacuuuuaucaagaggcugcccccgcacaauccgacguagcccuccuccguuucgucaacccugacaccggucgaguacuuuucgaauguaaacuucauaaaagcggauauguaacggucgcccacacuggccaauacgaccucgucauaccacccaacggauacuucagauucgacucuugggucaaucaauucuacacccucgcccccaugggcaacggaacaggccgucgacgauaa

SEQ ID NO: 38286 - RNA, 1617 nt, Artificial Sequence
  derived and/or modified sequence opt11 from VP1__Norovirus_and/or_Norovirus-like__AB541263
augaaaauggcguccaacgaugccaacccauccgacggcucagccgccaaccucguccccgaagucaacaaugaagucauggcacuagaacccguagucggcgccgcgaucgccgcccccgucgccggacagcaaaacgucaucgaccccuggauccgcaacaacuucguacaggcaccaggcggagaguucacaguauccccacgcaacgcaccaggcgaaauccucugguccgcuccacucggacccgaccucaaccccuaccucucucaccuagccagaauguacaacggcuacgccggcggauucgaagugcaagucauccuagccgguaacgccuucaccgcuggcaaaaucauuuucgcugccguaccgccaaauuuccccacagaaggccucucucccucucaagucaccauguuuccccacauaaucguugacguacgacaacucgaacccguccuuaucccccuucccgacgucagaaacaacuucuaccacuacaaccaaaguaacgacuccaccauaaaacucaucgcaaugcucuacacaccacuacgcgccaacaacgcaggcgaagacgucuucaccgucuccugcagaguacucacccgccccucccccgacuucgacuucaucuuccuaguuccacccaccgucgaaucccgcaccaaacccuucaccguccccauacucaccgucgaagaaaugaccaacucacgcuuucccaucccccucgaaaaacucuucaccggccccuccucugccuucgugguccagccacaaaacggccgaugcaccacggacggcguacuccucggcaccacccaacucucccccgucaacgucugcaccuuccgaggcgaugucacccacaucgccggcucccgaaacuacaccaugaaccucgccucacucaacuggaacaacuacgaucccacagaagaaaucccagcuccccucggcacucccgacuuuguaggcaagauccaaggcguccucacccaaacaaccaaaggcgacggcuccacccgaggucacaaagccacagucuacacuggcucagcccccuucacccccaaacuaggcuccguccaauucuccaccgacaccgagaacgacuucgaaacacaccaaaacaccaaauucacucccguaggcgucauccaagacgggggcaccacacacagaaacgaaccccagcaauggguacucccaucauauuccggccgugacguuccuaacguucaucuagccccagcggucgccccuaccuucccuggcgaacaacuccucuucuuccgaagcacaaugcccggcugcucuggauaccccaacauggaccuagauugccuccuaccccaagaauggguccaacacuucuaccaagaagcagcgccagcccaauccgacgucgcacuacuccgcuuugucaaccccgacaccggccgaguccuauucgaaugcaaacuccacaaauccggcuacgucacgguagcccacaccggucaacacgaccuagucauaccacccaacggcuauuuccgcuucgacuccugggucaaccaauuuuacacccucgcccccaugggcaacgguaccggccgacgccgcuaa

SEQ ID NO: 38287 - RNA, 1617 nt, Artificial Sequence
  derived and/or modified sequence opt11 from VP1__Norovirus_and/or_Norovirus-like__AB541256
augaaaauggccucaaacgacgccaaccccuccgacggcucagcagccaaccucgucccagaggucaacaacgaagucauggcacuagaacccgucguaggagccgccaucgcugcccccguggccggccaacagaacgucaucgacccuuggauucgcaacaacuucguacaagcccccggaggagaguucaccguaucccccaggaacgccccaggagaaauccucugguccgcuccccuaggacccgaucuuaaccccuaccuaucccaccucgcccguauguacaacggcuacgccggaggcuucgaaguacaagucauucucgcaggcaacgcauuuaccgcaggcaaaaucaucuucgccgcuguucccccaaacuuccccaccgaaggacucucaccaucccaagucaccauguucccccacaucaucgucgacguccgccagcucgaacccguccucaucccccuccccgauguccgcaacaacuucuaccacuacaaccaaucuaacgacuccacaaucaaacugauagccaugcucuacacaccccuucgcgcaaacaacgcaggcgaggacgucuucaccgucucaugccgcguucuaacccggcccucacccgacuuugacuucaucuucuuaguaccacccacaguugaaucccgaaccaaacccuucaccgugcccauccucaccgucgaagaaaugaccaauucacguuuucccaucccacucgaaaaacucuucaccggcccaagcggcgcuuucguaguccaaccacaaaacggccgcugcaccaccgacgguguccuacuaggcacaacucagcuuucacccguaaacaucugcaccuuccgcggcgacguaacacacaucgccggaucccgcaacuacaccaugaaccuagcagcccuaaacuggaacaacuacgacccgacagaggaaauccccgccccucucggaacacccgacuucgucggcaaaauccaaggcguacuaacccaaacaaccaaaggagacggcucaacgagaggacacaaagcuaccguguacaccggauccgccgacuuuacaccaaaacucggcuccguacaauucuccacugacacagaaaacgacuucgaaacacaccaaaacaccaaauucacccccgucggcgucauccaagacggauccacuacccaccgcaacgaaccccaacaauggguccucccuucauacuccggccgcaauguacauaacguacacuuagcccccgccgucgcccccacauucccuggcgagcaacuccucuucuuccgaucaaccaugccaggcugcuccggauaccccaacauggaccuggacugccuaaucccccaagaauggguacagcacuucuaccaagaagcugccccagcccaaucugauguagcacuauuacgauucgucaaccccgacacaggccgcguccuauucgaaugcaaacuacacaaauccggcuacguaaccgucgcccacaccggacagcacgaccucgucauucccccaaacggcuacuuccgcuucgacuccuggguaaaccaauuuuacacccucgcccccaugggcaauggcgccggccgcagacgcuaa

SEQ ID NO: 38288 - RNA, 1617 nt, Artificial Sequence
  derived and/or modified sequence opt11 from VP1__Norovirus_and/or_Norovirus-like__AB541240
augaaaauggcuuccaacgacgccaaccccagcgacggcucagccgccaaccuuguccccgaagucaacaacgaagucauggcccucgaacccguggucggcgccgcaaucgccgcacccgucgccggccaacaaaacguaauagaucccuggauccgcaacaacuuuguccaggccccaggaggcgaguucacugucucaccacgcaacgcgcccuccgaaauacugugguccgcuccacucggcccagaccuuaacccauaccucucucaccucgcacgcauguacaacggcuacgcaggcggcuucgaaguccaaguaauccuugcaggcaacgccuucacagccgguaagaucaucuucgccgccguacccccaaacuuccccacagaaggccuaucacccucgcaagucaccauguucccacacaucaucgucgauguccgccaacucgaaccaguccucaucccccuccccgacguaagaaacaauuucuaccacuacaaccaaucaaacgacucaacaaucaaacucauagcaaugcuauacacuccacugagagccaauaacgccggugaagacguauucacagucuccugccgcguacuaacccgccccagcccagacuucgacuucaucuuccuagucccacccaccguagaaucacgcacaaaacccuucaccgucccuauccucaccguagaagaaaugaccaacucccgcuuccccaucccccucgaaaaacuuuucaccggccccucaucagccuucgucguacaaccacaaaacggacgcuguacaacagauggaguacuccucggaaccacacaacuaucccccgucaacaucugcaccuuccgcggagacguaacccacauagcuggcucccggaacuacacuaugaaccuagcgagcauaaacuggaauaacuacgaccccaccgaagaaauccccgcaccacuuggaaccccagacuucgucgguaaaauacaagguguucucacccaaaccacaaaaggugacggcagcacacgcggacacaaggccaccgucuacaccggcuccgcaccauucacccccaaacuaggcuccguccaauuuucaaccgacaccgaaaacgacuucgaaacccaccaaaacacaaaauucacccccguaggcgucauucaagacggaggcaccacacaucaaaacgaaccacagcaaugggugcuccccggauacagcggccgcaacgucccaaacguccaccucgccccagccgucgcccccacauucccaggagaacaacuccucuuuuucagauccaccaugcccggaugcucuggcuaccccaacauggaccucgacugccuucuuccacaagaauggguacaacacuucuaccaagaagcagcccccgcacaaucagacguagcccuacuucgcuucguaaauccugacacaggacguguccuuuucgagugcaaacuacacaaaucuggcuacgucacggucgcccacaccggccaacacgaucucgucaucccuccaaauggcuacuuccgcuucgacucaugggucaaccaauucuacacacuagcacccaugggcaacggcaccggccggcgcagauaa

SEQ ID NO: 38289 - RNA, 1617 nt, Artificial Sequence
  derived and/or modified sequence opt11 from VP1__Norovirus_and/or_Norovirus-like__AB541233
augaaaauggccucauccgacgccaaccccucugacggcuccgccgcgaaccuaguucccgaaguuaacaacgaagucauggcacuagaacccgucguaggcgccgcaaucgcagcaccagucgccggccaacaaaacguaauagaccccuggauccgcaacaacuucguccaagcaccaggcggcgaguucacagucucaccccgcaacgcccccggagaaauauuaugguccgccccacugggacccgaccuuaacccuuaccuaagccaccucgcccgaauguacaacggcuacgcugguggauucgaaguacaaguaauccucgccgguaacgccuucacggcaggcaaaauaauauucgcagccguacccccaaacuuccccaccgaaggccucucccccucccaagucaccauguucccacacaucaucgucgauguacgacaacucgaaccuguacucaucccucuacccgacguccgcaacaacuucuaccacuacaaccaaagcaacgacucaacaaucaaacuaaucgcaaugcuauacaccccacuccgagccaacaaugcaggcgaagacguauucaccgucagcugccgcguucuaacccgccccuccccagacuuugacuucaucuuccucguucccccgaccgucgaaagccgcacuaagcccuucaccgucccaauccuaaccgucgaagaaaugacuaacucccgcuuccccaucccacucgaaaaacuauucacaggccccaguuccgccuucguuguccaaccccaaaacggccgcugcacaaccgacggaguccuccucggcaccacccaacucucccccguaaacaucugcaccuuccgcggagacgucacucacauagcaggcucucgcaauuacacaaugaaccucgccucccuaaacuggaacaacuacgaccccacagaagaaauacccgccccacucggcacccccgacuucgucggcaaaauccaaggcgucuuaacccaaaccaccaaaggcgacggaucaacgcgcggccacaaggccaccguauacaccggcuccgcucccuucaccccaaaacuuggaucuguccaauucuccacagacacagaaaacgacuucgaaacccaccaaaauaccaaauucacucccguaggugucauacaagauggaggcaccacacaccgcaaugaaccucaacaauggguccucccaucauauuccggccgcaacgucccaaacguacaccucgcacccgccgucgcaccaaccuuucccggcgagcaacuucucuucuuccggucuaccaugcccggcuguuccggauaccccaacauggaccucgacugccuccucccccaagaauggguacaacacuucuaucaagaagcagcucccgcccaguccgacguugcucuccuccgguucgucaacccugacacaggccgaguccucuucgaaugcaaacuccacaaagcaggcuacgucaccguagcccacacaggccaacacgaccuagugaucccacccaacggauacuuccgauucgacuccuggguuaaccaauucuacacccucgcacccaugggcaacggcacaggccgccgacguuaa

SEQ ID NO: 38290 - RNA, 1617 nt, Artificial Sequence
  derived and/or modified sequence opt11 from VP1__Norovirus_and/or_Norovirus-like__AB541215
augaaaauggccuccaaugacgccaaccccuccgacggcuccgccgcaaaccuaguccccgaaguaaacaacgaaguuauggcacuagaacccgucguaggcgccgccauagccgccccugucgccggucaacaaaacgucauagacccuuggauccgcaacaacuucguacaagcaccaggcggcgaguucaccgucucuccccgaaacgccccaggagaaauccccugguccgaaccccuaggacccgaucuuaaccccuaccucucccaccuugcccgaauguacaacggcuacgccggcggcuuugaaguucaagucauccuagccggaaacgccuucaccgcaggaaaaauaaucuucgccgccgugcccccaaacuuccccacagaaggccucucccccucacaagucacaauguucccccacaucaucgucgacguccgacaacucgaaccuguccucauaccccuccccgauguccgcaacaacuucuaccacuacaaucaauccaacgacucaaccauaaaacuuauagccaugcuuuacacaccccuacgagccaacaacgccggcgaggacgucuucaccguauccugcagaguucucacccgccccucucccgacuucgacuucaucuuccucguacccccuaccgucgaaucccgaaccaaaccauucaccguccccauucuaaccgucgaagagaugaccaacucacgcuuucccauuccccucgaaaaacucuucaccggcccauccucagcauuugucguccaaccccaaaacggcagaugcacuaccgacggaguccuccuuggcacaacccaacuaagccccguaaacaucugcacauuccgcggcgacgucacccacaucgccggcucccgcaauuacaccaugaaccuagcaucacugaacuggaacaacuacgacccaaccgaagaaaucccugcuccccucgguacccccgacuucgucggcaaaauucaaggcguccucacccaaaccaccaaaggcgacggauccacacgcggccacaaagccacagucuauaccggcucagccgacuucacaccuaaacucggauccguucaauucuccaccgacacagaaaacgacuucgaaacucaccaaaacaccaaauucaccccaguaggcgucauccaagacggcgguaccacccacagaaacgaaccccaacaauggguacucccaagcuacuccggccgaaacguccacaacguccaccucgcccccgccgucgccccaaccuucccaggggaacaacuccucuuuuuccgcucaaccaugccaggcugcucaggcuacccaaacauggaccuagacugccuccucccccaagaauggguacaacacuucuaccaagaagccgcaccagcccaauccgacgucgcacuacuacgauucgucaauccugacacgggccgaguacucuucgagugcaaacuacacaaauccggcuacgucaccguagcccacaccggccaacacgaccuagucaucccacccaauggcuauuuccgcuucgacucaugggucaaccaauucuacacacucgcccccaugggcaacggcacaggcagacgccgcuaa

SEQ ID NO: 38291 - RNA, 1617 nt, Artificial Sequence
  derived and/or modified sequence opt11 from VP1__Norovirus_and/or_Norovirus-like__AB541201
augaaaauggcauccaacgacgccaaccccuccgacgguuccgcagccaaccuaguacccgaaguaaacaacgaaguaauggcccuugaacccgucguaggcgcagccaucgccgcaccugucgccggccaacaaaacgucauugaccccuggauccgcaauaacuucguacaagccccagguggcgaauuuaccguaucaccccgcaacgcccccggugaaauccuaugguccgcuccccuuggccccgaucuaaaccccuaccucucucaccuugcccgaauguacaacggcuacgccggcggcuucgaaguccaaguuauccucgcuggcaacgccuucaccgcaggaaaaaucauauucgccgccgucccacccaacuuccccacggaaggacuaucucccucacaagucaccauguucccacacaucaucguagacgugcgacagcucgaacccguccuuaucccccuacccgacgugcgcaacaacuucuaucacuacaaccaaucaucugauucuaccauaaaacuuaucgcgaugcucuacacaccccuucgcgccaacaacgcuggugaagacguauucaccgucagcugccgaguccucacccgacccucuccagacuucgacuucauauucuuaguacccccaacagucgaaucucgcaccaaaccauucacaguccccauuuuaaccgucgaagaaaugacaaacucccgauuuccgauaccccucgaaaaacucuuuaccggccccuccggcgccuuugucguacaaccacaaaacggccgcugcacaacagacggaguccuccucggcaccacacagcucucccccgucaacaucugcaccuuccgaggcgacgucacucauauagcuggcucccgaaacuacacaaugaaccucgcaucucuuaacuggaacaauuacgaccccaccgaagaaauccccgcuccccuuggcaccccugauuuugucggcaagauccaaggcguccucacccaaaccaccaaaggcgacggcagcacccgaggccacaaagcaacuguauacaccggaucagcccccuucacccccaagcugggcuccguccaauucuccaccgacacagaaaacgacuucgagacacaccaaaacaccaaauucacaccagucggaguaauccaagacggcuccaccacacaccgaaacgagccacaacaauggguccucccuagcuauuccggacgaaauguccacaacguccaccucgcacccgcagucgccccaacuuuccccggcgaacaacuccuuuucuuucgcuccaccaugcccggcugcuccggcuacccaaauauggaccuggacugccuccuuccacaagaauggguccaacauuucuaccaagaggcagcuccagcccaaagcgacgucgcccuccuccgcuucgucaaccccgacaccggccguguguuauucgaaugcaaacuacacaaauccggcuacgucacagucgcccacacaggccaacacgaccucgucauuccacccaacggauacuuccgcuuugacuccugggucaaccaauucuacacccuagcccccauggguaauggcaccggccgccgacgcuaa

SEQ ID NO: 38292 - RNA, 1617 nt, Artificial Sequence
  derived and/or modified sequence opt11 from VP1__Norovirus_and/or_Norovirus-like__FJ411172
augaaaauggccagcaaugacgccaaccccuccgacggauccacugcaaaccuaguccccgaaguaaacaacgaagucauggcccucgaacccguagucggcgcugccaucgccgccccagucgccggacaacaaaacgucauagacccauggauccgcaacaacuucguacaagcccccggcggcgaguucacaguaucgccccgcaacgcaccaggcgaaauucuaugguccgcaccccucggccccgaucuuaaccccuaccucucacacuuagcccgcauguacaacggauaugccggaggauucgaaguccaagucauccuagccggcaacgccuucaccgcaggcaaaaucauauucgcagccguacccccaaacuuccccacagagggccucagcccaucccaagucaccauguucccacacauaaucguagacgucagacagcuggaacccguacucauaccccuccccgacguacgcaacaacuuuuaccacuacaaccaaucaaacgaccccaccaucaagcuaaucgccaugcucuacacuccacuccgugccaacaacgccggcgacgacgucuuuacagucucaugccgaguccucacaagaccuucacccgauuucgacuucaucuuccucgucccacccacagucgagucccgcacaaaacccuuuacaguucccauccucaccgucgaagaaaugaccaacucucgauuccccauaccccuagaacgccuauacaccggcccuuccuccgccuucgucguccaaccccaaaacggcagaugcaccaccgacggcguacuacucggaacaacacaacucuccgccgucaauaucugcaccuuccgcggugacguuacccacaucgcaggcucccgaaacuacacaaugaaccucgccagccaaaacugguccaacuacgacccaacugaagaaauccccgcgccccuaggcacaccugacuucguuggcaaaauacaagguaugcuuacacaaaccaccagaagagacggcagcacccgcggucacaaagccaccguccucaccggaagcgccgauuucgcccccaaacuuggccgcguacaauuugcaaccgacaccgacaacgacuucgaauccggcgaaaacaccaaauucacccccgucggcgucauccaagauggcuccacuacacaccgcaacgaaccccaacaaugggucuuacccaauuacuccggaagaaccggacacaacguccaucuugcaccagccgucgccccaaccuaccccggcgaacaacuccucuucuuccggucgaccaugcccggcugcucaggauaccccaacauggaccuggacugccuccucccccaagaauggguucgccacuucuaccaggaagccgcaccagcccaaucagacgucgcccuacuacgauucguaaaccccgacacuggccgcguccuuuucgaaugcaaacuacacaaauccggauaugucaccgucgcccacacaggacaacacgaccuugucaucccacccaacgguuacuuccgauucgauucauggguaaaccaauucuacacccucgcuccaauggguaacggcgccggccgacgccgauaa

SEQ ID NO: 38293 - RNA, 1617 nt, Artificial Sequence
  derived and/or modified sequence opt11 from VP1__Norovirus_and/or_Norovirus-like__AB447449
augaaaauggcauccaacgacgccaaccccuccgacggauccgccgcaaaccuaguccccgaagucaacaacgaagucauggcacuagagcccguagucggcgcagccaucgccgccccugucgcaggacaacaaaacguaaucgacccuuggauacguaacaacuucguccaagcacccgguggcgaguucaccgucagcccccgcaacgcacccggugaaauccuuugguccgcuccccugggaccagaccucaaccccuaccucucucaucuagcaagaauguacaacggcuacgccggcggcuucgaaguucaagucauccucgccgggaacgcuuucacagcuggcaaaaucauauucgccgcuguaccacccaacuucccaacagaaggacucuccccaucccaaguuaccauguucccccauaucaucguagacguccgacaacucgaaccuguacuuauaccccuccccgacguccgcaacaacuucuaccacuacaaccaauccaacgacuccaccaucaagcucauagccaugcuauacacaccccuucgcgcaaacaacgcgggcgaagacgucuuuaccgucucgugccgcguccuaacacggcccucccccgacuucgacuucaucuuucucguacccccaaccgucgaaucacgcacgaaacccuucacgguccccauacucaccgucgaagaaaugacuaacuccagauucccaaucccccuggaaaagcuauucaccggacccuccggcgcuuucguuguccaaccccagaacggccgcugcaccaccgacggaguccuccuaggcacaacccaacucucacccguuaacaucugcacuuuccgcggcgacgucacccacaucgcuggaucgcgagacuacacaaugaaccucgccagccuuaacuggaacaauuacgaccccacugaagaaauccccgcaccacucggaacccccgacuucgucggcaaaauccaaggcguccuuacccaaaccaccaaaggcgacggcuccacgcgaggccacaaagcuacuguauauacaggcuccgcccccuucacccccaaacuaggcucaguccaguucuccacggacaccgaaaacgauuucgaaacccaccaaaacaccaaguucaccccaguuggcgucauccaagacggcucaaccacccaucgcaacgaaccccaacaauggguucuccccagcuacucaggccgaaacguccacaacguccaccuugcacccgccgucgccccaaccuucccaggcgaacaacugcuauucuuccgcuccacaaugcccggcuguuccggcuaucccaacauggaccucgacugccuccucccccaagaauggguccagcacuucuaccaagaagccgccccagcccaauccgacgucgcccuacuccgcuucgucaaccccgacaccggccgcguccuauucgaaugcaaacuccacaaaucaggcuacgucaccgucgcccacaccggccagcacgaccuagucauaccaccgaacggauacuuccgauucgacuccugggucaaccacuucuacacccucgcacccauggguaacggaacuggacgacgccgauaa

SEQ ID NO: 38294 - RNA, 1617 nt, Artificial Sequence
  derived and/or modified sequence opt11 from VP1__Norovirus_and/or_Norovirus-like__AB447431
augaaaauggccaguaaugacgccaaccccucagaugguucaaccgccaacuuaguccccgaaguuaacaacgaagucauggcacuagaacccgucgucggcgcagcaauagcagcccccgucgccggacaacaaaacguuaucgacccauggauacgcaacaauuucguccaagcccccggcggcgaguucaccgucucaccccgcaacgcccccggcgaaauccuaugguccgcuccccucggccccgaccucaaccccuaccuuucccaccuagcccgaauguacaacggcuaugccggcggcuucgaaguccaaguuauacuagccggcaacgccuucaccgcaggaaaaaucauauucgcugcuguacccccuaauuuucccaccgaaggccucucccccucccaagucaccauguucccccacaucauugucgacguccgacaacuugaaccaguacucauaccccuccccgacguccgcaacaauuucuaccacuacaaccaauccaaugacuccaccaucaaacuaaucgccaugcucuacacgccccuacgcgccaacaaugcuggcgacgauguauucaccguaucaugccgcguacuaacccgcccaucacccgacuucgacuucauauuccuugugccucccaccgucgaaucccgcaccaaacccuucaccguccccauacucaccgucgaagaaaugaccaacucccgcuuccccaucccccuagaaaaacuauuuaccgguccauccuccgcuuuuguuguacaaccucaaaacggacgcugcacaaccgacgguguccuccucggaaccacacaauuauccccuguaaacaucugcaccuuccguggagacgucacccacaucgccggcucccgcaacuacacaaugaaccucgccucccuuaacuggaacaacuacgaccccaccgaagaaauaccugccccucucggcacccccgacuucgucggaaaaauacaaggaguacucacccaaaccaccaaaggagacggauccacccggggacacaaagccaccgucuacaccgguuccgccccauucacaccuaaacucggaucaguccaauucuccaccgacaccgaaaacgacuuugaaacccaccaaaacaccaaauucacccccgucggcgucauacaggacggaggcaccacacaccgcaacgagccucaacaauggguacuacccuccuacucaggccgcaacguccacaacguccaccuagcccccgccgucgcucccaccuuccccggcgaacaacuacucuucuuccgaucaaccaugcccggaugcucagguuaccccaacauggaccucgacugccuccucccacaagaauggguccaacacuucuaucaggaagcagccccagcccaauccgacguugcccuccuacgcuucgucaauccagacaccggccgcguacuuuucgagugcaaacuccauaaauccggcuacgucacaguagcuuacacaggacaacacgaucucgucauaccacccaacggcuacuuucgcuucgacuccuggguaaaccaauucuacacauuagcgcccaugggcaacggcaccggacgccgucgauaa

SEQ ID NO: 38295 - RNA, 1617 nt, Artificial Sequence
  derived and/or modified sequence opt11 from VP1__Norovirus_and/or_Norovirus-like__EU078415
augaaaauggcguccaacgacgccaccccuucggauggcagcaccgcaaaccucguacccgaagucaacaacgaagucauggcccuugaaccaguagugggugccgccauugccgcuccagucgcaggacaacaaaacgucauagaccccuggauccgcaacaacuucguacaagcgcccggcggugaauuuacaguaucacccagaaacgcacccggagaaauacucugguccgcaccacucggcccagaccucaaccccuacuugucgcaccucgcacguauguacaacggcuacgccggcggauucgaaguccaagucauccuagccggcaacgccuucaccgccggaaaaaucauauucgcagcagugccacccaauuuccccacagaaggacucuccccaucacaaguaaccauguucccucacaucaucgucgacgucagacaacuagaaccaguacuuauuccacuccccgacguacggaacaacuucuaccacuacaaccaauccaacgaccccaccaucaaacuaaucgcuaugcuauacacaccccuccgcgcaaacaacgcaggagacgacgucuucaccguguccugccgcguucuaacccgccccucacccgacuucgacuucaucuuccuuguuccacccaccgucgaaucccgcaccaaacccuucuccguacccauccuaacaguagaagagaugacaaacucacgcuuccccaucccccuagaaaaacuauucacaggucccuccuccucauucguaguccagccccaaaacggaagaugcaccaccgacggaguucuccucggcacaacccaacuuucccccgucaacauaugcaccuuccgcggggaugugacccacaucgccggcacccaaaacuacaccaugaaccucgccucucaaaacuggaacaacuacgaccccaccgaagaaaucccugcuccacucggcaccccagacuucgucggcaaaauccaagggguacucacccaaaccacccgcggugacggguccaccagaggccacaaagccaccgucuccaccggcuccguccacuucacccccaagcucggcucaguacaauuuucuaccgacaccucuaaugacuucgaaaccggacagaacacccgcuucacucccgucggcguaguacaagauggcucaaccacccaccaaaaugaaccacaacaauggguccuccccgacuacucaggacggaacucacacaacguccaccuagcaccagcagucgcacccaccuuccccggcgaacaacuacuauucuuccgcagcaccaugcccgggugcuccggcuacccaaacaugaaccucgacugccuccucccccaagaguggguacagcacuucuaccaagaauccgcacccgcacaaucagacguagcccuccuccgcuucgucaacccagacacuggccgcguccucuuugaaugcaaacuccacaaauccggcuacguaaccgucgcccacacuggacaacacgaccuagucaucccacccaacggcuacuuccgauucgacuccugggucaaccaauucuacacccucgcccccaugggcaacggcgcaggccgacgccguuaa

SEQ ID NO: 38296 - RNA, 1617 nt, Artificial Sequence
  derived and/or modified sequence opt11 from VP1__Norovirus_and/or_Norovirus-like__AB385643
augaaaauggccucauccgacgccaacccauccgacggcucaacagcaaaccuaguacccgaggucaacaacgaagucauggcccucgagcccgucgucggcgcagcaauagccgcccccguagccggucaacaaaacguaaucgaccccuggauccguaacaauuucguccaagcacccggcggcgaguucaccgucagcccacgaaacgcccccggcgaaauccucugguccgcuccccuaggcccugaccucaaccccuaccuaucacaccuugcacgcauguacaacggcuacgcaggaggauucgaaguccaaguaauacucgccggcaacgcuuucaccgccggaaaaaucaucuucgcagcaguaccacccaacuuccccaccgaaggacucucccccucccaaguaaccauguucccccacaugaucguagacguacgccaacucgaacccguacuaaucccccuacccgacguccgcaacaauuucuaccacuacaaccaaucgaacgauccaaccaucaaauuaauagccaugcuauauaccccgcuucgcgccaacaacgccggcgacgacguauucacagucucaugccgcguacucacacgaccaucaccagacuucgacuucauauuccucgucccacccacaguagaauccaggaccaaacccuucuccguccccauccucacaguggaagaaaugaccaacucccgcuucccaaucccccucgaaaaacucuucacaggccccucaucugcauucgucguccaaccccagaauggucgcugcaccacagacggaguacuccuaggcacaacgcaacucuccccagucaacaucugcaccuuccgcggcgacguaacacacaucgccgguacccaagaauacacaaugaaucucgcgagccaaaacuggaacaauuacgaccccacugaagaaauccccgccccacuugggacaccagacuuugugggcaaaauccaaggaguccugacacagacuacccgaggcgacggauccaccagaggccacaaggcuaccgucucuaccgguuccguccacuucacaccuaaacuaggacgaauccaauucucaaccgacacuuccaacgauuucgaaacaggacaaaacacccgcuucacccccgucggcgucguacaagacggaagcacaacgcaccaaaacgaaccacaacaauggguccuccccaacuacucaggucgagacucccacaacguccaccuugccccagccgucgcccccuccuuccccggcgaacaacugcuauucuuccgcuccacuaugcccggaugcucaggcuaccccaacaugaaccucgacugccuacucccccaagaaugggugcaacacuucuaccaagaagccgcacccgcccaaagcgacgucgcccuacuacgauucgucaaccccgacaccggccggguccuauucgaaugcaaacuccacaaaucaggcuacgucaccguagcccacaccggucaacacgaccucgucauaccgcccaacggcuacuuccgcuuugauuccugggucaaccaauucuacacacucgcccccauggguaacggcacuggccguagacgauaa

SEQ ID NO: 38297 - RNA, 1617 nt, Artificial Sequence
  derived and/or modified sequence opt11 from VP1__Norovirus_and/or_Norovirus-like__AB385636
augaaaauggccuccaacgacgccacccccucugacggcagcaccgccaaccucgucccagaagucaacaacgaaguaauggcucucgagccagucguaggcgccgcaaucgccgccccagucgccggucaacaaaauguaaucgacccauggauccgaaauaacuucgugcaggcccccggcggcgaguucaccgucuccccacgcaacgcuccaggagaaauccuuugguccgcaccccucggccccgaucucaacccuuaccucucccaccucgcccguauguacaauggauacgccggaggcuucgaaguacaagucauacucgccgguaaugccuucaccgccggcaaaaucauauucgccgccguucccccaaacuuccccaccgaaggccucuccccaucacaagucaccauguucccccacauaaucgucgacguccgccaacucgaacccguccucaucccccucccagacguccgcaacaacuucuaccacuacaaccaaucuaacgacccuaccauaaaacucaucgccaugcuauacacaccacuccgcgcaaacaacgccggagaugacgucuucacagauuccugucgaguccucacccgacccuccccagacuuugacuucauauuccucguaccacccacaguggaaucccgcaccaaacccuucuccguccccauacugaccgucgaagaaaugaccaacucacgauucccuaucccacuagaaaaacucuucaccggccccuccucugccuucguaguccaaccccaaaacggccgcugcaccacugacggcguucuacucggaaccacacaacucagcccaguaaacauaugcaccuuccgcggggacgucacccacauagccggcacccaaaacuacaccaugaaccuugcgucccaaaacuggaacaacuacgaccccaccgaggaaauaccagcaccccuuggaacccccgacuucgugggcaaaauacaaggaguacuaacacaaacaacaagaggagacggaucaacccgcgggcacaaagccacuguguccaccggauccguacacuucacccccaaacuaggaucuguccaauucuccaccgacacaucaaacgaccucgagacaggccaaaacacgcgauucacccccguaggcgucguucaagacggguccaccacacaccaaaacgaaccucaacaauggguccuacccaacuacuccggucgcgauagccacaacguccaccucgcccccgcuguagcccccaccuuccccggcgagcaacuccucuucuuccgcuccaccaugccuggaugcuccggcuaccccaacaugaaccucgacugccuccucccccaagaauggguccaacacuucuaucaagaaucagcacccgcucaauccgacguagcccuacuacgcuucgucaacccagacaccggcagaguccucuucgaaugcaaacuacacaaauccggauacgucacagucgcacauaccggccaacacgaccuagucaucccacccaacggcuacuuccgcuucgacuccuggguuaaccaauucuauaccuuggcccccauggguaacggagccggccgccgcagauga

SEQ ID NO: 38298 - RNA, 1617 nt, Artificial Sequence
  derived and/or modified sequence opt11 from VP1__Norovirus_and/or_Norovirus-like__AB385629
augaaaauggccaguaacgacgcuacacccucagacgguuccacggcaaaccucguccccgaagucaacaacgagguaauggcacuagaaccugucgcaggcgcagccaucgccgcuccagucgccggccaacaaaacguaaucgaccccuggauacgaaacaacuucguccaggcaccuggcggcgaguucacugucucgccccgaaacgcaccaggcgaaauccucugguccgcuccccuaggacccgaccuaaauccauaucucucacaccucgccaggauguacaacggcuacgccggcggcuuugaaguccaggucauucuugccggcaacgcauucaccgcaggaaaaauaauauucgccgccguaccacccaacuuccccacagaaggccucucacccucacaagucaccauguucccccacauaauaguugacguccgccaacucgaacccguccucaucccccuccccgacguacgcaacaacuucuaccacuacaaccaaucaaacgacccaacaauaaaacucaucgcuauguuauacacaccccuucgcgccaacaacgcaggcgacgacguuuucaccguuucaugccgaguccuaacccgcccaucccccgacuucgacuucauauuccuaguucccccuaccgucgaaucaagaaccaaacccuucucaguccccauccucaccguugaagaaaugaccaacagccgcuuuccaauaccucuagaaaaacucuucaccggccccuccagcgcauucgucguacaaccccaaaacggccgcugcacaaccgauggcguccuucuaggaacaacccaacucuccccagucaacaucugcaccuuccgcggcgacgucacacacaucgccaacacccaaaacuacaccaugaaccucgccucccaaaacuggaacaacuacgaccccacagaagaaauccccgcaccacuuggcaccccagacuucguaggccguauccaagguguccucacccaaaccacccgaggcgacggcucaacucgcggccacaaagccaccguauccaccggauccguccacuucacacccaaacucggcuccgugcaauucucuaccgacaccuccaacgaucucgaaacaggccaaaacacacgcuucacccccgucggagucguccaagacgguggcaccacccaccgcaaugaaccacaacaauggguacuccccgacuacucuggccgggacucacacaacguccaccucgcccccgccgucgcccccaccuucccaggcgaacaacuccucuucuuccgcuccacuaugcccggcugcuccgguuacccaaacaugaaccucgacugccuccucccccaagaguggguacaacacuuuuaccaagagucagcaccagcucaaagcgacgucgcccuccuccguuucguaaacccugauaccggccgaguucuauucgaaugcaaacuucacaaaucugguuacgucaccguagcucacaccggacaacacgaccucgucauacccccaaacggcuacuuccgauuugacucuugggucaaucaauucuauacccucgcccccaugggcaauggcgccggacgccgaagauaa

SEQ ID NO: 38299 - RNA, 1617 nt, Artificial Sequence
  derived and/or modified sequence opt11 from VP1__Norovirus_and/or_Norovirus-like__EU839586
augaaaauggcaucgaacgacgcgagccccucagauggcucaaccgcaaaccucgucccugaagucaacaacgaaguuauggcccuagaaccaguagucggagccgcaaucgcagccccuguaacaggucaacaaaacgucaucgaccccuggaucagaaacaacuucguccaagcccccggcggugaguucaccguauccccgagaaacgcccccggcgaaauccuaugguccgcaccccucggccccgauuuaaacccauaccuaucccaccucgcccgcauguacaacggcuacgccggaggauucgaaguacaggucauacucgccgguaacgcauucacagcuggcaaaaucauauucgccgcaguuccacccaacuuccccaccgaaggccucucacccucacaagucaccauguucccccacaucaucgucgacguacgccaacuagaacccguacucauaccacuccccgacguacgaaauaauuucuaccacuacaaccaaucaaaugacagcaccaucaaacucaucgccaugcuauacacaccacugcgcgccaacaacgcaggggacgacgucuucaccguauccugccgcguccuaacacgacccucccccgacuucgacuucauauuccucgucccaccaacagucgaaucccgaaccaaaccuuucacaguccccauccuaaccguugaagaaaugaccaacagccgcuuucccauaccucuugaaaaacuuuucaccggaccauccagcgccuucgucguccaaccccaaaauggccgcugcaccacagacggcguacuauuaggcaccacacagcuaucccccguaaacaucugcaccuuccgcggcgacgucacccacaucccuggcacccgaaccuaccgaaugaaccucgccucacaaaacuggaacaacuacgacccaaccgaagaaauaccagcuccccucggcacaccugacuuugucggcaaaauccagggcaugcuaacccagacaaccaaaggagacggauccacacgcggccacaaagccaccguauccaccggcuccguagacuucacucccaaacuagguuccguccaauucgccaccgacacagacaacgacuucgaaaccggccaaaacacccgcuucacacccgucggcguaauucaagacggaagcucaacccaucgcaaugagccccaacaauggguccuucccgacuacuccggacgaaccgcccacaacguccaccucgccccagccgucgcaccaacauuccccggcgaacagcuccucuucuuccgauccaccaugccaggaugcucuggcuaccccaauauggaccuagacugccugcuaccacaagaauggguccaacacuucuaccaagaagccgcacccucccaauccgacgucgcacuucuccgauucgucaacccagacaccggccggguccucuucgaaugcaaacuacacaaagcuggcuacgucaccguagcacacaccggacaacacgaccucgucauacccccaaacggauacuuuagauucgacuccugggucaaccaauucuauacccucgccccaaugggcaacggcgcuggacgccgccgcuaa

SEQ ID NO: 38300 - RNA, 1617 nt, Artificial Sequence
  derived and/or modified sequence opt11 from VP1__Norovirus_and/or_Norovirus-like__EU310927
augaagauggcauccucugaugccucccccagcgacggcuccacagccaaccuaguccccgaaguaaacaaugaaguaauggcccucgaaccugucgucggagccgccauagcagcacccgucgcaggacagcaaaaugucaucgaccccuggauccgaaacaacuucguccaagcacccggaggcgaguucacagucucuccccgcaacgcccccggcgaaauccucugguccgccccacucggacccgaccucaaccccuaccuaucacaccucgcacgaauguacaacggcuacgccggaggcuucgaaguccaaguaauucucgccgggaacgccuucacagcagguaaaauaaucuuugccgccguaccacccaauuuccccaccgaaggccucucccccucccaagucaccauguuuccacacaucauaguagaugucagacaacucgaacccguccucaucccccucccagacguccgaaacaauuucuaccacuacaaccaaucaaacgacccaaccaucaaacucaucgcaaugcucuacacaccccuccgcgcaaacaacgccggcgaugacguauucacagucucaugccgcguccucacccggcccucucccgacuuugacuucauauuccucguaccaccaaccgucgaaucacgaacaaaaccauucacaguccccauccucacggucgaagaaaugaccaacucacgcuucccaaucccccucgagaaacucuucacaggucccuccggcgccuucgucguacaaccacaaaacggacguugcacaaccgacggaguacuccucggcacaacgcaacucucccccguaaacaucugcaccuuccgcggcgacgucacucacauugccggaacccacgacuacaccaugaaucucgccucccaaaacuggaacaauuacgaccccaccgaagaaauccccgccccacucggcacaccagacuucgucggaaaaauccaaggcguacuaacacaaaccacccgcggagacggaucaacccgaggacacaaagccacugucagcaccggcuccguucacuuuaccccaaaacucggcuccguacaguuuaccaccgacacaaacaacgaccucgaaacaggccaaaacaccaaauucacaccaguaggcgucguccaagacggcaacucagcacaccaaaacgagccacaacaauggguccuacccaacuacagcggccguaccggccauaacguacacuuagcucccgccgucgcccccaccuucccaggcgagcaacuacucuucuuccgcuccaccaugcccggcugcuccggcuaccccaacaugaaccucgacugucuccuuccccaagaaugggugcuccacuucuaccaagaagccgccccagcucaauccgacgucgcccuccuccgcuucgucaaccccgacacaggccgcguacucuucgaaugcaaacuccacaaaucaggauacgucaccgucgcgcacacgggaccacacgauuuagucaucccacccaacggcuauuuccguuuugacuccugggucaaucaauucuacacccuagcccccaugggcaauggagccggccgcagacgguaa

SEQ ID NO: 38301 - RNA, 1617 nt, Artificial Sequence
  derived and/or modified sequence opt11 from VP1__Norovirus_and/or_Norovirus-like__AB294787
augaaaauggccuccaacgacgcaucccccucagacggaucugccgcaaaccuaguccccgaagucaacaacgaaguaauggcacuagaacccgucguaggcgccgccaucgccgcacccguagcaggccaacaaaacgucaucgaccccuggauccgcaacaauuucguccaagcccccggcggcgaguucacagucucaccccgcaacgccccaggagaaauccuaugguccgcaccacuagggcccgaccucaacccauaccucucucaccuggcccgcauguacaacgguuacgccgggggcuucgaaguccaagucauccuugcaggcaacgcauucaccgccggcaaaaucauauuugccgcagucccacccaauuuccccaccgaaggccuaucgcccucacaagucacuauguucccacacauaaucguagacguccgccaacucgaaccagugcucauuccucuccccgacguccgaaacaacuucuaccacuacaaccaaucaaacgacuccaccaucaaacucauugccaugcuuuauacaccccuacgcgcaaacaacgccggagacgauguauucaccguaucaugccgcguccuaaccagaccuucacccgacuucgacuuuauauuccucguaccacccaccguagaaucccgcaccaagcccuucacaguccccauccuaaccgucgaagaaaugaccaacucccgauuccccauaccccuugaaaaacucuucaccggcccauccagugcauucguaguacaaccccaaaauggccgcugcaccaccgacggcguacuccuaggcacaacacaacucuccccggucaacaucugcacauuccgcggagacguaacccacaucagcgguacacgaacauaccgcaugaaccuagcaucacaaaacuggaacaacuacgaccccaccgaagaaaucccagcaccgcuaggcaccccagacuucguaggcaagauccaaggcaugcucacacaaaccacuaaaggcgacggcucaacccgcggacauaaagcuaccguaagcaccggcuccguagacuucacccccaagcucggaucaguccaauucgccaccgauaccgacaacgacuucgaaaccggccagaacacuagauucacuccagugggcguaauccaagacggauccuccgcccaccgcaaugaaccccaacaauggguacuccccgacuacagcgggcguaccguccacaacguccaccucgcaccagccgucgccccuacauuccccggagaacaacuccucuucuuccgaucuacaaugccaggcugcucaggcuacccaaacauggaccuagacugccuccucccacaagaauggguacaacacuucuaccaggaagccgcccccucucaaucagauguagcccuacuccgauucgugaaccccgacacuggucggguauuauucgaaugcaaacuacacaaagcaggcuacguaaccgucgcacacacaggccaacacgaucucgucauuccacccaacggauacuuccgcuucgacuccuggguaaaccaauucuacacccucgcccccaugggcaacggcgccggccgacgucguuga

SEQ ID NO: 38302 - RNA, 1617 nt, Artificial Sequence
  derived and/or modified sequence opt11 from VP1__Norovirus_and/or_Norovirus-like__AY587987
augaaaauggcauccaacgaugccaaucccucagacggcucaaccgcaaaucuaguccccgaaguuaacaacgaagucauggcccuagaaccggucgucggugccgccaucgccgcccccguagccggccaacaaaacgucauagaccccuggauccgcaacaacuucguccaagccccgggaggcgaauuuaccgucucaccccgcaacgccccuggcgaaauccucuggucagccccacuuggcccggaccucaaccccuaccucucccaccuagcccgcauguauaacggguacgccgguggcuucgaaguacaaguuauccuagccggcaacgccuucaccgccggcaagauaauauucgcagccguaccacccaacuuccccaccgaaggacuauccccaagccaagugaccauguucccccacaucauaguagauguccgccaacucgaacccguccucaucccccuaccagacguccgcaauaauuucuaccacuauaaccagucaaacgacccaacaaucaaacucaucgccaugcucuacacaccccucagagccaacaacgccggagaagacgucuucaccguuucuugccgaguacucacccgccccuccccagacuucgacuucauuuuccucguuccacccacgguagaaucccgcacaaaaccuuucaccguccccauccugacagucgaagaaaugacaaacucccgcuuccccaucccccucgaaaaacucuucaccgguccuuccggcgcauucgucguacaaccccaaaauggccgaugcaccacagacggaguccuccuuggaaccacgcaacucucccccgucaacaucugcgccuuccgcggcgacgucacccacaucgcuggcacccauaacuacacaaugaaccucgccucccaaaacuggaacaacuacgaccccaccgaagaaauacccgcaccccucggcacacccgacuucgucggacgcauccaaggcaugcuaacccaaaccacacgcggcgacggcuccacucgcggccacaaagcgacaguaucaaccggagacguccacuucacccccaaacucggcuccauccaauucaacacugacaccaacaacgacuucgaaacuggccaaaacaccaaauucaccccaguaggcgucguccaagacggaaacggaacccaccaaaacgaaccacaacaauggguccuccccuccuacuccggacgaacgggccauaacguacaccuggcuccagcuguagcaccaacuuuccccggcgaacaacuccuuuucuuccgcuccaccaugccaggaugcucaggcuaccccaacaugaaccucgacugcuuacucccacaagaauggguccaacacuucuaccaagaagcagcaccagcacaauccgacgucgcccuacuccgauucguaaaccccgacaccggccggguccucuucgaaugcaaacuccacaaauccggauacguaacagucgcccacacaggccaacaugaccuugucaucccaccaaacggcuauuuccgcuucgacucuugggucaaucaauucuacacccuagcccccaugggcaacggaacaggccgccgcagauaa

SEQ ID NO: 38303 - RNA, 1617 nt, Artificial Sequence
  derived and/or modified sequence opt11 from VP1__Norovirus_and/or_Norovirus-like__AY502019
augaaaauggccucuaacgacgcaaaccccuccgacggaucaacagccaaccucguccccgaagucaacaacgaaguaauggcauuagaacccgucguaggcgccgccaucgccgcacccguagccggccaacaaaacgucauagacccuuggauacguaacaacuucguccaagcucccggaggcgaguucacaguaucgccccgaaacgccccgggugaaauccucugguccgcaccccucggcccagaccucaaucccuaccucucccaccuagcccguauguacaacggcuacgccggcggauucgaaguccaggucauacucgccggcaaugcauucaccgcaggcaaaaucguuuucgccgccguaccuccaaacuucccuacagaaggucucucccccucacaagucaccauguucccacacaucaucgucgacguccgccaacuagaacccguccucaucccccucccagacguacgaaacaauuucuaccacuacaaccaaucgaacgaccccaccaucaaacuaauagccaugcucuacacuccgcuccgagccaacaaugccggggaagacguauucaccgucuccugccguguccucacccgccccucccccgacuuugacuucaucuuccucguuccacccaccgucgaaucuaggaccaagcccuucacaguacccauccucacuguagaagaaaugacaaacucccgcuuccccaucccacucgaaaaacucuucaccggccccuccuccgcauucguaguacaaccacaaaacggccgaugcaccaccgacggaguccuacuuggcaccacccaacucucccccgucaacaucugcacuuuccgcggcgauguaacccauauagcuggcacccacaacuacacaaugaaccucgcaucucaaaacuggaacaacuaugacccaacagaagaaauccccgcaccccucggcaccccagacuuugucggccgcauacaaggcaugcucacccaaaccacccgaggcgacggcagcacuagaggccacaaggccaccgucuccacaggcgacguccacuucacccccaaacucgguucuauccaauuuaacaccgauaccaacaacgacuucgaaaccggacaaaacaccaaauuuaccccagucggcgucguccaagacggcaacggcacccaccaaaacgaaccucaacaguggguccucccaucguacuccggccgcaccggccacaacguacaccuagcccccgccgucgccccaaccuuccccggagaacaacuccucuucuuccgauccacaaugccaggcugcucaggcuaccccaacaugaacuuagauuguuuacucccacaggaauggguccaacacuucuaccaagaagccgcccccgcccaauccgacguagcccuacuccgcuucguuaacccagacaccggccgcguccucuucgagugcaaacuccacaaauccggcuacguuaccgucgcacauacaggccaacacgaccucguaaucccacccaacgguuacuuccgcuucgacucauggguuaaccaauucuacacacucgcccccaugggaaacggcacaggccgucgccgcuaa

SEQ ID NO: 38304 - RNA, 1617 nt, Artificial Sequence
  derived and/or modified sequence opt11 from VP1__Norovirus_and/or_Norovirus-like__LC177653
augaaaauggccuccaacgacgcaaacccuuccgacggauccgcagcaaaccucguccccgaagucaacaacgaagugauggcacucgaacccgucgucggcgccgccaucgccgccccaguugccggccaacaaaacgucaucgaccccuggauccgaaauaauuucguacaagcccccggaggcgaguucaccguuuccccucguaacgcccccggcgaaauccuauggucagcaccccuaggccccgaucuuaaccccuaccucucccaccucgcccgaauguacaacggauacgccggcggauucgaaguucaagucauacucgccggcaacgccuucaccgccggcaaaauagucuuugccgccguacccccaaacuuccccaccgaaggccucucccccucacaagucaccauguucccccacauaaucgucgacguccgacaacuugaacccguccucaucccacucccagacguacgcaacaacuucuaccacuacaaccaauccaacgacuccaccaucaaacuaaucgccaugcucuacacaccacuucgcgccaacaacgcuggagaagacgucuuuacaguaucaugccgaguucucacccgccccucaccagacuuugacuucauauuccucguaccacccaccguagaaucccgcaccaagcccuucaccguccccauccucaccgucgaagaaaugaccaacucccgauucccgauuccccucgaaaaauuauucaccggcccaucaggcgcuuucaucguacagccccaaaacggcagaugcaccacagacggcguacuccuaggcaccacccaacucucccccguaaacauuugcaccuuccgaggcgacgucacccacauagccggaucacgcaacuacacgaugaaccucgccucccuaaacuggaacaacuacgauccuacagaagaaauuccagcgccccuaggaacacccgacuuugucggcaagauccaaggcguucucacccaaaccaccaagggugacggcucaacccgaggacacaaagccacaguauacaccggcucagcccccuucacacccaaacuuggcuccguccaauucucaacagacaccgaaaacgauuucgaagcccaccaaaacaccaaauucacacccguaggcgucauacaagauggaggcaccacacaccgcaacgaaccgcaacaauggguccucccauccuacucaggccgugauguccacaacgugcaccuugcccccgccguagcccccaccuuccccggcgaacaacuccucuucuuccgcuccacuaugcccggcugcuccggcuaccccaacauggaccucgacugccuccucccacaagaguggguucaacauuucuaccaagaagcagccccagcacaauccgacgucgcccuccucagauucgucaaucccgacacaggccgcguccuauucgaaugcaaacuccacaaaucuggcuacgucaccgucgcucacacaggacaacacgaucucgucauucccccuaacggauacuuccgcuuugacucaugggucaaccaauucuacaccuuagcucccaugggcaacggcaccggccgacgucgauga

SEQ ID NO: 38305 - RNA, 1617 nt, Artificial Sequence
  derived and/or modified sequence opt11 from VP1__Norovirus_and/or_Norovirus-like__AB972486
augaaaauggccuccaacgacgccaacccauccgacgguuccgccgccaaccuaguacccgaagucaacaacgaaguaauggcacucgaacccgucguuggcgccgccaucgcagccccagucgcaggucaacaaaacgucauugacccauggauccgaaacaacuucguacaggcccccggaggcgaguucaccguuucuccccgaaacgcccccggcgaaauccucugguccgcgccccucgggcccgaccucaaccccuaccucucccaccucgcucgaauguacaacggcuacgccggaggcuuugaaguccaggucauucuagcaggaaacgcauucaccgcaggaaaaaucaucuucgcagccguaccacccaacuuucccacagaaggccuuucacccucccaaguaacaauguuuccccacaucaucguagacguccgccaacucgaacccguccucaucccccuaccagacgucagaaauaacuucuaccauuacaaccaauccaacgacuccaccaucaaacuaaucgccaugcucuacaccccacuucgugccaacaacgccggagaagaugucuucacagucucaugccgcguccucacacgccccucccccgauuucgacuucaucuuccucgucccaccgaccguagaaucccguacaaagccauucacgguaccuauacuaacagucgaagaaaugaccaacucacgcuuccccaucccacuagaaaaacucuucaccggccccuccuccgccuucguuguccaaccccaaaacgggcgaugcaccacagacggcguacuucuaggaacaacccaacucagccccgucaacauaugcaccuuucguggcgacgucacgcacauugcaggaucccgaaacuacacuaugaaucucgccucacuaaacuggaauaacuacgacccaacagaagaaauaccagcaccccuaggcacccccgacuucgucggaaaaauccaaggcaugcuaacacaaaccaccaaaggcgacggcuccaccagaggccacaaagcaaccgucuacaccggcuccgccccauucacacccaaauuagguuccguacaauucgccaccgacacagaaaacgacuucgaaacccaccaaaacaccaaauucacaccuguaggagucauucaagacggcggcaccacccaccgcaacgaaccacaacaauggguccuaccuuccuacucaggccgaaacguacccaacguccaccuagcccccgccguagcccccaccuuccccggcgaacaacuccuuuucuuccgcagcaccaugccaggcuguuccggcuaccccaacauggaccuagacugccuacugccucaagaauggguacaacacuucuaccaagaagcagcccccgcucaauccgacguagcccuccugcgcuucgucaaccccgauacagggcgcguacuauucgaaugcaaacuacauaaaucaggcuauguaaccgucgcccacacuggacaacacgaccucgucaucccacccaacggcuauuuccguuucgacagcugggucaaucaauucuauacccucgcccccaugggcaacggaacaggucgcaggcgauaa

SEQ ID NO: 38306 - RNA, 1617 nt, Artificial Sequence
  derived and/or modified sequence opt11 from VP1__Norovirus_and/or_Norovirus-like__KR904235
augaaaauggccucauccgacgcaaacccaucugauggaucaaccgcuaaccuggucccagaagucaauaacgaagucauggcccucgaaccagucguaggcgcagccaucgccgcacccgucgccggacaacaaaacgucaucgaccccuggauacgaaacaacuucguccaagcacccgguggcgaguucacagucucaccccgaaacgcacccggagaaauccucugguccacccccuuaggucccgaucuuaacccauaccuuucccaucucgcccgcauguacaacggauacgccggcggcuucgaaguccaagucauacuggccggcaacgccuucacugcaggcaaaaucaucuucgccgccguaccacccaauuuccccaccgaaggucucucucccucccaagucacaauguucccccacauuauaguagaugugcgacaacucgaaccuguccucaucccacucccagacguacgcaauaacuucuaccacuacaaccaauccaacgaccccacaaucaaacuaaucgccaugcuauacaccccacuacgagcgaacaacgccggcgacgacgucuucaccguaucgugccgcguacucacccgcccgucccccgacuucgacuucaucuuccucguaccacccacuguugaaucccgaaccaaacccuucuccgucccuguccucaccguugaagaaaugaccaacucaagauucccaaucccccucgaaaaacucuucaccgggcccuccucagccuucgucguccaaccccaaaacggccgcugcaccaccgacggcguccuacugggcaccacacagcuaucgccagucaacaucugcaccuuccguggagacgucacgcacaucuccggcucccgcaacuacaccaugaaccucgcuucccaaaacuggaacuccuaugaccccaccgaagaaauccccgccccucucggcacucccgacuucguaggaaaaauccaaggcguccuaacacagaccacccgcacagauggcuccacacguggccacaaagccaccgucuacaccggcagcgccgacuucucucccaaacucggacgcguccaauucgccaccgacaccgacaacgacuucgaaaccaaccaaaacaccaaauucacacccgucggcgucauccaagacggcucaacuacccacagaaacgaaccccaacaauggguccugcccagcuauuccggccgaaauacccacaacguccaccuagcacccgccguagccccaaccuuccccggagagcaacuccuuuucuuccgauccaccaugcccggcugcagcggcuaccccaacauggaccucgauugccuacucccccaagaauggguccaauacuucuaccaagaagccgcucccgcccaauccgacgucgcacugcuccgcuucguaaacccagacaccggccgaguccuauucgaaugcaaacuccacaaauccggguacguaacugucgcccacaccggccaacacgaccucgucauaccacccaauggcuacuuccgcuucgacuccugggucaaccaauucuacacccuagcccccaugggaaacggcacaggccgccguagauag

SEQ ID NO: 38307 - RNA, 1617 nt, Artificial Sequence
  derived and/or modified sequence opt11 from VP1__Norovirus_and/or_Norovirus-like__AB933753
augaaaauggcauccuccgacgcaaaccccuccgacggcucaaccgcaaaccucguccccgaagucaacaacgaaguuauggcacucgaacccgucgucggcgccgccauugccgcaccagucgccggccaacaaaacgucaucgacccuuggauccgaaacaacuucguccaagcaccaggcggugaguucaccgucagccccagaaacgcaccuggcgaaauacuaugguccgcuccccucgggcccgaccuuaauccuuaucucucccaccuugccagaauguacaacggcuacgccggcggcuucgaaguacaagucauccuagcaggcaacgcauucaccgcugggaaaauaaucuucgcugccgucccucccaacuuccccacugaaggccucuccccaucacaagucaccauguucccucacaucaucgucgacguccgccaacucgaacccguccuuaucccccuccccgacguccgcaauaacuuuuaccacuacaaccaaagcaacgacccaaccaucaaacucaucgccaugcuauacaccccacuacgcgccaauaaugcaggcgacgacgucuucaccguaucaugcagaguacuaacacgccccucccccgacuucgacuucaucuuccuaguaccacccacugucgaaucccgcacuaaacccuucucaguccccauccuuacaguugaagaaaugacgaacucaagguuccccaucccccucgaaaaacucuucaccggccccuccucaaccuucgucguccaaccccaaaacggccgcugcaccacagacgguguccuccucggcacaacccaauuaucccccgucaacaucugcaccuuccgaggcgaugucacacacaucgccggcucacgcaauuacacaaugaaccucgccucccaaaacuggaacuccuacgacccaaccgaagaaaucccagcaccccucggcacaccagacuucgucggcaagauccaaggaguacucacccaaaccacgcgcaccgacggcuccacccgaggccacaaagccacagucuacaccggcuccgcagacuucagcccuaaacucggacguguacaauucgccacagacaccgacaacgacuucgacgccaaccaaaacaccaaauucacaccugucggggucauccaagacggaggcaccgcucaccgcaacgaaccccaacaguggguccuccccagcuacucuggccgaaacacccacaacguccaccuugcccccgccgucgcccccaccuuucccggggaacaacuccucuucuuccgcuccaccaugcccggcugcuccggauaccccaacauggaccucgacugccuccuuccccaagaauggguccaauacuucuaccaagaagcagcccccgcacaaucagacgucgcuuuacuaagauucguuaaucccgacaccggccgcguucuuuucgaauguaaacuacacaaauccggcuacgucacagucgcacacaccggacaacaugacuuagucaucccucccaacggauacuuccgcuucgauuccugggucaaccaauucuacacccuagccccaaugggcaauggcacaggccgacgacgcuga

SEQ ID NO: 38308 - RNA, 1617 nt, Artificial Sequence
  derived and/or modified sequence opt11 from VP1__Norovirus_and/or_Norovirus-like__AB933721
augaagauggccagcaacgaugccaaucccuccgacggcucugccgccaaccucguccccgaaguuaacaacgaagucauggcacuagaacccgucguaggcgccgccaucgccgccccugucgcaggccaacaaaacgucaucgaccccuggauccgcaacaacuucguacaagcaccuggcggggaauuuacagucagcccccguaacgcccccggugaaauccucuggucugcaccccuaggcccagaccucaaccccuaccucucccaccucgccagaauguacaacggcuacgccggcggcuucgaaguacaaguaauccucgccggcaacgccuucaccgccggcaaaaucaucuucgccgccguuccacccaacuuccccacagaaggccucucccccucacaggucacaauguucccacacauaauagucgacguacgccaacucgaacccguccuaaucccccuccccgacguacggaacaacuucuaccauuacaaccaaagcaaugacucaaccaucaaacuaaucgccaugcucuacaccccacugcgggccaacaacgccggggaagacgucuucaccgucuccugccguguacucacccgaccuagcccugacuucgacuucauauuccucgugcccccaaccgucgaaucccgcaccaaaccauucacaguccccguccucaccguagaagaaaugacaaacucacgcuucccuaucccucuagaaaagcuauucaccggccccuccucagccuucgucguacaaccccaaaacggaagaugcaccaccgacggaguccuucucggaaccacccaacucucccccguaaacaucugcacauuccgcggcgacguaacccacaucgcaggcucucgaaacuacaccaugaaccucgccucccucaacuggaacaauuacgacccaacagaagaaaucccagccccacucggcacccccgacuucguagggaaaauccaaggaaugcucacccagaccacuaaaggcgacggcucaacccgcggccacaaagcaacaguauacaccggaucagcccccuucacuccuaaacucggauccguacaauucucaacagacaccgaaaacgacuucgaaacccaccaaaacaccaaauucaccccagucggcgucauccaagacggcucaacaacccaccgcaacgaaccacaacaauggguccuacccuccuacagcgggagaaauguccccaacguacaccuggcucccgccgucgcacccacuuuccccggugaacaacuccuauucuuccgauccacaaugcccgguugcucaggcuaucccaacauggaccucgacugccugcuaccacaagaaugggugcagcacuucuaccaagaagcagcacccgcccaaucagacguagcccuccuacgcuucgucaacccagacaccggcagaguccucuucgaaugcaaacuucacaaguccggcuacgucacagucgcccacaccggacaacacgaccucguaauaccaccaaacggcuacuuccgcuucgacucaugggucaaccaguucuacacacucgcccccauggguaacggaaccggcagacguagauaa

SEQ ID NO: 38309 - RNA, 1617 nt, Artificial Sequence
  derived and/or modified sequence opt11 from VP1__Norovirus_and/or_Norovirus-like__AB933706
augaaaauggccuccaacgaugcaaauccuucggacggcucugccgccaaccucguccccgaagucaauaaugaagucauggcccucgaaccagucgucggcgccgccauagcagcccccgucgccggccaacaaaacgucaucgacccauggauccgcaacaacuucguccaagcacccggaggcgaguucacagucucccccagaaacgcgccaggagaaauccucuggucagccccacucggccccgaccuaaaccccuaccucagccaccucgcccgcauguauaacgguuaugcaggcggcuucgaaguccaagucauccucgcaggcaacgcauucaccgcaggcaaaauaaucuucgccgccguucccccgaacuucccaacugaaggccucucgccaucccaagucacgauguucccacacaucaucgucgacguccggcaauuagaacccguccuaauaccccucccggacguacgcaacaacuucuaccacuacaaccaaucaaacgacuccaccaucaaacuuauagccaugcuuuacacgccccuccgagccaacaacgccggagaagacgucuucaccgucuccugccgcguacucacacgacccucccccgacuucgauuucaucuuccuaguacccccaaccgucgaaucccgcacaaaaccuuucaccguaccuauccucaccguagaagaaaugaccaauucgcgauuccccaucccacuugaaaaacucuucacaggacccuccucugccuucgucguccaaccacaaaacggucgcugcaccaccgacggccuccuacucggcaccacccaacucucacccguaaauaucugcacauucagaggugacguaacccacauugccggcucuagaaacuacacuaugaaucuagccucccucaacuggaacaacuacgaucccaccgaagaaauccccgcaccauuaggcaccccugacuucgucggcaaaauccagggcaugcucacccaaacaaccaagggugauggauccacccgaggccacaaagccaccgucuauaccggcuccgcaccuuucacgcccaaacucggcuccguucaauucucaaccgacacagagaacgacuucgaaacacaccaaaacaccaaauucaccccagucggcgucauccaagacggcucaacaacacaccgaaacgagccucaacaauggguacuccccuccuacuccggccgcaacgucccaaauguccaccucgcacccgccgucgccccaacguucccgggcgaacaacuccucuucuuccgauccaccaugcccggcugcucaggguacccuaacauggaccucgacugccuccuaccccaagaauggguccaacacuucuaccaagaagccgcccccgcccaaucggaugucgcccuucuacgcuucgucaaccccgacaccggacgcguccucuucgaaugcaaacuacacaaauccggauaugucacaguagcccacaccggccaacacgaucuagucaucccucccaacggcuacuuccgauucgacuccugggucaaccaauucuacacccuagcuccaaugggaaauggcaccggccgccgacgauaa

SEQ ID NO: 38310 - RNA, 1617 nt, Artificial Sequence
  derived and/or modified sequence opt11 from VP1__Norovirus_and/or_Norovirus-like__AB933669
augaaaauggccucuaaugacgcuaccgccuccgacggcuccgccgcuaaccucguacccgaaguaaacaacgaggucauggcacucgaacccgucgucggcgccgcaaucgcagcacccgucgccggacaacagaacgucauagauccauggauccgcaacaacuucgugcaagccccuggcggcgaguucaccgucuccccacgcaacgccccuggcgaaauccucugguccgcaccccuaggaccagaccucaacccauaccuuucccaccucgcacgcauguacaacggcuacgccggcggcuuugaaguccaagucauccuagccggcaacgcauucaccgcaggcaaaaucauuuucgccgcaguacccccaaacuuccccauugaaggacucucacccagccaagucacuauguucccucacaucaucgucgacguccgccaacucgaacccguccucaucccccucccagauguacgcaacaacuucuaccacuacaaccaaagcaacgacuccaccauuaaacucauagcaaugcuuuacacuccccuacgugcuaacaacgccggcgaagacgucuucaccguuucuugccgaguacuaacccgcccuucacccgacuucgacuucauauuccucguaccaccaacugucgaaagccgaaccaagccuuucaccguacccauacucaccgucgaagaaaugacuaacucccgcuuccccaucccccuggaaaaacuauucaccggccccucuucagccuucgucguccaaccccaaaacggccgcugcaccaccgacggaguacuacucggcaccacccagcuaucacccgucaacauaugcaccuuccgaggagacgucacccacaucgccgguucccgcaacuacaccaugaaccucgccucacucaauuggaacaacuacgaccccaccgaagaaaucccugcuccccuaggaacaccagacuucgucggcaaaauacaaggcguucucacgcaaacaacaaaaggcgacggaucaaccagaggccacaaagccaccguuuacaccggcuccgcacccuuuacacccaaacucgguuccguccaauucucaacggauacagaaaacgacuucgaaacccaccaaaacaccaaauucacaccaguuggcgucauacaagacggugguaccacccaccgaaacgaaccacaacaauggguccuaccaagcuauagcggacgaaacguuccaaacguccaccucgcccccgcagucgcacccacauuucccggagagcaacuacuauucuuccgcucuaccaugccaggcugcucuggcuacccaaacauggaccucgacugccuccucccccaagaauggguccaacacuucuaucaagaagcugccccagcacaaucagacgucgcccuccuccgauucgucaacccagacaccggccgcguccucuucgaaugcaaacuccacaaaucaggauacgucacagucgcccacaccggccaacacgaccucguaaucccacccaacggcuacuuucgcuucgacuccuggguaaaccaauucuacacccucgccccaaugggaaacggcacaggacgacgacgcuga

SEQ ID NO: 38311 - RNA, 1617 nt, Artificial Sequence
  derived and/or modified sequence opt11 from VP1__Norovirus_and/or_Norovirus-like__EU921350
augaaaauggcuuccuccgacgccaacccuuccgacggcucaaccgccaaccuagucccagaagucaacaaugaagucauggcucucgaaccaguugucggugccgcaaucgccgccccggucgcuggucaacaaaacgucaucgaucccuggauccgcaacaacuucguacaagcacccggcggugaguucaccgucucaccccgcaaugccccaggcgaaauccucugguccgcaccccucggccccgaccucaacccauaccuuucccaccuagcccgaauguacaacggauaugccggcggcuucgaaguccaagucauacuugccggcaacgccuucaccgccggaaaaauaauauuugccgccgucccuccgaacuuccccaccgaaggucucuccccuucgcaagucacaauguucccccacaucauagucgacguacggcaacuagaacccguucuaaucccccuaccugacguacgaaacaacuucuaccacuacaaccaauccaacgaccccacaaucaaacuaaucgcaaugcucuauacuccccuacgagccaacaacgcuggcgacgacgucuucacagucucaugucgcguccucacccgcccauccccagauuuugacuuuaucuuccucgucccgcccaccguagaaucccgcaccaaaccuuuuuccguccccauccuaacugucgaagaaaugacaaauucacgcuuccccaucccccuagaaaaacucuucacuggccccuccuccgccuucgucgugcaaccacaaaacggccguugcaccaccgacggcguccuccugggcacuacccaacucucaccagucaacaucugcacauuucgcggcgacgucacacacaucgccggcacacaagaauacacaaugaaccucgccucccaaaacuggaacaacuacgacccaaccgaagaaauaccugcaccccuaggaaccccagacuucguaggcaagauccaaggcguacucacccaaacaacacgccgagacggcuccacccgcggccacaaagccacaguaucaaccggcuccguacacuucacccccaagcuaggccgcauucaauucucaaccgacacauccaacgacuucgaaacaggucaaaacacucgcuucacccccguuggcguaguccaagacggauccaccacccaccaaaacgaaccccaacaaugggcgcuccccgacuacucaggacgcgacagccacaacguacaccucgcaccggccgucgcccccagcuuucccggcgaacaacuacuauucuuccgcuccacuaugcccggcugcuccggcuacccaaacaugaaccuagacugucuccucccccaagaauggguacaacacuucuaccaagaagccgcacccgcccaaucugacgucgcacuccuucgcuucgucaaccccgacaccggcagaguccuauuugaaugcaaacuacacaaauccggauacgucacggucgcccacaccggccaacacgaccucguaaucccacccaacggauacuuccgcuucgacuccuggguaaaccaauucuacacacuugcacccaugggcaacgggaccggccgccgccgauag

SEQ ID NO: 38312 - RNA, 1617 nt, Artificial Sequence
  derived and/or modified sequence opt11 from VP1__Norovirus_and/or_Norovirus-like__LC005712
augaaaauggcaucuaacgacgcaaaccccucagacggauccgccgccaaccuugucccugaaguaaacaacgaggucauggcccuagaaccugucgucggcgcugcaauagcagccccagucgcaggacaacaaaacguuaucgaucccuggauccgcaacaacuucguacaagcccccggcggcgaguucaccgucucaccccgaaacgcccccggagaaauccuaugguccgcuccccugggccccgaccuaaaccccuaccucucccaccucgcccgcauguacaacggcuacgccggcggcuucgaaguccaagucauccucgccggaaacgccuuuacugccggcaaaaucauauucgccgccgucccaccaaacuucccuacagaaggacucucccccucccaagucacuauguuuccacacaucauaguagacguacgacaacucgaacccguucuaaucccucuacccgacguacgaaacaacuucuaucacuacaaccaauccaacgacagcaccaucaaacuaaucgcaaugcuauacacaccccuccgcgcaaacaacgccggagaagacgucuucaccgucuccugccgcguccuaacccgaccauccccugacuucgauuuuaucuuccucgucccucccaccgucgaaagccgaaccaaaccauucacaguacccauacucaccguagaagaaaugacaaacucacguuucccaaucccccuagaaaaacucuucaccggccccuccuccgcuuucguuguccaaccacaaaacggccgcugcaccaccgacggaguacuucucggcaccacccaacucuccccagucaacaucugcacauuccgcggcgaugucacccacaucgccggaucacgaaacuauacaaugaaccucgccucucucaacuggaacaauuacgaccccaccgaagaaauaccagcaccccucgggacaccagacuucgucggaaaaauccaaggagucuuaacccaaacuaccaaaggagacggcucaacccgaggccacaaagccaccaucuacacaggcuccgcacccuucacaccaaaacucggaucaguacaguucuccaccgacaccgaaaacgacuucgaaacccaucaaaacaccaaauucacacccgucggaguuauacaagacggaggcacaacccaccgaaaugaaccccaacaauggguacuccccucauacuccggaagagacguccccaauguacaccucgccccagcagucgcaccaaccuuccccggcgaacaacuccucuucuuccgcagcaccaugcccggcugcuccggcuaccccaacauggaccucgacugccuccucccccaagaauggguccaacacuucuaucaagaggccgcccccgcacaaucugacgucgcacuccuccgauucgucaaccccgacacaggccgaguucuauucgaaugcaaacuccacaaauccggcuaugucaccguagcacacaccggacaacacgaccucguaaucccacccaacggcuacuuucgcuuugacagcugggucaaucaauuuuacacgcucgcccccaugggaaacggcaccggacgacgcagauga

SEQ ID NO: 38313 - RNA, 1617 nt, Artificial Sequence
  derived and/or modified sequence opt11 from VP1__Norovirus_and/or_Norovirus-like__LC018707
augaagauggccucaucggaugccaaccccagcgacggcuccgccgccaaccucguaccggaaguaaacaacgaagucauggcccucgaacccgucgucggcgccgccauagccgcucccgucgccggccaacaaaacguaauagaccccuggauccgaaacaauuuuguacaagccccaggcggcgaauuuacagucagcccccgcaacgcucccggcgaaauccuuuggagcgcaccccucggcccagaccucaaccccuaccucucccaccucgccagaauguacaacggauacgccgguggcuucgaaguccaagucauccucgcaggcaaugcauucacagcuggcaaagucauauucgcagccguacccccaaacuuccccacggaaggccuauccccaucacaaguaacaauguucccccacaucguugucgacguccgccaacucgaaccuguucuuaucccccuccccgacguacgcaacaacuucuaccacuacaaccaaucuaacgauccaaccauaaaacugaucgcuaugcucuacacuccacuacgcgccaacaaugccggcgacgacgucuucacggucucaugccgcguccuaacccgcccaagccccgacuucgacuucaucuuccucgucccacccaccgucgaaucccgcaccaaacccuucucaguccccguccucaccgucgaagaaaugacaaacucccgauucccuaucccccucgaaaaacucuucacuggccccuccucugccuucgucguacagccucaaaacggacgcugcaccacagacggcguccuccucgguaccacccaacuuucccccgucaacaucugcacauuccgaggcgacgucacacacaucaccggaucacgcaacuacaccaugaaccucgcaucucaaaacuggaacaacuacgacccgaccgaagaaauacccgcaccccuaggcacaccugacuucguaggaaaaauccaagguguccuuacucaaaccacccgcaccgacggcucaacacggggccacaaggccaccgucuacaccggaagcgcaaacuucagcccaaaacucggacgcguacaguucgaaacagacaccgaccacgauuucgaaguuaaccaaaacaccaaauucaccccagucggcguuauccaagacggaucaaccacccaccgaaacgaaccccaacaauggguccuccccuccuacuccggacgaaacacaccgaauguccaccucgcccccgccguagcacccaccuucccaggcgaacaacuacucuucuuucgcucaacaaugcccggcugcuccggcuacccuaauauggaccuagacugccugcuaccucaagaauggguccaauauuucuaccaagaagccgcaccagcccaaucagacgucgcccuccugagauucguaaaucccgacaccggccgcguucucuucgaaugcaaacuccacaaaagcggcuacguuacagucgcacacaccggccagcacgaccuugucaucccacccaacggcuauuuccgauucgacuccugggucaaccaauucuacacacuagccccaaugggcaacggaacaggcagacgcagauag

SEQ ID NO: 38314 - RNA, 1617 nt, Artificial Sequence
  derived and/or modified sequence opt11 from VP1__Norovirus_and/or_Norovirus-like__KM982955
augaaaauggccuccucagacgcuacaccaagcgacggcuccgccgccaaucucguacccgaggucaacaacgaagucauggccuuagaacccguagucggcgccgccauagccgccccggucgcaggccaacaaaacgucaucgaccccuggauccgcaacaacuucguccaagccccaggcggagaguucaccgucucuccccgcaacgcccccggcgaaauccucugguccgccccacugggccccgaccuaaacccauaccucagccaccucgcccgcauguacaacggguaugccggaggcuucgaaguccaagucauacucgcaggcaacgccuucaccgcuggcaagguaauauucgccgccgucccaccgaacuuccccaccgaaggccuaucccccucacaagucaccauguucccacacaucgucguugacguccgacaacucgaacccguccucauaccucuuccagacguccgaaacaauuucuaccacuacaaucaaucgaacgaccccaccaucaaacucauagcaaugcucuacaccccacuacgcgccaacaacgccggugacgacguauucacaguaucuugccgaguccuuacacgccccucccccgacuuugauuucauauuccuagucccucccacagucgaaucccgcaccaaacccuucucugucccaguccucaccguugaggaaaugaccaacucccgcuuccccauaccucuagaaaagcucuuuaccggacccuccucagccuucguaguccaaccccaaaacggccgcugcacuacagacgguguccuccucggcaccacucaacuauccccaguaaacaucugcaccuuccgcggcgacgucacccacaucaccggcucccacaauuacacaaugaaccuagccagccaaaacuggaacaacuacgaccccacagaggaaauaccagcaccccucggcacccccgauuucgucgguaaaauacaaggcguccucacacaaacaacccgcaccgacggcucuacccgcggacauaaagccacagucuacaccggcuccgccgacuucgcccccaaacucggucgaguccaauucgaaaccgacaccaaccacgacuucgaagccaaccaaaacaccaaauucacacccgucggagucauacaagacggaucaacuacccaccgcaacgaaccacaacaauggguacuccccuccuacuccggucgcaacacucauaacguccaccuggcccccgccgucgcacccaccuucccaggagaacaacuccucuucuuccguuccaccaugcccgguugcucaggcuaccccaauauggaccuggacugucuccucccccaagaguggguccaauauuucuaccaagaggccgcacccgcacaauccgacgucgcccuacuacgguucgucaaccccgacaccggccgcguccucuuugagugcaaacuacacaaaucaggcuacgucacagucgcacacaccggacaacaugaccuaguaauaccacccaacggcuacuuucgauucgacuccugggucaaccaauucuacacucucgcccccauggguaacggcaccggacgccgacgcuaa

SEQ ID NO: 38315 - RNA, 1617 nt, Artificial Sequence
  derived and/or modified sequence opt11 from VP1__Norovirus_and/or_Norovirus-like__KM982949
augaaaauggccucaucagacgccaacccuucagacggaucagccgccaaccuaguaccagaagucaacaacgaaguuauggcacucgaacccguagucggcgccgcaauagcagcccccguggcgggccaacagaacgucauagacccauggauccgcaacaacuucgugcaagcacccggaggagaguucaccguaucaccccgcaacgcacccggcgaaauccucugguccgcaccccuuggcccagaccucaacccguaccucucccaccucgccagaauguacaacggauacgccggcggcuucgaaguccaagucauccucgccggcaacgccuucacagccggcaaaguuauauuugccgcuguacccccaaacuuccccacugaaggacucucccccucccaagucacaauguucccccauaucgucgucgacguacgccaacucgaacccguccuuaucccccucccagacguccgcaacaacuucuaccacuauaaccaaagcaacgaucccacaaucaagcucaucgcaaugcucuacaccccacuucgagcaaacaacgccggugacgacguauucaccgucucaugccgaguacucacccgcccaucaccagacuucgacuucaucuuccucguucccccuaccguagaauccagaaccaagcccuuuucaguaccaguacuuaccgucgaagaaaugacuaacucaagauucccaauuccccuagaaaaacucuucaccggccccucauccgcauucgucguucaaccccaaaauggccgaugcaccaccgacggcguccuccucggcaccacacaacucuccccagucaacaucugcaccuuccgaggcgacauaacccacauaacaggcagccgcaacuacaccaugaaccucgcaucccaaaacugguccaacuacgaccccacagaagagauccccgcaccccucgguacccccgacuucguuggaaaaauccaaggcguccucacccaaaccacccgcaccgacggaucaacccgcggccacaaagccacugucuacaccggcuccgcagacuucgcccccaaacuuggccgcguacaauucggaaccgacacugaucacgacuucgaagcaaaccaaaauaccaaauucacaccagucggcgucauccaggacgguuccaccacccaccgaaacgaaccacaacaauggguccuccccuccuacuccggacggaacacaccaaacguccaccucgcacccgccgucgcccccacuuucccuggagaacaacucuuauucuuccgcucaaccaugccugguugcucaggcuaccccaacauggaccuagacugccuccuaccucaagaguggguacaauacuucuaccaagaagccgccccugcccagucagacgucgcccuccuacgcuucgucaaccccgacaccggacgaguccuauucgaaugcaaacuccauaaauccggauacguuaccgucgcccacacaggccaacacgaccucgugauacccccuaacggcuacuuccgcuucgacuccugggucaaccaauucuacacccuagcucccaugggaaacggcacaggacgcagacgcuag

SEQ ID NO: 38316 - RNA, 1617 nt, Artificial Sequence
  derived and/or modified sequence opt11 from VP1__Norovirus_and/or_Norovirus-like__KM406485
augaaaauggcaucuaacgacgccaacccauccgacggaucggccgcaaaccucguccccgaaguaaacaacgaagucauggcccucgaacccguagucggcgccgccaucgcagcccccgucgccggccaacaaaacgucaucgaccccuggauccgaaacaacuucguacaagcaccgggcggcgaauuuacagucucgccccgcaacgccccaggcgaaauccugugguccgcaccccucggucccgaucucaauccauaucucucccaccucgcccgcauguacaauggcuacgccggcggcuucgaaguccaaguaauccucgcaggcaacgcauucaccgccggcaaagucauauucgcggcaguaccacccaacuuccccaccgaaggucuaucucccucacaaguaaccauguucccccacauagucgucgacguacgccaacucgaaccaguccuuauaccacuaccugacguccggaacaacuucuaccacuacaaccaaucuaacgaucccaccauaaaacucauagccaugcucuauacuccccuccgagccaauaacgccggcgacgaugucuucaccguauccugccgcguccuuaccaggcccucaccagacuuugacuucaucuuccuagucccacccaccguagaaucccgcacaaaacccuuuuccgucccaguccuuacaguagaagaaaugacgaacucccgcuuccccaucccccucgaaaaauuauuuaccggccccuccucagccuucgucguccaaccccaaaacggccgaugcacuaccgacggcguccuccucggcacgacccaacuaaguccgguaaacaucugcaccuuccgcggcgacgucacacacaucacuggcucacgcaacuacaccaugaaccucgccucccaaaacuggaacaacuacgauccaaccgaagagaucccagccccacuuggcacaccagacuucgucggcaagauccaaggcguccucacacaaaccacccgcaccgacggcagcacccgcggccacaaagccaccgucuauacaggauccgccgacuucgcccccaaacucggucgcguccaauucgaaaccgacacggaccacgauuucgaagccaaucaaaauaccaaauucacaccuguaggcguuauacaagacggcucaacuacccaccgcaacgaaccacaacaauggguccucccauccuacagcggaagaaacaccccaaacgugcaucuagccccagcuguugcccccaccuuucccggcgagcaacugcucuuuuuccgcagcacaaugcccggcugcucgggcuaccccaacauggaccuagacugccuacuaccccaagaauggguccaauacuucuaccaagaagccgcaccagcccaguccgacguagccuuacuucgguucgucaaccccgacaccggccgaguccuuuucgaaugcaaacuccacaaauccggcuacgucacagucgcccacacaggacaacacgaccuaguaaucccgcccaacggcuacuuccgauucgacucuugggucaaccaauucuacacccuagcccccaugggaaacggaacaggucgccgccgauaa

SEQ ID NO: 38317 - RNA, 1617 nt, Artificial Sequence
  derived and/or modified sequence opt11 from VP1__Norovirus_and/or_Norovirus-like__KM198574
augaaaauggccuccaacgacgccaaccccucugacggcuccgccgccaaccucguccccgaaguaagcaaugaagucauggcacuagaacccguugucggagccgcaaucgccgcccccguagcaggacaacaaaacgucaucgaccccuggauccgaaacaacuucguccaagccccaggaggcgaguucaccgucuccccucgcaacgcccccggcgaaauccucugguccgccccacuaggucccgaccuaaacccuuaccucucccaccucgcccgcauguacaacggauacgcaggcggcuucgaaguccaaguaauucuagcaggcaacgcauuuaccgccgguaaaauaaucuucgccgcagucccacccaacuuccccacagaaggccuaucacccucccaaguaacgauguucccccacauaaucguagacguccgacaacucgaacccguucucaucccccuaccagacgucagaaacaauuucuaccacuacaaccaaaccaacgacucaacaauaaaacucauagccaugcucuacacuccccuaagagccaacaacgcuggcgaagacgucuucaccguauccugccgaguccucacccgaccaucucccgacuucgacuucaucuuccucguuccaccaaccguugaauccagaacuaaaccauucacagucccaauacucaccguggaagaaaugacuaacagccgcuuucccaucccccucgaaaaacucuucaccggcccauccggcgccuucgucguccaaccccaaaacggccgauguaccaccgacggaguccuccucggcaccacacaacucucccccgucaacaucugcaccuuccgcggugacgucacccacaucgccggcucccgcgacuacacaaugaacuuagcuucccucaacuggaacaacuacgaccccaccgaagaaauccccgcaccauuaggaacccccgacuucgucggaaaaauccaaggcguccucacacagaccacaaaaggcgacgguuccacucgcggccacaaagccaccgucuacaccggcucagcucccuucacccccaaacucggcucaguccaauucuccacagacaccgaaaacgacuucgagacacaccaaaacaccaaauucacacccgucggcgucauucaagauggcggaaccacucaccgcaacgagccccagcaauggguacuaccuuccuacagcggaagagacguacacaacguacaccucgcacccgcaguugcccccaccuucccaggcgaacaacuccucuucuuucgcucuacaaugcccggaugcucugguuaccccaauauggaccuugacugccuccucccucaagaauggguccaacacuucuaccaggaggccgcucccgcacaaucugacgucgcacuccuccgcuucgucaaccccgacacaggccgaguccucuucgaaugcaaacuccacaaauccggauaugucaccguugcccacacaggacaacacgaccuugucauaccacccaacggcuacuuccgauucgacuccugggucaaccaauucuacacccuagcccccaugggcaacggcacaggccgacgccgcuaa

SEQ ID NO: 38318 - RNA, 1617 nt, Artificial Sequence
  derived and/or modified sequence opt11 from VP1__Norovirus_and/or_Norovirus-like__KM198517
augaaaauggcauccaacgaugccaaccccuccgacggcuccgccgccaaccuaguacccgaagucucaaacgaagucauggccuuagagcccgucgugggagcagccaucgccgcacccgucgccggccagcaaaacgucaucgaccccuggauccgcaacaacuucgugcaagcccccggcggugaguucacaguaucaccccgcaacgcuccaggagaaauacuaugguccgcaccccuaggcccagaccuaaaccccuaccuuucccaccuagcccgcauguacaacggcuacgcuggcggauucgaaguacaaguaauccucgcaggaaacgccuucaccgccggaaaaaucaucuucgccgccgucccgcccaauuuccccaccgagggccucucccccucccaagucaccauguucccccacaucaucgucgacguacgccaacucgaacccguacuaauuccacucccugacguccgcaacaacuucuaccacuacaaucaaaucaacgaucccaccaucaaacucaucgcaaugcuauauacaccccuacgcgccaacaacgccggcgaagacgucuucacaguaucaugccgcguccuuaccagacccucccccgacuucgacuucaucuuucucgucccuccuaccguagaaucucgcacaaaacccuucaccguacccauacucacagucgaagaaaugaccaacuccagauucccaaucccccucgagaaacuuuuuacuggacccuccggcgccuuuguaguccaaccacagaacggccgcuguaccaccgacggcguacuccucggcaccacacaacucucccccgucaauaucugcacuuuucgaggcgacgucacccacauagccggcucacgcaacuacacaaugaaucuagccucacucaacuggaacaacuacgacccgaccgaagaaauaccagcaccacucggcacccccgacuucguuggaaaaauccaaggcguacuaacacaaaccaccaagggcgauggcuccacuagaggccacaaagccaccgucuacaccggcuccgcacccuuuacaccaaaacuuggcuccguccaauucucaaccgacacagaaaacgacuucgaaacccaccaaaacaccaaauucacgccggucggcgucauccaagacggcucaaccacccaccgcaacgaaccucaacaauggguccuccccagcuacagcggccgcgacauacacaacgugcaccuagcacccgcagucgccccaaccuucccaggagaacaacuucucuuuuuccgauccaccaugccaggaugcucaggcuaccccaacauggaccuugauugccuccucccacaagaauggguacaacacuucuaccaagaagcugcccccgcccagagcgacgucgcccuacuccgcuucgucaaccccgacacgggacgcguccuauuugaaugcaaacuccacaaauccggauacgucacagucgcccacaccggccaacacgaccucgucauaccacccaacggauacuuccgauucgacagcugggucaaccaauucuacacccucgcacccaugggcaacggcacaggccgacggagauaa

SEQ ID NO: 38319 - RNA, 1617 nt, Artificial Sequence
  derived and/or modified sequence opt11 from VP1__Norovirus_and/or_Norovirus-like__JX439839
augaaaauggcauccuccgacgcuaacccaagcgacggcuccgcagcaaaccucguucccgaaguuaacaacgaagucauggcccucgaacccguagucggcgccgccauugcggccccagucgccggccaacaaaacguaaucgacccauggauccguaacaacuuuguccaagcgccuggaggugaguucacagucuccccucgaaacgcacccggcgaaauccucugguccgcaccccucggccccgaccucaaccccuaccuaagccaccucgcccgaauguacaauggcuacgccggaggauuugaaguucaagucauucucgccggcaacgccuucaccgccggaaaaaucaucuucgcagccguaccacccaacuuccccacugaaggucucagcccaucccaagucaccauguucccccacaucaucgucgauguccgacaacuagaaccuguacucaucccccugcccgacguccgcaacaacuucuaccacuacaaccaauccaacgacuccacaaucaaacuuauagccauguuauacacgccccuccgcgccaacaacgccggcgaagacgucuucaccguuagcugucgaguccuaacacgccccuccccugacuuugacuucaucuuccucguaccgcccaccguagaaucaagaaccaaacccuucacagucccaauccuaaccguagaagaaaugaccaacucucgcuuccccaucccucucgaaaaacucuucacggguccauccucugccuucgucguccaaccccaaaacggccgcugcaccaccgacggaguccuacuagguacaacccaacuaucccccgucaacaucugcacauuccgcggugacgucacccacaucgcaggaucacacaacuacacaaugaaccuugccucacucaacuggaacaacuacgauccuaccgaagaaauccccgcaccccuagguacccccgacuucgucggaaaaauacaaggaguacucacccaaacaaccaaaggagacggcucaacccgcggccacaaagccacagucuacacaggcucagcaccauucacacccaaacucggcuccguccaauucuccaccgacaccgaaaacgacuucgaaacacaccaaaacaccaaauuuacacccgucggagucauacaggacggcggaaccacccaccgcaaugaaccgcaacaauggguccuacccagcuacucaggacgcaacgucccaaacguccaccuugccccagcaguagccccaaccuucccaggagaacaacuacuuuucuuucgauccacaaugccaggcugcucaggcuaccccaacauggaccucgacugccuccucccccaagaauggguacaacacuucuaucaagaagccgcccccgcccaauccgacguggcccuccuacguuuugucaaccccgacaccggcagaguccucuucgaaugcaagcuccacaaauccggguacgucaccgucgcacacaccggacaacacgaccuagucauuccuccaaacggauacuuccgauucgacuccugggucaaccaauucuacacccucgcccccaugggcaacggcacaggacggagacgauga

SEQ ID NO: 38320 - RNA, 1617 nt, Artificial Sequence
  derived and/or modified sequence opt11 from VP1__Norovirus_and/or_Norovirus-like__JX439837
augaaaauggcguccaaugacgcuaaccccuccgacggcuccacagccaaccucgucccagaaguaaacaacgaaguaauggcgcuagaaccaguagucggcgcugccauugcugccccagucgcuggucaacaaaacgucauagaccccuggauucgcaacaacuucguccaagcaccaggcggcgaguucacagucucccccagaaacgcccccggagaaauacucuggucugcaccccuaggccccgaccucaaccccuaccucucacaccucgcccgcauguacaacggcuacgccggcggcuuugaaguccaaguaauccucgccggaaacgccuucaccgccggaaagaucaucuucgccgccgucccacccaauuuccccacugaaggccucucacccucacaagucaccauguuuccccacaucaucguugacguucgacaacuugaacccguccuuauuccccuucccgacguccgcaacaacuucuaccacuacaaccaauccaacgacucaaccauaaaacucaucgccaugcucuacacaccccuacgcgccaacaacgccggcgaagaugucuucaccgucuccugccgcgucuuaacccgccccuccccagacuucgacuucaucuuccucguucccccaacuguugaaucccggaccaaaccauucaccguccccauccucaccgucgaagaaaugaccaacucgcgauucccgaucccccucgaaaaacucuucacaggcccaucauccgccuucgucguccagccacaaaacggccgcugcaccaccgacggaguccuccucgguaccacccaacucagcccagucaacaucuguaccuuccgaggugacguuacccacaucgcaggcucacgcaacuacaccaugaaccucgccucauuaaacuggaacaacuacgacccuaccgaagaaauucccgcaccccucggcacacccgacuucgucggcaaaauacagggcguacuaacccaaaccacuaaaggcgacggcuccacccgcggacacaaggcaaccguauauaccggcagcgcccccuucacccccaaacuuggcuccguccaguucucaaccgacaccgaaaacgacuucgaaacacaccaaaacaccaaauucacccccgucggagugauccaagacgguggcacaacacacaggaacgaaccacaacaauggguacucccuagcuacuccggccgcaacguccaaaacgugcaccucgccccagccgucgcccccaccuuccccggagaacaauuacuauucuuucgcaguaccaugcccggcugcucgggcuauccgaacauggaccucgauugucuccuaccucaagaauggguucaacacuuuuaccaggaagccgcaccagcccaaucagacguagcacuccuacgcuucgucaaccccgacacaggccggguccucuucgaaugcaaacuacacaaaucaggauaugucaccgucgcucacaccggacaacacgaccucgucaucccacccaacggcuacuuccgcuucgauucgugggucaaccaauucuacacacuggcuccaaugggcaacggcaccggccgccgucgcuaa

SEQ ID NO: 38321 - RNA, 1617 nt, Artificial Sequence
  derived and/or modified sequence opt11 from VP1__Norovirus_and/or_Norovirus-like__KC631815
augaaaauggccuccagcgacgcuaaccccuccgauggcuccaccgccaaccucguccccgaagucaacaacgaagucauggcucuagagccagucguaggcgcagccaucgccgcgccggucgcaggccaacagaacgucaucgaucccuggauccgcaacaacuucguccaggcccccggcggcgaguucaccgucucaccacgcaacgcaccaggagaaauccucuggucagccccucuaggccccgaccucaauccauaucuaucucaccucgcccgcauguacaacucauacgcaggagguuucgaaguacaagucauucucgcagguaacgccuucaccgccggcaaaauaaucuucgccgcuguucccccgaacuuuccaaccgaaggccuuucaccaucucaagucacaauguuuccccacauaaucgucgacguccgccaacucgaaccaguccuaauaccacuccccgacguccgcaacaacuucuaccauuacaaccaaucaaacgaucccaccaucaaacuaaucgcaaugcucuacacuccccuccgcgcaaacaacgccggcgacgacgucuucaccguguccugccgcgucuuaacccgccccucacccgacuucgauuucauauuccuugucccacccaccguagaaucacgaaccaaacccuucucaguacccauccucaccguagaagaaaugaccaacagccgcuuccccaucccuuuagaaaaacucuucacaggucccucauccgccuucgucguacagccccaaaacggccgcugcacaaccgacggcguacuacucggcaccacccaauugucgccaguaaacaucugcaccuuccgcggagacgucacacacauagccggcacccaagaauacaccaugaauuuagcaucccagaacuggaauaacuacgacccaaccgaagaaauccccgcaccccuagguaccccagacuucgucgguaaaauacaagguguccucacccaaacuacccgccgagacggcuccacacgcggccacaaagccacagucuccacagguucuguucacuucaccccaaaacucggccgaauccaauucagcacagacaccuccaacgacuucgaaaccggccaaaacacacgauucacccccgucggcguuguccaagacggcucaaccacccaccaaaacgaaccccaacaauggguccuacccaacuacuccggccgcgacucccacaacguucaccuugccccugccgucgcuccaucauuccccggagaacaacuccuauucuuccgcuccaccaugcccggauguuccggcuaccccaacaugaaccuagacugccuccucccacaagaauggguccaacacuucuaccaagaagcggcaccagcccaauccgacguagcacuacuacgcuucguaaaccccgacacaggccguguccucuucgaaugcaaacuccauaaaucgggauacgucaccgucgcacacacaggacaacacgaucuggucauaccacccaacggcuacuuccgauuugacuccugggucaaccaauucuacacccuagcacccaugggcaacggcaccggucgccgacgauaa

SEQ ID NO: 38322 - RNA, 1617 nt, Artificial Sequence
  derived and/or modified sequence opt11 from VP1__Norovirus_and/or_Norovirus-like__KC409315
augaaaauggccuccaacgacgcaaaccccuccgacggcucagcagccaaccugguacccgaaguaucaaacgaagucauggcccucgagccuguagucggagcagccauagcagcccccgucgcaggccaacaaaacgucaucgaccccuggauucguaacaauuucguccaagcccccggaggggaguucaccguauccccacgcaacgccccaggagaaauacucuggucagccccucuagggcccgaccuuaacccguaccuaucccaucucgcccgcauguacaauggauacgccggcggcuuugaaguccaagucauccucgccggaaacgcauucacagccggcaaaauaaucuucgccgcaguaccacccaacuuccccaccgaaggccuaucccccagccaaguaaccauguucccccacaucauugucgacguccgacaacuagaacccguacuaauaccccuccccgacguccgcaacaacuucuaucauuacaaucagacaaacgacuccaccaucaaacucaucgccaugcuauacacuccccuccgcgccaauaacgcaggcgaagacgucuucaccgucucaugccgcguccucacacgccccucccccgacuucgacuucaucuuccucgucccacccacaguagaaucccgcacuaaacccuucaccgucccuauccucaccgucgaagaaaugaccaacucaagauuucccaucccacucgaaaaacucuucaccgggcccuccggcgcauucguuguccaaccccaaaacggacgcugcacaaccgacggcguccuacucggcaccacccaacucucccccgucaacaucugcacauuucguggagacgucacccacauagcuggcucacgcaacuacaccaugaaccucgccucucucaacuggaacaacuacgaccccacugaagaaaucccugccccucucggcacacccgacuucgucggcaagauccaaggcguccuaacacaaacaacuaaaggcgacgguucgacccgcggccacaaagccaccguauacacuggcucagcaccauucacccccaagcucggcagcguccaauucuccacagacaccgaagacgacuucgaaacacaccaaaacaccaaauucacccccgucggagucauccaagacggcggcacuacucaucgcaacgaaccccaacaauggguacucccaucauauuccggccgagacguccacaacguccaccucgcacccgccguagcaccuacauucccaggggaacaacuccucuucuuccgauccacaaugcccggcugcuccggauaccccaacauggaccuagacugccuccucccccaagaauggguccagcacuucuaccaagaagccgcccccgcucaaucagacgucgcacuacucagauucguaaacccugacaccggccgcguacucuucgaaugcaaacuacacaaaucaggcuacgucaccgucgcccacacuggccaacacgaucuaguaauaccaccaaacggcuacuuccgcuucgacuccugggucaaccaauucuauacucuagcccccaugggaaacggcacuggccgacgacgguaa

SEQ ID NO: 38323 - RNA, 1617 nt, Artificial Sequence
  derived and/or modified sequence opt11 from VP1__Norovirus_and/or_Norovirus-like__KC409289
augaaaauggccuccaacgacgccaaucccuccgacggauccgcagcaaaccuaguccccgaagucucuaacgaaguuauggcccuagaacccgucgucggugccgcaauagcugcacccgucgcaggccagcaaaacgucaucgaccccuggauccgaaauaacuucguacaagccccaggcggcgaguucacagucagcccccgaaacgcucccggcgaaauccugugguccgcgccccucggacccgaccuaaaccccuaccuaucccaccuagcccgcauguacaacggauacgccggcggcuuugaaguccaagucauccuagccggcaaugccuucaccgccggcaaaaucaucuucgccgcaguaccacccaacuuccccacagaaggacucucccccucacaagucaccauguucccccacauaaucgucgacguccgucaacuagaacccguucuuauaccacuuccagacguccgaaacaacuucuaucacuacaaccaaaccaaugaccccaccaucaaacucauagcaaugcuauauacaccccuucgugcaaacaacgccggugaagacgucuuuaccgucuccugccguguccuaacccgacccucccccgacuucgacuuuaucuuccuaguacccccaaccgucgaaucccgaaccaaacccuucaccgucccaauacucaccgucgaagaaaugaccaacucccgauuccccauaccccuagaaaaacucuucaccggacccuccggcgccuucgucguccaaccacagaacggucgcugcaccaccgacggcguccuccuuggcaccacccaacucucccccgucaacaucugcaccuuuagaggcgacgucacccacauugccggaucccgcaacuacacaaugaaccucgccucccuaaacuggaacaacuacgacccaaccgaagagguacccgccccgcuaggaacaccggacuucguaggcaaaauccaagguguccucacccaaaccaccaaaggcgauggcuccaccagaggacacaaagccaccgucuacacgggcagugcccccuucaccccaaaacuuggcuccguccaauucucaaccgacaccgagaaugauuucgaaacccaccaaaauaccaaguucaccccagucggaguaauccaagacggaggcaccacccaccgcaacgaaccccaacaauggguccuucccuccuacuccggccgagacguacacaacguucaccuugcccccgccguagccccgaccuuccccggcgaacaacuccucuucuuccgauccaccaugcccgguugcucuggauaccccaauauggaccucgacugccugcucccccaagaauggguccaacacuucuaucaagaagccgcuccagcccaauccgacgucgcccuccuccgcuucguuaacccggacaccggccguguccuauucgaaugcaaacuacauaaauccggcuacgucacagucgcucacacaggccaacacgaccuaguaaucccucccaaugguuacuuucgcuucgacuccugggucaaccaguucuauacucuagcccccaugggcaacgguacaggccgucgccgcuga

SEQ ID NO: 38324 - RNA, 1617 nt, Artificial Sequence
  derived and/or modified sequence opt11 from VP1__Norovirus_and/or_Norovirus-like__KC409278
augaaaauggccucuaacgacgcuaacccauccgacggcuccgccgcaaaucuaguccccgaagucaacaaugaagucauggcacuagaacccgucgucggggccgccaucgccgcccccguagccggccaacaaaacgucaucgaucccuggauccguaauaacuucguacaagcccccggcggcgaauuuaccgucagcccucgcaacgcacccggcgaaauccucugguccgcaccccucggccccgaccuuaaucccuaccucucccaucucgcccgaauguacaacggauacgccggaggcuucgaaguccaagucauccucgccggcaacgcauucacagccggcaaaaucaucuucgccgccgucccacccaacuuccccacagaaggucucucccccucucaagucaccauguucccccacaucaucguugacguccgccaacucgaacccguacucaucccccuacccgacguccgcaacaacuucuaccacuacaaccaauccaacgacucuaccaucaaacuaauagcaaugcuauacacuccccuucgcgcuaacaacgccggugaagacgucuucaccguaucaugccgaguacuaacccgccccuccccagacuucgacuucaucuucuuagucccacccacagucgaaucacgaacgaaacccuucaccgucccaauccucacaguagaagagaugaccaacucgagauuccccauccccuuagaaaaacucuucaccggaccauccggcgccuucguuguccaaccccaaaacggccgcugcaccacagacggcguucuccuuggcaccacacaacuaucccccgucaacauaugcaccuuccgcggcgauguuacacacaucgcaggcucccgcaacuacaccaugaaccuugccagccucaacuggaacaacuacgacccuacugaagaaaucccagcgccccucggaacccccgacuucguaggaaaaauccaaggcguccuuacccaaacaaccaaaggcgacggcuccacccgaggccacaaagccaccgucuacacaggguccgccccauucacaccaaaacucggcuccguacaauucucaaccgacacagaaaacgauuuugaggcgcaccaaaacaccaaguucacccccgucggagucauccaagauggaggcacgacacaccgaaacgaaccucaacagugggucuuacccucauacuccggacgcgacguacacaauguacaccucgccccagccgucgcccccaccuucccaggagaacaacuccuuuucuuccgguccaccaugcccggaugcuccggcuaccccaacauggaccucgacugucuucucccacaagaguggguacagcauuucuaccaagaagccgcacccgcccaguccgacgucgcccuccuacgcuucguaaaccccgacaccggccggguacucuucgaaugcaaacuacacaaauccggcuaugucacagucgcccacaccggccaacacgaccuuguaaucccaccaaacggcuacuuccgcuucgacagcuggguuaaucaauuuuacacacucgccccaaugggcaacggcaccggacgccgacguuag

SEQ ID NO: 38325 - RNA, 1617 nt, Artificial Sequence
  derived and/or modified sequence opt11 from VP1__Norovirus_and/or_Norovirus-like__KC175402
augaaaauggcauccuccgaugccaacccauccgacggcuccgccgccaaccuaguacccgaagucaacaacgaagucauggcccucgaacccgucguaggcgccgcaaucgcagcccccguagccggucaacaaaacgucauagacccuuggauccgcaacaacuucguccaagcccccggcggagaguucaccgucucgccacgaaacgcccccggagaaauccuauggagcgcaccccuaggccccgaccucaacccauaccucagccaccuugcccgcauguauaacgguuaugcaggaggcuucgaaguccaaguaauccucgccggcaacgccuucacagcaggcaaaauuauauucgccgcuguaccucccaauuuccccaccgaaggccucucccccucccaaguuaccauguucccccacauaauagucgacguccgacaacucgaacccguccucauuccccuacccgacguucgcaacaacuuuuaccacuacaaccaauccaacgacagcaccaucaaacucauagccaugcucuacacuccccuccgagccaacaacgcaggcgaagacguauucaccguauccugccgcguccucacccgucccucacccgacuucgacuucaucuuccucguaccacccaccgucgaaucuagaaccaaacccuucacaguccccauccucacaguagaagaaaugacaaacagccgauuccccauaccccucgaaaaacucuucacaggaccaucuucugccuucguaguccaaccccaaaacggccgcuguaccaccgacggcguacuacucggcacaacacaacucucccccgucaacaucugcaccuuccgcggagacgucacccacauagcaggcucuagaaacuauaccaugaaccucgccucccucaacuggaacaacuaugacccaacagaggaaauccccgcuccccucggcacccccgacuucguaggcaaaauccaaggcguccucacacaaaccaccaaaggagacggcuccacaagaggccacaaagcaaccgucuacaccggaucggcacccuuuacccccaaacuuggcucaguacaauucucuaccgacaccgaaaacgacuucgaaacccaccaaaacacaaaauucacccccguaggagugauacaggauggcuccaccacccaccgcaacgagccccaacaauggguccuucccuccuacuccggcagaaacguccccaacguccaccucgccccagccgucgcaccaaccuuccccggcgaacaacuccucuucuuccgcucaaccaugcccggcugcuccggauacccuaacauggaccucgacugccuccucccgcaagaguggguacaacacuucuaucaagaagccgcacccgcacaaucugacgucgcccuccuucgcuucguuaaccccgacaccggccgcguccuauucgaaugcaagcuccacaagucaggcuacgucacagucgcacacaccggccaacacgaccuagucaucccacccaauggauacuuccgcuucgacuccugggucaaccaauucuauacgcucgcgcccaugggcaacgguaccggccgucgucgcuaa

SEQ ID NO: 38326 - RNA, 1617 nt, Artificial Sequence
  derived and/or modified sequence opt11 from VP1__Norovirus_and/or_Norovirus-like__JX459616
augaaaauggccuccaaugacgccaaccccucagacggcucggccgcaaaccuagucccagaagucaacaaugagguaauggcauuagaacccgucguaggagccgccaucgccgcacccgucgccggccagcaaaacguaaucgaccccuggauccgaaacaauuucguacaagcccccggcggcgaauuuaccguaucuccccgaaacgccccuggagaaauccuauggagcgcgccccucggccccgaccucaaccccuaccucucacaccucgcccgcauguauaacggauaugccggaggauucgaaguccaagucauccucgccggaaacgccuucaccgccggaaagaucaucuucgccgccguaccacccaacuucccaaccgaaggacucucaccaucccaagucacuauguucccccacaucauagucgacguccgccaacuagaacccguucucaucccccuaccagacguccgaaacaacuucuaucacuacaaccaauccaacgacucaaccaucaaacuaaucgccaugcucuacacgccacuucgcgccaauaacgccggcgaagauguauucaccguuuccugcagaguacucacacgaccaucccccgacuucgacuuuauuuucuuagucccacccacagucgaaucacgcaccaaacccuucacaguccccauacuaacugucgaagaaaugaccaacucccgguucccaaucccccucgaaaaacuauucaccggccccucaggcgccuucgucguccaaccccaaaacggacgcugcaccacugacggcguccuccuaggcaccacccaacuauccccagucaacaucugcaccuucagaggcgauguuacccacaucgcaggaucccgcaauuacacaaugaaccuagccucccuaaacuggaacaacuaugacccaaccgaagaaaucccagcaccccuagguacacccgacuucgucggcaaaauacaggguguccucacacaaacuacuaaaggcgacggcuccacacgcggccacaaagcaaccgucuacacuggcagcgcacccuucacccccaaacuuggaagcguacaauucuccaccgauaccgaaaacgacuucgaaacccaccaaaauaccaaauucacccccgucgguguaauccaagaugggggcacgacccaucgaaacgaaccccaacaauggguccugcccuccuauucaggacgcaacguccauaacguccaccuugcucccgcagucgcccccaccuuccccggcgaacaacuccucuucuuucgauccaccaugcccggcugcuccggcuaccccaacauggaccucgacugccuucucccacaagaauggguccaacacuucuaccaagaagccgcaccagcacaaucugacgucgcccuacuaagauuugucaaccccgacaccggccgcguccucuucgaaugcaaacuccacaaauccggcuacgucaccgucgcccacaccggacaacacgaccuaguuauacccccaaacggauacuuccgcuucgauuccuggguuaaccaauucuacacccuugcacccaugggaaacggaacaggccgaagacgauaa

SEQ ID NO: 38327 - RNA, 1617 nt, Artificial Sequence
  derived and/or modified sequence opt11 from VP1__Norovirus_and/or_Norovirus-like__JX459599
augaaaauggcuuccaacgacgccacaccaucugacggcuccaccgcaaaccuaguccccgaagucaauaacgaagucauggcccucgaaccaguugugggagcagccaucgccgcccccgucgcuggccaacaaaaugucaucgacccuuggauccgcaacaacuucguccaagccccaggaggagaauuuaccgucagcccucgcaacgccccaggcgaaaucuuaugguccgcaccccucggcccagaccuuaaccccuaccuaucacaccuaucccgcauguauaacggcuaugccggcggcuucgaaguacaagucauccuagccggaaacgcuuucacugccgggaaaaucaucuucgcagcaguucccccaaacuucccaacggaaggccuguccccgucccaaguaacuauguucccucacauaauagucgacguacgccaacucgaaccaguccucauccccuuacccgacguccgcaacaauuucuaccacuacaaccaaucaaacgaucccacaauaaaacucaucgcaaugcucuacacaccccuccgcgccaacaacgccggagaugauguauucacaguauccugccgaguucucaccagaccaucacccgacuucgacuuuauauuccuagugcccccaaccgucgaaucaagaacaaaacccuuuuccguacccauucucaccguagaagaaaugaccaacucccgauuucccauuccacucgaaaaacucuucacaggacccucaucagccuuugucguccagccacaaaacggucgcugcaccaccgauggcguccuccucggcaccacccaacucucaccaguaaacauuuguacguuccgcgguaacguaacaaacaucgcagguucacaaaccuauaccaugaaccucgccucccaaaacuggaacaacuacgaccccaccgaagaaauccccgcaccccuaggcaccccagacuucgucggacgcauacaaggcguccucacccaaaccacaagaggcgacggcagcacacgcggccacaaagccacuguaucaaccggcagcgcauacuucacccccaaacucggcuccguacaauucuccacagacaccuccaccgacuucgaaaccggccaaaacacccgauuuacccccgucggcgucguacaagacggcuccacaacccacaaaaacgaaccccaacaauggguccuccccagcuacucuggcagagacagccacaacguacaucucgccccagccgucgccccaaccuuccccggcgaacaaauccucuucuuccgauccaccaugcccggcugcuccggauaccccaacauggaccuagacugccuacuuccccaggaauggguacaacacuucuaucaggaaagcgcacccgcccaauccgacguugcacuccuccgcuucguaaauccagacacuggcagaguucucuucgaaugcaaacuccacaaauccgguuacguaaccguugcccacaccggccaacacgaccucgucauacccccaaacggcuacuuccgcuucgauuccugggucaaccaauucuacacccuggccccaaugggcaauggcgcuggccgccgccgcuaa

SEQ ID NO: 38328 - RNA, 1617 nt, Artificial Sequence
  derived and/or modified sequence opt11 from VP1__Norovirus_and/or_Norovirus-like__JN400603
augaaaauggccucaaacgacgccaaccccucagacggcucugccgcaaaccucgucccagaagucaacaacgaagucauggcccuagaacccguuguaggcgcagccaucgcagcccccguagcaggccaacagaauguaaucgaccccuggauacgcaauaacuucguccaggcacccggcggcgaguucacugucucccccaggaacgcaccaggcgaaauccucugguccgcaccccucggaccagaccucaaccccuaccucucccaccucgcccgcauguacaacggcuacgccggcggauucgaaguucaaguaauccucgcaggcaacgcguuuaccgccggcaaaaucauauucgccgcagucccgccuaauuucccaaccgaaggccucuccccaagccaaguaacaauguucccccacauaauagucgacguccgccaacucgaaccgguccucauaccccucccagacguacgcaacaacuucuaccacuacaaccaauccaacgacuccaccaucaaacucaucgccaugcuauauacuccccuacgggcaaacaacgcaggcgaagacguauuuaccguaucaugccgcguccucacccgccccucccccgacuucgacuucaucuuccuuguacccccaaccgucgaaucccgaacaaaacccuucaccguccccauccuaacgguagaagaaaugaccaacucccgcuuccccauaccccucgaaaaacucuucacgggccccucaucagccuucgucgugcaaccccaaaacggccgcugcacuacagacggaguccuccucggaaccacccaacucucccccguaaacauaugcacauuccgcggcgacguuacacacauagccggaucccgaaacuacaccaugaaccuagccucacuaaacuggaacaacuacgacccaaccgaagaaaucccagcaccccuaggcacccccgacuucguuggaaaaauacaaggaguccuuacgcaaaucacaaaaggcgauggaagcacccgaggccacaaagccacuguuuacaccgguggcgccccauucaccccuaaacuuggauccguccaauuuucaaccgacaccgaaaacgacuucgaaacacaccaaaacaccaaauucacccccgucggcgucauacaagacggcuccaccacccaccgcaacgaaccccaacaauggguccuccccuccuacuccggccgcaacguacauaacguacaccuagccccugccgucgcccccacauuccccggcgaacaacuauuauucuuccgcucuaccaugcccggcugcuccggauaccccaacauggaccucgacugccugcucccacaagaguggguccaacacuucuaccaagaagcagcgcccgcacaguccgacguugcccuccuccgcuucguaaaccccgacaccggccgcguccucuucgaaugcaaacuacacaaauccggcuacguuaccguagcccacacagggcaacacgaccucgucauaccacccaacggauacuuccgcuuugacucaugggucaaccaguucuacacccuagcccccaugggcaacggaaccggcaggcgccgauaa

SEQ ID NO: 38329 - RNA, 1617 nt, Artificial Sequence
  derived and/or modified sequence opt11 from VP1__Norovirus_and/or_Norovirus-like__JQ613572
augaagauggccucaaacgaugccaacccgucagacggcucugcagcuaaucucguccccgaagucaacaacgaaguaauggcccucgaaccagucgucggcgccgccauagcagcccccgucgcaggccagcaaaacgucaucgaccccuggauacgcaacaauuuuguccaagcacccggcggagaauuuacugucucaccccgcaacgcccccggagaaacccucugguccgcccccuuaggccccgaccucaaccccuaccucucccacuuagcacgaauguacaacggcuacgccggcggcuucgaaguucaagucauccucgccggcaacgccuucaccgccgguaaaauaaucuucgccgcgguaccacccaacuuccccaccgaaggacucuccccgucacaaguaacuauguucccucacaucaucguagauguccgacaacucgaaccuguucucaucccccuccccgacguccgcaacaacuucuaccauuacaaccaauccaacgacuccaccaucaaacucauugccaugcucuacacaccccuuagagccaauaacgccggugaugacgucuucacagucuccugcagaguucucacacgccccucccccgacuucgacuucaucuuccucgucccucccacagucgaaucacgcacaaaacccuucaccgucccaauacucaccguagaagaaaugaccaacucucgauucccuaucccacuugaaaaacucuucaccggccccucauccgccuucgucguccaaccgcaaaacggucgaugcaccacagacggcguccuucucggcaccacacaacucuccccugucaacauaugcaccuuucggggcgacgucacccacaucgccggcagccgaaacuacacaaugaaccuagcaucacuuaacuggaacaacuacgaccccaccgaagaaauaccagcaccccucggcacccccgacuucgucggaaaaauacaaggcaugcucacacagaccacacagggcgauggaucaacccgcggacacaaagccaccguauacacaggcuccgccgacuucaccccaaaacucggcucuguccaauucgccaccgacacagaaaaugacuucgaaacccaccaaaacaccaaauuuaccccugucggggucauacaagacggcucaaccacacaccgcaacgaaccccaacaaugggcccugccaagcuacagcggccgaucagcccacaacguccaucucgccccugcaguugcacccaacuucccaggugaacaacuccucuucuuccgcuccaccaugcccggcugcuccggcuaccccaacauggaccuagacugccuacucccacaagaauggguccaacacuucuaccaagaagcagcccccgcccaauccgacgucgcacuacuacgcuucgucaaccccgacaccggccgaguccucuucgaaugcaaauuacacaaaucuggauacgucacaguagcccacacaggccaacacgaccucguuaucccacccaacggauacuuccgcuucgacuccugggucaaccaauucuacacccuagccccaaugggaaacggcaccggcagacguagauag

SEQ ID NO: 38330 - RNA, 1617 nt, Artificial Sequence
  derived and/or modified sequence opt11 from VP1__Norovirus_and/or_Norovirus-like__JQ613525
augaaaauggcaucaaacgacgccaacccaagcgacgguuccgcagccaaucucguaccagaagucaacaaugaagucauggcccuagaacccgucgucggugccgccaucgccgcaccggucgcuggucaacaaaacgucaucgaccccuggauacgaaacaacuucguccaagcucccggaggagaguucacaguaucaccccgcaacgcacccggagaaauccuaugguccgcaccccucggacccgaucuaaaccccuaccucucccaccuagcccgaauguauaauggcuacgcaggcggauucgaaguccaagucauccucgcuggcaacgccuucaccgccgguaaaaucaucuucgccgcagucccucccaacuuccccacggaaggccuaucccccucccaaguaaccauguucccccacaucaucguagacguacgccaacucgaacccguacuuaucccccuacccgauguacgcaacaacuuuuaccacuacaaccaauccaacgacucaaccaucaaacuaaucgccaugcucuacacuccccuacgagccaacaacgccggcgacgacguuuucacagucuccugccguguccucacccgccccucucccgacuucgauuucaucuuccucgucccgcccacuguugaaucccgaaccaaacccuucaccguccccauccuaaccgucgaagaaaugaccaacucucgauuccccauaccccuagaaaaacucuucacaggucccuccagcgcauucgugguccaaccccaaaacggccguuguaccaccgacgguguucuccuaggaaccacccaacucucacccguaaacauaugcaccuuccgaggcgacgucacccacaucgcuggcucacgcaacuacacaaugaaccucgcaucccuuaacuggaacaacuacgacccgaccgaagaaauccccgcaccacuaggcacccccgacuuugucggcaagauccaaggcguccucacccaaaccaccaaaggugacggcuccacccgcggucacaaagccacuguguacaccggcuccgccgauuucacccccaaacucggcucuguucaguucuccaccgacaccgaaaacgacuucgaaacccaccaaaacaccaaauucaccccagucggaguaauccaagauggauccaccacacaccgcaacgaaccccaacaauggguacuacccuccuauucaggucgcaacguccacaacguucaccuagcccccgccguagcaccaaacuuccccggcgaacaacuacucuucuuccgcucaacaaugccaggcugcuccggcuaccccaacauggaccucgauugccuucuaccccaagaauggguccaacauuucuaccaggaagccgcuccagcccaauccgacgucgcucuacuacgcuucguaaaucccgacaccggcagaguacucuucgaaugcaaacuucacaaacccggcuacgucacugucgcacacaccggccaacacgaucucguaauacccccaaacggcuacuucagauucgacuccugggucaaccaauucuacacccucgcccccauggguaacggagccggacgccgaagauga

SEQ ID NO: 38331 - RNA, 1617 nt, Artificial Sequence
  derived and/or modified sequence opt11 from VP1__Norovirus_and/or_Norovirus-like__JQ613510
augaaaauggccuccaacgacgccaaccccucugacggaucagcagccaaccucguacccgaagucaacaaugaagucauggcacucgaacccguugucggcgcagccauugccgccccuguagcaggccaacaaaacgugaucgaccccuggauacgcaacaacuucguccaagcccccggcggcgaguucaccgucucaccccgcaacgcccccggcgaaauccucugguccgcaccccuuggcccagauuuaaacccuuaccucucccaccucgcccgcauguacaacggauacgccggaggauucgaagugcaagucauacucgccggcaacgccuucacagccggcaaaaucauauucgccgcagucccuccaaacuuccccaccgaaggccucucaccaucacagguaaccauguucccacacauaauuguagacguacgacaacuggaaccaguacucauuccacuccccgacguacgcaauaacuucuaccacuacaaccagucaaacgacuccaccauuaaacuaaucgcgaugcucuacaccccacuacgggccaacaacgcaggcgaagacguauucaccgucuccugccgcguacuaacccggccuuccccagacuucgacuucauauuccuuguucccccaacagucgaaucucgaaccaaaccguucaccguccccauacuuacuguagaagaaaugacaaacucacgcuucccaauucccuuagaaaaacucuucaccggcccauccuccgccuuuguaguccaaccccaaaacggucgcugcacaaccgacggaguccugcuuggcaccacucaacuaagcccaguaaauauaugcaccuuccguggagacgucacccacaucgccggaucccgaaacuaugcaaugaaccuagcaucacuuaauuggaacaauuacgacccaacagaagaaaucccagcuccccuaggcaccccagacuuugucggaaaaauucaaggccuccucacacaaaccaccaagggcgacggcuccacccgaggucacaaagccaccgucuacacaggcucagcaccuuucacccccaaacuuggauccguccaauucuccacagacaccgaaaacgacuucgaaacccaccaaaacaccaaauucacaccagucggcgugauucaggacggcuccaccacccaccgcaacgaaccccaacaaugggucuuacccuccuacuccggacgcaacguccacaacguacaccucgcccccgccguagcccccaccuucccuggcgaacaacuccucuuuuuccggucaacaaugcccggauguuccggcuacccuaacauggaccucgacugccuccuaccccaagaauggguccaacacuucuaccaggaagccgcacccgcacaauccgacgucgcucuacuccgcuucgucaaccccgacaccggucgaguccucuucgaaugcaaacuccauaaaagcgguuacgucacagucgcacacaccggccagcacgaccuaguaauaccacccaacggcuacuuccgcuucgacucauggguaaaccaauucuacacccucgcccccaugggcaauggaaccggccgucgccgauaa

SEQ ID NO: 38332 - RNA, 1617 nt, Artificial Sequence
  derived and/or modified sequence opt11 from VP1__Norovirus_and/or_Norovirus-like__GQ856450
augaagauggccuccaacgacgccaaccccuccgacggcagcgccgccaacuuaguaccugaaguaaacaacgaagucauggcucucgaacccgucgucggcgcagccaucgcagcccccgucgcaggccaacaaaacgucaucgaccccuggauccgaaacaacuucguccaagcccccggaggagaguucaccguuucaccccgcaacgcacccggagaaauucucugguccgcaccccucgguccagaccuaaacccuuaccuaucccaccuagcccgcauguacaacgguuacgccggugguuucgaaguccaagucauucucgccggcaacgccuccaccgcaggcaaaaucaucuucgccgccgucccacccaacuuccccaccgaagggcuaucacccucacaagucaccauguucccccacaucaucgucgacguacgccaacucgaaccaguacuuauuccacuuccagacguccgaaacaacuucuaccacuacaaccaaucaaacgacagcaccauaaagcucaucgcaaugcuguacacgccccuccgcgccaauaacgccggcgaagacgucuucacagucagcugccgcguccucacacgacccucccccgacuucgacuucauauuccuaguacccccaaccgucgaaucacgcaccaaaccauucacaguccccauacuaaccgucgaagaaaugaccaacucacgcuuccccauaccacuagaaaaacucuuuaccggacccuccuccgcauucgucguacaaccacaaaacggccgcuguaccacagauggaguacuacuaggcacuacccagcuauccccagucaacaucugcaccuuccgaggggacgucacccauauagccggaacccacaacuacaccaugaaccucgcuagccucaacuggaacaauuacgacccaaccgaagaaauccccgcaccccucgguacccccgacuucgucggcaaaauacaaggcguccuaacccaaacuaccaaaggcgacggcuccacacgaggacauaaagcuacuguauacacuggcuccgcccccuuuacccccaaacucggcuccguacaauucuccacagacacagaaaacgacuucgaaacccaccaaaauacaaaauucaccccaguaggcguaauccaagacggaucaaccacucaccgcaacgaaccucaacaauggguucucccuucguacuccgggggaaacguccaaaacguacaucucgcgcccgcaguugcccccaccuuccccggugaacaacuccuauucuuccgcuccacaaugcccggcugcuccggcuaccccaauauggaccucgacugccuccucccccaagaauggguacaacacuucuaccaagaagccgccccagcccaauccgacguagcccuucuaagauucguaaacccugacaccggccgaguccucuucgaaugcaaacuccacaaguccggauacguuaccgucgcccacacaggccaacacgaccucguaauaccuccaaacggauacuuccgcuucgacucauggguaaaccaauucuacacacuagcacccaugggcaacggcaccggccgacgcagguaa

SEQ ID NO: 38333 - RNA, 1617 nt, Artificial Sequence
  derived and/or modified sequence opt11 from VP1__Norovirus_and/or_Norovirus-like__AB541296
augaaaauggcaucuaacgacgccaaucccuccgacggcuccgccgccaaccucguccccgaaguaaacaacgaagucauggcccuagaacccguagucggcgccgcaauagccgcucccguagccggccaacaaaaugucaucgaccccuggauccgcaacaacuuuguccaagcccccggaggagaguuuacagucagcccacgcaacgcacccggcgaaauccuaugguccgccccacucggcccagaccuaaaccccuaccucucccaccuagcccggauguacaacggauacgcaggcgguuucgaaguccaagucauccucgcaggcaacgccuucacagcuggaaaaauaaucuucgcugccgucccucccaacuuccccacagaaggccucucccccucccaaguaacaauguuuccacacaucauaguagacgugcgccaacucgaacccguacucauaccacuaccagacguccgcaauaacuuuuaccacuauaaccaaagcaacgacuccaccauaaaacucaucgcaaugcuguacacaccccuacgagccaacaacgcuggcgaagacgucuucaccguauccugccgaguccucaccagacccucaccagacuucgacuucauauuuuuaguaccacccaccguugaaucaagaaccaaacccuucaccguccccauauuaaccguagaagaaaugacaaacucccgcuuccccauaccacuagaaaaacuuuucacaggcccauccggcgccuucguaguccagccccaaaacggucguugcacaacggacgguguccuccuaggcacaacccaacucuccccagucaacaucugcaccuuccgcggcgacgucauccacaucgccggaucccgcaacuacaccaugaaucucgccgcucuaaacuggaacaacuacgacccaaccgaagaaauccccgcgccacucggcacucccgacuucguaggcaaaauccaaggaguccuaacacaaacaaccaaaggcgauggcucaacuagaggucacaaagcaaccguauacaccggcagcgcugacuuuacccccaaacucggcucaguccaauucucaaccgacacagaaaacgacuucgaaacccaccaaaauaccaaauucacccccguaggagucauccaagacggcuccaccacccaccgcaacgaaccucaacaauggguacucccuuccuacuccggucgcaacguccacaacguccaccucgccccagccguagcccccaccuuuccaggagaacagcuacucuucuuuagauccacaaugcccggaugcuccgguuaccccaacauggaucucgacugccuccuaccccaagaauggguccaacacuucuaccaagaagccgcccccgcccaaucugacguugcccuccuucgcuucgucaaccccgacacaggccgaguucuuuucgaaugcaaacuccacaaaucaggcuacgucaccgucgcccacaccggccaacacgaccuggucaucccacccaauggcuacuucagauucgacuccugggucaaccaauucuacacucuagcccccauggguaacggaacaggacgucgcagauaa

SEQ ID NO: 38334 - RNA, 1617 nt, Artificial Sequence
  derived and/or modified sequence opt11 from VP1__Norovirus_and/or_Norovirus-like__AB541212
augaaaauggcgucaaacgacgcaaaccccuccgacggcuccgccgcaaaccuaguccccgaagucaacaacgaaguuauggcccucgaacccgucgucggagccgcgaucgcagcacccgucgcuggccaacaaaacguaaucgaccccuggauccgcaacaacuucguccaagcaccaggcggcgaguucacagucucaccccgaaaugcaccaggcgaaauccucugguccgcuccccuaggacccgaccucaacccauaucucucacaccuagcccgcauguauaacggcuaugccggaggcuucgaaguccaagucauucucgccggcaacgcauucaccgcaggaaaaaucauauucgccgccgucccucccaacuuucccacagaaggccucucccccucacaagucacaauguucccccacaucaucguagauguccgccaacucgaaccugugcucauuccccucccagacguccgaaacaauuucuaccacuacaaccagucaaaugacuccaccaucaaacucauagcaaugcucuacacaccccucagagccaacaacgccggcgaagacguauucaccguaucaugccgcguacucacacgccccucccccgacuucgacuucauauuccucguaccaccaaccgucgaaucacgcaccaaacccuucacaguccccauucucacagucgaagaaaugaccaacucacgguuccccauaccccuagaaaaacucuuuaccggccccagcucagccuucguaguccaaccccaaaacggccgauguaccaccgacggcguccuccuaggcacaacccagcucucccccguaaacaucugcaccuuccgaggagacgucacccacaucgcaggaucccgcgacuacaccaugaaccuugccucccucaacuggaauaacuacgaccccaccgaagagauccccgcaccccuaggaacacccgacuuugucggcaaaauccaaggcguccucacccaaacuacgaagggcgacggaagcacccgcggccacaaagccacagucuacaccggaucagcacccuucaccccaaaauuaggcuccguccgcuucucaaccgacaccgaaaaugauuucgaaacccaucaaaacaccaaauucacaccaguaggcgucauccaagauggcuccacuacccaccgcaacgaaccccaacaguggguacuccccuccuacucaggccgagacguccauaacguccaccuagcucccgccguagcccccaccuucccaggcgaacagcuccucuucuuccgaucuacuaugccaggaugcucaggcuacccaaacauggacuuggacugccuccuaccacaagaauggguccaacauuucuaccaagaagcagcccccgcccaaucagacgucgcacuccuccgcuucgucaaccccgacaccggccguguccuauucgaaugcaagcuccacaaaccaggauacgucacagucgcccacacuggccaacacgaucucgucaucccacccaacggguauuuccgcuucgauucuugggucaaccaauucuacacacuagcccccaugggcaauggaaccggccgccgcagauag

SEQ ID NO: 38335 - RNA, 1617 nt, Artificial Sequence
  derived and/or modified sequence opt11 from VP1__Norovirus_and/or_Norovirus-like__AB504321
augaaaauggcaucaaaugacgccaaccccuccgacggaucagccgccaaccuagucccagaagucaacaacgaaguuauggcccucgaacccgucguaggcgccgccaucgcagccccaguagccggacagcaaaacaucaucgaccccuggauacgaaacaacuucguccaagcacccggaggugaguucaccgucucaccgagaaaugccccuggcgaaauccucuggucagcaccccucggaccagaccuaaaccccuaccucucccaccucgcccgcauguacaacggauacgccggaggcuucgaaguccaaguaauccuagccggcaaugccuucaccgcaggcaaaauaaucuucgcagccgucccacccaacuuccccacagaaggccucucccccucccaggucaccauguucccccacaucaucguagacguacgucaacucgaaccaguccuaaucccccucccagacguucgcaacaauuucuaccacuacaaucagucuaacgacucaacaaucaaacucaucgccaugcuuuauacaccccuacgcgccaacaacgccggcgaagacgucuucacagucuccugcagaguccuaacucgccccucccccgacuuugacuucaucuuccuugucccaccuacagucgaaucucgcacaaaacccuucacggucccaauccuaacagucgaagagaugaccaacuccagauucccaaucccccucgaaaaacucuuuaccggacccucaggcgccuucgucguacaaccccaaaacggccgcugcaccacagacggaguccuccucggaaccacucagcucucaccagucaacauaugcacuuuccgcggcgacgugacccacaucgcaggcacacgcaacuacaccaugaaccucgccucccucaacuggaauaacuacgaccccacagaagagauccccgccccacucggaaccccagacuucgucggcaaaauucaaggcguauuaacucaaacaaccaaaggugacgguucaacccgcggacacaaagccacagucuacacaggcuccgcccccuucaccccaaaacuaggcucaguccaauucuccaccgauaccgaaaacgacuucgaaacccaccaaaacacaaaauucaccccugucggcguaauccaagacggcggcacaacccaucgaaaugaaccccaacaauggguacuuccgucauacuccggucgcaacguccacaacguccaccuagcaccagcaguagcccccaccuuccccggcgaacaacuccucuucuucagaucaaccaugccaggaugcucugguuaccccaacauggaucuagauugccuccuuccccaggaauggguacaacacuucuaccaggaagccgcacccgcacaauccgacgucgcccucaugcguuucguaaacccggacaccggccgaguacucuuugagugcaaacuacacaaauccggcuacguaaccgucgcccacaccggacagcacgaccuagucauacccccaaacggauacuuccgcuucgacucaugggucaaccaauuuuacacccuugccccaaugggcaacggcacaggccgacgccgcuaa

SEQ ID NO: 38336 - RNA, 1617 nt, Artificial Sequence
  derived and/or modified sequence opt11 from VP1__Norovirus_and/or_Norovirus-like__AB294785
augaaaauggcuuccaacgacgcaaccccuucagacggcucaaccgcaaaccuaguacccgaagucaacaacgaagugauggcccucgaacccgucgucggagccgccaucgccgcccccguagcaggacaacaaaacgucaucgaccccuggauucgaaacaacuucguccaagcccccggcggcgaauuuaccguuucuccccgcaacgcucccggcgaaauacucugguccgccccucucggacccgaucuaaaccccuaccucucacaccucgccagaauguacaacggcuaugcuggaggcuucgaaguacaagucauccuagccggcaacgcuuucacagccggcaaaauaaucuucgccgccgucccaccuaacuuccccacagaaggccucucaccuucccaagucaccauguucccucacauaaucgucgacguccgucagcuagaaccgguccuaauaccccuccccgacguccgcaacaacuucuaccacuauaaccaauccaaugauuccacuaucaaacucaucgccaugcucuacaccccacuacgcgccaacaaugccggcgacgaugucuucacaguaucuugucgcguauuaaccaggcccagccccgacuucgacuucaucuuccuaguaccucccacagucgaaucccgcaccaaacccuucuccgucccuauccuaaccguugaagaaaugaccaacucccgcuuccccauaccacucgaaaaacucuucaccggcccaucauccgcauucguaguccaaccacaaaacggccgcugcaccaccgacgguguccuccucggaacuacccaacuaucccccgucaacaucuguaccuuccgcggcgacguaacccacaucgccggaacgcaaaacuacaccaugaaccucgccucucaaaacuggaacaauuacgaucccaccgaagaaauccccgcgccccucggcaccccagacuuugucggcaaaauacaaggcguccucacccagacaacucgccgagacggcuccacccguggccacaaagccaccgucucuacaggauccguacacuucacaccaaagcucggcucaguacaguucuccaccgacaccucuaacgacuucgaaacaggacaaaauacaagauucacacccguaggcguagugcaagacggcuccacaacucaucaaaacgaaccccaacaauggguacuccccaacuacuccggccgcgacucccacaacguccaccucgcccccgcagucgcccccaccuuccccggagaacaacuccuuuucuuccgaucaaccaugcccggcugcuccggcuaccccaacaugaaccucgacugccuacucccacaagaauggguccaacacuucuaccaagaaagcgccccagcccaaucugacgucgcccuccuacguuucgucaacccugauaccggccguguccuauucgaaugcaaacugcacaagucgggcuacgucacagucgcccauacaggacaacacgaccuugucauacccccaaacggcuauuucagauucgacuccugggucaaccaauucuacacccucgcccccaugggcaacggugcaggcaggcgccgcuaa

SEQ ID NO: 38337 - RNA, 1617 nt, Artificial Sequence
  derived and/or modified sequence opt11 from VP1__Norovirus_and/or_Norovirus-like__AB294780
augaaaauggccuccaacgacgccaaccccuccgacggcuccaccgccaaccucgucccagaagucaacaacgaagucauggcccuagaaccagucgucggcgcagcaauagcagcccccguugccggccaacagaacgucauagacccauggauccgcaacaacuucguccaagcccccggaggcgaguucaccgucuccccacggaacgcacccggcgaaaucuuaugguccgccccacuaggccccgaccuaaacccauaucucucccaccucgccagaauguacaacggcuacgccgguggcuucgaaguccaagucauccucgccggaaacgccuucacagccggcaaaaucaucuucgcagccguacccccuaacuucccuaccgaagggcucuccccaucccaagucacgauguucccccacauaauagucgacguccgccaacucgaacccguccuaaucccccuaccugacguccgcaacaacuucuaucacuacaaccaaaguaaugaccccacaauaaaacuaaucgcgauguuauacacuccccuccgcgcaaacaacgccggcgaagacgucuucaccgucuccugccgaguacucacccgcccuucacccgacuuugacuucaucuuccucgucccacccacaguagaaucccgcacgaaaccauucacagucccaauacucaccgucgaagaaaugacaaacucccgauucccaauacccuuagaaaaacuauucacagggcccuccggcgccuucguuguacaaccacaaaacgggagaugcacuaccgacggcguccuacucggcacaacacaacuuuccccugucaacaucugcacauuccgcggcgacguaacccacaucgccggcacccacaacuacaccaugaaccuugcaucgcaaaacuggaacaacuacgacccaaccgaagaaauccccgccccacucggcacaccggacuuugucggccgcauccagggcauguuaacccaaacuacaaaaggcgacggcuccacacgaggacacaaagcaaccguguccacaggcgacguccauuucacuccaaaacuaggcuccauacaauucaacaccgacacaaacaacgacuucgaaaccggccaaaacaccaaauucacacccgucggcguaguucaagacggcaacggcacccaccaaaacgaaccccaacaauggguccuucccucauacucgggccgcaccggacacaacguccaccucgcccccgccguagccccaaccuuccccggagaacaacuccuauucuuccgcuccacuaugcccggcugcucaggcuacccaaacaugaaucuagacugccuccucccccaagaauggguacaacacuucuaccaagaagccgccccagcccaaucugacgucgcacuccuccgauucgucaaccccgacacaggccggguucucuuugaaugcaaacuccacaaauccggcuacgucacagucgcccacacaggccaacaugacuuaguaaucccucccaacggcuacuuccgauucgacucaugggucaaucaauucuacacacucgcccccaugggcaacggcacuggacgacgaagauaa

SEQ ID NO: 38338 - RNA, 1617 nt, Artificial Sequence
  derived and/or modified sequence opt11 from VP1__Norovirus_and/or_Norovirus-like__AB303933
augaaaauggcaagcaacgacgccaccccauccgacggcucaaccgcaaaccuagucccagaaguaaauaacgaggucauggcccuagaacccgucguaggagccgccaucgcugcacccguugccggccaacaaaaugucauugacccuuggauccgcaacaacuucguccaagcccccggcggugaguucaccgucucaccacgaaaugcacccggcgaaaucuuaugguccgcaccccucggacccgaccucaacccauaccucucccaccuugcccgaauguacaauggcuacgccggaggcuucgaaguccaaguuauucuagccggcaacgccuucaccgccggaaaaaucaucuucgccgccgucccucccaacuucccaacagaaggucucagccccucccaaguaaccauguucccacacauuaucgucgacguacgccaacucgaacccguccucaucccccucccagacguccgaaauaacuucuaccacuacaaccaaucuaacgaccccacaauaaaacucauugccaugcucuacacaccccuccgcgccaacaacgccggagaagacguauucacugucucaugccgaguccucacacgccccuccccagacuucgacuucauauuccuugucccgcccaccgucgaaucccgcaccaaacccuucacaguccccauacucacagucgaagaaaugaccaacuccagauuccccaucccccuugaaaaacucuucacaggcccaucaggagcauucgucguacaaccacaaaacggacgcugcacaaccgacgggguccuccuagguacuacucaacuuucaccagucaauaucugcacauuccgcggcgacgucacccacaucgccggaacgcacaacuacacuaugaaccucgccagccaaaacuggaauaacuacgacccaacggaagaaauacccgcaccacuuggaacacccgacuucgucggucgcauccaaggcaugcucacccaaaccacacgaggagacggcucaacccgcggccacaaagcuacagucucuaccggagacguccacuucaccccaaaacucggaagcauccaguucaacaccgacaccaacaacgacuucgaaaccggccaaaacacaaaauucacuccagucggcguaguacaagacggaaacgguacgcaccaaaacgaaccacaacaauggguccuuccauccuacuccggccgaaccggccacaacguccaccuggcacccgccgucgccccgacauuccccggagaacaacuccuuuucuuccggucaacaaugcccggcugcucaggcuaccccaacaugaaccucgacugccuucucccccaggaguggguacaacauuucuaccaggaagccgccccugcacaauccgacgucgcucuacuccgcuucgucaacccagacaccggccgcguguuauucgaaugcaaacuccacaaauccggcuaccucacagucgcccacacaggccaacacgaccucgucaucccaccaaacggauacuuccguuucgacuccuggguaaaccaguuuuacacccucgcaccuaugggcaacggcaccggacgucgccgauaa

SEQ ID NO: 38339 - RNA, 1617 nt, Artificial Sequence
  derived and/or modified sequence opt11 from VP1__Norovirus_and/or_Norovirus-like__AY587988
augaagauggccagcaacgacgccaaccccuccgacggcucaaccgcaaaccuaguaccagaagucaauaacgaagucauggccuuagagcccgucgucggcgccgccauugccgcuccagucgcaggccaacaaaacgucaucgacccuuggauccgaaacaacuucguccaagcgccgggcggcgaguucaccgugaguccccgcaaugccccuggcgaaauccuauggucagcaccccucggacccgaccucaacccauaccuaucccaccucgcaagaauguauaacggcuacgccggcggcuucgaaguccaaguaauccucgccggcaacgccuucacagccggcaaaauaaucuucgccgccguacccccaaacuucccaaccgaaggacuuuccccuucccaagucaccauguucccacacauaaucguugacguccgacaacucgaacccguacucauaccacuacccgacguccguaacaacuucuaccacuauaaccaaucuaacgaccccaccauaaagcucaucgccaugcuguacaccccucuccgcgccaauaacgccggugaagacgucuucaccguauccugccgcguccucacucgacccucacccgacuucgacuucaucuuccuagugccaccaaccguagaaucacgcacaaaacccuucacagucccaauccucaccgucgaagaaaugaccaacucccguuucccaauaccccuagaaaaacuuuuuaccggaccuuccggagccuucgucguccaaccccaaaauggccguugcacaaccgacggcguccuccucggcaccacacaacuuucccccguuaacaucugcgccuuccgaggagacguaacacacauugccggaacacacaacuacaccaugaaccuugcaucacaaaacuggaauaacuacgaccccaccgaagaaauccccgcaccacuaggcaccccagacuucgucggacgcauccaagguaugcucacccaaaccacccgaggcgacggauccacccgcggccacaaagccaccgucucaaccggagauguucauuucaccccgaaacuugguuccauccaauucaacacagacacaaacaacgacuucgaaacgggacaaaacacaaaauucaccccagucggcguaguccaagacggaaacggcacacaucaaaacgaaccccaacaauggguccuccccucauacagcggaagaaccggccacaacguacaccuagccccagccgucgcacccaccuuccccggagaacaacuacucuucuuccgauccacuaugcccggcugcuccggauaccccaacaugaaccucgacugccuccucccccaggaauggguccaacacuucuaccaagaagccgcacccgcacaauccgacguugcacuccuucgcuucgugaaccccgacacaggccgcguauuauucgaaugcaaacuccacaaaacaggauacgucaccguugcccacaccggucaacacgaccuagucaucccacccaacggcuacuuccgcuucgacucaugggucaaccaauucuacacacucgccccaaugggaaacggcacaggacgccgcagauaa

SEQ ID NO: 38340 - RNA, 1617 nt, Artificial Sequence
  derived and/or modified sequence opt11 from VP1__Norovirus_and/or_Norovirus-like__KX354103
augaaaauggccagcuccgacgcaaaccccuccgacggaucugccgcuaaccucgucccagaaguaaacaacgaaguaauggcucucgaacccgucgucggcgcagccaucgccgcacccgucgccggucagcaaaacguaauagacccauggauccguaacaacuucguccaagcacccggcggcgaguucacagucucacccagaaacgcacccggcgaaauccucuggucagcaccccucggacccgacuuaaaccccuaccuaucccaccucgcccgcauguacaacggcuacgccggcgguuucgaaguacaaguuauccucgccgguaaugcauucaccgcaggcaaagucauauuugccgcugucccaccaaacuuccccacagaaggccucuccccgucccaagucacaauguucccacacaucgucgucgacguacgccagcuugaaccaguacucaucccccuaccagacgucagaaacaacuucuaccacuacaaccaauccaacgaucccaccauaaaauuaauagccaugcuauacacaccacuaagagccaacaacgccggcgacgacgucuucaccguauccugccgaguacucacccgacccucacccgacuuugauuucaucuuccucguaccacccaccguagaauccagaaccaagcccuucuccgugcccguccucaccguugaagaaaugaccaacucccgcuucccaaucccccuugaacgccuauucacugggcccuccuccgcauucgucguccaaccccaaaacggacgaugcaccacagacggcguacuccucggaacaacacaacucucacccgucaacaucugcacauuccgcggcgacguaacucacaucaccggcucccacaacuacacaaugaaccuagcaucccaaaacuggaacaacuacgaccccaccgaagaaaucccagcaccccucggcacucccgacuucguaggcaagauacaaggcguacugacacagacuacccgcaccgacggcucaacacgaggccacaaagccaccgucuacaccgguagcgccgaguucgcccccaaacucggacgaguacaauucgaaaccgacaccaaccaugauuucgaagccaaccaaaacacaaaauucaccccuguaggcgucauacaagacggauccaccacccaccgaaacgaaccacaacaauggguacuuccaucuuacuccggcagaaacacccacaacguccaccucgcucccgccgucgccccaacauuuccaggcgaacaacuccucuucuuccgcucaaccaugccaggcugcuccggcuacccaaauauggaccucgacugccuacucccccaagaauggguacaauacuucuaccaagaagccgcccccgcccaaagcgacguagccuuacuccgcuucgucaacccagacacaggccgcguccuguucgaaugcaaacuacacaaauccggcuacaucaccgucgcacacacaggccaacacgaccucguaauacccccaaauggcuauuuccgauucgacuccuggguaaaccaauucuacacacucgcccccauggguaacggcaccggccgacgaagauaa

SEQ ID NO: 38341 - RNA, 1617 nt, Artificial Sequence
  derived and/or modified sequence opt11 from VP1__Norovirus_and/or_Norovirus-like__KX354048
augaaaauggccucuuccgacgccaacccauccgacggcucugcagcaaaccucgucccagaagucaacaacgaaguaauggcacuugagccagucgucggcgcagcaaucgcagcccccguagccggccaacaaaacguaaucgaccccuggauccgcaacaacuucguacaagcccccgggggcgaauuuacagucuccccacgcaacgcccccggugaaauacugugguccgcaccacucggacccgaccucaacccauaccucucccacuuagcacgcauguacaacgguuacgcuggcggauucgaaguucaagucauacucgccggaaacgccuucaccgccggcaaagucaucuucgccgcagucccucccaacuucccaacugagggccucucacccucacaaguuacuauguucccccauaucgucguagauguccgacaacuugaacccguacuaaucccccuccccgacguccgaaacaacuucuaccacuacaaucaauccaacgacccuacaauaaaacucaucgccaugcuauacacaccccuccgcgcaaacaaugccggcgacgaugucuucaccgucuccugccgcguccucacccgcccauccccagacuucgacuucauauuccucguaccucccaccgucgagucacguaccaaacccuucuccguacccguccucaccgucgaagaaaugacaaacucccgcuuccccaucccccucgaaaaacucuucaccggccccucauccgccuucgucguccaaccccaaaacggacgaugcaccacagacggaguacuccucggaaccacacaacucagcccagucaacauuugcaccuuccgcggcgacguuacccacaucaccggcucacgaaacuacacaaugaaucuagccucccaaaacuggaacaacuacgaucccacagaagaaauccccgccccacugggcacuccugacuucgucggcaaaauucaaggcguacucacccaaacuacacguacagacggcuccacccgaggucacaaagcaacagucuacaccggcucagcggacuucgcucccaaacuuggccgcguccaauucgaaaccgacaccgaccacgauuucgaagccaaccaaaacaccaaauucacccccgucggcgucauucaagacggcuccacaacccaccgcaacgaaccucaacaauggguacuaccuucauauuccggccgcaacacucacaacgugcaccucgcacccgccgucgccccuaccuucccuggcgaacaacuccuauucuuccgcuccaccaugccaggcugcucaggcuaccccaacacagaccucgacugucuacucccccaagaauggguccaauauuucuaccaagaggccgccccagcccaauccgacgucgcacuacuaagauucgucaauccugacaccggccgcguucuauucgaaugcaagcuccacaaaucuggguacgucaccgucgcacacaccggccaacacgaccucguaauacccccgaacggcuacuuccgcuucgacuccugggugaaccaauuuuacacucuagccccuaugggcaacggcacaggacgcagacgauaa

SEQ ID NO: 38342 - RNA, 1617 nt, Artificial Sequence
  derived and/or modified sequence opt11 from VP1__Norovirus_and/or_Norovirus-like__KX354047
augaaaauggcaagcuccgacgccucccccuccgacggcuccgcugccaaccucgucccagaaguuaacaacgagguuauggcccuugaaccaguagucggcgcagcaauugcugcacccgucgccggccagcaaaacguaaucgaccccuggauccgcaacaacuucguccaagcccccggcggcgaguucaccguaucuccccgaaacgcccccggugaaauacuaugguccgcaccccuuggccccgaccuaaaccccuaccucucccaccucgcccgaauguacaacggcuacgcuggaggauucgaaguccaagucauccuagcaggaaacgccuucaccgccggcaaaguaaucuucgcggccgucccacccaacuuccccaccgaaggucucucccccucccaggucaccauguucccccacauaguagucgacguccgccaacucgaaccaguacuaaucccacuccccgacguacgcaacaacuucuaucacuacaaccaguccaacgacccuaccaucaaacuaauagccaugcuauacaccccacuacgcgccaacaacgccggcgacgacguauuuacuguauccugccgcguccucacccgcccaucccccgacuucgauuucaucuuccugguaccacccacagucgaaagccgcacaaaacccuucuccguccccguccucaccgucgaagaaaugaccaauucccgcuuuccaaucccucucgaaaaacuauucaccggacccuccuccgccuucgucguccaaccccaaaacggcagaugcaccaccgacggaguccuacucggcacaacucaacucucccccgucaacaucugcacauuccgcggcgacguaacccacauaacaggcucccgcaacuacaccaugaaccuagcaucucagaacuggaacaacuacgacccaacagaagaaauccccgcccccuuaggaacacccgacuucgucggcaaaauacaaggcguccuaacacaaaccacccgaacagacggauccacacgcggacacaaggccaccgucuacaccggcuccgcagacuucgcacccaaacucggcagaguccaguucgaaaccgacaccgaccaugacuucgaagccaaccaaaacaccaaauucacacccgucggaguaauacaagacggcucaacaacccaucgaaacgaaccccaacaauggguguuacccucauacuccggucgcaacacccacaacguucaccucgccccagccgucgcgccuaccuuccccggcgaacaacuucuauucuuccgcucaacaaugcccggcugcucaggguacccaaacauggaccucgacugucuacuaccccaagaguggguccaauacuucuaccaagaagccgccccagcucaaucagacgucgcccuccuccgauucgucaacccugacaccggucguguucuuuucgaauguaaacuucacaaaagcggcuacguaacggucgcccauaccggccaacacgaccucguuaucccucccaacggauacuuccgcuucgacucauggguaaaucaauucuacacccucgcccccaugggcaacggcgcaggacgcagacgauga

SEQ ID NO: 38343 - RNA, 1617 nt, Artificial Sequence
  derived and/or modified sequence opt11 from VP1__Norovirus_and/or_Norovirus-like__KU985161
augaaaauggccuccucugacgcgaacccuuccgauggauccgccgccaacuuagucccagaagucaacaacgaagucauggcucucgaacccgucgucggcgccgccaucgccgcgcccguugccggucaacagaacgucaucgaccccuggauacgaaacaacuucguccaagcacccggcggcgaguucaccgucuccccacgcaaugcacccggcgaaauacuuuggucagcaccccucggcccugaccucaaccccuaccucucccaccuagcccgaauguacaacggcuacgcaggcggcuucgaaguccaaguaauccuagcaggcaaugcauucacagccggaaaagucaucuucgccgcuguacccccaaacuucccuaccgaaggccuaucacccagccaagucaccauguucccccacaucgucgucgacgucagacaacucgaacccguacucaucccccuaccugacguccguaacaacuucuaccacuacaaccaaucaaaugaccccaccaucaaacuaaucgcaaugcucuacacaccccuucgcgccaacaaugccggugacgacgucuucaccgucuccugccgaguccucacccgucccucccccgacuucgacuucaucuuccuagucccacccaccgucgaaagcagaacuaaacccuucuccguaccaguacuuaccgucgaagaaaugaccaacucccgcuucccaaucccccuggaaaaacucuucacuggcccaucuucagccuucguaguacaaccacaaaacggaaggugcaccaccgacggcguccuccuaggcaccacccaacucucucccguaaauaucugcaccuuccgcggcgacgucacacacauaacaggcucacacaacuacaccaugaaccucgcaucacaaaacuggaacaacuaugaccccacugaagaaauacccgcuccucuuggcaccccagacuucgucggcaaaauccaaggcguacuaacacaaaccacccgcaccgacggcucaacucgcggacacaaagcaaccguauacaccggaucagccgacuucgcccccaaacucggccgcguccaauucgccaccgacaccgaccacgacuucgaagccaaccaaaacacaaaauucacacccgucggaguuauccaagacggcuccaccacccacagaaacgaaccacaacaauggguccuccccucauacucaggacgcaacacacacaacguccaccucgcccccgccguagcacccacauucccaggcgaacaacuacucuucuuccgcuccaccaugcccggcugcagcggcuaccccaacauggaccuagacugccuccucccccaagaguggguacaauauuucuaucaagaagccgcccccgcucaaagcgacgucgcccuccuacgcuucgucaauccagacaccggaagaguccuauucgaaugcaaacuacacaaauccggcuacgucaccgucgcccacaccggacaacacgacuuagucauacccccuaacggcuacuuccgcuuugauucaugggucaaucaauucuacacccuagcccccaugggaaacggcaccggccgaagacguuaa

SEQ ID NO: 38344 - RNA, 1617 nt, Artificial Sequence
  derived and/or modified sequence opt11 from VP1__Norovirus_and/or_Norovirus-like__AB972517
augaaaauggccucguccgacgccaaucccuccgacggcucagcugccaaccuaguccccgaagucaacaacgaagucauggcccucgaacccgucgucggcgccgcaaucgccgcccccgucgccggucaacaaaacgucauagaccccuggauccgcaacaacuucguacaagcaccaggaggcgaguucacuguauccccacgcaaugcccccggagaaauccucuggagugcaccccuaggccccgaccucaaccccuaucuuucccaccucgcccgcauguacaacggcuacgcuggaggauucgaaguacaggucauacucgcaggcaacgccuucacagcaggcaaaguaauuuucgccgcagucccaccuaacuuccccacagaaggacucucccccucccaagucacaauguuuccccacaucgucgucgacguccgccaacuggaaccuguccucaucccccuacccgacguccgaaacaacuucuaccacuacaaccaauccaacgaucccacaauaaaacucaucgcaaugcuauacacaccccuucgcgcaaacaacgcaggagacgacgucuucaccguaucuugccgcgucuuaacccgaccuucucccgacuucgacuuuaucuuccucguuccacccacagucgaaucccgcaccaaacccuucuccguacccguccuaaccgucgaagaaaugaccaacucccgcuuccccaucccccuagaaaaacucuucacuggacccuccucagccuucgucguccagccccaaaacggacgaugcaccacagacggaguacuccucggcaccacccaacuaucaccagucaacaucugcacauuucgcggcgacaucacccacaucaccggcucccgcaacuacacuaugaaccucgccagccaaaacuggucaaacuacgaucccacagaagaaauccccgcgccucuuggaacaccagacuucgucgguaaaauccaaggcguccucacccaaaccaccagaaccgacggcucaacccgcgggcacaaagcaaccgucuacaccggcuccgcagacuucgccccaaaacucggucgaguacaauucgagaccgacacugaccacgauuucgaagccaaccaaaacaccaaauucaccccagucggagucauacaagacggcagcacaacccacagaaacgaaccccagcaauggguccucccaucauacuccggccgcaacacacccaacguacaccuagccccagccgucgcucccacauuccccggagagcaacuccucuucuuccgcagcacaaugcccgggugcagcggcuacccaaacauggaccucgacugccuacucccucaagaauggguccaacacuucuaccaagaagccgcccccgcacaaucagacgucgcccuacuccgcuucgucaaccccgacacaggccgcguccucuucgaaugcaaacuacacaaaucaggcuacguuaccguagcacacaccggacaacacgaccuagucauaccucccaacggauacuuccgcuucgacuccugggucaaccaauucuauacccucgcccccaugggcaacggcacaggccgcagaagauag

SEQ ID NO: 38345 - RNA, 1617 nt, Artificial Sequence
  derived and/or modified sequence opt11 from VP1__Norovirus_and/or_Norovirus-like__AB972494
augaaaauggccucguccgaugccaaccccagcgacggcuccgccgccaaccuaguccccgaaguaaauaacgaggucauggcccucgaacccgucgucggcgccgccauagccgcccccguagcuggccagcaaaacgucaucgaccccuggauuagaucaaacuucguacaagcccccggaggagaguucaccgucucaccccguaacgcacccggcgaaauccuauggucugcaccccucggacccgaccucaaccccuaccucucccaccuugccagaauguauaacggauacgccggaggcuucgaaguccaagucauacucgccggcaacgccuucaccgcgggcaaaguaaucuucgcagcaguaccucccaacuuccccacagaaggccucucacccucccaaguaacuauguucccccacauugucgucgacguacgccagcucgaaccaguccuaauaccacuaccagacguacgaaacaacuucuaccauuacaaccaaucgaacgacccaaccaucaaacuaaucgccaugcuauacacaccccuccgagcaaacaacgccggcgacgacguauucacagucuccugccgcguccucacccgccccucuccagauuucgacuucaucuuucuaguacccccaaccgucgaaucccgcaccaaacccuucuccguaccaguacucaccgucgaagaaaugacaaacucucgcuucccaaucccccuagaaaaacucuuuacaggacccuccuccgcuuucgucguccaaccacaaaacggacgaugcaccaccgacggcguacuccucggcacuacccaacucucccccguaaacauuugcacauuccgcggcgacgucacacacauuaccggcucccgaaacuacacaaugaaccucgcaucccaaaacugguccaacuacgaucccacugaagaaaucccugcuccccuaggaaccccugacuucguaggcaagauccaaggcguacucacccaaaccacucgcaccgacggcagcacccgaggccacaaagccaccguauauaccggcagcgccaacuucgcccccaaacucggccgcguccaguucgaaaccgacacagaccacgacuucgaagccaaccaaaacacuaaauucacccccguaggcgucauacaagacggcuccaccacccaccgaaaugaaccacaacaauggguccuccccagcuacuccggccgaaacacacccaacguacaccucgcccccgcugucgcgcccaccuucccaggcgaacagcuccucuucuuccgcagcaccaugcccgggugcucaggcuaucccaauauggaccuagacugccuccuaccccaggaauggguccaauacuucuaccaagaagcugccccagcccaauccgacgucgcccuccucagauucgucaaccccgacacaggccguguccucuucgaaugcaagcuacacaaaucuggcuacgucaccgucgcccacaccggccaacacgaccucgucauaccacccaacggcuacuuccgcuucgacucaugggucaaccaauucuauacccucgcccccaugggcaacggaaccggccgucgccgauga

SEQ ID NO: 38346 - RNA, 1617 nt, Artificial Sequence
  derived and/or modified sequence opt11 from VP1__Norovirus_and/or_Norovirus-like__KU311163
augaaaauggccucaaacgacgccaaccccuccgauggaucagcagcaaaccuaguaccagaagucaacaacgaaguuauggcccuagagccagucgucggagcggccaucgccgcccccgucgccggacaacaaaacguaaucgacccauggauccggucaaacuucguccaagccccagguggagaguucaccgucucaccacgcaacgcacccggagaaauccuauggucagcaccccuaggcccggaccuaaaccccuaccuaucacaccucgcccgcauguacaacggcuacgccggagguuucgaaguacaaguaauucucgcuggcaacgcuuucacugccggcaaaaucauauucgccgcagucccacccaacuuccccaccgaaggacucagccccucccaagucacaauguucccacacauaaucgucgacguccgacaacuugaaccaguccuuauuccccuucccgacguccgaaacaacuucuaccacuacaaccaauccaaagacagcaccaucaaacuaauagccaugcucuauacaccccuccgugcaaauaacgccggcgacgacgucuucaccgucucaugccgaguacuaacccgcccaucaccagacuucgacuucaucuuccucguuccucccaccgucgaaucccgcaccaaacccuucaccguccccauucuaacagucgaggaaaugaccaauucccgcuuccccaucccccucgagaaacuauucaccggacccuccaacgccuucgucguccaaccacaaaacggucgaugcacaaccgauggcguccuccucggcaccacccaacuauccccuguuaacauaugcaccuuccgcggagacgugacacaaaucgccucuacccaaaccuacaccaugaaccuugccucacuaaacuggaacaacuacgacccaaccgaggaaaucccagcuccccuuggugcacccgacuucaugggcaaaauccagggcgugcucacccaaaccacaagacaagacggcuccacacguggacacaaagcgaccgucuccacaggaucgguacacuucacaccaaaacucggcuccguccgauucgacacugacacaaacaacaaccuccaaccacaccaauccacccguuucaccccagucggcgucauccaagacggagacacccaccaaaacgaaccccaacaauggguccuccccugcuacuccggcagggacguuaauaacguccaccuugcccccgccguagcaccgucuuuucccggcgaacaacuucucuucuuccguuccacuaugcccggaugcuccgguuaucccaacauggaccuugacugccuccucccccaagaauggguccaacacuucuaccaagaagccgcccccgcacaguccgacgucgcccuacucagauucgucaaccccgacaccggccguguccucuucgagugcaagcuccauaaaucuggauacguaaccguagcccacaccggacaacacaaccuagucauucccccaaauggcuacuuccguuucgacuccugggucaaccaauucuacacacucgccccaaugggcaacggcacaggacguagacguguuuaa

SEQ ID NO: 38347 - RNA, 1617 nt, Artificial Sequence
  derived and/or modified sequence opt11 from VP1__Norovirus_and/or_Norovirus-like__KR904236
augaaaauggccucauccgacgccaacuccucugacggcucagcagccaaccucgucccagaaguaaauaacgaagucauggcacucgaacccgucguaggcgcugccaucgcagccccagucgccggccaacaaaacguaauugacccauggauacgcaacaacuucguccaagcuccuggcggugaguucacaguaucgcccagaaaugcccccggcgaaauccuuugguccgccccgcuaggccccgaccucaaccccuaccuaucccaccuugcaagaauguacaacggauacgccggcggcuucgaaguccaaguuauacucgccggcaacgccuucaccgcgggaaaaaucaucuucgcagccguucccccaaacuuuccaacagaaggccucucccccucccaagucaccauguucccccacauaauagucgacguccgacaacuagaaccgguacucauaccauuacccgacguccgaaacaacuucuaccacuacaaccaaucuaacgacccaaccaucaaacuuaucgcaaugcuauacaccccacuuagagccaauaacgccggcgacgacgucuucacagucuccugccgcguccuaacccgccccucccccgacuucgacuucauuuuccucguacccccuaccgucgaaucucgcaccaaacccuucuccgucccaauccucaccgucgaagaaaugacgaacucacgcuuccccauaccccucgaaaaacuauucaccggccccuccucagccuucgucguccaaccccaaaacgggcguugcaccacagacggaguccuauuaggcaccacccaacucagccccgucaacaucugcacauuccgcggcgacguuacacacaucaccgguucccgcaacuacaccaugaaccucgcuacccaaaacuggaacuccuacgacccuaccgaagaaauccccgcaccccuaggcaccccagacuucguaggaaaaauccaaggcguucugacccaaacuacaaaaacagacggauccacaagaggccacaaggccaccgucuauaccggguccgccgacuuugcacccaaacucggccgcguacaauuugccaccgacaccgacaacgacuucgaagcaaaccaaaacaccaaauucacaccaguuggcgucauccaagacggcggcaccacacaccgcaacgaaccccaacaauggguacuacccuccuacucaggacgcaauacacacaacguccaccucgcccccgccguagcccccaccuuccccggagaacaacuacuguucuuccgcucuaccaugcccggaugcucaggauaccccaacauggacuuagauugccuccucccccaagaauggguccaauacuucuaccaagaagccgcacccgcccaaucagacgucgcacuccuccgcuuugucaaccccgacaccggccgaguccuauucgaaugcaaacuucauaaauccggcuacguaacagucgcccacaccggcccucacgaccuaguaaucccacccaacgguuauuuccgcuucgacucguggguaaaccaauucuacacacuagcccccaugggcaacggcacaggacgccgccguuga

SEQ ID NO: 38348 - RNA, 1617 nt, Artificial Sequence
  derived and/or modified sequence opt11 from VP1__Norovirus_and/or_Norovirus-like__KR904225
augaaaauggccucgucagacgcaaaccccucugaaggauccaccgcaucucuaguccccgaaguaaacaacgaagucauggcacucgagcccguagccggcgcagccauugccgcaccaguugcaggccaagucaacguaaucgaccccuggauacgcaacaacuucguacaggcacccggcggcgaauuuaccgucucccccagaaacgcccccggugaaauccucuggucagccccacucgguccagaccucaaccccuaccuaucacaccuugcacguauguacaacggauaugcaggcggcuucgaaguccaagucauccucgcaggcaacgcauucaccgccggcaaaaucauauucgccgccguacccccaaacuucccaacagagggucucucaccaucucaagucacaauguucccccacaucaucgucgacguccgccagcucgaaccaguccucaucccccuccccgacguccgcaacaacuucuaccacuacaaucaauccaacgaaccaaccauaaaauuagucgcaaugcucuacacaccccuccgcgcaaacaacgccggcgacgacguauucacuguauccugccggguacucacaagacccucuccagacuucgacuucaucuuccuaguucccccuaccgucgaaucccgcacuaaaccauucuccguccccauccuaaccguugaagaaaugacaaacucccgauuccccaucccacuagaaaaacucuucaccggcccauccuccucauucguaguccaaccacaaaacggucgcugcaccaccgacggaguacuccuaggcaccacccaacuaucaccagucaacaucugcaccuuccgcggcgacgucacacacaucuccggcucacgcaaucacaccaugaaccucgcuucccaaaacuggaacucauacgaccccacagaagaaauccccgcgccccuaggaacaccagacuucgucggaaaaauacaaggcguacuaacccaaaccacacguuccgacggcuccacccgcggacacaaagccaccguauauaccggcuccgccgacuucagcccuaagcuaggcagaauccaauucgccacugacacugacaacgauuucgaaacaaaccaaaauaccaaauucacucccguuggagugauccaagacggcggcaccacccaccgcaacgaaccgcagcaauggguacucccaaccuacucaggacgcaauacccacaacguccaccuagcaccggccguagcacccacuuuccccggcgaacaacuacucuucuuccgcuccacaaugccgggcugcuccggcuaucccgauauggaccuugacugccugcuuccccaagaauggguccaacacuucuaccaagaagccgcacccgcccaaucagacgucgcacuacuaagauuugucaacccagacaccggccgaguacuuuucgagugcaagcugcacaaagccggcuacguaaccgucgcccacaccggccagcacgaccucgucaucccacccaacgguuacuuccgcuucgacagcugggucaaccaauucuucacccuagcccccaugggcaaugguaccggacgacgccgcuaa

SEQ ID NO: 38349 - RNA, 1617 nt, Artificial Sequence
  derived and/or modified sequence opt11 from VP1__Norovirus_and/or_Norovirus-like__LC005710
augaaaauggccuccaacgacgccaacccaucagacggcucagccgcuaaccuggucccugaggucaacaacgaaguaauggcccucgagcccgucgucggcgcggccauagccgcacccgucgcaggccaacaaaacgucauagaccccuggauacgcaacaacuucguccaagcccccggcggcgaguucacagucucgccccgcaaugcccccggcgaaauacucugguccgccccacucggccccgaccuaaaccccuaccucucccaccucgcacgcauguauaacggcuacgcaggcgguuucgagguccaagucauccucgcuggaaacgcauucacugcaggcaaaaucauauucgccgccgucccucccaacuuccccacagaaggccuaucccccucgcaagucaccauguucccccauaucaucgucgacguccgccaacucgagcccgucuuaaucccccuaccagacgucagaaacaacuucuaccacuacaaccaaagcaacgacuccaccauaaaacuaaucgcaaugcuuuacacgccccuccgugccaacaacgcaggcgaggacgucuucaccgucuccugccgcguccucacccgccccucccccgacuucgacuucaucuuccucgugccacccacagucgaaucacgcaccaaacccuucaccguacccacccucaccgucgaagaaaugaccaacucacgcuuccccaucccccucgaaaaacuauuuaccggcccaucaucagcauuuguaguccaaccccaaaacggacgaugcacaaccgacggcguucuccucgggaccacacaacuaucacccgucaacaucugcaccuuccgcggcgaugucacccacauagccggcucccgagacuacaccaugaaucucgccucccucaacuggaacaauuacgaccccaccgaagaaauccccgccccacucgggacccccgauuucgucggcaaaauccaaggcgugcuuacccaaaccacaaaaggagauggaagcacccgaggacacaaagccacaguuuacacaggaucugcaccauucacccccaaauuaggcuccguccgcuucucgaccgacacagaaaacgacuuugaaacccaucaaaauaccaaauucaccccagucggagucauccaagacggcucaaccacccaccgcaacgaaccccaacaauggguccuucccuccuacuccggccgcgacguacacaacguccaccuagccccugccgucgcaccaaccuuccccggagaacaacuccucuucuuuagauccaccaugcccggcugcuccggcuaccccaacauggaccuagacugccuccucccccaagaauggguccaacacuucuaccaagaagccgccccagcccaauccgaugucgcacuucuccgcuucguaaaccccgacaccggacgaguccuauuugaaugcaaacuacacaaauccggcuacgucacgguugcccacacaggccaacacgaccuaguaauaccucccaacggcuacuucagauucgacuccuggguuaaccaauucuacacacucgccccgaugggaaauggcacaggacgccgacgcuaa

SEQ ID NO: 38350 - RNA, 1617 nt, Artificial Sequence
  derived and/or modified sequence opt11 from VP1__Norovirus_and/or_Norovirus-like__LC018709
augaaaauggccuccuccgacgcaaaccccuccgauggcuccgccgcaaaccucguccccgaaguaaacaacgaagucauggcacucgaacccgucgucggcgccgccaucgcagcccccgucgccggacaacaaaacgucaucgaccccuggauccgcaacaauuucguacaagcccccggaggcgaguucaccgucucaccccgcaacgcuccaggcgaaauccuaugguccgcuccccuaggcccagaccucaaccccuaccucucccaccuagccagaauguacaacggauacgccgguggcuucgaaguccaagucauccucgccggcaacgccuucaccgccggaaaagucaucuucgccgccgucccacccaacuucccaacagaaggccucucccccucucaaguaacuauguucccccacaucgucgucgacguccgacaacuggaaccaguacuuauaccacuacccgacguccgcaauaacuucuaccacuacaaccaauccaaugaccccacgaucaaacuaaucgccaugcucuauacaccacuucgcgcaaacaacgcuggcgacgacgucuucacuguaucaugccguguccuaacccgaccaucaccagauuuugacuuuaucuuccucguaccaccuacaggcgaaucaagaacgaagcccuucuccguccccguacugacagucgaagaaaugaccaacagccgauuccccaucccccucgaaaaacucuucaccggacccuccagugccuucguaguccaaccccaaaacggcagaugcacaaccgacggaguccuacucggcaccacccaacucucaccagucaacaucugcaccuuucggggcgacguaacccacaccacaggcucacacaacuacaccaugaaccuagcaucacaaaacuggaacaacuacgaccccaccgaagaaaucccagcaccccugggcacccccgauuucguaggcaaaauccaaggaaugcucacucaaacuacccgcaccgacgguuccacccgaggacacaaagccacuguguacacaggaucagccgacuucgcccccaaacuuggccgcguucaauucggcaccgacaccgaccacgaucucgaagccaaccaaaacacaaaguucacaccagugggcguaauccaagacggcucuaccacccaccgcaaugaaccacaacaauggguccuaccauccuauucaggacgcaacaccccaaauguacaucuagcccccgccgucgccccaaccuucccaggcgagcagcuucucuucuuccgcuccacuaugcccgguugcucuggcuaccccaacauggaccucgacugccuccucccccaagaauggguccaauacuucuaccaagaggccgcccccgcccaauccgacgucgcacugcuccguuucgucaacccugacacaggccgcguucucuucgaaugcaaacuccacaaauccggcuacguaaccgucgcacacaccggacaacacgacuuagucaucccacccaacggcuacuuccgauucgacucuuggguaaaccaauucuauacacuggcccccaugggcaacggaacuggccgccgccgguaa

SEQ ID NO: 38351 - RNA, 1617 nt, Artificial Sequence
  derived and/or modified sequence opt11 from VP1__Norovirus_and/or_Norovirus-like__KM198587
augaaaauggccuccaacgacgcaaacccauccgacggcucagccgccaaccucguccccgaagucuccaacgaaguuauggcccuagaaccaguaguaggagcagccaucgcagcccccgucgccggccaacaaaauguaaucgaccccuggauccgcaauaacuucguccaggcaccaggcggugaguucacagucuccccucgaaacgcccccggcgaaauccucugguccgccccgcucggccccgaccuaaacccauaccucucacauuuagcccgcauguacaacgguuacgccggcggcuucgaaguccaaguaauccucgcaggcaaugccuucaccgccggcaaaaucauauucgccgccguaccacccaacuuccccaccgaaggccucucccccucacaagucacaauguucccccacaucaucguagacguccgccaacuagaaccaguccucaucccccuccccgacguucgcaacaacuucuaccacuacaaucaaaccaacgacaguaccaucaaacuaauagcaaugcucuacacaccccuuagagccaacaacgccggcgaagacgucuucaccgucuccugucgcguccucacccgcccaucuccagacuucgacuucauauuccucguacccccaacagucgagucccguaccaaaccauucaccgucccaauccuuacagucgaagaaaugaccaacucccgauuucccaucccccuugaaaaacucuucaccggcccuuccggagcauucgucguccagccgcaaaacggccgaugcaccaccgacggcguucuccucgguacaacgcaacucucccccgucaacauaugcaccuuccgcggcgacgucacccauauagcaggaucccgaaauuacaccaugaaccucgccagccucaacuggaauaauuacgaccccacagaagaaauccccgcaccccuaggaacccccgacuucgucggcaagauacaaggcguccugacccaaaccacaaaagaagacggcuccacccgcggacacaaagccacaguauacaccggcuccgccccuuucacccccaaacuaggcucaguccaauucuccacagacaccgagaacgacuucgaaacccaccaaaacaccaaauucacccccgucggagugauccaagacggaggcaccacccaccgaaaugaaccccaacaauggguccuccccagcuacagcggucgcgacguccacaacguccaccuagcccccgcugucgcaccaaccuuccccggcgaacaacuccuguuuuucagauccaccaugccaggcugcuccggcuaccccaacauggauuuagacugccuccucccccaagaauggguacaacacuucuaccaagaagccgcacccgcccaaucagacgucgcccuccuacgcuucguaaaccccgauaccggccguguacucuucgagugcaaacuacacaaauccggauauguaaccguagcccacaccggccaacacgaccucguaauuccgcccaacggauacuuucgcuucgacuccuggguaaaccaauucuacacccucgcccccaugggaaacggcacuggccggcgacguuaa

SEQ ID NO: 38352 - RNA, 1617 nt, Artificial Sequence
  derived and/or modified sequence opt11 from VP1__Norovirus_and/or_Norovirus-like__KM198560
augaaaauggcaucaaacgacgccaauccaucggacggaucagccgccaaccucgucccugaagucaacaacgaagucauggcccuagaaccagucgucggcgccgcgauagccgcucccguagccggccagcaaaaugucaucgaccccuggauccgcaacaacuucguccaagccccuggcggcgaguucaccgucucuccccgcaacgcccccggcgaaauacuauggucagccccucucggccccgaccucaaccccuaucucucacaccucgcccgcauguacaacggcuacgcaggcgguuucgaaguacaaguuauccuugcaggcaacgcauucaccgccgguaaaaucaucuucgccgccguaccgcccaacuuccccaccgaaggccucagccccucccaaguuaccauguucccccacaucauaguugacguccgccaacuggaacccguucuaaucccacucccagacguucgcaacaacuucuaccacuacaaccaauccaacgauucuacaaucaaacugaucgcaaugcuauacaccccgcucagagcuaacaaugccggcgaagacgucuuuacaguaucaugccggguauuaacccgcccaucacccgacuuugacuucaucuuucucgucccacccacaguagaaucccgcacaaaaccauucaccguccccauccucacagucgaagaaaugaccaacucccgauuccccaucccacucgaaaaacuuuucacaggccccucuggcgccuucaucguacaaccacaaaacggacgaugcacgacagacggcguccuucuaggcaccacccaacucuccccggucaacauaugcaccuuccgcggagacgucacccacaucgcagguucacgcaacuacaccaugaaccuagccucccucaacuggaacaacuacgacccaaccgaagagauccccgcaccacucggaacuccagacuucgucggaaaaauccaaggcguccuuacccaaaccaccaaaggcgacggauccacacgcggccacaaagcgaccguuuacaccggaucagcccccuucacccccaaacucggcagcguccaauucucaaccgacacagaaaacgauuucgaagcccaccaaaacaccaaauucaccccugucggcgucauacaagacggcggcaccacccaucgaaacgaaccccaacaauggguccuucccucauacuccggccgugacguccacaacguccaccucgcaccagccgucgcacccacauuccccggcgaacaacuacuauucuuccgcucaaccaugccaggcugcucaggcuaccccaacauggaccuagacugccuucuaccacaagaauggguccaacauuuuuaccaagaggccgcccccgcccaauccgacgucgcacucuuacgauucgucaaucccgacaccggccgcguccucuucgaauguaaacuccacaaauccggauacgucaccguugcacacaccggacaacacgaccucguaaucccacccaacggcuauuuucgauucgacucauggguaaaccaauucuacacccucgccccaaugggaaauggaacaggccgccgccgauaa

SEQ ID NO: 38353 - RNA, 1617 nt, Artificial Sequence
  derived and/or modified sequence opt11 from VP1__Norovirus_and/or_Norovirus-like__KM198521
augaaaauggcauccaacgaugcuaaccccuccgacggcucagccgccaaccucgucccugaagucuccaaugaagucauggcccucgaacccgucgucggagccgccauagccgcacccgucgccggacaacaaaacguaauagaccccuggauccgaaacaacuucguccaagcaccaggcggugaguucaccguaucaccccgcaacgccccaggcgaaauccuaugguccgcaccccuuggucccgaccucaaccccuaccucucucaccucgcccgcauguauaacggauacgcaggcggauucgaaguacaagucauccuagccggaaacgccuucaccgccgguaaaaucauuuucgccgccguacccccaaacuuccccaccgaaggccuuucacccucccaagucaccauguucccacacauaaucgucgacguacgacaacucgaaccaguccucaucccccuuccagacguccgcaacaauuucuaccacuacaaccaaaccaaugacuccaccaucaaauuaaucgccaugcucuacacaccccuuagggccaacaacgcaggcgaagacgucuuuaccgucucaugccguguccucacacgaccaucaccagacuucgacuucauauuccucgucccuccaacaguagaaucacgaacgaaaccauucaccgucccaauacucacaguagaagaaaugaccaacucgagauuccccauucccuuagaaaaacucuuuaccggccccuccggagccuucguaguacaaccccaaaacggccggugcaccaccgacggcguccuacuaggcacgacccaacuauccccugucaacaucugcgcauuccgaggcgacgucacgcacauagccggcuccagaaauuacaccaugaaccucgcaucgcucaacuggaacaacuacgaccccaccgaagaaauaccagccccacuagguacacccgacuucgucggcaaaauccagggcgucuuaacacaaaccaccaagggagacggauccacccgcggccacaaagccacugucuauaccggcuccgcccccuucacacccaaacucggcuccguacaauucucaacugacaccgaaaacgacuucgagacccaccaaaacaccaaguucacccccguuggagucauccaagauggcggaacaacucaccgaaacgaaccacaacaguggguccuccccagcuacagcggccgagacguccacaacguucaccuagccccugccgucgcucccaccuuccccggugaacaacuacucuucuuccguuccaccaugccaggauguuccggcuaccccaacauggaccucgacugccuccucccccaagaauggguccaacacuucuaucaagaagccgcccccgcccaauccgacgucgcccugcuccgcuucgucaacccagacaccggccgaguccucuucgaaugcaaacuccacaaauccggauacgucaccgucgcccacacaggccaacacgaccucguaaucccaccuaacggcuacuuccgcuucgacuccugggucaaucaauucuacacccucgcccccaugggcaacggcaccggccgcagacguuaa

SEQ ID NO: 38354 - RNA, 1617 nt, Artificial Sequence
  derived and/or modified sequence opt11 from VP1__Norovirus_and/or_Norovirus-like__KM198490
augaaaauggccucuaacgaugccaacccguccgacggcuccgccgcuaaccuaguccccgaagucucaaacgaagucauggcacucgaacccguagucggagccgccaucgccgcccccgucgccggccaacaaaacgucauagaccccuggauccgaaacaacuucguacaagcccccggcggcgaauuuaccgucagcccccgcaacgccccuggcgaaauccuaugguccgcaccccucggccccgaccucaaccccuacuuaucccaucucgcccguauguacaacggcuaugccggcggauucgaagugcaggucauccucgccgguaacgcauuuaccgcaggcaagauaauauucgccgccguaccacccaacuuucccaccgaaggccuaucccccucacaaguaaccauguucccccacauuauaguugacguccgccagcucgagcccguacucaucccccuccccgacguccgaaacaacuucuaccacuauaaccaaaccaacgacuccaccauaaaacuuaucgccaugcucuacacaccacuccgugcaaacaacgcaggagaagacguuuucacagucucaugccgcguguuaacccgcccaagcccagacuucgacuucaucuuucucgucccuccuaccgucgaauccagaacaaaacccuucaccguuccaauccucacagucgaagaaaugaccaacuccagauuucccauaccacuagaaaaacuauucacaggcccaucaggugccuucgucguacaaccccaaaacggccgcugcacaacagacggaguccuccucggcaccacgcaacuaucccccgucaauauaugcaccuuccgcggcgacauaacacacaucgccggaucccgcgacuauaccaugaaucucgccucccuaaacuggaacaacuacgaccccaccgaagaaaucccagcaccccucggaaccccugacuucgucggcaagauccaaggcgucuuaacccagaccaccaaacgagacgguucuacucgaggccacaaagccacagucuacacaggcuccgcaccauucacccccaaacucggcucaguccgauucagcaccgacacagaaaacgacuucgaaacacaccaaaacaccaaauucacccccguaggcgucauacaagacggcagcaccacccaucgcaacgaaccccaacaauggguccuacccuccuacuccggccgcgacguccacaacguccaucucgcacccgccguggccccaaccuuccccggcgaacaacuccuauucuuuagauccaccaugcccggcugcucgggcuaccccaacauggaccucgacugccuccucccccaagaauggguccaacacuucuaccaagaagccgcccccgcccaaucagacguagcccugcuccgcuucgucaaccccgauaccggccgaguccuauucgaauguaaacuccacaaauccggauacguuaccguagcccacaccggccaacacgaccuugucaucccacccaacggauacuuccgauucgacagcugggucaaccaauucuacaccuuagcccccaugggcaacggcaccggccgccgccguuga

SEQ ID NO: 38355 - RNA, 1617 nt, Artificial Sequence
  derived and/or modified sequence opt11 from VP1__Norovirus_and/or_Norovirus-like__KC409241
augaagauggcauccuccgacgccaaccccuccgacggcuccacagccaaccuaguacccgaagucaauaacgaaguaauggcacuagaaccaguaguuggcgccgccaucgccgcccccguagccggccaacaaaaugucauagacccauggauccgcuccaacuucguacaagcccccggcggcgaguucacugucucuccccguaacgccccuggagaaauccucugguccgccccacuaggccccgaccugaacccauaucuaucccaccuagcacgcauguacaacggcuacgcaggcggcuucgaaguccaagucauccucgccggcaacgcuuuuaccgcaggcaaaauaauauucgccgccgucccaccaaacuucccaacugaaggccucucccccucccaagucaccauguucccccacaucauagucgacguucgccaacucgaacccguacuaaucccccuacccgacguccgcaacaacuucuaccacuacaaccaaucaaacgaccccacaaucaaacuaaucgcaaugcucuacacaccccuccgcgccaacaacgccggcgacgacgucuuuaccgucucuugccgcguccuaacacgccccucacccgacuucgacuucaucuucuuaguaccacccacagucgaaagccgcaccaaaccauucagcguccccguccuaacagucgaagaaaugaccaacucccgcuuccccauaccacuugagaaacucuuuaccggccccucauccgccuucguuguccagccccagaacggccgcuguaccacagacggaguacuacuagguaccacccaacucuccccaguaaacauaugcacauuccgcggcgacguaacccauauccccggaucuaggaacuacaccaugaaccucgccucccaaaacuggaacucauacgacccaacggaagaaauacccgcaccacuaggaacccccgacuucgucggcaaaauacaaggcguacuaacccaaaccacacgaaccgacggcuccaccagaggacauaaagccaccguauacacaggcuccgccgacuuuucaccaaaauuaggacgaguccaauuugccaccgacaccgauaacgacuucgaaacaaaccaaaacaccaaauucacuccugucggcguaauacaagacgggucuaccacacaccgaaacgaaccccaacaauggguccucccauccuacucagggcgcgacguccauaacguccaccuagcaccagcagucgcaccaacguucccaggcgagcaacuucucuucuuccgcuccaccaugccgggcugcuccggcuaccccaacauggaccucgacugucuccucccccaggaauggguccaauacuucuaccaagaagccgcccccgcccaauccgacgucgcacuccuccgcuucguaaacccugacacaggacgcguccuuuucgaaugcaaacuccacaaauccggcuacgucacaguggcccacaccggacaacacgaccuugucaucccaccuaacggcuacuuccgcuucgacucaugggucaaccaauucuacacccucgcgccaaugggcaauggcaccggucgcagacgauag

SEQ ID NO: 38356 - RNA, 1617 nt, Artificial Sequence
  derived and/or modified sequence opt11 from VP1__Norovirus_and/or_Norovirus-like__JX459625
augaaaauggccucaaaugacgccaaccccuccgacggcuccgccgccaaccucguacccgaaguaaacaacgaagucauggcacucgagcccguagucggagcagcaaucgccgcacccguugccggccaacaaaaugucaucgacccauggauccgcaacaacuucguacaggccccgggcggagaguucacaguaagcccccgaaaugccccaggcgaaauacucugguccgccccacucggacccgaccucaaccccuaccuaucccaucucgcucgcauguacaacggcuacgccggcggauucgaaguccaagucaucuuagcaggaaacgccuucaccgcuggcaaaaucaucuucgcagcaguaccucccaacuuccccaccgaaggauuaucccccagccaagucacuauguucccccacaucaucgucgacguccgccaacucgaacccguacuaaucccccucccagacguaagaaacaauuucuaccacuacaaccaauccaacgacucaaccaucaaauuaaucgcaaugcuguacacaccccuacgcgccaacaacgcaggcgaagacgucuucaccgucucaugccgaguacucacccgccccucacccgacuucgacuucaucuuccucguaccacccaccgucgaaucccguaccaaacccuucacagucccaauacuaacugucgaagaaaugaccaauucccguuucccuauaccacuagaaaaacucuucacaggaccaucaggagccuucgucguccaaccccaaaacggacgcugcacaaccgacggcguccuccucggcaccacccaacucuccccagucaacaucugcaccuuccgcggcgacgucacccauauagccggcacaagaaacuacacaaugaaccucgccucacucaacuggaacaacuacgacccaaccgaagaaauccccgcgccccucggaaccccagacuuugucggcaagauccaaggcguacucacccagacaacaaaaggcgacggaucuacccgcgggcacaaagcuacagucuacaccggcuccgcaccauucacaccaaaacuagguucuguccaauucucaaccgauaccgaaaacgacuucgaaacccaucaaaacacaaaauucacacccguaggcgucauucaagauggcggcaccacccaucgaaaugaaccacaacaauggguacucccuagcuacucaggaagaaauguucacaacguacaccucgcccccgccgucgcccccacauucccaggcgaacaacuccucuucuuucgcucaaccaugcccggcugcuccggcuaccccaacauggaccucgacugcuuacucccccaagaauggguccaacauuucuaccaagaagccgcccccgcccaauccgacgucgcacuuaugcgcuucgucaauccagacaccggccgcguccucuucgaaugcaaacuccacaaauccggcuacguaaccguagcccacaccggccaacacgaucuagucaucccacccaacggcuacuuccgcuucgacuccugggucaaccaauuuuacacacucgcccccaugggcaacggcacuggacgccgaagauaa

SEQ ID NO: 38357 - RNA, 1617 nt, Artificial Sequence
  derived and/or modified sequence opt11 from VP1__Norovirus_and/or_Norovirus-like__JX459613
augaaaauggccucgaacgacgcccacccuuccgacggcuccgccgcaaaccuggucccagaaguaaacaaugaagucauggcuuuagaaccagucgucggagcagcaauagccgcucccgucgcagggcaacaaaacgucaucgacccuuggauacgaaacaacuucguccaagccccuggcggcgaauuuaccgucucaccccgcaacgcaccaggcgaaauccucugguccgcuccccucggccccgaccucaaccccuaccuaucccaccucgccagaauguauaauggcuacgcaggcggcuucgaaguccaagucauucucgccggcaacgccuucacugccggcaaaauaauauucgccgccgucccacccaacuucccuacagaaggacucucucccagccaggucaccauguucccccacaucaucguagacguccgacagcuagaaccuguacucauaccacuccccgauguccgcaacaauuucuaccacuauaaccaauccaacgacagcaccaucaaacucauagccaugcucuacacaccacuacgagccaacaacgcaggcgaagacguuuucacggucaguugccgcguccuaacucgcccaucaccggacuucgauuucaucuuccuaguacccccuaccguugaaucacgcaccaaacccuucaccguccccauccuaaccgucgaagaaaugaccaacagccgauucccaauuccccucgaaaaacucuucacaggaccauccggcgcauucgucguccaaccccaaaacggccguugcaccaccgacggcguccucuuaggcaccacccaacucucaccaguaaacaucugcaccuuccgcggcgacguaacccacaucgccggaucccgcaacuacaccaugaaccucgcaagccucaacuggaacaacuacgaccccacagaagaaauaccugcaccccucggaacaccagacuucgucggaaaaauccaaggaguccucacacaaacaaccaaaggcgacggauccacgcgcggccacaaagccacagucuacacuggcuccgcccccuucaccccaaaacugggcagcguacaauucucaaccgacaccgaaaacgacuucgaaacccaccaaaacaccaaauucacccccgucggcgucauccaagacggaggcaccacccaccgcaacgaaccccaacaauggguccuccccuccuacucaggacguaauguccacaacguccaccucgccccugccgucgcccccaccuuccccggagaacaacuccuauuuuuccgaucaacaaugcccggcugcuccggcuaccccaacauggaccuggacugccuucucccgcaagaauggguacaacacuucuaccaagaagcagcccccgcccaaucagacguagcccuacuccgcuucgucaaccccgacaccggcagagucuuauucgaaugcaaacuccacaaauccggcuacguaacaguugcacacacgggucaacacgaucuaguaaucccacccaacggauacuuccgcuucgacuccuggguuaaucaauucuacacccuggcccccauggguaacggaaccggacgccgccgauaa

SEQ ID NO: 38358 - RNA, 1617 nt, Artificial Sequence
  derived and/or modified sequence opt11 from VP1__Norovirus_and/or_Norovirus-like__JX459600
augaaaauggcauccaacgacgccaaccccucagacgguuccgcagcucaccuaguccccgaagucaacaacgaagucauggcacuagaacccguggucggcgccgcaaucgcggcaccagucgccggccaacaaaacgucaucgacccauggauccgcaacaacuucguacaagcccccgguggcgaguucacuguaagcccccgcaacgcaccaggcgaaauccuaugguccgcaccccuagggccagaccuaaaccccuaccuuucacaccuagcccgcauguacaacggcuacgccggcggauucgaaguccaaguaauccucgcaggcaacgccuucaccgccggcaagaucaucuucgccgcugugcccccaaacuuucccaccgaaggccucucuccuucacaaguaaccauguucccccacaucaucguagacguacgccaacuggaacccguacugaucccccucccugacguccgaaacaacuucuaucacuacaaccaauccaacgauuccaccaucaaacucaucgccaugcuauauacaccccuccgggccaauaacgccggagaagacgucuucaccgucuccugucgcguccuaacacgaccuucgcccgacuucgacuucauauuucuuguaccacccacagucgaaucacgaacaaaacccuucaccguaccgauccuaaccguagaggaaaugaccaacagcagauuccccaucccacucgaaaaacuauucacgggccccucaggcgccuucgucguacaaccgcaaaacggccgcugcacgaccgacggcguccuucuaggcaccacccaacucuccccagucaacaucuguaccuuccgaggcgacgucacccacaucgccggcucccgcaacuacacaaugaaccucgccucccucaacuggaacaacuacgaccccacagaagaaauccccgcaccccucggcacccccgacuucguuggaaaaauccaaggcguccuaacccaaaccaccaaaggagacggcucuacucgcggccacaaagccaccgucuacaccggcucagcccccuucaccccgaaacuuggcagcguccaauucucaaccgauaccgagaacgacuucgaaacgcaccaaaacaccaaauucacccccgucggagucauccaggacggauccaccacccaccgaaacgagccccaacaauggguccuaccuuccuacuccggccgcaauguccacaacguccaccuagccccggccgucgccccgacuuuccccggcgaacaacuacuauuuuucagauccacgaugcccggcuguuccggcuacccaaacauggaccucgacugccuccucccacaagaauggguccaacacuucuaccaagaagccgcccccgcccaauccgacgucgcccuacuccgcuucgucaaccccgacacaggccgcguccucuucgaguguaaacuccacaaaucaggcuacgucacaguagcccacacaggccaacacgaccuugucauucccccaaacggcuacuuccguuucgacuccuggguuaaccaauucuacacacucgcucccaugggcaacggcacaggccgacgccgcuaa

SEQ ID NO: 38359 - RNA, 1617 nt, Artificial Sequence
  derived and/or modified sequence opt11 from VP1__Norovirus_and/or_Norovirus-like__JX459596
augaaaauggccuccaacgacgcccaccccuccgacggauccaccgccaaccucguccccgaagugaacaacgaagucauggcccuagaacccguaguaggcgccgcaaucgccgcccccgucgcaggacagcagaacgucauugacccauggauccguaacaacuucguacaagccccagguggcgaguucacaguaucaccccgcaaugcccccggcgaaauauuaugguccgccccacucggccccgaccuaaaucccuaucucucccaccuagcccgaauguacaacggcuacgccggagguuucgaaguccaaaccauacuagcuggcaaugcauucaccgcaggcaaaaucaucuucgcagcagucccacccaacuuccccaccgaaggucuaucccccucacaagucacaauguucccacacaucaucgucgacguacgucaacucgaacccguacuaaucccccuucccgacguccgaaacaacuucuaccacuacaaccaaucaaaugaccccaccauaaaacucaucgcaaugcuauacacgccccuccgcgccaacaacgccggugacgacgucuucaccguauccugccggguacucacccgccccucaccugacuucgacuucaucuuccucgucccacccaccgucgaauccagaaccaaacccuucaccguccccauccuaaccgucgaagaaaugacaaacucccgcuuccccaucccccuagaaaaacucuucacaggaccaucaucagccuucguaguccaaccacaaaacggccgaugcaccaccgacggaguccuccucggcaccacacaacucucaccugucaacaucugcaccuuccgaggggacgucacccacauagccggaacccacaauuacacaaugaaccucgccucccaaaacuggaacaacuacgaccccacugaagaaaucccagcaccccuaggcacaccagacuucgucggaagaauacagggaauguuaacucaaaccacccgcggcgacggauccacacgaggccacaaggccaccgucagcaccggcgacguacacuucacccccaaacucggcuccauacaauucaacacugacacaaauaacgacuucgaaaccggccaaaacaccaaauucacaccagucggcgugguccaagauggaaacgguacccaccaaaacgaaccccaacaauggguccuccccucauacucuggcaggaccggccacaacguacaccuagcccccgccgucgccccaacauuccccggugaacaacuacuuuucuuccgcuccaccaugccaggaugcuccgguuaccccaacaugaaucuagacugccuccucccacaagaauggguacaacauuucuaucaagaagccgcuccagcccaaucugacgucgcccuucucagauucgucaaccccgacacaggccgaguacucuuugaaugcaaacuccacaaaucaggauacgucaccgucgcccacacaggccaacacgaccucguaauaccacccaacggcuacuuccguuucgacucaugggucaaccaauucuacacccucgcccccaugggcaauggcacgggccgcagacgauaa

SEQ ID NO: 38360 - RNA, 1617 nt, Artificial Sequence
  derived and/or modified sequence opt11 from VP1__Norovirus_and/or_Norovirus-like__JX155749
augaaaauggccagcaacgacgcaaaccccucagacggcagcgccgccaaccuugucccugaagucaacaacgaaguaauggcccucgaaccagucgucggagccgcuaucgcggcccccguagccggacaacagaacgucaucgaccccuggauccgcaacaacuuuguccaagccccaggcggcgaauuuaccgucagcccccgcaaugcccccggcgaaauacuguggucagcuccccucggccccgaucuaaaccccuaccuuucucaccucgcccgcauguacaacggcuacgcaggcggcuucgaaguccaagucauacucgccgggaacgccuucacagcuggaaagaucaucuucgcagccguuccaccuaacuucccaacagaaggccuaucaccuucacaagucaccauguucccccacauaaucgucgacguccgacaacucgaacccguacucaucccacucccagacguaagaaacaacuucuaccacuacaaccaauccaacgacucaaccaucaaacucaucgccaugcuauacacgccccuccgcgccaacaacgcaggcgaagacgucuucaccguuucuugccgcguccugaccagaccuucacccgacuucgacuucauauuccuuguaccacccaccguagaauccagaacuaaacccuuuaccgucccaauccuaaccgucgaagaaaugacaaacuccagauuccccauaccacucgaaaaacucuucaccggaccaucuuccgcauucgucguccaaccccaaaacggccgcugcacaacagacggcguccuccucgguaccacccaacuaucccccguaaacaucugcaccuuccgcggcgacgucacccacaucgccggcagccguaacuacaccaugaaccuagccucacuuaacuggaacaacuaugacccgacugaagaaauccccgccccacucgguaccccagacuucguaggaaaaauacaaggcguacuaacccagaccacuaagggcgacggcuccacacgcggccacaaagccacaguauacaccggcuccgccccauucacccccaaacucggcucgguacaauucuccaccgacacagaaaacgacuucgaaacacaccagaauaccaaauucacaccagucggcguuauccaagacggaggcaccacacaccgaaacgaaccccaacaauggguccuacccuccuacagcggccgcaacguccccaacguccaccucgcccccgccgucgcccccacauuccccggcgaacagcuccucuucuucagaucuaccaugcccggcugcagcggcuacccaaauauggaccucgacugccuccucccccaagaauggguccaacacuucuaccaagaagcagcccccgcacagucagacguagcccuacuacgauucgucaaccccgacaccggccgcguccuauucgaaugcaaacuccacaagcccggcuacguaaccgucgcccacaccggucaacacgaccucguuaucccacccaauggcuacuuccgcuucgacucuugggucaaccaauucuacacccuagcacccaugggaaacggcacaggccgacggcgcuaa

SEQ ID NO: 38361 - RNA, 1617 nt, Artificial Sequence
  derived and/or modified sequence opt11 from VP1__Norovirus_and/or_Norovirus-like__JQ613511
augaaaauggcauccagugaugcaaaccccucagacggcuccaccgcgaacuuaguacccgaagucaacaaugaagucauggcccucgaacccgucguaggcgccgccauagccgcccccguugccggccaacaaaacguuaucgauccguggauacgcaacaacuucguucaagccccaggcggcgaguucaccgucucuccccgaaacgccccaggcgaaauccugugguccgccccacucggacccgaccucaacccauaccucucccaccucgcccgaauguacaacagcuacgcaggcggcuucgaaguccaagucauccucgccggcaacgccuucaccgccggcaaaaucauuuucgcagcagucccaccaaacuuccccacagaaggccucucucccucacaagucaccauguucccccacaucauagucgacguacgacaacucgaacccguccucaucccgcucccagacguccgcaacaacuuuuaucacuacaaccaauccuccgacccgacuauaaaacuaaucgcaaugcuuuacacuccccuccgcgcaaacaaugccggcgacgacguauucaccgucagcugccgcguccuaacccgccccucucccgacuucgacuucaucuuccucgucccuccaacagucgaaucacgaacaaaacccuucucaguacccauccuuaccguagaagaaaugacaaacucacgcuuuccuaucccccucgaaaaacuauucacagggcccuccucagccuucgucguccaaccacaaaacggccgcugcaccaccgacggaguccuccuaggcacaacccaacucucccccgucaacauaugcacuuuccgaggcgacgucacacacauagccggaacccaagaguacaccaugaaccuggccucccaaaacuggaacaacuacgacccaaccgaggaaauuccagcaccccugggcaccccggauuucguaggcaaaauccaaggaguacuaacacaaaccacccgccgcgacggauccacccgcggucacaaagccaccgucuccaccgguucuguccacuucacaccuaaacucggccgaauccaauucuccaccgacaccuccaacgacuucgaaacuggccaaaacacccgauucacccccguaggcguaguccaagauggcagcacaacccaccaaaacgaaccacaacaauggguacucccaaacuauagcggccgagacucucacaacguccaccuagcccccgccguagccccauccuuccccggagaacaacuccucuucuuccgcuccacaaugcccggaugcuccggcuacccaaacauggaucuugacugccugcuaccccaggaauggguccaacacuuuuaccaagaagccgcacccgcacagucagacgucgcccuucuucgcuucguuaaccccgacaccggccgagugcucuuugaaugcaaacuccacaaaucaggcuacgucacggucgcacacacaggucaacacgaccucguaauuccacccaacggcuacuuccguuucgacucuugggucaaccaauucuacacccucgcacccaugggcaacggcacaggucggcgcagauga

SEQ ID NO: 38362 - RNA, 1617 nt, Artificial Sequence
  derived and/or modified sequence opt11 from VP1__Norovirus_and/or_Norovirus-like__HM802547
augaaaauggccagcucagacgccucccccuccgacggcucugccgccaaccucgucccggaagucaacaacgaaguuauggcccuagaacccgucgucggcgccgcaaucgcagccccagucgcgggccaacagaauguaaucgaccccuggauccgaaacaacuucguccaagcacccggaggcgaauuuaccgucuccccacgcaacgcacccggcgaaauccuaugguccgcaccccuaggccccgaccugaaccccuaccucagccaccuagcccgcauguacaauggcuacgcaggaggauucgaaguccaagucauccuugcaggaaacgccuucaccgccggcaaaaucauauucgcagcaguaccaccaaacuucccuaccgaaggucucucccccucccaaguuaccauguucccacacaucauuguagacguccgacaacucgaacccguacuaauuccccuacccgacguacgaaacaacuucuaccacuacaaccaauccaacgacuccaccaucaaacuaaucgcaauguuauacacuccccuacgagcaaacaacgccggcgacgacgucuucaccgucuccugcagaguccuaacccgcccaucacccgacuucgacuucaucuuccucguacccccaaccgucgaaucccgcacaaaacccuucaccgucccaauccucaccgucgaagaaaugacgaacucacguuuccccaucccccuagaaaaauuauucaccggccccagcuccgcauucgucguacaaccgcaaaacggccgaugcacaaccgacggaguccuccucgguacaacccaacuauccccaguaaacaucugcaccuuccgcggugacgucacccacaucucaggcucccguaacuaccgaaugaaccuagccucccaaaacuggaacaacuacgaccccaccgaggaaauucccgccccacuaggcacgccagacuucguaggcaagauacaaggaaugcuuacccaaaccacaaaaggcgacggcagcacacggggacacaaagcaaccgucucaaccggcuccgucgacuucacccccaaacucggcucaguacaauucgccaccgacacagacaacgacuucgaaacagggcaaaacaccagauucacacccgucggaguaauccaagacggcuccucggcacaccgcaacgaaccccaacaauggguccuacccgacuacuccggccgcacaguccacaacguccaccuagcucccgccguagcucccacauuccccggcgaacaacuucuuuucuuccgcucaaccaugcccggcugcucaggcuaucccaacauggaccucgacugcuuacuaccccaggaguggguacaacacuucuaccaagaagcagcccccucacaauccgaugucgcacuccuucgauucgucaaccccgacaccggacguguucucuucgaaugcaaacuccacaaagccggcuacgucacagucgcccacaccggccaacacgaccucguaauucccccgaacggauacuuccgcuucgacucaugggucaaccaauucuacacccucgcacccaugggaaacggagccggccgccgccguuaa

SEQ ID NO: 38363 - RNA, 1617 nt, Artificial Sequence
  derived and/or modified sequence opt11 from VP1__Norovirus_and/or_Norovirus-like__HM802544
augaaaauggcauccaacgacgccacacccuccgauggcucaaccgcgaaccucgucccugaagucaacaacgaaguaauggcccucgaaccagucguaggcgccgccaucgcagccccagucgccggccaacaaaacgucauagacccuuggauccgaaacaacuucguucaggcacccgguggcgaguucaccgucucaccucgcaacgcaccuggcgaaauacucuggucagcaccccuaggcccggaccucaaccccuaucucucucaccuugcccgcauguacaacggcuacgccgguggcuucgaaguccaaguaauauuagccggcaacgccuucaccgcaggcaaaaucaucuucgcagcaguaccaccaaacuuccccacagaaggacucucccccucccaaguaacaauguuuccccacaucauagucgacguccgccaacuagaacccguacuaaucccacuaccagacguccgcaacaacuucuaccauuacaaccaauccaacgacuccaccaucaaacucauugcgaugcuguacaccccacuccgcgcaaacaacgcaggcgacgacguauucaccgucagcugccgaguccuaacccggcccucccccgacuucgacuucaucuuccucguaccaccuaccgucgaaucucgcaccaaacccuucucggucccgauccuuaccguagaagaaaugaccaauucccgauuccccauacccuuagaaaaacuauucaccggcccauccagcgccuucgucguacaaccccaaaacggccgauguaccacagacggcguccuccuaggcacaacacaacucucucccguaaacauaugcaccuuccgaggcgacguaacccacaucgccggcacccaaaauuacacaaugaaccucgcaucacaaaacuggaacaacuacgaccccaccgaagaaaucccagcaccccuaggcacccccgacuucguaggcaaaauucaaggaguccuaacccaaaccacccgccgugacggcuccacccgaggccacaaagccaccgucucaaccggauccguccacuucacccccaaacuaggcagcguccaauucucaacugacacuuccaacgacuucgaaaccggacaaaacacacgcuucaccccagucggcguaguccaagacggcuccaccacccaccaaaacgaaccucaacaauggguacuccccgacuauuccggccgugacucacacaacguacaccuugccccagccguagcacccaccuuccccggugaacaacuacuauucuuccgcucaacaaugccaggaugcuccggcuaccccaacaugaaccucgacugccuacuuccacaagaguggguucaacauuucuaucaagaauccgcccccgcccaauccgacgucgcucuccugcgauucgucaacccagacaccggccgaguccucuucgaaugcaaacuucacaaaucuggcuacgucaccguagcccacacuggccaacacgaccuagucauacccccaaacggcuacuuccgauucgacuccugggucaaccaauucuacacacucgccccuaugggcaacggcgcuggccgaagacguuag

SEQ ID NO: 38364 - RNA, 1617 nt, Artificial Sequence
  derived and/or modified sequence opt11 from VP1__Norovirus_and/or_Norovirus-like__GQ856456
augaaaauggccuccaacgaugccaaccccucagacgguuccgccgccaaccucguacccgaagucaacaaugaaguaauggcccuugaacccgucgucggcgcugcgaucgccgcccccgucgcaggccagcaaaacguaaucgaccccuggauccgaaacaacuucguccaagcccccggcggagaguucaccgucagccccagaaacgcacccggcgaaauccuauggagugcaccccucggucccgaccuaaacccauaccuaucccaucucgcccgcauguacaacggcuacgcaggagguuucgaaguacaaguaauacucgcuggcaacgccuucacagcaggcaaaaucaucuucgccgccgucccacccaacuuccccaccgaaggccuaucccccucccaagucacaauguucccccacauaaucguuggaguacgccaacucgaacccguccucaucccccuccccgacguccgcaacaacuucuaccacuacaaccaauccaacgacagcaccauaaaacucaucgccaugcucuacaccccacuacgagccaacaacgccggcgaagauguauucaccgucucuugccgcgucuuaacucgacccucaccagacuucgacuucaucuuccuagucccacccacagucgaaucccgcaccaaacccuucacuguccccauccuuaccgucgaagaaaugaccaacucccguuucccaaucccccuugaaaaacucuuuaccggacccuccuccgcauucgucguccaaccacaaaacggccgaugcacuacagacggcguucuccucgggacuacacaacucuccccaguaaacaucugcacauucaaaggcgauguuacccacaucgcaggcucccgcaacuauacaaugaaccuugccagccucaacuggaacaacuacgacccaaccgaagaaauccccgcaccccugggcacacccgacuucgucggaaaaauccaaggaguccuaacccaaacuaccaaaggcgacggcuccacccgcggccacaaagccacagucuacaccggcuccgcccccuucaccccaaaacuaggcucuguccaauucagcaccgacaccgaaaacgacuucgagacccaccaaaacacaaaauuuacaccagucgguguaauccaagaugguggcaccacacaccgcaaugaaccccaacaauggguccuccccucauacucaggccgaaacguccaaaacguacaccucgcccccgcaguagcccccaccuucccaggcgaacaacuccucuucuuccgcagcacaaugcccggaugcucaggcuacccaaacauggaccucgacugucuacuaccccaagaauggguacaacacuuuuaucaagaagccgccccagcccaaucagacgucgcccuccuacgauucguaaaccccgauaccggccgaguccucuucgaaugcaaacuucacaaauccggauacgucacaguagcccauaccggccaacacgaccuaguaaucccucccaacgguuacuuuagauucgacucaugggucaaccaauuuuacacccucgcaccaaugggcaacggcaccggacgcagaagauaa

SEQ ID NO: 38365 - RNA, 1617 nt, Artificial Sequence
  derived and/or modified sequence opt11 from VP1__Norovirus_and/or_Norovirus-like__AB541332
augaaaauggccuccaacgacgcuaaccccagcgacggcuccgccgccaaccucguccccgaagucaauaacgaaguaauggcucucgaaccagucguaggugccgccaucgccgcccccgucgccggccaaacaaacgucaucgaccccuggaucagaaacaacuucguucaagccccuggaggagaguucaccgucuccccacguaacgcccccggcgaaauacuauggucagcaccccucggacccgaccuaaaccccuaccucucccaccucgcccgcauguacaacggcuacgccggaggcuucgaaguccaagucauccucgccggaaacgcauucaccgccggcaaaauuauauucgccgccguucccccaaacuuccccacugaaggccucucacccucccaagucacaauguucccacacaucauagucgacguccgccaauuagaacccguccucaucccccuccccgacguucgaaacaacuucuaccauuauaaccaauccaacgacucaaccaucaaacuaaucgcaaugcuuuacacaccccuccgcgcaaacaacgccggcgaagacgucuucaccguaagcugcagagugcucacccgaccaucaccagacuucgauuucaucuuccucgucccucccacagucgaaucccgaacuaaaccauucaccguaccaauccucaccguagaagaaaugacaaacucacgguucccaauacccuuagaaaaauuauucaccggccccucaggcgccuucgucguccaaccacaaaacggacgaugcacuacagacgguguccuccuaggaaccacacaacucuccccaguuaauauaugcaccuuccgaggagacguaacacacauagccggcucccgaaacuacaccaugaaccuagccucacucaauuggaacaacuacgacccuaccgaagaaauccccgcaccccuuggcaccccugacuucguuggcaaaauucaaggcguccuaacccagaccacaaaaggcgacggcucaacccgaggacacaaagccacugucuacaccggaggggcaccauucacacccaaacuaggcuccgcccaauucuccaccgacaccgaaaacgacuucgaaacacaccaaaauaccaaauucacgcccgucggcgucauccaagacggaggcacaacccaccgcaacgaaccccagcaauggguccucccuucuuacuccggccgcaacguccacaacguccaccuagccccagccgucgcaccaacauuccccggcgaacaacuccuuuucuuucgcuccacgaugcccggcugcuccgguuaccccaacauggaccuugacugccuccucccccaagaauggguccaacacuucuaccaggaagccgccccugcccaaucagacgucgcauuacuccgcuucgucaacccugacacaggacggguacuauucgaaugcaaacuacacaaauccggcuaugucacuguagcucacacuggccaacaugaccucguuaucccaccaaacggcuacuuucgcuucgacucaugggucaaucaauucuacacccuugcccccauggguaacggcaccggaagacgccgcuga

SEQ ID NO: 38366 - RNA, 1617 nt, Artificial Sequence
  derived and/or modified sequence opt11 from VP1__Norovirus_and/or_Norovirus-like__AB541316
augaaaauggcaucaaacgacgcaaaccccuccgacggaucagcagcgaaccuagucccugaaguuaacaacgaagucauggcacucgaaccagucgucggggccgcaaucgcagccccagucgccggccaacaaaacgucaucgaccccuggauucgcaacaacuucguccaagcacccggaggagaguucacagucagcccccggaaugcccccggcgaaauucuguggucagcaccccucggccccgaccuaaacccauaccuaucccaccucgcccguauguacaacggcuacgcaggcggguucgaaguccaaguaauucucgcuggcaacgccuucaccgccggcaaaaucauauuugccgccguaccacccaacuuccccaccgaaggccucucccccucccaagucaccauguucccccacaucaucgucgacguacgacaacuagagcccguucucaucccccuacccgacguccgaaauaacuucuaccacuacaaucaaucuaacgacuccacaaucaaacugaucgccaugcuuuacacaccccuacgcgcgaauaacgccggcgaagacguauucaccgucuccugccgcguccuaacccgccccucccccgacuucgacuucaucuuccucgucccacccaccguagaaucucgcaccaaacccuucacuguacccauccuaaccguagaggaaaugacuaacucccgauuccccauuccacuagaaaaacuauucaccggccccuccucagcuuucguuguacaaccccaaaacggucgauguaccacagacggaguacuccuagggaccacccaacuaucccccguaaacauaugcaccuuccgcggcgacgucacccacaucgcaggcucaagaaacuacacaauggaucucgccucccuaaacuggaacaacuacgaccccacagaagaaauuccagccccucucggcaccccggacuucgucggcaaaauccaaggcguauuaacccaaacuaccaaaggcgacggcucaacacgaggccacaaagccacagucuacacaggcuccgcccccuuuacacccaaacucggcucuguccaauuuuccaccgacaccgaaaacgacuucgaaacacaccagaacacaaaauucacccccgucggcgucauccaagacggaggaaccacccaucgaaacgaaccccaacaauggguacuccccuccuacucaggccgcaacguccccaacguacacuuagccccagccgucgcccccaccuuccccggcgaacaacuucucuucuucagauccaccaugccaggcugcucaggcuaccccaacauggaucucgacugucuccucccccaagaauggguccaacauuucuaccaagaagcugcccccgcacaauccgaugucgcccuccuacgcuucguaaaccccgacacaggacgcguucuuuucgaaugcaaacuccacaaauccggcuacgucacugucgcacacacuggacaacacgaccuugucaucccacccaacgguuacuuuagauucgacucaugggucaaccaauucuauacccuagcccccaugggcaacggcacaggccgccgacguuaa

SEQ ID NO: 38367 - RNA, 1617 nt, Artificial Sequence
  derived and/or modified sequence opt11 from VP1__Norovirus_and/or_Norovirus-like__AB541238
augaaaauggccuccaacgacgccaacccaucagacggcuccgcagcaaaccucgucccagaagucaacaacgaagucauggcucucgaacccgucgucggagccgcuaucgccgcaccuguugccggccaacaaaaugucaucgaccccuggauccgcaacaacuucguacaagcacccggcggugaguucacagucucuccccgaaacgcccccggagaaauacucugguccgccccacucggcccggaccucaaccccuaccucagccaccuugcucgcauguacaacggauacgccggcggauucgaaguccaaguuauccuagcaggcaacgccuucaccgccggcaaaaucauauucgcagcugucccacccaauuuucccacugaaggacuauccccaucccaagucaccauguucccccacaucaucguagacguccgccaacucgaacccguccucaucccccuacccgacguccgcaacaacuucuaccacuacaaccaaucgaacgacuccaccaucaaacucaucgccaugcucuacacaccacuacgagcgaacaacgccggcgaagacgucuucacaguaagcugccggguccuaacacgcccaucacccgacuucgacuucauauuccucgucccacccacaguagaaucgcggaccaaacccuucaccguaccaauccuaacugucgaagaaaugacaaacucccguuucccgaucccccuagaaaaacucuucaccggcccaucaggcgccuucgucguacaaccccagaacggccgcugcaccaccgacggcguccuccucggcaccacccaacuaucaccaguaaacaucugcacauuccgaggcgacgucacccacauagccggaucccgcaacuacacaaugaaccuugccucccucaacuggaacaacuacgaccccaccgaagaaauccccgcuccauuaggaacccccgacuucgucggcaagauacaaggcguccucacccaaaccaccaaaggcgauggcuccacccgaggccacaaggccacagucuacacaggauccgcacccuucacacccaaacuagguuccguccaauucagcacagacaccgaaaacgacuucgaaacccaucaaaacaccaaauucacacccgucggcguaauccaagacggaggcaccacacacagaaacgaaccccaacaauggguccuccccucauacuccggacgagacguccacaacgugcaccucgccccagccgucgcuccaaccuucccuggcgaacaacuccuauucuuccgcuccacaaugcccggcugcucagguuaucccaacauggaucuggacugccuacuaccccaggaauggguacaacacuucuaucaagaagcagcaccagcacaauccgacgucgcccuacuaagauucguaaaucccgacaccggacgcguccucuucgaaugcaaacuccauaaauccggcuacgucacuguagcacacaccggccaacacgaccuugucauacccccuaacggcuacuuccgcuucgacuccugggucaaccaauucuauacccucgcccccaugggcaacggaacaggccgccgccgauaa

SEQ ID NO: 38368 - RNA, 1617 nt, Artificial Sequence
  derived and/or modified sequence opt11 from VP1__Norovirus_and/or_Norovirus-like__AB535750
augaaaauggccuccaacgacgccaacccaucagauggaucugccgcaaaccucguacccgaagucaacaacgaagucauggcccucgaacccgucgucggagccgcaauagcagcccccgucgccggucaacaaaacgucauagaccccuggauccgcaacaacuucguacaagcccccggcggcgaauuuacaguuucgccccguaaugccccuggcgaaauacucugguccgccccgcucggccccgaccucaaucccuaccucucccacuuagcccgcauguacaacgguuacgccggcggauucgaaguacaagugauacucgccggcaacgccuucaccgccggaaaaaucaucuucgccgccgucccuccaaacuuccccacagaaggccuaggccccucccaagucaccauguucccccacauaaucgucgacguccgccaacuggaaccuguccucaucccccuacccgacguacgaaacaacuucuaccacuacaaccaauccaacgauuccaccaucaaacucauagcaaugcucuacacaccacuccgagccaacaacgccggcgaagauguauuuaccgucaguugccgcguacuaaccagacccucgccagacuucgacuucaucuuccucgugcccccuaccgucgaaucccgcacaaaacccuucaccguccccauccucaccgucgaagaaaugaccaacucccguuuccccauaccacucgaaaaacuauucaccggaccaucauccgccuucgugguccaaccccaaaacggacgaugcaccaccgacggaguccucuuaggaaccacucaacugucuccagucaacaucugcaccuuccgcggcgacgucacccgcaucgccgguucccgcaacuauacaaugaaccuagccucacuaaacuggaacaauuacgaccccaccgaagaaauccccgccccacuaggaacaccagacuucguaggaaaaauacagggaguacucacccaaacaaccaaaggcgacggguccacccguggucacaaagccaccgucuacaccggaucugcucccuucaccccaaaacuaggcuccguccaauucucgacagacaccgaaaacgauuucgaaacccaccaaaacaccaaauucacacccguaggcgucauacaagacggcggaaccacccaccgcaacgaaccccaacaauggguccucccauccuacucaggcagaaacguccccaacguacaccuugcuccagccguagccccaaccuuccccggcgaacaacuacucuucuuccgcuccaccaugcccggcugcuccggcuacccaaacauggaccucgacugccugcuuccccaagaauggguacagcacuucuaucaagaagcugccccagcccaaucagacguugcucuccuacgauucgucaaccccgacaccggccgcgucuuauucgaaugcaaacuacacaaauccggcuacguaacagucgcacacaccggacaacacgaccucguaaucccgcccaacggcuacuuccgcuucgacuccuggguaaaccaauuuuacacacucgcacccauggguaacggcaccggccgaagacgauaa

SEQ ID NO: 38369 - RNA, 1617 nt, Artificial Sequence
  derived and/or modified sequence opt11 from VP1__Norovirus_and/or_Norovirus-like__FJ538900
augaaaauggccucuaacgacgccaaccccuccgacggcucaaccgccaaccucguccccgaaguaaauaacgaaguaauggcacuugaacccgucgucggagccgccauagcugcaccuguagccggccagcaaaauguuauagacccauggauacgcaacaacuucguacaagccccaggcggcgaguucacuguaucaccccgcaacgcccccggagaaauccucugguccgcuccccuaggcccagaucucaacccauaccucucccaccucgccagaauguacaauggguacgccggaggcuucgaaguccaaguuauccucgccggcaacgccuucaccgccggcaaaaucauauucgcagccguaccacccaacuuucccacagaaggccugucucccucacaaguuaccauguucccccacauaauagucgacguccgccaacuagaacccguccuaauaccgcuacccgacguccgcaauaacuucuaccacuacaaucaauccaaugaccccaccauaaaacucaucgccaugcuuuacacuccccuaagagcgaacaacgccggugaagaugucuucaccgugagcugccgaguccuaacccgucccucucccgacuucgauuuuaucuuccuaguuccacccaccgucgaaucccgcaccaaacccuuuaccguucccauccuaaccgucgaagaaaugaccaacucucgcuuuccaaucccccucgaaaaacuauucaccggcccauccggcgccuucguaguccaaccacaaaacggccguugcacuacugacggaguccuccucggcacgacacaacucagcccagucaacaucugcaccuuccgcggugacgucacccacaucgccggcacucacaacuacaccaugaaucucgcaagccaaaacuggaacaacuacgaccccgcagaagaaauccccgccccacuugguacgcccgacuucgucggcagaauccaaggcguccucacccaaaccacccgcggcgacggcuccacucgaggccacaaagccaccgucucuacuggcgacguccacuucacccccaaacuaggcucaauccaguucaacacggacaccaacaacgacuucgaaacaggccaaaacacaaaauuuacccccguaggcgucguccaagacggcaacggaacccaccaaaacgaaccgcaacaauggguucuuccuuccuacucaggccgcaccggacacaacguccaccucgcacccgcuguggcccccaccuucccaggcgagcaacuccucuucuuccguucaaccaugccaggauguuccggcuacccaaacaugaaucucgacugucuacucccccaagaauggguccaacacuucuaucaagaagccgcacccgcccaaucugacgucgcccuacuacgcuucguaaacccugauacuggccgcguccuauucgaaugcaaacuucacaaauccggcuacgucaccgucgcccacaccggccaacacgaccucgucauaccucccaacggauacuuccgguucgacuccuggguaaaccaauucuacacacucgccccaaugggcaacggaacaggacgacgccgcuaa

SEQ ID NO: 38370 - RNA, 1617 nt, Artificial Sequence
  derived and/or modified sequence opt11 from VP1__Norovirus_and/or_Norovirus-like__EU876889
augaaaauggcauccuccgacgcaaaccccuccgacggcucaaccgccaaccucguaccagaagucaauaacgaaguaauggcacucgaacccgucguaggagcagcaaucgcagcccccgucgccggccaacaaaacgucaucgauccauggauacgcaacaacuucguccaagcacccggcggcgaguucaccguaucuccccgcaacgcccccggagaaauccucuggagcgcaccacucggcccugaucuuaaccccuaucucucgcaccuagcccgcauguacaauagcuacgcgggcggauucgaaguccaagucauccucgcagguaacgccuuuacagccggaaaaaucauauucgccgccgucccaccaaauuuccccaccgaaggacucucccccucucaagucaccauguuuccccacauaauugucgacguacgacaacuugaaccuguccucaucccccucccagauguccgcaacaacuucuaccacuacaaccaaucaaacgacccuaccauaaaacucaucgcaaugcucuacaccccacuacgcgcuaacaaugccggcgacgacguauucaccgucuccugccgcguauuaacacgcccaucccccgacuucgacuucaucuuccucgugccuccuacaguagaaucccgcaccaaaccauucagugucccuauccucaccguagaagaaaugacaaacucccgcuuccccaucccucuagaaaaacucuucaccggcccauccagcgccuuuguaguccagccccaaaacggccguugcacaaccgacggaguccuccucggcaccacccaacucucccccgucaacaucugcaccuuccgaggugacgucacccacaucgccgguacgcaagaauacaccaugaaccucgccagccaaaacuggaacaacuacgaccccaccgaagaaaucccagcaccccuaggcacccccgacuucgucggaaaaauccaaggaguacuaacacaaaccacccgucgagacggcuccacccgcggccacaaagccaccgucuccaccggcucaguccacuuuacccccaaacucggcagaauacaauucucaaccgauaccucaaacgacuuugaaacaggacaaaacacacgcuucacccccgucggcgucguccaagacggcggcacaacccaucaaaacgaaccccaacaauggguccucccaaacuacuccggccgugauucacacaacguccaccucgcccccgccguagcccccagcuuccccggagaacaacuccuauucuuccgcucuaccaugcccgggugcucaggcuacccaaacaugaaccuagauugccuccuuccgcaagaauggguacaacacuucuaccaagaagccgcccccgcacaauccgacguagcccuucuacgauucgucaaucccgacaccggccgaguccuauucgaaugcaaacuccacaaauccggauacgucacggucgcccacaccggccaacacgaucuugucauucccccaaacggcuacuuccgcuucgacagcuggguaaaccaauucuacacccucgccccuauggggaacggcaccggaagacgccgcuaa

SEQ ID NO: 38371 - RNA, 1617 nt, Artificial Sequence
  derived and/or modified sequence opt11 from VP1__Norovirus_and/or_Norovirus-like__EU876887
augaaaauggccucauccgacgccaacccaucagauggauccaccgccaaccuaguccccgaaguaaacaacgaagucauggcacucgaacccgucguaggagccgcaaucgccgcccccguagcaggccagcaaaauguaaucgaccccuggauccgcaacaacuucguccaagcccccgguggugaguucaccguauccccacgcaacgcucccggcgaaauccucugguccgcaccccuaggccccgaccuuaaucccuaccuaucucacuuagcccgcauguacaacucauacgcaggcggauucgaaguccaagucauccuagccggaaacgcauucaccgcaggcaaaauuaucuucgcugccgucccacccaacuuccccacggaaggccuaucucccagccaaguaacuauguucccccacaucaucguagacguccgccaacuagaacccguacuaaucccucucccagacgugagaaacaacuucuaccacuacaaucaaucaaacgacccuaccaucaaacucaucgcaaugcucuacacaccccuccgggccaacaacgccggagacgacgucuucaccguauccugccgcguccucacucgacccucccccgacuuugacuucauauuccuagucccacccaccguggaaucccggacuaaacccuucuccguccccauacucaccgucgaagaaaugacuaacagccgcuuccccauaccccucgaaaaacucuucaccggacccuccagugccuucgucguccaaccccaaaacggcagaugcaccaccgauggaguacuacuaggaaccacacaacucucccccgucaacauaugcacuuuccgcggcgacguaacccacaucgcaggcacccaagaauacaccaugaaccuggcaucacaaaauuggaacaacuacgaucccaccgaagaaauccccgcaccccuaggcacccccgacuucguuggcaaaauacaaggaguccucacccaaaccacccgccgagacggcucuacccgcggacacaaagcaacagucagcacaggcucaguacacuucacccccaaacucggccgcauccaauuuucaaccgacaccuccaacgacuucgaaaccggccaaaacacccgcuucacccccgucggcgucguacaagacggaucgaccacacaccaaaacgaaccccaacaauggguccuaccauccuacucaggccgagacucccacaacguacaccuagcacccgccguagcccccucauuccccggcgaacaacuccuuuucuuccgcuccaccaugccaggcugcagcggauacccaaacaugaaucucgauugccuacuuccacaagaauggguucaacauuucuaccaagaagccgcaccagcacaaucugacguagcccuacuccgauucgucaaccccgacacaggccgcguccuauucgaaugcaaacuccacaaauccggcuacgucaccgucgcacacacaggccaacacgaccuagucaucccacccaacggcuacuucagguucgacuccuggguaaaccaauucuacacacuagcccccaugggaaacggagccggacgccgcagauag

SEQ ID NO: 38372 - RNA, 1617 nt, Artificial Sequence
  derived and/or modified sequence opt11 from VP1__Norovirus_and/or_Norovirus-like__FJ411171
augaaaauggcaucaaacgacgcaaaccccuccgacggaucuacugcaaaccucguccccgagguaaacaaugaaguaauggcccuagaacccgucgucggcgccgccauugccgcaccagucgcaggccaacaaaacguaaucgaucccuggauccgcaacaacuuuguacaagcccccggaggagaguucacggucucaccccgcaacgcucccggcgaaauccucuggagcgccccacuaggccccgaccuaaacccauaccucucucaccuugcacgcauguacaacggcuacgccggcggcuucgaaguccaaguaauccuagcugguaacgccuucacagcaggaaaaaucaucuucgccgccgucccacccaacuucccaacagaaggacuaucacccucacaagucaccauguucccacacaugaucguagauguacgccaacucgaacccguacucauaccccuccccgacguccgcaacaacuucuaccacuauaaccaaucaaacgaccccaccaucaaacuaaucgccaugcuauacacuccccuacgagcaaacaacgccggcgacgacguauucaccguauccugcagaguacuaacccgcccauccccagacuuugacuucaucuuccucguacccccaaccgucgaaucccgaacaaaaccauucaccgucccaauccucaccguagaagaaaugaccaacucucgcuucccuauuccacucgaacgccucuauaccggccccuccagcgccuucguaguacaaccacagaacggcagaugcaccaccgacggcguccuacucggcaccacucagcucagcgccgucaacauaugcaccuuccggggcgacguuacccacauagccgguucaagaaacuacaccaugaaccucgcuucacaaaacuggucaaacuacgacccaacagaagaaauacccgccccacucggcaccccagacuucguaggcaaaauccaaggcaugcuaacacaaacaacccgccgugacggaucaacccgaggacacaaagcaacuguauuaacaggcuccgcagacuucgccccaaaacucggacgaguccaguucgccaccgacaccgauaaugacuucgaguccggcgaaaacaccaaauucacccccgugggagucauccaagacgguucaaccacccaccgcaacgaaccacagcaauggguccuccccaacuacuccgggcgcaccggccacaacguccaccucgcccccgcugucgcccccacauacccaggagaacaacuccucuucuuucgauccaccaugcccggcugcuccggcuauccuaacauggaccuggacugccuacuaccgcaagaauggguacgccacuucuaccaagaagcagcacccgcucaauccgacguugcccuacuccgguucguaaaccccgacacaggccgcguccuguucgaaugcaaacuacacaaaucaggauacgucaccgucgcucauaccggccaacacgaccucguuaucccgcccaacggauacuuccgcuucgacuccuggguuaaccaauucuacacccucgcaccaaugggaaacggugccggccgccgccgauaa

SEQ ID NO: 38373 - RNA, 1617 nt, Artificial Sequence
  derived and/or modified sequence opt11 from VP1__Norovirus_and/or_Norovirus-like__AB447460
augaaaauggccuccaacgacgccaauccauccgacggcucagccgccaaccucgucccagaaguaaacaacgaggucauggcccucgaacccgucguaggcgccgccaucgccgccccagucgccggccaacaaaacgucaucgacccauggauccgaaauaacuucguacaagcacccggcggugaguucaccguauccccacgaaacgcaccaggcgaaauucucugguccgccccacucggccccgaccucaacccguaccucucccaccucgcacgaauguacaacggcuacgccggcggcuucgaaguccaagucauccuagcaggaaaugcauucaccgccggaaaaaucaucuucgccgccguacccccaaacuuccccaccgaaggccuaucacccucccaggucaccauguucccacacaucauagucgacguccgacagcuagaaccgguccuuaucccacuccccgacguccgcaacaacuucuaucacuacaaccagucaaacgacuccaccaucaaacuuaucgcuaugcuguacaccccucuccgcgcaaacaaugccggugaagacguauucaccgucucaugccgcguucucacccgcccaucgccagacuucgacuucauauuccucguacccccaaccgucgaaucccgaacaaagcccuucacagucccaauccucacagucgaagaaaugaccaauagccgauuccccauuccacuagaaaaacucuucaccggccccucaggcgccuucgucguacaaccccagaacggacgcugcaccaccgacggcguccuccuuggaacaacucaacucucacccguuaacauaugcacuuuccgcggcgaugucacccacaucgccggcucccgcaacuacacaaugaaccucgccucacuaaacuggaacucuuacgaccccacagaagaaauaccagcucccuuaggcacccccgacuucgugggcaagauacagggccugcuaacccaaacaaccaaaggcgacgguucuacccgaggccacaaagcaaccguauauaccggcuccgcccccuucacacccaaacucggcucaguacaauucucgaccgacacagaaaacgacuucgaaacucaccaaaauacaaaauucacccccgucggcgucauccaagacggcuccacaacccacaggaacgaaccccaacaauggguccuaccauccuacuccggcagaaacguccacaacguccaucucgcaccagccgucgcacccacauuccccggcgagcaacuacucuucuuucgaucaacuaugcccggcugcucuggauaccccaacauggaucucgacugccuacucccccaagaauggguacaacacuucuaccaggaagccgccccagcccaauccgacgucgcacuccuacgcuucgucaaccccgacacuggacgcguccuauucgaaugcaagcuccacaaaucaggcuaugucacagucgcccacaccggacaacacgaccucgucaucccacccaacggcuacuuccgcuucgacuccuggguaaaccaauucuacacacucgcccccaugggcaacggcaccggacggcggcgauaa

SEQ ID NO: 38374 - RNA, 1617 nt, Artificial Sequence
  derived and/or modified sequence opt11 from VP1__Norovirus_and/or_Norovirus-like__AB447454
augaaaauggcuuccaacgacgccaaccccuccgauggcuccgccgccaaccuaguccccgaggucaacaacgaagucauggcacucgagcccgucgucggagcagcuaucgcagcccccguagccggacaacaaaacguaaucgaccccuggauacgaaacaacuucguacaagcccccggaggcgaguucacaguuagcccccgaaacgcacccggcgaaauacucuggagcgcaccccucggcccagaccucaaccccuauuugucacaccuagcucgcauguacaauggcuacgcgggcggcuucgaaguccaagucauccucgccggaaacgccuucacagccggaaaaaucauuuucgccgccguuccacccaacuucccaacagaaggacucucccccucucaaguaaccauguuuccccacaucaucgucgacguccgccaacuagaaccaguccugauaccccuacccgacguacgcaauaacuucuaccauuacaaccaauccaacgacucuaccaucaaacuaaucgccaugcucuacacaccccuacgcgccaacaacgcuggagaagacgucuucaccgucuccugccgcguccucacccgucccucaccagacuucgacuucauuuuccuagucccacccacggucgaaucacgaaccaaacccuucaccguccccauccucacagucgaagaaaugaccaauucaagauuccccauaccccuugaaaaacucuucaccggccccuccggcgcauuugucgugcaaccacaaaacggcagaugcaccacagacggcguucuucucggcaccacccaacuaucacccgucaacaucugcacuuuccgcggcgacgucacccacaucgcaggcacccgcaacuacacuaugaaccuagcaucacuaaacuggaacaacuacgaccccaccgaagaaauaccagcaccccucggaaccccugacuuuguagggaagauccaaggcguacuaacccaaaccaccaaaggugauggcagcacacgaggccacaaagccaccguauacaccggcucggccccuuucacgcccaaacuaggcuccguacaauucucaaccgacaccgaaaacgacuucgaaacacaccaaaacacaaaauucacacccgucggaguaauccaagacggaggcacaacacaccgaaacgaaccucaacaguggguccucccuuccuauagcggcagaaacguacacaacguccaccuagcccccgccguagcacccaccuuccccggcgaacaacuacucuucuuccgcucgacaaugccaggcugcuccggcuaccccaacaugaaccuagauugccuacucccccaagaauggguccaacacuucuaccaagaagcagcccccgcccaauccgacgucgcccuccuccgauucguaaaccccgacaccggccgaguccucuucgaaugcaaacuccacaaauccggcuacgucacaguagcccacaccggucaacacgaccucgucaucccacccaacggcuacuucagauucgacagcugggucaaucaauucuacacccuggcucccaugggcaacggcacuggccgccgacgauaa

SEQ ID NO: 38375 - RNA, 1617 nt, Artificial Sequence
  derived and/or modified sequence opt11 from VP1__Norovirus_and/or_Norovirus-like__AB447443
augaagauggccucaaacgacgccaacccuuccgacggcuccgccgccaaucuaguccccgaagucaauaaugaaguaauggcccuagagcccgucguuggagccgccauagccgcacccguagccggacaacaaaacgucaucgacccauggauccgcaacaacuucguccaagcacccgguggugaguucaccgucagcccccgcaacgccccaggcgaaauccuaugguccgccccacuuggucccgaccuaaaccccuaccucucccacuuagcccgcauguacaacggcuaugccggaggauucgaaguacaaguaauccucgccggcaacgccuucacagcgggaaagaucauauucgccgcaguucccccuaacuuccccacggaaggccucucacccucccaagucacaauguucccccauaucaucgucgacguacgacaacuagagcccguacuaaucccccuaccugacguucguaacaacuuuuaucacuacaaccaaucaaacgacucaacaaucaaauuaaucgcaaugcuauauacaccccucagagcaaauaacgccggcgaggacgucuucaccguuagcugccgcguccuaacccgaccaagccccgacuucgacuucaucuuccucguuccgcccacuguagaaucacgcaccaaacccuucacuguacccauccucaccgucgaagaaaugaccaacucacgcuuccccaucccccucgaaaaacuauucacaggccccucaggcgcguucgucguccaaccccagaacggccgaugcaccaccgacggaguauuacucggcaccacccaauuaucaccaguaaacauaugcacguuucgcggcgacguaacccacaucgcaggcucgcguaacuacacaaugaaccuggcgucacucaacuggaacaacuacgacccaacagaagaacuccccgcaccccucggcaccccugacuucguaggaaaaauccaaggaguucucacccaaacaacaaaaggagacggaucaacccgcggacacaaagccacaguauacaccggcuccgcaccauucacccccaaacucggcuccguacaauucuccaccgacaccgaaaacgacuucgaaacccaccaaaacaccaaguucacaccugucggcgucauccaagacggcucaaccacccaccgcaacgaaccccaacaauggguacucccgucauacuccggccgaaacguacauaauguucaccucgcaccagccguagccccaaccuuccccggagaacaacuccucuucuuccgaucaacuaugcccggauguuccggguacccuaacauggaccuagacugccuccuaccacaagaauggguccagcauuucuaccaagaagccgcccccgcccaauccgacgucgcccuccuacgcuucguaaaccccgacacaggccgcguccucuucgaaugcaaacuccacaaguccggcuacgucaccgucgcccacacaggccaacacgaccuagucauaccacccaacggcuacuuccgauuugacuccugggucaaccaauucuacacccucgcacccaugggcaacggcaccggccgccgccguuaa

SEQ ID NO: 38376 - RNA, 1617 nt, Artificial Sequence
  derived and/or modified sequence opt11 from VP1__Norovirus_and/or_Norovirus-like__AB447430
augaaaauggccucaaacgacgccaacccaucagacggauccacugccaaccuaguacccgaagugaacaacgaagucauggcacucgagcccguaguaggcgcagcaaucgccgcccccgucgccggccagaccaacgucauugaccccuggauccgcaacaacuucguucaagcacccggcggagaguucaccguaucaccucgcaaugcacccggcgaaauccucuggucagccccgcucggcccagaucuaaaccccuaccugucacaccuagcacgcauguacaacggauacgcaggcgguuucgaaguacaagucauccucgccggcaacgccuucacagcuggcaaaaucaucuucgccaaagucccaccaaauuuccccacugaagguuuaucacccucacaaguaacaauguucccgcacaucaucgucgacgucagacaacucgaacccguccuaaucccccuccccgacguacgaaacaacuucuaccacuacaaccaaucaaacgacuccacaauaaagcuaaucgcgaugcucuacacgccacuccgagccaacaacgccggcgaagacguuuucaccgucuccugucgcguccucacccgaccgucacccgacuucgacuucauauuccuugucccaccuaccgucgaaucccgcacaaaaccauucaccgucccaauccuaacaguagaagaaaugaccaacucacgcuuccccauaccucucgagaaacucuucacaggcccaucaggcgccuucgucguccaaccccaaaacggacgaugcaccacagacggcguacuacuaggcaccacacaacucucccccguuaacaucugcacauuccgcggugacgucacccacauagccgguucccggaacuacacaaugaaccuugccucccucaacuggaacaacuacgaccccaccgaagaaauacccgcaccccuaggaacccccgacuucgucggcaaaauacaaggaguccuuacccaaaccacuaaaggagacggcuccacaagaggacacaaagccacagucuacaccggaagcgcccccuucacccccaagcuaggcucuguccaguuuucaacagacaccgaaaacgauuuugaaacccaccaaaauaccaaauucacccccgucggcguuauccaagacggcuccaccacccaccgaaacgaaccccaacaauggguccuuccaagcuacucaggucgcaacguccacaacguccacuuagccccagcagucgcccccaccuuccccggcgaacaacuccucuucuuccgcucaaccaugcccggcugcuccggcuaccccaacauggaccucgacugccuccucccccaagaauggguucaacacuucuaccaagaggccgcuccagcacaaucugacgucgcacuccuacgauucgucaacccggacacgggccgaguccuuuucgaaugcaaacuucacaaauccggauacguuacuguagcacacacuggccaacacgaccucguuaucccaccaaacggauacuuccgcuucgacucauggguaaaccaauucuacacgcuagcaccaaugggaaacgguaccggcagacgcagauga

SEQ ID NO: 38377 - RNA, 1617 nt, Artificial Sequence
  derived and/or modified sequence opt11 from VP1__Norovirus_and/or_Norovirus-like__EU078420
augaaaauggccucaaacgaugccaacccauccgacggcucagccgccaaccuuguccccgaaguaaacaaugaagucauggcucuagaaccugucgucggagcugccaucgcagcccccgucgccggccaacaaaacgucaucgacccauggauacgcaacaacuucguccaagcacccggcggcgaauuuacaguaucaccccgcaacgccccaggagaaauccuaugguccgcaccccucggccccgaccucaacccuuaucuaucccaccuugcccgcauguauaacggcuacgccgguggcuucgaaguucaggucauccucgccggaaacgccuucaccgccggcaagaucauauucgccgccguacccccuaauuucccuacagaaggccucucccccucccaagucaccauguucccccacauaaucgucgacguccgccaacuagaacccguccuaaucccacuccccgacgucagaaacaacuucuaccacuauaaccaauccaacgacucaacaaucaaacucaucgccaugcucuacacaccccucagagcaaacaacgccggcgaagacgucuucacagucucaugucgcguacucacccgccccucccccgacuucgacuuuaucuucuuaguacccccgaccgucgaaucucguaccaaaccauucacaguccccauccuaacggucgaagaaaugacuaacucccgauucccaaucccucuagaaaaacuauuuaccggccccucaucagccuucgucguccaaccccaaaacggcagaugcaccacagacggcguccuccucgguacaacacaacucucaccaguaaacauuugcacauuucgcggagacgucacccacauagccggcucucgcaacuacaccaugaaccucgcaucccucaacuggaauaacuacgaccccaccgaagaaaucccagccccauuagguacacccgacuucguaggcaagauccaagguguccucacccaaaccaccaaaggagacggcagcacccgaggccacaaagccacaguuuacacaggcuccgcccccuucaccccaaaacucggauccguucaguucucuaccgacacagaaaacgacuucgaaacccaccaaaauacaaaauucacccccguaggaguaauccaagacgguuccaccacacaccgaaacgaaccccaacaauggguacuccccuccuacuccggucgcaacguccauaacguacaccucgcaccagccguagcaccaacauucccaggggaacaacuccucuucuuccgguccacaaugcccggcugcucuggauaccccaacauggaccucgacugccuccugccacaagaauggguccaacacuuccaccaagaagccgcccccgcacaaucagaugucgcgcuccuccgauucguaaacccugacacaggacgcguccuauucgaaugcaaacuccacaaaucaggauacgucacagucgcacacaccggccagcacgaccucguaaucccacccaacggcuacuuucgcuucgacuccugggucaaccaauucuacacccuagcccccaugggcaacggcacaggccgacgcagauaa

SEQ ID NO: 38378 - RNA, 1617 nt, Artificial Sequence
  derived and/or modified sequence opt11 from VP1__Norovirus_and/or_Norovirus-like__AB385637
augaaaauggcauccucagacgccaaccccuccgacggcagcaccgccaaccucguacccgaagucaacaacgaagucauggcccucgaacccguagucggcgccgccaucgcagccccagucgccggacaacaaaacgucauugacccuuggaucagaaacaacuucguccaagcacccggcggagaguuuaccgucucaccccgaaaugccccaggugaaauacucuggucagccccucuuggccccgacuuaaacccauaccucucacaccucgcccgcauguacaacucuuacgccggcggauucgaaguucaagucauccucgccggcaacgccuucacugcaggcaaaauaaucuucgcagccguaccacccaauuuccccaccgaaggccugucccccucccaagucacaauguucccacauaucaucguagacguucgucaacuagaaccaguacucaucccccucccagacguccgaaauaacuucuaccacuacaaccaauccaacgacccaacaaucaaacuaaucgccaugcuuuacacuccccuacgcgccaacaaugcuggcgacgacguauucaccgucuccugccgcguacucacccguccuagcccagacuucgacuucaucuuccucgucccacccaccguagaaucccguaccaaacccuucagcguccccauucucaccgucgaagaaaugacgaacucccgauucccaaucccccucgaaaaacucuucacuggacccuccucagccuucguuguccaaccccaaaacggacgaugcaccaccgacgguguccuccuuggcaccacccaacucagccccgucaacaucugcaccuuccgcggcgacguaacccacaucgcaggcacccaagaauacacaaugaaccuagccucacaaaacuggaacaacuacgaucccaccgaggaaaucccagcaccccuuggcacccccgacuucguaggcaaaauucaaggaguacuaacccaaacaacccgacgagauggauccacacgcggacauaaagccaccguauccaccggcuccguccacuucacaccaaaacuuggaagaauacaauucucaaccgauacauccaacgacuucgaaacaggacaaaacacccgguucacccccgucggcgucguccaagauggcuccaccacacaccaaaacgaaccccaacaauggguccuccccaacuacuccggccgagacggccacaacguacaccucgcaccagccguugcccccuccuuuccaggagaacaauuacuuuucuuucgauccaccaugcccggcugcuccggcuacccaaacaugaaccucgauugccuccucccccaagaauggguacaacacuucuaccaagaagccgccccugcacaauccgacguggcacuccuccgauucgucaacccagacaccggccgcguucucuucgaaugcaaacuccacaaaagcggcuacgucaccguugcccacaccggccaacaugaccucgucaucccacccaacggcuacuuucgcuucgauuccuggguaaaccaauucuacacacucgcccccaugggcaacggaaccgggcggagacgguaa

SEQ ID NO: 38379 - RNA, 1617 nt, Artificial Sequence
  derived and/or modified sequence opt11 from VP1__Norovirus_and/or_Norovirus-like__EF202568
augaaaauggcaucuaacgacgcaacucccuccgacggcucagccgccaaucuaguccccgaagucaacaacgaagucauggcccucgaacccgucguaggggccgcaauagcagccccagucgccggacaacaaaacguaaucgacccauggauccgaaacaacuucguccaggccccagguggugaguucaccgucucaccccgaaacgccccaggcgaaauacucugguccgcaccccucggcccagaccucaaccccuaccucucgcaucuugccagaauguacaacggcuaugccggcggcuucgaaguccaagucauccuagccggcaacgccuucaccgccggcaaaaucaucuucgcagcaguuccacccaacuuccccaccgaaggacucucacccucccaagucaccauguucccccacauaaucguagauguccgccaacucgaacccguccuaauaccccuccccgaugugcgcaacaacuucuaccauuacaaccaaagcaaugaccccacaauaaaacucaucgccaugcuuuacacuccguuacgugccaacaacgccggagacgacgucuucaccgucagcugccgcgugcucacucgacccuccccagauuucgacuucaucuuccucgucccacccaccgucgagagccguacgaaaccuuucucuguucccauccucacaguugaagaaaugaccaacucacgcuuucccaucccacucgagaaauuguucacaggacccuccuccuccuucgucguccaaccccaaaacggccgcugcaccaccgacggcguccuccuagguaccacccaacucucccccgucaacaucugcaccuuccgcggcgacgucacccacaucgcuggaacacaaaacuacaccaugaaccuagcaucccaaaauuggaacaauuacgaccccaccgaagaaauccccgcaccccuuggaaccccagacuucgucggcaaaauccaaggcguccucacccaaaccacucgccgcgacggcuccacccgcggucacaaagcaaccguaucaaccggauccguacacuucaccccaaaacucggcucuguucaauuuuccaccgacaccucaaacgacuucgaaacgggccaaaacacacgcuucaccccuguaggcguaguccaagacgguucuaccaccccucaaaacgaaccacaacaauggguccuacccgacuacuccggccgcgacucccacaacguacaccuagccccagccguagcccccacauuucccggagaacaacuccuauucuuccgguccaccaugccaggcugcucagguuauccaaacaugaaccuagacugccuucuuccccaagaauggguccaacacuucuaucaagaauccgccccugcucaauccgacgucgcucuccuacgauucgucaauccagacacaggccgcgucuuauucgaaugcaaacuccacaaauccggcuacgucaccguagcccacaccggccaacacgacuuagucaucccacccaacgguuacuuccgcuucgacuccugggucaaccaauucuacacccuugcccccaugggcaacggcgccggcaggcgccgcuga

SEQ ID NO: 38380 - RNA, 1617 nt, Artificial Sequence
  derived and/or modified sequence opt11 from VP1__Norovirus_and/or_Norovirus-like__AB294781
augaagauggcaucaaacgacgcaaaccccuccgacggcuccaccgccaaccuaguccccgaagucaacaacgaagucauggcccuugaacccgucguaggcgcugccauagccgcaccagucgccggccaacaaaacgucauagaccccuggauacgcaacaacuucguccaagcuccuggcggcgaguucacagucuccccacgcaacgcccccggggaaauacuauggucagcaccccucggcccagaccucaacccauaccugucccaccuugcacgcauguauaacggcuaugcaggcggcuucgaaguccaagucauccucgccggcaacgcauucaccgccggcaagaucauauucgccgccguaccacccaauuuccccacagaaggccuaucccccucccaaguaaccauguucccccacaucaucgucgacgucagacaacucgaacccguccuaauaccccuccccgacgugcgaaacaacuucuaccacuacaaccaaucaaacgaccccaccaucaaacucaucgccaugcuauacacaccccuacgcgccaacaacgccggcgaagacgucuucaccguauccugccgcguccucacccgccccuccccagacuuugauuucaucuuccuuguaccacccacaguugaaucccgcacaaaacccuucacaguccccguccucaccguugaagaaaugaccaacucccgcuuccccaucccucuagaaaaacucuucaccggacccuccggcgcauuuguaguccaaccccagaacggccguugcacaaccgacggcguucuccuuggcaccacccaacuaucccccgucaacaucugcacuuucagaggcgauguaacccacaucgccggaacccacaacuacaccaugaaccuugccucacaaaacuggaacaacuacgacccuaccgaagaaauccccgccccacucggcacaccugacuucgucggcagaauccaaggcaugcucacccaaaccacaaagggagacggcuccacacgaggccacaaagcaaccgucagcaccggcgacguccacuucacacccaaacucggcucuauacaauucaacaccgacaccaacaacgacuucgaaacuggccagaauaccaaauucaccccagucggcgucguacaagacggcaacggaacccaccaaaacgaaccacaacaauggguccucccaagcuacuccggccgcaccggccauaauguccaccucgccccagccgucgcgccuaccuuccccggcgaacaacuccucuucuuucgauccaccaugcccggcugcuccggcuaccccaacaugaaccuagauugccuucucccucaagaauggguccaacacuucuaccaagaagcagcccccgcgcaaucagacgucgcccuccuacgguuugucaaccccgauacaggcagaguccuauucgaaugcaaacuacacaaaucuggcuacguaaccgucgcccacaccggccaacacgaccucguaaucccaccaaacggcuacuuccguuucgacucaugggucaaccaauucuacacucucgcccccaugggcaauggaaccggccgacgccgauaa

SEQ ID NO: 38381 - RNA, 1617 nt, Artificial Sequence
  derived and/or modified sequence opt11 from VP1__Norovirus_and/or_Norovirus-like__AB303940
augaaaauggccuccaaugacgccacccccagcgacggcucaacagcaaaccuagucccugaagucaacaccgaagucauggcccuagaacccguagucggcgccgccauugccgccccagucgccggucaacaaaacgucaucgaccccuggauccgaaauaacuuuguccaagcacccggcggcgaauuuacagucuccccacgcaacgccccaggcgaaauccucuggucagcaccccuuggccccgaucucaaccccuaccucucccaccuagcccguauguacaacggcuaugccggaggcuucgaaguccaagucauccuagccggaaacgcauucaccgccggcaaaaucaucuuugcagccguacccccuaacuucccgacagaaggccuauccccuucccaagucaccauguucccucacauaauagucgacguccggcaacuugagccaguccucauuccacuucccgacguucgcaauaacuucuaccauuacaaucaauccaacgacccaaccauaaaacuaaucgccaugcucuacacuccccucagaaccaacaaugccggagacgacguauucacuguauccugccgcguauuaacccgccccucccccgacuucgacuucauuuuccucguacccccuacgguagagucccgaaccaaacccuucuccguccccauccuaaccgucgaggaaaugaccaauucacgauucccuaucccacucgaaaaacucuuuacaggaccaucguccgcauucguaguccaaccccaaaacggcagaugcaccaccgacggcguccuccugggaaccacucaacuaucccccguaaacaucugcaccuuccguggcgaugucacacacaucgcaggaacacaaaacuacaccaugaaccucgcaucccagaacuggaacaacuacgacccaaccgaagaaauucccgccccacucggaacccccgacuucguaggaaaaauacaagguguccucacccaaaccacacggcgcgacggcucaacccgaggccacaaagccacaguuuccacgggcuccauccacuucacacccaaacugggcuccguacaauucucaacagacacaucaaacgacuucgaaacaggccaaaacacacgcuucaccccagucggaguaguccaagacggaucaaccacccaccaaaacgaaccccagcaauggguccuccccgacuacagcggcagagacagccacaacguccaccuagcccccgcaguagcaccaacauucccaggcgaacaacuucuguucuuccgcuccaccaugcccggcugcucuggcuacccaaacaugaaccuagacugccugcuuccacaagaauggguccaacacuucuaccaagaaagugcaccagcccaaagcgacguugcccuacuacgauucguaaaccccgacaccggacggguccucuucgaauguaaacuccacaagucaggcuacguaaccgucgcccacacaggccaacacgaccuaguaauaccacccaacggauacuuccgcuucgacagcugggucaaccaauucuacacacuagcccccaugggcaacggcgcaggcagacgccgcuaa

SEQ ID NO: 38382 - RNA, 1617 nt, Artificial Sequence
  derived and/or modified sequence opt11 from VP1__Norovirus_and/or_Norovirus-like__DQ415279
augaaaauggcuuccaacgacgccaaccccagcgauggcuccaccgcgaaccucguaccagaaguaaacaacgaagucauggcucucgaacccguaguaggagcugccaucgccgcacccguagcuggccagcaaaacguuauagaccccuggauccgcaacaacuucguacaagcccccggaggugaguucacagucucaccccgaaacgcucccggagaaauacuuugguccgcaccccucggccccgaccucaacccauaccuaucccaccucgcccgcauguacaacggcuacgccggaggauucgaaguccaagucauccucgcaggcaaugccuucacagccggaaaaaucauauucgccgcagucccucccaacuucccaaccgaaggacucucccccucccaagucaccauguuuccccacgucaucgucgacguccgccaacuagaacccguccucauaccccucccagacguacgaaacaauuucuaccacuauaaccaauccaacgaccccaccaucaaacucaucgcaaugcuauacacuccccuacgcgccaacaacgccggcgaagacgucuuuaccgucuccugccgaguccuuacccgccccucaccagacuucgacuucaucuuccucgucccacccacaguagaauccagaaccaaacccuucacaguccccauacucaccguugaagaaaugaccaacuccagauuccccaucccccuagaaaaacucuucaccggcccauccggcgcauucgucguacaaccccagaacggacgcugcacaaccgacggcguccuacucggcaccacccaacucuccccuguuaacaucugcaccuuccgcggcgacguaacacacaucgccggaacccacaacuacacgaugaaccuugccucacaaaacuggaacaacuaugaccccaccgaagaaauccccgcaccgcuuggaacaccagacuucguaggccguauacaaggcaugcuaacccaaaccacacgcggagacggcuccacccgcggccacaaagccacuguaucuaccggagacguccauuucacacccaaauuagguucuauccaguucaacaccgacacaaacaacgacuucgaaacuggccaaaacaccaaauucacccccgucgguguaguccaagacggcaacggcacccaccaaaacgaaccacaacaauggguccuccccucuuacuccgggcgcacuggccacaacguccaccucgccccagccguagcacccacauuccccggcgagcaacuccuuuucuuccgcuccacaaugcccggaugcuccggcuaccccaacaugaaucuagacugccuccucccccaagaauggguccaacacuucuaccaagaagccgcccccgcccaaucugacguagcacuccuccguuucguaaacccagacacuggccgaguccuauucgaaugcaaacuucacaaauccggcuacgucaccgucgcucacaccggccaacacgaccucgucauaccacccaaugguuacuuccgcuucgauuccuggguaaaccaauucuacacacucgcacccaugggcaacgguacuggcagacgccgcuaa

SEQ ID NO: 38383 - RNA, 1617 nt, Artificial Sequence
  derived and/or modified sequence opt11 from VP1__Norovirus_and/or_Norovirus-like__DQ078794
augaaaauggccuccaacgacgccacacccagugacgguuccaccgcaaaccuaguaccugaaguuaacaaugaagucauggcacucgaacccguagucggagccgccaucgcugcacccguagccggccaacaaaacguuaucgaccccuggauccgaaacaacuucguccaagcccccggcggagaguucaccgucucuccccguaacgccccaggcgaaauccugugguccgccccacuaggccccgaccuaaaccccuaccuaucccaccuagcacgcauguacaacggauaugccggcggcuucgaaguacaagucauacucgcuggcaacgcuuucaccgcaggcaaaaucaucuucgccgccgucccacccaacuuccccacagaaguccucucccccucccaaguaaccauguucccccacaucauuguagacguacgccaacucgaacccguacucaucccccuuccagacgucagaaacaacuuauaccacuauaaccaauccaacgacccaacuauacgacuaaucgcaaugcuauacaccccacuccgggccaacaacgccggcgacgauguauucaccgucucaugccgcguccucacacgccccucacccgacuucgacuucauguuccucgucccacccaccgucgaaucccgcaccaagccauuuuccgucccaauccuaaccguagaagaaaugacuaacucccgcuucccaauaccacucgaaaaauuauucaccggcccaucgagcgcuuuuguuguccaaccacaaaacggccgcugcaccaccgacggaguccuauuaggaaccacccaacucucaccagucaacaucuguaccuuccgcggugacguaacccacaucgccggcgcccaaaacuauaccaugaaucucgcaucccaaaacuggaacaacuacgauccaacagaagaaaucccugcaccucucggcacccccgacuucgucggaaaaauccaaggcguccuaacccaaaccacucgucgcgauggguccacucgaggccacaaagccacagucucaaccggcucaguccacuuuacacccaaacucggcuccguacaauucuccacagacacaucuaaugacuucgaaacaggccaaaacacccgauucacucccguuggcguaguacaagacggcuccaccacacaucaaaacgaaccacaacaauggguccucccagauuauagcggccgcgacucccacaauguccaccuagcuccugccgucgcccccacuuucccuggcgaacaacuucuauucuuccgauccaccaugccaggcugcuccggauauccuaacaugaaccuugacugccuacucccacaagaauggguacaacacuucuaccaagaauccgcaccagcacaaucugacgucgcacuccuacgcuucgucaaccccgacaccggacguguccucuucgaaugcaaacuccacaaaucuggcuaugucacagucgcacacaccggacaacacgaccucguuaucccaccaaacggcuacuuccgcuuugacagcuggauuaaccaauucuacacccucgcaccuaugggaaacggcgccggacgccgccguuaa

SEQ ID NO: 38384 - RNA, 1617 nt, Artificial Sequence
  derived and/or modified sequence opt11 from VP1__Norovirus_and/or_Norovirus-like__KP784691
augaaaauggcuuccaacgacgccacccccuccgacggcuccaccgccaaccucguccccgaagucaacaaugaaguuauggcgcucgaacccguagucggugccgccauagccgcccccgucgccggccaacaaaacgucaucgacccguggauccgcaacaacuuuguccaagcaccuggcggcgaauuuacggucucaccccgcaacgcacccggcgaaauacucuggucagcaccccucggcccagaucucaaccccuaccucucccaccuagcgcgcauguauaacggcuacgcuggcggcuucgaaguacaaguaauccuagccggcaacgcauucaccgccggcaaaauaaucuucgcugccgucccacccaacuuccccaccgaaggccugucccccucccaaguaacuauguucccccacaucaucguugacguccggcaacucgaacccguccuaauaccccuccccgacguccguaacaauuucuaccacuacaaccaauccaacgaccccaccauaaaacucaucgccaugcuauacacaccccuucgugccaacaacgccggcgaugacgucuucaccguaucaugccgcguacuaacucgccccagccccgacuucgacuucaucuuccucgucccucccaccguagaaucccgcacaaaacccuucagcgucccaauacuuaccgucgaagaaaugaccaacucccgcuuccccauuccacuugaaaaacucuucaccggaccaucuuccgccuuugucguacaaccacaaaacggucgcugcacuaccgacggcguccuacucggcacaacucaacuaucacccguaaacaucugcaccuuucgcggggacgucacccacaucgccggaacccacaacuacaccaugaaccucgcuucacaaaacuggaacaacuaugacccaaccgaagaaauccccgcaccccucggaacuccagacuucgucggcaaaauucaaggcguccuaacccaaacaacgcgcggcgacggcuccacacgaggccacaaagcaacagucucaacaggagacgcccacuuuaccccuaaacucggcagcguuauguucuccaccgacaccaacaacgacuucgaaacuggacaaaacacacgcuucacaccagucggcgucguccaagacggcagcaccacacaccaaaacgaaccgcaacaauggguccuccccucauaccucggccgagacucccacaacguccaccucgcacccgccguagcucccuccuucccaggcgaacaacuucucuucuuccgcuccaccaugcccggcugcucaggcuaccccaacaugaacauggacugccuccuaccccaagaauggguccaacacuucuaccaagaagcagcaccagcccaauccgacguagcucugcuacgcuucgucaaccccgacacuggccgcguccucuucgaaugcaaacuccacaaaucaggcuacguuaccguagcccacaccggccaacacgaccucgucaucccacccaauggcuacuuucgcuucgauagcuggguaaaucaauucuacacccucgcccccaugggcaacggcaccggccggcgacgcuaa

SEQ ID NO: 38385 - RNA, 1617 nt, Artificial Sequence
  derived and/or modified sequence opt11 from VP1__Norovirus_and/or_Norovirus-like__KX907727
augaaaauggccuccucagacgccaaccccucagaugguuccgcagcuaaccuaguucccgaaguaaacaaugaagucauggcgcucgaacccguaguuggcgccgccauagccgcacccgucgccggccaacaaaacguaauagacccauggauacgcaacaacuucguccaagcccccgguggcgaauuuaccgucagcccccgaaacgcccccggagaaauacucugguccgccccucucggcccagaccuaaaccccuaucuaucccaccucgcccgcauguacaacggcuacgccgguggauucgaaguccaaguuauacuagcaggaaaugccuucaccgcgggaaagauuauauucgccgccgucccgccaaacuuccccaccgaaggccuuuccccaucacaagucacaauguucccccacauuaucguagacguucgccaauuagaacccguccucaucccccuaccugacguccgaaacaacuucuaccacuacaaccaauccaacgacccaaccaucaaacucaucgcgaugcucuacacaccccuccgcgcaaacaacgcaggcgacgacgucuucaccgucagcugccgcguacucacccgccccuccccagacuucgacuuuauauuccucgucccgcccaccguagaauccaggacuaaacccuucuccguaccgguccucacuguagaagaaaugacaaacucccgcuuccccauaccacucgaaaaacucuucacaggccccagcuccgccuucgucguccaaccccagaacggacgaugcacaacugacggcguacuccuuggcaccacacaacugucacccgucaacauaugcaccuuucgcggcgacgucacccacauuaccggcucccguaacuacaccaugaaccucgccucccaaaacuggaacaacuacgacccaaccgaagaaauccccgccccacucggcaccccagacuucgucgguaaaauccaaggcaugcucacccagaccacacgcaccgacgguaguacacgcggccacaaagccauagucuacacaggcucagcagauuucgcccccaaacuaggucgaguccaguucgaaaccgacacugaccacgacuucgaagccaaucaaaacacuaaauucaccccggucggcguuauccaagacggcucaaccacccaccgcaacgaaccacaacaauggguccuacccucuuacucaggccgcaacacacacaacguacaccucgcccccgccguagcccccaccuucccgggcgaacaacuccuauuuuuccgcuccaccaugcccggcugcucaggcuaccccaacauggaccuagacugccuccucccccaggaauggguccaauacuucuaccaggaagccgcccccgcucagucagacguagcacuccuccgauuugucaaccccgacaccggccgcguacucuucgaaugcaaacugcacaaauccggauacgucaccgucgcacacaccggccagcacgaccucguaauaccaccaaacggcuacuucagauucgacuccugggucaaccaauucuacacucucgcccccaugggcaacggcacaggcagaagacgcuaa

SEQ ID NO: 38386 - RNA, 1617 nt, Artificial Sequence
  derived and/or modified sequence opt11 from VP1__Norovirus_and/or_Norovirus-like__KX354049
augaaaauggccuccucggacgcgaacccaucugacggcuccgccgcaaacuuaguccccgaagucaacaaugaaguuauggcacuugagccaguggucggcgccgccaucgcagcccccgucgcaggccaacaaaacgucaucgaccccuggauccgcaacaacuucguacaagccccaggaggagaguucaccgucagcccccgcaacgccccuggagaaauacuauggucagccccacucggacccgaccucaacccauaccuaucucaccucgcaagaauguacaacggcuacgcaggcggcuucgaaguccaaguaauacuagccggcaacgcauuuaccgcuggaaaaaucauuuuugccgcagucccaccaaacuucccaacggaaggccucucacccagucaagucaccauguucccccacaucauugucgacguacgccaacuagagcccguccucauaccccuacccgacguacgcaacaacuuuuaccacuacaaccaauccaacgaccccaccauuaaacuaauagccaugcucuacacuccccuacgcgccaacaacgccggcgacgacguauuuaccgucuccugccgaguacuaacccgucccucgccagacuucgacuucaucuuccuaguaccuccaaccguagagucccgcacaaaacccuucuccguccccauccugacugucgaagaaaugaccaacucccgauucccaaucccacucgaaaaacucuuuaccggccccuccucagccuucguaguccaaccacaaaacggacgcugcaccacagacggcguccuccucggaaccacccaacuaucacccgucaacaucugcaccuuccgcggagacgucacccauaucacaggcuccagaaacuacaccaugaaccucgccucacaaaacuggaacaacuacgaccccaccgaggaaauccccgccccacuaggaacacccgacuuuguugguaaaauccaaggcguccuaacccaaacaacccgcgccgacggcucaaccagaggccacaaagcaaccgucuacaccggcucugcagacuucgcccccaaacucggccgcguacaauucgaaacagacaccgaccacgacuucgaagccaaccaaaacaccaaauucacacccgucggcgucauccaagacggcggcaccacccaucgcaacgaaccacagcaauggguccuccccuccuauagcggcagaaacacacacaacguccaccucgcaccagcagucgcccccaccuuccccggcgaacaacuccucuucuuucgauccacaaugcccggcugcuccggcuacccaaacauggaccucgacugccuacucccccaagaauggguacaauacuucuaccaagaagccgcccccgcccaaagcgacgucgcccuucuccgcuucguaaacccagacacuggccgcguacucuucgaaugcaaacuccacaaguccggauacgucacagucgcccacaccggacaacacgaccuuguaaucccaccaaauggcuacuuucgcuucgauagcugggucaaccaauuuuacacccucgcccccauggguaacggaaccggccgccgccgauaa

SEQ ID NO: 38387 - RNA, 1617 nt, Artificial Sequence
  derived and/or modified sequence opt11 from VP1__Norovirus_and/or_Norovirus-like__KX354024
augaaaauggccuccuccgacgccaaccccucagacgguucagccgccaaccuaguccccgaagucaacaacgaagucauggcccuugaacccgucgucggcgcagccaucgccgcccccguagcuggccaacaaaaugucaucgacccauggauccgcaacaacuucguccaagcacccggcggcgaguucacagucuccccacgcaacgccccaggagaaauacuauggucugcaccccuaggccccgaccucaacccuuaccucucccaccuagcccgcauguacaacggcuacgccggaggcuuugaagugcaaguaauccucgcgggcaacgccuucacagcagggaaagucaucuucgccgcagucccaccuaacuuccccacugaaggcuuaucgccaucccaagucaccauguucccccacaucgugguagacguccgccaacucgaacccguccucaucccccuaccagacguccgaaacaacuucuaccacuacaaccaaucaaacgacccaaccaucaaacuaauagccaugcucuacacaccccugcgagccaacaacgcaggagacgacgucuucaccguuucaugccgcguacucaccagaccaagcccagacuucgacuucaucuucuuaguacccccuaccgucgaaagccgcaccaaacccuucucagucccaguccucaccgucgaagaaaugaccaacucccgcuuccccauaccacucgaaaaacucuucaccggacccagcucagcauucgucguccaaccccaaaacggccgaugcaccacugacggcguucuccucggcaccacccaacucucccccgucaacauaugcaccuuccguggagacgucacacacacuacaggaucucgcaacuacaccaugaaccucgcuucucaaaauuggaacaauuacgacccaaccgaagaaauuccagccccgcuuggaaccccagacuucgucggcaaaauccagggcguccucacccaaacaacccgcacagauggguccacccgaggccacaaggccaccgucuacaccggcucagccgacuucgcccccaaacucggacgcguccaauuugaaacagauaccgaucacgacuucgaagccaaccaaaacaccaaauucacccccguaggagucauccaagacgguagcacuacccaccgaaacgaaccccaacaauggguacuccccuccuacagcggccgcaacacucacaacguccaccucgcccccgccgucgcaccaaccuucccaggagaacaacuccuauucuuccgaucaaccaugccaggaugcuccggcuaccccaacauggaucucgacugucuucuuccccaggaauggguacaauauuucuaucaagaagcagcccccgcacaauccgacgucgccuuacuccgcuuugucaaccccgauaccggacgcguacucuucgaaugcaaacuccacaaaucagguuacguuaccgucgcccacaccggccaacacgaccucguaauacccccaaacggcuacuuccgcuucgacaguugggucaaccaauucuacacacuugccccaaugggcaacggcacaggccgacgccgcuaa

SEQ ID NO: 38388 - RNA, 1617 nt, Artificial Sequence
  derived and/or modified sequence opt11 from VP1__Norovirus_and/or_Norovirus-like__KX353955
augaaaauggcaagcaacgacgcaaacccauccgacggaucagcagcaaaucucguccccgaagucucaaacgaagugauggcacuagaacccguaguuggagccgcaaucgccgcccccgucgccggccaacaaaacgucauagacccuuggauccgcaacaacuucguacaagcacccggcggcgaguucaccgucagccccagaaaugccccgggcgaaauauuaugguccgccccacucggccccgacuuaaaccccuaccuaucgcaccucgcccgaauguacaacggcuacgcaggcggguucgaaguccaaguuauccucgcaggcaacgcuuucacagccggaaaaauaaucuucgcugcaguucccccaaacuuccccaccgaaggccucucccccucccaaguuacaauguuuccucacaucaucgucgacguccgccaacucgaacccguccuaauaccccuccccgacguccgaaacaacuucuaucacuauaaccaaucaaaugacucaaccauuaaacucauagcaaugcucuacacuccccuccgcgccaacaacgccggugaagacguguucaccgucagcugccgcguacucacccgccccucacccgacuucgacuucaucuuccucgucccacccaccgucgaaucucgcaccaaacccuucaccguccccauccucacagucgaagaaaugaccaacucccguuuccccauaccccuagaaaaacucuucacaggccccucaggcgcuuucgucguccagccccagaacggccgcugcaccacggacggcgucuugcucggcaccacccaacuaucccccgucaacaucugcacauuccgaggcgacgucacccacaucgccgguucccgcaacuacacaaugaauuuagcaagucuuaacuggaacaacuacgaucccaccgaagaaaucccugccccucucggcacccccgacuucguagguaaaauccaaggcguccuaacccaaaccaccaaaggcgacggcagcacucgaggccacaaagccacagucuacaccggcuccgcccccuucacccccaaacucgguuccguccaauucagcaccgacacugaaaacgacuucgaagcccaccaaaacacaaaauucaccccgguuggcgucauccaagacggcucaacaacucaccguaaugaaccccaacaauggguacuacccucauauuccggccgaaauguccacaacguccaucucgcccccgcaguggccccaaccuuucccggagaacagcuccucuucuuccgcagcaccaugccaggcugcucaggcuaccccaacauggaccuugacugccuccuaccccaagaauggguccaacacuucuaccaagaagccgccccggcccaauccgauguggccuuacuccgcuuugucaacccugacaccggacgaguccucuucgaaugcaagcuacacaaaucaggcuaugucaccgucgcccacaccgggcaacacgaccucgucaucccgcccaacggcuacuuccgcuucgacucuugggucaaucaauucuacacacucgcccccaugggcaacggcacaggccgccgccgguaa

SEQ ID NO: 38389 - RNA, 1617 nt, Artificial Sequence
  derived and/or modified sequence opt11 from VP1__Norovirus_and/or_Norovirus-like__AB972518
augaaaauggccaguucagacgccaaccccuccgacggauccgcagccaaccuaguuccagaaguaaacaacgaagucauggcccuagaacccguaguaggcgcugcuauagcagcccccgucgccgggcaacaaaaugucaucgaccccuggauacgaaacaacuucguacaggcccccggaggcgaguucaccgucucaccccguaacgcccccggcgaaauccuaugguccgcaccccuaggccccgaccucaaccccuaccucucccaccuagcccgaauguacaacggauacgccggcggcuucgaaguccaagucauucucgccggcaacgccuucaccgcaggaaaagugaucuucgcagcugucccucccaacuuccccaccgaaggccucucccccucccaaguaaccauguucccccauaucgucgucgacguacgccaacucgaacccguccucaucccucucccagacguacgcaacaauuucuaccacuauaaccaauccaacgaccccaccaucaaacucaucgcaaugcucuacacaccccucagagccaacaacgccggugacgauguauucacaguaucaugccgcguucuaacucgccccucacccgacuucgacuucaucuuucuaguacccccuaccgucgaaucaagaaccaaaccauucuccguucccguccucacugucgaagaaaugaccaacagcagauuccccaucccacucgaaaaacucuucacuggccccuccuccgcauucgucguccaaccacaaaauggccgaugcacaacugacggcguacuccucggcaccacacaacuuagccccgucaacaucugcacauuccgcggcgacgucacacauaucacaggaucccguaacuacaccaugaaucucgccucacaaaacuggucaaacuacgacccgaccgaagaaauccccgcaccacucggcacccccgacuucguagggaaaauucaaggcgucuuaacacaaacaacccgaaccgacggcucaacccgaggccacaaagcaaccguuuacacaggcuccgccgacuucgcccccaaacucggacgcguacaauucgagaccgacaccgaccgagauuucgaagcuaaccagaacaccaaauucacccccgucggcgucauccaagacggcucaaccacacaccguaaugaaccccaacaauggguccuacccuccuacuccggccgcaccacacccaacguacaccucgccccagccgucgcccccacguuccccggcgaacaacuucucuucuuccgauccacuaugcccggcugcuccggcuacccaaacauggaccucgacugucuacucccccaagaauggguccaguacuucuaccaggaagccgcacccgcccaaucagacgucgcacuccuucgcuucgucaaucccgacacuggccgcguacucuuugagugcaaacuccacaaauccggcuacguaaccguagcccauacaggacaacacgaccucguuauuccacccaacggcuacuuccgauucgacucuugggucaaucaguucuacacccucgcccccaugggcaacggaaccggcagacggcgcuaa

SEQ ID NO: 38390 - RNA, 1617 nt, Artificial Sequence
  derived and/or modified sequence opt11 from VP1__Norovirus_and/or_Norovirus-like__AB933744
augaaaauggcauccuccgaugcaaacccauccgacggauccaccgcgaaccucguacccgaaguaaacaacgaagucauggcacuagaacccgucgucggcgccgcaaucgccgcccccgucgcuggccaacaaaacgucauugaucccuggauccguaacaacuucguccaggccccaggcggcgaauuuacaguaagcccgcguaacgccccgggcgaaaucuuaugguccgccccgcucggcccagaccucaaccccuaccucucccaccucgcccgcauguacaauggguacgccgguggcuucgaaguccaggucauacucgcuggaaacgccuuuacagcaggcaaaaucaucuucgcagccguaccucccaacuuccccacagaaggacucucccccagccaagucaccauguucccccacaucaucguagacguccgacaacuggaaccaguccuuaucccccuccccgacguacgcaacaacuucuaccacuacaaccaauccaacgaccccacuaucaaacuaaucgccaugcuauacacgccccuacgugcaaacaacgccggcgacgacguauucaccguuuccugcagagucuuaacccgaccaucacccgacuucgauuucauauuccucguacccccaacagucgaaucacgcaccaaaccauucagcgucccuauccucacugucgaagaaaugaccaacucccgauucccaaucccccuagaaaaacuauucaccggacccuccuccacauucgucguccaaccgcaaaacggccgcugcaccacugacggcguccuccuaggaacuacccaacuuucucccgucaacaucugcacauuucgcggagacgucacacacaucgccggcucucggaacuacacaaugaaccuagcaucacaaaacuggaacuccuacgacccuacagaagaaauaccagcaccccucggcaccccagacuucgucggcaaaauccaaggcguacuaacccagacgacccgcacagacggcagcacccgcggccacaaggcaaccgucuacaccggauccgccgacuucuccccaaaacuaggcaggguccaauucgccaccgacaccgacaaugacuucgacgcaaaccaaaacaccaaauucacucccgucggaguaauccaagacggaggaacggcucaccgcaacgaaccccaacaauggguccuaccauccuacuccggacgaaacacacacaacguacacuuagcccccgccgucgcccccacauucccaggcgaacagcuccuuuucuuccgcuccaccaugcccggaugcucaggcuaccccaacauggaccuugacugccuccucccccaagaauggguccaauacuucuaccaagaggcagcccccgcccaauccgacgucgcccuacucagauucgucaaccccgacaccggucgaguccuguucgaauguaaacuacacaaauccggcuacgcuaccgucgcacacaccggacagcaugaccuagucaucccgcccaauggauacuuccguuucgacagcuggguuaaccaauucuacacccuagccccaaugggcaacggcacaggccggcgacgcuaa

SEQ ID NO: 38391 - RNA, 1617 nt, Artificial Sequence
  derived and/or modified sequence opt11 from VP1__Norovirus_and/or_Norovirus-like__AB933673
augaaaauggcauccaacgacgcaaaccccucagacggcagcgcugccaaccuugucccugaagucaacaacgaaguuauggcacuugaaccagucguaggcgccgcaaucgcagcucccgucgcaggucaacaaaacgucauagaccccuggauccgcaacaacuucgugcaagcccccggaggcgaauuuaccguaucaccccgcaacgccccuggcgaaauccucugguccgccccauuaggaccggaccucaaccccuaccucucccaccucgcacgcauguacaacggauacgccggagguuucgaaguccaagucauccucgccggcaacgccuuuaccgccggacaaaucauuuucgcagccgucccacccaacuuccccaccgagggccucagccccucacaaguuacaauguucccccacaucauagucgacguacgacaacucgagcccguccuaaucccccuacccgacguccgcaacaacuucuaccacuacaaccaauccaacgacucaaccauaaaacuuaucgccaugcucuacacaccccuccgagcuaacaacgccggcgaagauguauucaccgucuccugcagaguccucacacgacccucaccugacuucgacuucaucuucuuagucccacccaccgucgaaucgcgaaccaaacccuucaccguccccauccuuaccguagaagaaaugacaaacucucgcuuccccauaccccucgaaaaacucuucaccggccccucauccgcauucgucguccaaccccaaaacggccgcugcacaacagacggcguucuccucgguacuacucaacucagcccaguaaacauaugcaccuuccgcggcgacguaacacacaucgccggcucccguaacuacacaaugaaccuagcgucccucaacuggaacaacuacgaccccaccgaagaaauccccgcuccccucggcacccccgacuucgucggaaaaauccaaggcguccucacacaaaccacaaaaggagacgggucaacacgcggacacaaagcuaccgucuacacaggcagcgcccccuucaccccuaaacuaggaucaguccaauucagcaccgacaccgaaaaugacuucgaaacccaccaaaacaccaaauucacuccugucggcgucauccaagacggcggcaccacccaccgaaacgaaccgcaacaauggguccuucccuccuacuccggccguaacguccccaacguccaccuagcuccggccgucgcaccaaccuucccaggagaacaacuccucuucuuccgauccaccaugcccggcugcuccgguuaccccaacauggacuuagacugccuccucccccaagaauggguccaacacuucuaccaagaagcugcccccgcacaauccgacgucgcccuucuccgauucguaaaccccgacaccggccgcguacucuucgaauguaaacuacacaaaucuggcuacgucacuguagcccacaccggacaacacgaccucgucaucccacccaacggcuacuucagauucgauuccuggguaaaccaauucuacacccucgcccccaugggcaacggaacaggucgaagaagauaa

SEQ ID NO: 38392 - RNA, 1617 nt, Artificial Sequence
  derived and/or modified sequence opt11 from VP1__Norovirus_and/or_Norovirus-like__KM245070
augaaaauggccagcaaugacgcaaacccaucagauggguccgccgcaaaccucguccccgaagucaauaacgaggugauggcacucgaaccagucguaggcgccgccaucgccgccccaguagccggccaacaaaacgucaucgaccccuggauccgaaacaacuucguccaagccccaggaggagaguucaccgucuccccacgcaacgcuccaggugaaauccuuugguccgcaccccuagggcccgaccuaaaccccuaccuaucccaccucgcacgcauguacaacggcuacgcaggcggcuucgaagugcaagucauucucgcuggaaaugcguucaccgccggaaaaauaaucuucgcagccguaccuccaaauuuccccaccgaaggccucucccccucccaagucaccauguucccacauaucaucguagacguccggcaacucgaaccaguacucaucccacuucccgacguccgcaacaacuucuaccacuacaaccaauccaacgacuccacaauuaaacuuaucgccaugcuauacacaccccucagagcaaauaacgcaggcgaagacgucuuuacugucucuugucgaguucuaacccgccccuccccagacuucgacuucaucuucuuagucccacccaccgucgaaucccgcacaaaacccuucaccguccccauccucaccguagaagaaaugaccaacucccgcuucccaauaccucuggaaaaacucuucacaggaccauccggcgccuucguaguccagccacaaaacggacgcugcaccaccgacggcguccuacucggcaccacccaacucucacccguaaacaucugcacauuccguggcgacgucacccacaucgcaggcucacgaaacuacacaaugaaccucgccucacucaacuggaacaacuacgaccccaccgaagaaauccccgccccacucggcacacccgacuucguaggcaaaauacaaggaguccucacccaaaccacaaaaggagauggcuccaccagaggccacaaagcaacugucuacaccggaggagccccauuuacccccaaacucggcucuguacaauucucaacagacacugaaaacgacuucgaaacacaccaaaacacuaaauucacacccgucggcgucauccaagauggcuccaccacacaccgaaacgagccccaacaauggguccuaccaucauacagcggccgcaacguacacaacguacaccucgcacccgccguagccccaaccuucccaggagaacaacuccucuucuuccgauccacaaugcccggcugcucuggcuacccaaacauggaccuagacugccuucucccucaagaauggguccaacacuucuaccaagaggccgcgccagcccaaagcgacgucgcccuauuacguuucguuaacccagacacuggccgcguccuauucgagugcaaacuccacaaauccggcuaugucacagucgcucacacgggucaacacgaccucgucauacccccaaacggcuacuuccgauucgacuccugggucaaccaauucuacacccuggcacccaugggaaacggcaccggccgacgccgauaa

SEQ ID NO: 38393 - RNA, 1617 nt, Artificial Sequence
  derived and/or modified sequence opt11 from VP1__Norovirus_and/or_Norovirus-like__EU921382
augaaaauggccucaaacgacgccaacccaagcgacggcuccgcagcaaaucucguccccgaaguaucaaacgaagucauggcccuagaaccagucgucggcgccgcaaucgccgcgcccgucgccgggcaacaaaacgucauugacccauggauccgaaacaacuuuguccaagcccccggcggagaguucaccgugucaccccgaaaugccccuggcgaaauacuauggucagcaccccucggccccgaccucaacccauaccucucccaccucgcccgcauguacaacggauacgccggaggcuucgaaguccaagucauccucgccggcaacgccuucaccgcgggaaaaaucaucuucgcagccguucccccuaacuuccccacagaaggccucucacccucccaagucacaauguucccccacauaaucguagacguuagacaacucgaaccaguccugaucccccuccccgacgucagaaacaauuucuaccacuacaaccaacucaacgacuccaccauaaaacucaucgcaaugcucuacacuccccuucgcgccaacaacgccggcgaagacgucuucaccgucuccugccgcguacuaacccgccccucaccagacuucgauuucaucuuccucguuccacccaccguugaauccagaaccaagcccuucacaguacccauacucacggucgaagaaaugacaaacucccgauuccccaucccccuugaaaaacucuucaccggccccuccggcgcuuucguaguccaaccgcaaaacggccgcugcaccacggacggcguacuccucggcaccacccaacuuucucccguaaacaucugcacauuccggggagauguaacccacauagccggcuccagagauuauaccaugaaccuagcuucucucaacuggaacaacuacgacccaaccgaagaaaucccagcaccccucggaacccccgacuucgucggcaaaauacaaggcguccucacacaaaccaccaaaggcgacggauccacacgcggccacaaagccacaguauacacaggcucggccccauucacacccaaacucggcucaguccaguuuucaaccgacacagaaaacgacuucgaaacccaccagaacaccaaauucaccccagucggcguaauucaagacggcuccacuacccaccgcaacgaaccccaacaauggguacuccccucauacuccggcagaaacguccacaacguacaccuugccccagcagucgcccccaccuucccaggagaacaacuccucuucuuccguuccacaaugccaggaugcuccggcuaccccaacauggaccuagacugccuucuuccccaagaauggguccaacauuucuaccaggaagcagccccggcucaaucggacgucgcgcuacuacgauucgucaacccugacacaggacgcguacucuucgaaugcaaacuacacaaaucaggcuauguuacaguugcccacacaggccaacacgaccucguaaucccucccaauggcuacuuccgcuuugacuccugggucaaccaauuuuacacccuggcacccaugggcaacggcaccggccgccgacguuag

SEQ ID NO: 38394 - RNA, 1617 nt, Artificial Sequence
  derived and/or modified sequence opt11 from VP1__Norovirus_and/or_Norovirus-like__KP293589
augaaaauggccagcucagacgcaaaccccagcgacggauccgccgccaaccuaguccccgaagucaauaacgaagucauggcacuugaacccgucguaggcgccgcaaucgccgcccccgucgccggucaacaaaaugucaucgaccccuggauacgcaacaacuucguccaagcaccaggcggcgaguucaccguauccccucgcaacgcacccggcgaaauacuauggucugcaccccucggccccgaucucaacccauaccucucccaccucgcccguauguacaacggcuacgccggaggauucgagguccaaguuauucucgccggcaacgccuucaccgccggcaaggucaucuucgccgccguaccacccaacuucccaacagaaggacucagcccaucccagguuaccauguucccgcacauagucguagacguacgacagcucgagcccguacuaaucccccugccagacguacgcaacaacuucuaccacuauaaccaauccaacgacccaacaaucaaacuaaucgcaaugcucuacaccccacuccgcgcaaacaacgccggagacgacgucuucaccguguccugccgaguauuaacacgcccaucccccgacuucgacuucauauuccuaguacccccuaccgucgaaucacgcacuaaaccauucuccguccccguccucaccgucgaagaaaugacaaacucccgcuuccccaucccacuagagaaacucuucaccggcccaucuagugcauucgugguucaaccccaaaacggucgcugcaccaccgacggcguacugcucggaaccacccaacuauccccagucaacaucugcaccuuucgcggcgacguaacccacaucacgggcucacgcaacuacacaaugaaccucgccucccaaaacuggagcaacuacgaucccaccgaagacauccccgccccacucggcacccccgacuucgucggaaaaauccaaggcguacuaacccaaacaacacgcaccgacggcagcaccagaggccacaaagccacagucuacaccggcucagccgauuucgccccaaaacuaggccgcguucaauucgaaacagauaccgaccacgacuuugaagccaaccaaaauacaaaauucacaccagucggugucauccaagacggcuccacaacucaccgaaacgaaccacagcaauggguauuacccucauacagcggccgcaacacgcccaacguucaucuagcccccgcagucgcacccaccuuccccggcgaacaacuccuuuucuuccgcucaaccaugcccggcugcucaggcuauccuaacauggaccucgacugccuucugccgcaagaauggguccaauacuucuaccaagaagccgcacccgcccaauccgacgucgcccuccucagauucguaaacccagacaccggaagaguucucuucgaaugcaaacuacacaaauccggcuacgucaccgucgcacacacaggccaacacgaccucguaaucccacccaacggcuacuuucguuucgacuccuggguaaaccaauucuacacacuugcccccaugggcaacggaacaggccgacgccgcuaa

SEQ ID NO: 38395 - RNA, 1617 nt, Artificial Sequence
  derived and/or modified sequence opt11 from VP1__Norovirus_and/or_Norovirus-like__KP241908
augaaaauggccuccuccgaugccaaccccuccgacggcuccgcagccaaccuagucccagaaguuaauaaugaagucauggcccucgaaccaguaguaggcgccgccaucgcagcucccguagccggacaacaaaauguaaucgaccccuggauacgcaacaacuucguccaagccccaggaggugaguucaccguaucaccccgaaacgcccccggcgaaauccucugguccgccccguuaggccccgacuuaaacccauaccuuagccaccuugcacgaauguacaacggcuacgcaggcggcuucgaaguacaaguaauacuggccggaaacgccuucaccgcaggcaaagucaucuucgccgccguaccucccaacuuccccaccgaaggacuaucccccucacaagucaccauguucccccacauaguagucgacguccgccaacucgaacccguccucaucccccuccccgaugucagaaacaacuucuaccacuacaaccaauccaacgaccccaccauaaaacucauagcaaugcuauacacaccacuccgcgccaacaaugcaggagacgacgucuucacagucucaugccgcguucuaacacgccccuccccagacuucgacuucaucuuccucgucccacccaccguagaguccagaaccaaacccuucuccguccccguacucaccgucgaagagaugaccaacucccgauuuccaauuccccuggaaaaacuauucaccggcccauccuccgcuuucguaguccaaccacaaaacggccgcuguacaaccgacggaguacuucucgggaccacacaacucuccccuguaaacauaugcacauuccgaggagacgucacccacaucacaggcucacacaacuacaccaugaaccuagccucacaaaacuggucuaacuacgaccccaccgaagaaauccccgccccacuaggcacaccagacuucgucgggaaaauacaaggcguccuaacccagaccacacgcacagacgguuccacccgcggccacaaggcaaccgucuacacuggauccgcugacuucgcccccaaauuaggccgcguacaauucgaaaccgacaccaaccacgacuucgaagccaaccaaaacaccaaauucaccccaguaggugucauccaagacggaucaaccacacaccggaacgaaccucaacaauggguauugcccucuuacucuggucgcaacacaccaaacguacaccuagcccccgcugucgcacccaccuuccccggcgaacaacugcuauucuuuagauccaccaugccaggcugcucaggcuacccuaacauggaccucgacugccuccucccccaagaauggguccaauacuucuaccaagaagccgcccccgcccaauccgacgucgcccuccuccguuucguaaacccagacacuggccgcgucuuauucgaaugcaaacuacacaaaagcgguuacgucaccgucgcccacaccggccaacacgaccuuguaauucccccuaacgguuacuuucgauucgacuccugggucaaccaauuuuacacacucgccccaaugggaaacggaaccggccgacgacgcuaa

SEQ ID NO: 38396 - RNA, 1617 nt, Artificial Sequence
  derived and/or modified sequence opt11 from VP1__Norovirus_and/or_Norovirus-like__KJ451059
augaaaauggccucauccgacgccagccccucugacggcucagccgccaacuuagucccugaagucaacaacgaggucauggcccucgaacccguugucggagccgccaucgccgcccccguagccggacaacaaaacguuauugaccccuggauccggaacaacuucguccaagcucccggcggcgaguucaccguaucaccacgcaacgccccaggcgaaauccucugguccgccccacucggccccgaccucaaccccuaccuaucacaccucgccagaauguauaauggauacgccggcggauucgaaguacagguaauucucgccggcaacgccuucacugccggaaaagucaucuucgccgccguaccuccuaacuuccccaccgaaggacucucccccucccaagucaccauguuuccccauauagucgucgacguccgccaacucgaacccgugcucauaccccucccagacguacguaauaacuucuaccacuacaaccaauccaacgaccccaccauaaaacucauagcaaugcuauacacaccacuccgcgcaaacaacgccggcgacgacgucuucaccguauccugccgaguuuuaacccguccuucucccgacuucgacuucauauuccucguucccccaaccgucgaaucccgcacuaaaccauucagcguccccguccuaacagucgaagaaaugaccaacucccgcuuccccaucccccucgaaaaacuauucaccggccccuccuccgccuucgucguccaaccccaaaacggccgaugcacaacugauggcguccuccucggaacaacccagcucucaccagucaacauauguacuuuccgaggcgacguaacacacaucacaggcucccgaaacuacaccaugaacuuagccagccaaaacugguccaacuacgaccccaccgaagaaaucccagcuccccuaggaacccccgauuucgucggcaaaauccagggaguccuuacccaaaccacccgcaccgaugggucuacccgcggccacaaagcaacugucuacacaggcuccgccgacuucgccccaaaacugggacgaguacaauucgaaaccgacaccgaccgcgacuucgaagccaaccaaaacaccaaauucaccccgguaggaguaauccaagacggcucaacaacccaccgcaacgagccccaacagugggucuuacccuccuacuccggacgcaacacccccaacguccaccucgccccagccguagcccccacauuccccggcgaacaacuacucuucuuccgcuccaccaugccuggcugcuccggcuaccccaauauggaccucgacugccuccucccccaagaauggguccaauacuucuaccaagaagccgcacccgcccaauccgacguagcccuccuacgcuucgucaaccccgacaccggccgcguacucuucgaaugcaaauuacacaaauccggauacgucaccgucgcucacacaggacaacacgaccucgucaucccucccaauggcuacuuccgcuucgacagcugggucaaccaauucuacacccuggcacccaugggcaacggcaccggccgccgacgcuag

SEQ ID NO: 38397 - RNA, 1617 nt, Artificial Sequence
  derived and/or modified sequence opt11 from VP1__Norovirus_and/or_Norovirus-like__KM198570
augaagauggccuccaacgacgccaaccccucugacggcucagccgcaaaccuggucccagaagucagcaacgaagucauggcacuggaaccugucgucggagccgccaucgccgccccagucgccggccaacaaaacgucaucgaccccuggauccgaaacaacuucguccaagcgccugguggagaauuuaccguaagcccacgaaaugcacccggcgaaauacucuggggcgcaccccucggcccagaccucaacccuuaccucucacaccucgcccgcauguacaacggauacgccggaggcuucgaaguccaaguuauacuagccggcaacgccuucaccgccggcaaaaucaucuucgccgccgucccgcccaacuuccccaccgaaggccuguccccuucccaagucacuauguucccacacaucaucgucgacguacgccaacuagaacccgugcuaauaccccuacccgauguacgcaacaacuucuaccacuacaaccaaaccaacgacuccacaauuaaauuaaucgccauguuauacacuccccuccgcgccaacaacgccggcgaagaugucuucacagucuccugccgcguacuaacccgccccucacccgacuucgacuucaucuuccugguaccacccaccguugaaucccgaaccaaacccuucaccguccccauccucaccguagaagaaaugacaaacuccagauucccuauaccauuagaaaaacuuuucacaggacccucuggugcauucgucguacaaccccaaaacggccgcugcaccaccgacggaguccuucuagggaccacccagcuauccccagucaauauuugcaccuuccgcggagacgucacacacaucgccggaucacgaaacuacacgaugaaccuggcaucccuuaauuggaacaauuacgacccaacagaagaaauaccggcaccccuaggaacccccgacuucgucggcaaaauccaaggcguccuaacacaaaccacaaaaggagacgggucaacccgaggccacaaagccacaguauauacaggauccgcccccuucacgccaaaacugggcuccguccaauucucaaccgacaccgaaaacgauuucgaaacacaccaaaacaccaaauuuacccccgucggcguaauacaagacggcggcaccacccaccgaaacgaaccacaacaauggguccuccccuccuacagcggccgagacguccacaauguacaccucgcccccgccguagccccuaccuuccccggcgaacagcuacucuucuuccgaucgaccaugcccggaugcuccggcuacccaaacauggaccuagacugccuccucccccaggaauggguccaacauuucuaccaagaagccgcccccgcacaguccgacgucgcccuacuccgcuucgucaauccugacaccggccgcguacucuucgaaugcaaacuccacaaguccggcuacgucaccgucgcccacaacggacaacacgaccucguaaucccgccaaauggcuacuuccgcuucgacaguugggucaaccaauucuacacccuagccccuaugggaaacggcaccggaagacgccgauaa

SEQ ID NO: 38398 - RNA, 1617 nt, Artificial Sequence
  derived and/or modified sequence opt11 from VP1__Norovirus_and/or_Norovirus-like__KM198558
augaaaauggccucaaaugacgcaaaccccuccgacggcuccgcagccaaccucguccccgaagucuccaacgaagucauggcccucgaacccguagucggcgcagcaaucgcagcccccgucgcagggcaacaaaacgucaucgaucccuggauccgcaacaacuucguacaggcucccggcggcgaguucaccgucucaccccgcaacgcccccggcgaaauccuuugguccgcuccccuuggacccgaccucaacccauaccuaucccaccuagcccgaauguacaacggcuacgccggcggcuucgaaguccaagucauccuagccgguaacgccuucaccgcugguaagaucaucuucgccgcaguacccccuaacuuccccaccgaaggucucucccccucacaagucaccauguucccccacaucaucgucgacguacgccaacuagaacccguacuaaucccccuacccgacguccggaacaacuuuuaccacuacaaccaaacuaacgaccccaccaucaaauugaucgcuaugcucuacaccccgcuuagagcaaacaaugcaggcgaagaugucuuuacagucuccugccgaguccucacccgcccaucacccgacuucgacuucaucuuccucguaccaccaaccgucgaaucgcgaacuaaacccuucaccguaccuauccucaccguagaagaaaugacuaacucccguuuccccauaccacucgaaaaacuuuucacuggccccucaggagccuucgucguccaaccccaaaacggccgcugcaccacggacggaguacuccucggaaccacccaacucagccccgucaacaucugcacauuccgcggcgacgucacucacaucgccggcucccgcgacuauaccaugaaccuagcaucacucaauuggaacaacuaugacccaaccgaagaaauacccgccccacuaggcacaccagacuucgucggcaaaauucaaggcguccucacacaaaccacccgcggcgacggcuccaccagaggccacaaagccaccgucuauacaggcuccgcacccuucgcccccaaacucggcucaguccaauucuccacugacacugaaaacgacuucgaaacacaccaaaacacaaaguucacucccguaggcguuauacaagacggaggcaccacccacagaaacgaaccacaacaauggguacuaccauccuacuccggacgagacguccacaacguucaccucgcccccgccgucgcccccacuuuccccggagaacaacuccucuucuuccgcuccaccaugcccggcugcuccggcuaccccaacauggaucuugacugccuccucccccaagaauggguacaacacuucuaccaagaagcagcacccgcacaauccgacgucgcucuccugcgcuucguaaaccccgauaccggacgcguccucuucgaaugcaaacuccacaaaucaggauacguaaccguagcccacacagggcaacaugaccuagucauaccgcccaacggauacuuccgauucgacuccuggguuaaccaauucuacacccucgcccccaugggaaauggcaccggacgccgccgcuag

SEQ ID NO: 38399 - RNA, 1617 nt, Artificial Sequence
  derived and/or modified sequence opt11 from VP1__Norovirus_and/or_Norovirus-like__AB447456
augaaaauggccucaaacgacgcuaacccauccgacggcagcgcagccaaccucgucccggaaguuaacaacgaaguaauggcccucgaacccgucgucggagccgcuaucgccgcccccgucgccggacagcaaaacguaaucgacccauggauccgcaacaauuucguccaggcaccaggcggagaauuuacggucagcccccgcaacgccccaggcgaaauccucuggucugccccacuaggucccgaccucaacccauaucucucccaucucgcacgaauguauaacggguacgccggcggauucgaaguccaagucauccucgccggcaaugcauucacagcaggcaagaucaucuucgccgccgucccuccgaacuuccccaccgaaggccucagccccucacaagucaccauguucccacacaucauugucgacguccgccaacuagaaccuguacuaauaccccuccccgacguacgcaacaacuucuaccacuacaaccaaagcaacgacagcaccauaaaacucauagcuaugcuauacaccccacuaagagcgaacaacgccggcgaagacgucuucacuguaagcugcagaguacuaaccagacccuccccagacuucgacuucaucuuccuaguaccacccacaguugaaucccgaaccaaacccuucaccguuccaauacucaccguagaagaaaugaccaacucacgcuuucccaucccacuugaaaaacuuuucaccggaccaagcggagccuucgucguccaaccccaaaacggcagaugcaccaccgacggcguccuacucggcacaacccaacuaucacccgucaacaucugcaccuuccgaggcgaugucacccacauagcaggaucccgcaacuacaccaugaaccuagcuucccucaacuggaacaacuacgaccccacagaagaaauccccgccccacucgggaccccagacuucgucggcaaaauccaaggacuccucacccaaacuacaaagggagauggcucaacacgcggccacaaagccaccguuuacaccggcuccgcacccuucaccccaaaacucggcucuguccaauucucuaccgacacggaaaacgacuuugaaacccaccaaaauacaaaauucacccccguuggagucauccaagacggaucaaccacacaucgcaacgaaccgcaacaauggguccucccaucauacagcggccgaaacguccacaacguacaccucgcccccgccguagcgccaacauuccccggcgaacagcuacucuucuucagauccaccaugccaggcugcuccggcuaccccaacauggaccucgacugccuacuaccacaggaauggguacaacacuucuaccaagaagccgcacccgcccaaucagacguagcccuccuacgcuucguuaacccagacacaggccggguacucuucgaaugcaaacuccacaagucgggcuaugucacagucgcccacacaggucaacacgaccuagucauaccuccaaauggcuacuucagauucgacucauggguaaaccaauucuacacacuagcccccauggguaacggcaccggccgccgccgcuga

SEQ ID NO: 38400 - RNA, 1617 nt, Artificial Sequence
  derived and/or modified sequence opt11 from VP1__Norovirus_and/or_Norovirus-like__KF177444
augaagauggcuuccucagacgccaaccccuccgacggauccgcugcaagccucguacccgaagucaacaacgaagucauggcucucgaacccgucguaggagcagcaaucgccgcacccguagcaggccaacaaaacgucauugacccauggauccguaacaacuucgugcaggcaccgggcggcgaauuuaccguuucaccccgaaacgcaccaggagaaauccucuggucggccccacucggccccgauuuaaaucccuaccucucccaccucgcacguauguacaacgguuacgccggcggcuucgaaguccaagucauccucgcaggcaacgcauucaccgcugggaaagucaucuucgccgcagucccacccaacuucccaacugaaggccuaucuccaucacaaguaaccauguucccccacauagucauugacguacgccaacucgaaccaguccucauaccccuccccgacguacgcaacaacuucuaccacuacaaccaaucaaaugacccaacaaucaaacucaucgccaugcucuacacuccccuccgagcaaacaacgcuggcgacgaugucuucacagucagcugccgcguacucacccgcccuuccccagacuucgacuucaucuuccuagucccacccaccgucgaaucacgaaccaaacccuucagcguaccagucuugaccguugaagaaaugacaaacucucgcuuccccauaccccucgaaaaacuauucaccggacccuccuccgccuucgucguucaaccacaaaacggccgcugcaccaccgacggcguccuccucggcaccacgcaacucuccccaguaaauaucugcacuuuccgcggcgacguaacacacaucaccggaagucgcaacuacacaaugaaccuagcuucucaaaauuggaacaacuacgaucccacagaggaaauccccgcuccccucggcacccccgacuucgucggcaaaauccaaggaguacucacccaaaccacccgcacugaugguuccacccgcggccacaaagccaccgucuacacaggcuccgccgauuucgcccccaaauuaggccgcguccaguucgaaacagacaccgaccacgacuuugaagcaaaccaaaacaccaaauucacccccgucggcgucauucaagauggcucaaccacccaccgcaaugaaccacaacaauggguacuacccuccuacagcggcaggaacacacccaacguccaccuagccccagccgucgcacccaccuuccccggagaacaacuccucuucuuccgaucaaccaugccaggcugcuccggauacccaaacauggaccuagacugccuucucccccaagaauggguccaauacuucuaccaagaagccgcccccgcccagagcgauguagcccuacuccgauuugucaaccccgacaccggacgcguucucuucgaaugcaaacuccacaaauccggguacgucaccguagcucacacaggccaacacgaccuaguaauucccccaaauggcuacuuccguuucgacagcuggguaaaccaauucuacacacucgcccccaugggcaacggcaccggccguagacgcuaa

SEQ ID NO: 38401 - RNA, 1617 nt, Artificial Sequence
  derived and/or modified sequence opt11 from VP1__Norovirus_and/or_Norovirus-like__KF429776
augaagauggcaagcaaugacgcaaaccccuccgacggcuccgccgcaaaccuagucccugaggucaacaacgaaguaauggcacuagaacccguaguaggcgccgccaucgccgcccccguagccggacaacaaaauguaaucgacccauggauacgaaacaacuucguccaagcuccgggcggcgaauuuacagucucaccccgaaacgcaccaggagaaauccuaugguccgcuccccucggcccagaccucaaucccuaccucucccaucucgccaggauguacaauggcuacgccggcggauucgaaguacaagucauccuugccggcaacgccuucaccgccggcaaaauaaucuucgccgcagucccucccaacuuccccaccgaaggccuaucccccucacaagucaccauguucccccacaucauagucgacgucagacaacucgaacccguacugauccccuuaccugacguacgcaacaauuucuaccacuauaaccaaucaaacgacucaacaaucaaacucaucgccaugcucuacacuccccuccgcgccaacaacgccggugacgacguauuuaccguaucaugcagaguccucacccgacccucacccgacuucgacuucaucuuccuugucccacccacagucgagucccgcacaaaacccuucucuguccccauccuaacaguagaagaaaugacuaauucccgcuuccccauaccccuugaaaaacuauucacaggccccucauccaccuucguaguccaaccccaaaacggccgcugcaccaccgacgguguccuacuugguaccacccaacucucuccugucaacauuugcaccuuccgaggcgacguuacacauaucgccggcucacgaaauuacaccaugaaccucgcaucacaaaacuggaacuccuacgaucccacagaagaaauccccgcgccccuagggacccccgacuuugucggcaaaauccaaggaguccuaacccaaaccacccgaaccgacggauccacacggggacacaaagccaccguauacacaggcuccgcagacuucucacccaaacucggccggguccaauucgcaaccgacaccgacaacgacuucgacgccaaucaaaacaccaaauucacuccaguaggugucauacaagacggaggaaccgcccaccgcaacgagccacaacaauggguccucccguccuacagcggcagaaacacccacaacguccaccucgccccagccgucgccccaaccuuccccggagaacaacuccucuucuuccgcucaaccaugccuggaugcuccggcuaucccaacauggaccucgacugccuucuuccacaagaauggguccaauacuucuaccaagaagccgcaccagcccaaucagacgucgcccuccuacgauucguaaaccccgacaccggccguguacuauucgaauguaaacuacacaaaccuggcuacguaaccgucgcccacacaggacaacacgaccuagucaucccucccaacggcuacuuccgcuucgacuccugggucaaccaauucuauacacucgcccccaugggaaacggcaccggccgccgacgcuaa

SEQ ID NO: 38402 - RNA, 1617 nt, Artificial Sequence
  derived and/or modified sequence opt11 from VP1__Norovirus_and/or_Norovirus-like__KC243078
augaaaauggccucauccgacgccaacccaagcgacgguucugccgccaaccuagucccagaagucaacaaugaagucauggcucucgaacccgucgucggcgcagccaucgcggcccccgucgccggacaacaaaacgucaucgaccccuggauccgcaacaacuuuguccaagcccccggcggagaguucacaguaucccccagaaacgcacccggugaaauccucuggucugcaccccucggccccgaccugaaccccuaccucucccaccucgcccgcauguacaacggcuacgccggcggcuucgaaguucaagucauccucgcuggcaacgccuucaccgccggcaaagucaucuucgcagccgucccaccaaacuucccaaccgaaggccucucccccucccaaguuaccauguucccccacaucgucguugacguccgucaacucgaaccaguccucauaccacuccccgacguccgaaacaauuucuaccacuacaaccaguccaacgaccccaccaucaagcucaucgccaugcucuacacaccccuucgagccaacaacgccggugacgacgucuucacagucuccugccgcguccugacccgccccucacccgacuucgacuucaucuuccuagucccacccacugucgaaucucgaaccaaacccuucucaguccccguccucacagucgaagaaaugaccaacucacgcuuccccauuccccucgaaaagcuauucacgggccccuccucagcauucgucguccaaccccagaacggccguugcaccaccgacggaguccuauuagguaccacacaacucucacccgucaacaucugcaccuuccgcggugacgucacccacaucaccggcucccgcaauuacaccaugaaccucgccucgcagaacuggaacaacuacgaccccaccgaagaaauccccgcaccccucggcaccccagacuuugucggaaaaauccaaggcguccucacccagacaacccgcaccgacggcucaacccguggccacaaagcuaccguuuacacaggcucugccgacuucgcacccaaacucggccgcguacaguucgaaacagauaccgaccacgauuucgaagccaaccaaaacaccaaauucacaccaguuggagugauccaagacgguggcaccacccaucgcaaugagccccagcaauggguacuaccauccuacucaggacguaacacccacaacguccacuuagcacccgccgucgcgccaaccuuucccggcgagcaacuccucuucuuccgaucaacaaugcccggaugcucaggcuacccaaacauggaccucgacugccuccucccccaagaauggguccaauauuucuaccaagaagccgcacccgcccaaucugaagucgcccuacuaagauucguaaaccccgauacuggccgcguccuauucgaaugcaaauuacacaaauccggcuacgucacugucgcccauaccggacaauacgaccucgucauacccccaaauggcuacuuccgcuucgacuccuggguaaaccaauucuacacucucgcacccauggguaacggcacaggacgccgccgcuaa

SEQ ID NO: 38403 - RNA, 1617 nt, Artificial Sequence
  derived and/or modified sequence opt11 from VP1__Norovirus_and/or_Norovirus-like__KC409280
augaaaauggcaaguaacgacgcuaaccccucagacggcuccgcagccaaccucguccccgaagucucaaacgaagucauggcacucgaacccgucguaggcgccgccaucgcagcccccgucgccggacaacaaaacguaauagacccauggaucagaaauaacuuuguacaagcccccggcggugaauuuacagucucaccccgcaacgcccccggcgaaauccucugguccgcaccccuaggacccgaccucaaucccuaucuaucccaccucgcccgcauguacaacggcuacgccgguggcuucgagguacaagucauccuagccgggaacgccuuuaccgccggcaaaauaaucuucgccgcagucccacccaacuuccccaccgaaggucucucccccucacaagucaccauguucccccacaucauugucgacguacgccaacucgaacccgugcucaucccacuaccugacguacgcaacaacuucuaccacuauaaucaaacaaacgacucuaccauaaagcuaaucgccaugcucuacaccccacuucgcgccaacaacgccggugaagaugucuuuaccgucagcugccgcguacuaacucgacccuccccagacuucgauuuuaucuuucucguuccgcccaccguugaaucccgcaccaaacccuucacaguccccauccucaccgucgaagaaaugaccaacucaagguucccaauuccgcucgagaaacucuucacuggccccucaggcgccuucguaguacaaccccaaaacggacgaugcacaaccgauggcguccuccuaggcacaacccaacuuucccccgugaacaucugcaccuucagaggcgacguaacccacaucgcaggaucccgcaauuacaccaugaaccucgcaagccucaacuggaacaacuaugacccaaccgaagaaauccccgccccacuuggaacccccgacuucguaggcaaaauucaaggcguacuaacccaaaccacaaaagaagacggcuccacccggggucacaaagccaccgucuacacaggcuccgcgccguucaccccuaaacuaggauccguccaauucuccacugacacagaaaacgacuucgaaacccaccaaaacaccaaauucacaccagucggcgucauccaagacggcggcacuacucaccgaaacgaaccccaacaauggguacucccauccuacuccggacgcgacguccacaacguacaccuagcacccgccgucgcccccaccuuccccggcgaacaaauccuuuucuuccgauccacaaugcccggcugcuccggauaccccaacauggacuuagacugccuacucccccaagaauggguccaacacuuuuaccaagaagccgccccugcucaaucugacguugcccuccuacgcuucgucaaccccgacacuggccgcguccucuucgaaugcaaacuccacaaauccggcuacguaaccguugcccacaccggccaacacgaccucguuauaccaccaaacggcuacuuccgauucgacucaugggucaaccaauucuacacccucgcccccaugggcaauggaaccggccgccgccguuaa

SEQ ID NO: 38404 - RNA, 1617 nt, Artificial Sequence
  derived and/or modified sequence opt11 from VP1__Norovirus_and/or_Norovirus-like__KC175357
augaaaauggcaagcuccgacgcaaaccccagcgacggcuccgccgcaaaccuagucccagaagucaauaacgaaguaauggcacuugaacccgucgucggcgcagccaucgcagcccccguagccggccaacaaaacguuauagacccauggauccgcaacaauuucguacaagccccaggaggcgaguucacagucucuccacgaaacgccccgggcgaaauccucugguccgcgccccucggccccgaccuuaaccccuaccucucccaccucgcccgcauguacaacggcuacgcaggcggauucgaaguacaagucauccuagccggaaacgccuucacagccggcaaaauaaucuucgcagcagucccacccaacuuccccaccgaaggccucucacccucacaagucaccauguucccacacaucauaguagacguccgacaacucgaacccguacuaauuccacucccugaugucaggaacaauuucuaccacuauaaccaguccaacgacuccacuauuaaacuaaucgccaugcuauacacaccccuacgagcaaacaacgccggcgaagacguauucaccgucagcugucgcguacuaacacgaccauccccagacuucgacuucauauuccucgugccucccaccguugaaucccgaacaaaacccuucaccguuccaauccucaccgucgaagaaaugacaaacucacgauuccccauaccccucgaaaaacucuucaccggacccucauccgccuucguuguacaaccucaaaacggccgauguaccaccgacggcguacuacuuggaaccacccaacugucccccgucaacaucugcaccuucagaggcgauguaacacacauagccggaucucgcaauuacacaaugaaccucgcgucccucaacuggaacaacuaugacccaaccgaagaaauccccgcaccacucggcacccccgacuuugucggcaaaauccaaggaguccucacccaaaccacaaaaggcgacggaucaacccgcggacacaaagcaacagucuauaccggcucagcacccuuuacccccaaacucggcucaguccaauucucaacugacaccgaaaacgacuucgaaacccaccaaaacaccaaguucacccccgucggcguaauacaagacggcggcaccacacaccgaaacgaaccgcaacaguggguacuccccuccuacucuggucgcaacguaccaaacguccaccucgcaccagccguagcccccaccuuccccggcgaacagcuccuauucuuccgcuccaccaugccaggcugcuccggcuacccaaacauggaccuggacugccuucucccucaagaauggguacaacacuuuuaccaagaagccgccccagcccaaucagacguagcccuccuccgcuucgucaaccccgacacaggacgcguccucuucgaaugcaaacuccacaaauccggcuaugucacagucgcccacacaggccaacaugaccuagucaucccucccaacggauacuucagauucgauucaugggucaaccaauuuuacacacucgcccccaugggcaacggcacuggccgaagacgcuaa

SEQ ID NO: 38405 - RNA, 1617 nt, Artificial Sequence
  derived and/or modified sequence opt11 from VP1__Norovirus_and/or_Norovirus-like__JX459621
augaaaauggccucuuccgacgccaacccaucagacggauccacugccaaccuagucccugaaguuaacaacgaagucauggcccuagaacccguaguaggugccgcaaucgccgcaccagucgccggacaacaaaacgucauugaccccuggauccgcaacaacuucguccaagcccccggaggcgaguuuacagucucaccccgcaacgcccccggcgaaauccucugguccgcuccccugggcccagaccucaaccccuaccucagccaucuagccagaauguauaacggcuacgcaggcggcuucgaaguccaagucauccuugccggaaacgcauucacagccggaaagauaauauucgcagccgucccacccaacuuccccaccgaaggacucucccccucacaagucaccauguucccccacauaauugucgacguccgccaacucgaacccguacucaucccccuccccgacguccgcaacaacuucuaccacuacaaccaaucaaacgacccaacaaucaaacuaaucgccaugcuguacacuccccuacgcgccaacaacgcaggcgacgacgucuucaccguuucaugccgcguacuaacacgacccagcccagacuucgacuucauauuccucguacccccuacagucgaaucccgaaccaaaccguucuccgucccaauacuaaccgucgaagaaaugacuaacucccgauuccccaucccacucgagcgccuuuucaccggccccucauccgcauucgucguccaaccacaaaacggucgauguaccaccgacggcguccuacucggcacaacgcaacucucgcccguaaauaucugcacauuucgcggagacgucgcacacaucgcaggcacccaagaauacacaaugaaccuagcuucucaaaacuggaacaauuacgaccccacagaagaaauccccgcacccuuaggaaccccagacuucgucggcaagauccaagguguccuaacccaaaccacccgacgugauggcuccacucgaggccacaaagcaacaguaucaaccggcucuguccacuucaccccaaaacucggccgaauccaauuuucgaccgacacauccaacgacuucgaaacaggacaaaacacacgauucacccccgucggcguuguacaagacgguggcaccacccaccagaacgaaccacaacaauggguccucccagacuacagcggccgugacucccacaacguccaccuagcccccgccguugcacccucauucccaggcgaacaacuucucuucuuccgcucaaccaugcccggaugcuccggcuaccccaacaugaaccuagacugccugcucccccaagaauggguccaacacuucuaccaagaagccgcccccgcacaauccgacgucgcacuccuccgauucgucaaccccgacaccggccgaguccuauuugaaugcaaacuccacaaauccggauacgucaccgucgcccacaccggccagcacgaucucguaaucccacccaacgguuacuuccgcuucgacuccugggucaaccaauucuacacccuugccccaaugggaaacgguacuggccgacgucgcuga

SEQ ID NO: 38406 - RNA, 1617 nt, Artificial Sequence
  derived and/or modified sequence opt11 from VP1__Norovirus_and/or_Norovirus-like__JQ613541
augaaaauggccuccucagacgcaaaccccucugacggauccaccgcuaaccuaguccccgaagucaacaacgaagucauggcccucgaacccgucguaggcgccgccaucgccgcacccguagcaggccaacaaaaugucaucgaccccuggauccguaacaacuucguccaagcccccggaggcgaguucaccgucucuccccgaaacgcccccggcgaaauccucugguccgcaccccucggccccgaccucaaccccuaccugucccaccuagcacgaauguauaacggauacgccggcggcuucgaaguucaagucauccucgccggaaacgcauucacagccggaaaaaucguguucgccgucgugcccccaaacuuccccacugaaggucuaucccccucacaagucaccauguucccgcacaucauagucgauguucgucaauuagaacccguccucaucccccuccccgacguucgcaacaacuuuuaccacuacaaccaaucaaacgaccccaccauaaaauuaaucgccauguuauacacaccccuacgcgccaauaacgccggcgacgacgucuucaccguauccugccgcguccucacccgccccagccccgacuucgacuucaucuuccuaguaccgcccacugucgaaucucguaccaaacccuucagcguuccaauccuaacaguugaagaaaugaccaacucgcgcuucccaauaccccucgaaaaacuguucacaggcccuagcucagcauucgucguccaaccccaaaacggacgcuguaccaccgacggcguccuacucggcacaacacaacucucucccgucaacaucugcaccuuccgaggcgauguuacccacaucgccggcucccacaacuacaccaugaaccuagcaucccaaaacuggaacuccuacgaucccaccgaagaaaucccagcaccccuaggcacacccgacuucguaggaaaaauccaaggaguccuuacccaaacuacccgcaccgauggaucuacuagaggacacaaagccaccgucuacaccgggucagccgaguucucccccaaacucggucguguccaauucgccaccgacacaaacaacgacuucgacgccaaccaaaauacuaaauucacccccguuggcguuauccaagacggcggcaccacacaccgcaacgaaccacaacaguggguccuaccauccuacuccggccgcaacacccacaacguacaucuugcccccgccguagcccccacauuucccggcgaacaacuccucuucuuccgauccaccaugccagguugcucgggcuaccccaacauggaccuagacugccuccucccacaagaauggguacaauacuucuaccaagaagcagcaccagcccaauccgacguugcacuccuaagauucgucaaccccgacaccggccgaguccucuucgaauguaaacuccacaaguccggauacgucaccgucgcacacaucggccaacacgaucuagucaucccacccaacggcuacuuccgcuucgacuccugggucaaccaauucuauacacucgcccccaugggcaacggaaccggccgccgcagauga

SEQ ID NO: 38407 - RNA, 1617 nt, Artificial Sequence
  derived and/or modified sequence opt11 from VP1__Norovirus_and/or_Norovirus-like__JQ613527
augaagauggccuccuccgacgccaacccaucugacggauccaccgccaaccucguaccagaagucaacaacgaagugauggcccucgaacccguugucggcgcagccaucgccgccccagucgccggccagcaaaacgucaucgacccuuggguccgcaacaauuucguacaagcgccagguggcgaguucacugucagcccucggaaugcccccggcgaaauacucuggucagcaccccucggcccagaccuuaauccguaccucucccaccucgcccgcauguacaacggcuacgccggaggcuucgaaguccaaguaauccuagccggaaacgccuuuaccgccggcaaaaucaucuucgccgcaguaccacccaacuuccccacagaaggccucuccccaucacaagucacaauguucccccacauaauagucgacguccgccaacuagaaccuguacucaucccucucccagacguccgcaacaacuucuaccacuacaaccaauccaacgacccgaccaucaaacucaucgcaaugcucuauacaccacuccgcgccaacaacgcaggagacgacgucuucacugucucaugccgcguccucacccgccccucccccgauuuugacuucauauuccuugucccacccaccgucgaaucacgcaccaaacccuucuccguccccaucuuaaccgucgaagaaaugaccaauucccgauuccccaucccacuagaaaaacucuucaccggcccuagcuccgcauucguuguacaaccacaaaacggccgcugcaccaccgacgguguacuacucggcacaacgcaauuaucccccgucaacauaugcaccuucagaggcgacguuacccauaucgccggcucccacaacuacacaaugaaccucgccucacaaaacuggaacuccuacgacccgacagaagaaauacccgcaccccucggaacacccgacuucguaggcaaaauccaggggguccuaacccaaaccacccgaaccgacggcucuaccagaggccauaaagccacaguauacacagguucaaccgaguucagccccaaacuaggccgaguccaauucgccaccgacacaaacaacgauuucgacgccaaucaaaacacuaaauucacccccguuggaguaauacaagacggaggcaccacccaucgcaacgaaccccaacaauggguacucccuagcuacuccggccguaacacgcacaacguccaccuagcccccgccgucgcccccaccuucccaggagaacaacuacucuucuuccgcuccaccaugcccggaugcuccggcuaccccaacauggaccuagacugccuccuaccccaagaauggguccaauacuuuuaccaagaagccgccccugcacaaucugacgucgcccuccuacgcuucgucaacccagauaccggacggguccucuucgaaugcaaacuacacaaauccggcuacguaaccgucgcucacacaggacaacacgaccucguaaucccacccaacggcuacuuucgauucgacucaugggucaaccaauucuacacacucgcccccaugggcaacggcaccggaagacgacgcuaa

SEQ ID NO: 38408 - RNA, 1617 nt, Artificial Sequence
  derived and/or modified sequence opt11 from VP1__Norovirus_and/or_Norovirus-like__JF827296
augaaaauggccuccaacgacgccacacccagcgacggcucaaccgcaaaucuagucccagagguaaacaaugaagucauggcucuagaacccguugucggagcugccaucgccgccccaguugccggccaacaaaacgucaucgaccccuggaucagaaacaacuucguccaagccccaggcggagaguucacagucagcccccgcaacgcuccaggagaaauccucugguccgcuccccucggacccgaccuaaaccccuaccucucccaucuagccagaauguacaacggcuacgccggcggauucgaaguccaaguaauccuugccggcaacguauucaccgccgggaaaauaauauucgccgcagucccacccaacuuccccaccgaaggacucucaccaucucaaguaacaauguucccacauauaaucguagacguacgccaacucgaacccguccucauaccacucccagacguccgaaacaacuucuaccacuacaaccaauccaacgaccccacuaucaaacuuaucgcuaugcucuacacaccccuucgagccaacaacgcaggcgacgacgucuucaccgucucaugccgcguccuaacucgaccgagcccagacuucgacuucauauuccucgcacccccaaccgucgaaucgcgaaccaaaccauucuccguucccauccugaccgucgaagagaugaccaacucacgcuuccccauaccccuugaaaaacucuucaccggccccucgucagcauucgucguccaaccccaaaacggccgcugcacaaccgacggcguccuccucggaacaacccaacucucacccgucaacauaugcacuuuccgcggcgacguaacccacauugcuggcacacaaaacuacaccaugaaccucgcaucccagaacuggaacaacuacgaccccaccgaagaaauuccagcaccccuaggaacccccgacuucgucggcaaaauucaaggcguccucacccagaccacccgccgcgacggaucaacaagaggccacaaagccaccgucucaaccgguuccguccacuucacacccaaacucggauccauccaauucuccacagacacguccaacgacuucgagaccggccaaaacaccagauucaccccagucggcgucguccaagauggaucuaccacccaccaaaacgaaccccaacaauggguacuccccgacuauucaggcagagacucccauaacguacaccucgccccagccguagccccaaccuuccccggugaacagcuccuuuucuuccgcucuaccaugcccgguugcucuggauacccaaacaugaaccucgacugccuccucccccaggaaugggugcaacacuucuaccaggaaucagccccagcccaguccgacguagcccuccuccgcuucguuaauccagacacuggccgcguccuauucgaaugcaaacuacacaaauccggcuacgucacaguagcccacacuggccaacacgaccucguaauaccaccaaacggauacuucagauucgacuccugggucaaccaauucuacacccucgcccccaugggcaacggagcaggccgccgacgcuag

SEQ ID NO: 38409 - RNA, 1617 nt, Artificial Sequence
  derived and/or modified sequence opt11 from VP1__Norovirus_and/or_Norovirus-like__JF713050
augaaaauggcauccaacgaugccaaccccucagauggcuccgcagccaaccucguccccgaagucaacaacgaggucauggcacucgaacccgucgccggcgcagcacucgcagcccccgucgcaggccaacaaaacgucauagaccccuggauucgaaacaacuucguccaagccccaggaggagaguucaccgucucaccuagaaacgcacccggcgaaauacucugguccgcuccccucuccccagaucucaaccccuaccucucccaccucgccagaauguacaacuccuacgccggcggcuucgaaguacaagucauccucgccggcaacgccuucaccgccggcaaaaucaucuucgccgccguaccaccgaacuuccccaucgaaggccucuccccaagucaagucaccauguucccccacauaaucguagacguacgccaacucgaacccguccuaaucccacucccugacguccgaaacaacuucuaccacuacaaccaaagcaacgagcccaccauaaaacucaucgccaugcucuacacgccccuacgcgccaacaacgccggcgaagacguauucaccgucuccugccgaguccuaacccgaccuagccccgacuucgacuucaucuuccuggucccacccacaguugaauccagaaccaaacccuucaccguccccauccuaaccguagaagaaaugacaaacagccgcuuccccaucccacucgaaaaacucuucaccggccccuccuccuccuucgucguccaaccucaaaacggaagaugcacuaccgacggcguccuccucggcaccacccaacuaucuccagucaacauaugcacauuccgaggagacgucacacacaucgcaggcucccgcaacuacaccaugaaccucgccucuauaaacuggaauaacuacgacccuacagaagaaauucccgcaccccuaggcacacccgacuucguaggcaagauccaaggcaugcucacgcaaaccaccagaggcgacggcuccacacgcggccaccgcgccaccguauacaccggcucagccccauuuacccccaaacucggcucuguucaauucacaacagacaccgacaacgacuucgaaaccaaccaaaacacaaaauucacucccgucggcguaguccaagacggcgacaccgcccaucgcaacgaaccccaacaguggguccucccuucguacucuggucgaaacguccaaaacguccaucucgcacccgcaguagcccccacguuccccggcgagcagcuacuauucuuccgcuccaccaugcccggcuguuccggcuaccccaacauggacuuagacugucuacucccucaagaauggguccaacacuucuaccaagaagccgcucccgcacaauccgacgucgcccuucuccguuucgucaaccccgacaccggccgugucuuauucgaaugcaaacuccacaaguccggauacguaacggucgcccacacaggccaacacgaccuugucaucccacccaacggauacuuccguuucgacuccugggucaaccaguucuacacccucgcgcccaugggcaaugguacaggccgccgacguuga

SEQ ID NO: 38410 - RNA, 1617 nt, Artificial Sequence
  derived and/or modified sequence opt11 from VP1__Norovirus_and/or_Norovirus-like__HM802548
augaaaauggccuccaacgacgccucccccucagacggguccaccgccaaccuaguacccgaaguaaacaacgaagucauggcucucgaaccagucguaggagccgccauagccgcaccuguagccggccaacaaaacguuaucgaccccuggauccgaaacaacuucguccaagcccccggcggcgaauuuaccgucucaccccgaaacgcccccggcgaaauccucuggucugcaccccuaggaccagaucucaacccauaccucucucaccucgcccgaauguacaacggauacgccggcggauucgaaguacaggucauccucgccgguaacgccuucaccgcaggaaaaaucaucuucgccgccgucccgccaaacuucccaaccgaaggccuuuccccaucccaaguaacaauguucccacacaucauagucgacguccgccaacucgaacccguacuaaucccccucccagacguacgaaacaacuuuuaccacuacaaccaauccaacgacuccacaauaaaacucaucgccaugcuauacaccccacuccgcgccaacaacgccggcgacgacguauucaccgucuccugcagaguccucacccgcccaucccccgacuucgacuucaucuuccucguacccccaaccgucgaaucccgcaccaaacccuucaccgucccaauccucaccgucgaagaaaugacaaacagcagauuccccauuccccucgagaaacuuuucacuggccccucgucugccuucgucguccaaccccaaaacggacgaugcacuacugacggcguacuacuaggcacaacucaacucucaccagucaauaucugcacauuccgcggcgacgucacccacauacccggaacccgaagcuaccgaaugaaccucgccucacaaaacuggaacaauuacgacccaacagaggagauucccgccccacucggcacaccagacuucguaggcaagauucaaggcaugcuuacacaaaccacaaaaagagacggcuccacccggggccacaaagcaaccgucucaaccggcucuguagauuucacaccaaaauuagguuccguccaauucgcaacagacacagacaacgacuucgaaaccggacaaaacaccagauuuacgccaguuggcguuauacaagacggcagcuccacucaccgaaacgaaccccagcaauggguacuccccgacuacuccggccgaacuguccacaacguacaccucgcccccgccgucgccccaacauucccaggcgaacaacuccuguucuuccgcucuacaaugccaggaugcuccggauauccaaauauggaccuagauugccuacuaccccaagaguggguacaacacuucuaccaagaagccgccccuucccaaucagacgucgcccuacuccgauucguaaaccccgacaccggacgaguccucuucgaaugcaaacuccacaaagcagguuacgucacagucgcccauaccggccagcacgaccucguaaucccgccgaacggcuacuuccgauucgacucguggguaaaccaauucuauacacuggcaccuaugggcaacggggcaggccgcagacgauaa

SEQ ID NO: 38411 - RNA, 1617 nt, Artificial Sequence
  derived and/or modified sequence opt11 from VP1__Norovirus_and/or_Norovirus-like__GQ856459
augaaaauggcaagcaacgaugcaaaccccuccgacggcagcgcugccaaccucgucccagaagucaacaacgaaguaauggcacuugaaccaguaguuggcgccgcaauagccgccccagucgccggccaacaaaacguaauugacccauggauccgcaacaacuucguccaagcccccggcggagaauuuacagucaguccccgcaacgcuccaggcgaaauacucugguccgccccacucggccccgacuuaaaccccuaccuuagccaccuagcccguauguacaacggcuacgccggcggcuucgaaguccagaugauccucgccggcaacgccuucacagcaggcaaaaucauuuucgcugcaguaccacccaacuuccccacggaaggccuaucccccagccaggucacaauguucccccacaucaucgucgacguucgccaacucgaacccguucucaucccacuacccgacguaagaaacaacuucuaccauuacaaccaaucaaacgacucaaccauaaaacuaaucgcaaugcucuacaccccacuucgggccaacaacgccggcgaagaugucuucacugucuccugcagaguccucacccgccccucucccgauuuugacuucauauuccucgucccgccaacaguagaaucccgaacaaaacccuuuacuguccccauacuuaccgucgaagaaaugaccaacagccgcuuccccauaccacucgaaaaacucuucaccggccccucaucagcauucgucguccaaccccaaaacggacguugcacaaccgacggcguccuccuaggcaccacccaacucucacccgucaacauaugcaccuuucgaggcgacguaacccauauagccggcucccgcaacuacacaaugaaccucgcaucacuuaacuggaacaacuacgaccccacagaagaaaucccagcaccacucggcaccccagacuucgucggaaaaauccaaggaguucucacccaaaccacaaaaggcgacggcuccacccgcggucacaaagccacagucuacaccggcucagcacccuucacacccaaacucggcuccgugcaauucucaaccgacacagaaaacgacuucgaaacccaccaaaacacaaaauucacccccgucggagucauccaagacggcggcaccacccaccgaaacgaaccacaacaauggguccuccccucuuacuccggacgcaacguccccaacguccacuuagcccccgcugucgcccccacauucccaggagaacaacuacuauucuuccgcuccacuaugccuggcuguucaggauacccaaacauggaccuggacugccuccucccccaagaauggguccaacacuucuaccaagaagccgcccccgcacaaucagacgucgcccuacuacgcuucgucaaccccgacaccggccgcguacucuucgaaugcaagcuccacaaaucgggcuacguuacugucgcacacacaggccaacacggccucgucaucccucccaacggauacuuccguuucgacucaugggucaaccaauucuacacccucgcacccaugggcaauggaaccggacgccgccgcuaa

SEQ ID NO: 38412 - RNA, 1617 nt, Artificial Sequence
  derived and/or modified sequence opt11 from VP1__Norovirus_and/or_Norovirus-like__AB541308
augaagauggccagcaacgacgcuaaccccagcgacggauccgccgcaaaucuaguccccgaagucaacaaugaagucauggcccucgaucccguagucggcgccgccaucgcugcacccgucgccggccaacaaaaugucaucgacccuuggauccgcaacaacuucguccaagccccaggaggagaguucaccgucucaccccgcaacgccccuggcgaaauacucugguccgcaccccucggccccgaccucaacccauaccucucacaccucgcccgcauguauaacggcuacgcaggcggauucgaaguccaaguaauccucgcgggcaacgccuucaccgcaggcaaaaucaucuucgccgccgucccacccaacuuucccacugaaggacucucccccucgcaagucaccauguucccccacaucaucgucgacguccgacaacuugaaccaguacucaucccccucccugacguacgaaacaauuucuaucacuacaaccaaucaaaugacagcaccauuaaacucaucgcaaugcucuacacaccccuccgcgcaaacaacgccggagaagaugucuuuaccguuuccugccgcguccuuacccgccccuccccugacuucgacuucaucugucucgucccacccacugucgaaucacgaaccaagcccuucaccgucccgauacucaccgucgaagagaugaccaacucccgcuuucccauaccccuagaaaaauuauucaccggccccagcucagcuuucgucguacaaccccaaaacggacgcugcacuaccgacggaguacuacucggcaccacacaacucagccccguuaacaucugcaccuuccgaggugaugucacacauaucgccggcucccgcaacuacacuaugaacuuagcaucccuaaacuggaacaacuacgauccaaccgaagaaaucccagcaccccucggcacccccgacuuuguaggaaaaauacaaggaguccuaacacagacaacaaaaggcgacggcuccacccgcggccacaaagccacaguauacaccggauccgcccccuucacccccaaacucggaucaguccaguucuccaccgacacugaaaacgacuucgaaacccaccagaacacaaaauucaccccugucggcguaauacaagacggcggcaccacccacagaaacgaaccccaacaauggguccuacccucuuacuccggccgcaacguccccaauguacaccucgcccccgccguagccccgaccuuccccggagaacaacuacucuucuuccgauccaccaugcccggauguucgggcuacccaaacauggaccucgacugucuccucccccaagaauggguucaacauuucuaucaagaagccgcucccgcccaauccgacgucgcacuucuacgcuucgucaaccccgacacagguagaguacuauucgaaugcaaacuccacaaaucuggcuaugucaccgucgcacacaccggacaacaugaccuugucauaccacccaacggauacuuccgcuucgacuccugggucaaccaauucuacacccucgcccccaugggaaauggaaccggcaggcgccgauaa

SEQ ID NO: 38413 - RNA, 1617 nt, Artificial Sequence
  derived and/or modified sequence opt11 from VP1__Norovirus_and/or_Norovirus-like__AB541276
augaaaauggccucaaaugacgcaaacccauccgacggcuccgcagcaucccugguccccgaaguauccaacgaagucauggcccucgaaccaguagucggcgccgccaucgcugcccccguagccggccagcaaaacguaaucgaccccuggauccgaaacaacuuuguccaagccccuggcggcgaguucaccgucucaccucgcaacgcccccggcgaaauucuaugguccgcaccccucggaccugaccucaaccccuaccuaucacaccucgccagaauguacaacggauacgccggcggcuucgaaguccaagucauccucgcuggaaacgccuucaccgcaggcaaaaucaucuucgccgcaguaccaccuaacuucccaacggaagggcuaucaccgucccaagucaccauguucccccacauaauaguagacguccgccaacuagaacccguacucaucccccuccccgauguccguaacaacuucuaccacuacaaccaaucaaaugacuccacgaucaaacuuaucgccaugcucuacacaccccuccgcgcaaacaacgccggagaagacguauucaccguuuccugcagaguccucacccguccauccccagacuucgacuucauauuccucgucccgcccacugucgaaucccgaaccaaacccuucacuguccccauccuaaccguagaagaaaugaccaacucgcgauuccccaucccccuugaaaaacuguucacaggccccuccggcgccuucgucguacaaccccaaaauggacgaugcaccaccgacggcguccuccucgguacaacccaacuuucaccaguuaacaucugcaccuuccgaggcgacgucacccacaucgccggaucacgaaacuacacaaugaacuuagccucgcucaacuggaacaacuaugacccaaccgaagaaaucccagcuccccucggaacccccgacuuugucggcaaaauacaaggcguacucacccaaacaaccaaaggcgacggaucaacacgcggccacaaagccacaguauacaccggcuccgccccauuuaccccaaaacuaggcuccguccaauucuccacagacaccgaaaacgacuucgaaacacaccaaaacaccaaauuuacacccguaggcgucauccaagacggcucuaccacacacagaaacgaaccacaacaguggguccucccuuccuacucaggcagagacguccacaacguccaccuagcacccgccgucgccccuaccuucccaggagaacaacuacucuucuucagauccaccaugccgggcugcucuggcuaccccaacauggaucucgacugccuacucccccaagaauggguccaacacuucuaccaagaagccgcccccgcccaaucagacguggcccuucuucgcuucguaaaccccgacaccggccgcguacuauucgaauguaaacuccacaaauccggauacgucacagucgcacacacuggccaacacgaccucguaauacccccaaacggcuacuuccgcuucgacucauggguaaaccaauucuauacacucgcacccaugggcaacggaaccggccgccgccgcuaa

SEQ ID NO: 38414 - RNA, 1617 nt, Artificial Sequence
  derived and/or modified sequence opt11 from VP1__Norovirus_and/or_Norovirus-like__AB541224
augaaaauggcaucaaaugacgcaaaccccagcgacggcuccgcagccaaccucguccccgaaguauccaacgaaguaauggcacuagaacccgucgucggggccgccaucgcagcacccgucgccggacaacaaaacguaauugacccauggauacgcaacaacuuuguacaagcccccggaggcgaauuuaccgucucaccccgcaacgcacccggagaaauccucugguccgcgccccucggaccagaccucaaccccuaccuaucucaccuagcacgcauguacaacggauacgccggaggcuucgaaguucaggucauccucgccggcaacgccuucaccgcaggaaaaauaauauucgcagccgucccaccaaacuuccccaccgaaggccucagucccucucaagucaccauguucccccacauaaucguugacguacgucaacucgaacccguccucaucccacuccccgauguucgaaacaacuucuaccacuacaaccaguccaacgacuccaccaucaaacucaucgccaugcuuuacacaccccuccgggccaacaacgcaggcgaagacgucuucaccgucagcugccgcguccucacaagaccuuccccagacuucgacuucaucuuccuugucccacccaccguagaaucacgcacaaaacccuucacaguccccauucucaccgucgaagaaaugacaaacucccguuuccccaucccccuagaaaaacucuucacuggccccucuuccgccuucgucguccaaccccaaaacggacguugcaccacagauggaguccuccucgguaccacucaacucuccccuguaaacaucugcacuuucagaggcgaugucacacacaucgccggaucacgaaacuacaccaugaaccucgcaucacucaacuggaacaacuacgaccccaccgaagaaauucccgcuccccuuggcaccccagacuucguaggaaaaauccaaggaguccuaacccaaaccaccaaaggcgauggauccacccgcggccacaaagcaaccgucuacaccggauccgccccuuucacaccaaaacucggcucaguccaguuuucuaccgauaccgaaaaugacuucgaaacccaccaaaacaccaaauucacacccgucggcgucauccaagacggcggcaccacgcaccgaaacgaaccacaacaguggguacuacccagcuacucaggccgcaacguccccaacguacaccucgcaccagccgucgcccccaccuucccuggugaacaacuccuauucuuucgcuccacaaugcccggcugcuccggauacccaaacauggaccucgacugccuucucccucaagaauggguccaacacuucuaccaagaagccgcccccgcccaaagcgacguggcccuacuccguuucgugaacccagacacuggccgaguccucuucgaaugcaaacuacacaaaucaggcuacgucaccgucgcccacaccggccaacacgaccuaguaaucccgcccaacggauauuuucgauuugacagcugggucaaccaauucuacacccucgccccaauggguaacggcaccggccgccgccguuaa

SEQ ID NO: 38415 - RNA, 1617 nt, Artificial Sequence
  derived and/or modified sequence opt11 from VP1__Norovirus_and/or_Norovirus-like__AB504330
augaaaauggcuuccaacgacgccaaccccuccgacggauccgcugccaaccucguccccgaagucaacaacgagguaauggcccucgaacccguagucggcgccgccauagccgcucccgucgccggacaaaccaacgucaucgaccccuggauccgaaacaacuucguccaagcucccggcggcgaguucaccgucucaccccgcaacgcacccggcgaaaucuuaugguccgcaccccucggcccagaccucaaccccuaccuaucccaccuggccaggauguauaacggguacgccgguggcuucgaaguucaagucauccucgcaggaaaugcauucacagccgguaaaaucauuuucgcagccgucccacccaacuuccccaccgaaggacuuucccccucacaagucacuauguucccccacauaauagucgacguucgucaacuugaacccguccucaucccacugccagacguccgcaacaacuucuaccacuacaaccaauccaacgacucgaccaucaaacucauagcuaugcuauauacaccccuccgcgccaacaacgcaggagaagacgucuucaccgucucaugucgcguccucacccgcccuucacccgacuucgauuucaucuuccucguaccacccaccgucgaaucccgaaccaaaccauucaccgucccaauccucaccgucgaagaaaugacaaacucccgcuuccucauuccccucgaaaaacuauucaccggccccucaggcgccuucgucguccaaccacaaaacggucgaugcaccaccgacgggguccuccucggcaccacacaacuauccccugucaacaucugcacuuuccgcggcgacgucacccacauagcuggcucucgaaacuacacaaugaaccuugcaucacuaaacuggaauaacuacgaccccaccgaagaaaucccugcuccucucggcacacccgacuucgucggaaaaauucaaggcguacuuacccaaacuaccaaaggcgaugguuccaccagaggccacaaagccaccguauauaccggcucagccccauucacgccuaaacucggcuccguccaauuuuccaccgacaccgaaaacgacuuugaaacccaccagaacaccaaauucacccccgucggcgucauacaagacggcucuaccacgcaccgaaacgaaccccaacaauggguccuaccauccuacuccgguagaaacguccacaauguccaccucgccccugcagucgcccccaccuucccaggcgaacaacuccuuuucuuccgcuccaccaugccuggcugcuccggauaccccaacauggaccuagacugccucuuaccccaagaauggguacaacacuucuaccaagaagccgcccccgcccaauccgacgucgcccuacuaagauucgucaacccagacacaggccgaguacuauucgaaugcaaacugcacaaaucuggauacguaaccguugcccacaccggccaacacgaucuagucaucccacccaauggauacuuccgauucgacucguggguaaaccaauucuacacacuagcccccaugggcaacggcaccggccgccgccgcuaa

SEQ ID NO: 38416 - RNA, 1617 nt, Artificial Sequence
  derived and/or modified sequence opt11 from VP1__Norovirus_and/or_Norovirus-like__AB447445
augaaaauggccuccaacgaugcaaaccccuccgacggcucagcagcaaaccuuguccccgaagucaacaacgaagucauggcccucgaacccgucguuggcgccgcaaucgccgcacccgucgcaggacaacaaaacgucaucgacccauggauacgcaacaacuucguccaagccccaggaggcgaguucaccgucagcccccgaaacgcccccggcgaaauccucugguccgcaccccuaggacccgaccuaaaccccuacuuaucccaccuagcccgcauguacaacggauacgccggaggauucgaaguacaagucauccucgcaggcaacgccuuuacagcaggcaaaauuaucuucgcggccgucccgccaaacuuccccaccgacggccuuucccccucacaaguaaccauguucccucauauuauaguagacguucgccaacucgaaccagugcucauaccccuuccagacguccgcaacaacuucuaccacuacaaccaauccaaugacuccaccauaaaacuaaucgcaaugcuauacacaccccuacgagccaacaacgccggagaagacgucuucaccgucuccugccgaguccuaacccgucccucccccgacuucgauuucaucuuucuaguacccccaacagucgaaucacgaaccaaaccauucacaguacccauccuaaccgucgaagaaaugacaaacucccgcuuccccauaccccuugaaaaacuauuuaccggcccgucauccgccuucgucgugcaaccccaaaacggccgcugcaccaccgacggcguacuucucggcaccacccaacucucuccggucaacaucugcaccuuccgcggcgacgucacccacaucgccggaucccgaaacuacaccaugaaccucgcaucccuuaacuggaacaacuacgacccuaccgaagagauccccgcaccccucggcacacccgacuuuguaggcaaaauccaaggaguccucacacagacaaccaagggagacgggucgacacgagggcacaaagccaccgucuacaccggaucagcccccuucaccccaaaacuaggauccguacaauucuccaccgacaccgaaaacgacuucgaaacacaccaaaacacaaaauucacacccgucggcguaauacaagacggaggcaccacucaccgaaacgaaccccaacaauggguccuccccagcuacucaggacgcaacguccacaacguccaccuagcacccgccguggcaccaaccuucccaggcgaacaacuccucuucuuucguuccaccaugcccggaugcucaggauaccccaacauggaccucgacugccuccucccccaagaauggguccaacacuucuaccaagaagcugccccugcacaaucggacgucgcccuacuccgauuugucaaccccgacacaggacgcguucucuucgaaugcaaauuacacaaauccggcuacgucaccguagcacauaccggccaacacgaucucgucauuccacccaacggauacuuccgauucgauuccugggucaaccaauucuacacacucgcacccaugggcaacggcaccggccgacgacgcuaa

SEQ ID NO: 38417 - RNA, 1617 nt, Artificial Sequence
  derived and/or modified sequence opt11 from VP1__Norovirus_and/or_Norovirus-like__AB294793
augaaaauggccagcaacgacgcuaaccccuccgacggcagugccgcaaaccucgucccagaggucaacaacgaagucauggcccucgaacccgucgucggcgccgcuauagccgccccagucgccggccaacaaaacguaaucgaccccuggauacgcaacaacuuuguacaggcccccggcggugaguucaccgucucuccccgcaacgccccaggcgaaauccucugguccgcaccccucggcccagaucuaaaccccuaccuuucccaccucgcucgaauguacaauggcuacgccggaggcuucgaaguccaaguaauacuagcaggcaacgccuucacagccggcaagaucaucuucgccgcagugccucccaacuuccccacagaaggucucucccccucccaggucacaauguuuccccacauuaucguugacguccgucaacuagaacccguccugaucccccuccccgacguccgcaacaacuucuaccacuacaaccaaucuaacgacucuacaauuaaacucaucgccaugcuauauaccccauuacgcgccaacaaugccggagaggacgucuucaccgucuccugccgcguucucacccgccccucacccgacuucgacuucaucuuccuagucccaccaacuguugaaagccgcaccaaacccuucacuguacccauccucaccgucgaagaaaugacaaacucccgcuuccccaucccccucgaaaaacucuucacaggcccuucaggcgccuucguaguccaaccccaaaacggccgcuguaccaccgaugguguacugcucgguaccacccaacuaucacccgucaacaucugcaccuuccgcggugacgucacacacaucgcagguucaagaaacuacacuaugaaccuagcuucccucaacuggaacaacuacgaccccaccgaagaaauacccgcuccccuaggcacuccagacuucgucggcaaaauucaaggaaugcugacgcaaacuaccaaaggagauggauccacucgaggccacaaggccacugucuacacgggcuccgcccccuucacccccaaacucgguucaguacaauucucuaccgacacggaaaacgacuucgaaacccaccaaaacaccaaauucacacccgucggcgucauccaagacggcuccaccacccaccgcaacgaaccccaacaauggguacuccccucauacuccggacgcaacguccacaacguccaccucgcacccgccgucgcaccaacauuccccggcgaacaacuucucuuuuuccgcuccacaaugcccggaugcuccggcuaccccaacauggaccuagauugcuuacuaccacaagaauggguccaacacuucuaccaagaagcagcacccgcccaauccgacgucgcucuacucagauucgucaaccccgacacuggacgcguacuauucgaauguaaacuacacaaauccggcuacguaaccgucgcccacacuggacaacacgaccucgucauaccacccaacggcuacuuccgguucgacucauggguaaaccaauucuacacccuagcccccaugggcaacggcaccggccgaagaagauaa

SEQ ID NO: 38418 - RNA, 1617 nt, Artificial Sequence
  derived and/or modified sequence opt11 from VP1__Norovirus_and/or_Norovirus-like__AB303934
augaaaauggccucuaacgacgccaacccauccgauggcuccacagccaaccucguacccgaagucaacaacgaaguaauggcccuagaacccgucgucggcgccgccaucgcugcacccgucgcuggccaacaaaacgucaucgaccccuggauccguaacaacuucguccaggcccccggcggcgaguucacagucucaccccgaaacgcacccggcgaaauccucugguccgcaccacucggccccgaccuaaacccuuaccucucccaccucgcccgaauguacaacggcuacgccggcgguuucgaaguccaagucauccucgccggaaaugccuucaccgccggcaaaaucaucuucgccgccguacccccaaacuuccccacugaaggacucucccccucccaagucaccauguucccucacaucaucgucgacguacgccaacuagaaccaguacuaaucccacuacccgacguccgcaacaacuucuaccacuacaaccaauccaacgaccccacaaucaaacucaucgcaaugcucuacaccccacuaagagcaaacaacgcaggcgaagacgucuuuacagucuccugccgcguccuaacccgccccucccccgacuucgauuucaucuuccucguacccccaacagucgaaucacguacaaaacccuucacagucccaauacuaaccgucgaagagaugacaaacucccgcuuccccauccccuuagaaaagcuauucaccggccccuccggcgcuuucgucguccaaccccaaaacgggcgcugcacuacugacggaguccugcuuggcacaacucagcuaucccccgucaacaucugcacauuccgcggagacgucacccacaucgcuggaacacacaauuacaccaugaaucucgccucccaaaacuggaacaacuacgaccccacagaagaaaucccagcaccccucggcacccccgacuucgucggacgaauacaaggcaugcuuacgcaaacuaccagaggcgacggauccacccgcggacauaaagcaaccgucucaaccggcgacguccacuucacaccaaaacuaggaucuauccaauucaauacagacacaaacaacgacuucgaaaccggccaaaacaccaaauucaccccagucgguguaauccaagacggaaacggagcccaccaaaaugaaccacaacaauggguacuccccuccuacucaggucgcaccggccacaacguacaccuagcccccgcaguagcgcccaccuuccccggggaacaacuccuauucuucagaagcaccaugcccggcugcuccggauaccccaacaugaaccucgacugccugcuaccacaagaauggguccaacacuucuaccaagaggccgcacccgcgcaaucagacguagcccuucuccgcuuuguuaaccccgacaccggccguguccucuucgagugcaaacuacacaagucaggcuauaucacugucgcccacacaggccagcacgacuuaguaauacccccaaacggcuacuuucgcuucgacucaugggucaaccaauucuacacccucgcgcccaugggcaacggcacaggccguagacgauaa

SEQ ID NO: 38419 - RNA, 1617 nt, Artificial Sequence
  derived and/or modified sequence opt11 from VP1__Norovirus_and/or_Norovirus-like__KU678205
augaaaauggcuucaucagacgccaaucccucugacggaucagcagccaaucucguccccgaggucaacaacgaaguaauggcccucgagcccgucguaggugccgccaucgccgccccugucgccggccagcaaaacgucaucgaccccuggauccgcaacaacuucguacaagcccccggcggagaguucacagugagcccccgaaaugcccccggcgaaauccucugguccgcaccucuaggcccagaccucaacccauaccuaucccaucuagcacguauguacaacggcuacgccggcggcuucgaaguacaagucauccucgccggcaacgccuucacagccggcaaaguuaucuucgcagccgucccucccaacuucccuacagaaggccucuccccaucacaagucaccauguucccucacauaguagucgacguacgucaacucgaaccaguccucaucccccuacccgacguccgaaacaacuucuaccacuacaaccaauccaaugacccaaccaucaaauuaaucgccaugcucuacacuccccuucgagccaacaacgcaggagacgacgucuucacaguaucaugccgcguacucacccgacccagccccgacuucgacuucaucuuccucgucccacccaccgucgagucccgaacaaaacccuucuccgugccuguacuuaccguagaagaaaugaccaacucccgauucccuaucccccuagaaaaacuauucaccggacccuccuccgccuucguaguccaaccacaaaacggccgcugcacaaccgacggaguccuccuaggcaccacacaacucuccccaguaaacaucugcacuuuccgaggcgacgucacccacaucaccggcucacauaacuacacaaugaaccucgcaucccaaaacuggagcaacuacgaccccaccgaagagauccccgcuccacucgguaccccugacuuugucggcaaaguccaaggaguccuuacacaaaccacacguacggacggcucaacacgaggccacaaagccacagucuacacaggcuccgccgauuucgcccccaaacuaggcagaguccaauucgagacagacacaaaccacgacuuugaagccaaccaaaacacaaaauucacccccgucggcgucauacaagacggcggcacaacacaccgcaacgagccccaacaauggguccuccccuccuacucuggccgaaacacaccaaacguccaccuagcccccgccguggcacccacuuucccaggcgaacaacuacuauucuuccgcuccacaaugcccgguugcagcggauaccccaacauggaccuggacugccugcuuccccaagaauggguccaauacuucuaccaagaagcagcaccagcccaaucagacguugcccuucuccgcuucgucaacccagauacaggacgcguacuauucgaaugcaaacuacacaaauccggauacgucacagucgcccacacaggacaacacgaccucgucauaccucccaacggcuacuuccgcuucgacuccugggucaaccaauucuacacccucgcccccaugggaaauggaacagggcgccgccgauaa

SEQ ID NO: 38420 - RNA, 1617 nt, Artificial Sequence
  derived and/or modified sequence opt11 from VP1__Norovirus_and/or_Norovirus-like__LC177657
augaaaauggcaaguucugacgccaaccccagugacggcuccgccgccaaccucgucccagagguaaacaacgaagucauggcacucgaaccugucgucggagccgccaucgccgcacccgucgccggacaacaaaacgucaucgaccccuggauccggaacaauuuuguccaagcacccggaggcgaguucacagucagcccccgaaacgcaccaggcgaaauccuaugguccgccccacuaggcccagaccucaaccccuaccugucccaccucgcccgaauguacaacggcuacgcaggcggcuucgaaguacaaguuauccucgccggcaacgccuucacagccggcaaaguaaucuucgcugccguuccucccaacuuccccaccgaaggacuaucccccucccaagucaccauguucccccacaucgucguagauguccgccaacuugaacccguccuuaucccccuacccgacguccgcaacaacuuuuaccacuauaaccaauccaacgaucccaccaucaagcucaucgccaugcuauacacuccccucagagccaacaaugccggcgacgauguuuucaccguuuccugccgaguccuaacccgacccucacccgacuucgacuucaucuuccuugucccacccaccgucgaaucacgaacuaaaccauucucagucccaguacucacagucgaggagaugacaaacucccgauuccccauccccuuagaaaaacucuucacaggacccuccuccgcuuucgucguccaaccacaaaacggccgaugcaccaccgacggaguacuccucggcaccacccaacuuucaccugucaacauaugcaccuuucgcggcgaugucacccacaucacuggcucucgcaacuacaccaugaaccuagcaucccaaaacuggaacaacuacgaccccacugaagaaauaccggcgccccucggcaccccagacuuugucgguaaaauacagggcaugcugacccaaaccacacgcaccgacggcuccacccgaggacacaaagccacgguauacaccggcuccgccgauuucgcccccaaacuagggcgcguccaauucgaaaccgacacugaccgcgacuucgaagccaaccaaaacacuaaauucacaccaguaggaguaauccaagacggauccacaacccaccgaaacgaaccccaacaauggguccuccccuccuacucaggccgcaauacccccaacguccaccuugcuccugcagucgcaccaaccuuccccggcgaacaacuacuauucuuccgcucuacuaugcccggcugcagcggcuaccccaacauggaccucgacugccuccuaccacaggaauggguccaauacuucuaccaagaagccgcaccagcccaaucagacgucgcccucguccgcuucguuaaucccgacaccggcagaguacucuucgaauguaaacuccacaaauccggauacgucacagucgcccacacaggccaacacgaccucguaaucccacccaacggcuacuuccgcuucgacagcugggucaaccaauucuacacacucgcuccuauggguaacggcacaggccgccgacgauaa

SEQ ID NO: 38421 - RNA, 1617 nt, Artificial Sequence
  derived and/or modified sequence opt11 from VP1__Norovirus_and/or_Norovirus-like__LC177656
augaaaauggcauccuccgacgcaaaccccuccgauggauccgccgcaaaccucguccccgaagucaacaaugaagucauggcccuugaacccgucgucggagcugccauagcagccccugucgccggccaacaaaacgucaucgaccccuggauccgcaacaacuucguccaagcccccggcggcgaguucaccguuuccccucgcaacgccccuggcgaaauccucugguccgcuccccuaggccccgaccuuaaccccuaccucucccaccucgcccgaauguacaacggcuacgccgguggcuucgaaguccaaguaauccucgcaggcaacgccuucaccgccggcaaagucaucuucgccgcuguaccacccaacuuccccaccgaaggccucucccccucccagguaaccauguucccacacaucgucgucgacguacgccaacuugaacccguacuaaucccacuacccgacguccgcaacaacuuuuaucacuauaaccaaucaaacgacccaacaaucaagcucaucgccaugcucuacacaccccuccgcgccaacaacgcaggcgacgauguuuucaccgugucuuguagaguccucaccagaccaagccccgacuucgacuucauauuccucguaccaccaaccguggaaucacgaaccaaacccuuuucagucccagugcucaccgucgaagaaaugaccaacucacgauuccccauaccccuugaaaaacucuucaccggaccauccucagccuucgucguccaaccacaaaacggacgcugcacuaccgacggaguccuccucggaacaacccaacuaucaccagucaacaucugcacauuccguggugacgucacacacaccacugguucccacaacuacacuaugaaucucgccucccagaacugguccaacuacgacccaacugaagaaauccccgcgccgcucggcacacccgacuucguaggcaaaauccaaggaguccucacgcaaaccacccgcauagacggauccacccgaggccauaaagccacaguauacacuggcuccgcagauuucgcaccaaaacuaggacggguccaauucgaaacagacacagaccacgauuucgaagcaaaucaauccaccaaauucacaccagucggcgucauccaagacgguuccacgacacaccgaaacgagccccaacaauggguccucccaucauacucaggacgcaacacaccgaacguccaccucgcccccgcagucgcccccaccuucccaggcgaacaacucuuauucuuccgcuccaccaugccaggcugcuccggcuaucccaacauggaccucgauugccuacuuccccaagaauggguccaauacuucuaccaagaagccgcccccgcccaaucggacgucgcccugcucagauucgugaaccccgacaccggccgaguacuuuucgaaugcaaacuccacaaaucuggcuacguaacuguagcacacacaggacaacacgaccuagucauaccgcccaacggcuacuuucguuuugacucaugggucaaccaauucuacacgcuagcccccaugggcaacggcaccgggcgacgacgguaa

SEQ ID NO: 38422 - RNA, 1617 nt, Artificial Sequence
  derived and/or modified sequence opt11 from VP1__Norovirus_and/or_Norovirus-like__KX354136
augaaaauggcaucaucagacgccaaccccuccgacggcucagccgcaaaccucguccccgaagucuccaacgaagucauggcccucgaacccguagucggcgcagccaucgccgcaccagucgccggccaacaaaacaucaucgacccauggauccgcaacaacuucguccaagccccaggcggcgaguucaccgucuccccacgcaacgccccaggagaaauccuauggucugcaccccucggacccgaccucaacccauaccuaucacaccuggcccgcauguauaacggcuacgccggaggauucgaaguccaagucauccuagcaggcaacgccuucaccgcaggaaaaaucauauucgcagcaguacccccaaacuucccaaccgaagggcuaucaccgucgcaagucaccauguucccccacaucaucgucgacguccggcaacucgaacccguccucaucccacuucccgacguccgcaacaacuucuaccacuacaaccaauccaacgacccuacaaucaaacugauagcgaugcuauauacaccccuccgcgccaacaacgccggagacgacguuuucaccgucuccugccgcguccucacccgccccucacccgacuucgacuucaucuuucucguucccccaaccgucgaaucacgaaccaagcccuucuccguccccauccucacuguagaagagaugacgaacagccgcuuucccauaccacuagaaaaacuauucacaggccccuccucagcuuucgucguccaaccccagaacggacgaugcacgaccgacggcguccugcugggaaccacccaacuuucccccgucaacaucuguaccuuucgcggcgacgucacccacaucaccggcucccacaacuacacuaugaaccuagcuucacaaaacuggaacaacuacgaccccacagaagaaauaccugcaccccuaggaacaccagacuucgucgguaaaauccaaggcguccucacccaaaccacccgcuccgacggauccacacgcggccacaaagccacagucuacacaggcuccgccgacuucgcaccuaaacuuggcagaguccaauucgagaccgacaccgaccgcgacuucgagacaaaccaaaacaccaaauucacccccguaggaguaauccaagacgguacaaccgcccaccgaaacgaaccccaacaguggguacucccuuccuacagcggacgaaacauacacaacguacaccuugccccugccguagccccaaccuuccccggcgaacaacuccuguucuuccgcuccacuaugcccgguugcucaggauaccccaauauggaccucgauugccuccuaccacaggaauggguccaauacuuuuaccaagaggccgcaccagcacaaucagacgucgcccuccuccgcuucguaaaccccgacacaggccgcguccucuucgagugcaaacuccacaaauccggcuacguuaccguagcccauacuggacaacacgaccuagucauaccacccaacgguuacuuccgcuucgauucauggguuaaccaauucuacacccuagcccccaugggcaacggcacuggccgucgccgcuaa

SEQ ID NO: 38423 - RNA, 1617 nt, Artificial Sequence
  derived and/or modified sequence opt11 from VP1__Norovirus_and/or_Norovirus-like__KX354121
augaaaauggcaucuuccgacgcaaaccccagcgacggaucggccgccaaccuaguccccgaagucaacaacgaggucauggcucucgaaccagucgucggcgccgcaaucgccgcacccgucgccggccaacaaaacguuaucgacccuuggauccgcaacaacuucguacaagccccaggcggugaguucacagucuccccacgcaacgcccccggcgaaauacucuggucugcccccuuaggucccgaccucaacccauaccuaucccaccuugcccgaauguacaacggauaugcaggcggcuucgaaguccaagucauccucgccggcaacgcauucaccgccggcaaaguaaucuucgccgccguucccccuaauuucccgaccgaaggacucuccccaucacaagucacaauguucccccacaucguuguagacguucgacaacucgaacccguacucauaccccuaccugacguacgcaacaacuucuaccacuacaaccaaucaaacgaccccacaauuaaacuaaucgccaugcucuauaccccacuacgcgccaacaacgccggugacgacguauuuaccguauccugccgaguccuaaccagacccucccccgacuucgacuucaucuuccuggucccacccaccgucgaaucccgcaccaaacccuuuucaguucccguccuaaccgucgaagaaaugacuaacagcagauuucccaucccacucgaacgucuauucacagggccuuccuccgccuucgucguacaaccacaaaacggucguugcaccacagacggcguccuacucggcaccacacaacuaucccccguaaacauuugcaccuuccgcggagacaucacacacaucacuggaucccacaacuacaccaugaaccuagccucacaaaacuggaacaacuacgaucccaccgaagaaauccccgcacccuuaggcacucccgacuucgucggcaaaauacaaggcguccuaacccaaaccacaagaacagacgggucaacccgcggccacaaagccaccgucuacacaggauccgcugaauuugccccaaaacucggccgcguccaauucgaaaccgacaccaaccacgacuucgaagccaaccaaaacaccaaauucacacccgucggugucauucaagauggaucgacaacccaccgaaacgaaccccagcaauggguacuccccuccuacuccggccgcaacacacacaacguccaccucgcaccagcggucgcucccaccuucccaggagaacaacuccuuuucuuccgcucaacaaugccuggaugcuccggcuacccuaacauggaccuagacugccuccuaccccaagaauggguacaauacuucuaucaagaagcagcucccgcccaauccgacgucgcccuccuccgauucguuaaccccgacaccggcagaguccucuucgaaugcaaacuucacaagagcggguacgucacaguagcacacacaggccaacacgaccucguaauacccccaaacggcuacuuccgauucgacagcuggguaaaccaguucuacacccucgcaccaaugggaaacggcacaggccgccgccgcuaa

SEQ ID NO: 38424 - RNA, 1617 nt, Artificial Sequence
  derived and/or modified sequence opt11 from VP1__Norovirus_and/or_Norovirus-like__KX354110
augaaaauggccuccuccgacgccaaccccuccgacgguucagcagcaaaccucguccccgagguaaauaacgaggucauggcucuugaaccagucguaggcgcugccauagcugccccugucgcuggccaacaaaaugucauagacccuuggauccgaaauaacuuuguccaagcccccggcggcgaguucaccguuucaccccgcaacgcacccggagaaauccucuggucggcaccucucggccccgaccuaaacccauaccuaucccaccucgcccgcauguacaacggcuacgccggcggauucgaaguccaagucauccucgccggcaaugccuucaccgccggcaaaguaaucuucgccgcaguaccacccaacuuccccacugaaggacucucccccucacaaguuacaauguucccccacauagucguagacguccgccaacucgagccaguccucaucccccuccccgacguccgaaacaacuucuaucacuacaaccaaagcaacgaccccaccaucaaacuaauagccaugcuauacacuccccucagagcuaacaacgccggcgacgacguauucaccgucuccugccgcguccuaacccgucccuccccagacuucgacuucauauuccuggucccucccaccgucgaaucacguaccaaaccauucuccguccccguccucaccguagaagaaaugaccaacucccgcuucccaauaccacucgagcgucuauucaccggccccucauccgccuucgucguccaaccccaaaacggaagaugcaccaccgacggcguccuacucggaaccacucagcucuccccagucaacauaugcacauuccgaggcgacguuacacacauaaccggaucccacaacuacaccaugaaccucgccucccaaaacuggaacaacuacgaccccaccgaagaaauccccgcaccacucggcaccccagacuucguaggcaaaauccaaggcguacucacccaaaccaccucuaccgacggcagcacccgcggacacaaagccacugucuacacaggauccgccgaguucgccccuaagcucggaagaguacaauucgaaaccgacaccgaccacgacuucgaaacaaaccaaaacaccaaauucacccccguaggaguaauacaagauggaucaaccacccaccgaaacgaaccccaacaauggguccuucccucauacuccggaagaaacacccauaauguccaccucgcccccgccguagcccccaccuuccccggcgaacaacuucucuucuuccgaucuaccaugccaggaugcuccggcuaccccaacauggaccucgauugccuacuaccccaagaauggguucaauauuucuaccaagaagcagcaccagcacaauccgacguugccuuacuccgcuucguaaaccccgacaccggucgcguccucuucgaauguaaacuucacaaaucaggcuacaucaccgucgcccacaccggucaacacgaccuuguaaucccuccaaacggauacuucagauucgacuccugggucaaccaauucuauacacucgcacccaugggcaacggcaccggacgacgccgcuga

SEQ ID NO: 38425 - RNA, 1617 nt, Artificial Sequence
  derived and/or modified sequence opt11 from VP1__Norovirus_and/or_Norovirus-like__KX354107
augaaaauggccuccucugacgcuaacccaucagacggcuccgccgccaacuuagucccagaagucaacaacgaagucauggcacucgaacccgucgucggagcagccaucgccgcaccaguggccggccaacaaaacaucaucgaccccuggaucagaaacaauuucguucaagccccaggaggcgaauuuaccgucucucccagaaacgcaccaggcgaaauucucuggagcgcaccacuaggccccgaccucaaccccuaccuaucccaccucgcccgcauguacaacggcuacgccggcggcuucgaaguccaagucauccuagcaggaaacgcauucaccgcaggaaaagucaucuucgccgcaguuccacccaacuuccccaccgaaggacucucgccuucccaggugaccauguucccgcacaucgucgucgacguacgccaacucgaaccuguccuaauaccccuucccgacgucagaaacaacuucuaccacuacaaccaauccaacgaccccaccaucaaacucaucgccaugcucuacaccccacuacgcgccaacaacgccggagacgacguauuuacagucuccugccgcguccucacccgccccagucccgacuucgacuucauauuccucguacccccgacagucgaaagccgcaccaaacccuucucaguccccguccuaaccgucgaagaaaugacaaacuccagauuccccaucccccuugagaaacuauucaccggucccucuuccgcauucgucguccaaccacaaaacggccgcugcaccaccgacggcguccuccucggcacuacacaacuaucccccgucaacauuugcacauuccgcggcgacgucacccacauaacuggcucucgcaacuacaccaugaaucucgccucccaaaacuggaauaacuacgaucccaccgaagaaauuccggcaccccucggcaccccagacuuuguaggaaagauacaaggcguacucacccaaaccacacgaacagacggcucaacccgaggccacaaggccacagucuacacaggaucugccgacuucgcccccaaacucggccgcguccaauucgaaaccgacaccgaccacgacuucgaagccaaccaaaacacaaaauucacccccgucggcgucauccaagacggcucaacuacccaccgcaacgagccucaacaauggguucuccccucuuauagcggccgcaacacccacaacguccacuuagcccccgcagucgcccccaccuuccccggcgaacagcuacucuuuuuccgcuccacaaugccuggcugcuccggcuaccccaacauggaccucgacugccuccucccucaagaauggguacaauauuucuaccaagaagccgccccagcacaauccgaugucgcccuucugcgauucgucaaccccgacacgggcagaguccucuucgaaugcaaacuccauaaauccggcuacgucaccgucgcucacaccggccaacacgaccucguuauacccccaaauggcuacuuccguuucgacucaugggucaaccaauucuacacccucgcccccaugggaaacggaacaggacgccgccgcuaa

SEQ ID NO: 38426 - RNA, 1617 nt, Artificial Sequence
  derived and/or modified sequence opt11 from VP1__Norovirus_and/or_Norovirus-like__KX353991
augaaaauggcauccaacgacgccaaccccucagacggauccaccgcaaaccuagucccagaagucaacaacgaaguaauggcccucgaacccguugucggcgccgccaucgccgccccgguagccggccaacaaaacguuaucgacccuuggauccgcaacaacuucguccaagcccccgguggugaguucaccguaucaccccgaaacgcccccggcgaaauccuuugguccgccccacucggaccugaccuaaaccccuaccucucccaccuagcccgcauguacaacggcuacgccggcggcuucgaaguacaaguaauccuagcaggcaacgcuuuuacugccggcaaaaucaucuucgccgccgucccacccaacuuccccaccgaaggacuuucacccucccaagucaccauguucccccacaucaucgucgacguucgacaacucgaacccguccuuaucccacuucccgacguccgcaauaacuucuaccacuacaaccaaucuaacgaccccacaauaaaacugaucgcuaugcucuacacaccccuccgagcaaacaacgccggugacgacguauucacagucuccugccguguccuaacccgcccaucacccgacuucgacuucaucuuucucguaccacccacugucgaaucacguacaaagcccuucucaguccccguccucaccguggaagaaaugaccaacucccgcaucccaaucccucuagaaaaauuauucaccggccccuccuccgcauucgucguccaaccccaaaacgggcgaugcaccacagacggcguccuacucggaaccacccaauuaucccccgucaacaucugcaccuuucgcggcgacgucacccacauugcgggcucgcgcaacuacacgaugaaccuggccucccaaaacuggaacuccuacgacccaacagaggagaucccugccccgcuaggcacaccagacuucguagguaaaauccaaggaguacucacccagacuacucguacagacggcuccacccgaggacauaaggcaaccguuuacaccggaucugcagacuucagccccaaacuaggucgcguccaauuugccaccgacaccgauaaugacuucgaaaccaaccaaaacaccaaauucacaccagucggagucauccaagacggcggcaccacccaccgcaacgaaccccaacaauggguccuccccuccuacucuggccgaaacacacacaacguccaccucgccccagcaguagccccgaccuuccccggagaacaacuacuauucuuucgcuccaccaugccaggcugcuccggcuaccccaacauggaccuagauugccuccuaccccaagaguggguucaauacuucuaccaagaagccgcacccgcccaaucggacgucgcccuccuccgcuucgucaacccugauaccggacgcguacuauucgaaugcaaacuccauaaauccggcuaugucacaguagcacacacaggacaacacgaccucgucaucccucccaacggcuacuuucgauucgauucauggguaaaccaauucuauacacuagcacccaugggcaacggcacaggccggcgccgauaa

SEQ ID NO: 38427 - RNA, 1617 nt, Artificial Sequence
  derived and/or modified sequence opt11 from VP1__Norovirus_and/or_Norovirus-like__KU985162
augaaaauggccaguagcgacgcuaaccccuccgacggcagugccgccaaccucgucccugaagucaacaacgaaguaauggcucuggaaccagucgucggcgccgccaucgccgcaccggucgccggacaacaaaacgucauagaccccuggauccgaaacaacuucguacaagcucccggcggcgaguucaccgucucaccucgcaaugcaccaggugaaauccuauggucagcaccccucggacccgaccuaaaccccuaccuuagccacuuagcccgcauguacaacggguacgccggaggcuucgaaguccaagucauccucgcuggaaacgcauucaccgccggcaaagucaucuucgcagccgucccucccaacuucccaaccgaaggccugucaccgucccaaguaaccauguucccccacauaguagucgacguacgccaacucgaacccguacucauaccacuccccgacguccgaaacaacuucuaccacuacaaccaaucaaacgaccccacuaucaaacuaaucgcuaugcucuacaccccacuccgggccaacaacgcaggcgacgacgucuuuacaguauccugccgaguccuuaccagaccaucacccgacuucgauuucaucuuucuugucccacccacagucgaaagccgcacaaaaccauucuccguacccguacucaccguagaagaaaugaccaacagccgguuucccaucccccucgaaaaacucuucacaggccccucauccgccuucgucguccaaccccaaaacggaagaugcaccacugacgggguccuacuagguaccacacaacuuuccccaguaaacauaugcaccuuccgaggcgacgucacccacauaaccggaucccacaauuacaccaugaacuuagccucacaaaacuggaacaacuacgauccaacugaagaaauuccagcuccccucggaaccccagacuucgucggaaagauccaaggcguccuaacccaaaccaccagaaccgacggcuccacucgaggccacaaagccacagucuacaccggcagcgcagacuucgccccaaaacucggccgcguccaguucgaaaccgacaccaaccacgacuucgaagcaaaccaaaacaccaaauucacacccguuggagucauacaagacggcuccaccacccauagaaacgaaccccaacaauggguccuacccucauacuccggccgaaacacaccaaacguccaccucgccccagcaguggcaccaacauuccccggcgaacaacuacuauucuuccgcucaacaaugcccggcugcucaggauaccccaauauggaccuagacugccuacucccacaagaauggguccaauacuucuaccaggaagccgcacccgcccaauccgacgucgcacuccuacguuucgucaacccugacaccggaagaguacuauucgaaugcaaacuacacaaauccggcuacguaacagucgcccacaccggacaacacgaccuagucauaccuccuaacggguacuucagauucgacuccugggucaaccaauucuacacccucgccccaaugggaaacggcaccggccggcgccgcuaa

SEQ ID NO: 38428 - RNA, 1617 nt, Artificial Sequence
  derived and/or modified sequence opt11 from VP1__Norovirus_and/or_Norovirus-like__AB972476
augaaaauggccucaaacgacgccaaccccuccgacggcuccgcagcaaaccucguccccgaagucaacaacgaagucauggcccucgaacccgucgucggcgcagccaucgccgcucccguagccggccagcaaaacgucaucgaccccuggauucgcaacaauuucguccaggcacccggcggcgaguucaccguaucaccccgcaacgccccaggagaaauucugugguccgcaccccuuggccccgaucuaaaccccuaccugucccacuuagcccgcauguauaacggcuacgccggaggcuucgaaguccaagucauccucgccggcaaugccuucacugcagggaaaauaaucuucgccgccguaccacccaacuuccccaccgaaggacugucccccucccaaguaacaauguucccccacauaaucgucgacguccgccaacucgaaccaguccuaaucccacucccagacguccgcaacaacuuuuaccacuacaaucaaucaaaugacucaaccauaaaacuaaucgccaugcuauacaccccacuccgagccaauaacgccggugaagacguauucaccgucucaugccgaguccucacccgaccaucuccggacuucgacuucaucuuucucguacccccaaccgucgaaucacgcacuaaaccguucacaguccccauucucaccgucgaagaaaugacaaacucccguuuccccaucccccuagaaaaacuauucacaggucccucuuccgcauucgucguccaaccacaaaacggccgcugcacaaccgacggaguccuacucggaaccacccaacuuucccccgucaacauaugcaccuuccgcggcgacguuacccacauagcaggcucacgcaacuacacaaugaaccuagcaucacuaaauuggaauaacuacgaucccaccgaagaaauccccgcaccccucgguacuccugacuucgucggaaaaauacaaggaaugcuaacucaaaccacuaaaggcgacggcucaacccgaggccacaaagccaccguuuacaccggaagcgccccauucacacccaaacuaggcucuguccaauuugaaaccgacacugaaaacgacuucgaaacacaccaaaacacaaaauucacacccgucggcguaauccaagacggcggaaccacccaccguaacgaaccacaacaauggguacuccccagcuacuccggacgcaacguccccaacguucaccucgccccugccgucgccccaacauuucccggcgaacaacuacucuucuuccgcucaacuaugccaggcugcuccggauaccccaacauggaucuagacugccuccucccacaggaauggguacaacacuucuaccaagaagcagcacccgcccaauccgacgucgcccuccucagauucgucaaccccgacacaggcagaguccucuucgaaugcaaacugcauaaauccggauacguuacagucgcccacaccggacaacacgaccuagucaucccacccaacggauacuuccgcuucgacuccugggucaaccaauucuacacccuugcccccaugggcaacggaaccgggcgccgacgcuaa

SEQ ID NO: 38429 - RNA, 1617 nt, Artificial Sequence
  derived and/or modified sequence opt11 from VP1__Norovirus_and/or_Norovirus-like__KU311162
augaaaauggccucgaacgacgccaacccaucagacggauccgcagccaaucucguacccgaggucaauaaugaggucauggcucucgaacccguagucggcgcggcaaucgccgccccugucgccggccaacaaaacgucaucgaccccuggauccgauccaacuucguacaagcccccggaggcgaguucaccgucucaccccguaacgcacccggcgaaauucucugguccgcaccacucggcccagaccucaacccuuaccucucacaccuagccagaauguacaacggcuaugccggcggcuucgaaguacaagucauccuugccggcaaugccuucaccgccggcaaaauaaucuucgccgccgucccacccaauuucccaaccgaaggccuaagcccaagucaagugacgauguucccacacaucaucguugacguccgccagcuugaacccguccuaaucccccuccccgacguacgcaacaacuucuaccacuacaaccaaagcaaagauucuaccaucaaacucauagcaaugcuauacacuccgcuacgagccaauaacgcaggcgacgacguauucaccgucuccugccgcguucucacccgccccagucccgacuucgacuucaucuuccucgucccacccaccgucgaaagccgcacaaaacccuuuaccgucccuauauuaaccgucgaagaaaugacuaacuccagauucccaaucccacucgaaaaacuuuucaccggcccguccaacgccuucgucguccaaccacaaaacggacgcugcaccaccgacgguguccuccucgguacaacccaacucuccccgguuaacauuugcaccuuccgaggcgacgucacccaaauagccuccacacagaccuacacaaugaaccuagccucccuaaacuggaacaacuaugaccccaccgaagaaauccccgccccacucggagcacccgacuucaugggcaaaauccaaggcgucuuaacccaaaccacccgucaaggcggaucgacccgcggccauaaagccacagucagcaccggcuccguccacuucaccccaaaacucggaagcguacgcuucgacacagacacaaacaaugaccuccaaccgcaccaauccacccgcuucacccccgucggugucauccaagacggcgacacccaccaaaacgaaccccaacagugggcacuccccugcuacuccggucgagacgucaacaacguccaccucgcccccgccgucgccccaucauucccaggcgaacaacuccuauucuuccgcucaaccaugcccgguugcuccggcuacccaaacauggacuuagacugccuccuaccccaagaauggguucaacacuucuaccaagaagccgcacccgcccaaagugacgucgcccuacuccgauuugucaacccagacaccggccgaguccuuuucgaaugcaaacuccacaaaucgggcuacguuacaguugcccacaccggccaacacaaccucguaauucccccuaauggauacuuucgcuucgauucaugggucaaccaauuuuacacccucgcccccaugggcaacggcacaggucgccgcagaguauaa

SEQ ID NO: 38430 - RNA, 1617 nt, Artificial Sequence
  derived and/or modified sequence opt11 from VP1__Norovirus_and/or_Norovirus-like__KR904212
augaaaauggcaucauccgacgcuaacccaagcgacggcuccaccgccaaccucguccccgaaguaaacaacgaagucauggccuuagagcccgucgucggcgccgccaucgccgcccccgucgccggccaacaaaacgucauagaccccuggauccggaacaacuucguccaagcccccggcggcgaguucaccguuucacccagaaacgcccccggcgaaauccuaugguccgcaccccucggacccgacuuaaaucccuaccucucacaccucgcccgaauguacaacggcuacgccggcggauucgaaguccaagucauacuagcaggcaacgccuucaccgccgguaaaaucacauucgccgcaguuccacccaacuuccccacagaaggacucucccccucucaagucacaauguuuccccacauuaucgucgacguccgccaacuagaaccaguacuaaucccccuucccgacguccgcaacaacuucuaccacuacaaccaauccaaugaccccaccaucaaacucaucgcuaugcucuacacaccacuccgggccaacaacgccggagacgacgucuucaccgucucaugucgaguacucacccgacccagccccgacuuugacuucauuuuccucguacccccaaccgucgaauccagaaccaaaccauucuccguccccauccucaccguagaagaaaugaccaacucacgauuucccaucccgcucgaaaaacuauucacaggccccucgucaaccuucgucguccaaccucaaaacggccgcugcacuaccgacggaguacuacucgguaccacccaacucucacccguaaacaucugcaccuuccguggcgacgucacccacauaaccggcucccacaacuacaccaugaaccuagcgagccaaaacugguccuccuacgaccccaccgaagagaucccagcaccccucggcacacccgacuucguuggaaaaauccaaggcguccucacccagaccacccggacagacggauccacacgaggccacaaagccaccgucuucaccggcucagccgacuucucccccaaacucggacgcguacaauucgccacagauacagauaacgacuucgucgccaaccaaaacaccaaauuuaccccugucggcgugauucaggacggcggcacagcccaccgcaacgaaccacaacaauggguacucccaucauacuccggccgcaacauccacaacgugcaccuggcacccgccgucgcucccacauuccccggagaacagcuccuauucuuccgcucaaccaugcccggaugcucaggauaccccaacauggaccuagacugccuccucccccaagaauggguacaauauuucuaccaggaagccgcccccgcccaaucagacgucgccuuacugcgcuucgucaacccugacacaggacguguacuuuucgaaugcaaacuccacaaauccggcuacguaacugucgcucacaccggacaacacgaccuaguuaucccuccaaacggcuacuuccgcuucgauucaugggucaaccaauucuauacacucgcgcccaugggcaacggaaccggccgacgacgauaa

SEQ ID NO: 38431 - RNA, 1617 nt, Artificial Sequence
  derived and/or modified sequence opt11 from VP1__Norovirus_and/or_Norovirus-like__AB933678
augaaaauggccuccaacgacgccaacccuuucgacggcucagccgcaaaccuagucccggaagucaauaacgaagucauggcccucgaacccgucgucggcgcagcaaucgccgcacccgucgccggccagcaaaacguaaucgacccauggauccgcaacaacuucguccaagccccagguggagaauuuaccgucucaccccgcaacgccccaggcgagauccucuggucagcaccccuaggccccgacuuaaacccguaccuaucccaccucgccagaauguacaauggauacgccggcggguucgaaguccaagugauccuagccgguaacgcauucaccgcaggcaaaauaaucuucgccgcugucccacccaacuuccccgccgaaggccucucccccucucaagucaccauguucccccacauaaucgucgacguccgucaacucgaaccuguacucaucccccuccccgauguaagaaacaacuucuaccacuacaaucaauccaacgacuccaccaucaaauuaaucgcaauguuauacacuccccuccgugcaaacaacgccggcgaagacgucuucaccgucucaugccgcguucucacgcgucccagccccgauuucgauuucaucuuccuagucccacccaccgucgaaucccgaacuaaacccuucaccguaccaauccuuaccgucgaagaaaugaccaacucacgauucccaaucccccucgaaaaacuauucaccggcccgucauccgcuuucgucguccaaccccaaaacggccgcugcacaaccgacggaguccuacuaggcacaacccaacuaagcccgguaaacauauguaccuuccgaggcgacgucacacacaucgccggcucccgcaauuacacuaugaaccuagccucccucaauuggaacaacuacgaccccaccgaagagauacccgcuccccucggcacaccagacuuugucggcaaaauacaaggaguccucacccaaacaacaaaaggcgacggcucuacccgcggccacaaggccacuguauauaccggcuccgcccccuucacacccaaacuaggcuccguacaauucuccaccgacaccgaaaacgacuucgagacccaccagaacaccaaauucaccccaguaggaguaauucaagacggugguaccacacaccguaacgaaccccaacaauggguccucccuagcuacuccggaagaaacguucccaacguucaccuugcacccgccguagcuccaaccuuccccggagaacaacuccucuucuuucgcucuaccaugcccggcuguucaggcuaccccaacauggacuuagacugccuacucccccaggaauggguccaacauuucuaccaagaagccgccccagcucaauccgacgucgcucuccuucgcuucgucaaccccgacaccggccgcguacucuucgaaugcaaacuucacaaauccggcuaugucacagucgcucacaccggccaacacgaccucguaaucccacccaacggcuacuuccgauucgacagcuggguaaaccaauucuacacacucgcacccaugggcaacggcaccggccgccgacguuaa

SEQ ID NO: 38432 - RNA, 1617 nt, Artificial Sequence
  derived and/or modified sequence opt11 from VP1__Norovirus_and/or_Norovirus-like__AB933648
augaaaauggccucaaacgacgcuaaccccuccgacggcuccgccgccaaccucgucccggaaguuucaaacgaaguaauggcacuagaacccgucguaggggccgcaaucgccgcaccuguggcaggacaacagaaugucaucgacccauggauccgcaacaacuucguacaagcccccggcggagaguucacaguauccccacgcaacgcacccggcgaaauccucugguccgcaccccucggacccgaccugaaccccuaccucucccaccucgcccguauguauaauggcuaugccggaggcuucgaaguccaagucaucuuagccggaaacgccuucaccgcaggcaaaaucaucuucgccgcagucccacccaauuucccgaccgaaggucucagccccucucaagucacaauguucccucacaucaucgucgauguccggcagcucgaaccaguacucaucccccucccugacguccgcaacaacuucuaccacuacaaccaaagcaacgacuccacaaucaaacucaucgccaugcucuacaccccacuccgcgccaacaacgccggcgaagacgucuucaccgucucaugccgcguccuaacaagacccucccccgacuucgacuucaucuuccucguacccccaacagucgaaucucgcaccaaaccguucacaguccccauccucacagucgaggaaaugaccaacagcagauucccaaucccccuagaaaaacuauucaccgggccauccggcgccuucguuguucaaccccaaaacggacgcugcacaacggacggcguacuccucggcaccacccaacucucgcccguaaacaucugcacauuucgcggcgacguaacccacauagccggcucccgaaacuacaccaugaaccucgccucauugaacuggaacaacuacgaccccacagaagaaaucccggcaccucuaggaacaccugauuucgucggcaaaauacaaggaguacucacccagacaacaaaaggcgacggauccacucgcggccacaaagccacugucuacacaggaucagcccccuucacccccaaacuaggcuccguacaauuuucgaccgacacagaaaacgacuucgaaacccaccagaacacaaaauucacaccagucggaguaauucaagacggcucaacuacacaccgaaacgaaccccaacaauggguucuccccucauacuccggacgagacguucacaauguccacuuagcccccgccguagcccccacauuccccggagaacaacuccucuucuuccgcuccaccaugccuggcugcuccggcuaccccaacauggaccuagacugccuccuaccacaggaauggguccaacacuucuaccaagaagcagcacccgcccaaucugaugucgcccuccuaagauucgucaaccccgacaccggccgaguucucuucgaaugcaaacuccacaaauccggcuacguaacaguagcccacaccggccaacacgaccuugucauacccccaaacggcuacuucagauucgacucuugggucaaccaauucuacacccucgcacccaugggaaacggcacuggccgccgccgauag

SEQ ID NO: 38433 - RNA, 1617 nt, Artificial Sequence
  derived and/or modified sequence opt11 from VP1__Norovirus_and/or_Norovirus-like__LN854571
augaaaauggccuccaacgacgccgcccccuccgacggcucaaccgcuaaccuaguccccgaaguuaacaacgaagucauggcccucgaacccguagucggcgccgccaucgcagcucccguagcgggacaacaaaacguaaucgaucccuggauccgcaacaauuucguacaagcccccggaggcgaguucacagucuccccacgaaacgcccccggcgaaauccucugguccgccccacucggcccagaccuaaacccauaccucucccaccuagcccgaauguacaacggcuacgcaggcggcuucgaaguccagguaauucucgccggcaacgccuucaccgccggcaaaaucaucuucgccgcaguaccacccaacuuucccacagaaggccuaucccccucccaagucacaauguucccccacauaaucgucgacguaagacaacucgaacccguccucauaccccuacccgacguccgcaacaacuucuaccacuauaaccaauccaacgaccccaccaucaaacucaucgcaaugcucuacacuccacuccgcgcaaacaacgcaggagaugacgucuucacugucuccugccguguccucacccgacccucucccgacuucgacuucauauuucucguacccccaaccgucgaaucccgcacgaaacccuucuccguccccguacucaccguagaagaaaugaccaacucccgcuuccccauuccccucgaaaaacuauuuaccggcccaucauccgccuucguaguacaaccccaaaauggccgaugcaccacagacggcguucuccucggaacaacccaauuaucccccgucaacauaugcaccuuucguggcgaugucauccacauacccggcucccgcaacuacaccaugaaccuugccucccagaacuggaacucauacgacccaaccgaagagauacccgcaccccuagguacccccgacuuuguaggaaaaauccaaggaguccucacccaaaccacccgaacaaacggcuccacacgaggccacaaagccaccgucuauaccggcagcgcagacuucucacccaaacugggacgaguccaauucgcgaccgacaccgacaacgacuucgaaacaaaccaaaacacaaaauucacacccguaggcgucauccaagacgguucaacaacuccacgcaaugaaccccaacaauggguccuuccuuccuacuccggccgcaacauacauaauguacaccucgcaccagccgucgccccaaccuuccccggugaacaacuccucuucuuccguucaaccaugccaggaugcucaggcuaccccaacauggaccucgacugccuucucccccaggaauggguccaauacuucuaccaagaagccgcccccgcccaaucagacgucgcccuucuccgcuucgucaauccagacaccggcagaguacucuucgaaugcaaacuacacaaaucuggauacgucacagucgcucacaccggccaacacgaccucgucaucccacccaacggauacuuccgcuucgacuccuggguaaaccaauucuacacacuugcccccauggguaaugggaccggccgacgccgauaa

SEQ ID NO: 38434 - RNA, 1617 nt, Artificial Sequence
  derived and/or modified sequence opt11 from VP1__Norovirus_and/or_Norovirus-like__EU921384
augaaaauggccuccaacgacgccaaccccucagacggcucagccgccaacuugguacccgaaguauccaacgaaguuauggcccuagaaccagucguaggcgccgcaaucgccgcaccgguagccggccaacagaacgucaucgacccguggauccgcaacaacuuuguccaagcccccggcggcgaguucaccgucagcccccgaaacgcacccggagaaauccucuggagcgcaccccucggacccgaccucaaccccuaccucucucaucucgcccgcauguacaacggcuacgccggcggcuucgaaguccaggucauacuagccggcaacgccuucaccgccggcaaaaucaucuucgccgcuguacccccaaauuuccccacagaaggccucuccccuucucaggucacuauguuuccccacauaaucgucgacgucagacaacuugaacccguccucauaccccucccagauguccgaaacaacuucuaucacuacaaccaauccaaugacuccacaaucaaacucaucgccaugcuauacacaccccuccgcgccaauaacgccggagaagacgucuucaccgucucuugucgaguacucaccagacccucccccgacuucgacuuuaucuuccucgucccgcccacugucgaaucccgcacuaaacccuucaccgugcccauccuaaccgucgaagaaaugaccaacuccagauuccccaucccccuagaaaaacucuucaccggccccuccggagcauucgucguccaaccccaaaacggucgaugcacaaccgacggcguccuccucggcacaacacaacuaucaccaguaaacaucugcacauuccgcggagacgucacacacauugccggcucccgaaacuacaccaugaaccuagccucacucaacuggaacaacuacgacccaacagaagaaaucccagcaccccugggcacacccgacuucgucggcaaaauacaaggcguccucacccaaaccacaaaaggcgacggaucaacccguggacacaaagccacaguuuauacaggcucagcccccuucacccccaaacucggaucuguacaauucuccacagacacagaaaaugacuucgaaacccaccaaaacaccaaauucacucccgucggcguuauccaagauggauccaccacccaccgcaacgaaccccaacaaugggugcuccccuccuacuccggacgcaacguccacaacguccaccuagccccagccguagccccaaccuuccccggcgagcaacuacuuuucuuccgauccaccaugcccggcugcagcggcuacccuaacauggaccucgauugccuccuuccccaagaauggguccaacauuucuaccaagaggccgccccagcccaaucagacgucgcccuccuacgcuucgucaacccagacaccggacgcguccucuucgaaugcaaacuacacaaaucaggguacgucacagucgcacacaccggucaacaugaccucgucauacccccaaacggcuacuuccguuucgacagcuggguaaaccaauucuacacccucgcucccaugggaaacggaaccggacgccgccgcuaa

SEQ ID NO: 38435 - RNA, 1617 nt, Artificial Sequence
  derived and/or modified sequence opt11 from VP1__Norovirus_and/or_Norovirus-like__LC005716
augaagauggccucaagcgaugcaaaccccuccgacggcucugccgccaaucucgugcccgaagugaauaacgaaguuauggcccucgaacccguagucggagccgcuaucgcagccccggucgccggccaacaaaacgucaucgauccauggauccgaaacaacuucguccaagcucccggcggcgaauuuaccguauccccgcgaaacgcccccggcgaaauccucuggucagccccacuaggccccgaucucaaucccuaccuuucccaccucgcacgcauguacaauggcuacgcuggcggauucgaaguccaagucauccucgccggcaacgccuucaccgcaggcaaaaucaucuucgccgccguaccucccaacuuccccaccgaaggucucucacccucccaaguaacaauguucccccauaucaucguggacguacgacaauuagaacccguacucauaccccuccccgacguacgcaacaacuucuaccacuacaaccaauccaacgacucaacaaucaaacucauagcuaugcuauauaccccacuccgcgccaacaacgccggcgaagacguauucaccguaucuugccgcguccucacacgccccucacccgacuucgacuucaucuuccucguacccccaacaguugaaucccgaacaaaaccuuucacggucccaauccuaacagucgaagaaaugacaaacucgcgauucccaaucccccucgaaaaacuauucacaggcccauccuccgccuucgucguacaaccacaaaacggacgcugcaccaccgacggcguccuccuaggaaccacccaacugucaccagucaacauaugcaccuuccgcggagacguaacccauaucgccggcuccggcaacuacaccaugaaccuagccuccguaaacuggaacaacuacgacccaaccgaagaaauuccagcgccccucgggacccccgacuucgucggcaaaauccaaggaaugcuaacccaaaccacaaaaggugauggcuccacccgcggucacaaagcuaccguguacaccgguuccgcccccuucacccccaaacuaggcucaguccaauucuccaccgauaccgaaaacgacuucgaaacccaccaaaacacaaaauucacccccgucggagucauccaagacggcaacacaacccaccgcaacgaaccucaacaauggguccuacccuccuacucaggacgcaacgucccaaacguccaucucgcccccgccguagcccccacauuccccggcgaacaacucuuguucuuccgcucaaccaugcccgguugcuccggcuacccaaacauggaccucgauugccuacuaccccaagaauggguccaacacuucuaccaagaagcagccccagcacaaucugacgucgcccuccuccgauucgucaacccagacaccggccgcguucuuuucgaaugcaaacuacacaaauccggcuacguuaccguggcacacaccggacaacacgaccucguuauacccccaaacggcuacuuccgcuucgacuccuggguaaaccaauucuacacccuagcucccaugggcaacggaacgggccgccgccgauag

SEQ ID NO: 38436 - RNA, 1617 nt, Artificial Sequence
  derived and/or modified sequence opt11 from VP1__Norovirus_and/or_Norovirus-like__KP241914
augaaaauggcaagcucagacgccaacccauccgacggguccgccgcaucccuuguccccgaagucaacaacgaaguaauggcccucgaaccugucgucggagccgccauagcagcucccgucgccggccaacaaaaugugauugacccauggauccgcaauaacuucguacaagcacccggcggagaguucaccgucagccccagaaaugcaccaggcgaaauacuaugguccgcaccucucggccccgaucuuaaccccuaccucucacaccucgcccgaauguacaacggauacgccggcggauucgaaguccaagucauccucgccggaaacgcauucaccgcaggcaaaguaauauucgccgccguuccucccaacuuccccaccgaaggauuaagccccucccaagucaccauguucccccacaucguuguagacguucgucaacucgaacccguccuaauccccuuacccgacguucgcaacaacuucuaccacuacaaccaaagcaacgacccuaccauaaaacugaucgccaugcuguacacaccacuacgagcaaacaacgccggagacgacgucuucaccguauccugccgaguccuaacacgccccuccccugacuucgacuucaucuuccucguaccucccacaguagaaucgcgcacuaaacccuuuuccguacccguccuaaccgucgaagaaaugaccaacucucgcuuccccauaccccuagaaaaacucuucaccggccccucauccgcauucgucguccaaccccaaaacggccgcuguaccaccgacggcguucuccuagguaccacccaacucucccccgucaacaucugcaccuuucgcggcgacgucacccacauaaccggcucucgaaauuacacaaugaaccuugccucacagaacuggaacaacuacgauccaaccgaagaaauaccagccccacuagguacccccgacuucgucggaaaaauucaaggcguucuaacacaaaccacccgcaccgacgguuccacccgcggacacaaagccaccgucuacacaggcuccgccgacuuuucucccaaacucggccgaguccaauucgaaacagacaccgaccgcgacuuugaagcaaaccaaaacacaaaauucacucccgucggcguaauacaagacggcggcaccacccaccgaaacgaaccccaacaauggguacuuccuucauacuccggacgcaacgccccuaacguccaccuugcccccgccgucgcccccaccuucccaggcgaacaacuccuuuucuuucgcuccaccaugcccggcuguuccggcuaccccaacauggaccucgacugccuucuaccacaagaaugggugcaauacuuuuaccaagaagccgcccccgcccaaucagacguagcccuccuccguuucgucaacccggacaccggccgcguacuauuugaauguaaacuacauaaauccggcuacgucaccguugcacacacaggccaacacgaccuugugaucccacccaacggauacuuccgcuucgacagcuggguaaaccaauucuacacccuugcccccaugggcaauggaaccggacgccgccgcuaa

SEQ ID NO: 38437 - RNA, 1617 nt, Artificial Sequence
  derived and/or modified sequence opt11 from VP1__Norovirus_and/or_Norovirus-like__KJ433968
augaaaauggccuccagcgacgccaaccccuccgacggauccgcagccaaccucguacccgaaguaaacaacgaagucauggcgcucgagcccguaguuggcgcugccaucgccgcacccgucgccggacaacaaaacgucaucgaccccuggauucgcaacaacuucguccaagcacccggaggcgaguucaccguuagcccccgaaacgcccccggcgaaauacuaugguccgcaccccuuggccccgaccuaaacccauaucucucccaccucgcccgcauguacaacggauacgccggcggauuugaaguccaagucauccucgccggcaacgccuucaccgccgguaaggucauauucgccgcaguaccacccaacuuccccaccgaaggccuaucccccucucaagucacaauguucccgcacaucguagucgacguccgccaauuagaaccuguccuaauuccucucccugacgucagaaacaacuucuaccacuacaaccaaagcaacgaccccacaaucaaacucaucgcuaugcucuacacaccccuccgcgccaacaacgccggagacgacgucuucaccguauccugccgaguccuaacccgaccgucccccgacuucgacuucaucuuccucguucccccaaccgucgaaucgcgaaccaaaccauuuuccguccccguccucaccguagaagaaaugaccaacucucgcuuucccaucccccucgaaaaacucuucacgggcccauccucagccuucgucguccaaccccaaaacggucgaugcaccaccgacgguguccuaccaggcacaacacaauuaucacccguaaauauaugcacauucagaggugaugucacacacauuaccgguucccgaaacuacaccaugaaccucgccucccaaaacuggaacaacuacgaccccacugaggaaauaccagcaccccucggcacccccgacuucguaggcaaaauccaaggaguacucacacaaaccacucgauccgauggcucaacucgcggccacaaagccacagucuacaccggcuccgccgacuucgccccaaaacucggccgcguacaauucgaaaccgacaccgaccgugacuucgaagccaaccaaaacaccaaauucaccccugucggagucauacaagacgguggcacaacacaccgcaacgaaccccaacaauggguccuaccaagcuacuccggaagaaacacccccaacguacaucucgcccccgccgucgccccaacauucccaggagaacaacuccuguucuuccgaucgacaaugcccggaugcucaggauauccaaacauggaucucgacugccuccuaccccaagaauggguccaguacuucuaccaagaagccgccccagcccaaucugacguagcucucuugagauucgucaaccccgacaccggccgaguccuauucgaaugcaaacuccacaaauccggcuacgucaccgucgcccauacaggccaacacgaccucgucaucccacccaacggcuauuuccgcuucgacuccugggucaaccaauucuacacacucgcccccaugggcaacggcaccggacgacgccguuag

SEQ ID NO: 38438 - RNA, 1617 nt, Artificial Sequence
  derived and/or modified sequence opt11 from VP1__Norovirus_and/or_Norovirus-like__KP176409
augaagauggccuccuccgacgccucuccuuccgacggauccgccgccaaucucguacccgaagucaacaacgaagucauggcucuugaacccgucgucggcgccgcuaucgcagcacccgucgccggccaacaaaaugucauugacccauggauccgaaacaacuucguccaagcccccgguggcgaguucaccguaucccccagaaacgcccccggcgaaauacucuggucagccccacucggucccgaccucaaccccuaucucucacaccuugcccgcauguauaacggcuaugccggcggauucgaaguccaggucauccucgcugguaaugccuuuaccgccggaaaaguaauauucgcagccgucccacccaacuuccccaccgaaggccucucccccucccaagucaccauguucccccacaucgucgucgacguccgacaacuagaacccguccuuauuccccuccccgacguccgaaauaacuucuaucacuacaaccaaucaaacgaccccaccaucaaacucaucgcaaugcuauacacuccccuccgcgccaacaacgccggcgacgacguauucaccgucagcugucgcguccugacacgacccucccccgacuucgacuucauauuucucgucccacccacaguagaaucacgcaccaaacccuucucgguucccguccucacaguagaagaaaugacaaacucccguuuucccaucccccuagaaaaacuauucaccggccccuccagcgcuuuugucguacaaccccaaaauggccguugcacaacagacggcguccuccuaggcaccacacaacucuccccagucaacauaugcaccuuccgcggagacguaacccacauaaccggaucacgcaacuacaccaugaaccucgcaucgcaaaacugguccaacuacgaccccaccgaagaaauacccgcaccccucggcacacccgacuucguuggcaaaauccaaggcguccucacccaaaccacccguaccgacgguuccacccggggacauaaagccacagucuacaccgguuccgccgacuucgcaccaaaacucggcagaguccaauucgaaaccgacaccgauagagacuucgaagccaaucaaaacaccaaauucacacccgucggcgucauacaagacggcggcacuacccaccgaaaugaaccccaacaauggguacuccccucauacuccggccgcaacaccccuaacguccaccuugccccggcagucgcuccaaccuuccccggagaacaauuacucuucuuccguuccacaaugcccggcugcuccggcuauccuaacauggacuuagacugccuacucccacaagaauggguucaguacuucuaccaagaagcugcacccgcccaauccgacguggcccuccuccgauucgucaaccccgacaccggccgcguccuauucgagugcaaacuccacaaaucaggcuacguaacaguagcacacacaggccaacacgaccucguaaucccaccaaacgguuacuuccgauucgacagcugggucaaccaauucuacacccucgcccccaugggaaacggcaccggucgccgccgcuaa

SEQ ID NO: 38439 - RNA, 1617 nt, Artificial Sequence
  derived and/or modified sequence opt11 from VP1__Norovirus_and/or_Norovirus-like__KM514064
augaaaauggccagcucugacgcaaacccauccgacgggucagcugcaaaccuagucccagaagucaacaacgaagucauggcccuugagcccgucgucggagccgcuaucgccgcacccgucgcaggacaacaaaaugucauagaccccuggauucgaaacaacuucguccaggcacccggcggcgaguucaccgucuccccgcgaaacgccccaggcgaaauccuauggucagccccacuaggcccagaccucaacccguaccucucccaccuagcccgaauguacaacggcuacgcggguggcuucgaaguccaaguaauacucgcaggcaacgcauucaccgccggaaaaguaauauucgcggcagucccacccaacuuccccaccgaaggccucagccccucccaaguaacuauguucccacacauaguugucgaugucagacaacuggaacccguacuaaucccccuccccgacguccgcaacaacuucuaccacuacaaccaaucaucagaucccaccauuaaauuaauagcaaugcuuuacacaccccuccgcgcaaauaacgccggcgacgacgucuucaccgucuccugccgaguccuaacccgacccucccccgacuucgacuucauauuccuuguacccccaaccgucgaaucacgcacgaaacccuucuccguccccguacucaccgucgaagaaaugacuaacucccgcuuccccaucccucucgaaaaacucuucaccggcccauccuccgccuucguuguucaaccccaaaauggccgaugcacaacagacggaguccuacucggaacaacccaacucucccccguaaacaucugcacuuuccgcggcgacguaacccacaucaccggcucacacaauuacaccaugaaccucgccagccaaaacuggagcaauuacgaucccaccgaagaaauuccagcaccacucggcaccccagacuuugucggcaaaauucaagguguccuuacccaaaccacacgaaccgacggauccacacgaggccacaaagccacagucuacacuggcucagccgauuucgcccccaaacucggccgcguccaauucgaaaccgacaccaaccacgacuucgaagccaaucaaaacaccaaauucaccccaguuggagucauccaagacggcuccaccacacaccgcaacgaaccacaacaguggguccuccccagcuacuccggccguaacaccccaaacguccaccucgccccagccgucgccccaaccuucccaggcgaacagcuacucuucuuccgauccaccaugccaggcugcuccggauauccaaacauggaucuugacugccuccuaccacaagaauggguccaauacuucuaccaagaagccgcaccagcccaaucugacgucgcacuacucagauucguaaacccagauaccggcaggguacucuucgagugcaaacuucacaagucgggcuacguaacagucgcccacaccggacagcacgaccuagucaucccacccaacggcuacuuccgcuucgacagcuggguuaaccaauucuauacacucgcccccaugggaaacggcacaggccgccgccgauaa

SEQ ID NO: 38440 - RNA, 1617 nt, Artificial Sequence
  derived and/or modified sequence opt11 from VP1__Norovirus_and/or_Norovirus-like__KJ649703
augaaaauggcaucuuccgacgcaaaccccagcgacgguucugcagccaaccucgucccagaaguaaacaacgaaguaauggcccucgaaccagucguaggagccgccauagccgcaccagucgcaggccaacaaaacguuauagaccccuggaucagaaauaacuucguucaagcccccgguggcgaguucacugucucaccccggaacgcccccggcgaaauccuaugguccgcuccucucggaccagaccucaaccccuaccuaucccaccucgcacgcauguauaacggcuacgccggaggauucgaaguccaagucauccucgccggcaacgcuuucaccgccggcaaagucaucuucgcagcaguacccccaaacuucccuaccgaaggccuaucccccucccaagucacaauguucccccacaucgucguagacguccgacaacuagaaccaguccucaucccccucccagacguacgcaacaacuucuaccacuacaaccaguccaacgaucccaccauaaaacucaucgcaauguuauacacaccccuacgagcaaacaacgccggagacgacgucuucacaguauccugccgaguucuuacccgacccucccccgacuucgacuucauauuccuaguacccccaaccguugaaucacgcaccaaaccauucuccguucccguccuaacagucgaagaaaugacaaacucgcgauucccaauuccucuagaaaaacucuucaccggacccuccagcgccuucguaguccaaccccaaaacggacgcugcaccaccgacggcguacuacuaggcaccacacaauuauccccaguaaacaucugcacuuuccggggcgacguaacacauauaaccggcucacacaacuacaccaugaaccucgccucccaaaacuggaacaacuacgaucccacagaagaaaucccagcaccacucggcacccccgacuucgucggaaaaauccaagguguccucacccaaacuacacgcacagacggcagcacccgugggcacaaggccaccguauacaccggcuccgccgacuucucaccuaaacucggccgaauccaauucgaaaccgacaccaaccaugauuucgaagcuaaccaaaauaccaaauucacccccgucggcguaauccaagacggaggaaccacccaccgcaacgaaccacaacaauggguccuacccuccuacagcggccgcaauacaccaaacguccaccuugcccccgccguggcacccaccuucccuggugaacagcuacuuuucuuccgcuccaccaugcccggaugcucaggcuaccccaacauggaccuagacugccuacuaccccaagaauggguacaauacuucuaccaagaagcagcacccgcccaaucagacguggcccuucuccgauuugucaaccccgauaccggccgaguccucuucgaauguaaacuccacaaauccggcuacguaaccgucgcccacaccggccaacacgaucucgucauucccccaaacggcuacuuccgauuugacuccuggguaaaccaauucuacacccuagcacccaugggcaacggcaccggccggcgccgcuag

SEQ ID NO: 38441 - RNA, 1617 nt, Artificial Sequence
  derived and/or modified sequence opt11 from VP1__Norovirus_and/or_Norovirus-like__KF177447
augaaaauggcuagcucagacgcaaaucccuccgacggcuccgccgcaaaccuaguccccgaaguaaacaacgaaguaauggcacucgaacccgucgucggcgccgccaucgcagccccaguagccggucaacagaacgucaucgaccccuggauccgcaacaacuucguccaagcacccggcggcgaguucaccgucuccccucgcaacgcccccggcgaaauccuuuggucagcaccccucggcccagaccucaaccccuaccuaucacaccuagcucgcauguacaacggcuacgccggcggcuucgaaguacaagucauccucgccggaaacgcguuuaccgccggcaaaguaaucuucgcagccgucccacccaacuuccccacugaaggccugucacccucacaggucacaauguucccccacaucguaguagacguccgccaacuagaacccguucugaucccccugcccgacguccgcaacaacuucuaccacuacaaucaaucaaacgaccccaccaucaaacucaucgccaugcucuacaccccucuccgagcaaacaacgcuggagacgacgucuucacaguuuccugccguguccucacacgcccaucucccgacuucgacuucaucuuccucgucccacccaccguggaaucccgcacuaaaccauucuccguacccguccugaccgucgaagaaaugaccaacucccgauuucccaucccccucgaaaaacucuucacaggacccucauccgcuuucgucguccaaccccaaaacggccgcugcaccacagacggaguccuccucggcaccacccaacuauccccagucaacaucugcacuuuccgcggcgacgugacccauaucaccggcucucgaaacuacaucaugaacuuagcuagccagaacuggagcaacuaugacccuaccgaagaaaucccagccccacucggcaccccggacuuugucggcaaaauccagggcguccucacacaaacaacccguacagacggauccacccgcggccacaaagccaccguuuacaccggcucugcagacuucgcccccaaacuaggacgcguccaauucgaaaccgacacugaucacgacuucgaagccaaccagaauacuaaauucaccccugucggcgucauccaagacggcuccaccacccacagaaacgaaccucaacaauggguccuaccauccuacucaggucgcaauacccccaacguccaccuagcccccgccgucgcucccaccuuuccaggugagcaacuacucuucuuccgcagcaccaugccugggugcucuggcuaccccaacauggaccucgacugccuucuaccccaagaauggguccaauacuucuaccaagaggcugcacccgcccaauccgacgucgcccuccuccgcuucguaaacccugacaccggccgcguccuuuucgaaugcaagcuacacaaaucaggauacgucaccgucgcacacaccggccaacacgaccucgucauacccccaaacggauacuuccgauucgacuccugggucaaccaauucuacacacucgcacccaugggcaacggaaccggccgucgacgcuaa

SEQ ID NO: 38442 - RNA, 1617 nt, Artificial Sequence
  derived and/or modified sequence opt11 from VP1__Norovirus_and/or_Norovirus-like__JX439820
augaaaauggccagcaacgacgcuaaccccucagacggcuccacagcgaaccucgucccagaagucaacaacgaaguaauggcacuagaaccaguaguaggcgcagcaaucgcagcgccagucgccggccaacaaaacguaaucgacccauggauuagaaacaacuucguccaagcccccggaggcgaauuuaccgucucaccccgcaacgcacccggcgaaauccuauggucagccccgcuaggccccgaccucaaccccuaccucucucaccuagccagaauguauaacgguuacgccggcggcuucgagguccaggucauacuagcaggcaacgccuuuaccgccggcaaaaucaucuucgcagccguacccccaaacuuccccaccgaaggacucucccccucgcaaguaaccauguucccacacaucauagucgacguacgacaacucgaacccguccucaucccccuccccgauguccgcaacaauuucuaccacuacaaccaaagcaacgaccccaccaucaaacucauugccaugcucuacacaccccuuagagccaacaacgccggggacgacgucuuuaccguaucaugccgcguccuuacccgccccucccccgacuucgacuucauauuccucgucccacccaccgucgaaucucgcacaaaaccuuucuccguaccuguccuuaccguagaagaaaugaccaacucacgcuuccccaucccccucgaaaaacucuucacuggccccucaucagccuucguaguacaaccccaaaacggccgcugcacgaccgacggagucuuacucggcaccacccaacuuagccccguaaauaucugcaccuuucgcggcgacgucacccacaucuccagcucacguaauuacaccaugaaccucgcaagccaaaauuggagcucuuacgaucccacggaagaaauccccgcaccccucggcaccccggacuucgucggcaaaauccagggcguccuaacacaaaccacccgcaccgacgguuccacccgaggacacaaagccacugucuacaccgguuccgccgacuucaguccaaaacuaggacggguccaauucgacaccgacaccgacaacgauuuugaaaccaaccaaaacaccaaauucacacccgucggcgucauccaagacggauccacaaccuaccgcaacgaaccacaacaguggguacucccuucauacuccggccgaaacacccacaacguccaccuagcccccgccguggcccccacauucccaggggaacaacuuuuauucuuccgaucuacuaugccaggcugcuccggcuacccaaacauggaccuagacugucuacuaccacaagaauggguacaauacuucuaccaagaagccgccccugcacaauccgacguugcacuccuccgcuucgucaaccccgacaccggccgaguccuauucgaaugcaaacuccacaaauccggcuacguaaccgucgcacacaccggccaacacgaccucgucauacccccaaacggcuacuuucgguucgacuccugggucaaccaauucuacacccucgccccgauggguaacggaaccggccgccgccgcuaa

SEQ ID NO: 38443 - RNA, 1617 nt, Artificial Sequence
  derived and/or modified sequence opt11 from VP1__Norovirus_and/or_Norovirus-like__HF952120
augaaaauggccuccucagacgccaaccccagcgacggcuccaccgccaaccucguaccagaaguuaacaacgaagucauggcacuagaaccagucguaggcgccgccauagccgcccccgucgccggacaacaaaauaucaucgacccauggauccguaauaacuucguacaagcccccggcggcgaauuuaccguaucaccccgcaaugcccccggagaaauccucugguccgcaccccugggcccagaccuaaaccccuaccuaucccaccuugcccgcauguacaacggauacgccggaggauucgaaguccaagucauccuugccggcaacgccuucaccgccggaaaaaucaucuucgcugcagucccaccuaacuuccccaccgaaggccucuccccaagccaagucacaauguucccccacaucauagucgacguccgccaacucgaacccguccuaguaccccuaccagacguacgcaacaacuucuaccauuauaaccaauccaaugaccccaccaucaagcucauugccauguuauacacuccucuucgagcaaacaacgcaggcgacgacguauucaccgucucuugccgcguccucacacgcccuuccccagacuucgacuucaucuuucucguaccacccaccgucgaaucccggaccaaacccuucagcguacccauccuaacaguagaagaaaugaccaacuccagguuucccauuccccucgaaaaacucuucacuggccccuccuccgccuuugucguccaaccccagaacggucgaugcacaaccgacggaguccuacucggaaccacacaacucucccccguaaacaucugcaccuuccgcggagacgucacccacaucgcaggaucacgcaacuacacuaugaaccucgcuucccaaaacuggaacuccuacgaccccacagaagaaauccccgcaccccucggaacccccgacuucgucgggaaaauucagggcguccuuacccaaaccacacgaaccgacggauccacacgcggccacaaagccaccguuuacacaggcucagcagacuucagccccaaacucggccgcguccaauucgcaaccgacaccgacaaugacuucgaggccaaccaaaacaccaaauucacaccagucggcguuauccaagacggaucaaccgcacaccgcaacgaaccccaacaguggguucucccaucauacucaggccgaaacauccacaacguucaccucgcacccgcugucgcacccaccuuccccggugaacaacuucucuucuuccgcucgacuaugcccggcugcuccggcuaccccaacauggaccucgacugccuacucccacaagaauggguccaauacuucuaccaagaagcagcccccgcccaaagcgacgucgcccuccugagauucguaaacccagacaccggucgagucuuauucgaaugcaaacuccauaaaccuggcuacgucaccgucgcucacaccggacaacacgaucucguuauacccccuaacggauacuuccgauucgacuccugggucaaccaauucuacacccuugcccccaugggcaacgguaccggcagacgucgauaa

SEQ ID NO: 38444 - RNA, 1617 nt, Artificial Sequence
  derived and/or modified sequence opt11 from VP1__Norovirus_and/or_Norovirus-like__KC517369
augaaaauggccucaaacgacgcaaaccccuccgacggauccgccgccaaccucgucccagaaguaaauaacgaagucauggcuuuagaacccgucguaggcgcagcaaucgccgcacccgucgcuggccaacaaaacgucauagacccauggauucgaaacaacuucguacaagcccccggcggcgaguucacagucucuccccguaacgcccccggcgaaauccuaugguccgcuccucucggccccgaccucaaccccuaccucucccaccucgcacgcauguacaacggauacgccggaggcuucgaaguccaagucauacucgcaggcaacgccuucacugccggcaaaaucaucuucgccacuguaccgcccaacuuccccacagaaggccugucccccucccaggugaccauguucccccacaucauagucgacguccgucagcuagaacccguccuaaucccacuaccagacguccgaaacaauuucuaccacuacaaccaauccaaugacucgacaaucaaacucaucgccaugcucuacacaccccuacgcgcaaacaacgccggugaagacguauucaccgucuccugccgcguccuuacacgcccaucacccgacuucgacuucaucuuccucgucccacccaccguagaaucucgcacaaaacccuucaccguacccauacucacagucgaagaaaugaccaacucacgcuuucccauaccccucgaaaaacucuucaccggacccucuagcgcuuucgucguccaaccccaaaacggacguugcaccaccgacggcguucuccucggaacuacccaacuuucccccguaaacaucugcaccuuccggggcgacguaacccacauagccggcucacgaaacuacaccaugaaccucgccucccuuaacuggaacaacuacgaccccaccgaagaaauccccgcaccccucggcacacccgauuucgucgguaagauacaaggaguccucacccaaaccaccaaaggugacggcuccacccgcggacacaaagccaccguauacacaggcucugcccccuuuaccccaaagcucgguuccguacaauucgagaccgacacagagaacgacuucgaaacacaccaaaacaccaaauuuaccccuguuggcguaauccaagacggcggcacuacccacagaaacgaaccacaacaauggguccuuccauccuacagcggacguaacguccccaacguacaucuugcccccgcagucgccccaacauucccaggcgaacaacuccuauuuuuccgauccacaaugccaggaugcucaggauaccccaacauggaccucgacugccuccuuccacaagaauggguccagcacuucuaccaagaagccgcccccgcacaaagcgacguugcacuucuccgguucgucaacccagauaccggccgcguccucuucgagugcaaacuucacaaaaguggcuacguaacugucgcccacacaggccaacacgaccucgucaucccaccaaacggauacuuccgcuucgacuccugggucaaccaauucuauacccucgcccccaugggcaauggcaccggucgccgacgauaa

SEQ ID NO: 38445 - RNA, 1617 nt, Artificial Sequence
  derived and/or modified sequence opt11 from VP1__Norovirus_and/or_Norovirus-like__KC409293
augaaaauggccucaaacgacgcaaaccccuccgacggauccgccgcgaaccucguccccgaagucucaaaugaagucauggcacucgaaccagucgucggcgccgcaaucgccgcgcccguagccggucaacaaaacgucauagaccccuggauccgcaacaauuucguccaagcacccggcggagaauuuacaguaucaccccgaaacgcacccggcgaaauccuguggucagccccacuuggacccgaccuaaaccccuaccuaucccaccucgcucgcauguacaacggauacgccggcggcuucgaaguacaaguuauucucgccggcaacgccuucaccgccggcaaaaucauauucgccgcagucccacccaacuucccaaccgaaggccucuccccuucacaagucacgauguucccacauaucaucgucgacguccgccaacucgagcccguccucaucccccuacccgacguacgcaacaacuucuaccacuauaaccagaccaacgacuccacaaucaaacucaucgccaugcucuacacgccccuacgcgccaacaacgccggcgaagacguauucaccguaagcugccgaguccucacccguccaucccccgauuucgacuuuauauuucuaguaccacccaccgucgaaagccgcacaaaaccauucacaguccccauacucacagucgaggaaaugaccaacuccagauuccccaucccacuagaaaaacucuucacaggcccuuccggcgccuucgucguccaaccccaaaacggaagaugcacaaccgacggcguccuccucggcacaacacaacucagcccugugaacaucuguacauuccguggagacgucacccacaucgccggaagcagaaacuacaccaugaaccucgcaucccuaaacuggaacaacuaugaccccaccgaagagauccccgccccacucggcaccccagacuucgucggcaaaauccaaggaguccuaacccaaacgacuaaaggugacggaucaaccagaggccacaaggccaccguuuacaccggcuccgcuccauucaccccaaaacucggauccguccaauucagcacagacaccgaaaacgacuucgaaacccaucaaaauacaaaauucacacccguaggcgucauacaagacggcggcacaacacacagaaacgaaccacaacaauggguccuccccucauacuccggcagagauguccaaaacguccaccucgcaccggcuguagcucccacauucccaggcgagcaacuacucuucuuucgcagcaccaugccaggaugcagcggauaccccaacauggaccucgacugccuucucccccaagaguggguacaacacuucuaccaggaggcugcacccgcccaauccgauguagcccuccuacgauucguaaaccccgacacgggacgaguucucuucgaaugcaaacuacacaaguccggcuacgucacugucgcgcacacaggccagcacgaccuagucaucccacccaacggcuacuuccgauucgacucaugggucaaucaauucuacacucuggcccccauggggaacggaacaggcagacgccgauaa

SEQ ID NO: 38446 - RNA, 1617 nt, Artificial Sequence
  derived and/or modified sequence opt11 from VP1__Norovirus_and/or_Norovirus-like__JX984951
augaaaauggccucaaaugacgccaaccccuccgacggcuccgcugccaaucucgucccagaagucaacaacgaagucauggcccucgaaccagucgucggcgcagcaaucgcagcuccaguugccggccaacaaaacguaauagaccccuggauccgaaacaacuucguacaagcccccggcggcgaguucaccgucucgccacgaaacgcacccggagaaauacucugguccgcgccccucggacccgaccucaaucccuaccucucccaccuagccagaauguacaacggauacgccggcggcuucgaaguacaagugauucucgccggaaaugccuucaccgccgguaaaaucauuuucgccgccguacccccuaacuuccccaccgaaggccuauccccaucacaagucacaauguucccccacauaaucguugacguaagacaacuagaacccguccucaucccgcuucccgacguccgcaauaacuucuaccacuacaaucaauccaacgacucaacaauaaaacucauagccaugcuauacaccccucucagagccaacaacgccggcgaagacguauucaccgucagcugcagaguacuaacccgcccaucccccgacuucgacuucauauuucucgucccucccacagucgaaucccgaacgaaacccuucaccguucccauccucacagucgaagaaaugacuaacucccgauuccccaucccccucgaaaaacucuucacaggcccauccucagcuuucgucguacaaccacaaaaugggcgcugcacaacagacggcguccuccuagguacaacccaacucuccccugugaauaucugcacauuccguggagacguuacccacaucgccggcucacgcaacuacacuaugaaccucgcaucccugaacuggaauaacuacgaucccaccgaagaaauccccgcaccucucggcacccccgacuucgucggcaaaauccaaggcguccuuacacaaacaaccaaaggcgacggcuccacccgcggccacaaagccaccgucuacaccggcucagcacccuucaccccuaagcuaggaucaguccguuucuccacagacacagaaaacgauuucgaaacccaccaaaacaccaaauucacucccguaggcgucauccaagauggcggaacaacccaccgaaacgaaccacaacaauggguccuccccaacuacuccggauccgacgucccaaacguccaccucgcuccagccguagcacccaacuuccccggcgaacaacuccuauucuuccgcucuaccaugcccggcuguuccggcuaccccaacauggaccuagauugccuucucccccaagaauggguccaacacuucuaccaagaagccgcccccgcacaaucggacgucgcccucuuacgcuucguaaaccccgauaccggccgcguccucuucgaaugcaaacuacacaaaagcggcuacgucacaguugcccacacgggccaacacgaucucgucaucccacccaacggcuacuuccgcuucgauuccuggguaaaccaauucuacacccuagccccgaugggaaacgguaccggccgacgccgguaa

SEQ ID NO: 38447 - RNA, 1617 nt, Artificial Sequence
  derived and/or modified sequence opt11 from VP1__Norovirus_and/or_Norovirus-like__JX459612
augaaaauggccuccucugacgcacaccccuccgacggcuccacagccaaucucgucccagaagucaacaacgaaguaauggcccuagaaccagucguaggugcugcaaucgccgcccccguagccggccaacaaaacgucaucgacccguggauacgcaacaacuucguccaagccccaggcggcgaguucacugucucuccucgcaacgccccaggcgaaauacucuggagcgccccacuggggcccgaccucaacccauaccuuucacaccucgcccggauguacaacucauacgcaggcggauucgaaguccaaguuauccuagccggcaacgccuucaccgcuggcaaaaucauauucgccgccguaccaccaaacuuucccaccgaaggcuuaucacccucccaagucaccauguucccccacaucaucguagacguccgccaacuagaacccguacucauaccccuacccgacguucgaaacaacuucuaccacuacaaccaaucaaacgaccccaccauuaaacucauagcaaugcuauacacuccccuacgcgccaacaacgcaggcgacgacgucuucaccguauccugccgcguccuaacccgccccucaccagacuucgacuucaucuuccucguacccccuaccgucgaaucgcgaaccaaacccuucucggucccaauccuaaccgucgaagaaaugacaaauucccgauucccaauccccuuggaaaaacuuuucaccgguccauccucagcauucgucguccaaccccaaaacggccgaugcaccaccgacggaguacuccucggaacaacgcaacuaucccccgucaauaucuguaccuuccguggggacguaacacacaucgccggaacccaggaguacaccaugaaccucgcaagccaaaacuggaacaacuacgaccccaccgaagaaauccccgccccucuagggacgccagacuucgucggaaaaauacagggcguucucacccaaaccacaucccgcgauggauccacucgcggccacaaagccaccgucucgaccggcagcguacacuucacccccaaacuaggacgaguccaauuuagcaccgacaccuccaacgacuucgaaacaggucagaacacuagauucacacccguaggagucguccaagacggcucaaccacacaccaaaacgaaccccaacaauggguacuacccaauuacuccggccgcgacucccacaacguccaccucgcccccgccguugcccccucauuuccaggagagcaacuccuuuucuuucgauccacuaugcccggcugcuccggcuacccuaacaugaaccuagacugccuccucccacaagaguggguacaacacuucuaccaagaagccgcccccgcacaauccgacgucgcacuccuccgauuuguaaaccccgacaccggccgaguccucuucgaaugcaaacuccacaaauccggauacgugacuguagcacacacaggucaacacgaccuugucauaccucccaacggcuacuucagauucgacuccugggucaaccaauucuacacacucgcccccaugggcaacggcacaggacgccgaagauaa

SEQ ID NO: 38448 - RNA, 1617 nt, Artificial Sequence
  derived and/or modified sequence opt11 from VP1__Norovirus_and/or_Norovirus-like__JX459604
augaaaauggccagcaacgacgucacccccagcgacggcucugcagcaaaccucguccccgaaguaaacaacgaagucauggcacuagaacccgucguaggcgccgcaaucgccgcccccgucgcaggccaacaaaacgucauagaucccuggauccgcaauaacuucguccaagcccccggaggcgaguucaccguaucacccagaaacgcacccggcgaaauccuauggucagccccucucggacccgaccucaaccccuaccuaucacaccuagcccgaauguauaacggcuacgcaggcgguuucgaaguacaaguaauucucgcaggcaacgccuucaccgccggcaaaaucaucuuugccgcugucccacccaacuuccccaccgaaggccuaucccccucgcaagucacgauguucccccacaucauagucgacguacgucaacuugaacccguccucauaccccuccccgacguccgcaacaacuucuaccacuacaaccaaagcaacgacuccaccaucaaacucaucgccaugcuauacacaccccuaagagccaacaaugcuggugaagacguauucaccgucuccugccgaguccucacccgaccgucucccgacuucgacuuuauauuccuagucccuccaaccgucgaaucccgaacaaaaccauucaccguaccaauacucaccguagaagaaaugaccaauucccgcuucccaauaccucuugaaaaacucuucaccggacccucaggcgcuuucgucguccagccacaaaacggucgcugcaccaccgacggcguccuccucggaacuacccaacucucccccguaaacaucugcaccuuccgaggcgacgucacccacauagcaggcucccgaaacuacacaaugaaucucgccucccuaaacuggaacaacuacgaccccacagaagaaaucccagcaccccucggcaccccugacuuuguaggaaaaauacaaggaguccucacccaaacaaccaaaggggacggcuccacacgaggacacaaagccaccguauacaccggcucggccccauucacccccaagcucggcucaguccaguucuccacagacacagaaaacgacuucgaaacacaccagaacaccaaauucacccccgucggcguuauccaagacggcggcacuacacaccgcaacgaaccacaacaauggguccucccuuccuacuccggccgcaauguccacaacguccaccuugccccagcuguagcccccaccuuccccggcgaacaacuacucuucuuccgcuccaccaugccaggcugcucagguuaccccaacauggauuuagacugccuucucccacaggaauggguccaacacuucuaccaagaagcagcccccgcucaauccgacgucgcccuccuacgcuucgugaaccccgacaccggccgcguccucuucgaaugcaagcuacacaaauccggauacgucacagucgcacacacaggucaacacgaccuugucauaccacccaacggcuacuuccgcuucgacucuuggguaaaccaauucuacacacucgcucccaugggaaacggcacuggccgacgacgcuaa

SEQ ID NO: 38449 - RNA, 1617 nt, Artificial Sequence
  derived and/or modified sequence opt11 from VP1__Norovirus_and/or_Norovirus-like__JX155745
augaaaauggcauccaacgacgcgaaccccuccgacggcuccgccgccaaccugguucccgaaguaaacaacgaagucauggcccuagagcccgucgucggcgcagcaaucgcagcccccgucgccggacaacagaacguaaucgaccccuggauacgaaacaacuucguccaggcacccggcggugaguucacggucucgccccguaacgcacccggcgaaauccucugguccgcaccccucggccccgaccucaaccccuaccucucccaccucgcaagaauguacaacggauacgcaggcggcuuugaaguccaaguuauccuagcaggcaacgccuuuaccgccggcaaaauuaucuucgcugccgucccaccaaacuuccccaccgaaggacucucuccuucccaggucaccauguucccccacauaaucgucgacguccgccaacucgaacccguacucaucccacuccccgacguacgaaacaacuucuaccauuacaaccaaucaaacgacucaacaaucaaacucaucgcaaugcucuacacgccccuacgggccaacaacgcuggagaagacgucuucaccgucucaugccgagucuugacacgcccuucccccgacuucgacuucaucuucuuagucccucccaccgucgaaucacgaaccaaacccuuuacuguccccauacucaccgucgaagaaaugaccaacucccgcuucccuaucccccucgaaaaacuauuuaccggucccuccucugccuucguaguccaaccccaaaacggcagaugcaccacggacggcguccuacucggcacaacccaacucucccccgucaacaucugcacuuuucgcggugacgucacccauaucgccggaucacgaaacuacaccaugaaccuagccucccucaacuggaacaacuacgaccccaccgaagaaauccccgcuccccugggcacccccgacuucgucggcaaaauccaaggcguccucacacagaccacccgcggagacggcucgacccgcggacacaaggccaccgucuacaccggauccgcacccuucaccccuaaaaugggcagcguccaauucucuaccgacacagagaacgacuucgaaacccaccaaaacacaaaauucacucccgucggugucauccaagacggaggaaccacccaccgcaacgaaccccaacaauggguacuccccucuuacuccggacgcaacguacccaacguccaucuagccccagccguagcccccaccuuccccggcgaacaacuccuauucuuccgaucaacuaugcccggaugcucaggcuacccuaacauggaccucgacugccuacuaccccaagaauggguccaacacuuuuaucaagaagccgcucccgcccaaagcgacgucgcccuacuccgauucguaaaccccgacacaggacgcguccucuucgaaugcaaacuccacaaaucagguuacgucaccgucgcccacaccggccagcacgaccucgucauaccucccaacggcuacuuccgcuucgauucauggguuaaucaauucuacacccuagcccccaugggcaacggcaccggacgcagacguuaa

SEQ ID NO: 38450 - RNA, 1617 nt, Artificial Sequence
  derived and/or modified sequence opt11 from VP1__Norovirus_and/or_Norovirus-like__HM635155
augaaaauggccuccucugacacaaaaaccagcgacggcuccaccgcaaaccucgucccagaagucaacaacgaagucauggcccucgaacccgucgucggcgccgccaucgcagcccccgucgcaggccaacaaaacgucaucgaccccuggaucagaaacaacuucguccaagccccgggaggagaguucacaguauccccucgaaacgcccccggcgaaauacucugguccgcuccccuuggacccgaccucaacccauaccuuucccaccuagcccgcauguacaacggcuacgccggcggcuucgaaguccaaguaauccuagccggcaacgccuucaccgcgggaaagaucaucuucgcagcugucccacccaacuuccccacggaaggucuaucccccucccaaguaaccauguucccccacaucaucguagacguccgccaacucgaaccuguccucaucccccuccccgauguacgcaacaacuucuaccacuacaaccaauccaaugaccccacgaucaaacucaucgcaaugcuauauaccccacuucgugccaacaacgcaggagacgaugucuucaccgucuccugccguguacucacucgccccucccccgacuucgacuucaucuuccucgucccacccaccguagaaucccgcaccaaaccauucucuguaccaaucuuaaccgucgaagaaaugaccaacucacguuuccccauaccccucgaaaaacucuucaccggucccucauccgccuucgucguccaaccccagaacggccgaugcacaaucgacggcguccuucucggcacaacccaacucucccccgucaacaucugcacguuccguggcgacgucacccacaucaccggaagccguaacuacacaaugaaccucgccacacaaaacuggaacucuuacgaccccaccgaagaaaucccugcgccucuaggcacaccagacuucguaggaaaaauccaaggcguacuaacccaaaccacccgcgcagacgguucuacaagaggccacaaagccaccgucuacaccggcucagccgacuucgcaccuaaacucggacgcguacaauucgccacagacaccgacaacgacuucgacgcuaaccaaaauaccaaauucacacccgucggcgugauccaagacggaaacaccgcacaccgcaacgaaccacaacaauggguccuucccucauacucaggccguaacucucacaauguccaucucgccccagccgucgcaccaaccuuccccggcgaacaauuacuauucuuccgauccaccaugcccggcugcuccggcuauccaaacauggaucucgacugccugcuuccccaagaauggguccaguacuucuaccaagaagccgcccccgcacaauccgacguagcccuucuccgcuucguaaacccagacaccggacgaguccuauuugaaugcaaacuacacaaaucgggauaugucaccguagcccacacaggccaacaugaccuaguaaucccucccaacggcuacuuccgauucgacucaugggucaaccaauucuacacccucgcuccaaugggcaacggcaccggacgcagacguuaa

SEQ ID NO: 38451 - RNA, 1617 nt, Artificial Sequence
  derived and/or modified sequence opt11 from VP1__Norovirus_and/or_Norovirus-like__JN400620
augaaaauggcauccaacgacguaaacccauccgacggcuccgccgcuaaccucgucccagaagucaacaacgaagucauggcccucgaaccagucgucggcgcugccaucgcagcaccugucgcuggccaacaaaacgucaucgaccccuggauccgcaacaacuucguacaagccccuggcggcgaguucaccgucucccccagaaacgcaccaggcgaaauacuauggucagcuccccucggccccgaccuaaacccauaccucucacaccucgcccgcauguacaacggcuacgccggcggcuucgaaguccagguaauccuugccggcaacgcauucaccgccggcaaaauaaucuucgcugccguacccccaaacuuccccaccgaaggacucucucccucucaaguaaccauguucccacacauaaucgucgacguccgucaacuagaaccaguacucaucccucucccggacguccgcaacaacuucuaucacuacaaccaauccaacgacuccaccaucaaacuaaucgccaugcucuauacaccccuccgagccaacaacgccggagaagacgucuucaccguaucaugccgaguucuaacccgacccuccccagacuucgacuucaucuuccuagucccacccaccgucgaaucccguaccaagccauucacaguaccaaucuuaaccgucgaagaaaugacaaacucacgcuuuccaaucccccucgaaaaacucuucacaggccccuccagcgccuucgucguacaaccccaaaacggccgcugcaccacggacggcguccugcucgguaccacacaacuauccccaguuaacauaugcaccuuucgaggagacgucacccauaucgcaggcucacgcaacuacacuaugaaccucgcaagccuuaacuggaacaacuacgacccuaccgaagaaauccccgcaccccuugguaccccagacuucgucggaaaaauacaaggcguccucacccaaacaaccaaaggagacggauccaccagaggccacaaagccaccgucuacaccggcuccgcacccuucaccccaaaacucggauccguccaauucucaaccgacacagaaaacgacuucgaaacccaccaaaacaccaaauucaccccuguaggcguaauacaagacgguggcaccacacaccguaacgaaccucaacaauggguacuccccucauacucaggccgcgacguccccaacguccacuuagccccggccgucgccccaaccuuuccuggcgaacaacuccucuucuuccgaucuaccaugcccggaugcucugguuaccccaauauggaccucgacugccuccucccacaagaauggguucaacacuucuaccaagaagccgccccagcccaaucagacgucgcccuccuucgcuuugucaaucccgauaccggcagaguccucuucgaaugcaaacuccauaaauccggcuacguaaccgucgcccacaccggucagcacgaccucgucauaccacccaacggcuacuuccgauucgauuccugggucaaccaauucuacacacucgcccccaugggcaacggcacaggcagacgccgcuaa

SEQ ID NO: 38452 - RNA, 1617 nt, Artificial Sequence
  derived and/or modified sequence opt11 from VP1__Norovirus_and/or_Norovirus-like__JQ613573
augaaaauggcuucuuccgacgccaaccccagcgacggcuccaccgccaaccuuguaccagaagucaacaacgaagucauggcccucgaacccgucguaggcgccgccauugcagccccugucgccggccagcaaaaugucaucgaccccuggauccgcaacaacuucguccaagcaccaggcggcgaguucacagucucuccccgaaacgcccccggcgaaauccuuugguccgcaccacuaggcccagaccuaaaccccuaccugucccacuuggcccgaauguacaacggauacgccggcgguuucgaaguccaagucauucucgcaggcaacgccuucaccgccgguaaaaucaucuucgccgcuguaccaccaaacuuccccaccgaaggccuaucuccgucacaaguaaccauguucccccacaucaucguagacguccgccaacucgaaccaguccuuauaccccuaccagauguacgcaacaacuucuaccacuauaaccagucaaacgacccaaccaucaaacuaaucgccaugcucuauacuccccuacgcgccaacaaugccggcgacgacgucuucaccguauccugccgcguccuaacccgcccauccccagacuucgacuucaucuuccuuguaccacccaccgucgaaucccgcaccaaaccauuuuccguaccaguccucaccgucgaagaaaugacaaacucccgauuucccaucccucuagaaaaacuuuucacaggacccuccucagcauucguaguccaaccucaaaacggcagaugcacaaccgacggaguacuucucggcaccacucaacucucccccgucaacaucugcaccuuccgcggcgacgucacccacaucccaucaucacgcaauuacaccaugaaccucgccagccaaaacuggaacuccuacgacccaacggaagaaauacccgccccacucggcacucccgacuucgucggcaaaauccaaggcguacucacccaaaccacucgaaccgacggcuccacacgcggccacaaggcuaccgucuacaccggcuccgcugacuucucaccaaaacuuggccgaguccaauucgcgaccgacaccgacaacgacuucgagacaaaccaaaacacaaaauuuaccccaguuggcgucauacaagacgggucaacaacccaccgaaacgaaccucaacaauggguacucccaucauacucaggacgcaacauccacaacguccaccuagcccccgccgucgcaccaaccuuccccggagaacaacuccucuucuuccgauccaccaugcccggcugcuccggcuacccaaauauggaccucgacugccuccuaccccaagaauggguccaauacuucuaccaagaagccgcucccgcccaauccgacguagcccuccuacgcuucgucaacccagacacaggacguguccucuucgaaugcaaacuccacaaauccggcuacgucaccgucgcccacaccggacaacacgaccucgucauaccacccaacggauacuuccguuucgauuccugggucaaccaauucuacacucuggcucccaugggcaacggaacaggccgccgaagauaa

SEQ ID NO: 38453 - RNA, 1617 nt, Artificial Sequence
  derived and/or modified sequence opt11 from VP1__Norovirus_and/or_Norovirus-like__JQ478408
augaaaauggccagcaacgacgcaaaccccuccgacggcucgacugcaaaccucguccccgaagucaacaacgaagucauggcacucgagcccgucgucggugccgcaaucgccgccccggucgccggccaacaaaacgucaucgaccccuggauccgaaacaacuucguccaagcacccggcggggaauuuacugucucaccccgcaacgcacccggcgaaauccucugguccgcaccacucggacccgaccucaacccauaccucucccaccucgccagaauguacaacggauacgcuggcggcuucgaaguccaaguaauacuugccggcaacgcauucacugccggcaaaaucaucuucgccgccgucccacccaacuuccccacagaaggccuaucccccucacaagucaccauguucccccacaucauugucgacguucgccaacucgaaccuguccucaucccacuacccgacguacgcaacaauuucuaccacuacaaccaaucuaacgacccuacaauuaaacucaucgccaugcuauacacaccccuacgcgccaacaacgccggagaagacgucuucaccgucagcugccgaguccucacccgcccaucacccgacuucgacuuuaucuuccucguaccacccaccgucgaaucacgaacuaagccauucaccguaccaauccucaccguugaagaaaugaccaacucucgcuuccccauaccccucgaaaaacuauucaccggccccuccggugcauucgucguccaaccccaaaauggucgcugcacaaccgauggcguacuccuaggcacuacccaacucucaccagucaacauaugcacauuucgcggagacgucacccacaucgcaggcacacacaacuauacaaugaaccucgcaucccaaaacuggaacaauuacgaccccaccgaagaaauccccgcgccccuaggcacccccgacuucguaggccguauccaaggcaugcucacccaaaccacaagaggagacggcuccacccgcggccacaaagccaccgucuccacuggugacguccacuucaccccuaaacucggcuccauacaauucaacacagacaccaacaacgacuucgaaaccggccaaaauaccaaauucacccccguaggagucguacaggacggcaacggcgcccaccaaaacgaaccacaacaguggguccuacccuccuacagcggccgaaccggacauaacguccaccuagcccccgccgucgcccccaccuuccccggagaacaauuacuauucuuccguuccaccaugccaggaugcuccggcuaccccaacaugaaccucgacugccuacucccccaagaauggguccaacacuucuaccaagaagcagcccccgcacaaucagacgucgcccuccuuagauuugucaaccccgacaccggacgcgucuuauucgaauguaaacuacauaagagcggauacgucaccguagcacauacuggucaacacgaccucguuaucccacccaacggauacuuccgauucgauucaugggucaaccaauuuuacacccucgcacccaugggcaauggcaccggacgaagacgcuaa

SEQ ID NO: 38454 - RNA, 1617 nt, Artificial Sequence
  derived and/or modified sequence opt11 from VP1__Norovirus_and/or_Norovirus-like__EF684915
augaaaauggcuuccaacgacgccaaccccuccgacggcucagcugcaaaccucguccccgaagugaauaacgaaguuauggcccuagaacccgucgucggagccgcaaucgccgcccccgucgccggccaacaaaacguaaucgaccccuggauccgcaacaacuucguccaagcccccgguggagaguucacuguaucacccagaaacgccccaggugaaauccuaugguccgcaccccuaggaccagaccuuaacccuuaccucucccaccuagcccgaauguacaacggcuacgccggcggcuucgaaguccaaguaauacuagccggcaacgccuucacagccgggaaaaucaucuucgccgccgucccacccaacuuccccaccgaaggacucucgcccucacaaguaaccauguucccccacauuaucguagacguucgccaauuagaacccguacucauaccccuccccgacguacgcaacaacuucuaccacuacaaccaaucaaacgacucaacaauaaaacucaucgccaugcuauacacgccccucagagccaacaacgcaggcgaagaugucuucaccgucuccugccgcguccuaaccagacccucgcccgacuucgauuucauauuccucguacccccuaccgucgaaucucgcacaaagccauucaccguccccauccugaccgucgaagaaaugaccaacucacgauuucccaucccccucgaaaaacucuucacgggccccuccggcgccuucgucguccaaccacaaaacggcagaugcaccaccgacggcguccuacucggcaccacccaacucucccccgugaacaucuguaccuuccgaggcgacgucacccacauugccggcucccgaaauuacaccaugaaucucgcaucucuaaaauggaacaaauacgacccaacugaagaaauucccgcaccccuaggaaccccugacuucgugggcaaaauucaaggaguccucacccaaaccaccaaaggagacggaucaacccggggccacaaagccaccauauacaccggaucagcccccuucaccccaaaacuuggcuccguacaguucuccaccgacaccgaaaacgacuucgaaacccaccaaaacacaaaauucacaccaguaggcguaacccaagacggcuccaccacacaccgcaaugaaccccaacaauggguccuaccaucauacuccggccgcaauguacacaacguccaccucgcccccgccguagccccgacuuuucccggcgaacaacuucucuucuuccgcuccaccaugccuggcugcuccggcuaccccaacauggaccuugacugccuccucccacaagaauggguucaacacuucuaccaagaagccgcccccgcucaaagcgacguagcccuccuacgcuuugucaacccggacaccggaagaguccuauucgaaugcaaacuccacaagucaggcuacgucaccgucgcacacacgggacaacacgaccuugucaucccacccaacggcuacuucagauucgacuccuggguaaaccaauucuacacucuugcccccaugggcaacggcaccggccgccgccgauga

SEQ ID NO: 38455 - RNA, 1617 nt, Artificial Sequence
  derived and/or modified sequence opt11 from VP1__Norovirus_and/or_Norovirus-like__HQ456331
augaaaauggccagcaacgacgccaacccaucagacggaucagccgcaaaccucguccccgaagucaacaacgaagucauggcacuagaacccguagucggggccgccauagcagccccagucgccggccaacaaaauguuauagaccccuggauccgaaacaacuucguccaagccccaggcggcgaguucaccguaagcccacgcaacgccccgggcgaaauucucugguccgccccucucggucccgaccucaacccauaccucucccaccuugcccgaauguacaacgguuacgccggcggauucgaaguccaaguuauccucgccgguaaugccuucacagccggaaaaaucaucuucgccgccgucccucccaacuuccccaccgaaggccucucccccucacaaguaaccauguucccccacaucaucguagacguccgacagcuagaacccguccucaucccccuacccgacguacgaaacaacuucuaccauuacaaccaaucaaacgacucgaccaucaaacuaaucgccaugcucuauacaccccuacgagccaauaacgccggcgaagacguauucacagugagcugccgaguccucacccgcccauccccggacuucgauuucaucuuccuuguacccccuacaguagaaucccgcacaaaaccauucacaguaccaauccucacuguagaagaaaugaccaacuccagauucccaaucccccucgaaaaacucuucacaggacccucaggcgccuucgucguccaaccccaaaacggcagaugcaccaccgauggaguacuccuaggcacuacacaacucagcccggucaacauuuguaccuuccguggagacgucacucacaucgcaggcucccguaacuacaccaugaaccuugccucccuaaacuggaacaacuacgacccaaccgaagaaacaccggcgccccuuggcaccccagacuucguuggcaaaauacaaggagucuuaacacaaacaaccaaaggcgacggcucaacccgcggucacaaagccaccgucuacaccggcagcgcccccuuuaccccaaaacuaggcucuguacaauucuccaccgacaccgagaacgacuucgaaacccaccaaaacacaaaauucacacccgucggaguaauccaagacggaucaaccacccaucgcaacgaaccccaacaguggguccucccaaguuacuccggacgaaacguccacaacguacaccuggccccagccguagcccccacuuuccccggagaacaacuccuauucuuccgcuccacaaugcccggcugcucaggauaccccaacauggaccuagauugccuccucccccaggaguggguccaacacuuuuaccaagaagcagccccagcacaaucggacgucgccuuacuccgauucguaaaccccgacaccggacgcguucuauucgaaugcaaacuccauaaaucaggauaugucaccgucgcccacaccggacaacacgaccucgucauacccccaaacggcuauuuccgcuucgacagcugggucaaccaauucuacacccucgcacccaugggcaacggaaccggccgaagacguuaa

SEQ ID NO: 38456 - RNA, 1617 nt, Artificial Sequence
  derived and/or modified sequence opt11 from VP1__Norovirus_and/or_Norovirus-like__HQ456322
augaagaucgccuccucagacgcaaaccccuccgacggguccaccgccaaccucgucccagaagucaacaacgaagucauggccuuagaaccagucguaggugcagccaucgccgcccccguagccggacaacaaaacgucaucgacccauggauccgcaacaacuucgugcaagcccccggcggagaauuuaccgucucaccacgcaacgcuccaggcgaaauccucugguccgcaccccuaggacccgaccucaaccccuacuuaucacaccuagcccgaauguacaacagcuacgccgguggcuucgaaguccaagucauccuagccggcaacgcuuucacagcaggcaaaauuaucuucgccgccguaccacccaacuuccccaccgaaggucuaucccccagccaagucaccauguuuccccacaucauaguagacguccgccaacucgaaccaguccucaucccccuccccgacguacgcaacaacuuuuaccacuacaaccaaucaaacgacccaacaaucaagcucaucgcaaugcuuuacaccccacuacgcgcuaacaacgcaggcgacgacgucuucaccgucucaugccgaguucuaacacgccccagcccagacuucgacuucauauuccucgugccuccaacagucgaaucacgaaccaaaccguucuccgucccuauacuuaccgucgaagaaaugaccaacucccgauuccccaucccacuggaaaaacuauucaccggccccucauccgccuuugucguccaaccccagaacggccgcugcaccaccgacggcguccugcuaggaacaacccaacucucccccgucaacauaugcaccuuccgaggugacgucacacacaucgcaucuacccaagaauacacaaugaaccucgccucccaaaacuggaacaauuacgaccccaccgaagaaauccccgcuccccuaggcacccccgacuucgucgguaaaauacaaggcguccuaacacaaacaacucgacgggacgguuccacccgcggccacaaagccaccgucuccaccggaucaguacacuucacaccuaagcuaggcagaauccaauucuccaccgacacuucaaacgacuucgaaaccggccaaaacacccgcuucacaccuguuggcguaguacaagacggaagcaccacccaccaaaacgaaccccaacaauggguucuaccuaacuacucaggacgcgacucccacaacguacaccuagccccagccguagcccccucauuucccggagaacagcuccucuucuuccgcucuaccaugcccggcugcuccggcuaccccaacaugaaccucgacugccuccucccacaagaauggguccaacacuucuaccaagaagccgcccccgcccagucagacguugcacuccuccguuucguaaaccccgacaccggucguguacuauucgaaugcaagcuacacaaauccggcuacgucaccgucgcucacaccggccaacacgaccucgucauaccacccaauggcuacuuccgauuugacucgugggucaaccaauucuacacccuugcucccaugggcaacgguacaggcagacgcagauaa

SEQ ID NO: 38457 - RNA, 1617 nt, Artificial Sequence
  derived and/or modified sequence opt11 from VP1__Norovirus_and/or_Norovirus-like__HM802551
augaagauggccucaaacgacgcuucaccaagcgauggcuccaccgccaaccucgucccagaaguaaacaacgaagucauggcccuugaaccagucgucggagccgcaauagccgcccccgucgcaggccagcaaaacguuauagaccccuggauucguaacaauuucguacaagcuccaggcggcgaauuuacagucuccccacgaaacgcccccggugaaauccucugguccgcuccccuaggcccugaccucaacccauaccuaucccaccucgcacgaauguacaacggcuacgccggcggcuucgaaguacaggucauccucgccggaaacgcauucacagcaggcaaaauaauauucgccgcuguaccacccaacuuccccaccgaaggccucucacccucacaaguaacaauguucccccacauuauaguagacguccgccaacucgaaccuguccucaucccccucccagacgucagaaacaacuucuaccacuacaaccaaucaaacgacucaacaauuaaacucauagccaugcucuacacucccuugagagcaaacaaugccggagacgacgucuuuaccgucuccugccgaguucuaacccgccccuccccagacuucgacuucaucuuccucgugccacccaccgucgagucccgcacaaaacccuucaccgucccaauccucaccgucgaagaaaugacaaacagccgcuucccaauaccccucgaaaaacucuuuaccggacccucauccgcauucgucguccaaccccaaaauggccgcugcaccaccgacggaguccuacucggcacuacccaacucucccccgucaacaucugcaccuuccgcggggacguuacucacaucuccggaucacgaacauacagaaugaaccuagcgucacagaacuggaacaacuacgauccaaccgaagaaauucccgccccgcuaggaacccccgacuucguaggcaagauccaaggcaugcuuacacagaccaccaaaggagacggcagcacucgcggccauaaagcaaccguauccaccggguccgucgacuucacccccaaacucggauccguacaauucgcaaccgacaccgacaacgacuucgaaaccggccaaaacaccagauucacccccgucggagucauccaagauggauccuccacccaccgcaacgaaccccaacaauggguccuaccagacuacuccggccgcacuguccauaacguccacuuagcacccgccgucgcccccacauuccccggcgaacaacuauuauucuuccgcuccacuaugcccggcugcucuggcuaccccaacauggaccuagacugccuccucccacaagaguggguccaacacuucuaccaagaagcagcccccucacaaucagacguggcucuacuccgauucgucaaccccgacacaggccgaguucuauucgaaugcaaacuucacaaagccggcuacguaacagucgcccacacaggccagcacgaccucguaauaccacccaacggcuacuuccgcuucgacuccugggucaaccaauucuacacacucgcccccaugggcaacggagccggacgacgccgguaa

SEQ ID NO: 38458 - RNA, 1617 nt, Artificial Sequence
  derived and/or modified sequence opt11 from VP1__Norovirus_and/or_Norovirus-like__HM802546
augaaaauggccuccaacgacgccucgcccucagacggcuccacugcaaaccucguucccgaggucaacaacgaagucauggcacucgaacccgucguaggagcagccaucgccgcccccgucgcugggcaacaaaacguaaucgaccccuggaucagaaauaauuucguccaggcccccggcggagaguucaccguuucaccccgcaaugccccaggggaaauccuaugguccgcaccccucggacccgaccuaaacccguaccuaucacacuuagcccgcauguauaacggcuacgccggcggcuucgaaguccaaguaauccucgccgguaacgccuucacggccggcaagaucaucuucgccgcaguaccaccaaacuucccaacagaaggcuuauccccuucccaaguuacaauguucccgcauaucaucgucgacguacgccaacucgaaccuguccuaaucccacuccccgacguccgaaacaacuucuaccacuacaaccaauccaacgacuccacaaucaaacucaucgccauguuauacacaccccuaagagcaaauaacgcaggcgacgacgucuuuaccgucuccugccgcguucuaacccgccccucccccgacuucgacuuuaucuuccucgucccaccaacagucgaaucccguaccaaacccuucaccguacccauccucacagucgaagaaaugaccaauucccguuuccccaucccacucgaaaaacucuucaccggccccuccuccgccuucgucguccaaccccaaaacggucggugcacaaccgacggcguccuacucggaaccacccaacuauccccagucaacaucugcacauuccggggcgacgucacacacaucuccggcacacgaacauaccgaaugaaccucgccucccaaaacuggaauaacuacgacccaacagaagaaauacccgcaccccucgguacgcccgacuucguuggaaagauacaaggcaugcuaacacaaaccaccaaaggagacggcuccacacgcggccacaaagccaccguauccaccggauccgucgacuucaccccuaaacuaggcuccguucaauucgccaccgauaccgacaacgacuucgaaacaggccaaaacacccgcuucacccccgucggagucauccaagacggaucuucagcucaccgcaacgaaccacaacaauggguccuaccagacuacuccggccgcaccguccacaacguccaccucgcuccagccgucgcacccaccuuccccggcgaacaacuacucuucuuccgcucaaccaugcccggcugcuccggcuacccaaacauggaccuagacugucuacucccccaagaauggguccaacacuucuaccaagaagcugcacccucccaauccgacguggcccuccuccgcuuuguaaaccccgacaccggccgcguccuuuucgaaugcaaacuacacaaagccggcuacguaacagucgcccacaccggacaacacgaccucguaaucccacccaacggcuacuuucgcuucgauucauggguaaaccaauucuacacacucgcacccaugggcaauggagcaggacgccgacgcuaa

SEQ ID NO: 38459 - RNA, 1617 nt, Artificial Sequence
  derived and/or modified sequence opt11 from VP1__Norovirus_and/or_Norovirus-like__GQ856453
augaaaauggccuccaacgacgccaacccauccgaugguucagcggccaaccuagucccagaaguuaacaacgaaguuauggcucucgaaccagucgucggcgccgcaauagcagcccccgucgcaggccaacaaaacguuaucgaccccuggauacgcaacaacuuuguucaagccccaggcggcgaguucaccgucuccccucguaacgcacccggagaaauccucuggucagcaccccucggcccugaccucaacccauaccucucacaccuagcccgaauguacaacggcuacgccggcggcuucgaaguccaagccauccucgccggcaacgcauucaccgccgguaagaucaucuucgcagccgucccaccgaacuuccccacagaaggacucucgccaucccaaguaaccauguucccccacaucauuguagacguccgacaacucgaaccuguccucaucccccuccccgacguacgcaacaacuucuaccacuacaaccaaucaaacgacagcaccauaaaacuaaucgccaugcuauacaccccacuacgcgccaacaacgcuggcgaagacgucuucacuguaucaugccguguacuaacccgccccucaccagacuucgacuuuauauuccuagucccucccaccguagaaucccguaccaaacccuucacuguacccauacucaccgucgaagaaaugaccaacucccgcuuucccauaccccucgaaaaacucuucacaggcccauccucagccuucgucguccaaccccaaaacggccguugcaccacagacggaguucuucuaggcaccacacaacucucaccagucaacauaugcacauuccgcggagauguuacccacaucgcaggaucccgaaacuacacaaugaaccuagccagccucaauuggaacaacuacgaccccaccgaagaaaucccagcuccccucggcacacccgacuuugucggaaaaauacaagggguucuaacacagaccaccaaaggagauggcuccacccgaggacacaaagccaccgucuacaccggcuccgccccauucacccccaaacuaggcucgcuccaauucuccacagacaccgaaaacgacuucgaaacccaccaaaacaccaaauuuacccccguaggcguaauccaagacggcggcaccacucaccgcaacgaaccccaacaauggguacuaccauccuacagcggucgcaacguacccaacguccaccuagcacccgcagucgcacccacauucccaggagaacaacuccucuucuuccgcucaacaaugccaggaugcucaggcuaccccaacauggaccucgacugccuucuaccccaagaauggguccaacacuucuaucaagaagccgcacccgcccaauccgacguggcccuccuccgcuuugucaacccagacacaggccgaguccucuucgaaugcaaacuccacaaauccggcuacgucaccgucgcccacacuggccaacacgaccucgucauuccaccaaacgguuacuuccgauucgacuccuggguaaaccaauucuacacacuagcaccaaugggcaacggcaccggccgccgccgcuaa

SEQ ID NO: 38460 - RNA, 1617 nt, Artificial Sequence
  derived and/or modified sequence opt11 from VP1__Norovirus_and/or_Norovirus-like__GQ856445
augaagauggccucaaacgacgccaacccaucagacggcucagccgccaaccucguacccgaagucaacaacgaaguaauggcccucgagccuguagucggcgccgcaauagcugcacccgucgccggccaacaaaacgucaucgaccccuggauccgcaacaacuucguccaagcccccggcggcgaauuuaccgucagcccccgaaacgcacccggcgaaaucuuauggucugcaccccucggacccgaccucaaccccuaccucucccaccucgcccgcauguacaacggcuaugccggagguuucgaaguacaagucauccucgcaggcaacgcauucaccgcuggaaaaaucaucuucgcagcaguuccgcccaacuuccccaccgaaggccuuucaccgucccaagucacaauguuuccucacaucaucgucgacguucgccagcucgaaccaguucuaauaccacucccagacguccgcaacaacuuuuaccacuacaaccaaucaaacgacuccaccauaaaacucaucgccaugcucuacacaccccuccgagccaacaaugcaggcgaggauguauucaccguauccugccgcguacucacccgccccucccccgauuucgacuuuaucuuccuaguuccucccaccgucgaaucccgaacgaaaccauucaccgucccaauccucaccguggaagaaaugaccaacucccgcuucccuaucccccucgaaaaacuauuuacuggacccucauccgccuuuguaguccaaccacaauccggcagaugcaccaccgacggcguccuccucgggacuacccaacuauccccugucaacaucugcaccuuccgcggcgauguaacccacaucgccggcucccgcaacuacaccaugaaccuugcaucacucaacuggaacaacuacgaccccacugaagaaauaccagcaccccuuggaacccccgauuucgucggcaaaauccaaggaguccucacacaaacuacaaaaggugacggauccacccgcggccacaaagccacuguauacaccggcuccgcccccuuuacccccaaacucggauccguccaguucuccacugacacagagaacgacuucgaaacacaccaaaacacaaaauucacaccagucggagucauacaagacggcggcaccacccacagaaacgaaccccaacaauggguacuccccucauacuccggaagaaacgugccaaacguccaccucgcccccgccgucgcccccaccuuccccggagaacaacuccucuucuuccgcagcaccaugcccggcugcuccggcuaccccaauguugaccucgacugccuacucccccaagaauggguacaacacuucuaccaagaggccgcuccugcccaauccgacgucgcacuccuccgcuucgucaacccagacaccggccgcguacuauucgaaugcaaacuccauaaauccggcuacgucacagucgcccacacaggccagcacgacuuaguuauaccacccaacggcuacuuccgcuucgacuccuggguaaaucaauucuacacccuagcccccaugggaaacggaaccggaagacgacgcuaa

SEQ ID NO: 38461 - RNA, 1617 nt, Artificial Sequence
  derived and/or modified sequence opt11 from VP1__Norovirus_and/or_Norovirus-like__AB541358
augaaaauggccucaaacgacgccaaccccuccgacggaucagcagccaacuuaguccccgaagucaacaacgaagucauggcccucgaacccguugucggcgccgcaaucgcagcaccagucgcaggacaacaaaacgucaucgaccccuggauccgcaacaacuucguccaagcucccggcggugaguucacaguaucaccacgaaacgccccaggcgaaauccucuggucugcaccccuaggcccagaccucaaucccuaccucucccaccuagcccgcauguacaacggauacgcaggcggauucgaaguccaagucauccucgcaggcaacgccuuuacugcuggaaaaauaauauucgcagcagucccaccuaacuuccccaccgaaggacuaucgcccucccaaguaaccauguucccccacaucaucguugauguccgccaacuagaacccguacuuauaccauuaccagacguccgcaacaacuucuaucacuacaaccaauccaacgacucaaccaucaaacucaucgcaauguuauacacuccccuucgcgccaacaaugccggcgaagauguauucacaguauccugccgcguccucacccgccccagcccagacuucgacuucaucuuucucguacccccgacugucgaaucacgcacuaaacccuuuaccguccuaauccucacagucgaggaaaugaccaacucccgcuucccaaucccccucgaaaaacuauucaccggacccucauccgcauucguaguccaaccucaaaacggccgcugcaccacagacggaguccuccucggcacaacccaacugucccccguaaauauaugcaccuuccgcggcgacgucacccacauagcuggcucccgcaacuacaccaugaaccucgccagccuaaacuggaacaacuacgacccuaccgaagaaauaccggcaccccuaggcaccccagacuucgucggcaaaauacaagguguccuaacccagaccacaaaaggcgacggaucaacccguggccacaaagccacagucuacacaggauccgcccccuucacccccaaacuaggcuccguacaauucucaacugacacagaaaacgacuucgaaauacaccaaaacaccaaauucacacccguuggagucauccaggacggcuccaccacccaccgaaacgaaccccaacaauggguacucccauccuacuccggacgcaacguccacaacguucaccucgcccccgccgucgccccaaccuucccaggcgagcaacuacucuucuuccgcuccacaaugccagguugcuccggauacccaaacauggaccucgacugcuuacucccucaagaauggguccaacacuuuuaccaagaggccgccccagcucaaucagacgucgcacuccuacgcuucguuaaccccgacaccggacguguccucuucgaaugcaaacuccacaaauccggcuacgucaccguugccuacacaggccaacacgaucucgucaucccacccaacggauacuucagguucgacuccugggucaaucaauuuuacacucucgcacccaugggcaacggcaccggacgacguagauaa

SEQ ID NO: 38462 - RNA, 1617 nt, Artificial Sequence
  derived and/or modified sequence opt11 from VP1__Norovirus_and/or_Norovirus-like__AB541349
augaaaauggccucuaacgacgcaaaccccagcgacggcucagccgcaaaccucgugccagaagucaacaacgaagucauggcccucgaacccguagucggcgccgcaaucgcggcccccgucgccggacaacaaaacgucaucgaccccuggauccgaaacaacuuuguccaagcccccggaggugaauuuaccguaagcccccgcaacgcccccggcgaaauccuaugguccgcaccccuaggcccugaccuaaacccauaccuuagccauuuagcccgcauguauaacggcuacgccggcggcuucgaaguccaggucauccucgccggcaaugccuuuaccgccggcaaaaucaucuucgcagcaguuccacccaacuuucccaccgaaggccucucccccucccagguaaccauguuuccccacaucaucguugacguccgccaacuagaaccaguccuuaucccacuccccgacguccgcaacaacuucuaccacuacaaccaaucaaacgacuccaccaucaaauuaaucgcaaugcucuacacaccccuccgagccaacaacgccggcgaagacguauucaccguuucuugccgaguacuuacccgcccaucacccgacuuugacuucaucuuccuagucccacccacaguagaaucccgaaccaaacccuucacaguccccauccuuaccgucgaagagaugaccaacucacgauuccccaucccccucgaaaaacucuucaccggaccaucgggcgcauucguaguccagccacagaacggacgcugcacuacggacggaguacuccucggcaccacacaacucucacccgucaacaucugcaccuuccgaggugaugucacccacaucgcuggaucccgaaacuacacuaugaaucuggcaucccucaauuggaacaacuacgaccccacagaagaaauacccgcaccccugggcacacccgacuucgucggaaaaauccaaggaguccucacacaaaccaccaaaggcgacggcuccacccgcggccacaaagccaccguauacacagguucuacaccuuuuaccccaaaacucggcagcguccaauucaguaccgacacagaaaacgacuucgaaacccaccaaaacaccaaauucacccccgucggcgucauccaagacggcucaaccauccaucgaaacgaaccucaacaauggguccuaccauccuacagcggacgcaacguccaaaacguccaccuagccccagccgucgcccccaccuuccccggcgaacaacuccucuucuuucgcuccaccaugcccgguugcucaggauauccaaauauggaccucgacugccuacuaccccaagaauggguacaacacuucuaccaagaagccgccccugcccaaagcgacgucgcacuccucagauucguuaacccugauaccggacgcguccucuucgaaugcaaacuacacaaauccggauacgugaccgucgcacacaccggccaacacgaccucgucauucccccgaacggcuacuuccgcuuugacuccuggguaaaccaauucuacacccuagccccaaugggcaauggaaccggccgccgccguuaa

SEQ ID NO: 38463 - RNA, 1617 nt, Artificial Sequence
  derived and/or modified sequence opt11 from VP1__Norovirus_and/or_Norovirus-like__AB541342
augaaaauggcauccaacgacgccaaccccuccgacggcucugcagccaaccucguccccgaagucaacaacgaaguaauggcacucgaacccguagucggcgccgcaaucgccgccccaguagccggccaaacaaacgucaucgacccguggauccgcaacaacuucguccaagcccccggcggagaguucacaguauccccacgcaacgcaccaggcgaaauccucugguccgccccaucaggccccgaucucaaccccuaccucucucaccuagcacgcauguucaaugacuacgccggcgguuucgaaguacaaguaauucuugcaggcaacgccuuuaccgcuggaaaaauaauauucgcagcaguaccacccaacuuccccaccgaaggacucucacccucgcaagucaccauguucccccacauaaucgucgacguccgccaacucgagccaguccucauaccccucccagacguacgcaacaacuucuaccacuacaaccaauccaacgacucuaccaucaaacucaucgccaugcucuacacaccccuucgagcaaacaacgccggcgaagacgucuucaccguuuccugccgcgugcucacucgccccucccccgacuuugacuucauauuccuaguuccacccaccgucgaaagccgcaccaaaccauucaccguaccaauccucaccguugaagaaaugacuaacucacgcuucccaauccccuuagaaaaacucuucacaggaccaucgggcgccuucgucguccaaccacagaacggccgcugcaccacagacggcguccuucucggcacuacccaacucuccccagucaauauaugcaccuuccgcggcgacgucacccauauagcagguucucguaauuacacaaugaaccuagccucccucaacuggaacaacuacgaccccacugaagaaauccccgcuccccuaggcacccccgacuucgucggaaaaauccaagguguccucacccaaaccaccaaaggagacggaucuacacgcggccacaaagccaccgucuacaccggcuccgccccauucaccccaaaguuaggcucaguccaauuuuccaccgacaccgaaaacgacuucgaagcccaccaaaacaccaaauucacacccgucggcgucauccaagauggcucaaccacccaccgcaacgagccucaacaauggguccuacccucuuacuccggcagaaacguccaaaacguacaccuagcacccgccgucgcccccaccuucccgggcgaacaacuccucuucuucagauccaccaugcccggcugcucaggcuaccccaacauggauuuagauugccuacucccccaggaauggguacaacacuucuaccaagaagcugcacccgcccaauccgacgucgcccuacuccgcuucgucaacccugacaccggacgcguccucuucgaaugcaaacuccacaaauccggcuacguuacaguagcccacacaggccaacacgaccuaguaauaccucccaacggauacuuccgcuucgacagcuggguuaaucaauucuacacacucgcucccaugggcaacggaaccggacgacgacgcuag

SEQ ID NO: 38464 - RNA, 1617 nt, Artificial Sequence
  derived and/or modified sequence opt11 from VP1__Norovirus_and/or_Norovirus-like__AB541248
augaaaauggcuagcaacgacgcgaaccccucugacggcuccgccgccaaccuugucccggaagucaacaacgaggucauggcccucgaacccguagucggagcagccaucgcagcccccguagccggacaacaaaacguaaucgaccccuggauacgcaacaauuucguucaggcccccggcggcgaguucacugucucuccccgcaacgccccaggcgaaauccuuugguccgccccacucggacccgaccucaaccccuaucucucacaccuagcccgaauguacaacuccuacgcuggaggauucgaaguucaaguaauacuugcuggcaacgccuucacagccggaaaaaucauauucgcagccguacccccaaacuuucccacagaaggccucucaccuucucaagucaccauguucccccacauuauaguagacguccgccagcuugaaccgguccucaucccccuacccgacguccguaacaacuucuaccacuacaaccaauccaacgacucaaccaucaaacucauagccaugcucuacacaccccuacgcgcaaacaaugccggcgaagauguauuuaccgucuccuguagaguacuaacgagacccuccccagacuucgauuucaucuuccucguucccccaaccguggaaucccgaaccaaacccuucacagucccgauccucaccgucgaagaaaugacaaacucccgauucccaaucccucuagaaaaacucuucacuggccccuccucugccuucgucguacaaccacaaaauggccgaugcacaaccgacggcguccuccuuggcaccacccaacuaucccccgucaacaucugcaccuuccgcggcgacguaacacauauagccggcucccgaaacuacaccaugaaccuugccucacuaaacuggaacaacuacgauccaacugaagaaauccccgcuccccucggcacaccagacuucgucggcaaaauacaaggcguacucacacaaaccacuaaaggagacggcuccacccgcggccacaaagccaccgucuauaccggcuccgcccccuucacacccaaacuuggaucaguccaguucagcaccgacaccgaaaacgacuucgagacacaccagaacacuaaauucacccccgugggcgucauccaagacggcggaacaacacaccgcaacgaaccccaacaauggguccuccccucauacuccggccgcgacguccacaacguccaccuagccccagccgucgcccccaccuuccccggcgaacaacuacucuucuuccgcuccacaaugccaggaugcuccgguuaccccaacauggaccuugacugccuacuaccacaagaauggguccagcacuucuaccaggaagccgcccccgcccagucagacgucgcccuccuccgauucguaaacccagacaccggacgcguauuguucgaaugcaaacuacacaaauccggcuacgucacagucgcccauaccggacaacacgaucucgucauaccacccaacggauacuuccgauucgacagcugggucaaccaauucuacacacucgcacccaugggcaacggcaccggccgccgccgcuaa

SEQ ID NO: 38465 - RNA, 1617 nt, Artificial Sequence
  derived and/or modified sequence opt11 from VP1__Norovirus_and/or_Norovirus-like__GQ246798
augaaaauggcaucaagcgacgccaacccauucgacggcuccaccgcaaaccucguaccagagguuaauaacgaaguaauggcccuugaacccgucgucggcgcagcaaucgccgcccccgucgccggacaacaaaacguaaucgaucccuggaucagaaauaacuucguacaagcccccgguggcgaguucaccgucucgccccgcaaugcccccggcgaaauccugugguccgcaccccucggcccagaccucaaccccuaccucucacaccucgcccgaauguacaacggauacgccggaggauucgaaguccaaguaauccucgcuggcaacgccuuuaccgccggaaaaauuaucuucgcagcaguacccccuaacuucccaaccgaaggacuaucccccucacaaguuaccauguucccucauauaaucgucgacguacgccaacucgaacccguccucaucccacugcccgacguccgaaacaacuucuaccacuauaaccagucaaacgaccccaccaucaagcugaucgccaugcucuacacaccccuaagagccaacaacgccggcgacgacguuuucaccgucuccugcagaguccucacccgccccucacccgacuucgacuucaucuuccucgucccacccaccgucgaaucccgcaccaaacccuucuccguacccauucuaaccgucgaagaaaugaccaacagccgcuuccccauuccucucgaaaaacucuucaccggccccuccuccgcguucguuguucaaccacaaaacggacgcugcaccaccgacgguguccuccuaggcaccacccaacuauccccagucaacaucugcacauuccgcggcgacguaacccacauaacaggaucacgcaauuacaccaugaaccucgccacucaaaacuggaacucauacgaccccacagaagaaaucccggcaccacuaggaaccccagacuucgucggcaagauccaaggcguccucacccaaaccacucgugccgacggcucaacccgcggacacaaagccaccguauacacaggcuccgcagauuucgccccaaagcucggccgcguccaauucgccaccgacacagacaacgacuucgacgccaaccaaaacacaaaauucacacccguuggcguuauccaagacggaaacaccgcccaccgcaaugaaccgcaacaaugggucuuacccuccuacuccgguagaaacucccacaacguccaccuagcccccgccguagcacccaccuuccccggcgaacaacuccucuucuuccgcucaaccaugccagguugcucaggcuaccccaacauggaccucgacugccuccuaccccaagaauggguacaauacuucuaccaagaagccgcccccgcacaaucugacguugcccuccuccgcuucgucaacccagacacgggacgaguccuauucgaaugcaaacuucacaaauccggcuacguuaccgucgcacacacgggacaacacgaccucgucaucccaccuaacggcuacuuccgcuucgacuccugggucaaccaauucuacacucucgccccaauggguaacggcaccggccgccgacgcuga

SEQ ID NO: 38466 - RNA, 1617 nt, Artificial Sequence
  derived and/or modified sequence opt11 from VP1__Norovirus_and/or_Norovirus-like__GQ246791
augaaaauggccagcaacgacgccaaccccuccgacggcucaacagccaaucucguccccgaaguaaacaacgaaguaauggcccuagaacccgucgucggcgccgccauagccgcacccguagcaggccaacaaaacgucaucgacccauggauacgcaauaacuuuguacaagcuccgggaggcgaguucacaguaucaccacgcaaugccccaggcgaaauucuaugguccgcaccacucggaccugaccuaaacccauaccucucccaccucgcccgcauguacaacggauacgccggcggguucgaaguccaaguaauacucgccggcaacgccuuuacagcaggaaaaaucauauucgcugccguacccccaaacuucccuaccgaaggacucucacccucacaagucaccauguucccccguauuaucgucgacguccgccagcuugaacccguacucaucccccucccagacguccggaacaacuucuaccacuacaaccaaucgaaugaccccacaaucaaacucaucgcaauguuauacacaccccuacgcgccaacaacgcaggcgacgacgucuucaccgucucaugucgcguccucaccagaccauccccagacuucgacuucaucuuccuaguaccaccaaccgucgaaucacguaccaaacccuucaccguccccauccuaacagucgaagagaugaccaauucccgcuuccccaucccacuagaacgccucuacaccggacccuccucagcauucgucguccaaccccaaaacggacgcugcacuacagacggagugcuccuuggcaccacccaacuaucagcaguaaacaucugcacauucagaggagacgucacucacaucgccggcucccgcaacuacaccaugaaucucgccagccaaaacuggaacaacuaugaccccaccgaagaaauccccgccccgcucggaaccccugacuucgucggcaaaauccaaggcaugcuuacucaaaccacacgcucagauggcucuacacgcggccacaaagcaaccgucuuaaccggcucugccgacuucgccccaaaacuaggacgcguacaauucgcaaccgacaccgacaacgacuucgaaucuggacaaaacaccaaauucacucccguaggcguaauccaagacggcucuacaacccaccgaaacgaaccccaacaauggguacucccaaacuacuccggccgcacuggccacaacguccaccuagcucccgcugucgcacccaccuacccaggcgaacaacuacuauucuuccgaucaacaaugccaggcugcuccggcuaccccaacauggaccuagacugccucauaccccaagacuggguccaacauuucuaccaggaagccgcccccgcccaauccgacgucgcccuacuacguuucgucaaccccgacacaggccgcguccuguucgaaugcaaacugcacaaaagcggcuacgucacaguugcacacaccggccaacacgaccucgucauaccacccaacggcuacuuccgcuucgacuccugggucaaccaauuuuauacacucgcacccaugggcaacggcaccggccgccgccguuaa

SEQ ID NO: 38467 - RNA, 1617 nt, Artificial Sequence
  derived and/or modified sequence opt11 from VP1__Norovirus_and/or_Norovirus-like__GU350225
augaaaauggcaucuaacgacgccucccccuccgacggcucaacagcuaaccucgucccagaaguuaauaacgaagucauggcccuagaacccguaguaggagccgcuaucgccgccccugucgccggacaacaaaaugucauagaccccuggauccgaaacaacuuuguucaagcacccggaggcgaauuuaccgucucuccccgcaacgcacccggagaaauucucugguccgcuccccucggacccgaccuaaacccauacuuaucacaucucgcgcgcauguacaacggcuacgccggcggauucgaaguccaagucauccuagccggaaacgccuucaccgccggaaaaaucaucuucgccgccgugcccccaaacuucccuaccgaaggucucucccccucccaaguaaccauguucccccacaucauaguugacguccgacaacuagaacccguacucaucccacuccccgacgucagaaauaacuucuaccacuacaaucaauccaacgauuccaccaucaagcuaaucgcaaugcucuacacaccccugcgcgccaacaacgccggagacgacguauucaccgucuccugucguguccuuacccgucccuccccagauuuugacuucaucuuucuuguacccccaaccgucgaaucccgaaccaaacccuucacagucccaauacucacagucgaagaaaugacaaacucacgauuccccaucccccucgaaaaacuauucaccggccccuccuccgccuucgucguccaaccccagaacggccgcugcaccacagacggcguccuacucggaacuacucaacucuccccagucaacauaugcaccuuucgcggcgacgucacacacauccccggcacccgaacauacagaaugaaccuagcaucacaaaauuggaacaacuacgaccccacagaagaaauccccgcaccacucggcacacccgauuucgucggcaaaauucaaggcaugcucacacagaccaccaaaggcgacggcuccacaagaggucacaaagcaaccguaucuaccgguucagucgacuucaccccgaaacucggcuccguccaauucgcaacagacacagacaacgacuucgaaaccggacaaaacacccgcuucaccccuguaggcguaauccaagacggaucaucaacacaucgcaacgaaccccaacaauggguacuccccgacuacucuggccgcaccgcucacaacguacaccucgcccccgcagucgccccaaccuuccccggcgaacaacuccucuucuuucgauccaccaugccuggaugcucuggcuaccccaacauggacuuagacugccuccuuccccaagaauggguacaacacuucuaccaagaagccgccccaucacaguccgacgucgcgcuacuacgcuucgucaaccccgacacuggucgaguacucuucgaaugcaaacuucacaaggcaggauacgucaccgucgcccacaccggccaacacgaccucguaauacccccaaacggcuacuuccgauucgacuccugggucaaccaauucuacacacucgcaccaaugggaaacggagccggacgacgccgcuaa

SEQ ID NO: 38468 - RNA, 1617 nt, Artificial Sequence
  derived and/or modified sequence opt11 from VP1__Norovirus_and/or_Norovirus-like__AB504319
augaaaauggccucuaacgacgcaaacccauccgacggauccgccgccaaccuaguuccugaggucaacaacgaagucauggcacucgaacccguagucggcgccgccaucgccgcccccgucgcaggacaacaaaacgucaucgacccauggauaagaaacaacuucguacaagcccccggcggcgaguucaccgucucaccccgaaacgcacccggcgaaauccucugguccgcuccucuagggccagaucucaaccccuaccucucucaccucgcacgaauguacaacggcuacgccggcggcuucgaaguccaaguaauccuggccggcaaugccuucacagcaggaaaaaucaucuucgcagccgucccuccgaacuucccaacugaaggccuaagccccucucaagucaccauguucccccacauaauagucgacguccgacaacucgaaccuguccucauaccccuccccgacguacgcaacaacuucuaccauuacaaccaaucaaaugacuccaccauuaaguuaaucgccaugcuuuacacaccccuccgcgccaacaaugccggcgaagacgucuucaccgucuccugccgaguccuaaccagacccagccccgacuuugacuuuauauuccuagugcccccaaccgucgaaucucgcaccaaaccauucaccguccccauacucaccgucgaagaggucaccaacucacgcuuccccauaccccucgaaaaacuauuuacuggucccucaggcgcuuuuguuguccaaccucaaaacggcagaugcaccaccgacggcguccuccucggcaccacacaacucuccccaguaaacaucugcaccuuccgaggggaugucacacacauagccgguacacgaaacuacacaaugaaccucgcaucgcuaaacuggaacaauuacgacccaaccgaagaaauccccgcuccccucggcacacccgacuucgucggcaaaauccaagguguccucacacaaacaacaaaaggagacggcuccacccgcggacacaaggccacaguauacaccggcagcgcacccuucacccccaagcuaggcuccguccaauucuccacggacaccgaaaaugacuucgagacccaccaaaacaccaaauucacaccagucggagucauccaggacggcggcaccacgcaccgcaaugaaccucaacaauggguccuccccucauacuccggacgcaacguccacaacguacaccuagcacccgccguagcccccaccuuucccggcgaacaacuccuauucuuccgcucaaccaugccgggaugcuccggcuaccccaacauggaccuagauugcuuacucccccaagaauggguucaacacuucuaccaagaagccgccccagcacaaucagacgucgcccucaugcgauucguaaacccagacaccggccgcguccucuucgaauguaaacuccacaaauccggcuacguaaccguugcccacacaggacaacacgaccuagucauacccccaaacggcuacuuccgcuucgacagcugggucaaccaguucuacacccuagcaccaaugggcaacggaaccggccggcgacgcuga

SEQ ID NO: 38469 - RNA, 1617 nt, Artificial Sequence
  derived and/or modified sequence opt11 from VP1__Norovirus_and/or_Norovirus-like__AB447458
augaaaauggccuccucugacgcaaacccaucagacggaucaaccgccaaccuuguacccgaagucaauaacgagguuauggcacucgaaccugucgucggcgccgcaaucgccgcccccguagccggacaacaaaacgucaucgaccccuggauucgaaauaacuucguccaagccccugguggcgaauuuaccgucuccccacgaaacgccccuggcgaaauacucuggagugcaccccucggccccgaccucaaccccuacuuaucacaccuagcucgcauguacaacuccuacgccggcggauucgagguccaggucauccuugccggcaacgcauucacagccggaaaaaucaucuucgcagccgugccacccaauuuccccaccgagggacucucccccucccagguaacuauguuuccccacaucaucguagacguccgccaacuagaacccguccucauuccccuccccgauguacgaaacaacuucuaccacuacaaccaauccaaugacccaaccaucaaacucaucgccaugcucuacacuccccuccgcgccaacaacgccggcgacgacguauucaccguauccugccgcguccuaacccgccccucaccagacuucgacuucauuuuucuagucccacccaccgucgaaucacgcaccaaaccauucagcguccccguccucaccguagaagaaaugaccaacucucgcuuccccaucccccuagaaaaacucuucaccggacccucauccgcauucgucguccaaccacaaaacggccgaugcaccaccgauggcguccuccucggcaccacccaacucucucccgucaacaucugcaccuuccguggcgacgucacacacauugcagggacccaagaauacaccaugaaccuugccucacaaaauuggaacaauuacgauccaaccgaagagauacccgcuccccugggcaccccugacuucgucggaaaaauccaaggcguccuaacucaaaccacccgccgagacggauccacacgaggccauaaagccaccgucuccaccggaagcguacacuucaccccaaaacuuggacguauccaauucuccaccgacaccuccaacgacuucgagaccggucaaaacacccgauucacccccguaggagucguccaggacggaggcaccacgcaccaaaacgaaccacaacaauggguccuccccaacuauucaggccgcgacucccacaauguacaccuagcccccgccgucgcccccuccuuccccggagaacaacuacuuuucuuccgcuccaccaugccuggcugcuccggauaccccaacaugaaccuagacugccuccucccccaagaauggguacaacacuuuuaccaagaagccgcucccgcacagucagacgucgcccucuuacgauucguaaaccccgacaccggucgaguacuuuucgagugcaaacuccacaaaucaggauacguuacugucgcccacaccggccaacaugaccucguaauacccccaaacgguuacuuccgcuucgacucauggguaaaccaauucuacacccucgcccccaugggcaauggcacaggccgccgccguuga

SEQ ID NO: 38470 - RNA, 1617 nt, Artificial Sequence
  derived and/or modified sequence opt11 from VP1__Norovirus_and/or_Norovirus-like__AB385640
augaagauggccaguucagaugccaaccccucagacggauccaccgccaaccucguccccgaagugaacaacgaagucauggcacuagaacccgucguuggcgccgccaucgcagcccccgucgccggccagcaaaacgucaucgacccuuggauccgcaauaacuucguacaagcccccggcggcgaguucacaguaagcccccgaaacgcacccggcgaaauccucugguccgcaccauuaggacccgaccucaacccuuaucuaucccaccucucccgaauguacaauuccuacgccggcggauuugaaguccaaguuauccucgcuggcaaugccuucaccgccggcaaaauaaucuucgccgcagucccacccaacuucccaaucgaaggccucucccccucacaagucaccauguucccccacaucaucgucgacgucagacaacucgaacccguacucaucccccucccugauguccgcaacaacuucuaccacuacaaccaaucaaacgaccccaccauaaaacucaucgcaaugcuauacaccccucuccgagccaacaacgccggugaugacguauucaccguaucaugccgcgugcuuacccgaccaucccccgacuuugacuucaucuuucucguaccacccaccgucgaaagccggaccaagcccuucucuguccccauacucaccguagaagaaaugaccaacucccgauuucccacccccgucgagaaacucuucaccggacccucuucagccuucaucguacaaccacaaaacgggcgcuguacuauagacggcguacuucuaggcaccacacaacuaucgccagucaauauaugcaccuucagaggagacgucacccacauagccggcacccaagaauacacaaugaaccucgcuucccaaaacuggaacaacuacgacccaaccgaagagaucccagcaccccucggaaccccggauuuugucggcaaaauccagggcguccuaacgcaaaccacacgacgagacggcuccacucgaggacacaaagcuaccgucuccaccggcuccguccacuucacccccaaacuaggccgcauccaauucucaaccgacacauccaacgacuucgaaacccgacaaaacacccgcuucacccccgucggcgucauccaagacggcuccacaacucaccaaaacgaaccccaacaauggguccucccaaacuacuccggccgagacucccacaacguccaccucgcacccgcagucgccccauccuucccgggcgaacaacuccucuucuuccgaucaaccaugccaggcugcuccggcuacccaaacaugaaccucgacugucuccucccccaagaauggguacaacauuucuaccaagaagcugcaccagcacaaucggacguagcacuccuucgguucgucaaccccgacacaggacgcgucauguucgaaugcaaacuccacaaaucuggcuacaucacagucgcccacacaggacaacacgaccucgucauaccacccaacggcuacuuccgcuucgacgccugggucaaccaguucuacacacuggcucccaugggcaacggcaccggacgccgccgcuga

SEQ ID NO: 38471 - RNA, 1617 nt, Artificial Sequence
  derived and/or modified sequence opt11 from VP1__Norovirus_and/or_Norovirus-like__AB385633
augaaaauggccuccuccgacgcaaaccccuccgacggcuccaccgccaaccuaguccccgaagucaacaacgaagucauggcccucgagcccguagucggcgccgcaaucgcagcccccgucgcaggccagcaaaacgucaucgaccccuggauccgcaauaacuucguacaagcucccggcggggaguucaccguaucaccccgcaaugcccccggcgaaauccucugguccgcaccccucggccccgaucucaaccccuaccuaucacaccuggcccgcauguauaacggcuacgccggcggcuucgaaguucaaguaauacucgcuggaaacgccuucacagccggcaaaaucgucuucgcagccguaccacccaacuuccccaccgaaggucucucccccucccaaguaacuauguucccccacaucaucgucgacguacgacaacucgaacccguacuaauaccccuccccgacguccgcaacaauuucuaccacuacaaccagucaaacgacaguaccaucaaacucaucgcaauguuauacacaccccuccgagccaacaacgcaggggaugacgucuucaccguaucaugccgcgugcucacaagaccuucccccgacuucgacuucauauuccucgucccacccacaguagaaucacgcaccaaacccuuuucgguccccauacuaacaguagaagaaaugaccaacagccguuuccccaucccccucgaaaaacucuuuaccggcccguccuccgccuucaucguccaaccccaaaacggccgcugcacaaccgacgggguccuacuaggaaccacucaauuaucacccguaaacaucuguaccuucagaggugacguaacacacauugccggcacacaagaauacacaaugaaccucgcaucccaaaacuggaacaacuacgaccccaccgaagaaauacccgcaccccucggcaccccagacuucguuggcaagauccaaggaguccuaacacaaacgacacguagagacggcuccacacgaggccacaaagccaccguuuccaccgggucuguccacuucacccccaaacucggccgaauacaauucuccaccgacacauccaacgacuucgaaaccggccaaaacacuagauucacccccguaggcgucguacaagacggcuccaccacccaccaaaacgagccccaacaauggguacuucccaauuaccucggcagggacucacacaacguccaccuagcccccgccgucgcccccagcuucccaggcgaacaacuacucuucuuccgcucaaccaugcccgguugcucuggcuaccccaacaugaaccucgacugccuccucccccaagaauggguccaacacuucuaccaggaagccgcccccgcccaaucagacgucgcacuacuucgcuucguuaaccccgacaccggccguguucuauucgaaugcaaacuccacaaauccgguuacgucaccgucgcgcacacuggacaacacgaccucguaaucccacccaacggcuacuuccgcuucgacuccugggucaaccaauucuacacccuggcacccaugggaaacggcacaggcagacgaagauaa

SEQ ID NO: 38472 - RNA, 1617 nt, Artificial Sequence
  derived and/or modified sequence opt11 from VP1__Norovirus_and/or_Norovirus-like__DQ658413
augaaaauggccucaaacgaugccaauccauccgacggguccacagccaaccuagucccugaagucaauaacgaagucauggcccuagaacccgucguaggcgccgccaucgcagcacccgucgccggccaacaaaacgucaucgacccuuggauccggaacaacuucguccaagcccccggcggcgaauuuaccgucagcccccgcaacgcccccggcgaaauacuuugguccgcaccccuaggaccagaccucaaccccuaccuuucccaccuagcccgaauguacaacggcuacgccggaggauucgaaguacaagucauccucgccggaaacgccuucacagccggcaaaaucaucuucgccgccgucccacccaauuuccccaccgaaggacuuucccccucccaagucaccauguucccccacaucauagucgacguacgccaacucgaacccguccucauaccacuccccgacgucagaaacaacuucuaccacuacaaccaauccaacgacccaacaaucaaacuaauagccaugcuauacacuccauuacgagcaaauaacgccggcgaagacguuuucaccgucagcugccgaguccuaacacgacccucaccagacuucgacuucaucuuccuuguaccuccaaccgucgaaucccgcaccaagccauucaccgucccaauccuaacagucgaagaaaugaccaacucacgguucccuaucccccuagaaaaacucuucaccggacccuccggcgccuucgucguccaaccacaaaacggccgaugcaccaccgacggcguccuucucggaacaacccaacucucaccaguaaacaucugcaccuuccgcggcgacgucacacacaucgccgacacccauaacuacaccaugaaccuagccucacaaaacuggaacaacuacgaccccacagaagaaauccccgcgccucucggcacucccgacuucgucggcaaaauccaaggaaugcuuacacaaacuaccagaggcgacggcuccacacgcggccacaaagcgaccgucuccacaggcgacguccacuucacccccaaacucggcuccauccaauuuaacacagacaccaacaacgacuucgaaaccggacaaaacacaaaauucacaccagucggcguuguacaagacggcaacggaacccaucaaaacgaaccucaacaauggguccuaccuucauacucuggccguacuggucacaacguccaccuugcacccgccgucgccccuacuuuccccggcgaacaacuacucuucuuucgauccaccaugcccggaugcuccggauaccccaacaugaaccuagacugccuccucccacaagaauggguacaacacuucuaccaagaagccgcccccgcccaauccgacgucgcccuucuacgauucgucaaccccgacaccggccgcguacucuucgaaugcaaacuccauaaaucuggauacguaacagucgcccacacaggccaacaugaccugguaauacccccaaacggauacuuccgcuucgacuccugggucaaccaauucuacacacucgccccaaugggcaacggcacaggccgacgucgcuag

SEQ ID NO: 38473 - RNA, 1617 nt, Artificial Sequence
  derived and/or modified sequence opt11 from VP1__Norovirus_and/or_Norovirus-like__AB220923
augaagauggcuuccaacgacgccucccccuccgacggcuccaccgcaaaccuagucccagaaguaaacaacgaagucauggcccucgaacccguugucggcgccgccaucgcagccccagucgcaggccaacaaaacgucaucgaucccuggaucaggaacaacuuuguccaagcccccggcggcgaguucaccguaucaccucgcaacgcuccgggagaaauacuaugguccgcaccucucggacccgaccuuaacccauaucuaucacaccucgcacgcauguacaacggcuacgcuggcgguuuugaaguacaaguaauccuugccggaaacgccuucaccgccggcaaaaucaucuucgccgccguacccccuaacuuucccacugaaggccucucaccaucccaagucaccauguucccccauaucaucgucgacguccgucagcucgaacccguccucaucccccuucccgacguccgcaacaacuucuaccacuauaaccaaucuaacgacagcaccaucaaacucaucgcaaugcucuacacaccccuccgcgccaacaacgccggagacgacgucuucaccgucuccugccgcguccucacccgccccuccccagauuucgacuucauauuccucgucccacccaccgucgaaagcagaaccaaacccuucaccgucccaauacucaccgucgaagaaaugaccaacuccagauuccccauaccccuagaaaaacucuuuaccggccccuccuccgcuuucgucguccaaccccaaaauggccgcugcaccaccgacggcguccuacucggaacuacccaacucagucccguaaacaucugcaccuuccgcggcgacgucacucacaucucaggaaccagaaccuaccgcaugaaccucgcuucccaaaauuggaacaacuacgaccccaccgaggaaauucccgccccacucggcacaccugacuucguuggaaaaauccaaggcaugcucacccaaaccaccaaaggcgacggcucaacacgcggucacaaggccacugucucuacgggcucagucgacuucacccccaaacuaggcuccguccaauucgccaccgacacugacaacgacuucgaaaccggccaaaacacucgcuucacccccgugggcgucauccaagacggaucuucaacccaucgcaacgaaccacaacaauggguccuacccgacuacucaggccgcaccguccacaacguacaccucgcccccgccgucgcccccaccuuccccggcgaacaacuccucuucuuccgcuccaccaugccaggcugcuccggcuaccccaacauggaccuagacugccuacuaccucaagaauggguccaacacuuuuaccaagaagccgcccccucccaaucugacguagcacuccucagauucgucaaccccgacaccggccguguccuuuucgaaugcaaacugcauaaagcuggguaugucaccgucgcccacacaggacaacacgaccucgucaucccucccaacggcuacuuucgauucgacuccugggucaaccaauucuacacccuagcccccaugggcaacggagccggacgucgccgcuaa

SEQ ID NO: 38474 - RNA, 1617 nt, Artificial Sequence
  derived and/or modified sequence opt11 from VP1__Norovirus_and/or_Norovirus-like__AY588016
augaaaauggcuuccaacgacgccaaccccucagacggcuccacagccaauuuaguccccgaagucaacaacgaaguaauggcccucgaacccguaguaggcgccgcaauagccgcaccagucgccggccaacaaaacgucaucgaccccuggauccgaaauaacuucguccaagcccccggcggagaguucaccguaucaccacgcaacgcucccggcgaaauucucugguccgcaccccucggucccgaccuaaaccccuaccucucacaccuugcccgcauguacaacggauacgccggcggguucgaaguccaagucauccuugccggcaaugcauucacugcaggcaaaaucauuuucgcagccgucccacccaacuucccuaccgaaggccuuuccccaucccaaguaacuauguucccccauaucaucgucgacguccgccaacucgaacccguacucaucccacuccccgacguccgaaacaacuucuaccacuauaaccaaucaaacgaccccaccaucaaacucauagccaugcucuacaccccacuucgagccaacaacgccggagaagauguauucacaguaucuugccgcguccuaacccgcccaucuccagacuucgacuucauauuccucgucccuccaaccgucgaaucccgcacaaaaccauucacagucccaauccuuacugucgaagaaaugacaaacucccgcuucccaaucccacuagaaaaacucuucaccggacccuccggcgccuucgucguccaaccacaaaacggacgaugcaccaccgacggaguccuacuaggcaccacucaacuaucacccgucaacaucuguacauuccguggcgacgucacacacaucgccggcacccacaacuacacaaugaaccucgccucccagaacuggaacaacuacgaccccaccgaagaaauccccgcaccccucggcaccccagacuucgucggccgcauccaaggaaugcucacacagacaacccgcggcgacggcucaacacgaggacacaaagccacagucuccaccggcgacguccacuucaccccgaaacucggcuccauccaauucaacaccgacaccaacaacgacuucgaaacaggccaaaauaccaaauuuacacccguuggcguuguacaagacggcaacggcacacaccaaaacgaaccccaacaguggguccuccccuccuacuccggacgcacaggccacaacguccaccucgcccccgccgucgccccuacauucccgggugaacaacuccucuucuuccgcuccgccaugccuggaugcuccggauacccuaacaugaaccuagacugccuacucccccaagaauggguacaacacuuuuaccaagaagcagcccccgcccaaagcgacgucgcccuccuccguuucgucaacccagacaccggccgcguucucuuugaaugcaaacuacacaaauccggcuacguuaccgucgcccacaccggccaacacgaccucguaaucccacccaacggauacuuccgcuucgauaguugggucaaccaauucuacacccuagcacccaugggcaacggaaccggacgacgccgcuaa

SEQ ID NO: 38475 - RNA, 1617 nt, Artificial Sequence
  derived and/or modified sequence opt11 from VP1__Norovirus_and/or_Norovirus-like__AY502022
augaaaauggccuccaacgacgccaaccccuccgauggcuccaccgcaaaccucguaccagaagucaacaacgaagucauggccuuagagccaguagucggcgccgcaauagccgccccagucgcaggccagcaaaacguaauagaccccuggauacgcaacaacuucguccaagcaccaggaggagaguucaccgucucuccccgaaacgccccaggcgaaauccuaugguccgcgccacucggaccagaccucaaccccuaccuuucccaccuugcccgaauguacaacggauacgccgguggauucgaaguccaggucauccucgcaggcaaugcauucacugcaggaaaaaucaucuucgcugccgucccaccaaacuuccccaccgaaggccucucacccucccaagucaccauguucccccacaucauagucgacguccgacaacucgaaccagucuuaauaccacuaccggacguccgaaauaacuucuaucacuacaaccaauccaacgacccaaccauuaaacucaucgccauguuauacacaccccuccgcgccaacaaugcaggcgaagacguuuucacagucuccugccgcguacuuacccgcccaucccccgacuucgacuucauuuuccucgucccucccacagucgaaucccgaaccaaacccuucacuguacccauacugaccguagaagaaaugacaaacucccgcuuccccaucccccuagaaaaacuauucaccggacccuccggcgccuucgucguacaaccccaaaacggacgaugcaccacagacggaguccuccuuggcacuacccagcuaucccccgucaacaucugcaccuuccgaggagacgucacccacaucgcagguacccacaacuacaccaugaaccuagcaucgcaaaacuggaacaacuacgaccccaccgaagaaauccccgccccacuaggaacacccgacuucgucggccguauacaaggaaugcuaacucaaaccacgcgaggagacggcucuacccgaggacacaaagccacagucuccaccggcgacguacacuucaccccuaaacuaggcucaauccaauucaacaccgacaccaauaacgauuucgaaacaggacaaaacaccaaguucacuccagucggagucguccaagacggcaacggcacacaccaaaacgaaccccaacaauggguccuccccucauacucaggccgcacaggccauaacguacaccucgcacccgccgucgccccgacuuucccuggagaacaacuccucuucuuccgaagcaccaugccaggcugcuccggcuaccccaacaugaaccucgacugccuucucccccaagaauggguacaacacuucuaucaagaagcagcccccgcccaaucagaugucgcucuacuccgcuuugucaaccccgacacaggucgcguucucuucgagugcaaacuccauaaauccggcuacgucaccguagcccacacaggacaacacgaccucgucauacccccuaacggcuacuuccgcuucgacucaugggucaaucaauuuuacacccucgcccccaugggcaacggcacgggaagaagaagauaa

SEQ ID NO: 38476 - RNA, 1617 nt, Artificial Sequence
  derived and/or modified sequence opt11 from VP1__Norovirus_and/or_Norovirus-like__KX158280
augaaaauggccagcuccgacgccaaccccuccgacggcucugcugccaaccucguacccgaagucaacaacgaagucauggcacucgaacccguagucggcgcugccauagccgcccccgucgccggccaacaaaacgucaucgaccccuggauccgaaacaacuucguccaagccccgggcggcgaauuuacaguauccccacguaaugccccuggcgaaauacucugguccgccccacuugguccagaccuaaauccauaccucucacaccucgcccgcauguacaacggcuaugccggcgguuucgaaguacaagucauccucgcaggaaacgccuucacagcaggcaaagucaucuucgccgccgucccacccaauuuccccacagaaggccucucgcccucacaagucacaauguucccccacaucguugucgacguccgccaacuagaacccguccuuaucccccuccccgacgucagaaacaacuucuaccacuacaaccaauccaacgaccccacaaucaaacuaauugcgaugcucuacacuccccuccgagcuaacaacgccggagacgacguauucaccguaucuugccggguccucacucgccccucucccgacuucgacuucaucuuccucgucccacccacuguagaaucccgcacuaaacccuucuccguacccguccucacaguagaagaaaugaccaacucccgcuuccccaucccccucgaaaaacuauucaccgggcccucuucugcauucgucguccaaccccaaaauggucgcugcaccacugauggaguccuacucggcaccacccaacucucccccguaaacaucugcaccuuccgcggcgacgucacccacaucacaggcucccguaacuacacuaugaaccuagccucccaaaacuggaacaacuacgaucccaccgaagaaaucccagcaccccucggcacccccgacuucguuggcaaaauccaagggguccucacccaaacaacgcgcacagacggcuccacccgcggccacaaagccaccguuuacaccggaucagccgacuucgcccccaaacugggucgcguccaauucgaaaccgacaccgaccacgacuucgaagccaaccaaaacacuaaauucacccccguagguguuauccaagauggcucaaccacccaccgcaacgaaccccaacaauggguauuaccuucauacucaggccgcaacacccccaacguacaccucgcccccgccguugcccccaccuuccccggcgaacaacuacuauucuuccgaucaacaaugccaggcugcucaggcuaccccaacauggaccucgacugccugcucccccaagaauggguccaauacuucuaccaagaagccgcucccgcccaauccgacguagccuuacuccgcuucguaaacccagacaccggacgcguccuauucgaaugcaaacuucacaaaucgggauacgucaccgucgcccacacaggccaacacgaccucgucaucccucccaacggcuacuuccgauucgacucaugggucaaccaauucuacacccuagcccccaugggcaacggcacaggacgccgccgcuaa

SEQ ID NO: 38477 - RNA, 1617 nt, Artificial Sequence
  derived and/or modified sequence opt11 from VP1__Norovirus_and/or_Norovirus-like__KX371606
augaaaauggcauccucagacgccaaccccagcgacggcucagcagccaaccucguucccgaagucaacaacgaagucauggcucuagaacccguagucggcgccgccauagccgcucccgucgccggacaacaaaacgucaucgaccccuggauacgcaacaacuucguacaagcccccggcggugaauuuacagucucaccaagaaaugcaccgggagaaauccucugguccgcaccccucggcccagaucucaacccauaccucucacaccuagcccguauguacaacggcuacgccggcggcuucgaaguacaaguuauccuugccggcaacgccuucaccgccggcaaagucaucuucgcagccguuccucccaacuuccccacggaaggccucucacccucacaaguaacaauguucccccacauagucguugacguacgccaacucgaacccguucucauaccccuccccgacguccgcaauaauuucuaccacuacaaccaaaguaacgaccccaccauaaaacucaucgccaugcucuacacaccccuccgugccaacaacgccggcgacgacgucuucaccguuucuugccgcguccucacccgccccucucccgacuucgacuucaucuuccucgucccacccaccgucgaaucccgcacaaaacccuucucaguccccgugcucacagucgaagaaaugacuaacuccagauuucccaucccacuugaaaaacucuucaccggcccauccucagcauucgucguccagccacaaaacggccgcuguaccaccgacggcguacuccucggaaccacccaacuguccccagucaacaucugcacuuuccgaggcgacguaacccacaucacaggcucucguaacuacaccaugaaccucgcaucccaaaacuggaacaacuaugacccaacugaagaaaucccagcuccccucggcacccccgacuucgucggaaaaauccaaggcguacucacccaaaccacccgcaccgacggcucaacucgcggccacaaagccaccgucuacacuggauccgccgauuucgccccuaagcucggucgcguacaauucgaaaccgacaccgaccacgacuucgaagccaaccaaaacaccaaauucacaccagucggcgucauucaagacggguccacuacccaccgcaacgaaccucaacaauggguccucccauccuacuccggccgaaauacacacaacguacaccuggcacccgccgucgccccaaccuuccccggcgaacaacuccuuuucuuccguuccacaaugcccggcuguuccggauacccuaacauggaccucgacugccuccuuccccaagaauggguacaauauuuuuaccaagaggccgccccagcccaaucagacguugcccuccuaagauuugucaacccagacaccggccgcguucuuuucgaaugcaaacuacacaaaucaggauacguuaccguagcacacaccggacaacacgaccuagucauuccacccaacgguuacuuccgauucgacuccugggucaaccaauucuacacacuugcccccaugggcaacggcaccggccgccgccgcuag

SEQ ID NO: 38478 - RNA, 1617 nt, Artificial Sequence
  derived and/or modified sequence opt11 from VP1__Norovirus_and/or_Norovirus-like__KX371605
augaaaauggccucauccgacgcaaauccaucggacggcuccgccgcaaaccuaguacccgaagucaacaacgaagucauggcccuagaaccagucguaggcgccgccaucgccgcccccguugccggacagcagaacgucauugaccccuggauucgcaacaacuuuguccaagccccaggcggcgaauuuaccgucagcccccgaaaugcacccggcgaaauacuaugguccgcaccccuaggacccgaccuaaaccccuaccuaucccaccuggcccgcauguacaacgguuacgccggaggcuucgaaguucaagucauccucgccggaaacgccuucaccgcuggcaaagucaucuucgccgccgucccaccaaacuucccuacagaaggccuauccccaucucaagucacaauguucccccacaucgugguagacguccgucagcuagaacccguacuaaucccccuccccgauguccgcaacaacuucuaccacuacaaccaaucaaaugacccaaccaucaaacuuaucgccaugcuauauacaccucuccgcgcaaacaacgccggcgacgacgucuucacuguauccugccggguucugacccgccccucuccagacuucgacuucaucuuccucgucccacccaccgucgaaucccgaacaaagcccuucuccguccccguccucacagucgaagaaaugacaaacucacgcuuccccaucccccucgaaaaacuauucacaggaccgucaucagccuucgucguccagccacaaaacggccguuguacgacugacggcguacuccucggcaccacccaacucucccccgucaacaucugcacuuucagaggugacgucacccacaucacagguucccguaacuacaccaugaaccuugccucccaaaacugguccaacuaugaccccaccgaagaaaucccagcaccacucggcaccccagauuucgugggaaaaauucaagguguccucacacaaacaacacgcacugacggcucaacccgcggccacaaagcaacuguauacaccggcuccgccgacuucgcccccaaacuuggccgcguacaauucgaaaccgacaccgaucacgacuucgaagcuaaccaaucaaccaaauucacccccguuggcgucauccaagacggauccacaacccaccgcaacgaaccacaacaauggguccucccuagcuacucuggacgcaacacccccaacguccaccuagcucccgccguagcacccaccuuuccaggugaacaacuacuuuucuuccgauccacuaugccaggaugcuccggauacccaaacauggaccuugacugccuccucccacaagaauggguacaauacuucuaccaagaagcagcacccgcacaauccgacguagcacuacuccgcuucgucaaccccgacaccggccgcguacucuucgaaugcaaacuccacaaaucuggcuacgucacagucgcacacaccggacaacacgaccucgucauacccccaaacggcuacuuccgauucgacuccuggguaaaccaauucuacacccucgccccaaugggaaacggcaccggccgacgaagauaa

SEQ ID NO: 38479 - RNA, 1617 nt, Artificial Sequence
  derived and/or modified sequence opt11 from VP1__Norovirus_and/or_Norovirus-like__KX354128
augaaaauggccuccaacgacgccaaccccuccgacggcuccgccgcaaaccucguccccgaagucaauaaugaagucauggcccucgaacccguagucggugccgcaaucgccgcccccgucgcaggacaacagaacgucauagaccccuggauccgcaacaacuucguccaagcccccggcggcgaauuuaccguauccccacgcaacgcccccggcgaaauucucuggucagccccucucggccccgaccuaaaccccuaccuuucccaucucgcacgcauguacaacggcuaugccggcggauucgaaguacaagucauacucgccggcaaugcauucaccgcaggcaaaauuaucuucgcugcagucccucccaacuuccccaccgaaggccucucccccagccaaguaacaauguucccccauaucauagucgacguccgacaacucgaaccaguacucaucccucuucccgacguacgcaacaacuucuaccacuacaaccaaucaaaugacuccaccaucaaacucaucgcaaugcucuauacuccccuacgcgccaauaacgccggcgaagacgucuucaccguaucuugccgaguacucacccgccccagcccugacuucgacuucaucuuccuagucccucccaccgucgaaagccgcaccaaacccuucacugucccaauacucaccgucgaagaaaugaccaacucacgauuccccaucccccucgaaaaacuuuucacuggccccuccagcgcuuuugucguccaaccccaaaacggccguuguacaaccgacggaguacuucuuggaacuacccaacucucccccguaaacaucugcaccuucagaggcgacguaacccacauagccggcucccgaaacuauacaaugaaccuugcuagccucaacuggaacaacuacgacccaaccgaagaaaucccagccccacucggcacccccgacuucgucgguaaaauccaaggccuccucacccaaacaaccaaaggagauggcucaacccgcggccacaaagccacugucuacaccggauccgcacccuucacaccaaagcucggcuccguccaauucgaaaccgacaccgaaaacgacuucgaaacccaccaaaacaccaaauucacccccgucggcguaauccaagacggcggaaccacccaccgaaacgaaccccaacaauggguacuacccucauacuccggccgcaacguccccaacguccaucuagcgccagccguagccccaaccuucccaggcgaacaacucuuauucuuccgcuccaccaugcccgguugcuccggauacccaaacauggaccuagacugccugcucccccaagaauggguccaacacuucuaccaagaagccgccccagcacaaucagacguagcacuccucagauuugucaaucccgacaccggacgcguccucuucgaaugcaagcuccacaaaucuggcuacguaaccgucgcacacaccggccaacacgaccuaguaauacccccaaauggauacuuccgcuucgacucaugggucaaccaauucuacaccuuagcacccaugggaaacggaaccggccgccgaagauga

SEQ ID NO: 38480 - RNA, 1617 nt, Artificial Sequence
  derived and/or modified sequence opt11 from VP1__Norovirus_and/or_Norovirus-like__KX354099
augaaaauggccucuuccgacgccucccccucggacggcucagccgccagccuaguccccgaaguaaacaacgaaguaauggcacuggaaccaguaguaggcgcugccaucgccgcccccgucgccggccaacaaaaugucaucgaccccuggauccggaacaacuuuguacaagcacccggcggcgaauuuaccgucucaccacgcaaugcacccggcgaaauccucuggucagcaccccucggccccgaucucaacccguaccucucacaccucgcccgaauguacaacggcuaugccggcggcuucgaaguucaagucauccuagccggcaacgccuucaccgcaggcaaagucaucuuugccgccguaccucccaacuuccccaccgaaggacuaucacccucacaggucaccauguucccccacaucgucgucgacguccgacaacuugaaccuguccucaucccacuacccgacgugcgcaauaacuucuaccacuacaaccaacuaaacgaccccacuaucaaacucaucgcaaugcucuacacaccccuacgagcuaacaaugcgggcgacgacguauucaccguaucaugccgaguccucacaagacccucaccagacuucgacuucaucuuccuuguaccaccaacagucgaauccagaacaaaaccauucucaguaccuguucucaccgucgaagaaaugacuaacucccgcuucccuauaccccucgaaaaacucuucaccggcccaucaucagcauucgucguccaaccucaaaacggccgcugcaccaccgacggcguccuccucggaacaacccaacucucaccagucaacaucugcacauuccgaggcgacguaacccacauaaccggaucucacaacuacacaaugaaccucgccucucaaaacuggaacaacuacgacccaaccgaagaaauccccgcaccccucgguacucccgacuuugucggcaaaauccaaggcguccuuacccaaacuacccgcgccgacgguuccacccgcggccacaaagccaccguuuacaccggcucagccgacuucgcccccaaacucggccgcguccaauucgaaacagacacggaccacgauuucgaaaccaaccaaaacaccaaauucacccccguaggcgucauacaagacggaggcacaacacaccgcaacgaaccacaacaauggguccuacccucuuacuccggccgaaacacccacaauguccaccucgcacccgcaguagcccccaccuucccuggcgaacaacuccuauucuuccgguccacuaugccaggcugcucuggauacccuaacauggacuuagacugccuccuaccccaagaauggguccaauacuuuuaccaagaagccgccccggcacaaagcgacguggcccuccuccgcuuuguaaaccccgacacaggcagaguccucuucgaaugcaaacuacacaaaucuggauacguaaccguagcccacaccggucaacacgaccuuguaauaccacccaauggcuacuuccgcuucgacaguuggguaaaccaguucuauacacucgcccccauggguaacggagcaggccgccgcagguaa

SEQ ID NO: 38481 - RNA, 1617 nt, Artificial Sequence
  derived and/or modified sequence opt11 from VP1__Norovirus_and/or_Norovirus-like__KX354087
augaaaauggccuccaacgacgccaacccauccgacggauccgccgcaaaccucguaccagaaguaaacaacgaaguaauggcacuugaacccguagucggcgccgccaucgcugccccaguagcuggccaacaaaacgucaucgacccauggauccguaacaacuuuguccaggcccccggcggcgaguucaccguaagcccacgaaacgcacccggagaaauccuaugguccgcaccccucggacccgaccucaacccauaccucucucaccucgcccgcauguacaacggcuacgccggcggcuucgaaguccaagucauuuuagcaggaaacgcauucaccgccggcaaaaucaucuucgccgccgucccaccaaacuuccccaccgaaggccucucccccucacaaguaacaauguucccccacaucaucguagacguccgccaacucgaaccaguccucauuccacuccccgauguacgcaauaacuucuaccacuacaaucaauccaacgauucuaccaucaaacuaaucgccaugcucuacaccccacuacgagccaacaacgcaggggacgacgucuucaccgucagcugccgaguccuaacucgacccucccccgacuucgacuucaucuucuuagucccacccaccgucgaaucacgcaccaaacucuucaccguacccauccuaacaguugaagaaaugacaaacucacgcuuccccaucccccucgaaaaacuauucaccgguccauccuccgccuucguaguccaaccacaaaacggccgcugcacuaccgacggaguacuucuaggaacaacccaacuauccccugucaacaucugcaccuucagaggcgacgucacucacauagcaggaucgcgaaacuacacaaugaaccuugccucacugaacuggaacaacuacgaccccaccgaagaaauccccgcuccccugggcacccccgacuucguuggaaaaauacaaggcguccucacacagacaacaaaaggagacggcuccacacgcggccacaaagccaccgucuacaccggauccgccgacuucacccccaaacucggaagcguacaauucgccacagauacugaaaaugacuucgaaauccaccaaaacacuagauucacacccgucggcgugauacaagacggcggcaccacacaccggaacgagccccaacaauggguccucccauccuacuccggaagaaacguccacaacguccaccucgcucccgccgucgcccccaacuuccccggcgaacaacuacuauucuuccgcuccacaaugcccggcugcuccggauaucccaacauggacuuagacugccuccucccccaagaauggguacaacacuucuaccaagaagccgcacccgcccaaucagacguugcccuacuccgcuucguuaacccagacaccggacgcguccuauuugaaugcaaacuccauaaaagcggauacguuaccguagcgcacaccggacaauacgaccuagucauacccccaaacggcuacuuccgcuucgacuccuggguaaaucaauucuacacccucgccccaaugggcaacggcacaggccgccgcagauag

SEQ ID NO: 38482 - RNA, 1617 nt, Artificial Sequence
  derived and/or modified sequence opt11 from VP1__Norovirus_and/or_Norovirus-like__KX354009
augaaaauggcuuccagcgacgcaaacccaagcgacggaucagccgccaaccuaguacccgaaguaaacaaugaagucauggcauuagagcccguaguaggcgccgccauagcggcccccgucgcuggacagcaaaacgucaucgaccccuggauacgcaacaacuuuguccaagcacccggaggagaguucaccgucagcccccgaaacgccccaggagaaauccucugguccgcaccccuaggccccgaccucaaccccuacuuaucccaccuagcccgcauguauaacggcuacgccggcggauucgaaguccaagucauccuggcaggcaacgcuuucaccgccggcaagaucaucuucgcugccgucccacccaacuucccuacugaaggacuauccccaucacaagucaccauguucccccacaucguagucgacguccgccaacuugaacccguacucaucccccuccccgacguacgcaacaacuucuaccacuacaaccaauccaacgaccccacaauaaaacuaauagccaugcuauacacaccccuccgagccaacaacgccggcgacgacgucuucaccgucagcugccgaguccucacuagacccucccccgacuucgacuucaucuuccucgucccacccaccguagaaucacgaaccaaacccuuuucuguccccguacuaacagucgaagaaaugaccaacucccgcuuucccauaccccuugaaaaacuuuucaccgguccaagcagcgcauucgucgugcaaccccaaaacggacgcuguacaaccgacggcguccuccuaggcaccacucaacucucucccgucaacaucugcaccuuccgaggcgacgucacacacaucaccggcucacgaaacuacaccaugaaccuagccucccaaaacuggaacaacuaugacccaacugaagaaauccccgcaccccucggaaccccagacuucgucggaaaaauacaaggcguccuaacccaaacaacccgcacagacgguucaacacgaggccacaaagccacaguuuauaccggcucagccgacuucgcacccaaacucggccgaguucaauucgaaaccgacacugaccacgacuucgaagccaaccaaaacacaaaauuuacacccguaggcgucauccaagacggcucaacuacacaccggaacgaaccccaacaauggguacuuccauccuacuccggccgcaacacucacaacguacacuuagcccccgccguagccccaacauucccaggcgaacagcuccuuuucuuccgcucuaccaugcccggcugcucaggauaccccaacauggaccucgacugccuccucccgcaagaauggguacaguacuuuuaccaagaagccgcacccgcccaaucagacguagcacuacuacgcuucgucaaccccgacaccggacgcguccuuuucgaaugcaaacuccacaaauccggcuacguaaccguugcacacacaggacaacacgaucuaguaauacccccaaauggauacuuccgauucgacuccuggguaaaccaauucuacacacuagcccccaugggaaacgguacaggacgacgccgauaa

SEQ ID NO: 38483 - RNA, 1617 nt, Artificial Sequence
  derived and/or modified sequence opt11 from VP1__Norovirus_and/or_Norovirus-like__KR131784
augaaaauggccucaucugaugccaaccccuccgacggcuccgcagccaaccucguacccgaagucaacaacgaagucauggcccuagaacccgucgucggagccgcuauagccgcaccugucgccggccaacaaaacguaauugaccccuggauccgcaacaacuucguccaagcacccggcggcgaguucaccguuucaccacgcaacgccccaggugaaauccucuggucagcaccccucggccccgaccucaacccauaccuaucucaccucgcacgaauguacaacggcuacgccggcgguuucgaaguccaaguuauccucgccggaaacgcauuuaccgccggcaaaguuaucuucgcagcaguaccucccaacuuccccaccgaaggcuuauccccaucacaagucacaauguucccccauaucgucgucgacguccgccagcucgaacccguccuaauaccccuucccgacguacgcaacaacuucuaccacuacaaccaaucaaacgaccccaccaucaaacuaaucgcaaugcuauacacuccccuccgcgccaacaacgccggcgacgacgucuucaccguaagcugccgcguacucacacgaccaagcccagacuucgacuucaucuuccucgucccacccaccgucgaaucucgcacuaaacccuucuccguccccguccucacagucgaggagaugaccaacucacguuuccccauaccccucgaaaaacucuucaccggucccuccucagccuucgucguccaaccccaaaacggaagaugcaccaccgacggcguccuccuuggcaccacccaacuuucccccgucaacauaugcacauuccgcggcgacgucacccacaucacuggcucacgaaacuacacaaugaauauggcaucucaaaacuggaacaauuacgaccccacagaagaaauccccgcaccccucggcacacccgacuucguagguaaaauucaaggcguccucacccaaaccacccgaaccgacggcuccacccgcggccauaaagcaaccgucuacaccggcuccgccgacuucgcccccaaacucggccgcguccaauucgaaaccgacacagaccacgacuucgaagcaaaccagaacacaaaauucaccccagucggagucauccaagacggcucgaccacucaccguaacgagccacaacaauggguccucccauccuacucaggaagaaacacccacaacguccaccucgcccccgccgucgcacccacuuuccccggagaacaauuacucuucuuucgcuccaccaugcccggcugcaguggcuaccccaacauggaccuagacugccuucucccccaagaauggguacaauacuuuuaccaagaagcggcacccgcucaauccgaugucgcacuccuacgcuuugucaaccccgacacuggccgaguccuuuucgaaugcaaacuucacaagaguggcuaugucaccgucgcccauacaggacaacaugaccuagugaucccucccaacggcuacuuccgauuugacuccugggucaaccaauucuacacccucgcacccaugggcaacggaaccggcagacgacgcuaa

SEQ ID NO: 38484 - RNA, 1617 nt, Artificial Sequence
  derived and/or modified sequence opt11 from VP1__Norovirus_and/or_Norovirus-like__AB972527
augaaaauggcauccuccgacgccaaucccuccgacggaucagcagccaaccuaguccccgaaguaaacaaugaaguaauggcucucgaacccgucgucggugccgcaaucgcagcccccgucgcgggccaacaaaacgucauagacccauggauccgcaacaacuuuguacaagcacccggcggagaguucacaguuucccccagaaacgcccccggcgaaauacucugguccgcuccccucggcccagaccucaaccccuauuuaucacaccucgcccgcauguacaacggcuacgccggcggcuucgaaguacaagucauccucgcuggaaacgccuucaccgcgggcaaagucauauucgccgccguaccacccaacuucccaaccgaaggacucucacccucccaaguaacaauguuuccccacaucguaguagacguccgucaacucgaacccguacuaaucccccuaccagacguaaggaacaacuucuaccacuacaaccaauccaacgaccccacaaucaaacuaaucgccaugcucuacacaccccuccgcgccaacaacgccggcgacgacgucuucaccguuuccugccgcguccucacccgcccauccccagacuucgauuucaucuuccucguaccacccaccgucgaaucccgaacaaaacccuucagcgucccaguccuaaccgucgaagaaaugaccaacucccgauuccccaucccccucgaaaaacuuuucacaggcccauccucagccuucgucguucaaccccaaaacggucgcugcacaacagacggcguccuacucggcacaacccaacuuucccccgucaacaucugcacguucagaggugacgucacgcacauaacuggcucccggaacuacaccaugaaccucgcaucacaaaacuggucaaacuacgaccccaccgaagaaauacccgcuccccuaggcacacccgauuucgucggcaaaauacaaggaguccuaacccaaaccacucgcacagacggauccacacgcggccacaaagcgaccgucuacaccggcucagcugacuucgcucccaaacuuggccgcguccaauucgaaacagacacagaccgugacuucgaagccaaccaaaacacaaaauucacccccgucggcgucauccaagacggaagcaccacccaucgcaacgaaccucaacaauggguguuacccagcuacuccggacgcuacacccccaacguccaccuagcuccagcagucgcccccacauucccaggagaacagcuccucuucuuccguucaaccaugcccggcugcuccggcuaccccaacauggaccucgacugccuauuaccgcaagaauggguucaauacuucuaccaagaagccgccccugcccaaagugaugucgcccuccuacgguucguaaaccccgacaccggccgcguacuauucgaaugcaaacuacacaaauccggcuacgucaccgucgcucacacaggccaacacgaccuagugaucccacccaacggcuauuucagauucgacagcugggucaaccaauucuacacacucgcccccaugggcaacggcaccggccgccgacgauaa

SEQ ID NO: 38485 - RNA, 1617 nt, Artificial Sequence
  derived and/or modified sequence opt11 from VP1__Norovirus_and/or_Norovirus-like__AB972525
augaaaauggccuccaacgacgccaaccccagcgacggcuccgcagcaaaccucguccccgaagucaacaaugaaguaauggcacucgaaccagugguaggagccgccaucgcagcccccguagccggacaacaaaaugucaucgauccauggauucguaacaauuucguccaagccccaggcggcgaguucaccgucucccccagaaacgcccccggcgaaauccucugguccgccccucucggcccagaccucaacccauaccucucccaccuugcccgcauguacaacggcuacgccggaggcuucgaaguccaggucauacucgcgggcaacgccuucaccgcaggcaagaucaucuucgcugcaguacccccaaauuuccccacggaaggccuaucucccucacaagucaccauguucccccacauaauagucgacguacgccagcucgaacccguacucaucccucucccagacguaagaaacaacuucuaccacuacaaccaaaguaaugacuccaccauaaaacucaucgcaaugcucuacacuccccuacgcgcaaacaacgccggcgaagacgucuucaccguguccugucgcguacucacccggcccucacccgacuucgacuucauauuccuaguucccccaacagucgaaucuagaaccaaacccuucaccguccccauccucaccgucgaagagaugaccaacucccgcuuuccaauaccccuagaaaaacucuucacagggcccuccagcgccuucguaguccaaccccaaaacggucgaugcaccacagacggcguccuucucggcaccacccaacucucccccgucaacaucugcacauucagaggggacgucacacacaucgccggaucacgcaauuacaccaugaaccucgcuagccugaacuggaacaacuacgauccaaccgaagaaauccccgcaccccuaggaacccccgacuucgucggcaaaauccaaggaaugcucacccaaaccacuaaaggcgacgguuccacacgaggacacaaggccacugucuacacaggcagcgcccccuucacccccaaacucggcucaguccaauucgaaaccgacaccgaaaacgauuucgaaacccaccaaaacaccaaauucacacccgucggcguaauccaagacggcggcacaacccaccgcaacgaaccccaacaauggguucuaccaagcuacuccggccgaaacgucccaaacguccacuuagcccccgccgucgccccaaccuuuccaggcgaacaacuacucuucuuccgcuccacagucccagguugcucuggauacccaaacauggaccuagauugccuccuaccgcaagaauggguccaacauuucuaccaggaagccgcccccgcccaaucggacgucgcccuacuccgguucguuaacccugacaccggacgaguccuauucgaaugcaaacuccacaaauccggcuacguuaccguagcccacacaggacaacacgaccuagugauacccccaaauggcuacuuucgauucgacucaugggucaaucaauucuacacucucgcccccaugggaaacggcaccggcagacgccgcuga

SEQ ID NO: 38486 - RNA, 1617 nt, Artificial Sequence
  derived and/or modified sequence opt11 from VP1__Norovirus_and/or_Norovirus-like__KT780388
augaaaauggcuucauccgacgcaaaucccucagauggcuccgccgcuaacuugguaccagaagucaacaacgaagucauggcccuagaacccgucgucggcgcagccauagccgcccccgucgccggucaacaaaacguuauugaccccuggauccgcaacaacuucguucaagcccccggaggcgaguucaccgucucuccaagaaacgcacccggcgaaauccuauggucagcaccccuuggaccagaccugaaccccuaccucucccaccuagcccguauguacaacggcuacgcaggcggcuucgaaguccaagucauccucgccggcaacgcauucaccgcuggcaaaguuaucuucgcggccgucccacccaacuuccccaccgaaggccuuucucccucccaagucaccauguuuccccacauagucguagacguccgccaacuugaacccguacucaucccccucccugauguccgcaacaacuucuaccacuacaaccaauccaacgacccaacuaucaaacucaucgccaugcucuacacaccacuccgagccaacaaugccggagaugacgucuucaccguguccugccgcguucucacccgaccaucccccgacuucgacuucaucuuccucgucccacccaccguagaaucacgcacaaaaccauucucaguucccguacucacugucgaagaaaugaccaauucaagauuccccaucccccuagaaaaacuauucaccggccccucauccgcguucgucguucaaccccaaaauggacgaugcacaaccgacggcguccuacucggcaccacacaacuaucccccguaaacaucuguacauuccggggagacgucacccacacaaccggcucucacaacuacaccaugaaucucgcaagccaaaacuggucaaacuacgaccccaccgaagaaauccccgcaccccuagguacacccgacuuuguaggcaaaauccaaggaguccuuacucaaacaacccgcaccgaugguuccacaagaggucacaaagccaccgucuacaccggcagcgccgacuucgccccaaaacucgggcgcguccaauucgccaccgacaccgaccaugauuucgaggccaaccaaaacaccaaguucacccccguaggugucauccaagacggaggcaccacacaccgaaacgaaccccaacaguggguccucccauccuacucaggccgaaauaccccaaacguccaccucgccccugccgucgcaccaacauucccuggcgaacaacuacuauucuuccgcucaaccaugccuggcugcuccggcuaccccaacauggacuuagacugccuccuaccccaagaauggguccaauacuucuaccaagaagccgccccagcccaaucagacgucgcccuccuccgcuuugucaaucccgacaccggccguguacuauucgaaugcaaacuccauaaaucuggcuacgucacaguagcucacaccggccaacacgaccuagucauaccuccaaacggcuauuuccgcuucgacuccugggucaaccaauucuacacccuagccccaaugggaaacggcaccggccgaagacgauaa

SEQ ID NO: 38487 - RNA, 1617 nt, Artificial Sequence
  derived and/or modified sequence opt11 from VP1__Norovirus_and/or_Norovirus-like__KT780373
augaaaauggccuccuccgacgcaaaccccuccgacggcucagccgccaaucugguaccagaggucaacaacgaagucauggcccucgaacccguaguaggagccgcaaucgcagcccccguagcaggacaacagaacgucauagacccguggauucgcaacaacuucguccaagcccccggcggcgaguucaccgucuccccacgaaacgccccgggagaaauccucugguccgcaccccuaggccccgaccuaaaccccuaccucucccaccucgcccguauguacaacggcuacgccggaggcuucgaaguccaagucauacucgcgggcaacgcauucacagcaggaaaagucaucuucgcugcaguaccacccaacuuccccaccgaaggacuaucacccagccaggucacaauguucccccauaucgucguugacguccgccaacuagaacccgucuuaaucccccuacccgauguacgcaacaauuucuaccauuacaaccaguccaacgaucccaccaucaaacuaaucgccaugcucuauaccccacuccgagccaacaaugccggugacgacgucuucacaguuuccugccgcguccuaacacgaccuuccccugacuucgacuucaucuuccuagugccacccacagucgaaucccgaaccaagcccuucuccguccccguccuaacugucgaagaaaugaccaacucaagauuccccaucccccuagaaaaacucuucacgggccccagcuccgccuucguaguacaaccccaaaacggcagaugcaccaccgacggcguacuccucggaaccacccaacucuccccagucaacaucugcaccuuccgaggcgacgucacucacaucaccggaagccacaacuacaccaugaaccucgcaucccaaaacuggucaaacuacgaccccaccgaagaaauacccgcuccccucggaacaccagacuucguuggcaaaauacaaggaguacucacccaaaccacucgcacagacggaucaacucgcggccacaaagccaccguauacaccggcuccgccgacuucgccccaaaacucggccgcguucaauucgccacagacaccgaccacgacuucgucgccaaccaaaacaccaaauucacaccugucggcguaauccaggacggcggcacaacccaccgcaacgaaccccaacaauggguccucccuuccuacuccggccgcaacacccccaaugugcacuuagcacccgccgucgcucccaccuuccccggugaacagcuacuauucuucagaucaacuaugcccggcugcuccggauaccccaacauggaccucgacugccuccuaccccaagaauggguccaauacuucuaccaagaagccgcccccgcacaaucagauguugcccugcuccgcuucguaaaccccgacacggggcgaguccucuucgaaugcaaacuccacaaauccggcuacgucaccgucgcacacaccggccaacacgaccuaguaaucccacccaacgguuacuuccguuucgacucuugggucaaccaauucuacacccucgcccccaugggaaacggcaccggacgucgacgcuaa

SEQ ID NO: 38488 - RNA, 1617 nt, Artificial Sequence
  derived and/or modified sequence opt11 from VP1__Norovirus_and/or_Norovirus-like__AB933723
augaagauggcauccaacgacgcuaacccuuccgacggcucggccgcaaaccuaguaccagaagucaacaacgaaguaauggcucucgaacccgucguaggugcagccaucgcagcccccguagccggccaacagaacgucaucgaccccuggauccgcaacaacuucguccaagccccaggaggcgaguucacagucucaccccguaacgcacccggagaaauccuuuggucugcgccccucggucccgaccucaaccccuaccucucacaccuagcacgcauguacaacuccuaugccggcgguuucgaaguccaaguaauccuagcaggcaacgccuucacagccggcaagaucauauucgcagcgguucccccuaacuuucccaccgaaggccucucccccucacaaguuaccauguucccccacaucauugucgacguacggcaacucgaaccagucuuaauuccccuucccgacguccgcaacaacuucuaccacuacaaucaauccaaugacucaaccaucaagcucauugcaaugcucuacaccccucuccgcgccaacaacgccggugaagacgucuucaccguaagcugccguguucuaacccgcccaucgccagacuucgacuucauuuuccuagucccacccacaguagaaucacgcaccaaacccuucacuguacccauccucacugucgaagaaaugaccaacuccagauuccccauaccccucgaaaaacucuucaccggccccagcuccgcuuucguuguacaaccccaaaacggcagauguacaacugacggaguccuacucggaaccacccagcucuccccagucaacaucugcaccuucagaggcgacguuacccacauagcauccuccagaaacuacaccaugaaccuugccucacucaacuggaacaacuacgaccccaccgaagaaaucccagcaccccucggaacaccagacuucgucggcaaaauacaaggcaugcuaacccaaacaaccaaaggcgacggauccacacgcggccacaaagcaacaguuuacacagguucagcacccuucacgcccaaacucggcucgguccaauucuccacagacaccgaaaacgacuucgaaacucaccaaaacaccaaauucacccccguaggggucauucaagacggaucaaccacacaccgaaacgaaccccaacaauggguacuccccucauacuccggacgcaacgucccaaacguccaccucgccccagcagucgcccccgccuuccccggcgaacaacuccuauucuuccgauccaccaugcccggcugcucaggauaccccaacauggaucuagacugccuacucccacaagaauggguacagcacuucuaccaagaagccgcacccgcacaauccgacgucgcccugcuacgcuucguaaaccccgacaccggacgcguccucuucgaaugcaaacuacacaaauccgguuacgucacagucgcacacaccggccaacacgaccucgucauacccccaaacggauacuucagauucgauuccuggguaaaccaauucuacacccucgcccccaugggcaauggcacaggccgucgccgcuaa

SEQ ID NO: 38489 - RNA, 1617 nt, Artificial Sequence
  derived and/or modified sequence opt11 from VP1__Norovirus_and/or_Norovirus-like__AB933708
augaaaauggcauccucagacgcaaaccccuccgacggauccgccgcaaaccucguccccgaagucaacaacgaagucauggcacucgaaccagucguaggagccgcaaucgccgcaccagucgcgggccaacaaaacgucauagaccccuggauccgcaacaacuucguacaagcccccggcggagaguucaccguaucaccccgcaacgcuccuggagaaauacucuggucagccccacucggcccagacuuaaaccccuaccucucucaccuagcacgaauguacaacggcuacgccggcggcuucgaaguacaagucauacucgcaggcaacgccuucacagccggcaaaaucaucuucgccgccguucccccaaacuucccaaccgaaggccucucccccucccaagucaccauguucccccacaucauugucgacguacgacaacuagagcccguccucaucccccuucccgacguucgcaacaacuucuaucacuacaaccaaucaaacgauagcaccaucaaacucaucgcaaugcuauacacaccccuacgcgccaacaacgccggagaagacgucuucaccgucuccugccgaguccucacccgccccucacccgacuuugacuuuaucuuccucguacccccaaccguagaauccagaaccaaaccauucaccguccccauccucaccguagaagaaaugaccaacagccgcuucccaaucccccucgaaaaacuuuuuacuggccccuccuccgcauucgucguacaaccccaaaacggccguugcacaacugacggaguccuacuaggcaccacucaacucucacccguaaacaucugcacuuuccgcggagacguuacccacaucgccggcucacgcaacuacaccaugaaucuagccagccucaacuggaacaacuaugaccccacagaagaaauaccagcaccccuaggcacaccugacuucgucggaaaaauacaaggaaugcuaacccaaaccacaaaaggagacggcucaacccgaggccauaaagccacagucuacaccggcagcgccccauucaccccaaaacuaggcuccguccaauucucaacugauaccgaaaacgacuucgaaacccaucagaauacaaaauuuacacccgucggcguuauacaagauggcucgaccacccacagaaacgaaccacaacaguggguccuccccucauacagcggacgaaacguacccaacguccaccuagcccccgccgucgccccaaccuucccuggcgaacagcuccuauucuuccgcuccaccaugccuggaugcuccggcuauccaaacauggaccucgacugccuccuaccccaagaauggguccaacacuucuaucaagaagccgcacccgcgcaguccgacgucgcccuccuccgcuucguaaaccccgacaccggccguguccucuucgaaugcaaacuccacaaguccgguuacgucaccguagcccacaccggacaacacgaccucgucaucccacccaacggcuacuuccgcuucgacuccuggguaaaccaguucuacacacucgcucccaugggcaacggcaccggaaggcgcagauaa

SEQ ID NO: 38490 - RNA, 1617 nt, Artificial Sequence
  derived and/or modified sequence opt11 from VP1__Norovirus_and/or_Norovirus-like__LC066046
augaaaauggccuccuccgacgcaaacccgucagacggcuccgccgccaaccucguccccgaagucaacaacgagguaauggcccuagaacccgucgucggugcagcuaucgcggcccccguugcaggacaacaaaacgucauugacccguggauucgcaacaacuucguccaagccccaggaggcgaguucaccgucucaccccgcaacgcccccggugaaauucuaugguccgcaccccucggacccgacuuaaacccuuaucucucccacuuagcccguauguacaacggcuacgcggguggauucgaaguccaggucauccucgcaggcaaugcauucacugccggcaaagucaucuucgcagccguaccucccaacuucccaaccgaaggccuuucccccucacaagucaccauguucccacacaucgucgucgacguccgacaacucgaacccguacucauccccuuacccgacgucagaaacaacuucuaccacuacaaccaaucaaacgacccaacuaucaagcuaaucgccaugcuuuacaccccucuacgcgcaaacaacgccggagacgacgucuucaccgucagcugccgaguccuaacccgucccuccccagacuucgacuucauauuucuaguacccccaacagucgaaagccgcaccaaaccauucuccguccccguccuuacagucgaagaaaugacaaauucccgcuuccccaucccccucgaaaaacucuuuaccggaccaucauccgccuuuguagugcaaccccaaaauggccguugcaccaccgacggcguccuccucgguaccacacaacuuucaccaguaaacauaugcaccuuucgcggcgacgucacacacaccacuggaucccacaacuacacaaugaaccuagccagccaaaacugguccaacuaugaccccacagaagaaauaccagcaccccucggaacacccgacuuugucgguaaaauccaaggcguccuaacccaaaccacacgaaccgauggcagcacacgaggacacaaagccacagucuacaccggcuccgccgacuucgcccccaaacugggccgcguccaauucgaaaccgacaccaaccaugacuucgaagccaaccaaaacacaaaauucacaccugucggcgucauacaagacggcggcacaacccacagaaaugaaccccaacaauggguccuacccuccuauuccggccgaaacacucccaacguccaccucgccccagccguagccccaaccuucccuggagaacaacuccuauucuuccgcuccaccaugcccggcuguuccggauaccccaacauggaccuagacugccuccuuccccaagaguggguccaauauuucuaccaagaggccgcccccgcccaauccgaugucgcucuccuccgcuucgucaacccagacaccggcagaguccuauucgaaugcaaacuucacaaaucgggcuacguaaccgucgcacacaccggccaacacgaccucgucaucccacccaacggcuacuuccgcuuugacuccugggucaaccaauucuacacacucgcccccaugggaaacggaaccggccgccgccgcuag

SEQ ID NO: 38491 - RNA, 1617 nt, Artificial Sequence
  derived and/or modified sequence opt11 from VP1__Norovirus_and/or_Norovirus-like__KJ678140
augaaaauggccucaagcgacgccaaccccagcgacggcuccgcagccagccuaguuccugaagucaacaacgaaguuauggcccuagaacccgucgucggagccgccaucgccgcacccgucgcaggccaacaaaacgucaucgaccccuggauacgaaacaacuucguccaagccccaggcggagaguucaccgucucaccccgaaacgcccccggcgaaaucuuaugguccgccccacucggccccgaucuuaaccccuaccucucccaccucgcccgcauguacaacggguaugcgggugguuucgaaguccaaguuauccucgccggaaacgccuucaccgccggaaaaguaaucuuugccgccgucccaccaaauuuccccacagaaggccucucacccucccaaguaacaauguucccccacguugucaucgauguacgucaacucgaacccguccuuauaccucuacccgauguccgaaacaacuuuuaccacuacaaccaaucaaacgacccaaccauaaaacucaucgccaugcuauacacaccccuccgcgcuaacaacgcuggcgacgacgucuuuaccgucuccugccgaguacucacccgccccucccccgacuucgacuucaucuuccuaguuccacccaccgucgaaucccgcaccaaacccuucucaguacccguccucacugucgaagaaaugacgaacucccgcuuccccauaccccuagaaaaacucuucacaggacccucuucagcuuucgucguccaaccacaaaacggccgcugcacaaccgacggcguacuccuaggcaccacucaacuguccccaguaaacaucugcaccuucagaggcgacgucacccacauaaccggaucccgaaacuacaccaugaaccucgccucccaaaacugguccaacuacgaccccacugaagagauucccgcaccucucggcacacccgacuucgucggcaaaauccaaggaguauuaacccaaaccacccgcaccgacggcuccacacgaggccacaaggccaccgucuacaccggcuccgccgacuucgccccgaaacuaggacgaguccaauucgaaaccgacaccgaccacgauuucgagacaaaccaaaacaccaaauucacuccagucggagucauucaagacggaggcaccacccaccgaaacgagccccaacaauggguucuaccauccuacagcggccgcaauacgcccaacguacacuuagcaccagccgucgcgcccacauuccccggcgaacaacuucuauucuuccgauccaccaugcccggaugcagcggcuacccuaacauggaccucgacugccuccucccucaagaauggguccaauacuucuaucaagaggccgcgcccgcgcaaucagacgucgcccuacuccgcuucgucaacccagacaccggacgcguccuauucgaaugcaaacuucacaaauccgguuacguaacagucgcccacacaggccaacacgaccucgucauaccacccaacggauacuucagguucgacuccugggucaaccaauucuacacccuagcacccaugggcaacggcacaggccgccgcagauaa

SEQ ID NO: 38492 - RNA, 1617 nt, Artificial Sequence
  derived and/or modified sequence opt11 from VP1__Norovirus_and/or_Norovirus-like__KJ678139
augaaaauggccuccuccgacgccaaccccuccgacggcucagccgcaucucucguccccgaaguaaacaacgaagucauggcccuggaacccguaguuggagccgcaauagcagcccccguagccggacagcaaaacgucaucgacccauggauucgcaacaacuucguacaagcucccggcggcgaguucaccguaaguccccgcaacgccccaggcgaaauccucugguccgccccacuaggacccgacuuaaaucccuaccucucccaccucgccagaauguacaacggcuacgccgguggcuucgaaguacaagucauccuagccggaaacgcuuucaccgccggaaaagucaucuucgccgccguaccacccaacuucccaacagaaggccuuucaccuucccaagucacgauguucccccacaucgucguagacguccgacaacuagaacccguacucauaccccuaccagacguccgaaacaacuucuaccacuacaaccaaagcaacgaccccacuaucaaacucauagccaugcucuacacaccccuccgcgccaacaacgccggugaugacgucuucacugucucaugccgcguacugacgcgccccucccccgacuuugacuucaucuuccucgucccacccaccgucgaaucccgcaccaaacccuucuccguacccguccuuaccgucgaagaaaugaccaacucccguuuucccaucccccucgaaaaacucuuuaccggccccuccuccgcauucgucguacaaccccaaaacggacgaugcaccaccgacggcguacuccucggaacuacucaacuaucccccgucaacaucugcacauuccgaggcgacgucacccacaucaccggcucccgcaacuacaccaugaaccuugccucacaaaacuggucuaacuacgacccaaccgaagaaauaccagcaccccuaggcacccccgacuucguuggaaaaauucaaggcguacucacacaaaccacacgcaccgacggcagcacccgcggacauaaagccaccgucuacaccgguucagccgacuucgccccuaaacuaggccgaguucaauucgaaaccgacacagaccacgauuucgaagcaaaccaaaacaccaaauucaccccagucggagucauccaagacggaucaacaacccaccgaaaugaaccucaacaguggguccuaccaucguacagcggcagaaacacccccaacguccaccuagccccagccgucgcacccaccuucccuggcgaacaacuccucuucuuccgcagcaccaugcccggcugcucaggauaucccaacauggaccuagacugccuccuaccccaagaauggguccaauacuucuaccaagaagccgccccagcccaaucagacgucgcccuccuccgauucgucaaccccgacaccggacgagugcucuuugaaugcaaacuccacaaauccgguuacgucacuguggcccacaccggacaacaugaccuggucaucccucccaauggcuacuuccgauucgacuccuggguuaaccaauucuacacccucgcccccaugggcaaugguaccggccgccggcgauag

SEQ ID NO: 38493 - RNA, 1617 nt, Artificial Sequence
  derived and/or modified sequence opt11 from VP1__Norovirus_and/or_Norovirus-like__EU921383
augaaaauggccuccaacgacgccaaucccagcgacggauccgccgccaaccucguaccagaagucuccaacgaggucauggcacucgaaccugucgucggagccgccaucgcagccccugucgccggccaacaaaauguaaucgaccccuggauucgaaacaauuucguccaagccccuggcggcgaguucaccgucagcccacguaacgccccaggcgaaauccugugguccgcaccccucggcccugaccucaauccauaccucucucaccuagcccgaauguacaacggauacgccggcggauucgaaguacaaguaauacucgcaggcaacgcauucacagcuggaaaaaucauuuucgccgccguacccccgaacuucccuaccgaaggacuauccccuucccaagucacuauguucccccacaucaucgucgacguccgccaacucgaaccaguucucaucccccuccccgacguaagaaacaacuucuaccacuacaaccaaagcaacgacuccaccaucaaacucaucgccaugcucuacacaccccuacgagcaaacaacgcaggggaagacgucuucacagucagcugccgaguccucacacgacccucccccgacuucgacuucaucuuccuaguaccacccacagucgaauccagaaccaaacccuucacuguccccauccuaaccguagaagaaaugacuaauucccgcuuccccauaccccucgaaaaacucuuuaccggccccagcggcgccuuugucguccaaccccaaaacggccgaugcaccacugacggcguccugcucggcacuacacaacuuuccccagucaacauauguaccuuccguggcgacgucacacacauagcaggcucccgcaacuacacgaugaaccuugccucacucaacuggaauaacuacgacccaaccgaagaaauacccgcaccacucggcacccccgacuucguaggaaaaauccaaggaguccucacacaaacaacaaaaggcgaugguucuacgagaggccacaaagccaccgucuacacaggcuccgcucccuucaccccaaaacucggauccguccaauucuccaccgauaccgaaaaugacuucgaagcucaccaaaacacaaaauucacacccgucggaguaauccaagacgggggaaccacccaccggaacgaaccacaacaauggguccuccccucauacagcggccgcaacguccacaauguacaccucgcaccagccgucgcacccacauuccccggcgaacaacuucuauucuuccgcuccaccaugccaggcugcuccggcuaccccaacauggaccucgacugccuccucccacaagaauggguccaacacuucuaccaagaagcagcaccagcacaaucugacgucgcacuauuacgguucguuaaccccgacaccggcagaguacucuucgaaugcaaacuacacaaaucuggauacguaacagucgcccacacaggacaacacgaccucguaaucccacccaacggcuacuucagauuugacucuugggucaaccaauucuacacccucgcccccaugggcaacggcaccggacgacgucgauaa

SEQ ID NO: 38494 - RNA, 1617 nt, Artificial Sequence
  derived and/or modified sequence opt11 from VP1__Norovirus_and/or_Norovirus-like__KP176405
augaaaauggcaucguccgacgccaaccccucggauggcuccgccgccaaccuugucccagaaguaaacaacgaagugauggcccuagaaccaguagucggcgccgccaucgcagcccccgucgccggccaacaaaacguaaucgaccccuggauccguaauaacuucguacaagccccuggaggugaauuuacaguuucuccccgcaacgcccccggcgaaauucucuggucagcuccccucggcccagaacuaaacccauaccucucccaucucgcccgaauguacaacggcuacgcugguggauucgaaguacaagucauacucgccgguaacgcauucaccgccggaaaaguaaucuucgcagccgucccacccaacuuccccacagaaggccuuucccccucccaagucaccauguucccucacauugucguagacguccgacaacuagaacccguacuuaucccucuccccgacguccgaaauaacuucuaccacuacaaccagucaaacgacccaaccauaaaacuaauagcaaugcuauacaccccacuccgcgccaacaacgccggcgacgacgucuucacagucuccugccgcguccuaacccgccccagccccgacuucgacuucauauuccuugucccaccaacaguugaaucacgcacaaaacccuucucaguccccguccucacagucgaagaaaugacaaauucucgauuccccaucccacucgagaaacuauucaccggacccucauccgccuucgucguccaaccccaaaacggcagauguaccaccgacggcguacuacucggcaccacccaacucucacccgucaauauaugcaccuuccgcggcgacguuacccacaucaccggcucacgcaacuauacuaugaaccuugccucccaaaacugguccaacuacgaccccaccgaggaaaucccagcuccccuuggcaccccagacuucgucggcaagauccagggcguucucacccaaacaacacgaaccgacggcuccacacgcggccacaaagccaccgucuacacuggcucagccgacuuugcaccuaaacucggccgcguucaauucgaaacugacaccgaccgcgacuucgaagccaaccaaaacaccaaauucacacccguaggugucauacaagacggauccaccacacaucgcaacgaaccacagcaauggguccuccccucauauucaggccgcaacacccccaacguccaccuagcccccgccguagcacccacguuccccggcgaacaacuauuauucuuccgcuccaccaugcccgggugcuccggauaccccaacauggaccucgacugucuccuaccacaagaauggguccaauacuucuaccaagaagcagccccugcccaauccgacguugcacuccuccgcuucgucaaccccgacaccggacgcgugcuauucgaauguaaacuccacaaaucaggauacguaaccgucgcacauacaggccaacacgaccucgucauacccccaaauggauacuucagauuugacagcugggucaaccaauucuauacccuugccccaaugggaaacggcaccggccgccgacgcuag

SEQ ID NO: 38495 - RNA, 1617 nt, Artificial Sequence
  derived and/or modified sequence opt11 from VP1__Norovirus_and/or_Norovirus-like__KP176403
augaaaauggcaucauccgacgcaaaccccucugacggaucagccgccaaccugguccccgaaguuaacaacgaagucauggcccucgaacccgucguaggugccgccaucgccgcccccgucgccggccagcaaaacguuaucgacccauggauccgcaacaauuucguccaggcaccuggcggagaguucaccguaucuccucgcaacgcacccggagaaauccuauggucagcaccacuugguccagaccucaaccccuaccucucccaccucgcacggauguacaacggauacgcaggaggcuuugaaguccaagucauccucgccggcaacgccuucacugccggaaaagugaucuucgccgcaguaccaccaaacuuccccaccgaaggccucucccccucacaaguaacaauguucccucacaucgucgucgacguacgccaacuagaaccaguccucauaccacuaccagacguccguaacaacuucuaccacuauaaccaaucuaacgaccccaccaucaagcucaucgcuaugcucuacaccccucuccgcgccaacaacgccggcgacgacguauucacagucuccugccgcguccucacucgccccagcccagacuucgauuucauauuccuagucccgccaaccgucgaaagccgaaccaagccauucucagucccgguccucacagucgaagaaaugaccaacuccagauuccccaucccccucgaaaagcuauucaccggaccaucauccgccuucgucguacagccccaaaacggccgcuguaccaccgacgggguccuccuaggcacaacccagcuauccccagucaacaucugcacuuuccgcggcgacgucacccacaucacuggcucucgcaacuacaccaugaaccucgccucccaaaauuggaacaacuacgaccccaccgaagaaauacccgcaccccucggcaccccagacuucgugggaaaaauccaaggaguucucacacaaacaacacgaacggauggcuccacccgcggccacaaagccaccguauacacuggcuccgccgacuuugcccccaaacuaggccgcguccaguucgaaacagacacagaccacgacuucgaagccaaccaaaacacacgauucacccccgucggcguaauccaagacggcggaaccacacaccgcaacgaaccgcaacaauggguccuacccuccuacucuggccgcaacacccccaacguccaccuagcgcccgccguagccccaaccuuccccggcgaacaacuacucuucuuucgauccaccaugcccggaugcucuggcuacccaaacauggaccucgacugccuucuuccacaagaauggguccaacacuucuaccaagaagccgcuccugcccaaucagacgucgcccuacucagauucguaaacccagacaccggcagaguacuguucgaaugcaagcuccacaaaucaggauacguuaccguagcacacacaggacaacacgaccucgucauacccccaaacggguacuuccgauucgacucuugggucaaucaauucuacacacuagcacccaugggcaacggcaccggccgccgucgcuaa

SEQ ID NO: 38496 - RNA, 1617 nt, Artificial Sequence
  derived and/or modified sequence opt11 from VP1__Norovirus_and/or_Norovirus-like__KP096343
augaaaauggcaagcucggacgccaaccccagcgauggauccgccgccaaccuaguacccgaaguuaacaacgaagucauggcucucgaaccaguaguaggcgcagcaauagcagcccccgucgccggccagcaaaacgucaucgacccauggauccgcaacaacuucguccaagcacccggcggcgaguucacagucucaccccgaaacgcacccggcgaaauacuauggucagcaccccucggccccgaccuaaaccccuaccucucacaccucgcccgaauguacaacggauaugcaggaggcuuugaaguacaaguaauacuagcaggcaacgccuucaccgccggcaaagucauuuucgcagcugucccacccaacuuccccaccgaaggccuuucucccucucaagucaccauguucccacacaucgucgucgacguccgccaacucgaacccguccucaucccacucccagacguccgcaacaacuucuaccacuacaaucagagcaacgaccccaccauuaaacucaucgcaaugcucuacacaccacuccgagcaaacaacgcuggcgacgacguuuucaccguaucaugccgaguacucacccgccccuccccagacuucgacuucauauuccucgucccaccaaccgucgaaucacgaacaaaacccuucuccguccccguccucacagucgaagaaaugaccaacucccgcuuccccgucccacuagaaaaacuauucaccggaccauccuccgccuucgucguccaaccccaaaacggccgcugcaccacagacggagucuugcucggcaccacacaacucagccccguaaacaucugcacauuccgaggagacguaacccacauuacaggcucucacaacuacaccaugaaccuagccucccaaaacugguccaacuacgaccccaccgaagaaauccccgccccucuaggcacaccugacuucgucggaaagauccaaggaguacuaacccaaaccacccgcaccgacggcuccacccgcggacacaaagcuacagucuacaccggaagcgccgacuucgcccccaagcucggccgcguucaguucgaaacugacacagacagagauuucgaagcaaaccaaaacaccaaauucacccccgucggcgucauacaagacggcgguaccacccaccgcaacgaaccccaacaauggguacuacccuccuacucaggacgcaacacacccaacguccaccucgcccccgccgucgcccccaccuuuccaggagaacaacuccuauucuuccgcucaaccaugccaggcugcucuggcuauccaaacauggaccuugacugccuccucccccaagaauggguacaauacuucuaccaggaagccgcccccgcccaaagugacguagcacuccuaagauuugucaaccccgacacaggccgcguccuguuugagugcaaacuacacaaaagcggcuacgucacggucgcccacaccggccaacacgaccuaguaaucccuccaaacggcuauuuccgcuuugacuccugggucaaccaauucuacacccuagcccccaugggaaacggcaccggccgccguagauaa

SEQ ID NO: 38497 - RNA, 1617 nt, Artificial Sequence
  derived and/or modified sequence opt11 from VP1__Norovirus_and/or_Norovirus-like__KM268101
augaaaauggccuccucagacgcaaaccccuccgacgguucagcugccaaccucguacccgaagugaauaacgaagucauggcucuagaaccagucgucggcgcagccauagcagcccccguugccggccaacaaaacgucauagacccuuggauccgcaacaacuucguccaagcccccggaggcgaauuuaccgucucccccagaaaugcacccggcgaaauccucugguccgccccacuaggcccugaccucaaccccuaucucucccaccucgcacgcauguauaacggcuacgccgguggauuugaaguacagguaauacuagcaggcaacgcauuuaccgccggcaaaguaaucuucgcagcaguacccccaaacuuccccaccgaaggccucucacccucccaagucaccauguucccccauauaguagucgacguacgccagcucgaaccaguccuaaucccccucccagacguccgcaacaacuucuaccacuacaaccagucaaacgacccaaccauaaaacucaucgccaugcucuacacuccccuaagagccaacaacgccggagacgacgucuuuacaguuuccugccgcguacucacccgccccuccccugauuucgacuucaucuuccucguaccuccaaccgucgaaucccgcaccaaaccuuucuccguaccaguccucacaguagaagaaaugaccaacuccagauucccaaucccccucgaaaaacucuucaccgggccaucuucagcuuucgucguccaaccccaaaacggcagaugcaccaccgacggcgucuuacuaggcacaacccaacucucaccuguaaacaucugcaccuucagaggcgacgucacccacaucacaggcucccacaacuacaccaugaaccuugcgucccaaaacuggaacaacuacgaccccacagaagaaauccccgcaccccucggcacccccgacuucgucggaaaaauacagggcguacucacacagaccacccgcaccgacggcucuacccgcggccacaaagccaccgucuacacaggcuccgccgacuucgccccgaaacucggccgcauccaauucgaaaccgauaccaaccacgacuucgaagccaaccaaaacaccaaauucacccccgucggcguaauccaagacgguggcacaacacaccgcaaugaaccacaacaauggguccuaccguccuacuccggaagaaacaccccuaacguccaccucgccccugccgucgcccccaccuuccccggagaacagcuacuuuucuuucgauccaccaugcccggcuguucuggcuaucccaacauggaucucgacugccuccucccccaagaauggguccaauacuucuaccaagaggccgcccccgcccaguccgacgucgcacuccuacgcuucgucaacccagacaccggacgcguucucuucgaaugcaaacuccacaaaagcggcuacgucacagucgcccacacuggucaacacgaccucguaauuccuccaaacggcuacuuccgguucgacucaugggucaaccaauuuuacacccucgcccccauggggaacggcaccggccgccgccgcuga

SEQ ID NO: 38498 - RNA, 1617 nt, Artificial Sequence
  derived and/or modified sequence opt11 from VP1__Norovirus_and/or_Norovirus-like__KM198568
augaaaauggccuccaacgacgcaaaccccucagacggcagcgccgccaaccucguaccagaagucaacaacgaaguaauggcccuugaacccgucgucggcgcugccauagccgcccccguagcgggccaacaaaacgucauagacccauggauacgcaacaacuucguccaagcccccggaggagaguucaccguaagcccccgcaacgcacccggugaaauccucugguccgccccacuuggccccgaucucaaucccuaccucucacaccuagcccguauguacaacggcuacgccggcggauucgaaguacaggucauacuagcaggaaacgccuucacagcuggcaaaaucaucuucgccgccgugcccccuaacuuccccaccgaaggccuaucccccagccaagucaccauguucccccauaucauagucgacguccgccaacuggaaccaguccucaucccccuccccgacguccguaacaauuucuaccacuacaaccaaucaaacgacucaaccauuaaacucaucgccaugcuguacacgccccuacgcgccaacaacgcaggcgaagacgucuucaccguguccugccgaguccucacccgacccuccccagacuucgacuucauauuucucguucccccgaccgucgaaucccgaacuaaaccauucacagucccaauccucaccguagaagaaaugacaaacucgcgcuucccaauucccuuagagaaacucuucaccggccccuccggcgccuucaucguccaaccccaaaacggccgcugcacuaccgacggaguccuccuagggacuacacaacuaucccccgucaacaucugcaccuucagaggcggagucacccacauagccgggucccgcaacuacacaaugaaccuagccucacucaacuggaacaacuacgacccaaccgaagaaauuccagcaccacuaggcacacccgacuucgucggcaaaauacaaggcguacuaacccaaaccacuaaaggugacggaucaacacguggccauaaagccacagucuacaccggauccgcacccuucaccccuaaacuaggcuccguccaauucucgaccgacaccgaaaacgacuucgaagcacaucagaacacaaaauucacccccgucggcgucauacaagacggaggcacaacccaccgaaaugagccacagcaguggguucucccauccuauucaggccgcgacguacacaacguccaccucgcacccgccgucgcacccaccuuccccggcgaacaacuacucuucuuucgcuccaccaugcccgguugcuccggcuaccccaauauggaccucgacugccuccuuccgcaagaguggguacaacacuucuaccaagaagcagcccccgcccaaucagacguagcccuccuccgauucgucaacccggacacaggacgaguccuauucgaaugcaaauuacacaaaagcggcuacgucacuguagcccacacuggccagcacgaccuagucauuccaccaaacggcuacuucagauucgauuccugggucaaucaauuuuacacccucgcgcccaugggcaacggcaccggccgacgccgcuaa

SEQ ID NO: 38499 - RNA, 1617 nt, Artificial Sequence
  derived and/or modified sequence opt11 from VP1__Norovirus_and/or_Norovirus-like__KM198532
augaagauggcgucuaacgacgcaaaccccucagauggcuccgcagccaacuuaguuccagaggucuccaacgaggucauggcccucgagccagucgucggcgccgccaucgccgcaccugucgcaggacaacaaaacguuaucgaccccuggauccgcaauaacuucguccaagcaccuggcggcgaguucaccgucucgccccgcaacgcccccggcgaaauacucugguccgccccucucggccccgaccucaaccccuaccucucccacuuagcaagaauguacaacggcuacgcaggcggcuucgaaguacaaguaauccuagcuggcaacgcuuucaccgccggaaaaaucaucuuugcugccguucccccaaacuuccccacagaaggcuuauccccaucccaagucaccauguuuccccacaucaucgucgauguccgccaacucgaacccguccucaucccccuacccgacguacguaacaacuucuaccauuacaaucaaacuaacgacucaacuauaaaacuuaucgccaugcuguauaccccacuccgcgcaaacaacgcuggcgaagacgucuucaccguaagcugccgcguacucacacgcccaucacccgacuucgacuucaucuuccuugucccucccaccguagaauccagaacaaagcccuucaccgucccaauccucaccgucgaagaaaugacaaacuccagauuccccguuccccucgaaaaacucuucaccggacccuccggcgccuucgucguacaaccccaaaacggacgcugcaccaccgacggcguacuacucggcacaacucaacuaagcccugucaacaucugcacauuccgaggcgacgucacacacauagccggaucccgcaacuauaccaugaaccucgcaagccugaacuggaacaacuacgaccccaccgaagagauacccgccccacuagguacccccgacuucgucgguaaaauucaaggaguccuuacccaaaccacaaaaggcgacggguccacccgcggccacaaagcaaccgucuacacaggaagcgcucccuucacccccaaacucggcucaguacaauucuccacagacacagaaaacgacuucgaaacccaucaaaacacaaaauucacccccguaggcgucauccaagacgguggcaccacccacagaaaugaaccccaacaauggguacucccauccuacuccggacgcgacguccacaacguccaccuagcaccagccgucgcacccacauuccccggagaacaacuccucuucuuccgauccaccaugcccggcugcuccggauaccccaacauggaucuugacugccuccuaccccaagaauggguacaacauuucuaccaagaggccgcacccgcccaaucugacgucgcccuacucagauucgucaacccagacaccggccgcguccuuuucgaaugcaaacuccacaaaucaggcuaugucacggucgcccacaccggccagcacgaccucguaaucccacccaacggcuauuuccgauucgacuccuggguaaaccaauucuacacccucgcucccaugggcaacggcaccggucgccgacgcuaa

SEQ ID NO: 38500 - RNA, 1617 nt, Artificial Sequence
  derived and/or modified sequence opt11 from VP1__Norovirus_and/or_Norovirus-like__KM198527
augaaaauggcuagcaaugacgcuaauccauccgacggauccgccgccaaccucguacccgaagucucuaacgaagucauggcccuagaaccagucgugggugccgccaucgcagcccccguagccggacaacaaaaugucauagaccccuggauucgcaauaacuucguucaagcccccggcggcgaguucacagugagcccccgcaacgcccccggcgaaauacucugguccgcaccacucggucccgaccuaaauccuuaccuaucacaccucgcaagaauguacaacggcuacgccggcggauucgaaguccaagucauucuugcaggaaacgcauucaccgcuggcaaaaucauuuucgccgccgucccaccaaacuucccaaccgaaggccuaucacccucccaagucaccauguuuccacacaucaucgucgacguccgccagcuagaaccaguccucaucccccuccccgacguccguaacaauuucuaccacuauaaccaaaccaacgauuccacaaucaaacuaaucgcuaugcucuacacuccacuccgcgcuaacaacgccggcgaagauguuuucaccgucuccugccgcguucucacgcgacccucgccagacuuugacuuuaucuuccucguucccccaaccgucgaaucccgcaccaaacccuuuaccgucccaauccucaccguagaagaaaugaccaacucccgguuccccauuccccuagaaaaacucuucaccggacccuccggugccuuuguuguccaaccccaaaacggccgaugcaccacagacggcguccuacuaggaacaacccaacuaucccccgucaacaucugcacauuccgcggagacgucacgcauaucgccggcucccggaacuacacaaugaaccucgccagccuaaacuggaacaacuacgacccaaccgaggaaauccccgcuccccuaggcacaccagacuucgucggcaaaauacaaggaguucuuacucaaaccacgaaaggcgacggcucaacccgaggucacaaagccaccgucuacacgggcucagcccccuucacccccaaacucggcucaguccaauucuccacagacaccgaaaacgacuucgagacccaccaaaacaccaaauuuaccccagucggcgucauccaggacggcuccaccacccaccgcaacgaaccacaacaauggguucuacccuccuacucuggccgugacguacacaacguacaccuagcaccagcagucgcccccacauuccccggugaacaacuccucuucuuccgcuccaccaugccaggcugcucaggauaucccaacauggaccucgacugccuccuaccacaagaauggguccaacacuucuaccaagaagcagccccugcccaauccgaugucgcccuacuacgauucguaaauccagacacaggccgcguacucuucgagugcaaauuacacaaaagcggcuacgucacuguagcccauaccggacaacacgaccuaguaauacccccuaacggauacuuccgauucgacuccugggucaaccaauucuauacccucgcccccaugggcaacggcaccggccgccgccguuga

SEQ ID NO: 38501 - RNA, 1617 nt, Artificial Sequence
  derived and/or modified sequence opt11 from VP1__Norovirus_and/or_Norovirus-like__KF177448
augaagauggcauccagcgacgccaaccccucagauggcucagccgccaaucucgucccagaagucaacaaugaggucauggcccuagaaccagucgucggcgcagccauagcagcacccgucgccggacaacaaaacguaauugaccccuggauccggaacaacuucguacaagcccccggaggcgaguucaccgucucaccccgaaacgcuccaggugaaauacuuugguccgccccucuagguccagaccuaaaucccuaccugucccaccuagcccgaauguacaacgguuacgcaggcggcuucgaaguccaggucauccucgccggaaacgccuucacugccggcaaagucaucuucgccgcagucccaccaaacuucccaaccgaaggacucucaccaucccaagucacaauguucccccauaucguagucgacgucagacaacuagaacccguccucauaccacugccagacgucagaaacaacuucuaccauuacaaccaauccuccgaccccaccauaaaacuaaucgccaugcucuacacaccccuacgcgccaacaacgccggcgacgacguauucaccguauccugccgaguccucacacgccccucccccgacuuugacuucaucuuccucgugcccccaaccguagaaucacguaccaaacccuucuccguacccguccuaacagucgaagaaaugacaaacagccgauucccaauaccacuagaaaaacuguucacgggcccuuccucagccuucgucguacaaccccaaaacggucgguguacaacagacggcguacuacugggcaccacccaacucucacccguuaacaucugcaccuuccgaggagacgucacccacauaaccggcucccgcaacuacaccaugaaccucgcaucacaaaacuggaacaacuacgacccaaccgaagaaauaccagcacccuuaggcacccccgacuucgucggcaaaauccaaggcguacucacacagaccacccgcacagacggcuccacccguggccacaaagccacaguauacacgggcuccgccgacuuugcccccaaacucggccguguccaauucgaaaccgacaccgaccacgacuucgaagcaaaccaaaauaccaaauucacccccguaggcguaauacaagacggcucgaccacccaccgcaacgaaccacaacaguggguccuaccaucauacuccggccgcaacacacacaacguccaucucgcccccgccgucgccccaacuuuccccggcgaacaacuccuauucuucagauccaccaugcccggaugcagcggcuaccccaacauggaccucgacugccuacuaccacaagaauggguccaauacuuuuaccaagaagcugcacccgcacaguccgacguagcccuacuucguuucgucaaccccgacaccggccgaguucucuucgaaugcaaacuccacaaaagcggcuacgugacaguagcacacacuggccaacacgaccucguaaucccacccaacggcuacuuccgauucgacucaugggucaaccaauucuacacacuagccccgaugggcaacggcaccggacgccgacgcuaa

SEQ ID NO: 38502 - RNA, 1617 nt, Artificial Sequence
  derived and/or modified sequence opt11 from VP1__Norovirus_and/or_Norovirus-like__KF008244
augaaaauggccucaucagacgcuaaccccucggacggcuccgccgcaaaccucguccccgaaguaaauaacgaagucauggcccuagaacccguagucggagcagcaauagcagcacccguagcaggccaacaaaacgucaucgaccccuggauccgcaacaacuuuguccaagcacccggcggcgaauuuaccgucucuccacgaaacgcccccggcgaaauacucugguccgcaccccucggccccgaucucaacccauaccucucacaccucgcccgcauguacaacggauacgccgguggcuucgaaguccaagucauacuugccggcaacgcauucaccgccggaaaagucauuuuugccgccguacccccuaacuucccaacagaaggccucucacccucccaagucaccauguucccccacaucgucgucgauguccgccaacucgaacccguccuaauuccccuccccgacguacgaaacaacuucuaccacuauaaccaaucaaacgacccaaccaucaaacuaaucgccaugcucuacacaccccuccgcgcaaauaacgccggcgacgacgucuucaccgucuccugccgcguacucacacgccccuccccagacuucgacuucaucuuccucgucccacccacagucgaaucccgcacaaagcccuucucaguuccaguccugaccgucgaagaaaugacaaacucucgcuuccccaucccccucgaaaaacuauucacagggcccucuuccgcauucgucguacaaccccaaaacggccgaugcaccaccgauggcguccugcucggcacaacacaacuuuccccugucaauaucugcaccuucagaggcgacguuacccacaucaccggcucacgcaauuacacaaugaaccucgcaucucaaaacuggaacaacuacgaccccaccgaagaaauuccagcaccccuuggaacaccugacuuugucgggaaaauccaaggcguccucacccaaacaacccgaaccgacgguucaacaagaggccauaaagcaaccguauacaccggcuccgccgacuucgcccccaaacuaggacgcguucaauucgaaaccgacaccgaccacgacuucgaaacuaaucaaaacacaaaauucacacccguaggcgucauacaagacggauccaccacacaccgcaacgaaccacaacaauggguccucccauccuacucaggccgcaacacacacaacguccaccuagcgccugccguagccccaaccuuccccggugaacaacuccucuucuuucgauccaccaugcccggcugcuccggcuaccccaacauggaccucgacugccuucucccccaagaauggguccaauacuucuaccaagaagcagcaccagcccaaucagacgucgcucuccuccgcuucgucaaccccgacacaggccgcguccucuucgaaugcaaacuacacaagucagguuacguaaccgucgcccacaccgggcaacacgaccucguaauaccacccaacgguuacuuccgcuucgauucaugggucaaccaauucuacacccuagcccccaugggcaacggcaccgguagacgccgcuaa

SEQ ID NO: 38503 - RNA, 1617 nt, Artificial Sequence
  derived and/or modified sequence opt11 from VP1__Norovirus_and/or_Norovirus-like__KF060103
augaaaauggccucauccgacgccaaccccuccgacgguucaacagccaaccucgugccagaagucaacaacgaagucauggcacuagaacccguagucggcgccgccauagccgcaccaguagccggccaacaaaaugucauagaucccuggauccgcaacaacuucguccaagcccccggcggagaauuuaccguaucuccccgaaacgcccccggagaaauccuuuggucagcuccccucggacccgaccuaaaccccuaccuaucccaccuagcccgaauguacaacggcuacgccggcggauucgaaguccaagucauccucgcaggcaacgccuucacugcaggcaaaaucaucuucgcugcagucccacccaacuuccccaccgaaggccucuccccaucacaaguaaccauguucccacacauaaucgucgacguccgacaacucgaacccguacuaauaccccuacccgacguccgcaacaacuucuaccacuauaaccagucaaacgacccuacaaucaaauuaaucgccaugcuauacacgccccucagagccaacaacgcaggagacgaugucuucaccgucuccugccggguccuaacccgacccagccccgacuucgacuucauuuuccucguuccaccaaccguugaaucacgcaccaaacccuucucggucccugucuugaccguagaagaaaugacuaacucacgauucccaauaccccuugaaaaacuauucaccggucccucaucugccuucguuguccagccccaaaacggccgaugcaccaccgacggcguccuccucggcaccacacaacucucgcccgucaacaucugcacauuccgcggcgacgucacccacaucuccggcucacacaacuacaccaugaaccucgccucccagaacuggaacuccuaugaccccaccgaagaaaucccagccccacuaggcacaccagacuucguuggcaaaauacaaggaguacucacccaaaccacccgcacagacggcuccacacgcggucacaaagcuaccguauacaccgggucugccgacuucucccccaaacucggccgcguccaguucgccacagacaccgacaacgacuucgaaaccaaccaaaacaccaaauucaccccaguuggaguaauccaagacggcgguaccacccaccggaacgaaccccaacaauggguccuuccaucauacuccggcagaaacauccacaacguacaccucgcuccagccguagcccccacauuccccggugaacaacuauuauucuucagaucuaccaugcccggcugcucgggcuaucccaacauggaccucgacugccuacucccccaggaauggguacaauacuuuuaccaagaagcagcccccgcccaaucagacguagcucuccuccgauucgucaaccccgacaccggcagagucuuauuugaaugcaaacuccacaaaucaggcuacgucaccgucgcacacaccggacaacacgaccucguuaucccucccaacggcuacuuccgcuucgacuccuggguaaaccaauucuacacacuagcacccaugggaaacggcaccggccgccgccgcuaa

SEQ ID NO: 38504 - RNA, 1617 nt, Artificial Sequence
  derived and/or modified sequence opt11 from VP1__Norovirus_and/or_Norovirus-like__KC960615
augaaaauggccuccaacgacgcuaaccccuccgacggaagcgccgccaaccuaguacccgaagucucaaacgaagucauggcacuagaacccgucguaggcgccgccaucgcagcacccgucgccggucaacaaaacgucaucgacccauggauacgcaacaacuucguccaagccccaggaggagaguucacaguaucuccacgaaacgcucccggcgaaauacuauggagcgcaccgcucggccccgaccuaaacccauaccuaucucacuuagcacguauguacaacggauacgccggugguuuugaaguccgcguuauccuagccggcaacgccuuuacagccggaaaaaucaucuucgccgcaguaccucccaacuuccccaccgaaggccucagccccucccaagucaccauguucccucacaucaucguagacguccgccagcucgaacccguccucauaccacucccagacguuagaaacaacuucuaccacuauaaccaaaccaacgacuccaccauaaaacuaauagcaaugcucuacacaccucuccgcgccaacaacgcaggagaagacguuuucaccguuagcugccgcguccuaacaagacccuccccagacuucgacuucaucuuccugguaccacccaccgucgaaucccgcaccaaacccuucaccguccccauccucaccguugaagaaaugaccaacucacgcuuccccaucccccucgaaaaacucuucaccggccccucaucagcauucguaguacaaccccaaaauggccgcuguaccaccgacggcguccuccuuggaaccacucaacucucacccgucaacauaugcaccuuucgcggugacguuacccacauugcuggcucccgcaacuacaccaugaaccucgcgucacucaacuggaacaacuaugaccccaccgaagaaauccccgccccacucggaacaccugacuuugucggcaaaauacaaggaguacuaacacaaaccacaaaaggagacggguccacccgcggccacaaagccacaguauacaccggaucagcccccuucacccccaaacucggcuccguacaauucuccaccgacaccgaaaacgacuucgaaauccaccaaaacacaaaauucacacccgucggagucauccaagacggcggcacuacccaccgaaacgaaccccagcaauggguccuacccuccuauuccggacgagacguccauaacguacaccuugcccccgccgucgcccccaccuuccccggcgaacaacuccuauucuuccgcuccaccaugcccggcuguucaggcuaucccaacauggaccuagacugccuccuaccacaagaauggguacaacacuuuuaccaagaagcagcaccggcccaaucugacgucgcccuccuacguuucgucaaccccgacaccggccgcguccuauucgaaugcaaacuacacaaauccggauacgucacaguugcccacacaggccagcacgaccuuguuaucccucccaauggauacuuccgcuucgacucauggguaaaccaauucuacacucuagcccccaugggcaacggaacaggccgccgccguuag

SEQ ID NO: 38505 - RNA, 1617 nt, Artificial Sequence
  derived and/or modified sequence opt11 from VP1__Norovirus_and/or_Norovirus-like__KC517373
augaaaauggcuucaaacgacgccaacccaucagacggcucagcagcaaaccucguacccgaagugaacaaugagguuauggcccucgaacccguaguaggcgccgcaaucgccgccccaguggccggacaacaaaacguaauagaccccuggauacgcaacaacuucguccaagcccccggcggagaguucaccgucucaccccgaaacgccccaggcgaaauacuaugguccgccccacucggccccgaccucaauccuuaccucucacaccucgcucguauguacaacggauacgccggcggauucgaaguacaagucauccucgccggaaacgccuucaccgcaggcaagaucauauucgcagccguaccacccaacuuccccacagaaggccucucccccagccaagucacaauguucccacacauaaucgucgacguaagacaacucgaaccagugcuaaucccccuacccgacguacgcaauaacuucuaccacuacaaccaaucaaacgacuccaccauaaaauuaaucgccaugcucuacaccccacuccgcgccaauaacgcaggagaagacguauucacugucucaugccgcguccuaaccagacccucccccgacuucgacuucaucuuccuagucccucccacagucgaaagccgcacuaagccauucacaguaccuauccuaaccgucgaagaaaugacuaauucaggcuuccccauaccacuagaaaaacuauucacgggccccuccuccgccuucguaguccaaccacaaaacggccgaugcaccaccgacggcgucuuacuuggcaccacccaacucuccccagucaacaucugcacauuucgcggcgacgucacacacaucgccggcucccgcaacuauaccaugaaccucgcaucgcugaacuggaacaacuacgaccccacagaagaaauacccgcccccuuaggaaccccagacuucguaggcaagguccaaggcguucucacccaaacaaccaaaggugacggcuccacccguggccacaaggcuaccguauauacuggcucagcccccuucaccccuaaacuuggaucaguucaauucgaaaccgacaccgaaaacgacuucgaaacccaccaaaauaccaaauucacccccguuggcguaauccaagacgguggaaccgcacaccgcaaugaaccccaacaauggguccucccaagcuacucaggacgaaacguccccaacguucaccuagcuccagcugucgccccaaccuuccccggugaacaacuccuauucuuccgcuccacgaugcccggcugcucaggcuaccccaacauggaccucgacugcuuacugccucaagaauggguucaacacuucuaccaagaagccgcccccgcacaauccgacguagcacuucuccgcuucgucaaccccgacaccggccgcguccucuucgaaugcaaacuccauaaauccggcuacgucaccguagcccacaccggucaacgcgaccuaguuauaccacccaacggauacuuccgcuucgacuccuggguaaaccaguucuacacacucgcucccaugggcaacggaaccggucgacgacgcuaa

SEQ ID NO: 38506 - RNA, 1617 nt, Artificial Sequence
  derived and/or modified sequence opt11 from VP1__Norovirus_and/or_Norovirus-like__JX459615
augaaaauggcauccaacgacgccaaccccagcgacggcucagcagccaaccuagucccagaggucaacaacgaagucauggcccucgaacccguuguaggagccgcaaucgccgcccccgucgcaggacaacaaaacguaaucgaccccuggauacgcaacaacuucguccaagcccccggcggcgaguucacaguuucaccacguaacgccccaggcgaaauacucugguccgcaccacuuggcccagaccucaaucccuaccucucccaccucgcccgaauguacaacggcuacgccgguggcuucgaaguccaaguaauccucgcaggcaacgccuucaccgccggaaaaaucauauucgccgccgucccuccuaacuucccaaccgaaggccuuucaccgucccaaguaaccauguucccccacauaaucgucgacguccgccaacucgaacccguccucauaccacucccagacgucagaaacaacuucuaucacuauaaccagucaaacgacuccaccaucaaacucaucgcaaugcucuacacaccccuccgagcuaacaacgccggagaagacguauucaccgucucaugccgcguacuuaccagaccaucccccgaguucgacuucauauuccucgucccacccacaguggaaucacgcaccaaacccuuuacaguccccauacucaccgucgaagaaaugacuaacucacgcuuccccaucccccuagaaaaacuauucaccggccccucaggagcauucgucguccaaccacaaaacggucgaugcacaaccgacggcguacuccucggcacaacacaacucuccccagucaacauuuguaccuucagaggagacgucacccacauagccgguucucgcaacuacaccaugaaccucgcaucucucaacuggaacaacuacgaccccacagaagaaauccccgcaccccucggcaccccagacuucgucggcaaaauccaagguguccucacccaaacaaccaaaggugacggcucaacacgaggccacaaggccacagucuacaccggcuccgccccuuucacaccaaaacucggcuccguccaguucuccacagacaccgaaaacgacuuugaaacacaccaaaacacuaaauucacccccgucggagucauccaagacggcgguaccacccaccgaaacgaaccccagcaauggguacuacccuccuacucaggccgcaacguccacaacguacaccucgcacccgccgucgcaccgaccuuccccggugaacaacuccuauucuuccgcucaaccaugccgggcugcuccggauaccccaacauggaccucgacugccuccucccccaagaauggguccaacacuucuaccaagaagcugcucccgcacaauccgacguagcccuacuccgcuucguaaaccccgacacuggccgcgucuuauucgaauguaaacuccacaagucgggauacguuacaguagcccacacaggccagcacgaccugguaaucccucccaacggcuacuuccgcuucgacagcugggucaaccaguucuacacacucgcccccaugggcaacggaacaggacgucgccgcuaa

SEQ ID NO: 38507 - RNA, 1617 nt, Artificial Sequence
  derived and/or modified sequence opt11 from VP1__Norovirus_and/or_Norovirus-like__JX459603
augaaaauggcauccaacgaugcaacccccuccgacggcgucgccgcccaccucguccccgaaguuaacaacgaagucauggcccucgaaccugucgucggcgccgccaucgccgcccccgucgcaggacaacaaaacgucaucgaccccuggauacgcaacaacuucguccaagcaccuggaggcgaguucaccgucucuccccgcaacgcccccggcgaaauacuauggucagccccacucgguccagaccuuaaccccuaccucucccaccucgccagaauguacaacggcuacgcaggcggcuucgaaguccaagucauccucgccggcaacgcauucaccgcaggcaaaaucaucuucgccgccguuccucccaacuuccccaccgaaggccucucuccaucacagguaacuauguuuccccacauaauaguagacguccgccaacucgaaccaguccucaucccccuccccgacguacgcaacaacuucuaccacuacaaccaaagcaacgacucaacaaucaaacuaaucgccaugcuuuacacaccccuacgagccaacaacgcuggcgaagacgucuucaccgucucaugcaggguccucacccgcccuuccccagacuucgacuucaucuuccuaguacccccaaccguagaaucaagaaccaaaccauuuaccgucccaauccucacaguagaggagaugacaaacucccgcuucccaaucccccuugaaaaacuguucacugggcccagcggcgcauucgucguccaaccccaaaacggccgcugcaccacugacgguguucuccuagggacaacccaacuuaguccugucaacauuugcaccuuccgaggagacguuacccauaucgccggcuccagaaacuacacaaugaaccucgccucccucaacuggaacaacuacgaccccaccgaagaaauccccgcuccccuaggcacccccgacuucgucggcaaaauccaaggcguauuaacccaaacuacuaaaggagacgguaguacccgcggccacaaagcaacagucuacacaggcuccgccccauucaccccaaaacuaggcuccguccaauucuccacagacacggaaaacgacuucgaaacccaucaaaacacaaaauucacucccgucggcgucauccaagauggaggcacaacacaccgcaacgaaccccaacaauggguacucccauccuacagcggacgcaacguccacaacguucaccucgcacccgccgucgcaccaaccuuccccggcgaacaacuacuauucuuccgcuccaccaugcccgguugcuccggcuacccaaacauggaccucgauugccuacucccccaagaauggguacagcacuucuaccaagaagcagcacccgcccaaagcgacgucgcccuccuccgcuucguaaaccccgacacaggccgaguacucuuugaaugcaaacuacacaaauccggauacguaacagucgcccauacaggacaacacgaccucguuaucccacccaacggcuacuuccgcuucgacuccugggucaaccaauucuacacccucgcccccaugggcaacgguaccggacgccgacgcuaa

SEQ ID NO: 38508 - RNA, 1617 nt, Artificial Sequence
  derived and/or modified sequence opt11 from VP1__Norovirus_and/or_Norovirus-like__JX155746
augaaaauggccuccaacgacgcaaacccaucagacggcuccgccgcaaaccucgucccagaaguaaauaacgaagucauggcccuugaacccguaguaggggccgccauagccgccccagucgccggccaacaaaacgucaucgaccccuggauacgcaacaacuucguacaagcccccggaggcgaguucaccguaucuccccgcaacgcccccggcgaaauccucugguccgcuccacucgguccagacuuaaaccccuaccucucccaccuugcacgaauguacaacggcuacgccggcggcuucgaaguacaagucauccuggcaggcaacgcauucacagccggcaaaaucaucuucgccgccguucccccgaacuuccccaccgaaggacucagccccucccaaguaacgauguucccccacauaaucgucgacguccgccaacucgaacccguccucauuccacuacccgacguccgaaacaauuucuaccacuacaaccaaucaaacgacuccacuauaaaacucaucgcuaugcuuuacacaccccuucgcgcaaacaacgcuggggaagacgucuucaccgucucaugccgcgugcucacccgaccauccccagacuucgacuucauauuccucguacccccaaccgucgaaucccgcaccaaaccuuucaccguuccaauacucaccgucgaagaaaugacaaauucacgcuuccccaucccccucgaaaaacucuucacaggcccauccucagcauucgucguccaaccccaaaacggucgaugcaccaccgacggaguacuacuaggcaccacucaacucucucccguaaacaucugcacauuccgcggagacgucacacacaucgccggcucucgaaauuacacgaugaaccucgccucccuuaacuggaacaacuacgaccccaccgaagaaauccccgccccacucggcacacccgacuucgucggcaaaauacaaggaaugcucacccagacuacaaaaggagacggguccacacgcggucauaaagcuaccguauacacuggcucggcccccuucacacccaaacuaggauccguccaauucucuaccgacaccgaaaacgacuucgaaacccaccaaaacacaaaauucaccccaguaggugucauucaagacgguuccaccacccaucgcaaugaaccacaacaauggguacuaccaagcuauucaggccgaaacguccccaacguacaccuagcccccgcagucgcccccacauuccccggagaacaacuccucuucuuccgauccacaaugcccggcugcucaggcuacccaaacauggaccucgacugccuacucccccaagaauggguccaacauuucuaccaagaagccgcccccgcccaaucagacguugcccuuuuacgauucgucaauccagauacaggacgaguccuuuucgaaugcaagcuccacaaacccggcuacgucaccguugcacauaccggacaacacgaccucguaauaccacccaacggauacuuccgcuuugacucaugggucaaccaauucuacacccuugcucccaugggcaacggcaccggccgacgacgauaa

SEQ ID NO: 38509 - RNA, 1617 nt, Artificial Sequence
  derived and/or modified sequence opt11 from VP1__Norovirus_and/or_Norovirus-like__AB541333
augaagauggcaagcaacgacgccaaccccuccgacggcuccgcugccaaccuaguacccgaagucaacaacgaagucauggcccucgaacccgucgucggugccgcaaucgccgcacccgucgccggccaacaaaacgucaucgaccccuggauacgaaauaacuuuguacaagcaccaggcggagaauuuaccgucuccccacgcaaugccccaggcgaaauccucugguccgcaccccucgaccccgaccuaaacccauaucucucacaacucgcccguauguacaacggcuaugccggcggcuucgaaguccaagucauccuggcaggcaacgccuucaccgccggcaaaaucaucuucgcagcagucccacccaacuuccccacagaaggccucucccccucccaaguuaccauguucccccauaucaucguugauguccgccaacucgaaccaguacuaaucccccucccagauguccgaaacaacuucuaccacuacaaccaauccaacgacuccacaaucaaacuuaucgcaaugcucuauaccccacuccgagccaacaaugcuggcgaagacgucuucaccgucucaugucgaguacucacccgucccucccccgacuucgauuucaucuuccuagucccacccaccgucgaaucccgaaccaaaccauucacaguccccauacuaaccguagaagaaaugaccaacucgcgcuucccaaucccacucgaaaaacuauucacaggacccucaagugccuucgucguccaaccccaaaacggccgcugcaccaccgacggcguccuccuaggcaccacucaacucucccccgucaacauaugcaccuuccgcggcgacgucacccacaucgcaggcucccgcaacuacacaaugaaccucgccucccuuaacuggaacaacuacgaccccaccgaagaaauccccgccccauuaggaacccccgacuucgucgguaagauccaaggcguccucacccaaaccaccaaaggcgacggauccacucgcggccacaaagcaacaguuuacaccggcuccgcucccuucaccccuaaacuuggcuccgugcaauucuccacugacaccgaaaacgacuucgaaacccaccaaaacacaaaauucaccccagucggcgucauccaagacgguggaaccacccaccgcaacgaaccccaacaguggguucucccuucauacuccggacggaacguccccaacguccaccuagcucccgcaguagccccaacauuccccggcgaacaacuccuauucuuccguagcaccaugcccgggugcuccgguuaucccaacauggaccuagacugcuuacucccacaagaauggguccaacacuucuaccaggaagccgcccccgcacaguccgacgucgccuuauugcgcuucguaaacccagacacaggccguguccucuucgaaugcaaacuacacaaauccggcuacgucaccgucgcacauacaggccaacacgaucuagucauacccccaaacggcuacuuccgcuucgacuccuggguaaaccaauucuacacccuugcuccgaugggcaacggaacaggccgcagacgcuga

SEQ ID NO: 38510 - RNA, 1617 nt, Artificial Sequence
  derived and/or modified sequence opt11 from VP1__Norovirus_and/or_Norovirus-like__AB541220
augaaaauggccucgaacgacgccaaccccuccgacggcuccgcggccaaccuaguucccgaagucaacaacgaaguaauggcacucgaacccgucgucggcgcugccaucgccgcccccguagccggccaacaaaacgucaucgaccccuggauccgcaacaacuucguccaagcacccggcggcgaguucaccguaaguccccgcaacgccccaggcgaaauccucugguccgcaccccugggaccagaccucaacccauaucucucccaccucgcccgcauguacaacggguacgccggaggcuucgaaguacaaguaauacucgccggcaacgccuuuaccgccggcaaaaucaucuucgccgccguuccuccaaacuucccaacugaaggcuugucuccuucacaaguaaccauguucccgcacauaaucgucgacguacgccaacucgaacccguacucaucccacuccccgaugucagaaacaacuucuaccauuacaaccaauccaacgacuccaccauaaaauuaaucgccaugcuuuacacuccccuccgcgcaaacaacgccggggaagacgucuuuaccguauccugccgaguccuuacccgacccagcccagacuucgacuucauauuccucgucccacccaccgucgaaucucgcaccaaaccauucaccguccccauacucaccguugaagaaaugaccaacucccgcuucccaauuccccuagaaaaacucuucaccggccccuccucugcauucgucguacaaccacaaaacggacgaugcaccaccgacgggguucuccuugguaccacccaacucucacccguaaacaucugcaccuuccgcggagacgucacccacauagccggaucaagaaacuacaccaugaaccucgccucccucaacuggaacaacuaugacccgaccgaagaaauccccgcaccccucggcaccccagacuucguuggcaaaauccaagggguacucacccaaaccacuaaaggcgacggaagcacacgcggccacaaagccaccguguacaccggcagcgcccccuucacccccaaacucggcuccguccaauucuccaccgauacagaaaacgacuucgaaacccaccaaaacaccaaauucacccccgucggcguuauccaagacggcgguaccacacacagaaacgaaccccaacaauggguacuaccauccuacagcggccguaacguccccaacguccaccucgcaccggccguagccccaaccuuccccggcgaacaacuccucuucuuccgcucaaccaugcccggaugcuccgguuacccaaauauggacuuagacugccuacucccccaggaauggguccaacacuucuaccaagaagcagccccggcacagucagacgucgcccucuuacgcuuugucaaccccgacacaggccgcguacuuuucgaaugcaaacucuauaaauccggcuacgucaccguugcccacacaggccaacacgaccuagucaucccacccaacggcuacuuccgcuucgacucaugggucaaccaauucuauacccucgcacccaugggcaacgguacaggccgacgccguuaa

SEQ ID NO: 38511 - RNA, 1617 nt, Artificial Sequence
  derived and/or modified sequence opt11 from VP1__Norovirus_and/or_Norovirus-like__AB504312
augaaaauggcauccaaugacgccacucccucggauggaucaacagccaaccucguccccgaagucaacaacgaagucauggcccucgaacccguagucggcgccgcaaucgccgcccccguagcaggccaacagaacgucaucgaccccuggauccgcaacaacuucguccaagcucccggcggcgaauuuaccguaucaccccgaaacgcccccggugaaauccuuugguccgccccauuaggccccgaccucaaccccuaccuaucacaccucgcccgcauguauaauggcuacgccggcggauucgaaguccaaguaauucucgccggaaacgccuucaccgccggcaaaaucaucuucgcagccgucccuccuaacuuccccaccgaaggacuaucacccucucaagucacaauguucccucacaucaucguagacguccgccaacucgaacccguccucauaccacuccccgaugugcgcaacaacuucuaccacuauaaccaguccaacgacuccaccaucaaacucaucgccaugcucuacacaccccuccgugccaacaacgccggugacgacgucuucaccguauccugccgcguacucacacgccccucacccgacuucgauuucauuuuccuuguaccaccuaccguagaaucacguaccaaacccuucucuguccccauucucaccguagaagagaugaccaacucccgcuuccccaucccucucgagaaacuauucaccggcccauccuccgcauucgucguucaaccccaaaauggacgaugcacuaccgacggcguacuccugggcaccacccaacuaucccccgucaacaucugcaccuuucgaggcgacguaacccacaucgccggcacucaaaacuacaccaugaaccucgccucccagaacuggaacaacuacgaccccaccgaagaaauuccagcaccccuuggcacuccagacuucgucggaaaaauccaagguguacucacucagaccacccgccgagacggcaguacccgaggccacaaggccaccgucucaaccggcucuguacacuucacccccaaacuuggcuccguacaauucucuaccgacaccucaaacgacuucgaaacuggucaaaacacccgcuucacacccguaggcgucguacaagacggcuccaccacccaucaaaacgaaccccaacaguggguccuccccaacuacuccggccgcgacucccacaacguucaccuagcccccgccgucgcucccaccuucccaggcgaacaacuacucuucuuccguucgacgaugcccggcugcucuggauaccccaauaugaaccucgacugccuacuaccccaagaauggguccaacacuucuaccaagaaagcgccccagcccaauccgacgucgcccucuuacgcuucgucaaccccgacacaggacgcguauuauuugaaugcgaacuccacaaauccgguuacgucaccgucgcacauacaggccaacaugaccucgucaucccucccaacggcuacuuccgauucgacucaugggucaaccaauucuauacccucgcgcccaugggaaacggagcaggccgccgaagguaa

SEQ ID NO: 38512 - RNA, 1617 nt, Artificial Sequence
  derived and/or modified sequence opt11 from VP1__Norovirus_and/or_Norovirus-like__GQ849126
augaaaauggccucaagcgacgcaaacccaucagacggcucuaccgcgaaccucguccccgaagucaacaacgaagucauggcccucgaacccguagucggagccgcaauagccgccccugucgccggccaacaaaacgucauagacccguggauacgcaacaacuucguccaagcaccaggaggggaauuuaccgucagcccccgcaacgcccccggcgaaauucuaugguccgccccacuaggacccgaccucaacccuuaccucucacaccucgcaagaauguacaacucguacgccggaggcuucgaaguccaaguaauccuugcagguaacgccuucaccgccgguaaaaucaucuucgccgccguaccuccaaacuuccccaccgaaggccucucccccucccaagucacuauguucccccacaucgucgucgacguccgccaacuagaacccguccucaucccacuacccgacguccgcaacaacuuuuaccacuacaaccaaagcaaugaccccaccauuaaacucaucgcuaugcucuacacccccuuaagagcaaacaaugcaggcgacgacgucuuuaccguaucuugccguguccucacccgccccucacccgauuucgauuucauauuccuaguaccucccacugucgaaagccggaccaaacccuucuccguccccauccuaaccgucgaagaaaugaccaauucacgcuuccccaucccacucgaaaaacuuuucaccggcccaucauccgccuucgugguacaaccccaaaacggccgcugcacaaccgacggcguauuacucggcaccacacaacuaucaccaguaaacaucugcacauuccgaggaaacgucacccacaucgccggcacacaagaauauaccaugaaccuagcgagccaaaacuggaacaacuacgaccccaccgaagaaaucccagcaccccuaggaaccccugacuuuguaggcaagauccaaggaguccucacccaaaccacccgccgcgacggaucaacccguggacacaaagccacgguaucaacaggaucaguccacuucaccccaaaacuaggccgaauccaauucagcacagacaccuccaacgacuucgaaacaggacaaaacaccagauucacccccgucggcguaguccaagacggauccaccacccaccaaaacgaaccucaacaauggguacuaccaaacuauagcggccgcgacucacacaacguccacuuagccccagcagucgcucccucuuuccccggcgaacaacugcuauucuuccgauccacaaugcccgggugcucaggauaccccaacaugaaccucgacugccuacucccccaagaauggguccaacacuucuaucaggaggccgcccccgcccaauccgacgucgcccuacuaagauucgucaaucccgauacuggcagaguccuauucgaaugcaaacuccacaaauccgguuacgucaccgucgcucacaccggccaacacgaccucgugauuccucccaacggcuacuuccgauucgacuccugggucaaccaauucuacacacuagcacccauggguaacggcaccggccgccgccgauaa

SEQ ID NO: 38513 - RNA, 1617 nt, Artificial Sequence
  derived and/or modified sequence opt11 from VP1__Norovirus_and/or_Norovirus-like__AB447459
augaaaauggccuccaacgacgccaacccguccgacggcuccgccgcaaaccuaguccccgaggucaauaacgaaguaauggcccucgaaccagucgucggcgccgccaucgccgcccccguugccggacaacaaaaugucaucgacccuuggauccgcaauaauuucguccaagcacccggcggcgaguucacagucucaccacgcaacgcucccggagaaauucucugguccgccccucucggcccugaucuaaacccuuaccuaucccaccucgcucgcauguacaauggcuacgcaggcggcuucgaaguccaagucauccuggccggcaacgccuucacagccggaaagaucauauucgcagcagucccacccaauuuccccaccgaaggacucucccccucacaaguaaccauguucccacacaucaucgucgacguccgccaacucgaacccguccucaucccccuaccagacguucgcaacaacuucuaccacuacaaccaauccaacgacuccaccauaaaacucaucgcuaugcuauauaccccucuacgugccaacaaugcuggagaagacguauuuacaguaucaugccgcguccucacccgccccucaccugacuucgauuucaucuucuuagucccacccaccgucgaaucacgaaccaaacccuuuaccguaccaauccuaacaguugaagaaaugaccaacucccgauuccccaucccccuagaaaaacuauucaccggccccuccggugcuuucguaguccaaccccaaaacggccgcugcaccacugacggcguacuccucggcacaacacagcuuucaccagucaacaucugcaccuuccgcggagacguaacccacaucgccggcucacgcaacuacaccaugaaccucgccagccuuaacuggaacaacuacgaccccacggaagaaauccccgcaccucuaggcacccccgacuucguuggaaaaauccaaggccuccucacucaaaccaccaaaggagacggcucuacacgcggacacaaagccaccgucuacacagguagcgccccauucaccccaaaacugggcuccguccaauucuccacagacacugaaaacgacuucgaaacacaccaaaacacaaaauucacccccgucggcguaauucaagacggcucuacaacccaccguaacgaaccccaacaauggguccugcccucauacuccggacgaaacguacauaacguccaccucgccccagccguugcuccaaccuucccaggagaacaauuaauauucuuccguucaacaaugcccgggugcuccggcuaccccaacauggaccucgacugccuccucccucaagaauggguccaacacuucuaccaagaagccgccccagcccaauccgacgucgcccuucucagauucgucaaccccgacacgggccgcguccucuucgaauguaaacuacacaaauccggcuacguaacagucgcccauaccggacaacacgaccucgucaucccacccaacggcuacuuccgauucgacuccugggucaaccaauucuacacacucgcccccaugggcaacggcaccggccgccgccgcuaa

SEQ ID NO: 38514 - RNA, 1617 nt, Artificial Sequence
  derived and/or modified sequence opt11 from VP1__Norovirus_and/or_Norovirus-like__EU078413
augaagauggcuuccaacgacgccaaccccuccgauggcuccacugccaaccucguccccgaagucaacaacgaagucauggcccuugaacccgucguaggcgcugccaucgccgcacccgucgccggccaacaaaacgucaucgaccccuggauacgaaacaacuuuguccaagccccuggcggcgaauuuaccgucucaccccgcaacgcacccggugaaauccucugguccgcaccccucggccccgaccucaaccccuaccuuucccaucucgcccgaauguacaacggcuacgccggcggcuucgaaguccaaguaauccucgccggaaacgccuucaccgcaggaaaaauaaucuucgccgcaguacccccaaacuuuccaacagaaggacuaucccccucucaagucaccauguucccucacaucaucgucgacguacggcaacucgaaccuguccuuauacccuuaccagacguccgcaacaacuuuuaccacuacaaccaaucaaacgacuccaccauaaaacuaaucgccaugcuuuacaccccacuccgcgccaacaacgcaggcgacgacgucuucacagucagcugccgcgucuuaacccgcccaagcccagacuucgacuucaucuuccuagucccacccaccguagagucaagaacgaaacccuucaccguacccauccucaccguagaagaaaugaccaacucccguuucccaaucccucuggaaaaacucuucacaggccccuccggagcauuugucguccaaccccaaaacggacgcuguacaaccgacgguguccuacuaggcaccacucaacuuucgccaguaaauauuugcaccuuccgcggcgaugucacacacaucgccgguacacgaaacuacacgaugaaucucgccucgcaaaacuggaacaacuacgaccccaccgaagaaauccccgcuccucuaggcacccccgacuuugucggucgcauccaaggaaugcucacacaaaccacccgccgagacggcucaaccagaggccacaaagccaccgucuccacaggcgaugcucacuuuacaccaaaacucggcuccaucauguucucaaccgacacagacaacgacuucgaaacuggccaaaacacaaaauucacccccgucggcgucguccaagacggaaacggcacccaccaaaacgaaccacaacaguggguccuucccuccuauucuggccgcaccggacacaacguacaccucgcgccagccgucgcccccaccuuccccggcgaacaacuccucuucuuccgcucaacaaugcccggcuguuccggcuaccccaacaugaaccuagacugccuucuuccucaagaauggguccaacacuucuaccaagaagccgcccccgcacaauccgacgucgcccuacuacgcuucguaaacccagacaccggcagaguccucuuugaaugcaaacuccacaaauccggauacgucacagucgcacacacaggacaacacgaccuaguaauacccccaaacggcuacuuccgcuucgacucauggguaaaccaauucuacacccuagccccaauggguaacggaaccggccgccgacgauaa

SEQ ID NO: 38515 - RNA, 1617 nt, Artificial Sequence
  derived and/or modified sequence opt11 from VP1__Norovirus_and/or_Norovirus-like__EU078411
augaaaauggcaucaaacgacgccucaccauccgacggcuccaccgccaaccucguaccagaagucaacaacgaaguaauggcccucgaaccagucgucggcgcagccaucgccgcccccgucgcaggacaacaaaacguaaucgaccccuggauccguaacaacuucguacaagccccuggcggagaguucaccgucucuccccgcaacgccccaggugaaauccucugguccgcaccccucggcccagaccucaacccuuaccucucccaccuugcccguauguacaacgguuacgccggcggcuucgaaguacaagucauccucgcaggcaacgcauuuacagcaggaaaaaucaucuucgccgcaguacccccaaacuuucccacagaaggccucuccccaucccaagucaccauguucccgcacaucauuguugacguccgccaacuagaacccguucuaauccccuuaccugacguccgcaauaacuucuaccacuacaaccaauccaacgacccuacaaucaaacuaaucgcaaugcuauacacaccccuucgagccaacaacgccggugacgacguauucaccgucucaugccgcguacuaacccgaccuucaccagacuucgacuucaucuuccuuguucccccuaccgucgaaucacgcaccaaaccuuucaccguccccauacuaaccgucgaagaaaugaccaacucccgcuuccccauaccccuagaaaaacuuuucacaggcccauccuccgccuucgucguccaaccccaaaacggccgcuguacaaccgacgguguccuacuuggcaccacacaacucuccccaguuaacauaugcaccuuccgaggcgacguaacacacaucccuggcacccguacauaccgaaugaaccuagcuucucaaaacuggaauaacuacgacccaaccgaagaaauaccagcuccauuagguacacccgacuucgucggcaaaauccaaggcaugcucacccaaaccacaaaaggugacggcuccacccgcggccacaaagcaacugucucaacaggauccgucgauuucaccccaaaacucggcuccguccaauucgccacagacacagacaacgacuucgaaacaggccaaaacacccgcuucacaccaguaggcguaauccaagacggcuccuccgcccaccgcaacgaaccacagcaguggguucucccagacuacagcggccgcaccguccacaacguacaccucgcaccagcaguagcucccacuuucccaggcgagcaacuccucuucuuccguucaaccaugcccggcuguagcggauacccaaacauggaccucgacugccuucuaccccaagaauggguacaacacuucuaccaagaagccgcacccgcccaauccgacgucgcccuccuccgcuucgucaaccccgacacaggacguguccucuucgaaugcaaacuccacaaaaccgguuacgucacuguagcucauaccggccaacacgaccuaguaauucccccaaacgguuacuuccgcuucgacucauggguaaaccaauucuacacccucgcccccaugggaaacggcgccggucgcagaagauaa

SEQ ID NO: 38516 - RNA, 1617 nt, Artificial Sequence
  derived and/or modified sequence opt11 from VP1__Norovirus_and/or_Norovirus-like__AB385632
augaaaauggccagcuccgacgccaaccccucagacggcuccaccgccaaccuagucccagaagucaacaacgaagucauggcacucgaacccgucgucggcgccgccaucgcagcaccaguugccggccagcaaaacgucaucgaucccuggauccgaaacaauuucguccaagcacccggaggagaauuuaccgucuccccacguaacgcucccggcgaaauccucugguccgcaccccuaggccccgaccucaaccccuaucuuucacaccuagcccguauguacaacuccuacgcaggaggcuucgaaguucaaguaauucuagcuggaaacgccuucaccgcaggcaaaaucgucuuugccgccguaccucccaacuuucccaccgaaggccucucccccucacaagucaccauguucccccacaucaucguagacgucagacaacucgaaccaguccucaucccacuaccagacguccguaacaauuucuaucacuacaaccaauccaaugacccaaccaucaaauuaaucgccauguuauacacaccacuccgcgccaauaacgccggagacgaugucuucacaguauccugccgaguccucacucgucccuccccggacuucgacuucauauuccucguucccccuacagucgaaucacguacaaaacccuucucaguuccaauccucacagucgaagaaaugacaaacucacgcuuccccaucccccuggaaaggcuauucaccgguccauccuccgcauucguaguacaaccccaaaacggcagaugcaccaccgacggcguccuccuuggcaccacucaacucagccccgucaacaucugcaccuuccguggcgacgucacccauaucgccggcacacaagaauacaccaugaaccucgcuucccaaaacuggaacaacuacgacccgaccgaagaaguccccgcaccccuaggcacacccgacuuuaugggcaaaauccaaggaguccucacacaaacaacccgcagagacggcuccacccggggccacaaagccaccgucuccacuggauccguccacuucacacccaaacuuggccguauccaauucuccaccgacaccucaaacgacuuugaaaccggccaaaacacccgcuucacacccgucggcguuguccaagacggaucuaccacccaucaaaacgaaccacaacaauggguacuacccaacuacucaggacgcgacucccacaacguccaucucgcccccgcagucgcccccucauuccccggagaacaacuacucuucuuccgcuccaccaugccaggauguucaggauacccaaacaugaaccucgacugccuccuaccccaagaauggguccaacacuucuaccaagaagccgcccccgcgcagucagacgucgcccuccuacgauucgucucaccugacaccggccgaguucuauucgaaugcaaacuacacaaauccggcuacgucaccgucgcccacaccggacaacacgaccuugucauaccacccaacggcuacuucagauucgacucaugggucaaccaauucuauacccuugcaccaaugggaaacggcacuggccggcgccguuaa

SEQ ID NO: 38517 - RNA, 1617 nt, Artificial Sequence
  derived and/or modified sequence opt11 from VP1__Norovirus_and/or_Norovirus-like__EU839595
augaaaauggccaguaacgacgcaaaucccucagacggcucagcagccaaccucgucccagaggucaacaacgaagucauggcccuagaacccgucguaggagccgcaaucgccgcccccgucgccggccaacaaaacgucaucgaccccuggauccgcaauaauuucguccaagcacccggcggcgaguucacagucucaccccgcaacgcacccggcgaaauacuaugguccgccccgcuaggacccgaccuaaacccauaccucucacaccucgcgcgcauguacaacggcuacgccggcggauucgaaguccaagucauccuagcaggcaacgccuucacggccggaaaaauaaucuucgccgccgucccacccaacuuccccaccgaaggacucagccccucucaagugacaauguucccccacauaaucgucgacguucgucaacuagagcccguacuaaucccucuacccgacguccguaacaacuucuaccacuacaaccagucaaacgacagcacaaucaaacuaauagccaugcuauacacuccccuccgagcuaacaacgccggcgaagacgucuucacggucucaugccgcguacucacccgacccaguccaggcuucgacuucaucuuccucgucccaccaaccgucgaaucccgaaccaaacccuucaccguccccauacucaccguugaagaaaugacuaacucacgcuucccuaucccacuagaaaaacucuucaccggccccagcucagccuucguaguccaaccacaaaacggacgcugcaccaccgacgggguccuccuuggcacuacacaacuuagccccgucaacauaugcaccuuccgaggcgacguaacacacauagcgggcucccgaaacuacaccaugaaccucgccucacuaaacuggaacaacuacgacccaaccgaagaaauccccgcaccacuagguaccccagacuucguaggcaaaauccaaggcguccuaacucaaaccaccaagggagacggauccacacgcggccacaaagcaacaguauacaccggcucagccccguucacacccaaacucggauccguccaauucuccacagacaccgaaaacgacuucgaaacacaucaaaacaccaaauucacccccgucggagucauccaagacggaggcaccacacacagaaacgagccccaacaauggguccuacccuccuacucuggccgcaacguccccaacguccaccuggccccugccgucgcccccaccuucccaggagagcaacuucucuucuuccgcucaaccaugcccggauguuccggauaccccaauauggaccucgacugccuccucccacaagaauggguacaacacuucuaucaagaagcagcccccgcccaauccgacgucgcccuccucagauucgucaaccccgacaccggccgcguccucuucgaaugcaaacuccacaaaucaggcuacguaaccguagcacacaccggacaacaugaccucgucaucccacccaacggcuacuucagauucgauagcugggucaaccaauucuacacccuugcccccaugggcaacggaaccggccgacggagauaa

SEQ ID NO: 38518 - RNA, 1617 nt, Artificial Sequence
  derived and/or modified sequence opt11 from VP1__Norovirus_and/or_Norovirus-like__AB294788
augaaaauggccucaaacgacgcaacccccucagacggcucaacagccaaccuaguccccgaagucaacaaugaagucauggcccucgaacccguugucggcgccgccaucgccgcaccaguagccggccaacaaaacguaauugacccauggauccgaaacaacuucguccaagcacccggaggagaguucacagucagcccgcguaacgcccccggagaaauacuuuggucagcuccccucggccccgaccucaaccccuaccucucccacuuagcccgcauguacaacggcuaugccggcggcuucgaaguccaaguaauccuggccgguaacgccuucaccgccggcaaaaucaucuucgccgccguacccccaaacuucccaaccgaaggccuaucuccaucgcaggucaccauguucccccacaucauagucgacguccgacaacucgaacccguccucaucccacuucccgacguccgaaacaacuucuaccacuauaaccaauccaacgacuccacaaucaaacucaucgccaugcucuacacaccccuccgcgccaacaacgcaggagacgacguauucaccgucuccugccgcguacuaacccgaccuucccccgacuucgacuucauauuccuaguaccaccaaccguagaaucgcgaaccaaacccuucagcguaccaauccuaaccgucgaagaaaugaccaacucccgcuucccaaucccccucgaaaaacuauucacuggccccuccagcgcauucgucguacaaccccaaaacggccggugcaccacagacggcguacuccucggaaccacccagcuauccccagucaacaucugcaccuucagaggcgacgucacacacaucgcaggcacgcaaaacuacacuaugaaccuagccucacaaaacuggaacaauuacgacccaacagaagaaaucccagcaccccuaggcacaccagacuucguagguaaaauccaaggcguccucacacaaacgaccacccgcgacggcuccacccgcggacacaaggccaccguaucuacaggcuccguucacuucaccccuaaacuugggucaguccaauucuccaccgacaccuccaacgacuucgaaacuggacagaacacccgauucacccccgucggagucguccaagacgguuccacaacccaccaaaacgaaccccagcaauggguccuucccgacuacuccggccgcgacucucacaacguccaccucgccccagccgucgccccuaccuucccaggcgaacaacuccucuucuuccgcuccacaaugccaggcuguucaggcuacccaaacaugaaccucgauugccuccucccacaagaauggguccaacacuuuuaccaagaauccgccccugcucaaucugacguagcccucuuacgcuucgucaacccagacacaggccgaguccuauucgaaugcaagcuacacaaauccggauacguaaccgucgcccacaccggccaacacgaccuuguaaucccaccaaauggauacuuccgauucgacuccugggucaaccaauuuuacacacuagcccccaugggcaauggcgccggccgccgacguuaa

SEQ ID NO: 38519 - RNA, 1617 nt, Artificial Sequence
  derived and/or modified sequence opt11 from VP1__Norovirus_and/or_Norovirus-like__AB303936
augaaaauggccuccaacgacgccaccccauccgacggcucaaccgccaaccucgucccagaagucaacaacgaagucauggcacucgaacccgucgucggugccgcaaucgcagcaccagucgccggacaacaaaacguuaucgacccuuggauccgcaacaacuucguccaagcccccggcggcgaguucaccgucuccccaagaaacgcucccggugaaauccuuugguccgcaccccuagguccugaccucaaccccuaccuaucucaccucgccagaauguacaacggcuacgccggcggauucgaaguccaagucauccuagccggcaacgccuucaccgccggcaaaaucaucuucgccgccgucccacccucauuucccaccgaaggccuaucccccucccaagucaccauguucccccacauaaucguugacguaagacagcucgaaccagugcucaucccccuccccgacguccgcaacaacuuuuaccacuacaaccaauccaacgaccccaccaucaaauuaaucgccaugcucuacacaccccuacgagcaaacaacgccggugaagaugucuucaccguaucgugccggguacucacccgcccaucccccgacuucgauuucaucuuccucguuccucccacuguagaauccagaaccaaaccauucacgguccccauccucacaguagaagaaaugacgaacucccgguuccccauuccccuagaaaaacucuucacuggacccuccggcgccuucguaguccaaccccaaaacggacgaugcaccaccgacggcguccuccucgguaccacacaacucucccccguuaacaucuguaccuuccgcggagacgugacccauaucgccggaacccacaacuacacuaugaaccucgcaagccagaacuggaauaauuaugaccccaccgaagaaauccccgcaccccucggcacaccggacuucguaggccgcauccaagggaugcucacgcaaaccacccgcggcgacggcucuacucgaggccauaaagccaccgucucaacaggcgacguccacuucacccccaaacucggcuccguucaauucgacaccgauaccaacuccgacuucgaaaccggacagaacacuaaauucaccccgguaggaguaguccaagacggcaacggagcccaccaaaacgaaccacaacaauggguccuccccuccuacucgggccgaacaggacacaacgcccaccucgcccccgccgucgccccaaccuuccccggcgaacaacuccuauucuuccgaucaaccaugcccgguugcuccggauaccccaacaugaaccucgacugucuccuuccccaagaauggguccaacacuuuuaccaggaagccgcacccgcccaauccgacguagcccuacuaagauucgucaacccugacaccggaagaguacuuuucgaaugcaaacuccacaaauccggcuacguaaccgucgcccacacaggacaacacgaccuaguuaucccucccaacggcuacuuccgauucgacuccugggucaaccaauucuacacccucgcaccaaugggcaacggcacaggccgucgccgauaa

SEQ ID NO: 38520 - RNA, 1617 nt, Artificial Sequence
  derived and/or modified sequence opt11 from VP1__Norovirus_and/or_Norovirus-like__AB303935
augaaaauggccuccaacgacgcaaaccccuccgacggauccacagccaaccuaguacccgaagucaacaacgaagucauggcucuagaaccagucgucggcgcagccaucgcagcaccagucgccggccaacaaaacgucaucgacccuuggauacguaacaacuucguccaggccccuggaggagaguucaccguaucgccacgcaacgcacccggcgaaauccuaugguccgcuccacucgggcccgaccuaaaccccuaucuuucacaccuagcccgcauguacaacggauacgcaggaggcuucgaaguccaagucauucucgccggcaacgcauucaccgccggcaaaaucaucuucgccgccguacccccuucuuuccccacagaaggccucucacccucccaagucaccauguucccccacaucauagucgacguccgacaacuagaaccaguccucaucccacucccugacgucagaaacaacuucuaccacuacaaccaauccaacgaccccacaaucaaacucauagccaugcuauacaccccacuccgcgccaacaacgcaggcgaagacgucuucacagucagcugccgcguucucacccguccaucacccgauuucgacuucaucuuccuugucccacccacaguugaaucccgcacaaaaccauucacaguaccaauucucaccgucgaggaaaugaccaacucuagauucccaaucccccucgaaaaacuauucaccgggcccucaggugccuucguaguacaaccacaaaacggccgcugcacaaccgacgguguacuccucggcaccacccaacuaagccccguaaacaucugcaccuuccgaggcgacgucacacacaucgccggaacccacaacuacaccaugaaccuagccucccagaacuggaacaacuacgauccaacagaggaaaucccagcuccccucggcacccccgacuucguaggcagaauccaaggcaugcucacacaaaccaccagaggcgacggcuccaccagaggacacaaagccaccguaucaaccggcgacguacacuucacacccaaacucggcucuauccaauucaacaccgauaccaacaacgacuucgaaaccggacaaaauaccaaguucaccccaguaggcguaguucaggauggcaacggcacccaccaaaacgaaccccaacaauggguccuccccuccuacuccggacgaacaggccacaacguccaccuagccccagccgucgccccaaccuuuccaggggaacaacuccucuucuuccgcuccaccaugcccggcugcuccggcuacccaaacaugaauuuagacugucuccucccccaagaguggguucaacacuucuaccaagaagccgcucccgcacaaucagacgucgcacuccuacgcuucguaaacccagacaccggaagagugcuguucgaaugcaaacuacacaaaucgggauacgucacagucgcccacaccggacaacacgaccuaguaaucccaccaaacgguuacuucagauuugacuccuggguaaaccaauucuacacacucgcacccaugggcaacggaaccggccgucgacgcuaa

SEQ ID NO: 38521 - RNA, 1617 nt, Artificial Sequence
  derived and/or modified sequence opt11 from VP1__Norovirus_and/or_Norovirus-like__AY588018
augaagauggcaucuaacgacgcaaacccuagcgacggcucaaccgcaaaucucguaccagaagucaacaaugaaguuauggcccuagaaccagucgucggagcagccaucgccgcccccgucgccggacaacaaaaugucaucgaccccuggauccgcaacaacuucguacaagcacccggaggugaguucaccgucagcccacguaacgcccccggcgaaauccucuggucagccccauuaggaccugaccucaaccccuaccucucacaccuagcccgcauguacaauggcuacgccggagguuucgaaguccaagucauccucgccggcaacgcguucaccgcaggcaaaaucauuuucgccgccgucccucccaacuuccccaccgaaggacucucacccucccaagucaccauguucccacacaucauagucgauguccgacaacuagaacccguccucaucccccucccagauguacgcaacaacuucuaccacuacaaccaaucgaacgaucccacaauaaagcucaucgccaugcuauacaccccacuacgcgccaauaacgccggcgaagacgucuucacaguauccugccgcguacuaacccgccccuccccagacuucgacuuuauauuccuagucccacccaccgucgaaucucgaacaaagcccuucaccguccccauccucaccgucgaagaaaugaccaacucccgcuucccaaucccccucgaaaaacuauucaccggcccauccggugcauucgucguacaaccccaaaauggacgaugcacaacagacggaguccuucuuggcacaacccaacuuucccccgucaacauauguacauuccgcggagacgucacccacaucgcuggcacccacaacuacaccaugaaccucgccucccaaaacuggaacaacuacgaccccaccgaagaaauccccgcuccccucggcacccccgacuucgucggccgcauccaaggcaugcucacacaaaccacccgaggcgacggaucaacccgaggccauaaagccaccgucuccaccggcgacguacacuucacaccaaaacugggcucaguccaauucaacaccgacacaaacaacgacuucgaaacaggucaaaacaccaaauucacaccuguuggugucguucaagacggaaauggggcccaccaaaacgagccccaacaauggguccuccccuccuacucaggacgcacuggccauaacguccacuuagcucccgccgucgcacccaccuuccccggcgagcaacuacuauucuuccgcuccaccaugcccggcugcuccggcuacccuaacaugaaccucgacugccuccuaccccaagaauggguacaacacuucuaccaagaagccgcccccgcccaaucugauguagcucugcuacgcuucgucaaccccgacaccggcagaguccucuuugaaugcaaacuucacaaauccggauacgucaccguagcccacaccggccaacacgaucuagucauacccccuaacgguuacuuccgcuucgacucuuggguaaaccaauucuacacccucgcccccauggguaacggcaccggccgacgacgcuaa

SEQ ID NO: 38522 - RNA, 1617 nt, Artificial Sequence
  derived and/or modified sequence opt11 from VP1__Norovirus_and/or_Norovirus-like__KU678203
augaaaauggccuccucugacgcaaaucccucagauggcuccgccgccaaccuuguccccgaagucaacaacgaaguaauggcccucgaacccgucguaggcgccgccaucgcagcuccugucgccggacaacaaaacguaaucgaucccuggauccgaaacaacuucguucaagccccaggcggagaguucacagucucuccccgcaacgcccccggcgaaauacucugguccgccccacucggacccgaccucaaccccuaccuaucacaccuagcccgaauguacaacggcuacgccggcggcuucgaaguccagguaauccuggccgguaacgccuucaccgccggcaaagucaucuucgcugcagucccgcccaacuuccccacagaaggccuaagcccaucacaggucaccauguucccacacauagucgucgacguacgccaacuagaaccaguccucaucccccuaccagacguccgaaacaacuucuaccauuacaaccaauccaacgaccccaccaucaaacucauagcuaugcuuuacaccccacuccgagccaacaacgccggagacgacgucuucacaguaucaugucgcguacugacccgaccaucgcccgauuuugacuucaucuuccuaguaccacccacagucgaaucaagaaccaaacccuucucaguucccguacucaccgucgaagaaaugacaaacagccgcuuccccaucccccucgaaaaacucuucaccggccccuccagugccuucgucguccaaccccaaaacggccggugcacaacagacggcguccuccuuggcaccacccaauuaucuccagucaacaucugcaccuuccgaggagacgucacccacaucacuggcucacacaacuacacaaugaaucucgcuucccaaaacugguccaacuacgacccaaccgaagaaaucccagccccacuaggcacacccgacuucgucgguaagauccaaggcguacuaacccaaacaaccagaacagacggauccacacgcggccauaaagcaaccgucuacaccggaucggccgacuucgcccccaaacucggucgcguacaguucgaaaccgauaccaaccacgacuucgaagcaaaccagaacaccaaauucacucccgucggagugauacaagacggaggaaccacccaccgcaacgaaccacaacaauggguccuacccuccuacagcggccguaacacccccaacguccaccucgccccagcagucgcccccaccuucccaggcgaacaacuccuauucuuccgcuccaccaugccgggauguuccggauacccaaacauggaccuugacugccuccucccccaagaauggguccaauacuucuaccaagaagccgcccccgcucaauccgacgucgcacuacuccgcuucguaaaccccgacaccggccgcguccuauucgaaugcaaacuacacaaauccggcuacguuacaguagcgcacacaggccaacaugaccuagucaucccacccaacggcuacuuccgcuucgacucuuggguaaaccaauuuuacacccucgcacccaugggcaacggcaccggccgccgacgcuaa

SEQ ID NO: 38523 - RNA, 1617 nt, Artificial Sequence
  derived and/or modified sequence opt11 from VP1__Norovirus_and/or_Norovirus-like__KP176410
augaagauggcuucaagcgacgcaaacccaagugacggcucagcagccaaccucguccccgaaguaaauaaugaaguaauggcauuagaacccgucguuggugcugccauagccgcgcccgucgccggccaacagaacgucaucgauccuuggauccgaaacaacuucguccaagcaccaggcggcgaguucaccgucucccccagaaacgcccccggggaaaucuuaugguccgcaccccucggacccgaccuaaaccccuaccuuucacaccucgcccgcauguacaacggauacgccggcggcuucgaaguacaaguaauccucgcuggcaaugccuucacagccggaaaaguaaucuucgcagccguaccacccaacuuccccacagaaggacucuccccuucccaagucacaauguucccccacauagucgucgacguccgccaacucgaacccguacuaaucccacuacccgacguuagaaacaacuucuaccacuacaaccaauccaaugaccccaccauaaaacuaaucgcaaugcuauacacaccacuucgcgcaaacaacgcuggcgacgacgucuuuaccgucucaugcagaguccuaacacgacccucacccgacuucgauuucaucuuccucguaccacccaccguugaaucccgcaccaaacccuucuccguacccguacucacuguagaagaaaugaccaacuccagauuuccaauccccuuagaaaaacucuucaccggucccuccuccgccuucgucguccaaccccaaaacggccgcugcaccacugacggaguacuacucggaacaacacaacuuagcccagucaacauaugcaccuuccgcggagauguaacccacauaacuggcucgcgaaacuacaccaugaaucucgccucccaaaacuggucaaacuacgaccccaccgaagagauccccgcaccccucgggacacccgauuucguugggaaaauccaaggcguacucacgcaaaccacaagaaccgacggcuccacucgcggucacaaagccacggucuacaccggcagcgccgacuucgcccccaagcuaggacgcguacaauucgaaacagauaccgaccgcgacuucgaagccaaccaaaauaccaaauucacaccagucggagucauacaagacggcggcacaacccaccguaacgaaccacaacaauggguccuccccucauacuccggccgcaacaccccaaauguccaccucgcccccgcagucgcacccaccuuccccggcgaacaacuccucuucuuccgauccaccaugcccgguugcucaggauaccccaacaccgacuuagacugccuucuaccgcaagaguggguccaguacuucuaccaggaagccgcccccgcccaauccgacgucgcccuacuccgguucgucaacccagauaccggccgcguccuauucgaaugcaaacuccauaaaagcggcuacgucaccguagcacacacagggcaacacgaccucgucaucccacccaacggcuacuuccguuucgacucauggguaaaccaauucuacacacuagccccaaugggaaacggcacaggccgacgccgcuaa

SEQ ID NO: 38524 - RNA, 1617 nt, Artificial Sequence
  derived and/or modified sequence opt11 from VP1__Norovirus_and/or_Norovirus-like__KX371609
augaaaauggccuccaacgacgcaaaccccagcgacggcuccgccgccaaccucguacccgaaguaaacaacgaagucauggcccuagaacccgucgucggagccgccaucgccgccccaguagccggccaacagaacguaauagaccccuggauccgcaacaacuuuguccaggccccaggcggcgaauuuacaguuucaccacgcaacgcccccggcgaaauccucuggucagcaccccucggcccagaccucaaccccuaccucagccaccucgcccgaauguacaacggcuacgccggaggcuucgaaguccaagucauacucgccggcaacgccuucacagccggaaaaauuaucuucgccgccgucccacccaacuuccccacugaaggccucucacccucucagguuacaauguucccacauauaauagucgacguaagacaacuugaaccaguacuaaucccucuacccgacgucagaaacaacuucuaccacuacaaccaauccaacgauucgaccaucaaacucaucgcuaugcucuacaccccucuccgagcaaacaacgccggcgaagacgucuucacaguguccugccgaguccucacccgccccucccccgacuucgacuucauauuccucgucccacccaccgucgaaagccgcacaaaacccuucaccguacccauacugacagucgaagaaaugaccaauagccguuuccccauaccccuagaaaaacucuucaccggccccagcucagcauucgucguccaaccccagaacggccgcugcaccacagacggaguacuacucggaaccacccagcucuccccaguaaauaucugcaccuuccggggagacguaacccauaucgcaggaagccgcaauuacacuaugaaccuagccagccuuaacuggaacaacuacgaccccacagaagaaauccccgcaccacucggcacucccgauuucgucggcaaaauacaaggcaugcuuacccaaacgacccgaggcgacggauccacacgcggccacaaagccaccguauauaccgguucugcuccauucacaccuaaacucggauccguccaauucgaaaccgacaccgaaaaugacuuugaaacccaccagaacaccaaauuuacccccgucgguguuauccaagacgguggaaccacccaccgaaacgaaccccaacaauggguacuccccuccuauuccggccgaaacguaccuaacguccaccuagcaccagcagucgcccccaccuuccccggagaacaacuccucuucuuccgaucaaccaugccaggcugcucuggcuaccccaacauggaccucgacugccuccuaccgcaggaauggguccaacacuucuaccaagaagcagccccagcccaaucugacguagcacuccuacgcuucgucaaccccgacacaggccgaguacucuucgaauguaaacuacacaaauccgguuacgucacugucgcccacaccggacaacacgaccuagucaucccucccaacggcuacuucagauucgacuccugggucaaccaauucuacacacuugcccccaugggcaacgggaccggccgccgccgcuag

SEQ ID NO: 38525 - RNA, 1617 nt, Artificial Sequence
  derived and/or modified sequence opt11 from VP1__Norovirus_and/or_Norovirus-like__KX354130
augaaaauggccucaucagacgccaaccccucagacggcucagcugccaaccucguccccgaaguaaacaacgaaguuauggcccucgaacccgucguaggcgccgcuauagccgcacccgucgccggccaacaaaacgucaucgaccccuggauccgcaacaacuucguacaagcacccggaggagaguucacagucagcccccggaacgccccuggugaaauacuuugguccgcaccccuaggccccgaccuaaaccccuaccucucacaucuggcccgcauguacaacggcuacgcaggcggcuucgaaguucaaguaauucucgccgguaacgccuucacagccggcaaagucauauucgccgcagucccucccaacuuccccaccgaaggacucucccccucccaagucaccauguucccacacaucgucgucgacguccgccaacuagaaccaguccucaucccccucccagacgucagaaacaauuucuaccacuacaaccaaagcaacgaccccaccauaaaacuaaucgcuaugcucuacacaccccuccgcgccaacaacgccggcgacgacgucuuuacugucagcugccgcguauuaacccgccccucccccgacuucgacuucauauuccuaguacccccaacagucgaaucccgcacuaaaccauucuccguccccgucuuaaccguagaagaaaugaccaacucccgauucccuauuccccuagaacgccuauucaccggcccaucuuccgccuucguaguucaaccccaaaacggacgcugcaccaccgacggaguccuccuaggcacgacccaacuuuccccagucaacauuuguaccuuccgcggagacaucacccacaucaccggcucccauaacuauacaaugaaccucgccucccagaacuggaacaacuacgaccccaccgaagaaauccccgcaccccucggcacgcccgacuucgucggcaaaauccaaggaguacucacacaaacaacgagaaccgacgguucaacuagaggccacaaagccacagucuacacaggcuccgccgaguucgcccccaaauuaggccgaguucaauucgaaacagacaccaaucacgacuucgaagcuaaccaaaacacaaaguucacacccguaggagucauccaagacggaucaaccacccaccgcaacgaaccccaacaauggguccuccccucuuacuccggacgaaauacacacaacguccaccuagcacccgcaguugcacccaccuuucccggcgaacaacuccucuucuuccgcagcaccaugccuggcugcucaggcuaccccaauauggaccucgacugccugcuaccccaagaauggguccaauacuucuaccaagaagcagcccccgcacaauccgaugucgcacuccuacgcuucgucaaccccgacaccggacgaguccuauucgaaugcaaacuccacaaaucaggcuacauaaccgucgcacacacaggacaacacgacuuaguaauaccacccaacggcuacuucagauucgacuccugggucaaccaguucuacacccuugcccccaugggcaauggcaccggccgcaaacgauaa

SEQ ID NO: 38526 - RNA, 1617 nt, Artificial Sequence
  derived and/or modified sequence opt11 from VP1__Norovirus_and/or_Norovirus-like__KX354120
augaaaauggcauccucggacgccaaccccuccgacggcucugccgcaaaccucgucccagaagucaacaacgaagucauggcccucgaacccgucguaggagcagccaucgccgccccugucgccggacaacaaaaugucaucgacccuuggauccgaaauaacuuuguccaagccccaggcggcgaguucacaguaucuccacggaacgcacccggcgaaauccucugguccgcuccccuaggacccgaccucaauccauaucucucacaccucgcccgcauguacaacggauacgccggaggauucgaaguccaaguaauacuagcaggcaacgcuuucaccgccggaaaagucaucuuugccgccguaccacccaacuucccaaccgaaggccuaagcccuucacaagucacaauguucccccacaucgucgucgauguccgacaacucgaacccguacuuaucccacugccagacguccgcaacaauuucuaccacuacaaccaauccaacgacccgaccaucaaacucaucgccaugcucuacaccccacuacgagccaauaaugccggcgacgacguuuucacugucuccugccgaguccuaacccgccccuccccagacuucgacuucaucuuccucgucccacccaccguugaaucccgaacaaaacccuucucaguccccguccucacagucgaagaaaugaccaacagccgcuuccccaucccacucgaaaagcuauucacaggucccucauccgccuucguaguacaaccacaaaacggccgaugcaccaccgacggcguccuacucggaacuacucaacucucacccgucaacaucugcaccuuccgcggcgaugucacccacaucaccggcucaagaaacuacaccaugaaccucgcaucccaaaacugguccaacuacgaccccaccgaagaaauccccgcaccccuaggaaccccagacuucgucggaaaaauccaaggaaugcucacccaaaccaccagaaccgacgguuccaccagaggucacaaagccaccgucuacaccggcucagccgacuucgccccuaaacucggacgcguccaauucgaaacugacacagaccacgauuucgaagucaaucaaaacacuaaauuuacccccgucggcguaauccaagacggguccaccacccaccgcaacgaaccacaacaauggguucugccauccuacucaggacgcaacacaccgaauguccaccuugcccccgccgucgcucccaccuucccaggcgaacaacuccuauucuuccgcuccacuaugccaggcugcucaggcuaccccaauauggaucuagacugccuccucccccaagaauggguacaauacuucuaccaagaagccgcucccgcacaguccgacguagcacuccuccgauucgucaauccggacacaggccgaguccuauucgaaugcaaacuccacaaauccggcuacguaaccgucgcccacaccggccagcacgaccucgucauacccccaaacggauacuucagauucgacuccugggucaaccaauuuuacacucucgccccaaugggcaacggcacaggacgccgucgcuaa

SEQ ID NO: 38527 - RNA, 1617 nt, Artificial Sequence
  derived and/or modified sequence opt11 from VP1__Norovirus_and/or_Norovirus-like__KX354113
augaaaauggccuccuccgacgcuucacccucagacggcuccgccgcgaaccucguccccgaagucaacaaugaaguaauggcccucgaacccgucgucggagcagccaucgccgcccccguagcaggccaacaaaacgucaucgacccauggauccgcaacaacuuuguccaagcacccggaggcgaguucaccguaucaccuagaaacgcaccaggcgaaauccucuggagcgcaccccucggccccgacuuaaacccuuaccuuucccaccuagcccguauguacaauggcuacgccggcggcuucgaaguccaaguaauccucgccggaaacgccuucacugcuggaaaaguaauauucgcagcuguaccacccaacuuccccaccgaaggacucucccccucccaagucaccauguucccgcacauagucguugacguccgccaacuugaaccaguacucaucccacucccagacguccgcaacaacuuuuaccacuacaaccaaucaaacgaccccacaaucaagcucauugcaaugcucuacacuccccuacgcgccaacaacgcuggcgacgacgucuucaccguuuccugcagagugcucacccgccccucucccgacuucgacuucaucuuccucguucccccaaccgucgaaucccgcacaaaacccuucuccguccccguccuaacagucgaagaaaugacaaacucccgcuuccccaucccacucgaacgccucuuuaccggacccuccuccgccuucguaguacaaccacaaaacggacgcugcacaacagacggcguccuccucggcaccacucaacucucccccguaaacaucugcacauuccgaggcgacgucacccacaucaccgguucccgcaacuacacuaugaaccucgcuucccaaaacugguccaacuacgacccaaccgaggaaauccccgcgccgcucggaacucccgauuucguaggcaaaauccaaggcguccucacccaaaccacacgcaccgacggcuccacccgcggccacaaagccaccgucuacacaggcagcgcagacuucgccccaaaacucggccguguccaguucgaaacagacaccgaccacgauuuugaagccaaucaaaacaccaaauucacaccaguaggcgucauccaagauggcggaaccacccaccgaaaugagccccagcaauggguccuaccuucauauucuggccgcaacacacccaauguccaucucgcaccggccgucgcaccaaccuuccccggcgaacaacuacuauucuuccgcucaacaaugcccggcugcuccgguuaccccaacauggaucucgacugccuucucccccaggaauggguccaauacuucuaccaagaagcugcacccgcccaauccgacgucgcacuccuucgcuucgucaaccccgacaccggucgcguccucuucgaaugcaaacuccacaaaucgggauacguaacagucgcccacaccggccaacacgaccuugucaucccaccaaacggcuacuuccgcuucgacucguggguuaaccaauucuacacgcuagccccaaugggaaacggcacgggccgccggagauaa

SEQ ID NO: 38528 - RNA, 1617 nt, Artificial Sequence
  derived and/or modified sequence opt11 from VP1__Norovirus_and/or_Norovirus-like__KX354105
augaaaauggccuccucagacgcaaaccccucagacggcucagccgcaaaccuagugcccgaagucaacaacgaggucauggcacucgaacccgucguaggugccgccauagcugccccugucgcaggccaacaaaacgucaucgaccccuggauacgcaacaacuucguacaagccccaggcggagaauuuacagucaguccccgcaacgccccaggagaaauccucugguccgcaccccuuggccccgaccucaaccccuaccucucccaccuugcccgaauguacaacgguuaugccggcggcuucgaaguccaagucauccucgccggcaacgccuuuacagcuggaaagguuaucuucgccgcaguaccacccaacuuccccacagaaggccugucccccucucaagucaccauguucccacacaucguuguagaugucagacaacuggaaccaguccuaauucccuuaccagacguacgaaacaacuucuaucacuacaaccaaucuaacgaccccacaauaaaacucauagccauguuauacaccccacuucgcgcaaacaacgccggcgacgacgucuucacugucucuugccgaguccuaacccgcccuucccccgacuucgauuucaucuuccuugucccacccaccguagaaucccgaacaaaacccuucucuguucccguccucaccguagaagaaaugacuaacucacgcuuccccauaccccucgaaaaacuuuucacuggaccauccuccgcguucguaguccaaccacaaaacggccgaugcaccacugacggcguccuccuuggaacaacccaacugagccccgucaacauaugcaccuuccgcggagacguaacucacaucacaggcucccgcaacuacaccaugaaccuagccucacaaaacuggucgaacuacgauccaaccgaagaaauccccgcgccccuuggcacccccgacuucgucggaaaaauccaaggaguacucacccaaaccacccgcacugacgguucaacacgcggccacaaagccaccgucuacaccggauccgcagacuucgcacccaaacucggccgcguccaauucgaaaccgacacagaccgagacuuugaagccaaccaaaacaccaaauucacaccagucggagucauccaagacggcagcaccacccauagaaacgaaccacaacaauggguccuccccucauacuccggacgaaacacccccaacguccaccucgcccccgcagucgccccaaccuucccaggugaacaacuccuauucuuucgcuccacaaugcccggaugcucaggcuaccccaauauggaccucgacugccuucuaccacaagaguggguccaauacuucuaccaagaagcagcccccgcccaaucagacgucgcccuccuccgauucguaaaccccgacaccggacgcguccucuucgaaugcaaacuccacaaauccggcuacgucacaguagcucacaccggccaacaugaccucgucaucccacccaacgguuacuuccgauucgacuccugggucaaccaauucuacacucucgcacccaugggcaaugguaccggccgacgccgguaa

SEQ ID NO: 38529 - RNA, 1617 nt, Artificial Sequence
  derived and/or modified sequence opt11 from VP1__Norovirus_and/or_Norovirus-like__KX354077
augaaaauggcauccaacgacgcaaaccccuccgacggcuccgccgcaaaccucguacccgaagucaacaacgaagucauggcccuagaaccggucguaggcgccgccaucgcugccccagucgccggucaacaaaacgucaucgaccccuggauccgaaacaacuucguacaagcaccaggcggcgaguucacagucuccccacgcaacgcucccggagaaauccuaugguccgcuccacucggccccgaccucaacccauaccucucccaccuagcccguauguacaacggcuacgccggcggguucgaaguccaggucauccuugccggaaacgccuucaccgccggcaaaaucaucuucgccgccguacccccaaacuuucccacagaaggccuuucacccucccaagucaccauguucccccacaucaucgucgacguccgacaacucgaaccaguccuaaucccuuuacccgacguucgcaacaacuucuaucacuacaaccaauccaacgauuccacuaucaaauuaaucgcaaugcucuacacaccacuacgcgccaacaacgccggcgaagacgucuucaccguuagcugccguguacucacccgacccuccccugacuucgacuucaucuuccuugugccacccaccgucgaaucccgcaccaaacccuucaccguccccaucuuaaccguugaagaaaugacaaacucccgcuucccuaucccccucgaaaaacuauucacaggccccuccuccgcauucguaguccaaccacaaaauggccgauguacuacugacggcguccuccuaggcacaacccaacucucccccgucaacauaugcaccuuccgcggcgacguaacccacaucgccggcucgcgaaacuacaccaugaaccuagccagccuaaacuggaacaacuacgacccuacagaagaaauucccgcaccacuaggcacacccgauuucguaggcaaaauccaagguaugcuaacccaaaccacccgcggggacggcucaacaagagggcacaaggccaccgucuacacagguucugcccccuucaccccuaaacucggcucuguccaauucgaaacagacaccgaaaaugacuucgaaacccaucaaaacaccaaauuuacacccguuggcguaauccaagacggaggcaccacucaccgaaaugaaccccaacaauggguucucccauccuacucaggacgcucugucccgaacguccaccucgccccagccguugcccccaccuucccuggcgaacaacuccucuucuuccgaucuacaaugcccggaugcuccggauaccccaacauggaucucgacugccuccucccccaagaauggguccaacauuucuaccaagaggccgcacccgcucaaagcgacgucgcccuccuccgcuucgucaaccccgacacuggccgaguacucuucgaaugcaaacuacauaaauccggcuacgucacagucgcgcacaccggacaacacgaucucgucaucccacccaauggauacuuccgauucgacuccugggucaaccaauucuacacacuugcccccaugggaaacggcaccggccgucgacgcuaa

SEQ ID NO: 38530 - RNA, 1617 nt, Artificial Sequence
  derived and/or modified sequence opt11 from VP1__Norovirus_and/or_Norovirus-like__KR131785
augaaaauggccucauccgacgcuaaccccucagacggaucggccgccaaccugguaccagaagucaacaacgaagucauggcccucgagcccguagucggagccgccaucgccgcuccagucgccggacaacagaacgucaucgaccccuggauccgcaacaacuucguccaagcuccaggcggcgaguucaccgucucaccccggaacgccccaggugaaauacuuuggagcgcgccccucggccccgaccucaaccccuaccuuucacaccuugcccgcauguacaauggcuacgccggcggcuucgaagugcaagucauacuugccggcaacgccuucaccgccggaaaagucaucuucgcagccguacccccaaacuuccccacagaaggccucucacccucccaagucaccauguucccacacauaguagucgauguacgccaauuagaacccguccuaauaccccucccugauguccguaacaacuucuaccacuacaaccaauccaacgaccccacgauaaaacucaucgccaugcucuacacuccccuccgcgccaacaacgcuggagacgauguauuuaccgucucaugccgaguccucacacgcccaucccccgacuucgacuucaucuuccuaguucccccaaccgucgaaucccgcacaaaacccuucuccguccccguccucaccgucgaagaaaugaccaacucccgauuucccauaccccucgaaaaacuauucaccggucccuccucagcauucgucguacagccccaaaacggccgcugcacgaccgacggaguacuccucggaacaacccaacucucccccguaaacaucugcacauuucgcggcgacgucacccacaucaccggcucccacaacuacacuaugaaccuagcaucacaaaacuggaacaauuacgaucccaccgaagaaaucccagcaccccuagguaccccagacuucgucggcaagauacaaggaguccucacccaaaccacaagaaccgacggcuccacacgcggccacaaagccacagucuacaccggaucugccgacuucgcacccaaacucggccgaguccaauuugaaaccgacaccaaccacgacuucgaagccaaccaaaacaccaaauucacacccguuggcguaauccaagacggcggcacaacccaccgcaaugaaccucaacaauggguccuccccucauacucaggccgaaacacccacaacguacaccuagccccagccgucgcccccaccuucccaggcgaacaacuacuauucuuccgaucuaccaugccaggcugcuccgguuaccccaauauggaccucgacugccuccucccccaagaauggguccaauauuucuaccaagaagccgcaccagcccaauccgacguugcacuccuccgauucgucaaccccgacacuggacguguccucuucgagugcaaacuccacaaauccggcuacguaaccguugcccacacuggacaacacgaccuuguaaucccucccaaugguuacuuccgcuucgacaguuggguaaaccaauuuuacacucuagcacccaugggcaacggcaccggccgccgacgcuaa

SEQ ID NO: 38531 - RNA, 1617 nt, Artificial Sequence
  derived and/or modified sequence opt11 from VP1__Norovirus_and/or_Norovirus-like__AB972530
augaagauggccucguccgacgccaaccccuccgacggcuccgccgccaaccuuguacccgaagucaauaacgaagucauggcccuagaacccguagugggcgcagccaucgccgcacccguagcaggacaacaaaacguaaucgaccccuggauccgcaacaacuucguccaagcccccggaggagaauuuaccgucucaccacgaaacgccccaggcgaaauccuuuggucagcgccccuaggccccgaccucaacccauaucuaucacaccuggcccgaauguauaacggcuacgccggcggcuucgaaguccaaguaauccucgccggcaacgccuucaccgcuggcaaaguaaucuucgcagcagucccacccaacuuccccaccgaaggccucagccccucccaaguaaccauguucccccauauagucgucgacgucagacaacucgaacccguccucauaccccuacccgacguccgcaacaacuucuaucacuacaaccaauccaacgacccuacaauaaaacuaaucgccaugcucuacacaccccuacgcgcaaacaacgccggcgacgaugucuuuaccguuucaugccgcguccucacacgaccaucccccgacuucgauuucaucuuccuugucccacccaccguagaaagccgcacaaaaccauuuucuguacccguccuaaccgucgaagaaaugaccaacuccagauucccaauaccccuagaaaaacucuucaccggccccuccuccgccuucgucguccagccccaaaacggucgcugcaccacagacggcguacuucuaggaaccacccagcucucccccgugaacauaugcaccuuccgcggcgacgucacccacauaaccggcucucgaaacuacacaaugaaccucgccucccaaaacugguccaacuaugaccccacagaagaaauucccgcuccacucggaacccccgacuucguaggcaaaauacagggaguccucacccaaaccacucgcaccgacggguccacccgcggccacaaggcuaccgucuacaccggcagcgccgacuucgcacccaaacucggacgaguccaauucgaaaccgacacagaccacgacuucgaagcaaaccaaaacaccaaauucaccccagucggagucauccaagacggcucaaccacacaccgcaacgaaccacaacaauggguccuacccuccuacuccggccgaaacacacccaacguacaccuagcacccgcaguagcacccaccuucccaggcgaacaacuccucuucuuccgcuccacaaugcccggcugcuccggcuacccaaacauggaccuugacugccucuuaccacaagaauggguccaauacuucuaucaagaagccgcccccgcacaaucugaugucgcgcuauuacgcuucgucaacccagacaccggacgcguacucuucgaaugcaaacuccauaaaucaggauacguaacagucgcacacaccggccaacaugaccucgucauacccccaaacggcuacuuccgcuucgacagcugggucaaccaauucuacacacuagcccccaugggaaacggcaccggcagacgaagauaa

SEQ ID NO: 38532 - RNA, 1617 nt, Artificial Sequence
  derived and/or modified sequence opt11 from VP1__Norovirus_and/or_Norovirus-like__AB972526
augaaaauggcaagcuccgaugcaaaccccucugacggauccgccgccaacuuaguaccagaaguaaacaacgaagucauggcccuugaacccgucgucggcgcugccaucgcggcacccgucgcaggccaacaaaacgucaucgaccccuggauacgaaacaacuucguccaagccccaggcggcgaguucaccguuucgccccgcaacgcccccggcgaaauacuuugguccgccccacuuggacccgaccuuaaccccuaccuaucccaccucgcacggauguacaacggauacgcaggcggcuucgaaguccaagucauccucgcagguaacgccuucaccgccggcaagguaaucuucgccgccguaccucccaacuuccccaccgaaggccucagccccucacaagucacaauguucccccacaucguagucgacguccgccaacuagaacccguacucauaccacuccccgacgucagaaacaacuucuaccacuacaaccaauccaaugaccccaccaucaaacucaucgccaugcuauacacgccccuacgagcaaacaacgcuggcgacgacgucuucaccguguccugccgaguccucacccgcccauccccagauuucgacuucauauuucuagucccgcccaccguagaaucccgcaccaaacccuucagcguccccguacucaccguugaagaaaugaccaacucccgcuucccaaucccacucgaaaaacucuucaccggacccuccuccgccuucguaguccaaccccaaaacggacgauguacaaccgacggaguccuucucggaacuacgcaacucuccccuguaaacaucugcaccuuccgcggagacguaacccacauaaccggcucccacaacuacaccaugaaccucgcaucccagaacuggaacaacuacgaccccacagaagaaaucccagcaccccucggcaccccagacuucgucggcaaaauacaaggcguucucacccaaaccacccguaccgacggaucaacucgaggccacaaagccacagucuacacuggcagcgccgacuucgcccccaaacuaggccgcguccaauucgagaccgacaccgaccacgauuucgaggcaaaccaaaacaccaaauucacaccaguaggcguaauacaagauggcggaaccacccaccgaaacgaaccccaacaauggguacucccauccuacuccggccguaauacccacaacguccaccuagccccagcugucgcccccaccuuccccggcgaacaacuacuguucuuccgauccacaaugcccggaugcuccggcuauccaaacauggaccucgacugccuccucccccaagaauggguucaauacuucuaccaagaagcugccccagcucaaucagacgucgccuuacuacgcuucgucaacccagacacaggacgcguucuauucgaaugcaaacuucacaaguccggcuacguaaccguagcccacacuggccaacacgaccuagucauacccccaaacggcuauuuccguuucgacagcugggucaaccaauucuacacccuagcuccaaugggcaauggcacaggacgccgccgcuaa

SEQ ID NO: 38533 - RNA, 1617 nt, Artificial Sequence
  derived and/or modified sequence opt11 from VP1__Norovirus_and/or_Norovirus-like__AB972522
augaaaauggcguccuccgacgcaaaccccuccgacggcuccgccgcaaaccucguccccgaagucaacaacgaaguaauggcccuagaacccgucguaggcgccgccaucgcugcuccagucgccggccaacaaaacgucaucgacccauggauccgcaacaacuucguccaagccccuggcggcgaauuuaccgucaguccccggaacgccccaggugaaaucuuauggucagcaccucucggccccgaccucaacccauaccucucccacuuagcccgcauguacaauggcuacgccggcggauucgaaguccaagucauacucgccggaaacgcuuucaccgcaggaaaagucauauucgccgccguaccacccaacuuccccaccgaaggccuaucacccucccaaguaaccauguuuccccacaucguagucgacguacgccaacucgaaccaguccuaauaccccuccccgacguuagaaacaacuucuaccacuacaaccagucgaacgaccccaccauaaaauuaaucgcuaugcuauacacuccucuacgcgccaacaacgcaggagacgacgucuucaccgucagcugccgcguccuuacccgcccaucccccgacuucgacuucaucuuccuugucccgcccaccgucgaaucccguaccaaacccuucuccguacccguacucaccguggaagaaaugaccaacucacgauuccccauccccuuagaaaaacucuucacaggccccagcuccgccuucgucguacagccccaaaacggacgcugcaccacugacggaguacuccuugguacgacccaacuaucacccgucaauaucugcaccuuccgaggagacgucacccacauaaccggcucgcgcaacuacacuaugaacuuagccucacagaauugguccaacuacgaccccaccgaagaaaucccugcaccccucggcacccccgauuuugucggcaaaauccaaggcguccuaacacaaacaacccgcacggacggaucuacccgcggucacaaagccacaguauacaccggcucagccaacuucgcccccaaacucggccguauccaguucgaaaccgacacagaccacgacuucgaagccaaccaaaacaccaaauucacccccgucggagucauccaagacggcuccaccacccaucgcaacgaaccccaacaauggguccuccccuccuacucaggacgaaacaccccaaacguccaccucgcaccagcugucgcccccacauuccccggugaacaauuacuauucuuccgauccaccaugccggguugcuccggauaccccaacauggaccucgacugccuacucccccaagaauggguucaauacuuuuaccaagaagccgcacccgcucaauccgacguugcccuccuccgcuuuguaaaccccgacacaggcagaguucucuucgaaugcaaacuucacaaaagcggauacgugaccgucgcccacaccggccaacacgaccuaguaaucccgcccaauggcuacuuccgcuucgacucuugggucaaucaauucuacacacucgcacccaugggaaacggcacuggccgacgccgauaa

SEQ ID NO: 38534 - RNA, 1617 nt, Artificial Sequence
  derived and/or modified sequence opt11 from VP1__Norovirus_and/or_Norovirus-like__AB972514
augaaaauggccuccaacgacgccaaucccuccgacggcucagccgcuaaccuaguccccgaaguuaacaacgaagucauggcccucgaacccgucgucggcgccgcuaucgccgcucccgucgccggccaacaaaacgucaucgaccccuggauacgcaauaacuucguccaagccccuggaggcgaguucacagucucaccacgcaacgcgcccggagaaauccucuggucagcaccccucggucccgaccucaaccccuaccucagccacuuagcccguauguacaacggcuacgccggcgguuuugaaguccaggucauacucgcaggaaacgccuucaccgccggcaagaucauauucgccgcuguaccacccaacuuccccaccgaaggacucagccccucgcaaguaacaauguucccccacaucaucgucgacgucagacaacucgaacccguccucaucccgcucccagacguacgaaacaacuuuuaccacuacaaccaauccaaugacucuacuaucaaacucaucgcgaugcucuacacgccccuccgugcuaacaacgccggagaagacguguucaccguuucaugccguguccuaacacgucccucaccagacuucgacuucauauuccucguuccacccaccguagaaucacgcacaaaacccuucaccguccccauccucacagucgaagaaaugaccaacucccgcuuccccaucccccuagaaaaacucuucaccggcccauccuccgccuucgucguacaaccccaaaacggacgcugcaccacagacggcguacuucuuggcaccacucaacuuucccccgugaacaucugcaccuuccgcggagacgucacccauauagccggcucccgcaacuacaccaugaaccuugccucccuuaauuggaacaauuacgaccccaccgaagaaauacccgcaccccuuggcacccccgauuucgucggcaaaauccaaggaaugcuaacccaaacaaccaaaggcgacggaagcaccagaggccauaaagccaccgucuacacgggcagcgcccccuucacccccaaacuaggaagcguccaguucgaaacugacaccgaaaacgacuucgaaacgcaccagaacaccaaguucacccccgucggaguaauccaagacggaggcaccacccacagaaacgaaccccaacaauggguacuaccauccuacucaggccggaacgucccaaacguucaccucgcccccgccguggcccccaccuuccccggugaacagcuccuauucuuccgcuccauaaugcccggcugcucaggauacccaaacauggaccucgacugccuccucccacaggaauggguucaacacuucuaccaagaagcagcaccagcccaauccgauguagcccuccuccgauuugucaacccagacaccggacgcguccuuuucgaaugcaaacuacacaaaucugguuaugucaccgucgcccacaccggccaacacgaccuuguaauacccccaaacggcuacuuccgauuugacuccugggucaaccaauucuacacccucgcuccaaugggcaacggcacaggccgacgccgcuaa

SEQ ID NO: 38535 - RNA, 1617 nt, Artificial Sequence
  derived and/or modified sequence opt11 from VP1__Norovirus_and/or_Norovirus-like__AB972505
augaaaauggccuccucggacgcuaaccccuccgauggauccgccgcaaaccuuguacccgaagucaacaaugaggucauggcccucgaacccguagucggcgccgcaauagccgcccccguagccggccaacaaaacguuaucgaccccuggauccgcaauaacuucguccaggcccccggcggggaguucacagucucaccccgaaaugcgcccggagaaauccuuuggagcgcaccacuaggacccgaccuaaaccccuaucucucccaccuagcccgcauguacaauggauacgccggcgguuucgaaguucaagugauccucgcagguaacgccuucacagcaggcaaagucaucuucgcagccgucccacccaacuuccccaccgaaggcuuaucccccucccaagucaccauguucccccacaucgucgucgacguaagacaacucgaacccguucuaaucccccuucccgacguccgcaacaacuucuaccacuacaaccaaucaaacgaccccaccauuaagcucaucgccaugcuuuauacuccccuccgagcuaacaacgccggugacgaugucuuuaccgucucaugccguguccucacccgucccuccccagauuuugacuucaucuuccuugucccacccacaguugaaucacgcaccaaacccuucucaguccccguacucaccgucgaagaaaugaccaacucucgauuccccauuccacucgaaaaacuuuucacuggccccucauccgcauucgucguccaaccccagaacggccgaugcaccacagacggcguucuacucgguaccacccaacucucccccgucaacauaugcaccuuucgcggagacgucacucacaucacaggaucaagaaacuacaccaugaaccucgcaagccaaaacugguccaacuacgaccccaccgaagaaauccccgcaccccuaggaacccccgacuucguugguaaaauccaaggcguccucacccaaacaacacgaaccgacggcucuacccgcggccacaaagcaacugucuacacaggaagcgccgacuucgcccccaaacucggcagaguccaauucgaaacagacaccgaccacgacuucgaagcaaaccaaaacaccaaguucacaccagucggcgucauccaagacgguuccaccgcacaucgaaaugaaccacaacaauggguccuuccaucguacuccggccgcaacacccccaacguccaccucgccccagcuguugccccaaccuuccccggagaacaacuccucuucuuccgcucaacaaugcccggaugcuccggcuaccccaacauggaccuagacugccuacuuccgcaagaauggguccaauacuucuaccaagaagcagcacccgcccaauccgacguggcccuccuccguuucgucaaccccgacaccggccgcguccucuucgaaugcaaacuccacaaauccggcuacgucaccguagcccacaccggccaacaugaccucgucaucccacccaacggauacuuccgauucgacuccugggugaaccaauucuacacacucgcacccaugggcaacggaacaggccgaagacgcuaa

SEQ ID NO: 38536 - RNA, 1617 nt, Artificial Sequence
  derived and/or modified sequence opt11 from VP1__Norovirus_and/or_Norovirus-like__AB972473
augaaaauggccuccuccgacgcaaacccaagcgacggcuccgcagcaaaccuaguucccgaagucaacaacgaagucauggcccuagaaccagucgucggugcagcuauagccgcccccgucgcaggccaacaaaacgucauagacccguggauucgcaacaacuucguccaagcuccaggcggcgaauuuacaguauccccacgaaacgcccccggcgaaauccucugguccgcaccacuaggcccagaccucaaccccuaucuuucucaccucgcacgcauguauaacggcuacgccggaggcuuugaaguccaagucauacucgcuggaaacgccuucacagcaggaaaagucauuuucgcagcagucccucccaacuuccccacagaaggccuuuccccaucccaaguaacaauguucccacacaucguagucgacguccgccaacucgaaccuguacucauaccacucccugacguccggaacaacuuuuaucauuacaaccagucuaacgacccaaccaucaaacuaaucgccaugcucuauacgccccuacgcgccaacaacgccggugacgacguauucaccgucuccugccgaguucuaacccgccccucucccgacuuugacuucaucuuucuaguaccacccaccgucgagucccgcacaaaacccuucucaguccccguccucaccgucgaagaaaugaccaacucccgcuuucccauaccccuugaaaaacucuucacaggccccuccuccgcauuugucguacaaccucaaaacggccgcugcacgaccgacggcguccuccuaggaaccacucaacucucccccgucaacaucugcaccuucagaggcgacgucacccacaucaccggcucacgcaacuacaccaugaaccucgcaucacaaaacuggaacaacuacgaccccaccgaggaaaucccagccccgcucggcacucccgacuucgucggaaaaauccaaggcguccuaacccaaaccacccgcaccgacggaagcacccgcggacacaaggccaccgucuacaccggcuccgcugacuucgccccaaaacucggccguguccaguucgaaaccgacaccgaccgcgacuucgaagcaaaccaaaacacaaaauucaccccuguaggaguuauacaagacggcuccacaacccaccgaaacgaaccgcaacaauggguccucccuuccuauagcggacgcaauacccacaacguacauuuagccccugcggucgccccaaccuuucccggcgaacaacuacuauucuuccgcucaaccaugcccggcugcucaggauaccccaacauggaccucgauugccuccuaccccaagaauggguccaauacuucuaccaagaagccgcccccgcccaauccgaugucgcacuccucagauucgucaacccagacaccggaaggguccucuucgaaugcaaacuccacaaauccggauacgugaccgucgcccacaccggacaacacgaccuaguaaucccaccaaacgguuauuuccgauucgacucauggguaaaccaauucuacacccuagcccccaugggcaacggcaccggacgccgcagauga

SEQ ID NO: 38537 - RNA, 1617 nt, Artificial Sequence
  derived and/or modified sequence opt11 from VP1__Norovirus_and/or_Norovirus-like__KT780381
augaaaauggccucaucggacgcaaaccccucagacggcucagccgccaaccuagucccugaaguaaacaacgaagucauggcccucgaacccguaguaggagccgccaucgccgccccugucgccggacagcaaaacgucauagaccccuggaucagaaacaacuucguacaagcccccggcggagaguucacagucucgccccguaaugcccccggcgaaauccucugguccgcuccacuaggaccugaccuuaaccccuaccucucccacuuagccaggauguacaacggauacgccggcggcuucgaaguccaagucauccucgccggaaacgcuuucacugccggaaaagucauauucgcugccguuccacccaacuuccccaccgaaggccucucgcccucccaagucaccauguucccccacaucgucgucgacguccgacaacuagaacccguccucaucccccuacccgacguccgaaacaacuucuaccacuacaaccagucaaacgacccgaccaucaaacucaucgccaugcuauacacuccccuccgcgccaacaacgccggcgacgacguauuuaccguauccugccgcguccuaacccgccccuccccagacuucgacuucauauuccucgucccacccaccguagaaucacgcaccaaaccauucucagucccaguacuaacugucgaagaaaugacaaacucgagauuccccaucccccuagaaaagcuauucaccggacccaguuccgcguucgucguccaaccucaaaacggccgcugcaccacugacgguguacuucucgguaccacccaacuaucacccguuaacaucugcacuuuccgcggagacgucacucacauaaccggcucccgcaacuacacaaugaaccucgccucacaaaacugguccaacuacgacccaaccgaagacauaccugccccucucggcaccccagacuucgucggaaaaauacaaggcguccucacccaaaccacccgcaccgacggcucgacucgaggccacaaagcuacugucuacaccggcagcgcagacuucgcacccaaacucggccgaguccaauucgaaaccgacaccgaccacgacuucgaagccaaucaaaauacaaaauucacacccgucggagugauccaagacggaggaaccacccaucguaacgaaccucaacaauggguccugccaagcuacuccggacgaaacaccccuaacguucaccuagcccccgccgucgccccaaccuuccccggagaacaacuucucuucuuccgcuccaccaugccaggaugcucagguuacccaaacauggaccucgacugccuccucccccaagaauggguccaauacuucuaucaagaagcagccccugcccagucagacguagcccuccuacgcuucguaaaccccgacaccggccgcguacucuucgagugcaagcuccauaaaucuggcuacgugacaguugcgcacacgggacagcacgaccuaguuauaccacccaacggauacuuccguuucgacucuuggguaaaccaauucuacacccuagcccccaugggaaacggcaccggccgacgacgauaa

SEQ ID NO: 38538 - RNA, 1617 nt, Artificial Sequence
  derived and/or modified sequence opt11 from VP1__Norovirus_and/or_Norovirus-like__KT780372
augaaaauggcauccuccgaugccaaccccuccgacggcagcgccgccaaccucguucccgaggucaacaacgaagucauggcucuugaaccuguaguaggagccgcuaucgccgcccccgucgccggccaacaaaacgucaucgaccccuggauucgaaacaacuucguccaagcccccggcggugaguucacaguaucgccaagaaacgcacccggagaaauacucugguccgcaccacucggccccgaccuaaaccccuaucucucccaccucgcacgaauguacaacggauacgcaggcggcuucgaaguccaaguccuccuagccgguaacgccuuuacagccggcaaaguaaucuucgccgcagucccaccuaacuuccccaccgaaggacucuccccaucccaagucacaauguucccccacaucgucguagacguccgacaacuagaacccguacucaucccacuccccgacguccgcaacaacuucuaccacuauaaccaaagcaacgaccccacuauaaaacucaucgcaaugcucuacacaccacuccgcgccaacaacgccggcgacgacguauucacaguuuccugccguguacucacccgcccaucaccugacuucgacuucauauuccuaguucccccaaccgucgaaucucgcaccaaaccauucuccgugcccguacuaaccgucgaagaaaugaccaacucacgauuccccaucccccuagaaaaacucuucaccggacccuccucugcauucgucguucaaccccaaaacggaagaugcacgacagacggcguccuccucggcaccacacagcuaucccccguaaacaucugcaccuuucgcggagacguaacccacaucacuggaucuagaaacuauacaaugaaccuagccucccaaaauuggagcaacuacgacccaacugaagaaauaccagcuccccucggcacuccugacuucgucggaaagauccaaggaguacuaacacaaaccacccgcaccgacggcuccacucguggccacaaagccaccgucuauaccggaucugccgacuucgccccaaaacucggccgcguccaauucgaaacagacaccgaccacgauuucgaagccaaccaaaacaccaaauuuaccccagucggcgucauccaagacggcuccaccacccaccgaaacgaaccccaacaauggguccuccccuccuauucaggccgcaacacccccaacguccaccucgcccccgccguugcacccacauuucccggugaacaacuccucuuuuucagauccacaaugcccggcuguucuggcuacccaaacauggaccucgauugccuccucccccaagaauggguacaauacuucuaucaagaggcagcccccgcucaguccgacguugcccuccuccgauucguaaacccagauacaggccguguacuauucgaaugcaaacuucacaaauccggcuacguaacaguagcacacaccggccaacacgaccuugucaucccacccaacggcuacuuccgauucgacuccuggguaaaccaauucuacacccuagcccccaugggcaacgggaccggccgacgccgcuag

SEQ ID NO: 38539 - RNA, 1617 nt, Artificial Sequence
  derived and/or modified sequence opt11 from VP1__Norovirus_and/or_Norovirus-like__KT202797
augaaaauggcauccucugacgcaaaccccuccgacggcucagccgccaaccucguccccgaagucaacaacgaagucauggcacucgaaccaguagucggagccgccaucgccgccccaguagccggacaacagaacgucaucgacccuuggauccgaaacaacuucguucaagccccaggcggcgaguucacagucucuccacgcaacgcccccggagaaauccuuuggucggccccucuaggucccgaccuuaacccauaccuaucccacuuagcucgcauguacaacggauacgccggaggcuucgaaguccaagucauacuagccggcaacgccuucacugccggcaaagucaucuucgccgcaguucccccgaacuuccccacagaaggacuaaguccaucccaagugacuauguucccacacaucguagucgacgucagacagcucgaacccguccucauaccccuccccgauguacgcaacaacuucuaccacuacaaccaaucaaacgacccaaccauuaaacuaaucgccaugcucuacaccccucuccgcgccaacaacgcaggagacgauguauucaccguaucaugccgcguucucacccgacccucccccgauuucgacuucauauuccucguacccccaacagucgaaucccguaccaaacccuucucaguccccguccucaccguugaagaaaugacuaauucccgcuuucccaucccccuagaaaaacuauuuaccggccccuccucagccuucguaguccaaccccaaaacggccgaugcacaacagacggcguccuccucggaaccacccaacucucccccguuaacaucugcacauuucgcggagacgucacucacauaacuggcucccacaauuacaccaugaaccuagcaagccaaaacuggucaaacuacgaccccacagaagaaauacccgcaccccugggcacacccgacuucgucggcaaaauccaaggcguccuaacccaaacuacccgcacagacggcagcacacgaggucacaaagcuacggucuacaccggcucagccgacuucgccccaaaauugggccgcguccaauuugaaacagacaccgaccgcgacuucgaagccaaccaaaacacuaaauucacccccgucggcgucauccaagacggcggcacaacacaccgaaaugaaccccaacaaugggucuuacccuccuacuccggccgcuccacucccaacguccaucucgcacccgccgucgcuccaaccuuccccggagaacaacugcuauucuuccgcucaacaaugccuggcugcuccggguaccccaacauggaccucgacugccuccuaccccaagaauggguacaauacuucuaccaggaagcagcucccgcacaauccgacguugcccuccuacgcuucgucaacccagacaccggucgcguacucuucgaaugcaaacuccauaaauccggcuacgucaccgucgcccacacgggacaacacgaccucguaauacccccaaacggcuacuuccgauucgauuccugggucaaccaauuuuacacucuagcucccaugggcaacggcaccggccgccgccgcuag

SEQ ID NO: 38540 - RNA, 1617 nt, Artificial Sequence
  derived and/or modified sequence opt11 from VP1__Norovirus_and/or_Norovirus-like__KR904226
augaaaauggccucaagcgacgccaaccccuccgacggaucagcagccaaccucguccccgaagucaacaacgaagucauggcccuagagcccgucgucggggccgccaucgcugcaccagucgcaggccaacaaaacgucaucgaccccuggauucgaaacaacuuuguacaggcacccggcggagaguucacugucucuccccgcaaugcuccaggcgaaauacucugguccgcaccccuaggaccagaccucaacccauacuuaucccaccuugcacgaauguacaacggcuacgcaggaggcuucgaaguacaggucauucuagccggaaacgccuucaccgccggcaaaauaaucuuugcugcugucccucccaacuuccccaccgaaggccucucaccaucccaagucacuauguucccccacaucaucgucgacguccgccaacucgagcccguucucaucccacuacccgacguccguaacaauuucuaccacuauaaccaauccaacgaccccaccaucaaacugaucgcaaugcucuacaccccacuccgcgccaacaacgccggagacgacgucuucaccguauccugccgcguccuuacacgccccucccccgacuucgacuucaucuuccuggucccucccacaguagaaucucgaaccaaacccuucucuguccccguacucacaguagaagaaaugaccaacucucguuuccccaucccccucgaaaaacuuuuuacuggccccucuuccgccuucguaguccaaccccaaaauggucgaugcaccaccgacggcguccuccuaggcaccacccaacuaucacccgucaacaucuguaccuuccgaggcgacgucacccacaucacaggcucacgaaacuacacaaugaaccucgccucccaaaacuggaacaacuaugaucccaccgaagaaauaccagccccgcuaggaacuccagacuucguaggaaagauccaaggcaugcuaacucagaccacccgaaccgacggcuccacccgcggccacaaagcaaccgucuacaccggcuccgcagacuucgcccccaaacucggccgcguccaauucgaaaccgacaccgaccacgacuucgaagccaaccaaaacaccaaauucacccccgucggcgucauccaagacggcagcaccacccacagaaacgaaccacaacaauggguacuaccgagcuacuccggccgcucagcccacaacguacaccuagcccccgcugucgcuccaaccuucccaggagaacaacuccuguucuuccgaucaacaaugcccggcugcuccggcuaucccaacauggaccucgacugccuccucccacaagaauggguacaauacuucuaccaagaagccgcccccgcacagucugacgucgcacuacuccgcuucgucaaccccgacaccggccgaguccucuucgaaugcaaacuccacaaauccggcuacgucacaguugcccacaccggccaacacgaccucgucauaccacccaacggauauuuccgauucgauagcugggugaaccaauucuacacccucgccccgaugggcaacggcacaggccgucggcgauaa

SEQ ID NO: 38541 - RNA, 1617 nt, Artificial Sequence
  derived and/or modified sequence opt11 from VP1__Norovirus_and/or_Norovirus-like__KR904208
augaaaauggcuagcucagacgccaaccccuccgacggcuccgccgcuaaccuaguaccggaagucaauaacgaagucauggcccuggaacccgucgucggcgccgccauagcagcccccgucgccggucagcagaacgucauagaccccuggauccgaaacaacuucguccaagcccccggcggagaguucaccgucuccccacgcaacgccccgggcgaaauacucuggucagcgccccucggcccagaccucaaccccuaccucucccaucucgcccgcauguacaacggguacgcaggaggcuuugaaguucaagucauccucgcaggcaacgcauucaccgccggcaaaaucguauucuccgccguacccccaaacuucccaaccgaaggccucucgccaucccaaguaaccauguucccacacaucauagucgacguacgccagcuugaacccguccucaucccccuacccgacgucaggaacaacuucuaccacuacaaccaauccaacgacccuaccauaaaacuuauagcaaugcucuacacacccuuacgcgccaacaaugcaggcgacgacguauucacagucucaugccgcguccuuacccguccauccccugacuucgacuucaucuuccuaguuccaccaacuguagaaucacgaaccaaacccuucuccguccccauccuaaccgucgaagaaaugaccaacucacguuuccccaucccacucgaaaaacucuucaccggacccucauccaccuucguuguccaaccccaaaacggacgcugcaccaccgacggaguucuccucggcaccacccaacucucccccgucaauauaugcaccuuucgcggagacguaacccacaucgccggcucacgcaacuacacaaugaaccuagccucucaaaacuggaacuccuacgaccccaccgaagaaauucccgcaccccucggcacccccgacuucguuggcaaaauccaaggcguccuuacccaaacaacccgcaccgacggcagcacccguggccacaaagccacagucuacacuggauccgccgacuucucccccaaacucggccgcguccaauucgccaccgacaccgacaacgacuucgaugccaaccaaaacaccaaauucacuccagucggagucauccaggaugguaacaccgcccaccgcaacgaaccccaacaauggguccuccccuccuacuccggacgaaacacacacaacguccaccucgcacccgcagucgccccaacauuucccggagagcaacuacuauuuuuccgcucgaccaugcccggcugcuccggcuaccccaacauggaccucgacugccuccucccccaagaauggguacaauacuucuaccaagaagccgcacccgcccaaucagauguugcacuccuccguuucgucaacccagacacaggacgaguccucuucgaaugcaaacuccacaaauccggauacgucacugucgcccauacaggacaacacgaccuugucaucccacccaacggauacuuccgcuucgacucaugggucaaccacuuuuacacccuagcucccgucggcaacggaaccggccgccgccgcuaa

SEQ ID NO: 38542 - RNA, 1617 nt, Artificial Sequence
  derived and/or modified sequence opt11 from VP1__Norovirus_and/or_Norovirus-like__AB933709
augaaaauggccuccuccgacgcgaaucccuccgacggaucagccgcaaaccucguccccgaagucaacaacgaagucauggcccucgaacccguugucggagcugccauagccgcccccguagcaggacaacaaaacgucaucgaccccuggauccguaacaacuucguacaagcccccggcggcgaauuuacagucuccccacgaaacgcccccggcgaaauacucugguccgccccgcuagggccagaccucaauccauaccuaucccaccucgcccgcauguacaacggcuacgccgguggauucgaaguccaagucauccuagcugguaaugccuucaccgccggaaaaaucaucuucgccgcaguaccacccaacuucccaaccgaaggacuaucgcccucccaagucaccauguucccccacaucaucguagacguccgccaacuagaaccaguacuuaucccccuccccgacguccgaaacaacuucuaccacuacaaccaauccaacgacuccaccauaaaacuaauagccaugcuauacacaccacuccgcgcaaacaaugcuggugaagaugucuucaccguauccugcagaguccuaacccgaccaucacccgacuucgacuucaucuuccucguaccaccaaccguugaauccagaaccaaacccuucaccguacccauacucaccgucgaagaaaugacaaacucgagauuccccaucccacuagaaaaacuauucacaggcccauccuccgcauucguaguccaaccccaaaacggacgcugcaccacugacggcguacuccucggcaccacacaacucucucccgucaauaucugcaccuuccgcggagacgucacccacaucgcaggaucucgcaacuacacuaugaaccucgcaagccuaaacuggaacaacuacgaccccacagaagaaauccccgcaccgcucggaacacccgauuucgucggaaaaauccaaggcaugcuuacacaaaccacgaaaggagacggcagcacccgaggccacaaggccacuguguacaccgggucggcccccuucacccccaaacuaggcucaguccaauucuccaccgacaccgaaaacgauuucgaaacccaccaaaacaccaaauucacccccguuggcguaauacacgacgguuccaccacacaccgcaacgaaccccaacaauggguccuucccuccuacuccggcagaaacguccccaacguacaccucgcccccgcagucgccccaaccuucccaggcgaacaacuccucuucuuccgcuccaccaugcccggaugcuccggauauccuaauauggaccuugacugccuacuaccccaagaauggguccaacacuucuaccaagaagccgcacccgcccaauccgacgucgcacuccuccgauucgucaaccccgacaccggccgcguacucuucgaaugcaagcuccacaaauccggcuacguaaccgucgcccacacuggccaacacgaccucguaauuccacccaauggcuacuucagauucgacucaugggucaaccaauucuacacacucgcccccaugggcaacggcaccggccgacgacgcuaa

SEQ ID NO: 38543 - RNA, 1617 nt, Artificial Sequence
  derived and/or modified sequence opt11 from VP1__Norovirus_and/or_Norovirus-like__EU921352
augaaaauggcauccucugacgcaaaccccucagacgguuccacggcaaaccucguaccagaaguaaacaacgaagucauggcauuagaaccuguagucggcgccgcuaucgcagcccccgucgcaggacaacaaaacgucaucgaccccuggauucgaaacaacuucguccaagccccaggcggcgaauuuacaguaagcccaagaaacgcucccggcgaaauccucuggucagcaccccuagggcccgaccucaaccccuaucuuucccaucucgcccgcauguacaacggcuacgcuggcgguuucgaaguccaaguaauccuagcaggaaacgccuucaccgccggcaaaauaaucuucgccgccgucccacccaauuuccccaccgaaggccucucccccucacaagucaccauguucccccacaucaucguagauguccgccaacucgaacccguucuaaucccccuuccagacguacgcaacaacuucuaccacuacaaccaaagcaacgacucaacaauaaaacucauagcaaugcucuacaccccacuccgugccaacaacgccggugaugacgucuucaccgucucaugccgcguucuuacccgccccucccccgacuucgacuucaucuuccuaguucccccaaccgucgaauccagaaccaaaccuuucuccguccccauacucaccguagaagaaaugaccaacucacgcuucccuaucccacucgaacgauuauucacaggccccuccucagccuucgucguccaaccccaaaacggccgcugcaccaccgacggcguucuucucggcaccacacaacuaucccccguaaacaucugcacauuccgcggcgaugugacacacaucgccggcacacaagaauacaccaugaacuuagccagccaaaacuggaacaacuacgacccaacagaagaaaucccagcaccccuaggaacccccgacuucgucggcaaaauacaaggcguauuaacccaaaccacccgccgcgacggaucaacccgcggccacaaagcaaccgucuccacaggcucaguucacuucacacccaaacucggccguauccaauucuccacagacaccuccaacgacuucgaaaccggccaaaacacccgauucacaccaguaggagucguucaagacggaggcaccacccaucaaaaugaaccccaacaauggguacuacccgauuacuccggacgcgacggccacaauguccaccuagcccccgccgucgcaccuucauucccaggcgaacaacuccucuucuuccguaguaccaugcccggcugcuccggcuacccaaacaugaaccucgacugccuccucccccaagaauggguucaacacuucuaccaagaagccgcacccgcacaauccgacgucgcccuccuaagauucgucaaccccgauacuggacgcguccuauucgaaugcaaacuccacaaauccggcuacgucaccgucgcccacaccggacaacacgaccucgucauaccacccaacggguacuuccguuucgacuccugggucaaccaauucuacacccuagcacccauggguaacggcaccggacgccgccgcuaa

SEQ ID NO: 38544 - RNA, 1617 nt, Artificial Sequence
  derived and/or modified sequence opt11 from VP1__Norovirus_and/or_Norovirus-like__LC005735
augaaaauggccagcucagacgcaagccccucagacggauccgccgccaaucucguccccgaaguuaacaacgaagucauggcacucgagcccgucguaggagccgccaucgccgcccccgucgccggccaacaaaauguuauagacccauggauucgcaacaacuucguccaggcacccggcggugaauuuaccguaucaccacgcaacgcacccggcgaaauacucugguccgccccacucggccccgaccuaaacccauaucuaucccaccuagcaagaauguacaacggcuaugccggcggcuucgaaguccaaguaauccucgcuggcaacgccuucacagccggcaaagugauauucgccgccguaccaccuaacuuccccacagaaggccuuucccccucccaaguaacaauguucccccacaucgucgucgacguacgccaacucgaacccguacucaucccacuacccgacguacgcaacaacuucuaucacuacaaccaguccaacgacccaaccaucaaacucaucgccaugcucuacacaccccuacgcgccaacaacgccggagacgacguauucaccgucucaugccgcguacugacgcgccccagccccgauuucgacuuuauuuuucuuguacccccgaccgucgaaucgcgcacgaaaccauucagcguccccguccucacggucgaagaaaugacgaacucucgauuccccauaccccuagaaaaacucuucacaggccccuccuccgccuucgucguccagccacaaaacggccgcugcaccaccgaugggguacuccucgguacaacccaacucucacccguaaacaucugcaccuuccgaggagacguaacccacauaaccggcucccgcaacuacaccaugaaccuugccucccaaaacugguccaacuacgaccccaccgaagaaauccccgcaccccuaggaacacccgacuucguuggaaaaauccaaggcguccuaacccaaacuacccgcacggacggcucaacccgaggacacaaagccacugucuacaccggcucagcugacuucgcaccuaaacucggccgaguccaauucgaaaccgacaccgaccacgauuucgaagcuaaccaaaacaccaaauucacacccgucggcguuauacaagacggcggcaccacucaccgcaacgaaccacaacaguggguccuacccucauacagcggccgcaacaccccuaacguccaccucgcccccgccguagcccccaccuuucccggagaacaacuacuauucuuccgcuccaccaugcccggcugcucgggcuaccccaacauggaccuagacugccuccucccccaggaauggguucaauacuucuaccaagaagccgcccccgcccaauccgacgucgcccuacuccgauucgucaaccccgacaccggccgaguacuuuucgaaugcaaacuacacaaaucaggcuacgucacagucgcccacaccggccaacacgaccuagucaucccacccaacggcuacuuccgauucgacuccugggucaaccaauuuuacacccuagcacccaugggaaacggcaccggcagacggcgcuaa

SEQ ID NO: 38545 - RNA, 1617 nt, Artificial Sequence
  derived and/or modified sequence opt11 from VP1__Norovirus_and/or_Norovirus-like__KP241909
augaaaauggccuccucagacgccaaccccucagacggcuccgccgcuaaccucguucccgaagucaacaaugaagucauggcccucgaaccuguaguaggagcagccaucgccgcaccagucgcgggacaacaaaaugucauagaccccuggauccguaacaacuucguccaagccccuggcggcgaguucaccgucuccccaagaaacgcuccaggggaaauccuauggucagcaccccucggcccagaucuaaaccccuaccucucucaccucgcgcgaauguacaacggcuacgccggugguuucgaaguucaaguaauccucgcuggcaacgccuucaccgcaggcaaagucaucuucgccgcaguaccacccaacuuccccacagaaggccucucacccucacaaguuaccauguucccacacauaguagucgacguccggcaacucgagccuguccucauaccccucccagacguccgcaacaacuucuaccacuacaaccaauccaacgaccccaccauaaaacucauagcaaugcucuacacaccccuccgcgccaacaacgcaggcgacgacguauucacaguuuccugcagaguccuaacccgcccauccccugacuucgacuucaucuucuuaguaccucccacagucgaaucacgaacgaaacccuucucgguucccguccucacagucgaagaaaugaccaacucccgauuccccaucccccucgaaaaacuauucaccggccccuccuccgccuucguagugcaaccccaaaacggcagauguaccaccgacgguguacuccucggcacaacccaacuaucacccguaaacaucugcaccuucagaggcgacgucacacacaucacuggcuccagaaacuauaccaugaaccucgcaucccaaaacuggucaaacuacgaccccacagaagaaaucccagcgccccucggaaccccagacuucguaggaaaaauccaaggcguccucacacaaacaacucgaaccgacggcucaacccgcggccacaaagccaccguauauacuggcagugccgacuucgccccgaaacucggccgcguacaauucgaaacugacaccgaccacgacuucgaaacuaaccaaaacaccaaauucaccccuguaggcgucauccaagacggcggcaccacccaccgcaacgaaccccagcaauggguccucccuucauacuccggccgaaacacacccaacguccaccuagccccagccgucgcccccaccuuccccggcgaacaacuccucuuuuuccgcuccacaaugcccggcugcuccggcuacccaaacacagaccuagacugccuccuaccucaagaauggguccaauacuuuuaccaagaagccgcuccagcccaaucagacguagcccuccuccgcuucgucaacccggacaccggacgcguacuauucgaaugcaaacuccauaaaucaggcuacguaacagucgcacacacaggccaacacgaccuggucauaccacccaacggauacuuccgcuucgacuccuggguaaaccaauucuacacccucgcacccaugggaaauggaaccggaaggcgccgcuga

SEQ ID NO: 38546 - RNA, 1617 nt, Artificial Sequence
  derived and/or modified sequence opt11 from VP1__Norovirus_and/or_Norovirus-like__KJ533132
augaaaauggcauccagugaugccaaccccuccgacggaagcgccgcaaaccucguaccagaagucaacaacgaggucauggcccuagagccaguagucggcgcagccauagccgcccccguagccggccaacaaaacgucauagaccccuggauaagaaacaacuucguacaagcacccggcggcgaguucacagucucgccccgaaacgcucccggcgaaauacucugguccgcaccccugggccccgaccucaaucccuaccugagccaccucgcccgaauguacaacggcuacgccggaggcuucgaaguccaagucauccuagccgguaacgccuucacggccggcaaaguaauauucgcugccgucccacccaacuuucccaccgagggacuaucccccucacaagucacaauguucccccacauagucgucgacguccgccagcuugaacccguccuaauaccacuacccgacguuagaaacaauuucuaccacuauaaccaaagcaacgaucccaccauuaaacuaaucgccaugcuuuacacuccccuacgagcaaacaacgccggagacgacgucuuuaccguauccugccgaguccuaacccgacccucacccgacuucgauuucaucuucuuaguaccucccaccgucgaauccagaaccaaaccuuucuccgucccgguccuaacagucgaagaaaugacaaacucccgcuuccccauaccccucgaaaaacucuuuaccggccccucauccgccuucgucguccaaccccaaaacggccgcuguaccacugauggcguucuccucgguaccacccaacuauccccagucaacaucugcacuuuccgaggcgacguuacccacaucaccggaucccgcaacuacaccaugaaccucgccucgcaaaacuggaacaacuacgaccccaccgaagagaucccugcaccccuuggaacaccggacuucgucggcaaaauccaaggaguccuaacccaaaccacccgcaccgacggcuccacaagaggccacaaagccaccgucuacacaggauccgcagacuucgccccaaaacucggccgagugcaauuugaaaccgacaccgaccacgacuucgaagcaaaccaaaacacuaaauuuacucccguaggcgucauccaagacggcggaacgacacaucgcaacgaaccucaacaauggguccucccuuccuacaguggccgcaacacccauaacguucaccuugcccccgccgucgcccccaccuuccccggugaacaacuccucuucuuccguagcacaaugcccggcugcuccggcuauccaaacauggaccuagacugccucuuaccccaagaguggguacaauacuucuaccaagaagccgcccccgcacaaucagacgucgcacuacuacgcuucgucaaccccgacacaggacgaguccucuucgaaugcaaacuucacaaaagcggauacgucacagucgcacacaccggccaauacgaccucguaauuccacccaacggcuacuuccgauucgacagcuggguaaaccaauucuacacacucgcacccauggguaacggcaccggccgccgccgcuaa

SEQ ID NO: 38547 - RNA, 1617 nt, Artificial Sequence
  derived and/or modified sequence opt11 from VP1__Norovirus_and/or_Norovirus-like__KP176407
augaaaauggcaucaucagacgccaaccccucagacggcuccgccgccaaccucguaccagaagucaacaacgaagugauggcacuugagccagucguuggagccgcaauagccgcccccgucgcaggccaacaaaacgucaucgaucccuggauccguaacaacuuuguccaagcacccggaggcgaguucaccguuuccccacgcaacgcccccggcgaaauccucuggagcgccccacucggacccgaacuuaacccauaccucucccaccucgcacgcauguacaacggcuacgcaggcggcuuugaaguccaaguaauccuugccggcaacgccuucaccgccggaaaagucaucuucgccgccgucccaccaaacuuccccacugaaggacuauccccaucccagguaaccauguucccccacauugucgucgacguacgccaacucgaaccuguccuaauaccccucccagacguccggaacaacuucuaccacuacaaccaauccaacgacccaaccaucaaacucaucgcaaugcucuacacuccccuccgcgcaaauaacgcgggcgaugacgucuucaccguauccugccgcguacucaccaggccuucaccugacuucgauuucauauuccucgucccacccaccgucgaaucacgcacaaaaccuuucuccguaccaguccucacaguagaagaaaugaccaacucccgcuuccccauuccacucgagaaauuauucaccggccccucaucagcauucguaguucaaccacaaaacggacgcugcacuacagacggaguacuacucggcaccacucaacucucccccguaaauaucugcacauuccgaggcgacguaacacacauaaccggcagccgcaacuacaccaugaaccucgcaucccaaaacugguccaacuacgaccccacagaagaaauccccgccccacucggaacccccgacuuuguuggcaaaauccaaggcguacuaacccaaacaacccgaaccgacggcuccacccgcggacacaaagccaccgucuacaccggcucugccgacuuugcccccaaauuaggccgaguccaauucgagaccgacacagaccgcgacuucgaagccaaccaaaacacaaaauuuacccccgucggcguaauccaagacggcucaaccacacaccgaaacgagccacaacaauggguccuccccuccuauuccggacgcaacacacccaacguacaccuugcccccgccgucgcacccacauuccccggcgaacaacuccuauuuuuccgaucaaccaugcccgguuguucaggauacccuaaccgagaccuggacugccuccugccccaagaauggguccaauacuucuaccaagaagccgcaccagcccaaagcgacguagcucuccuccgcuucgucaaccccgacaccggccgcguccucuucgaaugcaaauuacacaaaucaggcuacgucacagucgcacacaccggccaacacgaucucgucaucccucccaacggcuacuuccgcuucgacuccugggugaaccaauucuacacccuugcaccuaugggaaacggaaccggacgacgacguuaa

SEQ ID NO: 38548 - RNA, 1617 nt, Artificial Sequence
  derived and/or modified sequence opt11 from VP1__Norovirus_and/or_Norovirus-like__KP176406
augaaaauggccucaucugacgcuaacccaucggauggauccgccgcuaaccuaguccccgaagucaauaacgaaguaauggcacucgaaccaguggucggcgccgcuaucgcugccccagucgccggccaacaaaacgucauagacccuuggauccgcaacaacuucguccaagcacccggcggcgaguucaccgucucaccccgcaacgcaccaggagaaauccucugguccgcaccccucggaccagaccucaacccauaccuaucacaccucgcccgcauguacaacggcuacgccggcggcuucgaaguacaagucauccuugccggcaacgccuucaccgccggcaaagucaucuucgccgccguaccucccaacuucccaaccgaaggccuaaguccaucccaaguuacaauguucccacacaucgucgucgacguccgacaacucgaacccguacuaauaccacuccccgacguucgcaacaacuucuaccacuacaaccaaagcaacgaucccacaauaaaacucaucgccaugcucuacacuccccuacgcgccaacaacgccggugacgacgucuucaccguaucuugucgcguacucacacgcccuucaccagacuucgacuucaucuuucugguaccacccaccgucgaaucucgaaccaaacccuucuccguacccauccuaaccgucgaagaaaugacaaacucccgcuuccccauccccuuagaaaaacucuucacaggcccuagcucagccuucgucguccaaccccaaaacggccgaugcacuaccgacggcguucuccucgguaccacacaacucuccccagucaacaucugcaccuuccgcggggacguaacccacauuacaggcucacgcaacuacaccaugaaccucgcaucccaaaacugguccaauuacgaccccaccgaagaaauucccgcaccccucgguauacccgacuucgucggcaaaauccaaggcaugcuaacacaaaccacccgaaccgacggcuccacacgaggccauaaagccaccgucuauaccggcuccgccgacuucgccccaaaacucggccgcguccaauucgaaacagacaccgaccacgacuucgaagcuaaccaaaacacaaaauucacgcccguaggcgucauccaagauggcuccaccacccaccgcaacgaaccccaacaauggguccuccccucauacuccggccgaaacaccccaaauguccaucucgcccccgccgucgccccaaccuucccaggugaacaacuccucuucuuucgauccaccaugcccggcugcucaggguauccaaacauggaccuagauugccuccucccccaagaauggguccaauacuucuaccaagaagccgcucccgcccaauccgacguagcucuccuccgauucgucaaccccgacaccggccgaguucucuuugaauguaaacuccacaaaucaggcuacguuaccgucgcccacacuggccaacacgaccuaguaaucccgccuaauggauacuuccgcuucgacuccugggucaaccaauuuuacacccuagcacccaugggaaacggcaccggccgccgccguuga

SEQ ID NO: 38549 - RNA, 1617 nt, Artificial Sequence
  derived and/or modified sequence opt11 from VP1__Norovirus_and/or_Norovirus-like__KP123606
augaaaauggcuuccucagacgccaaccccuccgacggcuccgcugcuaaucuaguccccgaagucaacaacgaaguaauggcccucgaaccugucgucggcgccacaaucgccgcuccuguagcaggccaacaaaacgucaucgaccccuggauacgaaacaacuucguccaagccccaggaggagaauuuacaguuucacccagaaacgcucccggcgaaauccucuggucugccccacuaggucccgaccucaaccccuaccuaucacaccuggccagaauguacaacggcuaugccggcggauucgaaguacaaguuauccucgccggcaacgccuucacagccggcaaagucaucuucgccgccgucccacccaacuucccaaccgaaggccucucccccucucaagucaccauguucccacauaucgucguagacguccgccaacuagaaccaguccuuauaccccuccccgacguccgcaacaacuucuaccacuacaaucaguccaacgacccaaccaucaaacucaucgccaugcuuuacacaccccuacgcgccaacaacgcaggcgacgacgucuucaccgucagcugccgcguccuaacacggcccuccccagauuucgacuucauauuccucgucccucccaccgucgaaucucgcaccaaacccuucucaguccccauacuuaccguagaagaaaugaccaacagccgcuucccaaucccccuagaaaaacuuuucaccggacccucauccgccuucguaguccaaccacagaacggacgcugcacuacagacgguguccuccucggcacaacccaacugucccccgucaacaucugcacauuccgaggggacgucacccacaucaccggcucccgaaacuacacaaugaaucucgcaucccaaaacugguccaacuacgaucccaccgaagaaauccccgccccuuuaggcauccccgacuucgucggcaaaauacaaggcaugcucacacaaacaacccgcacggacggcuccacacgcggccacaaagccaccgucuacacaggcagcgcagacuucgccccuaaacucggccgcguccaauucgaaaccgacaccgaccacgacuucgaagccaaucaaaacacaaaguucacccccguuggcguaauccaagacggcuccaccacccaccgaaacgaaccacaacaauggguccuaccaagcuacucaggccgaaacacacccaacguacaccuagccccagccguagccccaacuuuccccggugaacaacuccucuucuuucgcuccaccaugccuggcugcucagguuacccaaacauggaccucgacugucuacuaccccaagaauggguccaauacuucuaccaagaagccgccccugcccaguccgacgucgcccuccuccgauucguaaaccccgacaccggacgagucuuauucgaaugcaaacuccacaaauccggcuacguaaccguugcacacacaggccaacacgaccucgucaucccuccaaacggcuacuuccgcuucgacuccugggucaaccaauucuacacacuagcccccauggggaacggcacaggacgccgacgauaa

SEQ ID NO: 38550 - RNA, 1617 nt, Artificial Sequence
  derived and/or modified sequence opt11 from VP1__Norovirus_and/or_Norovirus-like__KP096335
augaaaauggccucauccgacgcaaacccguccgacggcuccgccgccaaccuaguccccgaaguuaacaacgaaguaauggcccucgaacccguagucggcgccgcaauagccgccccgguagcaggacaacaaaacguaaucgacccauggauacgaaauaacuuuguccaagcccccggcggcgaauuuaccgucucaccccgcaacgcccccggcgaaauacucuggucugcgccccucggccccgaccucaauccuuaccugucacaccucgccagaauguacaacggcuacgccggcggauucgaaguacaaguaauccucgccggcaacgccuucaccgccggaaaaguaaucuucgcagccguacccccaaacuuccccacagaaggacucucacccucccaagucaccauguucccacacaucgucgucgacguccgccaacucgaacccguccucauuccccuuccagacguccgcaacaacuucuaccacuacaaccaauccaacgaccccacaaucaaacuaauugcuaugcuauacacaccacuccgcgccaacaacgccggcgaugacguauucaccgucucaugccgcgucuugacccgccccucaccugauuucgacuuuaucuuccucgucccacccaccgucgaaucaagaaccaaacccuucuccguacccguacucaccguugaggaaaugacaaacagcagauuccccaucccccucgaaaagcuauucacagggcccucaagcgccuucgucguccaaccccaaaacggacgcugcaccacagacggcguacuccucggcaccacccaacucagccccguaaacaucugcaccuuccgcggcgacgucacucacaucacaggcucccgcaacuacaccaugaaucucaccagccaaaauuggagcaacuacgaccccaccgaagaaauccccgcaccccucggcaccccugacuucgucggcaaaauccaaggaaugcucacucaaacaacccguacagacggcagcacccgcggccacaaagccaccguauacaccgggucagccgacuuugcccccaagcucggcagaguccaauuugaaaccgacaccgaccacgauuucgaagccaaccaaaacaccaaauucaccccuguaggaguaauucaagauggaagcaccacacaccgcaaugaaccacaacaauggguacucccaucauacucaggacgcaacaccccaaacguccaccuagcacccgcugucgccccaaccuuucccggcgaacaacuacucuucuuccgcuccaccaugcccggaugcucaggcuacccaaacauggaccuugacugccuccuaccacaagaauggguccaauacuucuaccaagaagccgcccccgcccaaucugacguagcccuucuccgguucgucaacccagacacaggccgaguccucuucgaaugcaagcuccacaaauccggcuacgucacaguagcgcauaccggccaacacgaccucguuauacccccuaaugguuacuuccgcuucgacucauggguaaaccaauucuacacccuagcccccaugggcaacggaacuggcagacgcagauga

SEQ ID NO: 38551 - RNA, 1617 nt, Artificial Sequence
  derived and/or modified sequence opt11 from VP1__Norovirus_and/or_Norovirus-like__KM268095
augaaaauggccucuucagacgcaaaccccuccgacggaucagcagcgaaccuuguacccgaagucaacaacgaagucauggcucucgaacccgucguaggcgccgccaucgcagcccccguagccggccaacaaaacguaauugaccccuggauacgcaacaacuucgugcaagcacccggaggagaguucacugucucaccacgaaacgcucccggcgaaauccuuugguccgccccacucggccccgacuuaaaccccuaccuaucccaccuagccaggauguacaauggauacgccggaggcuucgaaguccaaguaauccuugcaggcaacgccuucaccgcaggcaaaguaauauucgccgccguaccgcccaacuuccccacagaaggacuaucccccucacaaguaaccauguucccacacauagucgucgauguccgccaacuagaacccguccucaucccccuucccgacguccgcaacaacuucuaccacuacaaccagucaaacgaccccaccauaaaacucaucgccauguuauacacaccacucagagcuaacaacgccggugacgacguauuuacagucucaugccguguccucaccagaccaucccccgacuuugacuucaucuuucucguuccaccaacagucgaaucacgaaccaaacccuucuccguccccguacuaaccgucgaagaaaugaccaacucccgauuccccaucccgcucgaaaaacuuuucaccgguccuuccuccgcauucguaguccaaccccaaaacggacguuguacuaccgacggcguccuccucggcacaacccaacuaucaccagucaacauaugcacguuccgcggcgacguaacccauauaaccggaucccgaaacuacacaaugaaucuagcaucccaaaauuggucaaauuaugacccaacggaagaaauacccgccccucucggaacccccgacuucguagguaaaauccaagguguccucacacaaaccaccagaacggacggcagcacacgcggccacaaagccaccgucuacaccggauccgccgauuuugcccccaaacuaggccgcguccaauucgaaaccgacacagaccacgacuucgaaaccaaccaaaacaccaaauucacacccgucggcgucauccaagacggcuccacaacccauaggaacgaaccccaacaaugggugcuccccuccuacuccggacgcaacaccccuaauguccaccuagcccccgccgucgcccccaccuucccgggcgaacaacuacucuucuuccgauccaccaugccgggcugcuccggcuaccccaacauggaucuagacugcuuacuaccccaggaauggguacaauacuucuaucaggaagccgcacccgcccaauccgacgucgcccuccuccgcuucgucaaccccgacacaggacgaguacuuuucgaaugcaaacuccacaaauccggcuacgucaccguggcccacaccggccaacacgaccucgucauucccccaaacggauacuuccgcuucgacuccugggucaaccaauucuacacccuagcacccaugggcaacggcaccggcagacgacgauaa

SEQ ID NO: 38552 - RNA, 1617 nt, Artificial Sequence
  derived and/or modified sequence opt11 from VP1__Norovirus_and/or_Norovirus-like__KM268094
augaaaauggccucuucagacgcaaaccccagcgacggcuccgccgccaaccuaguacccgaaguaaacaacgaagucauggcccucgaaccaguaguaggagccgccaucgccgcccccgucgcuggucaacaaaacgucaucgacccuuggauccgaaacaacuucguccaagcacccgguggcgaguucaccguaucaccccgcaacgcucccggcgaaauccuaugguccgcuccccuaggccccgaucucaacccauaccuaucccaccucgcacgaauguacaacggcuacgcuggaggcuucgaaguacagguaauccuagccggcaacgcauucacagcaggaaaagucaucuucgcggccgucccacccaacuuccccacugaaggccucucccccucccaagucaccauguucccccacauaguaguagacgugcgccaacucgaaccuguccuaaucccccuacccgacgucagaaauaacuucuaccacuacaaucaaucaaacgaccccacaaucaaacuuaucgccaugcuauacaccccacuccgcgcaaacaacgcaggagacgacgucuucaccguauccugcagaguacucacccgacccagccccgacuucgacuucauauuucuaguacccccuacgguagaauccagaaccaaacccuucucaguccccauacuuacagucgaagaaaugaccaacucccgauuccccaucccucuagaaaaacucuucacaggacccagcucagcauucgucguucaaccacaaaacggcagaugcacaaccgacggaguacuccuugggaccacccaacuaucaccugucaacauaugcacguuccgcggagacgucacccacaucacuggcucccgaaacuacacaaugaaccucgccucucaaaacuggagcaacuacgacccaaccgaagaaauccccgccccacuagguacccccgacuucguaggcaaaauccagggcguacucacccaaacaacccgaaccgacggcucaacacggggccacaaagcaacagucuacaccggauccgccgacuuugccccuaaacuaggacgcguccaauucgaaaccgacaccgaccacgacuucgaagccaaucaaaacaccaaauucacgccgguaggugucauccaagacggcucaacaacccaccgcaacgaaccucaacaauggguccuacccuccuacagcggccgaaacacacccaacguccaccuagccccagccguagccccaaccuuccccggcgaacaacuacucuucuuccgaucaaccaugcccggaugcucaggcuacccaaacauggaccuagacugccuacucccacaagaauggguacaauacuucuaccaagaagcagcacccgcccaauccgacgucgcacuccuccgcuucgucaacccagacacagggagaguacuauucgaaugcaaacuccacaaaagcggcuacgucacaguagcccacacaggccaacacgaccucgugauacccccuaacggcuauuuccgcuucgacuccugggucaaucaauucuacacccuagccccaaugggcaacggcaccggccgccgacgcuaa

SEQ ID NO: 38553 - RNA, 1617 nt, Artificial Sequence
  derived and/or modified sequence opt11 from VP1__Norovirus_and/or_Norovirus-like__KM268093
augaaaauggcauccucagacgccaaccccucagacggcuccgcagcaaaccucguucccgaaguaaacaacgaagucauggcccucgaaccaguaguaggagccgccauagcagcacccguagcuggacaacaaaacgucauagaccccuggauacgauccaacuucguucaagcacccggcggcgaauuuaccgucucuccccgaaacgcaccaggcgaaauacuauggucagcaccccucggcccagaccuaaacccauaccucucacauuuagcccgaauguacaacggcuaugccggcggcuucgaaguccaagugauccucgcgggaaacgccuucaccgccgguaaagucaucuucgccgccguaccacccaacuucccaaccgaaggacucucaccaucccaagucacaauguucccacacaucgucguagacguuagacaacuagaacccguacucauuccccuaccagacguccgaaacaacuucuaccauuacaaccaaagcaacgaccccaccaucaaacuaauagccaugcucuacaccccucuccgcgccaacaaugccggcgacgaugucuucaccgucucaugucguguccuaacccgacccagcccagacuucgacuucaucuuccucguaccucccaccgucgaaucccgcaccaaacccuucuccguucccguccucaccgucgaagaaaugacaaacuccagauuccccaucccccuagaaaaacuauuuaccgggccauccucagccuucgucguccaaccccaaaauggccgcugcaccaccgacggcguccuccucggcaccacccaacucucuccaguuaacaucugcacauuccgcggugacgucacccacaucacgggcucccgcaauuacacuaugaaccucgccucccaaaacugguccaacuacgaccccaccgaagaaauccccgccccacuuggaacuccugacuucgucggcaaaauacaaggcguccucacccaaaccacacgcacagacgggucaacccgcggccacaaagccacagucuacaccgggucagcagacuucgccccaaaacucggacgcguccaauucgaaacagacaccgaccacgacuucgaagcaaaccaaaauacaaaauucaccccaguaggcgucauacaagacggcgguaccacccaccgcaacgaaccacaacaauggguccuccccucauacuccggccgaaacacccccaacguacaccucgcacccgccgucgcaccuacauuucccggugaacaacuacucuucuuucgcucaacaaugcccggaugcucuggcuaccccaacauggaucuagacugccuccuuccacaagaauggguacaauauuucuaccaagaagccgcccccgcccagucugacguagcccuccuccgcuuugucaaccccgacaccggccgcguccucuuugaaugcaagcuccacaaauccggcuacgucaccgucgcucacaccggccaacacgaccuggucaucccacccaaugguuacuuccgcuucgacuccuggguuaaccaauucuacacccuugcccccaugggcaacgguaccggccgucgccgguga

SEQ ID NO: 38554 - RNA, 1617 nt, Artificial Sequence
  derived and/or modified sequence opt11 from VP1__Norovirus_and/or_Norovirus-like__KM198591
augaaaauggccuccaacgacgccaacccauccgacggcucagccgccaaccucguucccgaagucuccaacgaagucauggcccucgaacccgucgucggcgcagcuaucgccgcacccguagccggccaacaaaacguaaucgaccccuggauccguaacaacuucguccaagcccccggcggcgaauuuaccgucucuccccggaacgcacccggcgaaauccuuugguccgcgccccuaggcccagaccucaaccccuaccucucccaccucgcccgaauguacaacggcuacgccggcggauucgaaguacaaguuauccucgccggcaacgccuucaccgccggcaaaauaauauucgccgccgucccgcccaacuuccccacagaaggccucuccccaucccaaguaaccauguucccccacaucauagucgacguccgacaauuggaaccaguccuaauaccacuccccgauguacgaaacaacuucuaccacuacaaccaaacaaacgacuccaccauaaaacucauagccaugcuauacacaccccuccgcgcaaacaacgccggcgaagaugucuucaccgucucaugccgcguccuaacccgcccuucccccgacuucgacuucaucuuccuuguacccccaaccgucgaaucucgcaccaaaccuuucaccguccccauccucaccgucgaagagaugaccaacuccagauuucccaucccacuagaaaaacuauucaccggucccuccggcgcguucgucguccaaccccaaaacggccgcuguaccacugacggaguccuccucggaacuacccaauuauccccaguuaacaucugcaccuuccgaggcgacguaacccacaucgccgguucccgcaacuacaccaugaauuuagccucccucaacuggaacaacuacgaccccaccgaagaaauccccgcaccacucggaacacccgacuucgucggcaaaauacaagggguccucacucaaacaacaaaaggagacggcucaacccguggccacaaagccaccgucuacaccggcuccgcccccuucaccccaaaacucggcuccguccaauucuccacagacacagaaaacgauuucgaaacccaccaaaacacaaaauucaccccagucggagucauacaagacggcggcacaacccaccgcaacgaaccccaacaauggguccuccccucauacucaggacgcgacguccacaacguccaccucgcccccgcugucgcacccaccuucccaggugaacaacuccuauucuuccgcuccaccaugccugggugcuccggcuaccccaauauggaccucgacugccuacucccacaagaauggguucaacacuucuaucaggaagccgcacccgcccaauccgacgucgcacuccuccgcuucgucaaccccgacacaggccgaguucuuuucgaaugcaaacuacacaaaucuggauacguaacagucgcccacaccggccaacacgauuuaguaaucccuccaaauggcuacuuccgcuucgacucaugggucaaccaauucuauacacucgcccccaugggcaacgguaccggccgccgacgcuga

SEQ ID NO: 38555 - RNA, 1617 nt, Artificial Sequence
  derived and/or modified sequence opt11 from VP1__Norovirus_and/or_Norovirus-like__KM198589
augaaaauggccuccaacgacgccaacccuuccgacggcucggccgccaaccucguccccgaagucagcaacgaaguuauggcccuagaaccaguugucggcgccgcaaucgccgcaccagucgcaggccaacaaaacgucauagacccauggaucagaaacaacuucguccaagcacccggcggcgaguucacagucuccccacgaaaugcacccggagaaaucuuauggucagcaccccuuggaccagaucuuaacccauaccuaucacaccucgcacgaauguacaacgguuacgccggcggcuucgaaguccgagucauacuagccggcaacgccuucacagcgggaaaaaucaucuucgcugccguucccccaaacuuccccacagaaggacucucacccucccaagucacaauguucccccacaucaucgucgacguucgacagcuagaaccaguccucauaccacuuccugacguccgcaacaacuucuaccacuacaaccaaacaaacgacuccaccaucaaacucaucgcaaugcuauacaccccacuucgggcaaacaacgcuggagaagaugucuuuaccgucagcugccgaguucucacacgccccucccccgacuucgacuucauuuuccuuguaccacccaccguagaaucccgcacaaaacccuucaccguccccauccucacugucgaagaaaugacaaacucccgcuucccaauaccacuugaaaaacucuuuaccggccccucaggugcauucgucguccaaccccaaaacggccgaugcacuacagacggaguccuccuaggcaccacccaacucuccccagucaacaucugcaccuuccgcggcgacguaacacacauugccggcagcagaaacuauaccaugaaccucgcgucccuuaacuggaauaacuacgaccccacggaagaaaucccagccccucuaggcacccccgacuucgucggcaaaauccaaggcguccuaacccaaaccaccaaaggcgacggcucuaccagaggacacaaagccaccgucuacaccggcuccgccccuuuuacccccaaacuuggcuccguccaauucuccacagacacugaaaacgacuucgaaauacaccaaaacaccaaauucacacccgucggcgucauccaggacggcggaacgacccaccgcaacgaaccacaacaauggguccuucccuccuacagcggccgcgacguccacaacguccaccuagccccagccguagcccccacauuccccggcgaacaacuacuauuuuuccgaucaacaaugcccggaugcuccggcuacccaaacauggaccucgacugccuccucccgcaggaguggguccagcacuucuaccaggaagcagcacccgcccaaucagacguugcccuucuuagauuuguaaaccccgacacaggcagaguacuauucgaaugcaaacuacaccgcuccggcuauguaacagucgcccacaccggacaacaugaccucguaaucccacccaacggauacuuccgauucgauuccugggucaaccaauucuacacacuagcccccaugggcaacggcaccggacgccgccgauaa

SEQ ID NO: 38556 - RNA, 1617 nt, Artificial Sequence
  derived and/or modified sequence opt11 from VP1__Norovirus_and/or_Norovirus-like__KM198576
augaaaauggccucuaaugacgccaacccauccgacggcucugccgcuaaccugguccccgaaguaaacaacgaaguuauggcccuagaaccagucguaggcgccgccaucgcagcaccagucgccggccaacaaaacgucaucgaccccuggauccgcaacaacuucguccaagcccccggcggagaguucaccgucucaccccgcaacgcaccaggcgaaauccuuugguccgccccacucggccccgaccuaaaccccuaccuuucccaccuggcucgcauguacaauggcuacgccgggggcuuugaaguacaagucauacucgcuggcaacgccuucaccgcagguaaaauaaucuucgcugccguacccccgaacuucccaacugagggccuaucccccucccaagucaccauguucccccacauaaucgucgacguccgccaacucgagccgguacucaucccacuccccgacguccgaaacaacuucuaccacuacaaccaaucaaacgacuccacaaucaaacucaucgcuaugcuauacacuccccuucgcgcuaacaacgccggcgaagacgucuucaccgucuccugccgaguccuaacccgccccucccccgacuucgacuucauauuccucgucccacccacaguagaaucaagaacaaaacccuuuacaguaccaauccucaccguagaagagaugacaaacucccgauucccaaucccccucgaaaaacucuucaccggccccagcggcgcauucaucguccaaccccagaacggccgcugcaccaccgacggcgucuuacucggcaccacccaacuaagccccguaaacaucugcaccuuccgaggcgacgucacccacauagcuggcucccgcaacuauaccaugaaccucgcaucccuaaacuggaacaauuacgaccccaccgaagaaaucccagcaccccucggcacccccgacuucgucggcaaaauccaaggaguccucacccagacaacaaaaggagauggaucaacacgcggccacaaagcaaccgucuacaccggcucagcccccuucacaccaaaacuuggaagcguccaguucuccaccgacacagaaaaugacuucgaggcacaccaaaauaccaaguucacacccgucggcgucauccaagacggaggaaccacucacaggaacgaaccccaacaguggguacugccaagcuacagcggccgggacguacacaacguccaccuagcaccagccguggccccaacauucccaggggagcaacuccucuucuuccgcuccacaaugcccgggugcuccggauaccccaacauggaccuagacugccuccucccucaagaauggguucaacacuucuaccaagaagccgcacccgcccaaucagacgucgcguuacuccgcuucgucaacccagacacuggccgcguacuauucgaaugcaaacuucacaagccaggcuacgucaccguagcgcacaccggucaacacgaccuagucauacccccaaacggcuacuuccgcuucgacucaugggucaaccaauucuacacccuagcaccuaugggcaacggaaccggacgcagacgcuaa

SEQ ID NO: 38557 - RNA, 1617 nt, Artificial Sequence
  derived and/or modified sequence opt11 from VP1__Norovirus_and/or_Norovirus-like__KM198564
augaagauggccucaaacgacgcaaaccccucagacggcucagccgccaaccuagucccugagguuaacaaugaaguaauggcccucgaacccguaguaggagccgccaucgccgcccccgucgccggacaacaaaacguaaucgaccccuggauacgcaacaacuucguccaagcccccgguggagaguucaccgucucaccccguaacgccccgggagaaauccuuugguccgcuccccuaggccccgaucuaaacccauaucuaucccaccucgcccgaauguacaacggcuacgccggaggcuucgaaguucaaguaauucucgccggaaacgccuucaccgccggcaagaucaucuucgccgccgucccacccaacuuucccaccgaaggacucucacccucacaagucacaauguucccccacaucaucgucgacguccgucaguuagaaccaguauuaaucccccugccagauguacgcaacaacuuuuaccacuacaaccaguccaacgacucaacaauaaaauuaaucgccaugcucuacacuccccucagggcaaacaacgccggcgaggacgucuucaccgucucuugcagaguacuaacccgaccaucccccgacuucgauuucauauuccucgucccacccaccguagaaucccgcacuaaacccuucacaguacccauccuuaccgucgaagaaaugaccaacucccgauuccccaucccccuagaaaaacuauuuaccggccccucaggcgccuucaucguccaaccccaaaacggccgaugcaccaccgacggcguccuccucgguaccacccaacuuucgcccguuaacauaugcaccuuccgaggcgacguaacacacauugccgggucccgcaacuacaccaugaaccucgccucccuaaacuggaacaacuacgaccccacugaagaaauacccgccccacucggcacccccgacuucgucggcaaaauccaaggcguccucacccaaaccaccaagggcgacggauccacccgaggccacaaagcuaccguauacaccgguggcgcacccuucaccccaaaacuaggcucaguacaguucucaaccgacacagaaaacgacuucgaggcccaccaaaacacaaaauucacccccgucggcgucauacaagauggcggcaccacacaccguaacgaaccacaacaauggguccucccuuccuauucaggccgagacguccacaacguccaccuagcaccagcaguagccccuaccuucccaggcgagcaacuccucuucuuccgaucaaccaugccaggcugcucaggauaccccaauauggaccucgauugccuccucccccaggaauggguacaacauuucuaccaagaagcagcacccgcccaaagugacgucgcccuccuccgauucgucaaccccgacaccggccgcguccucuucgaaugcaaacuacacaaauccggauacgucaccgucgcccacaccggacaacacgacuuagucauacccccaaacgguuacuuccgcuucgacagcugggucaaccaauuuuacacccuagcacccauggguaacggaaccggccgccgacgcuga

SEQ ID NO: 38558 - RNA, 1617 nt, Artificial Sequence
  derived and/or modified sequence opt11 from VP1__Norovirus_and/or_Norovirus-like__KJ716355
augaaaauggccucauccgacgccaaccccuccgacggauccgccgccaaucuaguuccagaagucaacaacgaagucauggcccucgaacccguagucggcgcggccaucgccgccccaguugccggacaacaaaacgucaucgacccauggauccgcaacaacuucguucaagcacccggcggcgaguuuaccguaucuccccgcaacgcacccggcgaaauccuauggagcgcaccccucggccccgaccucaaccccuaccuaucccaucucgcccgaauguacaacggcuacgccgggggcuucgaagugcaggucauccuagccggaaacgcguucacugcuggcaaagucaucuucgccgcaguaccaccaaacuuccccacagaaggacuaucuccuucccaagucacuauguucccacacaucguugucgacguacgccaacucgaacccguacucauaccccuucccgacguacgaaacaacuucuaccacuacaaccaaucaaacgaccccaccaucaaacuaaucgccaugcuauauaccccacuccgcgccaacaacgccggcgacgaugucuuuaccgucuccugucgaguccucacgcgccccuccccagacuucgacuucauauuccucgucccucccaccguagagucccgcaccaaaccauucagcguccccauccuaacaguagaagaaaugacaaacucccgauuccccaucccccuagaaaaacucuucaccggcccauccuccgcuuucgucguccaaccucagaacggccgcugcacaacugacggcguccuacucggcaccacucaacuaucccccgucaacaucugcaccuuccgcggcgacguaacacacaucaccggcucacgcaacuacaccaugaaccucgcaucccagaacuggaacaacuacgaccccaccgaagagauucccgcaccacuagguacccccgacuucguaggcaaaauccaggguguccucacacaaaccacccguaccgacggcaguacccgcggacacaaagccacagucuacacaggaucggccgacuucgcacccaaacuaggccgcguccaauucgaaaccgauacagaccacgacuucgaagccaaccaaaacaccaaauucacaccagucggaguuauacaagauggcggcacuacccaccguaacgaaccucagcaauggguccuuccaucauacuccggacgcaacacacauaacguccacuuggcucccgccgucgcaccaaccuuuccaggcgaacaacuccuauuuuuccgauccaccaugccaggaugcuccggauauccaaacauggaccucgacugccuccuaccccaagaauggguccaauacuucuaucaagaagccgcacccgcccaauccgacgucgcacuacuccgcuucgucaaccccgacaccggcagaguccuguucgaaugcaagcuacacaaaagcgguuacgucacagucgcucacaccggacaacacgaccucgucaucccacccaacggcuacuuccgcuucgacuccugggucaaccaauucuacacccucgcacccaugggaaacggcaccggacgccgacgcuaa

SEQ ID NO: 38559 - RNA, 1617 nt, Artificial Sequence
  derived and/or modified sequence opt11 from VP1__Norovirus_and/or_Norovirus-like__KJ685408
augaaaauggccagcuccgacgccaaccccuccgacggcuccacugccaaccucgucccagaaguaaacaacgaaguaauggcccucgaaccagucguaggagcagcaaucgccgccccagucgcaggccaacaaaacgucaucgaccccuggauccgcaacaacuucguccaagccccaggcggagaguucaccguuucaccacgcaaugcucccggagaaauccuaugguccgccccacucggccccgaccuaaaccccuaccucagucaccuggcacgcauguacaacggcuacgccggcggcuucgaaguccaaaccauacuagccggaaaugcuuucacagccggcaaaauaaucuucgccgcagucccacccaacuucccaacagaaggucucucacccucccaagucaccauguucccucacauaaucgucgacguaagacaacuagaacccguucucaucccccuacccgacguccgcaacaacuucuaucacuacaaccagacaaacgacccaaccauaaaacucaucgcgaugcucuacaccccacuccgagccaacaacgcaggagacgacgucuucacugucucaugccgcguccuuacgcgaccaucccccgacuucgauuucaucuuucucgucccuccuaccguugaaucccgaaccaaaccauucuccguccccguccuaacagucgaagaaaugacaaacucccgcuuccccaucccccucgaaaaacuuuucaccggccccucauccgcauucguaguccaaccccaaaacggacgcugcacaacagacggcguccuacuaggcaccacacaacuuucacccgucaacaucugcacuuuccgaggcgacgucacccacaucagcggcucccgaaacuacacaaugaaccucgccucacagaacuggaacuccuaugacccaaccgaagaaaucccagccccacucggcacacccgacuucguaggaaaaauccaaggaguacucacccaaacaacccgcaccgauggaucuaccagaggccacaaagccaccgucuacaccggcuccgccgacuucucccccaaauuaggccgcguccaguuugcaaccgacaccgacaaugacuucgaaaccaaucaaaacaccaaauucacacccgucggcguaauccaagacggaggcaccacccaccaaaacgaaccacagcaauggguacuccccuccuacuccggccgcgacacucauaauguccaccucgcgccagccguagccccgacauuccccggcgaacaacuacucuucuuccgaucgaccaugccuggcugcuccggauaccccaauauggaccucgacugccuacucccacaggaguggguccaauacuuuuaccaggaggccgcacccgcccaauccgacguugcacuccuucgcuucgugaaccccgacacuggccgcguccucuucgagugcaagcuacacaaauccggauacgucaccguugcacacaccggacaacacgaccuagucaucccacccaacgguuacuucagauucgacagcuggguaaaucaauucuacacacucgcccccaugggcaacggcaccggccgacgccgcuag

SEQ ID NO: 38560 - RNA, 1617 nt, Artificial Sequence
  derived and/or modified sequence opt11 from VP1__Norovirus_and/or_Norovirus-like__KJ144999
augaaaauggccagcaacgacgccaaccccucagacggcuccgccgcgaaccucgucccugaagucaacaacgaagucauggcucuagaaccagucgucggagcagcgaucgccgcccccguagccggccaacaaaacgucauagaccccuggauacgcaauaacuucguccaagcacccggcggcgaguucacagucucuccccgaaacgcccccggcgaaauacucuggucagccccacucggccccgaccucaaccccuaccuaagccaccucgcccgaauguacaacggcuacgcgggcggcuucgaaguccaagucauacucgcuggaaacgcauucaccgccggaaaaauaauauucgccgccguaccacccaauuuccccacagaaggacucucccccucccaagucaccauguucccccacaucauaguugacguuagacaacucgaaccaguccucaucccacuaccagacgugagaaauaacuucuaccacuacaaccaauccaaugacuccacaaucaaacucaucgccaugcuauacacaccccuccgcgcaaacaacgccggcgaggacguauucacugugucaugcagaguccuuacaagacccucucccgacuucgacuucaucuuccuugucccacccacaguagaaucacgcacaaaacccuucacaguucccauccuaaccgucgaagaaaugaccaacucucgcuuucccauaccacucgaaaaacucuucaccggaccaucaggcgcuuuugucguccaaccccaaaacggacgauguaccaccgacggcguccuccucggcaccacccaacucucccccguaaacaucugcaccuuccgcggcgacgucacacacauagccggcuccagaaauuacaccaugaaccuagcgucccucaacuggaacaacuacgacccuaccgaagaaauucccgcaccccucggcaccccugacuucguaggcaaaauccaaggcguccucacccaaaccacaaaaggagacggcucaacacgcggucacaaagccacggucuacaccggcggcgcccccuucacuccaaaacucggaucaguccaauucuccacagacaccgaaaacgacuucgaaacccaccaaaacaccaaauucacccccgucggcguaauucaggacggaucaaccacccaccgcaacgaaccacaacaauggguacuccccaacuacuccggacgcaacguacacaacguucaccucgccccagcugucgcaccaaccuuccccggcgaacaacuccucuucuuccgaucaaccaugccagguugcucuggcuaccccaauauggaucucgacugccuccuaccgcaagaauggguccaacacuucuaccaagaagccgccccugcucaaucagacguagcacuacuccgauuuguaaaccccgacacuggacguguccuauucgaaugcaaacuccacaaauccggcuacgucaccgucgcacacaccggacaacacgaccucgucauacccccaaauggcuacuuucgguucgacuccugggucaaccaauucuauacccucgcacccauggguaacggcgccggccgcagacgcuaa

SEQ ID NO: 38561 - RNA, 1617 nt, Artificial Sequence
  derived and/or modified sequence opt11 from VP1__Norovirus_and/or_Norovirus-like__KF060016
augaaaauggccuccuccgacgcaaaccccuccgacggauccacugccaacuuaguccccgaagucaacaacgaaguaauggcacuggaacccgucguuggcgccgccaucgccgcccccgucgccggccaacaaaacguaaucgauccauggauccgaaacaacuucguacaagcaccaggcggcgaguucaccgucuccccuaggaacgccccuggcgaaauucucugguccgccccucucggucccgaucuaaacccauaucuuucucaccucgcccggauguacaacggauacgcuggcggcuucgaaguucaagucauacucgccggcaacgccuuuaccgccggaaaaauuaucuucgccgccgucccaccaaacuuucccacggaaggacucucccccucgcaagucacaauguucccccacauaaucgucgauguccgacaacucgaaccaguccuuauaccccuccccgacguacguaacaacuucuaccacuacaaccaauccaacgacccaacuauaaagcucauagcaaugcuauacaccccucuaagagcaaacaacgccggcgacgacguauucacagucuccugccguguucuaacacgcccaucccccgacuucgacuucaucuuccucgucccucccacagucgaaucucgaaccaaacccuucuccguccccguacucaccgucgaagaaaugacaaacuccagauuccccgucccccucgaaaaacuauucacaggacccuccagcgcauucgucguccaaccccaaaacggccgauguaccaccgacggcguccuccucggcaccacacaacuaucccccgucaacauaugcaccuuccguggcgacguaacucacaucacuggcucccgaaacuacaccaugaaccucgccagccaaaacuggaacuccuacgaccccaccgaagaaauaccagcaccccugggcacccccgacuucguaggcaaaauccaaggaguccuuacccaaaccacacgaaccaacggcucaacccgcggccacaaagccacggucuacacaggcagcgccgacuucucccccaaacucggcagaguccaauucgccacagacaccgacaacgacuucgaaacaaaccaaaacacaaaauuuacccccgucggagugauacaagacgguuccaccaccccucggaacgaaccccaacaguggguccuccccuccuacagcggacgaaacauccacaacguccaccuagccccagcagucgccccaacuuucccaggagaacaacuccuauucuuccgcucaaccaugccaggcugcucaggcuacccaaacauggaccucgacugccucuuaccccaagaauggguucaauacuucuaccaagaagccgcacccgcccaauccgacgucgcgcuacugagauucguaaaccccgacacuggccgcguccucuucgaaugcaaacuacauaaaucgggcuacgucacaguagcacacacaggccagcacgaucuagucaucccacccaacggauauuuccgauucgacuccuggguaaaccaauuuuacacccuagcccccaugggaaacggcacuggccggcgccgcuaa

SEQ ID NO: 38562 - RNA, 1617 nt, Artificial Sequence
  derived and/or modified sequence opt11 from VP1__Norovirus_and/or_Norovirus-like__KC517367
augaaaauggccucaaacgacgcaaacccauccgacggaucugccgccaaccucguacccgaagucaacaacgaagucauggcacuagaacccgucgucggcgccgccaucgcagcccccgucgccggacaacaaaacguaaucgacccauggauccgcaauaacuucguccaggccccgggcggagaguucaccgucagcccccgcaacgcuccgggcgaaauacuaugguccgcaccccucggucccgaccuaaaucccuaccuaucccaccucgccagaauguacaacgguuacgccggcggcuucgaaguccaaguaauccuagccggcaacgccuucacugccggcaaaaucaucuucgcagccgucccacccaacuucccuacagaagggcucucccccucccaaguaaccauguuuccccacaucauaguagacguacgccaacuagaacccguccuaauucccuuaccagacguccgcaacaacuucuaccauuacaaccaauccaacgacuccacaaucaaacucaucgcaaugcucuacacuccccuacgcgccaacaacgccggcgaagacgucuucacugccuccugccgcguacucacccgccccagcccugacuucgacuucaucuuccucguaccaccaacugucgaaucacgaaccaaaccuuucaccguccccauucuaaccgucgaagaaaugacgaacucaagauucccgaucccccucgaaaaacucuucacaggccccucauccgccuucgucguacaaccccaaaacggccgcugcacuaccgacgguguccuccuaggcaccacccaacuguccccugucaauaucugcaccuuccgcggagacgucacccacaucgccggcagccgaaacuacaccaugaaccuagcaagccuaaacuggaauaacuacgacccuaccgaagaaauuccugcaccccuuggaacccccgacuucgucgguaaaauucaaggaaugcucacccaaaccaccaaaggcgacggaucuacucgcggacauaaagccacugucuacaccggcuccgccccuuucacccccaaacuaggauccguccaguucgaaaccgacaccgaaaaugacuucgaaacccaucaaaauacaaaauucaccccaguuggcgucauucaagacggaggaacagcccaucgcaacgaaccgcaacaguggguccucccaucuuacucaggccgaaacguccccaacguccaccucgcucccgcagucgcccccaccuuccccggcgaacaacuacuuuucuuccgcucuaccaugccaggaugcuccggcuaccccaacauggaccuagacugccuucucccucaagaauggguccagcacuucuaucaagaagcagcucccgcgcaaucagacguugcacuucuccgcuucgucaacccagacacaggccgcguccucuucgaaugcaaacuucacaaguccggcuacgucaccguagcccacaccggccaacacgaucucgucaucccacccaacggcuacuuccgauucgacagcugggucaaccaauucuacacccuggcccccaugggcaacggcacuggucgacgacgauaa

SEQ ID NO: 38563 - RNA, 1617 nt, Artificial Sequence
  derived and/or modified sequence opt11 from VP1__Norovirus_and/or_Norovirus-like__KC517366
augaaaauggccuccaacgacgccaaccccuccgacggcucagccgccaaccuaguccccgaaguaaacaacgaaguaauggcccuagaacccgucgucggagccgccaucgcagccccagucgccggccaacaaaacgucauugacccuuggauccgaaacaacuucguccaagcacccggcggcgaguucaccgucucuccccgcaacgcaccaggcgaaauacucuggucagcuccucucggcccagaccuaaaucccuaccucagccaccucgcacgcauguacaacggcuacgccggcggauucgagguccaaguaauacuagcuggcaacgccuucacagccggcaagauaaucuucgcagcuguacccccaaacuuccccaccgaaggccucagccccagccaagucaccauguucccccacaucauagucgacguaagacaacuagaacccguacucaucccacugcccgacguacgcaacaacuuuuaucacuacaaccagucuaacgacuccacaaucaaacucaucgcaaugcuauacacuccccuccgcgcaaacaacgcaggcgaagacgucuucaccguauccugccgcguccucacccgccccucucccgacuucgacuucaucuuccucgucccacccaccgucgaaucccgaaccaaacccuucaccgucccaauccuaaccguagaagaaaugaccaacucacgauuccccaucccacuugaaaaacuguucaccgggcccuccuccgcuuucgucguccaaccccaaaacggccgcugcaccaccgacggcguauuacucggcaccacccaacuaucuccagucaacaucugcaccuuucgaggagacgucacccacaucgccggcagcagaaauuacaccaugaacucugccagucuuaacuggaacaacuacgacccaaccgaagaaaucccugcuccacuagguacucccgacuucgucggaaaaauacaaggcaugcuaacacaaaccaccaaaggcgacggcagcacacgcggccacaaagcaaccgucuacacuggaagcgcaccauuuacccccaaacuaggcuccguccaauucgaaaccgacaccgaaaacgacuucgaaacccaccaaaacaccaaauucacccccgucggaguaauccaagacggcggcaccacccaccgcaacgaaccccaacaauggguacuucccuccuauagcgguaggaacgucccuaacgugcaccuagccccagccguagccccaacauucccaggcgaacaacuacuuuucuuccgauccacuaugccaggcugcuccggcuaucccaacauggaccuggacugccuauuaccacaagaguggguacaacauuucuaccaagaagcugccccagcgcagucagacgucgcccuccucagauucguaaaccccgacacuggucgaguccucuucgagugcaagcuacacaaaucaggcuacgucaccgucgcucacaccggccaacacgauuuagucauacccccaaacggcuacuucagauucgacuccuggguaaaccaauucuacacccucgcacccaugggcaauggcacuggccgacgacguuaa

SEQ ID NO: 38564 - RNA, 1617 nt, Artificial Sequence
  derived and/or modified sequence opt11 from VP1__Norovirus_and/or_Norovirus-like__KC517359
augaaaauggccuccaacgacgcaucacccuccgacggguccgcagccaaccucguacccgaaguaaacaacgaggugauggcccucgaacccgucgucggagccgccauagccgccccgguagcaggacaacaaaacgucaucgaccccuggauaagaaauaacuucguccaagcucccggcggcgaguucaccgucagcccccgcaacgcccccggcgaaauccucuggucugccccacuaggacccgaccuuaaccccuaccucucccaccucgccagaauguacaacggcuacgccggcggauucgaaguccaaguaauucucgccggcaacgccuuuaccgcuggcaaaaucaucuucgccgcaguaccucccaacuuccccaccgaaggccucucacccucucaagucacaauguucccccacaucaucguagacguccgcaggcuagaacccguccuaaucccacuccccgacgucaggaacaacuucuaccacuauaaccaauccaacgacuccacaaucaagcucaucgcaaugcucuacacaccacuccgggccaacaacgccggcgaagacgucuucaccguaucaugccgcguccuaaccagaccuucaccugacuucgacuucauuuuccuugucccacccaccgucgaaucccgcacaaaacccuucaccguccccauacuaaccgucgaagaaaugacauacucccgcuucccaaucccccucgaaaaauuauucaccggccccuccucagccuucgucguccaaccccaaaacggccgcugcacaaccgacggcguccuccucggcaccacacaacucagcccaguuaacaucugcacauuccguggcgacguaacccauauagcuggaagccguaacuacaccaugaaccuagccucacuaaacuggaacaacuacgaccccacagaagaaauccccgcaccccucggcaccccagacuucguaggcaaaauacaaggaaugcucacucaaacaaccaaaggggacggcucuacaagaggccacaaggccaccgucuacacaggcagcgcccccuucaccccaaaacucggcucaguacaauuugaaaccgacaccgaaaacgacuucgaaacacaccaaaacaucaaauucaccccugucggcgucauucaagacggcggcacaacacaccguaacgaaccccaacaauggguuuuacccuccuacuccggcagaaacguacccaacguucaucuagccccagccguagccccaaccuucccaggcgaacaacuccuuuucuuccgcuccacaaugcccggaugcuccggcuaccccaauauggaccucgacugccuacucccccaagaauggguucaacacuucuaccaagaagccgccccagcccaaucagacgucgcccuccuacgauuuguuaacccugacaccggccgaguccuauucgaaugcaaacuacacaaauccggcuacguuacagucgcacacaccggccaacacgaccucaucauuccacccaacggcuauuuccgcuucgacucgugggucaaucaauucuauacccucgcccccaugggcaacggaaccggccgccgacgauga

SEQ ID NO: 38565 - RNA, 1617 nt, Artificial Sequence
  derived and/or modified sequence opt11 from VP1__Norovirus_and/or_Norovirus-like__KC409303
augaagauggccuccucggacgcaaaccccuccgacggcuccaccgccaaccuaguacccgaagucaacaacgaagucauggcauuagaacccgucgucggugccgcaauagcugcaccuguagccggccaacaaaauguaauugaucccuggauccggaacaacuucguccaggcacccggaggagaguucaccguaucaccacgcaacgccccuggagaaaucuuauggucggcaccccuaggacccgaccucaacccuuaccucucccaccuagcccgaauguacaacggauacgccggaggcuucgaaguccaaguuauccucgccggcaacgccuucaccgccggcaaaaucaucuucgcagcagucccacccaacuuccccacagaaggccucucaccaucgcaaguaaccauguucccccacaucaucguagacguccgccaacuagagcccguacucaucccccuccccgacgugcgcaauaacuucuaccacuacaaccaaucaaacgacccuaccauaaagcucaucgccaugcuauacaccccacuacgugcaaacaacgccggcgacgauguauucaccguauccugccgaguccuaacccgccccucccccgacuucgacuucaucuuccucgucccucccacagucgaaucccgcacaaaacccuucucaguccccguccucaccgucgaagaaaugacaaacucacgcuuccccaucccccucgaaaaacuauucaccggccccuccuccgcauucguaguccaaccccagaacggccguugcaccaccgacggcguccuccugggcaccacccaacuaucccccgucaacaucuguacauucagaggcgacgucacucacauauccggcuccagaaacuauacaaugaaccucgcuucacaaaacuggaacucauacgaccccaccgaagagauacccgccccacucggaacgccggacuucgucggcaaaauccagggcgucuuaacacaaaccacucguacagacggcuccacccgcggccacaaagccaccgucuacacaggcuccgcagacuucucacccaaacucggacgaguacaauucgcgacagacacugacaacgacuucgaaaccaaucaaaacaccaaauucacccccguaggcguaauccaagacggaggaaccacacaccgcaacgaaccucaacaauggguccuccccuccuacuccggacgcaacauccacaacguacaccuagcccccgccgucgccccuaccuuccccggagaacaacuccucuucuuccgaucaacaaugcccggaugcucaggauacccuaacauggaccuagacugccuacucccacaagaauggguccaauacuucuaccaagaagcagcacccgcccaauccgaugucgcccuacuacgauucguaaaccccgacaccgguagaguccuauucgaguguaaacuacacaaaucgggcuacgucacaguagcccauaccggccaacacgaccuuguaauuccacccaacggcuacuuccgcuucgacucaugggucaaccaauucuacacccuugcccccaugggcaacggcaccggccgccgccgcuga

SEQ ID NO: 38566 - RNA, 1617 nt, Artificial Sequence
  derived and/or modified sequence opt11 from VP1__Norovirus_and/or_Norovirus-like__JX459608
augaaaauggccuccaaugacgcaaaucccuccgacggcucagccgcuaaccuaguccccgaagucaacaacgaagucauggcccucgaaccugucguaggggcagcuaucgcagcccccgucgccggacaacaaaacgucaucgacccauggauccgcaauaacuucguccaagcccccggaggagaguucaccgucucacccagaaacgcucccggagaaauccuauggagcgcaccccucggacccgaccuaaaucccuaccuaucccaccucgcccgaauguacaacgguuaugccggaggcuucgaaguccaagucauccucgccggcaacgcauucaccgccggcaaaauuaucuucgccgccgucccuccaaacuuccccaccgaaggccuaucccccucccaaguaaccauguucccccacauuaucgucgacguccgacaacucgaaccaguccuuaucccacuacccgacguccgcaacaacuucuaccacuauaaccaauccaacgacucaacuaucaaacucaucgccaugcuauacacaccccuucgcgccaacaacgccggugaagacgucuucaccgucuccugccguguccucacccgccccucacccgacuuugacuucauauuccuaguaccacccaccguagaaucccgaaccaaacccuucacuguccccauccucaccgucgaagaaaugacuaacucacgcuucccgauuccccucgaaaaacucuucaccggcccaucuggcgcauucgucguacaaccucaaaacggcagaugcacaacagacgguguacuacuaggcaccacacaacucucacccguaaacaucugcaccuuccguggcgacguuacccacaucgccggcucacgcaacuacacaaugaaccucgcuucacucaacuggaacaacuacgacccuaccgaagaaacccccgcgccacuuggcacccccgacuucgucggaaagauccaaggcguccucacccaaacaaccaaaggcgacgguucaacccgcggccauaaagccaccgucuacaccggcuccgcccccuucacacccaaacuaggcuccguacaauuuuccaccgacaccgaaaacgacuucgaaacccaccaaaacaccaaauucaccccuguaggugucauacaagacggcggaaccacccaccgcaacgaaccccaacaauggguccuaccuuccuacuccggacgcaacguccacaacguccaucucgcccccgccgucgcccccacauuccccggugaacaacugcuauucuuccgaucgaccaugcccggaugcuccggcuacccgaauauggaccucgacugucuucuaccccaagaauggguucaacacuucuaccaagaagccgccccagcgcaauccgacgucgcccucuuacgauucgucaaccccgacaccggacgcguccucuucgaaugcaaacuccacaaauccggauacguaaccguagcccacaccggacaacacgaccucgucaucccucccaaugguuacuuccgcuucgacucuugggucaaucaauucuauacuuuagcccccaugggcaacggcaccgggcgucgucgauaa

SEQ ID NO: 38567 - RNA, 1617 nt, Artificial Sequence
  derived and/or modified sequence opt11 from VP1__Norovirus_and/or_Norovirus-like__JQ320073
augaaaauggccuccaacgacgcaaacccaucugacggcucuacugcaaaccucguacccgaaguaaacaaugaaguaauggcccucgaacccgucgucggcgccgccaucgcagcccccgucgcgggccaacaaaacgucaucgaccccuggauccgaaacaacuucguccaagcccccgguggugaguucacaguaucccccagaaacgccccaggugaaauccuaugguccgccccacucggccccgaccucaaccccuaccucucacaccuugcccgcauguacaacggcuacgcuggaggcuucgaaguccaaguuauccuugccggcaacgccuuuacagcaggaaaagucaucuucgccgcaguacccccaaacuucccuacagaaggucuaucacccucccaagucaccauguuuccccacaucgucgucgacguacgccagcucgaaccaguccucaucccccuccccgacguccgcaacaauuucuaccauuacaaccaauccaacgacccaaccaucaaacucauagcgaugcucuauaccccuuuaagagccaacaaugccggugaagacgucuucaccguuuccugccgcguccucacacgaccauccccugacuucgacuucaucuuucuagucccaccaacaguggaaucgcgaaccaaacccuucaccguacccauccucacaguagaagaaaugacaaacucacguuuccccaucccacucgaaaaacucuucacaggccccucaggcgcauucgucguacaaccccaaaacggccgcugcaccacagacggcguccugcucggcaccacccaacucucacccguaaacaucugcacauuccgcggcgacgucacucacaucgcugguacacacaacuacaccaugaaccucgcuucacaaaacuggaacaacuacgaccccaccgaagaaaucccagcaccacugggaacccccgacuucguuggccgcauucaaggaaugcuaacucaaaccacccgaggugacgguucuacacgcggacacaaagccaccgucucaaccggggacguucacuucaccccgaaacuaggaucuauacaauucaacaccgacaccaauaacgacuucgaaaccggacaaaacaccaaauucacacccguaggagucguccaggacggaaacggaacucaccagaacgaaccccaacaauggguccucccauccuacucaggacgaacaggucacaacguccaccuagcccccgccgucgccccaaccuuccccggcgaacaacuacuauucuuucgcuccaccaugcccggcugcuccggcuaccccaacaugaaccucgacugccuccucccccaagaguggguucaacacuucuaccaagaagccgcaccagcccaauccgacguagcccuacuacgcuuuguaaacccagacaccggaagaguccucuucgaaugcaaacuccacaaaucaggauacguaaccguagcccacaccggacagcacgaccuagucauacccccuaacggcuacuuccgcuucgacaguugggucaaccaauucuacacccucgcaccaaugggcaacggaacaggucgacgacgcuaa

SEQ ID NO: 38568 - RNA, 1617 nt, Artificial Sequence
  derived and/or modified sequence opt11 from VP1__Norovirus_and/or_Norovirus-like__HM802552
augaaaauggccuccaacgacgccucuccauccgacggcucuaccgccaacuuaguacccgaagucaacaacgaagucauggcccucgaaccuguagucggcgccgcaaucgcugcccccguugcaggccaacaaaacgucaucgaccccuggauccgaaacaacuuuguacaagcccccggcggcgaguucaccgucucaccccgcaacgcgcccggcgaaauccuuugguccgcuccccucggccccgaccucaauccauaccuuucccaccuagccagaauguacaacggcuacgccggcggcuucgaaguucaagucauacucgccgggaacgcuuucaccgcaggaaaaaucaucuucgcggcagucccacccaacuuccccacggaaggccuauccccuucccagguaaccauguucccacacaucaucgucgacgucagacaacucgaaccgguccucauuccgcuacccgauguaagaaacaacuucuaccacuacaaccaauccaacgacucaaccaucaaauuaaucgcaaugcucuacaccccacuccgagcaaacaacgccggcgaugacgucuucacuguauccugccgaguccucacacgccccagccccgacuucgacuucaucuuccucgugcccccaacagucgaaucccgcaccaaaccuuucaccguccccauccucacaguagaagaaaugacaaacucucguuuccccaucccacuagaaaaacucuucacaggccccagcucagcauucgucguccaaccccaaaacggcagauguaccaccgacggcgucuuacucggaacaacccaacucucccccgucaacaucugcaccuuccgaggcgacgucacccacauccccggcacacgcaccuacagaaugaaccucgcuucacaaaacuggaacaacuacgacccuaccgaagaaauaccagcgccccuaggcaccccagacuucguaggcaaaauacaaggcaugcuuacccaaaccaccaaaggcgacggaucaaccagaggccacaaagcaacggucuccacuggcuccgucgacuucacccccaaacucgguuccguccaguucgcaacagacaccgacaacgauuuugagaccggucaaaacacccgcuuuacacccguuggcgucauccaagacggcucauccacccaccgaaacgaaccccaacaauggguccuccccgacuacuccggccgcaccguccacaacguucaccucgccccugcugucgcacccaccuucccuggcgaacaacuccucuucuuucguuccacaaugcccggaugcuccggauaccccaacauggaccuagacugccuccucccacaggaauggguccaacacuucuaucaagaagcagcucccucccaauccgacguagcccuccuucgcuucguaaaccccgacacaggccgaguacuauuugaaugcaagcuccauaaagccggauacgucaccguagcccacaccggccaacacgaccucgucauacccccaaacggcuacuucagauucgacuccugggucaaucaauucuacacccucgcccccauggggaacggagccggccgccgccgcuga

SEQ ID NO: 38569 - RNA, 1617 nt, Artificial Sequence
  derived and/or modified sequence opt11 from VP1__Norovirus_and/or_Norovirus-like__AB541320
augaaaauggcauccuccgacgcuaaucccuccgacggcuccaccgccaaccuaguaccagaaguaaacaacgaaguaauggcccuugaacccguagucggcgccgcaaucgccgcccccgucgcuggccaacaaaacgucaucgacccguggauccgcaacaacuucguccaagcccccggcggcgaguucaccgucagcccccgaaacgccccaggcgaaauacuauggucagccccacuaggcccugaucucaaccccuaccucucccaccuugcacgaauguacaacggcuaugccggcggauucgaaguccaaguaauccucgcaggcaacgccuucaccgccggcaaaaucaucuucgccgccguaccacccaauuuucccaccgaaggccuaucacccucacaagucacaauguucccacacauaauagucgacguuagacaacucgaacccguucuaaucccacuccccgacguccgcaauaacuucuaccacuacaaucaauccaacgaccccacuaucaaacucaucgccaugcuguacacuccccuccgcgcaaacaacgcaggcgacgacgucuucaccguuuccugccgcguccuaacccgaccuucacccgacuucgacuucauauuccucgucccucccaccgucgccucccgcaccaaacccuucucaguccccuccgugacaguagaagaaaugaccaacucccgauuccccauaccccucgaaaaacucuucacuggucccucauccgccuucguaguccaaccccaaaauggucgcuguacuaccgacggaguccuccucggcacaacccaacucucaccaguuaauaucugcacauuccgcggcgacguuacacacaucacgggcucacgcaauuacaccaugaaccucgccacccaaaacuggaacucuuacgaccccaccgaagaaauccccgcgccccucggcacccccgauuucgucggcaaaauccaaggcguccucacucaaaccacccgcgccgauggaucaacacgcggacacaaagcaaccguauacacuggauccgcagacuuugccccaaaauuaggccgcguccaauucgccaccgacacagacaacgacuucgacgccaaucaaaacaccaaauucaccccagugggagucauccaagacggcgacacagcacaccgaaacgaaccccaacaauggguccucccuucauauuccggccgcaacucccacaauguacaccuagccccaaccguagcccccaccuucccuggcgaacaacuacucuucuuccgcucuaccaugcccggaugcuccggauaucccaacauggaucuagauugccuacuaccacaagaauggguacaauauuucuaccaagaagccgcacccgcgcaaucugacgucgcccuccuacgcuucgugaaccccgacaccggcagaguccuuuucgaaugcaaacuccacaaauccggauacgucacggucgcgcauacgggccaacacgaccucgucauaccucccaacggcuacuuccgauucgacuccugggucaaccaauucuacacacuggcacccaugggcaacggcaccggccgacgacgauaa

SEQ ID NO: 38570 - RNA, 1617 nt, Artificial Sequence
  derived and/or modified sequence opt11 from VP1__Norovirus_and/or_Norovirus-like__AB541227
augaaaauggcuucaaacgacgccaaccccuccgacggcucagccgccaaccucguccccgaaguguccaacgaagucauggcacucgaaccagucguuggugccgcaaucgccgccccagucgccggccaacaaaacgucaucgaccccuggauacgcaauaacuucguacaagcccccggcggcgaguucaccgucaguccccguaacgcacccggcgaaauccuauggagcgcaccacucggccccgaccuaaaccccuaccucucacaccuugcccgcauguacaauggcuacgcaggaggcuucgaaguacaagucauccuugcaggcaacgcuuucaccgccggcaaaauaaucuucgcagcugucccacccaacuucccaaccgaaggccuaucacccucacaagucaccauguucccccauauaauagucgacguacgacaacucgaaccaguacuuauaccccuccccgacguccgcaacaacuucuaccacuauaaccaaucaaacgacucaaccauaaaacugaucgccaugcuauacacuccacuccgagccaauaacgcuggcgaagacgucuucaccgucuccugcagaguacucacccgcccaucucccgacuucgacuucaucuuccucgucccacccaccgucgaaucccgcaccaaacccuucacaguccccauucuuacuguugaagaaaugaccaauucacguuuccccauccccuuggaaaagcuauucaccggccccucaggagccuucguaguccaaccccaaaacggccgaugcaccacagacggcguacuccucggaaccacacaacucucacccguaaacaucugcaccuuccgcggcgacgucacccacauagcaggcucacgcaacuacacaaugaaccucgccucccucaacuggaacaacuacgaccccacagaagaaauccccgcaccccuagggacacccgacuucguaggcaaaauccaaggcguccucacacaaaccaccaaaggcgacggaucaacccgaggccauaaagccaccguguacaccggcucugcaccauucacaccuaaacucggcuccguccaauucuccacugacaccgaaaacgacuucgaaacccaccaaaacaccaaauucaccccagucgguguaauacaagacggcggaacgacucacagaaacgaaccccaacaauggguccucccaucauacuccggccgcgauguccacaacguacaccuagcccccgccguagccccaacuuucccaggcgagcaacuacuauucuuccguuccaccaugcccggcugcuccggcuaccccaacauggaccuagacugccuacucccgcaagaauggguccagcacuucuaccaagaagccgccccugcccagagcgacguagcccugcuccgcuucgucaacccagacaccggacgaguccucuucgaaugcaaacuacacaaaucuggcuauguuacaguagcccacacaggccaacacgaccuaguaauaccacccaacggcuacuuccgauucgacuccugggucaaccaauucuacacccucgcccccaugggcaacggcaccggccgacgacgcuaa

SEQ ID NO: 38571 - RNA, 1617 nt, Artificial Sequence
  derived and/or modified sequence opt11 from VP1__Norovirus_and/or_Norovirus-like__AB504318
augaaaauggccucaaacgacgccaaccccuccgacggcuccgcugcaaaccuaguacccgaagucaacaacgaagucauggcccucgaacccguaguaggagcugccauagccgccccagucgccggccaacaaaacgucaucgaccccuggauccgcaacaacuucguccaagcccccggaggagaauuuaccguaagccccagaaacgcccccggcgaaauacuuugguccgcaccccucggccccgaccucaaccccuaccuaagccaccuugcccgcauguacaacggcuacgccggcggcuucgaaguacaagucauacuagccggcaaugccuucacagccggcaaaauaauauucgcagccguaccacccaacuuccccacagaaggccucucacccucucaaguaaccauguucccccacaucaucguugacguacgacagcuagaaccuguucucaucccccuaccggacguccgaaacaacuucuaccacuacaaccaauccaacgacucaaccauuaaacuaauugcuaugcucuacacaccccuacgcgccaacaacgccggggaagaugucuuuaccgucuccuguagaguccuuacacgacccucacccgauuucgacuuuaucuuuuuagucccacccacagucgaaucacgcacaaaacccuucacaguccccauccucacaguagaagaaaugacaaauucccgauuccccauaccccucgaaaaacucuuuaccggacccucaggugccuucgucguccaaccccagaauggccgaugcaccacagacggcguacuccucggcacaacccagcucuccccagucaacauaugcacauuucgaggcgacgucacucacauagccggaucucgcaacuacacaaugaaccucgccagccuaaacuggaacaacuacgaccccacagaagaaauccccgccccucucggaacacccgauuuuguuggaaaaauccaaggccuacucacccaaaccaccaagggcgacggaagcacucgaggucacaaagcaaccguauacaccggcuccgcccccuucaccccaaagcucggcggcguccaauucuccacagauacagaaaaugacuucgaaacccaccaaaauacuaaauucacaccaguaggaguuauccaagacggcucgaccacccaccgaaacgaaccacaacaauggguccuacccucauacucaggcagaaacguccauaauguccaccucgccccagcaguagcccccacauuccccggcgaacaacuacucuucuuccgcucaaccaugcccggcugcuccggcuaccccaacauggaccuugacugccugcucccccaggaauggguccaacacuucuaccaagaagcagccccggcacaauccgacgucgcccuucuccgcuucguaaacccagacaccggacgcguacucuucgaaugcaaacuacacaaauccggcuacguuacugucgcccacaccggacaacacgaccuagucauaccacccaacggcuacuuucguuucgacucuuggguaaaccaauucuacacacucgcacccaugggaaacggcaccggccgccgccgcuga

SEQ ID NO: 38572 - RNA, 1617 nt, Artificial Sequence
  derived and/or modified sequence opt11 from VP1__Norovirus_and/or_Norovirus-like__AB504311
augaaaauggcaucaaacgacgccacacccucagacggcuccaccgccaaccuaguaccugaagucaacaaugaaguuauggcccucgaaccagucgugggagccgccaucgccgcccccgucgcaggccaacaaaacgucaucgaccccuggauccguaacaacuucguacaagcccccggcggugaguucaccgucuccccacgcaacgccccaggcgaaauacucugguccgcaccccucggccccgaccucaaccccuaccuaucacaccucgcucguaccuacaacggcuacgcuggaggcuucgaaguccaagucauacuagccggaaacgccuucaccgccggaaaaauuaucuucgccgcagucccuccaaacuucccaacagaaggacucuccccaucccaagucaccauguucccucauaucaucgucgacgucagacagcuugaacccguacucaucccccuccccgacgucagaaauaacuucuaccacuacaaccaauccaacgacuccaccaucaaacucauagcgaugcucuacaccccacuacgggcuaacaacgccggugacgacgucuucacagucucaugccgcgugcucacccgccccagccccgacuucgacuuuauauuccucguacccccuacugucgaaucacggacuaaacccuucuccguccccauacuuaccgucgaagaaaugaccaauucccguuuccccaucccccucgaaaaacuauucacaggccccuccuccgcauucgucguacaaccccagaacggacgcuguaccaccgacggcguccuccucggaaccacccaacuuucaccugucaacauaugcaccuuccgcggugacgucacacacauugccggaacccaaaacuacacgaugaaccucgccucccaaaacuggaacaauuaugacccaaccgaagaaaucccagcaccccucggaacacccgacuucguggguaaaauccaaggaguacucacccaaacaacuagacgcgacggcagcacacgcggacacaaagccacagucucaaccggauccguccacuucacacccaaacucggcucuguccaauucaguacagacacauccaaugacuucgaaaccggccagaacacccguuucacaccagucggcgucguacaagacggaagcaccacccaccaaaacgaaccucaacaauggguacuucccaacuacucaggacgcgacucccacaacguucaccucgcgcccgccguugcaccaaccuuccccggcgaacaacuccuauucuuccgcagcaccaugcccgguugcucaggauacccuaacaugaaccuggauugccuacucccccaagaauggguccaacacuucuaccaggaaucagcacccgcucaauccgacguugcccuccuccgcuucgucaaccccgacaccggucgaguccuauucgaaugcaaacuacacaaaucaggcuacgucaccgucgcccacacuggccaacacgaccuagucauacccccaaacggcuacuuccgauucgauuccugggucaaccaauucuacacccucgcaccaaugggaaacggagccggccgccgacgcuaa

SEQ ID NO: 38573 - RNA, 1617 nt, Artificial Sequence
  derived and/or modified sequence opt11 from VP1__Norovirus_and/or_Norovirus-like__FJ537135
augaaaauggcuucauccgacgccaaccccagcgauggcucuacagcaaaccuaguccccgaagucaacaacgaggucauggcccuagaaccagucguaggcgcagccauagcagcaccugucgcaggccaacagaacaucaucgaucccuggauccgcaacaacuucguccaagcccccggcggcgaguucaccgucuccccucgaaacgcccccggugaaauacucugguccgccccucucucccccgaccuaaacccauaucuaucacaccucucccgaauguacaacggcuacgcaggcggcuucgaaguccaagucauccuggccggcaacgccuucaccgccggcaaaaucaucuucgcugccaucccacccaacuuccccacagaaggccucuccccaucccaaguaacgauguucccccacauaaucgucgacguccgacaacucgaaccuguccucaucccacucccagacguccguaacaauuucuaccacuacaaccaagcacacgacuccacccuaaaacuaaucgccauguuauacacaccccuccgcgccaacaacgccggcgacgacgucuucaccguauccugccgaguccucacccguccuuccccagacuucgauuucaucuuccucgucccaccuaccgucgaaagccgaaccaaacccuucacaguccccauccucaccgucgaagaaaugucaaacucccgauuccccaucccauuagaaaaacucuacaccgggcccuccuccgcguucguaguacaaccucaaaacggccgcugcacaaccgacggcguccuucugggaaccacccagcucuccgccgucaacaucugcaacuuccgcggcgacgucacccguguaggcaucucccacgauuacaccaugaaccucguaucacaaaacuggaacaacuacgacccaaccgaagaaauccccgcaccccucggcacaccagacuucgucggcaaaauccaaggccuccucacacaaaccaccagagccgauggcuccacccgagcacacaaagccacuguauccaccggaucaguacacuucacgcccaaacuuggcuccguccaauucaccaccgauacuaacaacgacuuccaaaccggccaaaacaccaaauucacgcccgucggagucauccaggacggcgaucaccaccaaaacgagccccaacaauggguacuucccaacuacucaggcaccucgggacacaacguacaucuagcucccgcaguagcccccaccuuccccggcgaacaacuccucuucuuucgauccaccaugccgggcugcuccggcuaccccaacaugaaucuagacugccuccuaccacaagaaugggucucacacuucuaccaagaagccgcccccgcccaaagcgacgucgcccuacuccgcuucguaaaccccgacaccggacgcguucuauuugagugcaaacuccacaagucaggcuacauaacggucgcccacaccggccccuacgaccucgucaucccacccaacgguuacuuccgauucgacuccugggucaaucaauucuacacccuagcccccaugggcaacggcuccggccgcaaacgcgucuaa

SEQ ID NO: 38574 - RNA, 1617 nt, Artificial Sequence
  derived and/or modified sequence opt11 from VP1__Norovirus_and/or_Norovirus-like__GQ413969
augaaaauggccagcaacgacgcuaaccccuccgacggcuccaccgcaaaccucgucccagaagucaacaacgaagucauggcucucgagccagucgucggcgccgcaaucgccgcacccgucgccggacagcaaaaugucaucgacccauggauccgaaacaacuucguccaagcccccggaggagaauuuaccgucagcccccgcaacgcaccaggcgaaauucucuggucagcaccccucggccccgaccuaaaccccuaccuaucacacuuggcccgcauguacaacggauacgccgguggcuucgaaguccaagucauccucgccggaaacgccuucacagcaggcaaaaucaucuucgccgccguaccucccaauuucccaaccgaaggucucucccccagccaagucacaauguucccucacaucaucgucgacguacgccaacucgaacccguacuaauaccccuccccgacgucagaaacaacuucuaucacuacaaccaaagcaacgaccccacaaucaaacucaucgccaugcuauacaccccucuacgggccaacaacgccggcgaugacguauucacugucuccugccgaguccucacucgaccauccccagacuucgacuucauauuccuagucccaccaaccgucgaaucgcgaacaaaacccuucaccgucccaauacuaaccguugaagaaaugacaaacucacgcuuccccauaccccucgaacgacuuuacaccggacccuccucugccuucgucguucaaccccagaacggcagaugcaccaccgacggcguacuacuaggcacaacccaacucuccgccguaaacaucugcaccuucagaggcgacguaacucacauagccggcucacguaacuacaccaugaaccucgcaagccaaaacugguccaacuacgaccccaccgaggaaaucccagcaccccucggcacaccagacuucgucggaaaaauacaaggcaugcucacccaaacgaccggccgcgacgguucaacccgcggacacaaagccaccguccuaacaggauccgcagacuucgccccaaaacuaggccgcguccaauucgcgaccgacaccgacaacgacuucgaaucaggcgaaaacaccaaauucacccccguaggcguaauccaggacggcagcaccacacaccgcaacgaaccacaacaauggguccuccccaacuacuccggccguaccggacacaacguacaccucgcacccgccgucgcccccaccuaccccggagaacagcuccuauucuuccgcuccaccaugcccgggugcucuggauaccccaacauggaccuugauugccuacucccccaggaauggguacgacacuuuuaucaagaagccgcccccgcccaauccgacgucgcucuccucagauucgucaacccagacacaggacgaguucucuucgaaugcaaacuacauaaacccggcuacgucaccgucgcccauaccggacaacacgaccucgucaucccaccaaacggcuacuucagauucgacuccugggucaaccaauucuacacacucgcacccaugggaaacggcacuggccggagacgguaa

SEQ ID NO: 38575 - RNA, 1617 nt, Artificial Sequence
  derived and/or modified sequence opt11 from VP1__Norovirus_and/or_Norovirus-like__EU839592
augaaaauggcaucuaacgacgccaaccccuccgacggcuccgccgcaaaccucguucccgaaguaaacaacgaagucauggcccuagaacccguagucggcgccgccaucgcagcacccgucgccggccaacaaaacgucaucgaucccuggauccgaaacaacuucguacaagcccccggcggcgaauuuacgguuucaccacgcaacgcaccaggagaaauccucugguccgcaccccucggccccgaccucaaccccuaccucucccaccucgcccguauguacaacggauacgccggaggauucgaaguucaaguaauucucgccggcaacgccuucaccgccggcaaaaucaucuucgcagccguacccccuaacuucccaaccgaaggccuaucacccagccaagucacuauguucccacacaucaucgucgacguacgccaacuagaacccguccucauacccuuaccagacguacgaaauaacuucuaccacuacaaucaaucaaacgacucaaccaucaaacucaucgcaaugcucuacaccccucuucgcgcaaacaacgcaggcgaagacguauucacugucuccugccgcguccucacucgacccucaccagacuucgacuucauauuccuaguaccacccacuguagaaucccgaaccaagccuuucaccguaccaauacucaccgucgaagaaaugacgaacucccgcuuccccauaccacuagaaaaacucuucaccggucccuccucagcuuucgucguccagccccaaaacggccgaugcaccaccgacggcguucuucucggcaccacccagcugucccccguuaacauaugcaccuuccgaggcgacgucacccacaucgccggcucccggaacuacaccaugaaccucgccucacucaacuggaacaacuacgaccccacagaagaaaucccugcuccccucggcacaccagacuucgucggcaaaauccaaggcguacugacccaaaccaccaaaggugacggcuccacacgcggccacaaagccaccgccuacaccggguccgcacccuucacccccaaacuuggcucgguacaauucuccaccgacaccgaaaacgacuucgaaacccaccaaaacacuaaauucgcacccguaggcgucauccaggacggcggcacaacacaccgaaacgaaccccagcaauggguacucccaagcuacuccggccgcaacgucccaaacgugcaccucgcuccagcagucgcccccacauucccuggcgaacaacuccuuuucuuccgaucaacaaugcccggcuguucaggguaccccaacauggaccucgacugccuccucccacaagaauggguacaacacuucuaccaagaagccgccccagcacaaucagacguagcccuacuacgauucgucaacccagacaccggucgaguccucuuugaaugcaaacuacacaaauccggauaugucacaguagcgcacaccggccaacacgaccucgucaucccacccaacggcuacuucagauucgacuccuggguaaaccaauucuauacucucgcccccaugggcaauggcacaggccgacgccgauga

SEQ ID NO: 38576 - RNA, 1617 nt, Artificial Sequence
  derived and/or modified sequence opt11 from VP1__Norovirus_and/or_Norovirus-like__EU839587
augaaaauggccuccaacgacgcaucccccagcgauggcucaaccgccaaccuaguccccgaagucaacaacgaagucauggcacucgaacccguugucggugcugcaaucgcagccccaguagcuggacaacaaaacguaauugaccccuggauccgcaacaacuucguccaagcacccgggggcgaauuuacagucaguccacgcaacgcaccaggugaaauccuuugguccgcaccccuaggccccgaccucaaucccuaccucucccaccuagcccggauguacaacggcuacgccggaggauucgaaguacagguaauacuagccggcaacgcauucacugccggcaaaaucaucuucgccgcuguaccacccaacuuccccacagaaggccucucccccucccaagugacuauguucccucacaucauagucgacguucgucaacuagaacccguacucaucccccucccagacguccgcaauaacuucuaccacuacaaucaauccaacgauuccacaaucaaauuaauagccaugcucuacacuccccuccgcgcuaacaaugccggcgacgacgucuuuaccgucuccugucgcguacucaccagaccaagccccgacuuugacuucauuuuucuagucccaccaacagucgagucacgcaccaaacccuucaccguacccauacuaaccgucgaagaaaugaccaacucucgauuccccauaccccucgaaaaacucuucaccggcccuuccuccgcauucgucguacaaccccaaaacggcagaugcacaacagacggcguccuacuggguaccacccaacuaucaccagucaacaucugcaccuucagaggugacgucacccauauccccggaacacgcgcauaccgcaugaaccucgccucgcaaaauuggaacaacuacgacccuaccgaagaaauaccagccccacuuggcaccccugacuucguuggaaaaauccaagguaugcucacacaaaccaccaaaggcgacggcuccacccguggccacaaagccacugucagcaccggcuccgucgacuucacacccaagcuaggcucaguccaauuugccaccgacaccgacaacgacuucgaaaccggacaaaacacacgcuucacucccgucggaguaauccaagacggauccuccacccaccgcaacgaaccacaacaauggguccuccccgacuacuccggacgcaccguccacaacguucaccucgcccccgccgucgcccccacuuuccccggcgaacaacuccuauucuuccgcucaaccaugccuggcugcucaggcuaccccaauauggaccucgauugccuccucccucaagaguggguccaacauuucuaccaagaagccgcccccucccaaucagacguugcccuccuacgcuuuguaaaccccgacaccggccgcguccuuuucgaaugcaaacuccacaaggcuggcuacgucaccgucgcucacaccggccaacacgaccucguaauucccccaaacggauauuuccgauucgacuccugggucaaccaauucuacacccucgcccccaugggcaauggcgcuggacggagacgcuaa

SEQ ID NO: 38577 - RNA, 1617 nt, Artificial Sequence
  derived and/or modified sequence opt11 from VP1__Norovirus_and/or_Norovirus-like__EU839583
augaaaauggcuuccaacgacgcaucccccuccgacggcucaacugcaaaucuagucccagaaguuaauaaugaagucauggcacucgaaccaguagucggcgccgcaaucgccgccccaguagcaggccagcaaaacguaaucgacccauggaucagaaacaacuucguccaggcccccggaggagaguucacagucagcccccgcaacgccccaggagaaauccuaugguccgcuccccucggacccgaccucaaucccuacuuaucucaccucgcccgaauguacaacggcuacgcaggcggcuucgaaguccaagucauacuugccggcaacgccuuuacggccggaaaaaucauauucgccgcagucccacccaacuuccccaccgaaggccucagccccucccaagucaccauguucccccacaucaucgucgacguacgacaacucgaacccguacucaucccacuccccgacguccgcaauaacuucuaccacuacaaccaaucaaacgauucaaccauaaaacucaucgcaaugcucuauacaccccugcgagcaaacaacgcaggcgacgauguuuucaccgucuccugccgaguacuaacccgccccucaccagacuucgacuucauauuccuuguacccccaaccgucgaaucaagaaccaaacccuucaccguccccauccucaccguugaagaaaugaccaacucccgcuucccaaucccccuagaaaaacucuucaccggcccguccuccgccuucguaguccaaccccaaaacggacgaugcaccaccgacggaguccuacucggaaccacacaacuuucacccguaaacaucugcaccuuccgcggcgacgucacacacauccccggcacccgaacuuacagaaugaacuuagccucacaaaacuggaacaacuacgacccuacagaagaaauccccgcaccccucgggacccccgacuuugucggcaaaauccaaggaaugcucacccaaaccacaaaaggcgacggcucaacacgcggucauaaagccaccgucuccaccggcuccguagauuucacacccaaacuuggcucaguccaauucgcaaccgauaccgacaacgacuucgaaacuggacaaaacacccgcuucacaccagucggaguaauccaagacggaucuucagcacaccgcaacgaaccccaacaauggguccugccagacuacuccggccgcacaguccacaacguacaccuagccccagcugucgcccccacauuccccggcgaacaacuacucuucuuuagaucaaccaugcccggcugcucaggguaccccaacauggaccuagacugccuccuaccccaagaauggguccaacacuucuaccaggaagcagcgccaucccaaucugacgucgcacuccucagauucgucaaccccgacaccggccgcguccuauucgaaugcaaacuccacaaagccggcuacgucacuguagcccacaccggacaacacgaccuaguuauacccccgaacggauacuucagauuugacagcugggucaaccaauucuacacucucgcccccaugggcaacggggcaggccgccgucgcuaa

SEQ ID NO: 38578 - RNA, 1617 nt, Artificial Sequence
  derived and/or modified sequence opt11 from VP1__Norovirus_and/or_Norovirus-like__AB303931
augaaaauggccuccaacgacgcaaaccccucagacggaucagccgcgaaucuaguacccgaaguaaauaaugaagucauggcccucgaacccgucgucggcgcagccauagcagcccccgucgcaggucagcaaaacgucaucgacccauggaucagaaacaacuuuguccaagcacccggcggagaauuuacaguauccccacgcaacgccccaggcgaaauccucuggagcgcaccccucggacccgaccucaaccccuaccucucacaccuagcccgaauguacaacggcuacgccggcggcuucgagguacaagucauacuagcaggaaacgccuucacagccggcaaaauuaucuuugccgccguacccccaaacuuccccacagaaggucucuccccaucacaaguaaccauguucccacacaucauagucgacguuagacaauuagaaccaguccucaucccacuccccgacguccgaaacaauuucuaccacuacaaccaauccaaugacucgaccaucaaacucaucgccaugcucuacacaccucuacgcgccaacaacgccggcgaagacgucuucaccguaucaugccgaguccucacccgcccguccccagacuucgacuucauauuccucgucccacccaccgucgaaucccguacgaaacccuuuacagucccgauacuuacagucgaagaaaugaccaacucccgcuuccccaucccccucgaaaaacuuuucaccggcccuucuggcgccuucguaguacaaccccaaaacggccgcugcaccacagacggcgucuuacucggcaccacacaacuuucacccguaaacaucugcaccuuccgaggagauguuacacauaucgccggcacacacaacuacaccaugaaccucgcuucccaaaauuggaacaacuacgaccccacugaagaaauacccgcuccucucggcaccccugacuucgucggccgcauccaagguaugcucacccaaaccacccgcggcgacgggucaacccgcggacacaaagccaccgucucgacuggcgacguucacuucaccccaaaacugggcuccauccaauucaacacugacacaaacaacgacuucgaaacuggccaaaacaccaaauucacccccgucggcgucguccaagacggcaacggcgcccaccagaacgaaccgcaacaauggguccuccccuccuacuccggacguaccggccacaacguccaccuagcccccgccgucgcaccaaccuuccccggagaacaacuacucuucuuccgcucuaccaugccaggaugcuccggguacccaaacaugaaccucgacugccuucuaccccaagaauggguacaacacuucuaccaagaagcagcucccgcgcaauccgacguagcccuacuacgcuucgucaaccccgacaccggccgcguccucuucgaguguaaacuccacaaaucgggcuacgucacgguugcacacaccggucaacacgaccucgucaucccuccaaacggcuacuuccgguucgacucaugggucaaccaauucuacacccuagcccccaugggcaacggaaccgguagacgccgauaa

SEQ ID NO: 38579 - RNA, 1617 nt, Artificial Sequence
  derived and/or modified sequence opt11 from VP1__Norovirus_and/or_Norovirus-like__KY341923
augaaaauggccucaucugaugccaaccccuccgacggcucagcagcuaaccuuguccccgaagucaacaacgaaguaauggcccuagaacccguagucggcgcagcgaucgccgcccccgucgcuggacaacaaaacgucaucgaccccuggauccgcaacaacuucguccaagcccccggcggcgaguucacagucucccccagaaacgcacccggugaaauacuguggagcgcaccccuaggcccagaccucaaucccuaccucucacaccucgcccgcauguauaacggcuacgcaggaggauucgaaguccaggucauacucgcaggaaacgccuuuaccgcaggcaaaguuaucuucgccgccguaccacccaacuuccccacagaaggccucucucccucacaagucaccauguucccccacaucguaguagacguacgccaacuagaacccguccucauaccacuacccgacguccgcaacaacuucuaccacuacaaucaaucuaacgaccccaccaucaaacucaucgccauguuguacaccccucuccgcgccaacaacgccggugacgacguauucaccgucucaugccgcguccucacccgcccaucccccgacuucgacuuuaucuuccucgucccacccaccgucgaaucgcgcaccaaacccuucucauucccuguccucacaguagaagagaugaccaacucccgauuccccauaccacuggaaaaacuauucaccggccccuccuccgcguucgucguucaaccucaaaacggccgcuguaccacagacggcguccuacuuggcaccacccaacuaucacccguaaacaucugcaccuuccgaggcgacgucacccacaucacagguucccgcaacuauacaaugaaccucgcaagccaaaacuggaacaacuaugacccaacagaagagauacccgcccccuuaggaacacccgacuucgucggaaaaauacaaggaguccuaacacaaaccacccguaccgaugggagcacccgaggccacaaagcaacaguauauaccggaucagccgacuucgccccaaaacucggacgcguacaauucgagaccgacaccgaccacgacuucgaagcaaaccaaaacaccaaauucacacccguaggcguuauccaagacggauccaccacccaucgcaacgaaccacaacaauggguccuaccauccuacucgggccgcaacacacccaacguucaccuagcccccgccguagccccuaccuuccccggagaacaacuccucuucuuccgaucaaccaugccaggcugcucaggauacccaaacauggaccucgacugccuacucccccaagaauggguccaauacuucuaucaagaagcagcacccgcccagagcgacgucgcucuccuacgcuucgucaaccccgacaccggucgaguccucuucgaauguaaacuacacaaauccggcuacgucaccgucgcucacacagggcaacacgaccucgugauaccacccaacggcuacuuccgauucgacucaugggucaaccaauucuauacucuagcccccauggguaacggcaccggacgucgacgcuaa

SEQ ID NO: 38580 - RNA, 1617 nt, Artificial Sequence
  derived and/or modified sequence opt11 from VP1__Norovirus_and/or_Norovirus-like__KX514317
augaaaauggccuccuccgacgccaaccccucagacggguccaccgccaaccuaguccccgaagucaauaacgaagucauggcccucgaaccagucgucggagcagccauugccgccccagucgccggccaacaaaacgucaucgacccauggauucgaaacaacuucguccaagcccccgguggugaguucacugucucaccccgcaacgcucccggcgaaauccucugguccgcaccccuaggacccgaccucaaccccuaccuaucucaucucgcccgaauguacaacggcuacgccggcggcuucgaaguacaagucauccucgccggaaacgcauucaccgccggcaaaaucaucuucgcugccgucccacccacuuuccccaccgaaggucucucacccucccaagucacaauguucccccacauaaucgucgacguccgccaacuagaacccguacucauaccccuacccgacguucgcaauaacuucuaccacuacaaccaaucaaacgacucaacgaucaagcucaucgcuaugcucuacacaccccuccgcgccaacaacgcuggcgacgacguauucaccgucuccugccgcguccuuacccgacccucacccgacuucgacuucauauuccucguaccucccaccgucgaaucccgcuccaaacccuucuccguccccguacucacagucgaagaaaugaccaacucucgcuuccccgcaacccucgacaaauuauucacaggccccucaucaacauucgucguccaaccucaaaauggucgcugcacuauagacggagaacuccuaggaacaacccagcuaucauccguaaacauaugcaccuuccgaggcgacgucacacacccacgagauuccaaaauauauaccaugaaccucgccuccccuaacuggaacaacuacgacccuaccgaagaaaucccugccccacucggaacucccgacuucgucggcaaaauccaaggcaugcucacccaaacaaccaaaggagaaggaucaacgcgaggccaccgcgcaacugucuacguaggcuccgccaacuacgcccccaaacuuggacgaguccaguucgaaaccgacacuaccgacgaucucgacgcccaccaaaacacaaaauucacccccgugggcgucguacaaggcggggaaucuccaaaaggcuccgaaccccaacaauggguacuucccaacuacuccggcgcgaacaccuucaauguacaccuggcaccagccgucgcccccaacuuccccggagaacaacucuuauucuuccgcuccacccuacccgguugcggcggccacccaaacauggaccuugacugccuacuaccacaagaauggguccaacacuucuaucaagaagcggccccagcucaauccgaugucgcccuccuccgcuucgucaaccccgacaccucccgaguacuauucgaaugcaaacuccauaaguccggauacgucaccgucgcccauaccggccaauacgaccucguccuacccucaaacggcuauuuccgcuucgacuccugggucaaccaguucuacacccucgcacccaugggcaacggcaccggacgacgucgcuag

SEQ ID NO: 38581 - RNA, 1617 nt, Artificial Sequence
  derived and/or modified sequence opt11 from VP1__Norovirus_and/or_Norovirus-like__KU678204
augaaaauggccagcuccgacgccaaccccucagacggcuccgccgcaaaccuuguucccgaagucaacaacgaaguaauggcccucgaacccguagucggcgccgccauagccgcucccgucgccggacagcaaaacguuauagaccccuggauccgauccaacuucguccaggcccccggcggcgaguucaccgucucaccccgaaacgccccaggcgaaauacuaugguccgccccacuaggaccagaccucaacccauaccucucccaccuugcccgcauguacaacggcuaugccggcggcuucgaaguacaagucauccuagcaggcaacgccuucacagcaggcaaagucaucuucgcagccguacccccuaacuuccccaccgagggccugucccccucacaagucaccauguucccacacauagucgucgacguacgccaacucgaacccguccucaucccccuacccgacguccgaaacaacuucuaccacuacaaccaauccaacgaucccacaaucaaacucaucgccaugcuauacacuccccuacgcgccaacaacgccggcgacgacgucuucaccguaucaugcagaguacucacccgcccaucccccgacuucgacuucauauuucucguaccacccaccgucgaaagcaggaccaaacccuucuccguacccguccuaaccgucgaagaaaugaccaacucccgcuucccaaucccccuugaaaaacucuucaccgguccaucaucagcuuucgugguacaaccacaaaacggacguugcaccaccgaugggguccuccuaggaaccacccaacuaucaccagucaacaucugcacauuucgcggcgacgucacccacauaaccgguucccgaaacuacaccaugaaucucgccagccaaaacugguccaauuacgacccaacagaagaaaucccagcaccccucggcacccccgacuucguagguaaaauccaaggcaugcucacccaaaccacccgcacugacggauccacccgaggacacaaagccacaguauauaccggcuccgccgacuucgcucccaagcugggacgcguccaauucgaaaccgacaccgaccacgacuucgaagccaaccaaaacacuaaguucacacccgucggcguaauccaagacggcuccacaacccaucgcaacgaaccacaacaauggguccuccccagcuacagcggucgcaacacccccaacgugcaccuagcaccagcagucgcaccaaccuuuccaggugagcaacuccucuucuuccgcuccaccaugccaggaugcuccggcuaccccaacauggaccucgacugucuacucccacaagaauggguucaauacuucuaccaagaagccgcccccgcccaaagcgacguagcauuacuccgcuucgucaaccccgacaccggccgaguacucuucgagugcaaacuacacaaauccggcuacgucaccgucgcccacacuggccaacacgacuuagucauaccacccaacggguacuuccgauucgacucaugggucaaccaauuuuacacccucgcucccaugggcaacggcacaggaagacgccgguaa

SEQ ID NO: 38582 - RNA, 1617 nt, Artificial Sequence
  derived and/or modified sequence opt11 from VP1__Norovirus_and/or_Norovirus-like__KX158283
augaaaauggcuaguuccgacgccaaccccuccgacggcuccgccgccaaucucguccccgaagucaacaacgaggucauggcccucgaacccgucgucggcgccgccauagccgcccccgucgccggccaacaaaacgucauagacccauggauacgcaacaacuucguacaggccccaggcggcgaguucacaguaucaccccgcaaugcacccggcgaaauccuaugguccgccccacucggccccgaccuaaaccccuaccucucucaccuagcccgaauguauaauggcuacgccggcgguuucgaaguccaagucauccuugccggcaacgccuucaccgcaggaaaagucaucuucgccgccgucccacccaacuuucccaccgaaggucucucacccucccaagucaccauguucccccauaucguagucgacguucgacaacucgaaccaguccucauccccuuaccugacguccgcaacaacuucuaccacuacaaccaauccaacgaccccaccauaaaacucauagcaaugcucuacacaccccuucgcgcaaacaaugccggugacgacgucuucaccgucucaugucguguucucacccgcccaucccccgacuucgacuucauauuccuaguacccccaaccgucgaauccagaacaaaacccuucuccguccccguccucaccguugaagaaaugacaaacucucgacucccuauaccccucgaacgucucuucacaggacccuccuccgcauucgucguccaaccucaaaauggucgaugcaccaccgacggcguccuccucggaaccacacaacuaucccccguuaauaucugcacuuuccgaggcgacgucacacacaucaccggcucacacaacuacacaaugaaucucgccucccaaaauuggaacaacuacgaucccaccgaggaaauaccagcuccacuaggaacccccgacuucguaggcaaaauacaaggcguacucacacagacaacccgcaccgacggauccacccguggccacaaagcaaccgucuauacgggcuccgccgaguucgcacccaaacucggccgcguacaguucgaaaccgacacaaaccacgauuucgaagccaaccaaaacaccaaauucacaccagucggaguaauacaagacggcuccaccacccacagaaacgaaccacaacaauggguucuaccauccuacuccggccgcaacacacacaacguccaccucgcacccgccguagccccaaccuuuccuggcgaacaacuccucuucuuccgauccaccaugccgggcugcuccggauaccccaacauggaucuugacugccuuuuaccccaagaauggguccaauacuucuaccaagaagccgcaccagcucaauccgacgucgcccuucuccgcuucguaaaucccgacaccggccgcguccucuucgaaugcaaacuucacaaaucaggcuacaucaccgucgcacacaccggacaacacgaccuagucauuccgcccaauggauacuuccguuucgacucguggguaaaucaauucuacacacucgcccccauggguaacggcaccggccgccgccgcuaa

SEQ ID NO: 38583 - RNA, 1617 nt, Artificial Sequence
  derived and/or modified sequence opt11 from VP1__Norovirus_and/or_Norovirus-like__KX354088
augaaaauggccuccaacgacgcaaaccccagcgacggcuccgccgccaaccucguccccgaagucaacaaugaagucauggcucucgaacccguugucggcgccgccaucgcagcacccguagccggacaacaaaacgucaucgacccguggauacguaacaacuucguccaagcccccggaggcgaguucaccguaucaccccgcaacgcccccggcgaaauacuaugguccgcuccacucggcccagaccuaaacccauaccucucccaccuagcccgcauguacaacggguacgcaggaggcuucgaaguccaagugauacucgccggcaacgccuucacagccggcaaaaucauauucgcagccguacccccaaacuuccccaccgaaggccucucuccaucgcaagucacaauguucccccacaucaucguagacguccgccaacucgaaccaguacucaucccccuccccgacguccgcaacaacuucuaccacuauaaccaauccaacgacucaacuaucaagcucaucgccaugcuauacacaccacuacgagcgaacaacgccggcgacgaugucuuuaccgucuccugccgaguccuaacccgacccucccccgacuuugacuucauauuccucgucccucccaccgucgaaucacgcacuaagcuauucacagucccuauucugaccgucgaagaaaugaccaacucccgauuccccaucccccucgaaaaacucuucacaggacccucauccgccuuuguuguccaaccucaaaacggacgaugcaccaccgacggcguccuccucgguaccacccaacucucacccgucaacaucugcaccuuccgaggcgacgucacccauaucgcaggaucccgaaauuacacuaugaaccucgcaucccucaacuggaacaacuaugaccccacagaagaaauaccggccccacucggaacccccgacuucguaggcaaaauacaaggcguccucacccaaaccacuaaaggcgauggcagcacccgaggacacaaagcaaccgucuacaccggcuccgccgacuucacaccaaaacucggcucaguccaauucgcaacugacacagaaaacgacuucgaaacccaccaaaauacacgcuucaccccaguuggaguuauccaagacgggggcacaacccacagaaaugaaccccaacaguggguacuuccuuccuauuccggccgaaacguacacaacguucaccuagcacccgccguggcucccaacuuccccggcgaacaacuacucuucuuccgcucaaccaugccuggaugcucaggcuaccccaacauggauuuagacugccuccuuccgcaagaauggguccaacacuucuaccaagaagccgcucccgcucaguccgacgucgcccuccuccguuucgucaacccugacaccggaaggguucuuuucgaaugcaaacuccacaaauccggcuacgucacagucgcucacaccggacaauacgaccucguuauuccacccaacggauacuuccgcuucgacuccuggguuaaucaauucuacacccucgcccccaugggcaacggcaccggccgcagacgauaa

SEQ ID NO: 38584 - RNA, 1617 nt, Artificial Sequence
  derived and/or modified sequence opt11 from VP1__Norovirus_and/or_Norovirus-like__KX354032
augaaaauggcuuccucugacgcauccccauccgauggcucagccgccaaccugguccccgaaguuaacaacgaagucauggcccuagaaccugugguaggcgccgccaucgccgcuccagucgccggacaacaaaauguaaucgaccccuggauacgcaauaacuucguacaagcccccggcggcgaguucaccgucucaccccgcaacgcacccggcgaaauacucugguccgcaccccuuggccccgaccuaaaccccuacuuaucacaccucgcgcgcauguacaacggcuacgccggagguuucgaaguccaaguaauccuagccggcaacgccuucacagcaggaaagguaaucuucgccgcagucccucccaacuuccccacugaaggccucuccccuucacaagucaccauguuuccccacaucgucgucgacguucgccagcucgaaccuguccuuaucccccuccccgauguccgcaacaacuucuaccacuacaaucaaucuaacgacccaaccaucaaacucaucgcaaugcuauacacaccccuccgcgccaauaacguuggcgaugaugucuucacagucucgugccgaguacuuacccgucccucaccagacuucgacuucaucuuucuagucccgcccaccguugaaucucgaaccaagcccuucagcguccccguccucacggucgaagaaaugaccaacucccgauuccccauuccccuagaaaaacucuucacaggccccucauccgccuucguaguacaaccccaaaacggccggugcaccaccgacggaguccuccucggcaccacacaacucuccccaguuaacaucugcaccuuccgcggcgacguaacccacaucaccggcucacgcaacuacaccaugaaccuagccucccaaaacuggaacaacuacgaccccaccgaagaaauaccagccccacucggcacucccgacuucgucggcaaaauccaaggaguacucacgcaaacuaccagaaccgacggcuccacccgcggccacaaagccaccgucuauaccggcuccgccgacuucgcccccaaacucggccgcguucaauucgaaacagacacggaccacgacuucgaagcgaaccaaaacacuaaauucaccccagucggcguuauccaagacgguuccaccacucaccgcaacgaaccacaacaauggguucuccccagcuacuccggccgcaauacacacaauguccaccuagcccccgccgucgcccccacauuccccggcgaacaacucuuauucuucagauccacaaugcccgguuguucaggcuacccuaacauggaccucgacugccuccucccccaagaauggguacaauacuucuaucaagaagcagccccagcacaauccgacguugcccuccuccgcuuuguaaaccccgacaccggacgaguacucuuugaaugcaaacuccacaaauccggcuacguuacugucgcccacaccggccaacaugaccuagucauaccaccaaacggauacuucagauucgacuccugggucaaccaauucuacacccucgcccccauggguaacggugcuggccgccgccgcuaa

SEQ ID NO: 38585 - RNA, 1617 nt, Artificial Sequence
  derived and/or modified sequence opt11 from VP1__Norovirus_and/or_Norovirus-like__KX354015
augaaaauggccucaagcgacgccuccccaucugacggaucggcagcaaaccucgucccugaggucaauaacgaagucauggcccuagaacccguagucggcgccgccaucgcagccccagucgccggccaacaaaacguuaucgaucccuggauccgaaacaacuucguccaagcccccggcggcgaguucaccguuucaccccgcaaugcccccggcgaaauccucuggucggcaccccuaggccccgacuuaaaccccuaccuaucacaccucgcccgcauguacaacgguuacgccggcggcuucgaaguccaaguaauccucgccggcaaugccuucaccgccggaaaagucaucuucgcugcagucccaccgaacuuccccaccgaaggccucucccccucucaagucaccauguucccccacaucgucguagacguccgucaacucgaaccaguguuaaucccacuccccgacguccguaacaacuucuaccacuauaaccaauccaacgaccccaccaucaaacuaaucgccaugcucuacacgccccuacgagccaacaacgccggagacgacgucuuuaccgucucaugccgcguccuaacccgacccucacccgacuucgacuucaucuuccucgucccacccaccgucgaaucgcgaaccaaacccuucucuguccccguccucaccguagaagaaaugaccaacucacgcuuccccauaccccucgaaaagcuauucaccggcccauccucagccuuugucguccaaccacagaauggccgaugcaccacagacggaguccuacucggcaccacucaacuaucccccgucaacaucugcacauuccgaggagaugucacacacaucacuggcucgcguaacuacacaaugaaccucgccucccaaaacuggaacaauuacgaccccacagaagaaauccccgcuccccucggcaccccagacuucgucggcaaaauccagggaguccucacccagaccacacgcacagacggcucaacccgaggucacaaagccaccgucuacacaggcucugccgacuucgcacccaaacucggccgaguccaauucgaaaccgacaccgaccacgauuucgaagcaaaccaaaacaccaaguucacaccaguaggcguaauacaagacggcuccaccacccacagaaaugaaccucaacaauggguccucccauccuauucaggccgaaacacucauaacguccaccucgcccccgccguagcccccaccuuccccggcgaacagcuccucuucuuccgaucaaccaugcccggcugcuccggcuaccccaacauggaccucgacugccuccucccccaagacuggguccaauacuucuaccaagaagccgcccccgcccaauccgacgucgcccuacuacgcuucguaaacccagacaccggccguguucuauucgaaugcaaacuacacaagucgggcuaugucacagucgcccacacaggacaacacgaccuuguuauucccccaaaugguuacuucagauucgacuccugggucaaccaauucuacacccuagcaccuaugggcaacggggccggccgacgccgcuaa

SEQ ID NO: 38586 - RNA, 1617 nt, Artificial Sequence
  derived and/or modified sequence opt11 from VP1__Norovirus_and/or_Norovirus-like__KX353999
augaagauggcgucguccgacgccaaccccucagacggauccaccgcuaaccuuguucccgaagugaacaacgaagucauggcgcuagaacccgucguuggcgcagccauagccgcccccgucgcaggccaacaaaacgucauagaccccuggauccgcaauaacuucguccaagcccccggcggcgaguucaccgucucaccccgcaacgcuccgggcgaaauccuuugguccgccccacuaggccccgaccuuaaccccuaccuaucccaccucgcccgcauguacaacggcuacgcaggcggcuucgaaguccaaguaauccucgccggcaacgccuucaccgcuggcaaaaucaucuucgcugccguacccccuaacuuccccaccgaagggcuaucucccucgcaagucaccauguucccccacauaauagucgacguacgccaacucgaacccguccucauuccccucccagacguccgcaacaacuucuaccacuacaaccaguccaacgaccccaccauuaaacucaucgccaugcuguauacaccccuacgagccaacaaugccggcgacgacgucuucaccguauccugccgaguucuaacacgcccaucacccgacuucgacuucaucuuccucgucccgcccaccguagaaucccggaccaaacccuucuccgucccaauccucacaguugaagaaaugaccaacucucgcuuccccaucccccucgaaaaacuauuuaccggcccauccuccgccuucgucguccaaccucagaacggucgcugcacaaccgacggaguccuccucggcaccacccaacucucuccagucaacaucugcaccuuccgcggcgacgucacccacaucuccggauccagaaacuacaccaugaaucuagccucacaaaacuggaacuccuacgacccaaccgaggaaauccccgcaccccugggcacccccgacuucgucggaaaaauccaaggcguccuaacccaaacaaccuccaccgacggcuccacccgaggacacaaagccaccgucuacacaggaucagcagauuucucacccaaacucggccgcguacaauucgccaccgacaccgacaacgacuucgaaaccaaccaaaacacuaaguucacccccgucggaguaauccaagacggcggcacuacacaccgcaacgaaccacagcaauggguccucccauccuacuccggccgcaacauccacaacguacaccucgcccccgccgucgcacccacauuccccggcgaacaacuccucuucuuccgcuccaccaugccuggcugcucgggauaccccaacauggaccucgacugccuccucccccaagaauggguccaauacuucuaccaagaagccgccccugcacaaagcgacgucgcucuccugcgcuucgucaaccccgacacaggccgcguccucuucgaaugcaaacuccacaaauccggauacguaaccgucgcccacacaggccaacacgaucucgucaucccaccaaacggguacuuccgcuucgacuccugggucaaccaauucuacacccucgcaccaaugggcaacggcaccggccgccgcagauaa

SEQ ID NO: 38587 - RNA, 1617 nt, Artificial Sequence
  derived and/or modified sequence opt11 from VP1__Norovirus_and/or_Norovirus-like__KX353987
augaaaauggccucauccgaugccaaucccucugaugguuccacagccaaccuaguuccagaaguaaacaacgaagucauggcccucgaaccagucgucggcgcagcaauagccgcaccaguagcaggccaacaaaacgucaucgaccccuggauucgaucaaacuucguccaggcgcccggaggagaguucaccguuucaccccgcaacgcgcccggcgaaauccuuuggagcgcaccccucggccccgaccuaaaccccuaccuaucccaccuggcccgcauguacaacggcuacgccggcgguuucgaaguccaagucauccucgccggcaacgcauuuaccgccggaaaaaucauauucgcagcagucccacccaacuuccccacagaaggccuaucccccucccaaguaaccauguuuccccacaucauagucgacguccgccaacucgagccaguacucauaccccuaccagacguccgaaacaacuucuaccacuacaaccaaucaaacgacuccaccaucaaacuaaucgcuaugcuauacaccccacuccgcgcaaacaacgccggcgacgacgucuucaccgucucuugccguguccuaacaagacccuccccagacuucgacuucauauuccuuguacccccaaccgucgaaucaagaacaaaaccauucuccguaccaguccuuaccgucgaagaaaugacaaacucacgcuuccccauaccacuagagaaacuauucaccggacccucauccgccuucguaguccaaccccaaaacggccgcuguacaaccgacggcguacuccucggaaccacccaacuaucaccagucaacauuugcacuuuucgcggcgacgucacacacaucucaggcucccauaacuacaccaugaaccuagccucacaaaacuggaacucauacgacccaaccgaagaaauccccgcuccucuuggaaccccagacuucgucggaaagauccaaggcguccucacccaaaccaccaaaacaaacggcucaacacgcggccacaaagccaccgucuacaccggcucagccgauuucucccccaaacucggccgaguucaauuugccacugacacagacaacgauuucgagacgaaucaaaacaccaaauucaccccagucggcguuauccaagacggcuccaccaccccacgcaaugagccccaacaaugggugcugcccuccuacucaggccgcaacacccacaacguccaccuugcccccgccguagcccccaccuucccaggagaacaacuccucuucuuccgcuccaccaugcccggcugcuccggcuaccccaacauggacuuagacugccuccucccccaagaauggguccaauacuucuaccaagaagccgccccagcucaauccgacguagcccuacuacgcuucguaaauccagacacuggccgaguccuauucgaaugcaaacuacacaaaucaggcuacguaaccgucgcacacaccggucaacacgaccucgucaucccacccaacggcuacuuccgauucgacucaugggucaaccaauucuacacucucgcgccaaugggcaacggcaccggccgccgacgauaa

SEQ ID NO: 38588 - RNA, 1617 nt, Artificial Sequence
  derived and/or modified sequence opt11 from VP1__Norovirus_and/or_Norovirus-like__KX353970
augaaaauggcaucaucagacgcaaacccguccgacggcuccacugcuaaccuagucccagaagucaacaacgaagucauggcccucgaacccguagucggagcugccaucgcggcuccagucgccggccaacaaaacgucauagacccauggauccgaaacaacuucguccaagcaccuggcggcgaguucacagucucaccccgcaacgcucccggugaaauacuaugguccgcaccccuaggacccgaccucaaccccuaccucucccaccucgcccgcauguacaacggauacgccggcggauucgaaguacaaguaauacucgccggcaacgccuucaccgccggcaaaauuaucuucgcagccgugccucccaacuuucccaccgaaggccuuucucccucucaaguaacaauguucccccacaucaucgucgacguacgccaacucgaaccaguucucaucccccuccccgacgucagaaacaauuucuaccacuacaaccaauccaacgaccccaccaucaaauuaaucgcaaugcuguacacuccacuacgcgccaacaaugcaggagacgauguauucaccguauccugcagaguccuuacaagacccucgccagacuucgacuucaucuuccucgucccacccaccguagaaucucgcacaaaacccuucucaguacccguccuaaccgucgaagaaaugaccaacucacgcuuccccauuccacucgaaaaacucuucacaggcccaucauccgccuucgucguacaaccacagaacggccgcugcaccaccgacggcguccuacuaggaaccacacaacucucccccguaaauauauguaccuuccguggcgacguaacccacaucucuggcucaagaaacuacaccaugaaccucgcuucccaaaacuggaacagcuacgaccccacagaagaaaucccagccccucuaggcacaccagacuucgucggaaaaauccaaggcguucucacccagaccacucgcacuaauggcucaacucgcggccacaaagccacagucuauaccggcuccgccgacuucuccccgaaacucggacgcguccaauucgccaccgacacagacaacgacuuugaaacaaaccaaaacacaaaguuuacaccagucggcgucauccaagacgguuccaccaccccacgcaacgaaccccaacaguggguacucccaucuuacagcggccgcaacacccacaacguccaccucgccccagccguugcuccaacauuccccggagaacagcuccuauucuuccgaucaaccaugccuggaugcucuggcuaccccaauauggaccuagacugccuucucccccaagaaugggugcaauacuuuuaccaagaagccgccccugcacagucugacgucgcucuccuccgcuucgucaaccccgacaccggacgcguccuauucgaaugcaaacuacacaaauccggcuauguaaccguagcccacaccggccaauacgaccuagucaucccucccaacggcuacuuccgcuuugauuccugggucaaccaauucuacacccucgccccaaugggcaacggcacaggccgccgccgcuaa

SEQ ID NO: 38589 - RNA, 1617 nt, Artificial Sequence
  derived and/or modified sequence opt11 from VP1__Norovirus_and/or_Norovirus-like__KU985156
augaaaauggccagcuccgacgcgaacccuagcgacggcuccgccgcaaaccucguacccgaaguaaacaacgaagucauggcccucgaacccgucgucggcgcagccaucgccgccccagucgcgggccaacaaaacgucaucgacccuuggauccggaacaacuucguccaggcaccaggcggcgaauuuaccgucuccccacgcaacgccccaggcgaaauccuuugguccgcaccccuuggacccgaucugaaccccuaucuaucacaccuugcccgcauguacaacgguuacgccggaggauucgagguucaagucauacuugccggcaacgccuucacagccggcaagguaaucuucgcagccgugccacccaacuuccccacagaaggacucucgccaucacaagucacaauguucccccauauagucguagacgucagacaacucgaaccaguacucaucccccucccagacguucgcaacaacuucuaccacuauaaccaaagcaacgaccccacaaucaaacuaaucgccaugcuauacacaccccuccgcgccaacaacgccggagacgacguuuucaccgucucaugccgcguacuaacccgccccuccccagacuucgacuucauauuucuaguaccacccaccgucgaaucaagaaccaaacccuucucggucccaguacucaccgucgaagaaaugaccaacucccgcuucccaaucccgcucgaaaaacucuucacaggccccuccuccgcauucgucguccaaccccaaaacggacgcugcacaaccgacggaguccuacucggcaccacccaacuuucccccguaaacaucugcaccuuccgcggagacguaacccacauaaccggaucccgcaacuacacaaugaaccucgccucgcaaaacuggaacaauuacgaccccaccgaggaaauccccgcaccccucggaaccccagacuucguaggcaaaauccaaggcguccucacccaaacuacccgcacagacggcucaacacgaggccacaaagccacagucuacaccggcuccgccgacuucgcucccaaacucggacgaguccaauucgaaacagacacugaccacgacuucgaagccaaccaaaacacaaaguucacccccguaggcgucauacaagacggcggcaccacccaccgcaacgaaccccaacaauggguacucccauccuacucaggccgcaacacacacaacguacaccucgcccccgccgucgcccccacuuuccccggcgaacaacuccuauucuuccgcagcaccaugcccggaugcuccggcuaccccaacauggaccuagacugccuccuaccucaagaauggguccaauacuuuuaccaagaagccgcccccgcccaauccgacgucgcccuccuccgcuucguuaaucccgacaccggcagaguccuuuucgaaugcaaacuacacaaauccggcuacgucacugucgcccacaccggacaacacgaccuaguuauaccacccaauggauacuuccgauucgacucaugggucaaccaauucuacacccucgcacccaugggcaacggcacuggccgacgccgcuaa

SEQ ID NO: 38590 - RNA, 1617 nt, Artificial Sequence
  derived and/or modified sequence opt11 from VP1__Norovirus_and/or_Norovirus-like__KU985155
augaaaauggcauccuccgacgcaaaucccuccgacggcucagcagccaaccuuguccccgaaguuaacaacgaagucauggcccucgaacccgucgucggugccgcaaucgccgccccagucgccggacaacaaaacgucaucgaccccuggauccgaaauaacuucguccaagcccccggcggagaauuuaccguaucuccccgcaacgccccaggcgaaauacuaugguccgccccucucggacccgaccuaaacccuuaccucucgcaccuugcuagaauguacaacgguuacgcaggcggcuucgaaguccaagucauccuugcaggcaacgcuuucaccgcagguaaagucaucuucgccgccgucccuccaaacuuccccacagaaggccuaucccccucccaagucaccauguucccccacauaguagucgacguccgccaacuugaaccaguccuuaucccccucccagacgucagaaacaacuucuaccacuacaaccaguccaacgaccccacuauuaaacucaucgccaugcuguacacaccacuacgcgccaacaacgccggugacgaugucuucaccguauccugcaggguccucacccggccaucucccgacuucgacuucaucuuccucgucccuccaacagucgaaucucguacaaaacccuucucagucccugugcucacugucgaagaaaugacuaacucccgauuccccaucccccuagaaaaacucuucaccggcccauccagcgccuucgucguccaaccccagaacggccgcugcaccaccgauggcguacuccuaggcacaacucaacuaucccccgucaacaucuguacauuucgcggcgacgucacccacaucacaggcagccgaaacuacacaaugaaccuagcuucacaaaacuggaacaacuacgaccccacagaagaaauccccgcaccccucggaacccccgacuucguaggcaaaauccaaggcguucuaacacaaaccaccagaacagacggcuccacacgcggacacaaagccaccgucuacacuggcuccgccgacuucgccccuaaacucggccgaguccaauucgaaacagauacagaccacgacuuugaagucaaccaaaacaccaaauucacucccgucggcguuauccaagacggcggcaccacccaccgaaacgaaccccaacaauggguacuucccucauacuccggccgcaacacucacaacguccaccuagccccagccgucgcgccuacauucccaggcgaacaacuccucuucuuccgcuccacuaugcccggaugcucuggcuauccaaacauggaccuagacugccugcuuccccaagaauggguacaguacuucuaccaagaagcagccccagcacaaucugacgucgcucuccuccgcuucgugaacccagacaccggccgcguccucuucgaaugcaaacuccauaaacccggcuacguaacagucgcccauacaggacaacacgaccuagucaucccucccaacggauauuuccgcuucgacuccugggucaaccaauucuacacccucgcccccaugggcaacggcaccggccgacgucgauaa

SEQ ID NO: 38591 - RNA, 1617 nt, Artificial Sequence
  derived and/or modified sequence opt11 from VP1__Norovirus_and/or_Norovirus-like__KM514075
augaaaauggccuccuccgacgccaaucccucagacggcucagccgccaaccucguucccgaaguaaacaacgaaguuauggcccucgaacccguugucggcgccgccauagcagcaccagucgcuggccaacaaaacgucauagaccccuggauccgcaacaacuucguucaagcccccggcggcgaguucacaguguccccacgcaacgcaccgggagaaauucuauggucagcaccccucggaccagaccucaaccccuaccuaucacaccuagcccggauguauaacggcuacgccggcgguuucgaaguacaagucauccucgcaggcaacgcauuuaccgccgguaaagucaucuucgccgccgucccucccaacuucccuacugaaggccuaucccccucacaagucaccauguucccccacaucgucgucgacguucgccaacuggaacccguccuuauaccccucccagacguccgaaacaacuuuuaccacuacaaccaauccaacgauccaaccauaaaacucaucgccaugcuauauacuccccuccgcgcuaacaacgccggcgacgacgucuucaccguauccugcagagucuuaacccgccccucuccagacuucgacuucaucuuccucgucccaccaaccgucgaaagccgcaccaaacccuucuccgucccuguccuaaccguagaagaaaugacaaauucccgcuuccccaucccccuagaaaaacuauucaccggccccucauccgcauucgucguccaaccccagaacggccgcugcacaaccgacggaguucuccucggcacaacccaacucucccccguaaacaucugcacauuccgcggcgacgucacccauaucacagguucacacaauuacacuaugaaccucgccucacaaaacugguccaacuacgaucccaccgaagaaauccccgcgccccuuggcacaccagacuucgucggcaaaauccaaggaguacucacccaaacuacccgaacagacggaagcacucgcggucacaaagccacaguauacaccggcucagccgacuucgcccccaaacucggacgcguucaauucgaaaccgacaccgaccgcgauuucgaagccaaccaaaacaccaaauucacccccgucggagucauccaagacggcggcaccacccaccguaacgaaccccaacaauggguccuucccagcuacuccggccguaacacccccaacgugcaucucgcccccgccguugcccccacauucccuggcgaacagcuccucuucuuccgcucuacaaugcccggcuguucaggcuaccccaacauggaccuagacugccuccucccacaggaauggguacaauauuucuaccaagaagcagccccagcacaaucagacgucgcccucuuacgcuucguaaaccccgacaccggucgcguccucuucgagugcaaacuccacaaaagcggcuacgucacagucgcccacaccggccaacacgaccucgucauaccaccuaacggcuacuuccgauucgacucaugggucaaucaauucuacacacuggcacccaugggaaacgguacaggccgacgcagauga

SEQ ID NO: 38592 - RNA, 1617 nt, Artificial Sequence
  derived and/or modified sequence opt11 from VP1__Norovirus_and/or_Norovirus-like__AB972484
augaaaauggccuccagugacgcaaaccccuccgacggauccgccgccaaccuagucccggaagucaacaaugaagucauggcccuagaacccgucgucggcgcagccaucgccgcccccgucgccggccaacaaaacguaauagacccuuggaucagaaauaacuucguccaagccccuggcggcgaguucaccguaucgccccgaaacgccccgggcgaaauacucuggucagccccacucggacccgaccuaaaucccuaccucucccaccuagcaagaauguacaacggauacgccggcggcuucgagguccaagucauucuagccggcaacgcauucaccgccggaaaagucauauucgcagcaguucccccuaacuucccaaccgaaggccucucccccucccaagucacuauguucccacacauaguagucgacguccgccaacuagaacccguucuuaucccacugcccgacguccgaaacaacuucuaccacuacaaccaauccaacgaccccacuaucaaacuaaucgccaugcucuacacaccccuccgagccaauaacgcaggagacgacguauucaccguauccugcagaguccugacccggccauccccugacuuugacuucauauuucucguaccaccaaccgucgagagccgcacaaaacccuuuucaguaccaguccucacagucgaagagaugacuaacucacgauuccccauuccccucgaaaaacucuucaccggcccaucaucagccuucgucguacaaccccaaaacggaagauguacaaccgacggaguucuacucggaaccacccagcucucucccgucaacauaugcaccuuccgaggcgacgucacacacauaaccggcucacgaaacuacacaaugaaccucgcaagccaaaacuggaacaacuacgaccccacggaagaaauccccgcuccccucggcacccccgacuucgucggaaaaauacaaggcguccucacccaaaccacccgaaccgacggauccacccgcggccacaaagcaacaguauacacaggaucggccgacuucgccccaaaacucgguagaguacaauucgagaccgacaccgaccacgacuucgaagcuaaccaaaacacaaaauucacccccgucggcgucauacaagacggaggcacaacacaccgcaacgaaccacaacaauggguccuaccuuccuacucaggucgcgacacccacaacguacaccuagcgcccgccguagcacccaccuuucccggcgaacaacuccucuucuuccguuccaccaugcccggcugcucaggauacccaaacauggaccucgacugucuacucccucaagaauggguacaauacuucuaccaagaagccgcaccagcccaauccgacgucgcacuucuacgauucgucaacccagacaccggccggguccuauucgaaugcaaacuucacaaguccggauacguuaccgucgcccacacaggccaacacgaccucgucaucccaccaaacggcuacuuccgguucgacuccugggucaaccaauucuacacacuagcccccaugggcaacggcaccggccgccguagauaa

SEQ ID NO: 38593 - RNA, 1617 nt, Artificial Sequence
  derived and/or modified sequence opt11 from VP1__Norovirus_and/or_Norovirus-like__KT780391
augaaaauggccuccuccgacgccaacccuucagacggcuccgcagcuaaccucguaccugaagucaauaaugagguaauggcccucgaacccgucgucggagccgccaucgccgcccccgucgccggccaacaaaacgucaucgacccuuggauccgcaacaacuucguccaagccccaggcggcgaguucaccguuuccccucgaaacgcccccggcgaaauacucuggagcgcaccccucggaccugaccucaaucccuaucuaucccaccucgcccgaauguauaauggcuacgccggcggcuucgaaguccaagucauccucgcuggaaaugccuucaccgccggcaaggucaucuucgccgccguacccccaaacuucccaacagaaggccucucacccucacaagucaccauguucccucacaucgucgucgacguucgacaacucgaacccguccuaauuccacuccccgacguccgcaacaacuucuaucacuacaaccaauccaacgaccccaccauaaaacuuauagcaaugcucuacacaccccuccgcgcaaacaaugccggcgacgacgucuucaccguauccugccgaguccucacccgccccuccccggacuucgacuucauuuuccucgucccaccaaccgucgaaucccgaaccaaacccuucuccguccccguucucaccguagaagaaaugaccaauucucgguuucccauaccccucgaaaaacuauuuacaggcccauccuccgccuucgucguccaaccccaaaacggccgcuguacaaccgacggcguccuccuagggaccacccaacucuccccuguaaacauaugcacauuccgaggcgacgucacucacauaaccggaucccgaaacuacaccaugaaccucgccucccaaaauuggaacaacuacgauccaaccgaagaaaucccagcuccacucggcacccccgacuucgucggcaaaauccaagguguacucacucaaacgacacgcaccgauggcucaacacgcggccauaaagcaaccgucuacaccggcuccgccgacuucuccccaaaacucggucgcguccaauuugaaaccgacaccgaccacgacuucgaagccaaccaaaacaccaaauucacccccgucggcguaauccaagacggcggaacuacccaucgcaacgaaccccaacaauggguccuucccuccuacucaggcagaaacacccccaacguccaccuugcacccgccgucgcgccaaccuuccccggcgaacaacuccuauucuuucgauccaccaugcccggcugcucaggcuacccgaauauggaccuagacugccuccuaccccaagaauggguacaauauuucuaccaagaagcagccccagcccaauccgacgucgcacuccuccgcuucguaaaccccgacacaggucgaguccuauucgaaugcaagcuacacaaauccggcuacguuaccguagcccacaccggccaacacgauuuagucauaccucccaacggcuacuuccgcuucgacuccugggucaaccaauucuacacccucgcucccaugggcaacggaaccggacgccgacgcuaa

SEQ ID NO: 38594 - RNA, 1617 nt, Artificial Sequence
  derived and/or modified sequence opt11 from VP1__Norovirus_and/or_Norovirus-like__KT780390
augaaaauggcaucaagcgacgccaaccccuccgacgguuccgccgccaaccucguccccgaagucaacaacgaggucauggcccucgaacccgucgucggcgcagccauagccgcccccgucgccggccaacaaaacgucauagacccauggauccgcaacaacuuuguccaggccccaggaggcgaguucacaguauccccacgaaacgcacccggcgaaauccucugguccgcaccccuaggccccgaucucaaucccuaccucucacaucucgcacgcauguacaacggauacgccggaggcuucgaaguccaagucauccuagccggaaaugcauucaccgccggcaaagucaucuucgccgccgucccaccaaacuuccccacugaaggccucucgcccucccaaguaacaauguuuccccacauagugguagacguccgacaacucgaacccguacuaauaccacuccccgacguacgcaacaacuuuuaucacuacaaccaaucgaacgaccccacaaucaaacuaaucgcuaugcucuacacaccccucagagcaaacaacgccggcgacgacgucuucaccguaucaugccgcguacuaacccgaccuucccccgacuucgacuucauauuccucguaccucccaccgucgaaucccgaacaaaacccuucuccguccccguucugacagucgaagaaaugaccaacucuagauuccccauaccacuugaaaaacucuucaccgggccauccuccgccuucgucguacagccacaaaacggacgaugcacaaccgacggaguccuccuaggaaccacacaacuuucccccgucaacaucugcacauuccgaggcgacguaacccacaccaccggcucccacaacuacaccaugaaccuagcaucccaaaacuggucuaacuacgacccaaccgaagaaauccccgcaccccucggcacccccgacuuugucggcaaaauacaaggcguacucacacaaacaaccagaaccgacggaucaacucgaggccacaaagccacaguguacacaggcagcgcagacuucgcccccaaauuaggccgcguccaauucgaaaccgacacugaccacgaccuagaagccaaccaaaacacaaaauucacccccgucggcguuauccaagacgguggcgccacgcaccggaacgaaccccaacaauggguacucccaucuuacucaggccgcaacacccccaacguccaccucgccccugcagucgcucccaccuuccccggagaacaguuacucuucuuccgcucaaccaugcccggcugcucaggcuaccccaauauggaccuugacugucuccuaccccaagaauggguccaguacuucuaccaagaagcagcucccgcacaguccgauguagcucuacuacgauucguaaaucccgacaccggccgaguccucuucgaaugcaaacuccacaaguccggcuauguaacagucgcccacaccggucaacacgaccucgucaucccucccaauggauacuuccguuucgacucaugggucaaccaguucuacacccucgcccccaugggcaacggcacaggacgccgccgcuaa

SEQ ID NO: 38595 - RNA, 1617 nt, Artificial Sequence
  derived and/or modified sequence opt11 from VP1__Norovirus_and/or_Norovirus-like__KT780376
augaagauggcaagcucagaugccaaccccuccgacggcucagccgccaaccuaguacccgaagucaacaaugaaguccuugcucucgaacccgucgucggcgccgccaucgccgcucccguugcaggucaacaaaacgucaucgaccccuggauccgaaauaacuucguccaagcacccggaggcgaguucacaguuuccccacgaaacgcccccggcgaaauccugugguccgcaccccucggacccgaccucaacccuuaucuaucacaccuagcccgaauguacaacggcuacgccggcggcuucgaaguccaagucauccucgccggaaacgcuuucaccgccggcaaaguaauauucgcagcagucccacccaacuuccccacugaaggccuguccccaucccaaguuaccauguucccccacauagucgucgauguccgucagcuggaaccaguccuaaucccccuaccagacguccgcaacaacuucuaccacuacaaucaguccaacgacccuacuauaaaacucaucgcaaugcuauacacaccccuccgcgcaaacaaugccggcgacgacgucuucaccgucuccugccgaguacucacccgacccucccccgacuucgacuucaucuuccuagucccucccacagucgaaucccgcaccaagcccuuuucgguucccgucuuaaccguugaagaaaugacaaacucacgauuccccaucccccucgaaaaacucuucacuggccccucaucugccuucgucguccagccccaaaacggacgcuguaccacugacggcgucuuacucggcaccacccaacucagcccaguaaauauaugcaccuuucgcggugacgucacccacauaaccggaucccacaacuacacaaugaaccucgccucacaaaacugguccaacuacgacccuaccgaagaaaucccugccccacuaggaacacccgacuucguagggaaaauccaaggcguucucacacaaacaacccgcaccgacggcuccacacgcggacacaaagcaaccguauacaccggaucagcagacuucgcaccaaaacucggccgcguccaauucgaaaccgacaccaaccacgacuucgaagccaaccaaaacacaaaauucacccccguagguguaauccaagacggaucaaccacccaccgcaacgaaccacaacaauggguacuccccuccuauuccggccguaauaccccaaauguccaccucgcccccgccgucgcgccaaccuucccuggcgaacaacuccuuuucuuccgauccacgaugcccggcugcucaggcuacccaaacauggaucuggacugccuacuuccccaagaauggguacaauacuucuaccaagaagccgcccccgcccaauccgaugucgcacuccuucgcuuugucaauccggacaccggccgaguccuauucgaauguaaacuccacaaauccggcuacgucaccgucgcccauaccggccaacacgaccucguaauucccccaaacggcuacuuccgcuucgacucaugggucaaccaauucuacacccucgcccccauggguaacggcaccggcagacgccgcuga

SEQ ID NO: 38596 - RNA, 1617 nt, Artificial Sequence
  derived and/or modified sequence opt11 from VP1__Norovirus_and/or_Norovirus-like__KT780375
augaagauggcuuccuccgacgcaaaccccagcgauggcuccgccgccaaccuuguaccagaagucaacaacgaaguaauggcccucgaacccguagucggcgccgccaucgcagccccagucgccggacaacaaaacguaauagaccccuggauccguaauaacuucguccaggccccaggcggagaguucacaguaucuccacgaaacgcaccaggcgaaauccucuggagcgcaccacuaggccccgaucucaaccccuaccuaucccaccucgcccgcauguacaacggcuacgccggcggauuugaaguccaagucauccucgcgggaaacgcauucacagccggcaagguuaucuucgcagccguaccaccaaacuuccccaccgagggccuaucccccucccaaguaacaauguucccacacaucgucgucgacguccgccaacucgaaccaguacucauaccacugccggaugugcgaaacaacuucuaccacuacaaccaguccaacgacccaaccaucaaacucauagccaugcucuacacaccccuccgcgccaacaacgccggcgacgacguauucaccguuuccugucgcguacucacacgaccaagcccagacuucgacuucaucuuccucguuccucccacaguagaaucucgcaccaaacccuucucgguccccauccuaaccgucgaagaaaugaccaacucccgcuuccccaucccucuagagaaacucuucaccggcccuuccuccgccuucgucguccaaccacaaaauggccgcugcaccacagacggcguacuccucgguaccacccaacucuccccagucaauaucugcaccuuccgaggugacaucacccacaucacugguucccgcaacuacaccaugaaccuagccucccagaacuggagcaacuaugauccaacagaagaaauccccgcaccccucggcaccccagacuuugucggcaagauccaaggaguccugacacaaacgacccguacagacgguagcacccgcggccacaaagccacugucuacaccggcuccgccgacuucgccccuaaacuaggacgcguucaauucgagaccgacaccgaccaugacuucgaagccaaccagaacaccaaauucacacccgucggcguuauacaggaugguuccacuacccaccgcaacgaaccacaacaauggguacucccauccuacuccggacgcaacacccccaacguccaccuagcacccgcaguugcaccaaccuuccccggcgaacaacuucuauucuuccggucaaccaugcccggcugcuccggcuaccccaacauggaccuagauugccuccuuccccaagaauggguccaauacuucuaccaagaagcagcacccgcccaauccgacgucgcccuccuccgcuucgucaacccagacacaggccgcguccucuucgaaugcaaacuccacaaaucuggcuacgucacagucgcucacaccggccaacacgaccucguaaucccaccaaauggauacuuccguuucgacucaugggucaaccaauucuauaccuuagcccccaugggcaacggcaccggccgccgccgcuaa

SEQ ID NO: 38597 - RNA, 1617 nt, Artificial Sequence
  derived and/or modified sequence opt11 from VP1__Norovirus_and/or_Norovirus-like__LC016607
augaaaauggccagcaaugacgccucccccagcgacggaucuacagcuaaccucgucccggaaguuaacaacgaagucauggcccuagaacccguggucggcgcagccauagccgcccccgucgccggacaacaaaacgucauagaccccuggauacgcaacaacuucguccaagcccccggaggcgaguucaccgucucuccucgcaacgcccccggagaaauccuuuggagcgcaccccuuggaccagaccuaaacccauaccucucccaccucgcccguauguacaacgguuacgccggcggcuucgaaguccaagucauccucgccggcaacgccuucacagccggcaagaucauauuugccgccguaccacccaacuuuccaaccgaaggucucagccccucccaagucaccauguucccucauaucaucgucgauguccgccaacuagaaccaguccucaucccccuccccgacgucagaaacaauuucuaccacuauaaccaaucuaacgacucaaccaucaaacuuaucgcaaugcucuacacaccccuccgcgccaacaacgcaggagacgacgucuucaccgucucaugccgcguacuaacccgcccaucacccgacuuugacuucaucuuccugguacccccaaccgucgaaucucgcaccaaacccuucacaguccccauacucaccgucgaagaaaugaccaacucacguuuccccaucccacucgaaaaacucuucaccggccccucaucagcauucguaguacaaccucagaacggucgcugcaccaccgacggcguccuacucggcacuacccaacugucuccaguaaauauaugcacguuucguggcgacgucacccacauccccaacacucacacuuaccgaaugaaccucgccucacaaaacuggaacaauuacgaccccacagaagaaauacccgcaccccuaggcacccccgauuucgucggcaagauacaaggaauguuaacccaaaccaccaaaggcgacggauccacccgaggacacaaagccaccguaucgacaggcuccgucgacuucacaccaaaacuaggcuccguccaauuuaccaccgauacagacaacgacuucgaaaccggccaaaacaccagauucaccccagucggagucauccaagacggcaacggagcccaccgcaacgaaccucaacaauggguacuccccgacuacucaggaggcacuguccacaacguacaccucgcccccgccguagccccaacauuuccaggcgagcaacuccucuucuuccgcucaaccaugccugguugcucgggcuaccccaacauggaccuugacugccuacucccucaagaauggguccaacacuucuaucaagaagcagcccccgcccaauccgacgucgcacuacuccguuuugucaaccccgacaccggacgcguccuguucgaaugcaaacuccacaaaacgggauacgucacaguagcacacaccggccagcacgaccucgucauaccucccaauggauacuuccgcuucgacagcugggucaaccaauucuacacucuagcacccaugggcaacggagccggaagacguagauaa

SEQ ID NO: 38598 - RNA, 1617 nt, Artificial Sequence
  derived and/or modified sequence opt11 from VP1__Norovirus_and/or_Norovirus-like__KP241915
augaagauggccuccucagacgcaaaccccucagacggcucugccgccaaccuugucccugaagucaacaacgaagucauggcccuagaacccgucgucggcgcagcaaucgccgcaccuguugcaggccaacaaaacgucaucgaccccuggauccgaaacaacuuuguacaagcacccggcggcgaguucaccgucucaccccgcaacgcaccaggcgaaauccucuggucagcaccccuaggacccgaccuaaacccauaccucucccaucucgcccgcauguauaacggauacgccggcggauucgaaguccaaguaauccuagccggcaacgccuucacugccggcaaaguaaucuuugcagccguaccacccaauuuccccaccgaaggucucucucccucccaagucacaauguucccccacauaguaguagacguccgccaacuagaaccuguccucauccccuuacccgacguacgcaacaacuucuaccacuacaaccaaucaaacgaccccacaaucaaacucaucgcaaugcucuacacaccccuccgcgccaacaacgccggagaugacgucuucacagucucuugcagaguacucacccgucccucccccgacuuugacuucaucuucuuaguucccccaacaguagaaucccgcacuaaaccuuucucugucccaguacuaacugucgaagaaaugacuaacucccguuuucccaucccccucgaaaaacuuuucaccggccccuccucugccuucguaguccagccccaaaacggacgaugcaccaccgacggaguccuccuaggaaccacccaacucuccccggucaacaucugcacauuccgcggcgacgucacccacaucacuggcucacacaacuauaccaugaaucucgccucccaaaauuggucaaauuacgacccuaccgaagaaauccccgcaccccucggcacccccgacuucguaggcaaaauccaaggcguccucacccaaacaacacgcgccgacgguuccacccgcggccacaaagccacagucuacacgggcucagcagacuuugccccaaaacuuggccgaguccaauucgaaacagacaccaaccacgauuucgaagccaaucaaaacacaaaauucacgcccguaggagucauccaagacggcggaacaacccaccgaaacgagccccaacaauggguacuccccucauacagcggccgaaacacacccaacguccaccucgcccccgccgucgccccaacauuccccggcgaacaacuccucuucuuccgauccacaaugcccggcugcuccggcuaccccaauauggaccucgacugccuacucccccaagaguggguccaauacuucuaccaagaagcagcaccagcacaaucagacguagcacuccuccgauuuguaaacccagacaccggccgaguccucuucgaaugcaaacuacacaaauccggcuacgucacggucgcacacaccggucaacacgaccucguaauacccccuaacggcuacuuccgauucgacuccugggucaaccaauucuacacccuagcaccaaugggcaacgguacaggccgccgccgauaa

SEQ ID NO: 38599 - RNA, 1617 nt, Artificial Sequence
  derived and/or modified sequence opt11 from VP1__Norovirus_and/or_Norovirus-like__KM514065
augaaaauggcuuccuccgacgcaaacccauccgacggaucagccgccaaucuuguccccgaagucaacaacgaagucauggcccuugaacccguagucggagcagccaucgccgcccccgucgcuggacaacaaaacgucauagaccccuggauccgaaacaacuucguacaagcacccggcggcgaauuuaccguaaguccccgcaacgcccccggcgaaauccuauggucagcuccccucggcccagaccuaaacccauaccucucacaccuagcccgcauguacaacggcuacgccgguggauucgaaguacaaguaauccucgccggcaacgcauucacagccggcaaagucaucuucgcugccguacccccaaacuuccccaccgaaggucucagcccaucccaagugaccauguucccccacauagucgucgacgucagacaacuagaacccguccucaucccacuaccagacguccgcaacaacuuuuaucacuacaaccaaucaaaugaccccacaaucaaacucaucgccaugcuuuacacaccacuccgugccaacaacgccggcgacgacgucuucacagucucaugcagaguccucacaagacccucccccgacuucgacuucaucuuccucgucccacccaccguggaaucacgcacaaaacccuucagcguccccguccucaccguugaagaaaugaccaacagucguuuccccauaccccuugaaaaacuuuucaccggccccucuuccgccuucgucguacaaccccaaaacggccgcugcacuaccgauggcguccuccucggcacaacacagcucucacccguaaacaucugcaccuuccgcggugacguaacacacaucacaggaucccgaaacuacacuaugaaccucgccucccaaaacugguccaauuacgaccccacagaagaaauacccgcgccccucgguacacccgacuucguaggaaaaauccaaggaguccugacucagaccaccagaacagacggauccacaagaggccacaaagccaccgucuacacgggcucagcaggcuucgccccuaaacucggccgaguacaauucgaaaccgacaccgaccacgacuucgaagccaaucaaaacaccaaauucacucccgucggagucauccaagacggcuccaccacccaccgaaacgaaccccaacaauggguucuacccucuuacagcggacgcaacacccccaacguucaccuagcacccgccguagcgcccaccuucccaggagaacagcuccuauuuuuccgcuccaccaugcccggaugcucaggcuaccccaacauggaccucgacugccuccucccccaagaauggguacaauacuucuaucaggaagcagcacccgcccaaucggacguagcacuacuacgcuucgucaaucccgacaccggacgcguccuauucgaaugcaaauuacacaaauccggauacgucaccguagcacacaccggccaacacgaccugguaaucccaccgaacggauacuuccgauuugacuccuggguuaaccaauucuacacccuugcuccaaugggcaacggcaccggacgccgacgcuaa

SEQ ID NO: 38600 - RNA, 1617 nt, Artificial Sequence
  derived and/or modified sequence opt11 from VP1__Norovirus_and/or_Norovirus-like__KM268097
augaagauggccuccucagacgccaaccccucagacggauccgcagccaaccucguccccgaagucaauaaugaggucauggcccucgaacccgucgucggcgcugccaucgccgcaccugucgccggccaacaaaacgucaucgaucccuggauacgcaauaauuucguacaagccccaggaggcgaguucaccguauccccacgcaacgcucccggagaaauccuaugguccgcaccgcuuggcccugaccuaaacccuuaccucucccaccucgcccgcauguacaauggauacgccggcggcuucgaaguccaagucauccucgccggcaacgccuuuaccgccggcaaagucauauucgcggcagucccucccaacuuucccacagaaggccucucacccucccaagucaccauguucccccauauagucgucgacguacgccaacucgaacccguccuaaucccccuacccgacguacgcaacaacuucuaccacuacaaccaauccaacgacccaacuaucaaacuaaucgccaugcuuuacaccccacuaagagccaacaacgcaggcgacgacgucuucacuguuucaugccguguccuaacacgcccuucccccgacuucgacuucauuuuccucguuccacccaccgucgaaucucgcaccaaacccuucuccguacccguccucacagucgaagaaaugacaaacucccgcuucccaaucccacuggaaaaacuuuucaccggccccucuucagccuucguuguccaaccacaaaacggccgcugcaccaccgacggcguacuccucgguacaacacaacuaucuccaguuaauauaugcaccuuccgaggugacgucacccacaucacaggaagccacaacuacaccaugaaccucgccucucaaaacuggaacaacuacgaccccaccgaagaaauccccgcaccccucggaaccccagacuuugucggcaaaauacaaggcgucuuaacccaaaccacccgcaccgauggcucuacacguggucacaaagcaaccguauacaccgguucagccgacuucgcaccaaaacucgguagaguccaauucgaaaccgacaccaaccacgacuucgaagccaaccaaaauacaaaauucacccccgucggcgucauccaagacggcggaaccacccaccggaacgaaccccagcaauggguacucccauccuacucaggccgcaacacaccaaacguccaccuagcuccagccguugcccccaccuucccuggagaacaacuucucuucuucagauccaccaugccaggcugcagcgguuaccccaacauggaccucgacugccuccucccacaagaguggguccaauacuuuuaccaagaagccgccccagcccaauccgacguugcacuccuccgcuucgucaaccccgacaccggacgcguccucuucgaaugcaaacuacacaaauccgguuacgucaccgucgcccacaccggacaacacgaucucguuaucccacccaacggcuauuuccgauucgacuccugggucaaccaauucuacacacuagcuccaaugggcaacggcacaggcagacgacgauaa

SEQ ID NO: 38601 - RNA, 1617 nt, Artificial Sequence
  derived and/or modified sequence opt11 from VP1__Norovirus_and/or_Norovirus-like__KM268084
augaaaauggcauccagcgacgccaaccccucagacggcucagcagcaaacuuagucccagaaguaaacaacgaagucauggcacucgaacccguagucggcgcagccaucgcugccccagucgccggacaacaaaacgucaucgaccccuggauccgcaacaacuucguccaagcuccuggcggcgaguucaccgugucaccccgaaacgcccccggcgaaauccuaugguccgcaccccucggucccgaccuaaaccccuaccuaucccaccucgcucgcauguacaacggcuacgcaggcggauucgaaguccagguaauccucgccgggaacgccuucacagcagguaaaguaaucuucgccgccgucccuccuaacuuccccacagaaggccuaucccccucccaagucacaauguucccacacauaguaguagacguccgacaacuagaaccaguccuaauaccccuaccagauguccguaacaacuucuaccacuacaaccaauccaacgacccaaccaucaaauuaaucgccaugcuauacacaccucuccgagccaacaacgcuggagacgacguauucaccgucagcugccgcguccucgcccgucccagccccgacuucgacuucauauuccucguaccacccacagucgaaucccgcacaaaacccuucucagucccaguacuaaccgucgaagaaaugacaaacucccgcuucccuauuccacuagaaaaacucuucaccggccccuccuccgccuucguuguccagccacaaaacggccgcugcaccacagacggcguacuccucgggacaacacagcucucaccagucaacaucugcaccuucagaggcgacgucacccacaucaccgggucccgcaacuacacaaugaaccuggcuagccaaaacugguccaacuaugacccuacugaagaaauucccgcuccacuaggcacaccagacuucgucggcaaaauccaaggcguccuaacccaaaccaccaaaacugacggcucgacccguggacacaaagccacaguauacaccggaagcgccgacuucgccccuaaacuaggccgcguacaauucgaaaccgacaccgaccacgacuucgaagcaaaccaaaacaccaaauucacccccgucggcguaauacaagauggcucaacgacccaucgaaacgaaccucaacaauggguccucccuagcuacagcggccgaaacacacccaacguacaucucgcccccgcagucgccccgaccuuccccggcgagcaacuccuauucuuccgcucaaccaugcccggcugcucaggcuaccccaacauggaccuagacugccuccucccccaggaauggguccaauacuucuaccaagaagccgcucccgcccaaagcgacgucgcgcuccuccguuucgucaaccccgacacaggcagaguccucuucgaaugcaaacuccacaaguccggcuacgucaccgucgcacacacaggccaacacgaccucgucaucccacccaacggcuacuuccgcuucgacucaugggucaaccaauuuuacacacuagcacccaugggcaacggaacaggccgccgucgcuaa

SEQ ID NO: 38602 - RNA, 1617 nt, Artificial Sequence
  derived and/or modified sequence opt11 from VP1__Norovirus_and/or_Norovirus-like__KJ649704
augaaaauggcaucauccgacgccaaccccucagacggcuccgcagcaaaccucguccccgaaguaaacaacgaaguccuagcccucgaacccgucgucggagcagccauugcagcaccagucgcaggccaacaaaacgucaucgacccauggauacgaaacaacuucguccaagccccaggaggagaguucaccgucucaccccgaaaugcccccggcgaaauccucugguccgcuccccucggacccgaccucaaccccuaccuuucccaucucgcucggauguacaauggcuacgcaggcggcuucgaaguccaagucauccucgccggcaacgccuucacagccggcaaagugaucuucgcagccgucccgcccaauuuccccaccgaaggccuaucccccucacaaguaaccauguucccccacauagucguagacguccgacaacucgaacccguccugaucccccuccccgacguccguaacaacuucuaucacuacaaccaguccaacgaccccacuaucaagcucauagccaugcuuuacacaccccuccgagccaacaaugcaggagacgacguauucaccgucagcugccgaguccuaacacgccccagccccgauuucgacuucaucuuccucguacccccaaccgucgaaucacgaaccaaaccauucuccgucccaguacuaacagucgaagaaaugacaaauucacgauuccccauuccccucgaaaaacucuucaccggucccagcucagcguucgucguacaaccccaaaacggccgcugcaccaccgacggcguacuacucgguaccacccaacucucccccgucaacauauguacuuuccgcggagacgucacccacauaaccggaucucacaacuacacaaugaaccucgccucccaaaacuggaauaacuacgaccccacagaagaaaucccggcaccacuugguacccccgacuucgucgggaaaauacaaggcguacuaacccaaaccacacgaacagacggcuccacccguggccacaaggcaacagucuacacuggcucugccgacuucucccccaaacuuggccgaauccaauucgaaaccgacacaaaccacgacuucgaagccaaccaaaacacaaaauucacccccguaggagucauacaagacggcggcaccacccaucgcaacgaaccccaacaauggguccuccccucauacagcggcagaaacacacccaacguacaccucgcgccugcagucgccccaaccuuccccggagaacagcuccucuucuuccgcuccaccaugcccggcugcucaggcuacccgaacauggaccuagauugccuacucccccaagaauggguccaauauuucuaccaagaagccgccccagcccaauccgacguagcacuacuacgcuucguaaacccagacacaggacgaguccucuucgaaugcaaacuccacaaaucaggauacguaaccgucgcccacacaggccaacacgaccucgucauaccacccaauggcuauuuccguuucgacaguugggucaaccaauucuacaccuuagcacccaugggcaacggaaccggccgccgccgcuaa

SEQ ID NO: 38603 - RNA, 1617 nt, Artificial Sequence
  derived and/or modified sequence opt11 from VP1__Norovirus_and/or_Norovirus-like__KC577174
augaaaauggccuccucagacgcaaaccccagcgacggcuccaccgccaacuuaguacccgaagucaacaaugaagucauggcccuagaacccguuguaggggcagcaauugccgcucccgucgccggccaacaaaacguuaucgacccguggauacgcaacaacuucguccaagcacccggaggcgaguucaccgucucuccccgcaacgccccaggagaaauucucugguccgcaccucuaggccccgaccucaauccguaccucagucaccucgcccgcauguacaacggcuacgccggcggauucgaaguucaaguaauccuugccggcaacgccuucaccgccggcaaaauaaucuucgcagccguuccucccaacuuccccacagaaggccuaucaccuucacaagucaccauguucccccacauaaucguagacguccgccaacuagagcccguccucaucccccuaccagacguccgcaacaauuucuaccauuacaaccaaucaaacgauuccaccauaaaacucauagcaaugcucuacacaccccuacgcgcaaacaacgccggcgacgacgucuucaccgucucaugccgaguccucacccgccccuccccagacuucgauuucauauuccuagucccucccaccgucgaaucccgcaccaaaccuuuuucagucccaguacucaccgucgaagaaaugaccaacucacgcuuuccgaucccccucgaaaaacuauucacagggccaucauccgcauucgucguccaaccccaaaacggacgcuguaccaccgauggaguucuucucggaaccacacagcucucaccaguaaacaucugcacuuuccgcggagauguuacccacauaucaggauccucaaacuacacaaugaaccuagccucccagaacuggaacucauacgaccccaccgaagaaauccccgcuccccucggcaccccagacuucguuggcaaaauucaaggcguccuaacccaaacaacccgcaccgacggcuccacacgcggccacaaagcaaccgucuacaccgguuccgccgacuucuccccaaaacuaggccguguacaauucgccaccgacaccgacaacgacuucgaaaccaaccaaaacaccaaauucaccccagucggcgucauccaagacggcgcaacaacccaucgcaacgaaccccaacaauggguccucccauccuacagcggccgcaacacacauaacguacaccucgcacccgccguugcacccacauucccaggcgaacaacuucucuucuucagauccaccaugccaggaugcucaggcuaccccaacauggaccuagacugccuacucccacaagaauggguccaauacuucuaccaagaagcggcgcccgcacaaucagacguagcccuacuucgcuucgucaacccagacacuggccgcguccucuucgaaugcaagcuccacaaauccggauaugucacaguagcccacaccggucagcacgaccuagucaucccaccaaacggcuacuuccgcuucgacuccuggguuaaccaauuuuacacacuagcccccaugggcaacggcacuggcagaagacgauaa

SEQ ID NO: 38604 - RNA, 1617 nt, Artificial Sequence
  derived and/or modified sequence opt11 from VP1__Norovirus_and/or_Norovirus-like__KF177451
augaagauggcaagcuccgacgccaaccccuccgacggcucugcggccaaccuuguucccgaaguaaacaacgaagucauggcccucgaacccguggucggcgccgccaucgccgcccccgucgcgggccagcaaaacgucauagaccccuggauacgcaauaacuucguccaagcccccggaggagaauuuaccguaagcccacgcaacgcccccggagaaauacuuugguccgccccacuaggccccgaccucaaccccuaccucucccaccucgcacgcauguacaacggcuacgccggcggcuucgaaguucaagucaucuuagccggcaacgccuucaccgccggcaaagucauauucgccgccgucccacccaacuuccccaccgaaggccuaucccccucacaagugacaauguucccccacaucgucguagacgucagacaacuagaacccguccucaucccguuacccgacguacgcaacaacuucuaccacuacaaccaaucuaacgaccccaccaucaaacuaaucgccaugcucuacacuccccugcgcgccaacaacgccggcgacgacgucuucaccguuuccugcagaguuuuaacccgaccaucaccugacuucgacuucauauuccucguacccccaacagucgaaucuagaacaaaaccuuucuccguccccguccucacuguagaagaaaugaccaacucacgauuccccaucccccuugaaaaacuauucaccggacccucaucagcauucgucguccaaccccaaaacggacgaugcaccaccgacggaguauuacucggcaccacccaacuuuccccaguaaacaucugcaccuuccgcggcgacgucacccauauaaccggcucacgaaacuacaccaugaaucucgccucccaaaacuggaacaacuacgaccccaccgaagaaauccccgcaccccucggcacccccgacuucgucggaaaaauccaaggaguccuuacacaaacaacccgaaccgacggauccaccagaggacacaaggccacagucuacaccggcuccgccgauuucgcccccaaacucggacgaguacaauucgaaaccgacaccgacaacgacuucgaagccaaccaaaacaccaaauucacacccguaggcguaauccaagacggaggcaccacccaccgcaacgaaccccaacaauggguacuccccucauacuccggaagaaacacccacaacguccaccuagccccagccguagccccaacauucccaggcgaacaacuccucuucuuccgauccacaaugcccggaugcuccggcuauccaaacauggaccucgacugccucauaccgcaagaauggguccaauauuucuaucaagaagcagcccccgcacaauccgacgucgcccuccuccgauucguaaacccagacaccggccgaguccuauucgaaugcaagcuacacaaaucaggcuacgucaccgucgcacauaccggccaacacgaccuaguaaucccucccaacggcuacuuccgcuucgacuccugggucaaccaauucuauacacuagcccccaugggcaacggaaccggcagacgucgcuaa

SEQ ID NO: 38605 - RNA, 1617 nt, Artificial Sequence
  derived and/or modified sequence opt11 from VP1__Norovirus_and/or_Norovirus-like__KF177429
augaaaauggcauccuccgacgcuaaccccucagaugguuccgccgcaaaccucgucccugaagucaacaaugaaguuauggcacuugaaccagucgucggcgccgccauagcagcaccaguugccggccaacagaacguuauagaccccuggauccgcaacaacuucguucaagccccgggcggcgaauuuaccguauccccacgaaacgcccccggcgaaauccucugguccgccccacucggacccgaccucaaccccuaucucucacaccucgcccguauguacaacggauacgcuggcggcuucgaaguucagguaauacuggccggaaacgccuucaccgcagguaaggucaucuucgccgccguaccacccaacuuucccacagaaggccuuucccccucccaagucaccauguucccucacaucgucgucgacguccgucagcucgaacccguccucauaccccugccagacguacgaaacaacuucuaccacuacaaccaaucaaacgaccccaccaucaaacucauagccaugcucuacacacccuuacgagccaacaacgcuggcgacgacgucuucacagucagcugccgcgugcucacccgacccagcccggacuucgacuucaucuuccucgucccgcccacagucgaaucccgcacaaaacccuucucagucccaguucucacaguagaagaaaugacaaauagccgcuucccaauaccacucgaaaaacuauucaccggccccuccucagccuucgucguccaaccacaaaauggccgcuguaccacagacggcguccuccucggcaccacccaacuuucacccguaaauaucugcaccuuccgcggcgacgucacccacauaaccggcucacguaacuacaccaugaaccuagccagccaaaacuggaacaacuacgaccccaccgaagaaauaccagcuccccucggaacacccgacuucgucggcaaaauucaaggcguccucacacaaacuacacgcaccgacggcuccacacguggccacaaggccaccgucuacaccggcuccgccgacuuugcacccaaacuuggccgcguccaguucgaaaccgacaccgaccacgacuucgaagccaaccaaaacaccaaauucaccccaguaggcgucauucaagauggaggcaccacccaccgaaacgaaccccaacaauggguauuacccuccuacuccggccgcaacacccccaacguccaccucgccccagccgucgcacccaccuuccccggcgaacaacuccucuucuuccguagcaccaugcccggcugcuccgguuaccccaacauggaccuagauugccuccuaccccaagaauggguccaauacuucuaccaagaagccgccccagcccaaagcgacgucgcccuccuccgcuucgucaauccugauaccggccgcguccuauucgaaugcaaacuucacaaauccggcuacguaacggucgcucacucaggacaacacgaccuagucauaccaccaaacggcuacuucagauucgacuccugggucaaccaauucuacacccucgcccccauggguaacggcacaggccgacgaagauaa

SEQ ID NO: 38606 - RNA, 1617 nt, Artificial Sequence
  derived and/or modified sequence opt11 from VP1__Norovirus_and/or_Norovirus-like__KF060005
augaaaauggcauccuccgacgccaaccccagcgacggcuccaccgccaaccuaguaccagaagucaacaacgaagucauggcccucgaacccguugucggcgccgcaaucgccgcucccgucgcuggccaacaaaacgucauagaccccuggauccgcaacaacuucguacaagcaccuggcggcgaguucaccguaucaccccgcaacgccccuggcgaaauacuuugguccgcuccacucggcccagaccucaaccccuacuuaucucaccucgccagaauguacaacggauacgcaggaggauucgaaguccaagucauucuagccggaaacgcauucaccgccggcaaaaucaucuucgccgcagucccacccaacuuccccacagaaggcuugucgccuucacaagucacaauguucccccacauuauagucgaugucagacaacucgaacccguccucauaccccugccagacgucagaaacaacuucuaccacuacaaccagucaaacgaccccaccaucaagcugaucgccaugcuuuauacaccccuccgcgccaacaacgccggagacgaugucuucaccguauccugccgcguccucacccgacccagcccagacuucgacuuuaucuuccucguacccccuaccgucgaaucccgaacaaaaccauucuccguccccguccuuaccguagaagaaaugacuaacucacgcuuccccaucccacucgaaaaacucuucacaggcccauccuccgccuucguuguccaaccacagaacggccgaugcaccaccgacgguguccucuuaggcaccacacaacucuccccagucaacauaugcaccuuccgcggcgacgucacccacaucuccggcucccgcaacuauacaaugaaccucgccucacaaaacuggaacuccuacgaccccaccgaagaaauucccgcuccccucggaaccccugacuucgucggcaaaauccaaggcguacucacccaaaccacucgcaccgacggcuccaccagaggccacaaagccaccgucuacaccggaucugccgacuucaccccaaaacucggccgcguccaauucgccaccgacaccgacaacgacuucgucacaaaccaaaacacaaaauucaccccagucggcgucauccaagacggcagcaccacaccccgaaaugaaccgcaacaauggguccuccccucauacuccggacguaacacccacaacguccaccucgcaccagcagucgcccccaccuuccccggugaacaacuccuauucuuccgaagcaccaugcccggcugcuccggcuaccccaacauggaccucgacugccuccucccacaagaauggguucaauacuuuuaucaagaagcagccccagcccagucagacguugcccuccuccgcuucgucaaccccgacacaggacgaguacuuuuugaaugcaaacuacacaaaucuggauacguaaccgucgcacacacaggacaacacgaccucgucaucccucccaacggcuacuuccgcuucgauagcugggucaaccaauuuuacacacucgcucccaugggcaacggcaccgggcgacgacgcuga

SEQ ID NO: 38607 - RNA, 1617 nt, Artificial Sequence
  derived and/or modified sequence opt11 from VP1__Norovirus_and/or_Norovirus-like__JX439821
augaaaauggccuccuccgacgccaaccccucagacggaucgacagccaaccuaguucccgaagucaacaacgaagucauggcccucgaacccgucguuggugcugccaucgccgcccccgucgccggacaacaaaacguuaucgaucccuggauccgcaacaacuucguccaagccccaggaggcgaguucaccgucucuccacgaaacgcacccggcgaaauccucuggagugcaccccucggcccagaccucaacccauaccuuucccaccucgcccgaauguacaacggcuacgccggaggauucgaaguacaaguaauacuagccggcaacgccuucaccgccggcaaaaucaucuucgccgcagucccucccaauuuccccaccgaaggccuuucacccucccaagucacaauguucccccacaucaucgucgacguccggcaacucgaacccguccucauaccccuacccgacguuagaaacaauuucuaccacuacaaccaaagcaacgacccaacaaucaaacucaucgccauguuauacacaccacuccgcgcaaacaacgcaggagacgacguauucacaguauccugccguguccucaccagacccuccccagacuucgacuuuauauucuuaguaccucccaccguagaaucccgcaccaaaccauucucugugcccguccuuaccguagaagagaugaccaacucccgcuuccccaucccccucgaaaaacuuuucaccggacccuccucagcauucgucguacaaccccaaaacggcagauguaccacagacggcguucuacucggaaccacgcaacucagcccggucaacaucugcaccuuccgcggagacgucacccacaucucaagcucacguaauuacacuaugaaccuagccucacaaaacuggucaucuuacgacccaaccgaagaaaucccagcuccccucggcacccccgacuucgucggcaaaauacaaggcguucuuacccaaaccacccguacagacggaaguacacgcggccacaaagccaccgucuacaccggcucagccgacuucuccccuaaacugggccgaguccaauucgacacagacacagacaacgacuucgaaacaaaccaaaacacuaaauucacccccguugguguaauccaagacggcuccacaacauaccguaacgaaccccagcaauggguccuuccaucauacuccggccgaaacacccauaacguccaucuagcccccgcaguugcccccacauuccccggcgagcagcucuuauucuuccgcuccaccaugcccgguugcucaggcuacccaaacauggaccucgacugccuccucccacaagaauggguccaauacuuuuaccaagaagccgcccccgcacaaucggacguagcgcuccucagauucguuaacccugacaccggccgcguacucuucgaaugcaaacuccacaaaucaggcuacgucacaguagcccacaccggccagcacgaccucgucauaccacccaacggauacuuccgcuucgacagcugggucaaccaauucuacacccucgcccccaugggaaacgguaccggcagacgccgauaa

SEQ ID NO: 38608 - RNA, 1617 nt, Artificial Sequence
  derived and/or modified sequence opt11 from VP1__Norovirus_and/or_Norovirus-like__KC517361
augaaaauggccuccuccgacgcaaacccaucagauggcucagccgccaaccucgucccagaaguuaacaacgagguaauggcacucgaacccguugucggagccgcaauagccgccccagucgcaggacaacaaaacguuaucgaccccuggauccgaaacaacuuuguccaagccccaggcggagaguucaccgucagcccccgcaaugcacccggcgaaauacucugguccgcaccccucggucccgaccucaacccauaccucucccaccuggcacggauguacaacggcuacgccggcggcuucgaaguccaagucauccuagcgggcaacgcauucaccgcaggaaaaguaaucuucgccgcagucccacccaacuuccccacagaaggccuauccccaucccaagucaccauguucccucacauuguaguagacguucgccaacuugaacccgucuuaauaccacuacccgauguccgcaacaacuuuuaccacuacaaccaauccaacgacccgaccauaaaacuaaucgccaugcucuacacaccccuacgagccaacaacgccggcgacgaugucuucaccguuagcugccguguccuaacuagacccucacccgacuucgacuucaucuuccuugucccucccaccgucgaaucccgaaccaaacccuucuccguacccguccuaaccguugaagaaaugaccaacuccagauuccccauuccccucgaaaaacuauucacgggacccagcucugccuucguaguacaaccccaaaacggacguugcacaaccgauggcguccuccucggaaccacacaacucagccccgucaacaucugcaccuuccgcggcgacaucacccacaucacugguuccagaaacuacaccaugaaccucgcuucccaaaacuggaacaacuacgaccccacggaagaaauacccgcaccccuaggaacccccgacuucgucggcaaaauccaagguguccuuacacaaacaacccgcaccgacgguagcacccgcggccauaaagccacaguccacacaggauccgccgacuucgcccccaaacuaggccgcguacaauucgaaaccgacacugaccacgacuucgaggccaaccaaaacacgaaauucacgcccgucggcgucauccaagacggcggaacaacccaccgcaacgaaccccaacaguggguccuccccucauacucaggccgcaacacucauaacguacacuuagcccccgccguagccccgaccuuccccggagaacaauuacucuucuuccguaguaccaugccaggcugcucaggauacccaaacauggaccuagacugccuccuuccccaagaauggguacaauacuucuaccaagaagccgcccccgcccaauccgacguggcccuacuaagauucgucaaucccgacacaggccgcguacucuucgaaugcaaacuccacaaaagcggcuacgucacaguugcccacaccggccaacacgaccuagucauuccacccaacggcuacuuccgcuucgacucaugggucaaccaauuuuauacccucgcccccaugggcaacggaaccggccgucgacgauaa

SEQ ID NO: 38609 - RNA, 1617 nt, Artificial Sequence
  derived and/or modified sequence opt11 from VP1__Norovirus_and/or_Norovirus-like__KC175378
augaaaauggcaucaaacgacgccaaccccucagacggcuccgccgccaaccuuguacccgaaguauccaacgaaguuauggcucuagaaccagucguaggcgccgccaucgccgcgcccgucgccggccaacaaaacgucaucgaccccuggauacgaaacaacuucguacaagcccccggcggcgaguucacagucucccccagaaacgcacccggugagauacucugguccgccccacuaggaccagaccucaacccauaccucucccaccuugcccgaauguacaacggcuacgccggcggauucgaaguccaagucauacucgccggcaaugccuucaccgcaggaaaaaucaucuucgccgccguaccacccaacuuccccacagaagguuuaucacccucccagguaacuauguucccccacaucaucguagacguacgccaacucgaacccguucucaucccccuccccgacguaagaaacaacuucuaccacuacaaccaaacaaaugacucuaccauuaaauuaaucgcgaugcuguacacuccccuccgagccaacaacgccggcgaggacgucuucaccgucuccugccgcguccucacccgacccuccccagacuucgacuucaucuuccuuguaccgcccacagucgaaucccgcaccaaaccauucacuguccccauccucacggucgaagagaugacaaacagcagguuccccauaccccucgaaaaacuauucaccggcccgucaggcgccuuuguaguccaaccccaaaacggaagauguaccacugacggaguacuucucggcaccacacaauuaagcccagucaacaucugcaccuuccgaggcgacgugacccacauagccggcucacgcaacuacacaaugucacuagcaucccuaaacuggaacaacuacgaccccaccgaagaaaucccagcaccgcucgguaccccagacuucgucggcaaaauccaaggcgucuuaacccaaacaacaaaaggcgacggaucgacccgaggacacaaggccacagucuacaccgguuccgcccccuucaccccuaaacucggcuccguccaauucuccaccgacaccgaaaacgacuucgaaacacaccaaaacaccaaauuuacuccagucggcguuauacaggacggcggaacaacacaccgaaaugaaccccagcaauggguacuacccucauauuccggacgcgauguccacaacguccaucuagcccccgcaguugcccccaccuuucccggcgaacaacuacucuucuuccgauccaccaugcccggaugcuccggcuacccuaacauggaccucgacugccuacucccacaagaauggguccaacacuucuaccaagaagccgcccccgcccaauccgacguagcccuacuccgauucgucaauccagacacaggccgaguccucuucgaaugcaaacuccacaaaucaggcuaugucaccgucgcccauaccggccaacacgaccuagucauacccccaaacggcuacuuccgcuucgacuccuggguuaaccaguucuacacccucgcccccaugggaaacggcaccggucgccgccgcuga

SEQ ID NO: 38610 - RNA, 1617 nt, Artificial Sequence
  derived and/or modified sequence opt11 from VP1__Norovirus_and/or_Norovirus-like__JX459648
augaaaauggccuccaacgacgccaacccuuccgaaggcucugccgccaaccuagucccagaaguaaacaacgaagucauggcccucgaacccgucgucggcgcagcuauagcagcacccguagccggacaacaaaacguaaucgaccccuggauucgcaacaacuucguacaagccccaggcggcgaguucaccgucucaccucguaacgcacccgggaccauccgaugguccgcuccccuaggccccgaccuaaaccccuaccucucccaccucgcccgcauguauaacggcuacgccggcggauucgaaguccaaguuauccucgccggcaacgccuucacugccggcaaaaucauauucgccgccgucccacccaacuucccuaccgaaggacuaucccccagccaggucacaauguucccccacauaauagucgacguaagacaacucgaacccguccuaauaccacuccccgacguccgcaacaacuucuaccacuacaaccaaucaaacgacucaacaaucaaacucaucgccaugcucuacaccccucuccgcgccaacaacgccggagaagacgucuucacaguauccugccgaguccucacuagacccucgcccgacuucgacuucaucuuccuaguacccccuaccgucgaaucccgcaccaaacccuuuacaguccccauacuaaccgucgaagaaaugaccaauucacgcuucuccaucccacuugaaaaacucuucaccggccccuccggagcauucgucguccaaccacaaaacggccgcugcaccacagacgguguccuccucggaacaacccaauuaucccccguuaacauaugcaccuuccgcggcgacgucacucacaucgcaggaucacgcaacuacacaaugaaucucgcugcccucaauuggaacaacuaugaucccaccgaagaaauccccgccccacuagguaccccugacuucgucggcaaaauccaaggcguccuuacacaaaccacaaaaggcgacggcucaacacgcggacacaaagccaccgucuacacaggguccgcugacuucacccccaaacuuggcuccguacaauucuccaccgacaccgaaaacgauuucgaaucccaccaaaacaccaaauucacccccgucggcguaauccaggacggcuccacaacacaccgcaacgaaccacaacaauggguucucccaagcuacucaggccgcaacguccacaacguccaccucgccccagcuguugcacccaccuuccccggagaacaacuccuuuucuucagaucaacuaugcccggcugcuccggcuacccaaacauggaccuagauugccucaucccacaagaauggguccaacacuucuaccaagaagccgccccagcacaauccgacguagcccuacuccgcuucgucaaccccgauaccggacgcguucuuuuugaaugcaaacuucacaaaucaggcuacgucacagucgcccacacaggccaacacgaucuaguaaucccucccaacggcuacuuccgcuucgacucauggguuaaccaauucuacacucucgcacccaugggcaacggcgcaggccggcgccgauaa

SEQ ID NO: 38611 - RNA, 1617 nt, Artificial Sequence
  derived and/or modified sequence opt11 from VP1__Norovirus_and/or_Norovirus-like__JX459635
augaaaauggccagcaacgacgccaaccccuccgacggcuccgcagccaaccuaguccccgaggucaauaacgaagucauggcccuugaaccugucguaggugccgccaucgcggcccccguagccggccaacaaaacgucaucgaccccuggauccgcaacaacuucguccaagccccgggcggcgaguucaccgucaguccccgaaacgcucccggagaaauccucugguccgcaccccucggacccgaccucaaucccuacuuaucucaccuagcccgcauguacaacggauacgccggcggcuucgaaguacaagucauccucgccgguaacgccuucaccgccggcaaaaucaucuucgccgccguacccccaaauuucccaaccgaaggccuaucccccucacaagucaccauguucccacacauaauccuggacguacgccaacucgaaccaguccucaucccccugccagacguucgcaauaacuucuaccacuacaaccaaucaaacgacuccaccaucaaacuaaucgccaugcuauacaccccacuccgagcaaacaacgccggagaagacguguucacgguauccugccgcguacuaacccgccccucccccgacuucgacuuuaucuuccucguaccucccaccguagaaucacgaaccaaacccuucacaguccccauccucacaguagaagaaaugaccaauucccgcuuuccaauaccccuggaaaaacucuucacaggccccucuggugcauucguagugcaaccucaaaacggacgcugcaccaccgacgggguacuccucggcaccacccaacucucccccgucaacauaugcaccuuccgaggagacgucacccacauagcagguucacgcaauuacaccaugaaccuugccucacucaacuggaacaacuacgacccaaccgaagaaauaccagcaccccuuggaacccccgacuucguaggaaaaauccaaggaguacucacacaaaccaccaaaggcgauggauccaccagaggccauaaagccaccguauacacaggaucagccccauuuaccccaaaacucggcuccguacaguucuccaccgacaccgaaaacgacuucgaaacucaccaaaacaccaaauucacccccgucggagucauccaagacggcuccacaacccgccgcaacgaaccacagcaauggguacucccuucuuacuccggccgcaacgcccacaacguccaccucgcccccgccgucgcccccaccuucccaggcgaacaacuccucuucuuccgcucaaccaugcccggcuguucaggcuaccccaacauggaccucgacugccugcucccucaagaauggguccaacacuucuaccaagaggcugcacccgcgcaaucagacgucgcccuacuccgcuucgucaaccccgauacaggccgcgucuuauucgaaugcaaacuccacaaauccggcuacgucaccgucgcacacaccggccaacacgaccuagucauacccccaaacgguuacuuccgauucgacuccugggucaaucaauucuacacccucgcaccaaugggcaacgggacaggccgcagacgauga

SEQ ID NO: 38612 - RNA, 1617 nt, Artificial Sequence
  derived and/or modified sequence opt11 from VP1__Norovirus_and/or_Norovirus-like__JX459624
augaaaauggccuccaaugacgcccaccccucugacggcuccgccgccaaccucgucccugaaguaaacaacgaaguaauggcucuugaacccgucgucggugcagccaucgccgcccccgucgcaggccaacaaaacguaauagaccccuggauucgcaacaacuucguccaagcccccggcggcgaauuuacuguaucaccccgcaaugcccccggcgaaauccuaugguccgcaccccuuggucccgaccuuaaccccuaccucucccaccucgcucgcauguauaacggcuacgccggaggcuucgaaguccaagucauccucgcaggaaacgccuucaccgcaggaaaaaucauauucgccgccguucccccaaacuuccccaccgaagguuuauccccaucacaagucacaauguuuccccacaucauagucgacguccgccaacuagaaccuguccucaucccccuacccgacguacgcaacaacuucuaccacuacaaccaauccaacgacucuacaaucaaacucaucgccaugcuauacacaccccuccgugcuaauaacgcaggcgaagacguauucaccguuuccugccgaguccuaacccgccccucacccgacuucgacuucauuuuccucgucccgccaaccguagaaucccgcaccaaacccuucaccguaccaauccuaacggucgaagaaaugacaaacucccgcuuuccaaucccccuagaaaaacucuucaccggcccauccggagccuucgucguacaaccccagaacggucgcugcaccaccgacggcguccuccucggcaccacccaacucucccccgucaacaucugcacuuuccgaggagacguaacccacauugccggcacccguaacuacaccaugaaccucgccagccucaacuggaacaacuaugaccccacugaagaaaucccagcgccccugggcccucccgacuucgucggaaaaauacaaggcguacuaacccaaaccacuaaaggagacggaucuacacgcggccacaaagcaaccgucuacacugguucagcccccuuuacucccaaacucggcucuguccaauuuucgacagacaccgaaaacgacuucgaaacccaccaaaacaccaaauucacaccagucgguguaauccaagacggcggaacuacccaccgaaacgaaccacaacaauggguccuccccuccuacagcggacgcaacguccacaacguccaccucgcccccgcagucgccccuacauucccuggagaacaacuccucuucuuccgaagcacaaugcccggcugcucaggcuaccccaacauggaccucgacugccuccucccccaagaauggguccaacauuucuaucaagaagccgcacccgcccaaucugacgucgcccucaugcgcuucgucaacccagacaccggucgcguccuguucgaauguaaacuacacaaauccggcuacgucacagucgcacacacaggacaacacgaccuagugauuccucccaacggcuacuucagauucgacucaugggucaaccaguuuuacacacucgccccaaugggcaacggaacaggccgccgccgauaa

SEQ ID NO: 38613 - RNA, 1617 nt, Artificial Sequence
  derived and/or modified sequence opt11 from VP1__Norovirus_and/or_Norovirus-like__JX459614
augaaaauggcguccaacgacgcaaaccccuccgacggcuccgccgccaaccuagucccugaagucaacaacgaagucauggcacucgaacccguuguaggcgcagccaucgccgcaccagucgcaggccaacaaaacgucaucgacccauggaucaggaacaacuucguacaagcccccggcggcgaguucaccgucucaccacgcaacgccccuggcgaaauccuuugguccgcaccccucggccccgaccucaaccccuaccucucacaccuagcccgaauguacaacggguacgccggcggauucgaaguacaagucauccuagccggcaacgccuucaccgccggaaaaauuauauucgccgccgucccgcccaacuuccccaccgaaggacuaucacccucccaagucacuauguucccacacaucauaguagacguaagacaacucgaaccaguccucaucccccuccccgacguccgaaacaauuucuaccacuacaaccaaagcaacgacuccaccauaaagcucauagcaauguuauauacgccccuccgagccaacaacgccggagaagaugucuucaccgucuccugccgcguacuuacccgccccucacccgacuucgacuuuaucuuucuagucccaccgaccgucgaaucccgcaccaaacccuucaccgucccaauccucaccgucgaagaaaugaccaacucccgcuuccccaucccccucgaaaaacuuuucaccggccccucuggagccuucgucguccaaccccagaacggacguugcacuaccgacggcguacuccucggcaccacacaacuauccccagucaacaucugcaccuuucgaggcgacguaacacacaucgccggcucccgcaacuacacaaugaaccucgccucacucaacuggaacaacuacgaccccaccgaagaaauccccgcaccgcuagguaccccugacuuugucggaaaaauccaaggcguccuaacccaaaccacuaaaggugacgguuccacccgaggacacaaagccacuguauauaccggcuccgcccccuucacacccaaacucgguuccguacaauucuccaccgacacugaaaaugacuucgaaacccaccaaaauacaaaauucaccccagucggagucauccaagacgguggcacgacccaccgcaacgaaccccaacaauggguacuccccuccuauuccggcagaaauguccacaacguacaccuagcacccgccguugcccccaccuucccuggagaacaacuccuauucuuucgcucaacgaugccgggcugcucgggauaccccaauauggaccuugacugccuucucccacaagaauggguccaacacuucuaccaagaagccgcccccgcccaauacgacgucgcacuccucagauucguaaacccagacaccggacgcguccuguucgaaugcaaacuacacaaaucaggcuacgucaccgucgcccauaccggccagcacgaccucgucaucccacccaacggcuacuuccgcuucgacuccuggguaaaccaauucuacacccucgcucccaugggcaacggcaccggcagacgccguuaa

SEQ ID NO: 38614 - RNA, 1617 nt, Artificial Sequence
  derived and/or modified sequence opt11 from VP1__Norovirus_and/or_Norovirus-like__HM635103
augaaaauggccuccuccgacgcaaaccccucugacggcuccaccgccaaccuagucccagaaguaaacaaugaaguuauggcccucgaaccagucgucggugcagccaucgcagcacccgucgccggccaacaaaacgucauagacccuuggauccgcaacaacuucguccaagcccccggcggagaguucaccgucucaccccgcaacgcacccggcgaaauccucugguccgcuccccucggaccugaccucaaccccuaccucucccaucuugcccguauguacaauggcuacgcaggcgguuucgaaguccaagucauucucgcaggcaacgccuucaccgccggcaaaaucaucuucgccgcaguaccuccuaacuuccccaccgaaggccuaucacccucucaagucacaauguucccccacaucaucgucgacguccgccaacucgaacccguacuaaucccccuccccgacguccgaaacaacuucuaccacuacaaccagucuaacgacccuaccaucaaauuaaucgcaauguuauacacaccccuccgagcaaacaacgccggcgacgacgucuucaccgucuccugccgcguccucacccgccccucccccgauuucgacuuuaucuuccucgucccacccaccgucgaaucacgaaccaaacccuuuucaguccccguauuaaccguugaagaaaugacgaacucuagauucccuauaccccucgaaaaacucuuuacuggccccucauccgccuucgucguccaaccucaaaacggccgcugcaccaccgacggaguccuccuaggaacaacccaacucagcccagucaacaucugcaccuuccgaggcgacguaacccacaucccaggcucccgcaacuacacaaugaaccuagcaucgcaaaacuggaacuccuacgacccaaccgaagaaauacccgcaccccucggaacccccgauuucgucggcaaaauacaagggguacuaacacagacuacccgcaccaacgguucaacccgcggccacaaagccacagucuacacaggcuccgccgacuuuuccccaaaacucggacgcguccaauucgccaccgacaccgacaacgaucucgaaacaaaccaaaacacaaaauucacccccgucggcguaauccaagacggauccacuacaccacgaaacgaaccacaacaauggguccucccauccuacuccggucgcaauauacacaacguccaccuagccccagccguagccccaaccuucccaggcgaacaacuccucuucuuccgcuccacaaugccuggcugcuccggauaccccaacauggaucuggacugccuccucccccaagaauggguccaauacuucuaccaagaagccgcccccgcacaauccgacguagcccuacuucgauucgucaaccccgacacuggccgaguacucuucgaaugcaaguuacauaaauccggcuacguaaccgucgcccacaccggccagcacgaccuaguuaucccacccaacggguacuuccgauucgacuccugggucaaccaauucuacacacucgcccccauggguaacggcaccggccgaagacgcuga

SEQ ID NO: 38615 - RNA, 1617 nt, Artificial Sequence
  derived and/or modified sequence opt11 from VP1__Norovirus_and/or_Norovirus-like__JQ613522
augaaaauggccagcaacgaugccaacccauccgacggaucugcagcaaaccuagucccagaagucagcaaugaaguuauggcccucgaacccgucgucggcgccgccaucgccgcccccgucgccggccaacaaaacguuaucgaucccuggauccgaaauaauuucguacaagcccccgguggcgaguucacaguauccccacguaacgcccccggagaaauccucuggucagcaccccucgguccagaucucaaccccuaccucucucaccuggcccggauguacaacggcuacgccggcggauucgaaguccaagucauauuagccggcaacgccuucacagccggcaaaauaauuuucgccgccgucccacccaacuuccccaccgaaggacucucccccucacaagucaccauguucccccacauaauagucgacguccgccaacuagaacccguacuaaucccauuaccagacguacguaacaacuucuaccacuacaaccaauccaacgacucaacaaucaaacuaaucgccaugcuauacacaccccuucgagcuaacaacgccggugaagauguauucaccguauccugccgaguccuaacccgucccucucccgacuucgacuucauuuucuuaguacccccaacaguugaaucccgcacaaaacccuucacaguccccauccuaaccgucgaagaaaugacuaacucccgcuuccccauaccccucgaaaaacuauucaccggccccuccggcgcauucgucguccaaccccaaaacggccgcugcaccaccgacggcguccuacucgggaccacacaacucuccccagucaacauaugcaccuuccgcggcgacguaacccacauagccggcucccgcgauuauaccaugaaccucgcaagccucaacuggaacaauuacgaccccacagaagaaaucccagccccacucggaacccccgacuucguuggcaaaauacaagguaugcucacccaaaccaccaaaggcgacggauccacccgcggccauaaagcuacagucuacaccggcucugcacccuucacucccaaacucggcucgguacgauucucaaccgacaccgaaaacgacuuugaaacccaccaaaacacuaaauucacccccguuggcgucauccaagacggcuccacaacccaccgcaacgaaccacaacaauggguccuccccucauauucaggacgagacguccacaacguccaccuagcaccagccguagcuccgaccuucccaggagaacaacuucuuuucuuucgcucaaccaugcccggcugcucaggcuaccccaacauggaccucgacuguuuacucccccaagaauggguucaacauuucuaccaagaagccgccccagcacaauccgacguugcacuccuucgcuucguaaaccccgacaccggacgcguccucuucgaauguaaacuucacaagucaggauacgucaccguugcccacaccggccagcacgaccucgucaucccacccaacggcuacuuuagauucgacuccugggucaaccaauucuacacccucgcccccaugggaaacggaaccggccgccgacgcuaa

SEQ ID NO: 38616 - RNA, 1617 nt, Artificial Sequence
  derived and/or modified sequence opt11 from VP1__Norovirus_and/or_Norovirus-like__AB629942
augaaaauggcuucaaacgacgcaaaucccucugacggauccgccgccaaccucguccccgaaguaaacaacgaggucauggcccucgaacccguggucggagccgcgauagcagcacccgucgccggccaacaaaacguaauagaccccuggauccgaaacaacuuuguccaagcccccgguggcgaguucaccguuucaccccgcaacgccccgggcgaaauccucugguccgccccacuaggccccgaccucaaccccuaccucucccaccucgcccgcauguacaacggauaugccggcggcuucgaaguacaagucauacucgcaggcaacgccuuuacagcaggcaaaauaauuuucgccgccgucccaccuaacuuccccaccgaaggccucagccccucccaaguaaccauguucccacauaucauagucgacguccgccaacucgaacccguccugauuccccucccagacgucagaaacaacuucuaccauuacaaccaauccaacgauuccaccauaaaacucaucgccaugcuauauaccccacuccgcgcaaacaacgccggagaagacguguucacaguuuccugcaggguccucacgcgccccucuccagacuucgacuucauauuccucgucccaccuaccguagaaucacgcaccaaacccuucaccgucccaauccucaccgucgaagaaaugaccaacucacgcuucccaaucccccuagaaaaacuauucaccggucccagcagcgccuucguuguacaaccccaaaacggccgaugcacaacagacggcguccuccuaggcacaacccaauuaagccccgucaacauuugcacauuccgcggcgacguuacgcauaucgcaggaucacgcaacuacacuaugaaccuagccucacucaacuggaacaacuacgacccaaccgaagaaauucccgcaccccuaggcacccccgacuucgucggcaaaauccaaggcguacuaacucaaaccacaaaaggcgacggcagcacucgaggccacaaagccacaguauauacaggcuccgcccccuucacucccaaacuaggcucuguccaauucucgaccgacacccaaaacgacuucgaaacacaccaaaacaccaaauucacacccguuggaguaauccaagacggcggcaccacccaccguaaugaaccacaacaauggguccucccaucauacuccggccgaaacgucccaaacguccaccuggccccugccguugcacccaccuuccccggagaacaacucuuauucuuccgcucaaccaugccaggcugcuccggcuaccccaacauggaccucgacugccuccuaccacaagaauggguccaacacuucuaccaagaagcagccccagcacaauccgacgucgcccuccuuagauucguaaacccagacaccggccgcguccuauucgaaugcaaacuacacaaaucucgcuacgucacuguagcacacacaggccaacacgaccucgucauaccucccaacggauacuuccgauucgacuccugggucaaccaauucuacacccuugcccccaugggaaacggcacuggccgccggagauga

SEQ ID NO: 38617 - RNA, 1617 nt, Artificial Sequence
  derived and/or modified sequence opt11 from VP1__Norovirus_and/or_Norovirus-like__GQ856457
augaaaauggcuuccaacgacgcaaaccccuccgacgggccagccgcuaaccucguacccgaagucaacaacgaagucauggcccucgaacccgucguaggcgccgcaaucgccgcaccaguagcaggccagcaaaacguaauugaccccuggauccgcaacaacuucguccaagcaccaggcggugaguucaccguaagcccccgcaacgcucccggcgaaauccucugguccgcaccccucggcccagaccuaaacccuuaccuaucccaccucgcccgaauguacaacggcuacgccggcggcuucgaaguacaagucauacucgccggcaacgccuucaccgccggcaaaauaaucuucgccgccguaccacccaacuuccccacugaaggccuaucccccucacaaguaaccauguucccccacaucauaguagacguccgacaacuagaacccguccucaucccccuccccgacguccgcaacaacuucuaccauuacaaccaauccaaugacucuaccauaaaacucauugccaugcuguacacaccccuucgcgcaaacaacgccggagaagaugucuucaccgucuccugccgaguccuaacacgcccuucccccgacuuugacuucaucuuccucguacccccuaccgucgaaucucgcaccaaaccuuucacaguacccauccucaccgucgaagagaugaccaacucccguuucccaaucccccuagaaaaacuauucacaggccccucuuccgccuucguuguccaaccacaaaacggacgcugcaccacagauggaguccuccuaggcacaacccaacucuccccagucaacaucugcaccuuccgcggagacguaacccacauagcaggcuccuccaacuacaccaugaaucucgcaucccucaacuggaacaacuacgaccccacugaagaaauacccgcaccccucggcacuccagacuucgucggcaaaauccagggaguacucacccaaacaacaaaaggcgacggcuccacccgcggccacaaggccacagucuacaccggcuccgccccguucacaccuaagcucgguuccguacaauucucuacagauacccaaaacgacuucgagacacaccagaauacaaaauucacacccgucggcguaauccaagacggcggcacuacccaccgcaacgaaccccaacaguggguccuccccuccuacuccggcagaaacguccaaaacguucaccuagcccccgccguagccccaaccuuccccggcgagcaacuucuauuuuuccggucaaccaugcccggaugcaguggcuaccccaacauggacuuagacugccuccuaccccaagaauggguacaacacuucuaccaagaggccgccccugcacaaucagacguggcacugcuccgcuucgucaauccugacacaggccgcguccucuucgaaugcaaacuccacaaaucuagauacguaaccguagcccacacuggacaacacgaccuagucaucccuccaaacggauacuuccgcuucgacagcugggucaaccaauucuacacacuugccccaaugggaaacggaaccggccgucgccgauaa

SEQ ID NO: 38618 - RNA, 1617 nt, Artificial Sequence
  derived and/or modified sequence opt11 from VP1__Norovirus_and/or_Norovirus-like__EU876883
augaaaauggccuccuccgacgcaaaccccagcgauggauccaccgccaaccuuguccccgaaguaaacaacgaagucauggcacuagaaccagucgugggcgccgccauagccgcaccugucgcaggccaacaaaacguaaucgaccccuggauacgcaacaacuucguccaagcccccggcggagaguucaccguuucuccccgaaacgcccccggcgaaauacuauggucagcaccccucggccccgaccucaaccccuaucuaucacaccuugccagaauguacaauggcuaugcaggcggauucgaaguccaagucauccuagccggcaaugcauucacagccgggaagauaauauuugccgccguacccccaaauuuccccaccgaaggccuaucgcccucacaagucacaaugucaccccacaucaucgucgacguccgucaacucgaaccaguccuaaucccacuccccgacgucagaaauaacuucuaccacuacaaccaauccaaugacccuaccaucaaacucaucgccaugcucuacacuccccuucgcgcaaacaacgcaggagacgacgucuucaccgucuccugccgaguccuaacccgaccaucccccgacuucgacuucauauuccuagucccacccacagucgaaucacgcaccaaacccuucuccguccccauccuaacaguagaagaaaugaccaauucacgauuucccaucccccuagaacgccucuucaccggaccauccucagccuucguuguccaaccccaaaacggccgcuguaccacugacggaguccuacuuggcaccacccagcuuucacccgucaacaucugcaccuuccgcggcgauguaacccacauagcaggcacacaagaauacaccaugaaccuggcaucccaaaacuggaauaacuacgaccccaccgaagaaauccccgcaccccucggcacaccagacuucgucggcaaaauacaagggguccucacccaaaccacccgucgcgacggcuccacccgaggacacaaggccaccgucucaaccgguuccguacacuucaccccaaaacucggccgcauacaauucucaaccgacaccucgaacgacuucgaaacaggccaaaauacccgauucacacccgucggaguuguccaagacggcggaaccacacaccaaaacgaaccccaacaauggguccuccccaacuacagcggccgcgacggccacaacguccaccuugcccccgccguagcccccuccuuccccggagaacaacuccucuucuuccgauccaccaugcccggcugcuccggcuaccccaacaugaaccucgacugccuacuuccacaagaauggguucaacauuucuaccaagaagccgcccccgcccaauccgacguagcacuacuaagguucgucaacccagacacaggaagaguauuauucgaaugcaaacuucacaaaucugguuacgucaccgucgcacacaccggccaacacgaccucgucaucccacccaacggauacuuccgcuucgacuccuggguaaaccaauucuacacccucgcacccaugggaaacggcaccggcaggcgccgcuaa

SEQ ID NO: 38619 - RNA, 1617 nt, Artificial Sequence
  derived and/or modified sequence opt11 from VP1__Norovirus_and/or_Norovirus-like__AB447455
augaaaauggccuccaacgacgcaaaucccuccgacggcucagcugccaaccucguccccgaagucaacaacgaagucauggcucuugaaccuguagucggcgccgccaucgcugcccccguagccggccaacaaaacgucaucgacccuuggaucagaaacaacuucguccaagcccccggcggugaguucacggucuccccacgcaacgcccccggcgaaauacuaugguccgcaccccucggacccgaucuaaaccccuaccuaagccaccuagccagaauguacaacggcuacgccggaggcuucgaaguccaaguuauucucgccggcaacgcauucaccgcaggcaagaucauauucgccgcaguucccccaaacuucccaacagaaggccucuccccaucacaagucacaauguucccccacauaaucguagacguccgccaacucgaacccguacuaaucccacuacccgacguccgaaacaacuucuaccacuacaaucaaucaaacgacucuaccaucaaacucaucgccaugcucuauaccccacuacgcgcaaacaacgccggcgaagacguauucacaguauccugccgcguacuaacacgccccucccccgacuucgacuucauauuccucgucccaccuaccgucgaaucucgcaccaaacccuucacaguccccauacuaacaguagaagaaaugaccaacucaagauucccaaucccccuugaaaaacuuuucacaggaccaucaggggccuucguuguccaaccccaaaacggacgcugcaccaccgauggcguccuccugggcaccacccaacuuucccccguaaacauaugcaccuuucgcggugacgucacccacaucgccggcacccgaaacuacacaaugaaccuugcaucacucuccuggaacaacuaugacccaacagaagaaaucccagcaccccuaggcacccccgacuucgucggcaaaauccaagguguccucacccaaaccacaaaaggagacggaucaacccgcggacacaaagccaccgucuacacaggcucagcucccuuuacuccgaaacuuggcuccguacaauucuccaccgauacagaaaacgauuucgaaacccaccaaaacaccaaauuuacccccguaggcgucauccaagauggcggcaccacccaccgaaacgaaccucaacaauggguccuacccucuuacagcggccgcaacguccacaacguccaccucgccccagccgucgcccccaccuucccaggcgaacaacuccuauucuuccgauccaccaugccaggaugcuccggauacccaaacauggaccucgacugccuacucccacaagaauggguccaacacuucuaccaagaagccgcccccgcccaauccgacgucgcccuaaugcgcuuuguaaauccagacaccggcagaguccuauucgaaugcaaacuccacaaauccggcuaugucaccgucgcccacaccggacaacacgaccucgugauacccccaaacggcuacuuccgcuucgacucaugggucaaucaauucuacacauuagccccaaugggcaacggcaccggccgacgaagauga

SEQ ID NO: 38620 - RNA, 1617 nt, Artificial Sequence
  derived and/or modified sequence opt11 from VP1__Norovirus_and/or_Norovirus-like__EU078409
augaaaauggccucaaaugacgccaacccuucagacggcuccaccgcuaaccucguccccgaagucaacaacgaagucauggcacuugaacccgucgucggcgccgccauagcagcaccuguagccggccaacaaaacgucauugaccccuggauccgcaacaacuucguacaagcccccggcggugaguuuacaguaucaccccgaaaugcccccggcgaaauacucugguccgcaccccucggcccagaccuaaaccccuaucucucacaccucgcccgaauguacaacggcuacgccggaggcuucgaaguucaaguuauccucgcaggcaacgcauucaccgccggaaaaaucauauucgcugcaguaccacccaacuuccccaccgaaggccucagccccucucaagucacaauguucccccacaucaucgucgacguucgccaacucgaacccguacuaauaccccuccccgacguacgcaauaacuuuuaucacuacaaccaaucgaacgaccccacaauuaaacucaucgcuaugcucuacaccccucugagagcaaacaacgccggagaagacguauucaccgucucaugccgaguccucacccgucccuccccagacuucgacuucaucuuccucguacccccuaccgucgaaucccgaaccaaacccuuuacaguccccauccuaaccgucgaagaaaugaccaacucccgauuccccaucccacucgaaaaacuauucacuggccccuccggcgccuucgugguccaaccccaaaacggccgcugcaccaccgacggcguccuccuaggaaccacccaacuauccccaguaaacaucugcaccuuccgaggcgacguuacccauauagccgguacccacaacuacaccaugaaccuagccucccaaaacuggaacaacuacgaccccaccgaagaaauccccgcaccccuaggcacccccgacuucgucggacgcauccaaggcaugcucacacaaaccacccgaggcgacggcucuacccgcggccacaaagcaacagucuccacaggcgauguccacuucacccccaaacucggcuccauccaauucaacaccgacacaaauaacgacuucgaaaccggucaaaacaccagauucacuccaguaggcgucguccaggacggaaacggaacacaccaaaacgaaccacaacaauggguccuccccucuuacuccggccgcacaggccacaacguccaccucgcuccagccgucgccccaaccuucccuggagaacaacuacucuucuuccgcuccaccaugcccggcuguuccggauaccccaacaugaaccucgacugccuacucccacaggaauggguacaacacuucuaccaagaagccgccccagcgcaauccgacgucgcccuucuccgcuucgucaacccagacacuggccgcguccuauucgaaugcaaacuacacaaaucuggauacguaaccgucgcacacaccggacaacacgaccuagucauaccgcccaacggcuacuucagauucgacucaugggucaaccaauucuacacgcucgcccccaugggaaacggcaccggacgccgccgauaa

SEQ ID NO: 38621 - RNA, 1617 nt, Artificial Sequence
  derived and/or modified sequence opt11 from VP1__Norovirus_and/or_Norovirus-like__AB303928
augaaaauggccuccaacgacgcaaaucccucugauggcucuacagccaaccuaguccccgaagucaacaacgagguaauggcacucgaacccguagucggcgccgccaucgcagcacccguagcuggccaacaaaacgucaucgaccccuggauccgcaacaauuucguccaagcccccggcggcgaauuuaccguauccccaagaaacgccccuggagagauccuauggucagcuccacuaggaccugaccucaaccccuaucucucccaccucgcccgaauguacaacggauaugcaggcggcuucgaaguccaggucauacucgccggaaacgcuuuuaccgcuggcaaaauaaucuucgcugccguacccccaaacuuccccacagaaggacuaagccccucacaagucaccauguucccccacaucaucgucgacguccgccaacucgagcccguacucaucccucucccugacguccgcaacaauuucuaccauuacaaccaaucaaaugaucccacaauaaaacuuauagccaugcucuacacaccccugagagccaauaaugccggcgaagacguauucaccgucuccugccgagugcugacccgccccucccccgacuucgacuucauauuccuagucccacccaccgucgaaucaagaacaaaacccuucaccguccccauccucaccguagaagaaaugaccaacagccgauuuccaaucccccucgaaaaacuauucaccggucccagcggcgccuucgucguacaaccacaaaacggcagaugcaccaccgacggcguccuccuaggaacuacccagcucucccccguuaacaucugcacacuccgaggcgacguaacacacaucgccgggacacacaacuacacaaugaaccucgcuucacaaaacuggaacaacuacgacccuacagaagaaaucccagccccucucggcacaccggacuucguuggacgcauccaaggaguccucacccaaaccaccagaggagacggcuccacacgcggccacaaagccacaguguccaccggagauguacacuucacccccaaacucggguccguccaauucaacacagacaccaacaacgacuucgaaaucggacaaaacacucgcuucacccccgucggcguaguccaagauggaaacggaacacaccaaaacgaaccccaacaauggguacuucccagcuacucuggccgcaccggccacaacguccaccuagcaccagccguagcccccaccuuucccggagaacaacuccuauucuuccgcuccacuaugcccggcugcuccggcuacccaaacaugaaccucgacugccuccugccccaagaguggguacaacacuucuaccaagaggcugccccagcccaaagcgacgucgcucuccuccgcuuugucaacccagacacaggacgaguccuauucgaaugcaaacuccacaaaagcggauauguaacagucgcccacacuggacaacacgaccucguaauacccccuaaugguuacuuccgauucgacucaugggucaaccaauucuauacccucgcccccaugggcaacggaaccggccgccgccgauaa

SEQ ID NO: 38622 - RNA, 1617 nt, Artificial Sequence
  derived and/or modified sequence opt11 from VP1__Norovirus_and/or_Norovirus-like__AY502023
augaaaauggccuccaaugacgccaaccccuccgacggcucuacagcaaaccucguccccgaagucaacaacgaagucauggcgcuagagcccguaguaggcgcagcaaucgcagcuccagucgccggccaacaaaacgucaucgacccuuggauaagaaacaacuucguacaagcccccggaggcgaauuuaccgucagcccccgcaacgcacccggcgaaauccuguggucugcaccccucggaccagaccucaaccccuaccucucccaccucgcccgcauguacaacggcuacgccgguggcuuugaaguccaagucauacucgccggcaacgccuucaccgccggcaagaucaucuucgccgcaguuccacccaacuuccccaccgagggccucucucccucgcaaguaacaauguucccccacaucauagucgacgugcgccaacucgaaccaguccucauaccacuccccgacguccgaaacaacuucuaccacuacaaucagcucaacgaccccaccaucaaacucaucgccaugcucuauacaccccuccgcgcuaacaaugccggagaagacguauucaccgucucaugccgcguccuaacccgcccgagcccagacuuugacuucaucuuccuaguaccaccgacagucgaaucccgcacaaaaccauucaccgucccuaucuuaaccgucgaagagaugacaaacuccagauuccccaucccccuagaaaaacucuucaccggccccucuggcgcauucgucguacaaccccaaaacggacgaugcaccaccgacgguguucuccucggcaccacacaacucucacccgucaacaucugcacauuccgcggcgacgucacccacaucgccggaacccacaacuacaccaugaaccuagcuagccaaaacuggaacaacuacgaccccaccgaagaaauacccgcuccccucggcacccccgacuucguaggccgaauccaaggcaugcugacccaaacuacccgaggugacggaucaacccgaggccacaaagccaccgucaguaccggcgacguccacuucacucccaaacucggaucuauccaauucaacaccgacaccaacaacgacuucgagaccggccaaaacaccaaauucacccccguaggcgucguacaagacggcaacggcacccaccaaaacgaaccccaacaauggguccuccccucauacuccggccgcacaggacacaacguacaccucgcccccgccguagcccccacuuucccaggcgaacagcuccuauucuuucgcuccaccaugccaggaugcuccggcuacccaaacaugaaccucgacugucuccucccacaagaauggguccaacacuucuaccaagaagccgccccagcacaaucagacguagcauuacuacgcuucgucaaccccgacaccggccgcguccucuucgaaugcaaauuacacaaaucagguuacgucacagucgcacacaccggccagcacgaccucgucauucccccuaacggcuacuuccguuucgacucuugggucaaucaauucuacaccuuagcccccaugggcaacggaaccggaagacgccguuaa

SEQ ID NO: 38623 - RNA, 1617 nt, Artificial Sequence
  derived and/or modified sequence opt11 from VP1__Norovirus_and/or_Norovirus-like__KU678202
augaaaauggcaucguccgaugcuaaccccucagacggcucagccgccaaccuaguacccgaagucaacaacgaagucauggcccucgaaccagucgucggcgccgccauugcagcuccagucgccggacaacaaaacgucaucgaccccuggauccguaacaacuuuguacaagcccccgguggcgaguucacaguauccccacgcaacgcccccggcgaaauccuaugguccgcaccccuuggacccgaccucaauccauaccucagccaccucgcacgcauguacaacggcuaugccgguggcuucgaaguccaagucauccucgcugguaacgccuucaccgccggaaaagucaucuucgccgccguacccccuaacuuccccaccgaaggacuaucacccagucaagucaccauguucccacacauugucgucgacguaagacaacucgaaccaguucuaauaccccuccccgacguccgcaauaacuucuaccacuacaaccaauccaacgacccaaccaucaaacucaucgccaugcucuacacaccccugcgcgccaacaaugccggcgacgacgucuucaccgucagcugucgaguccucacccgucccucaccggacuucgacuucaucuuccucgucccacccaccguugaaucacgcaccaaacccuucuccguccccguccucaccguagaagaaaugacuaacucccguuuucccaucccccuagaaaaacuauuuaccggccccuccuccgcauucguaguccaaccccaaaacggucgcugcacuacagacggcguacuccucggcacaacccaacuaagccccguaaacaucugcacauuccgaggcgacguaacacacaucaccggaucccacaacuacacuaugaaccucgccucccagaacuggucaaacuacgaccccacagaagaaauacccgccccucucggaacccccgacuucgucggcaagauccaagguaugcugacacaaacaacccgcaccgacggcucaacacgaggucacaaggccacagucuacaccggcagcgccgacuucgcccccaaacucggcagaguacaauucgaaacugacaccaacaacgacuucgaagcaaaccaaaacacaaaauucaccccagucggcgucauccaagacggcggcacaacacaccgcaacgaaccccaacaauggguccuaccuucauacucaggccgaaacacacccaacguacaccucgcuccagccguugcucccaccuuccccggagaacaacuccucuucuucagaucaaccaugccaggcugcuccggcuacccaaacauggaccucgacugccuccuaccacaagaauggguccaauacuucuaccaagaagccgccccagcccaauccgacguagcccuccuccgguuugucaacccagacaccggccgaguucuauucgaaugcaaacuccacaaauccggcuacgucacugucgcccauaccggccaacacgaccuuguaaucccacccaacggauacuucagauucgacucauggguaaaccaauucuacacccucgcccccaugggaaauggagcaggccgccgccgauaa

SEQ ID NO: 38624 - RNA, 1617 nt, Artificial Sequence
  derived and/or modified sequence opt11 from VP1__Norovirus_and/or_Norovirus-like__KX371607
augaaaauggcgucaucugacgccaacccguccgauggaucggccgccaaccucguccccgaagucaacaacgaagucauggcccucgaacccguaguuggagcagccaucgccgcccccguagcuggccaacagaacguaaucgaccccuggauccggaacaacuucguccaagccccgggcggugaguucaccgucuccccacgcaacgcuccaggcgaaauccucuggucagccccacuuggccccgaccuaaaccccuaccucucccaccucgcacgcauguacaacggauaugcuggcggauucgaaguccaagucauccucgccggaaacgcuuucaccgccggcaagguaaucuucgccgcagucccaccaaacuuccccaccgaaggccucucccccucccagguaaccauguuuccccacauaguaguagacguacgccaacucgaacccguccucaucccccuccccgacguccgcaacaacuucuaccacuacaaccaauccaacgacccaaccauaaaacucaucgccaugcucuauacuccccuccgagcgaacaacgccggcgacgacgucuucaccgucucuugucggguccucaccagaccaucccccgacuucgacuucaucuuccucguuccacccaccgucgaaucccgcacaaaacccuucuccgucccuguacucaccguagaagaaaugacgaacucccgcuucccaauuccacucgaaaaacuauucacaggccccucauccgccuucgucguacaaccacaaaacggacgcugcaccaccgacggcguccuccuuggcacaacccaacuaucacccgucaacaucugcacauucagaggcgacgucacccauauaaccggcucccgaaacuacaccaugaaccuugccucccaaaacugguccaauuacgacccaacugaagaaauccccgcaccccucggcacucccgacuucgucggaaaaauccaaggaguccucacccaaacaacacgcacagacggaucaacccgaggucacaaagccaccguuuacaccggauccgccgacuuugccccaaaacuaggucgaguccaauucgaaacggauaccgaccgcgacuucgaagccaaccaaaacaccaaauucaccccagucggcgucauacaagacggaggcaccacucaccgcaacgaaccccaacaauggguacuccccucauacucaggccgcaauacccccaacguacaccuagcccccgccgucgccccaacauuucccggcgaacaacuccucuucuuccgauccaccaugcccggcugcucaggcuaucccaacauggaccucgauugccuacucccccaagaauggguacaauacuucuaucaagaagccgcacccgcccaauccgacguagcccuacuacgcuucguaaaccccgacaccggcagagucuuauucgaaugcaaacuacacaaauccggcuacgucacagucgcccacacuggccagcacgaccuagucaucccuccuaauggcuacuucagauucgacagcugggucaaccaauucuacacacuugcuccaaugggcaauggcaccggacgaagacgauaa

SEQ ID NO: 38625 - RNA, 1617 nt, Artificial Sequence
  derived and/or modified sequence opt11 from VP1__Norovirus_and/or_Norovirus-like__KX354112
augaagauggcaagcucagacgccaaccccagcgacgguucagccgccaaucucguacccgaagucaacaacgaaguuauggcccuagaacccguaguaggcgccgccaucgccgcacccguagccggacaacaaaacguuaucgaccccuggauccgaaacaacuuuguccaagccccaggcggcgaauuuacagucucaccuagaaacgcacccggagaaauacuauggucagcaccacucggccccgaccugaaccccuaccucucacaccucgcccgcauguacaacgguuacgccggaggauucgaaguacaaguaauccuagcaggcaacgcauucaccgcuggcaaaguaaucuucgccgccgucccgccaaacuuccccacugaaggccucucacccucccaaguaacaauguuuccccacaucgucguugacguccgacaacucgaacccguacucauaccacugcccgacguccgcaacaacuucuaccauuacaaucaaucaaacgaccccaccaucaagcucauagccaugcuauacaccccacucagagcaaacaacgcaggcgacgacguauucaccguaucaugccgcguccucacacgaccauccccagacuucgacuuuaucuuccucgucccacccaccgucgagucgagaacaaaacccuucuccguacccgucuuaaccguugaggaaaugaccaacucacgcuuccccaucccccucgaaaaacucuucaccggccccucauccgccuucgucguccaaccacaaaauggccgaugcacaaccgacggcguccuauuaggcacaacccaacucagcccagucaacauaugcacauuccgcggcgacgucacccacaucaccggaucccgaaacuauacaaugaaucucgccucacaaaauuggaacaacuacgacccaaccgaagaaaucccugcaccccuaggcacccccgauuucgucggcaaaauucaaggaguacucacacaaacuacacgcaccgacggaucaacccguggucacaaagccacagucuacaccggauccgccgacuuugccccaaaacuaggccgaguucaauucgaaaccgacaccgaccacgacuucgaagcuaaucaaaacacaaaauucacacccguaggcgucauccaagacggcuccacaacccaccgcaacgaaccccaacaauggguccuccccucauacagcggccgcaacacccacaacguccaccucgcucccgccguagcaccaaccuuccccggagaacaacuccucuucuuccgauccacuaugcccggcugcuccgguuacccaaacauggaucucgauugucuccucccacaggaauggguccaguacuucuaccaagaggcggcacccgcccaauccgacgucgcccuccuccgcuucgucaacccagacacaggccgcguccucuucgaaugcaaacuccauaaauccggauacguaaccguagcccacaucggccaacacgaccucgucauaccucccaacggauacuuccgcuucgacucuugggugaaccaauucuacacccucgcucccaugggcaacggcacaggacgucgccgcuaa

SEQ ID NO: 38626 - RNA, 1617 nt, Artificial Sequence
  derived and/or modified sequence opt11 from VP1__Norovirus_and/or_Norovirus-like__KX353993
augaaaauggcaagcuccgacgccaaccccucagacggaucuaccgccaaccucguacccgaagucaacaacgaaguuauggcacucgaacccgucgucggcgccgcaaucgcggcacccgucgccggacaacaaaacgucaucgaccccuggauccgcucaaauuuuguccaagcgcccggcggcgaguucaccgucucaccccgcaaugccccaggugaaauccucugguccgcaccacucggaccggaccucaaccccuaccucucacaccucgcccgcauguacaauggcuacgccggcggauucgaaguacaaguaguacucgccggcaaugccuucaccgcaggaaaaauuaucuucgccgccgucccucccaacuuccccaccgaaggccuuucccccucccaagucaccauguucccacacaucaucgucgacguccgccaacucgagcccguccucauaccucucccugacguccguaacaacuucuaccacuacaaccaaagcaacgacccaacaaucaaacuuaucgcaaugcuauacacaccccuccgagcgaacaacgccggcgacgacguauucaccgucuccugccgcguacuuacccgccccucacccgacuucgacuucauuuuccucgucccaccaacaguagaaucacgaaccaaacccuucucaguaccaguacuaacagucgaagaaaugaccaacucccgcuuccccaucccccucgaaaaacucuucaccggcccauccuccgcauuugucguucaaccccaaaauggccgcugcaccacugacggaguccuucucgguaccacccaacucucccccgucaacaucugcaccuuccgcggagacgucacccacauaccaggcucgagaaacuacaccaugaaucucgccucacaaaacuggaacuccuacgacccaacagaagagauacccgcaccgcucggcacucccgacuucgucggcaaaauucaaggaguccucacccaaaccacccgcaccaacggcucaacccgcggccacaaagccacuguauacaccggcagcgcagacuucucgcccaaacucggccgcguccaauucgccacugacaccgacaacgauuucgaaacaaaccaaaacaccaaauucacccccguaggcgucauacaagacggagccacuacaccccgaaacgaaccucaacaguggguccuuccaucauacuccggucgaaacauccacaacguucaccuagcacccgccgucgccccaaccuuucccggcgaacaacuacuauucuuucgcuccaccaugcccggcugcuccggcuacccuaacauggaccuagacugcuuacuuccccaagagugggugcaauacuucuaccaagaagcagcccccgcccaaucugacgucgcacuccuacgcuucgucaaccccgacaccggccgcguccucuucgaaugcaaacuucacaaaucuggcuacgucacagucgcacacacaggccaacacgaucucguaauacccccgaacggguacuuccgauuugacuccuggguuaaccaauucuauacccucgcccccaugggcaacggcacaggacgccgccgcuaa

SEQ ID NO: 38627 - RNA, 1617 nt, Artificial Sequence
  derived and/or modified sequence opt11 from VP1__Norovirus_and/or_Norovirus-like__KR131762
augaaaauggccucuucagacgcaaacccauccgacggcagcgcagcaaaccugguccccgaaguaaacaacgaagugauggcacucgaacccgucgucggcgcagcuaucgccgcccccguagcaggccaacaaaacgucauugaccccuggauaaggaauaacuucguacaagccccugguggagaguucacugucucacccagaaacgcccccggugaaauccuguggucugccccacucgguccagaccucaacccauaccuaucccaccuagcacguauguacaacggauacgccggcgguuucgaaguccaaguaauccuagcaggcaacgccuuuaccgcaggcaaaauaauauucgcggccguaccaccaaacuuccccaccgaaggccuaagccccucccaagugaccauguucccccacaucaucgucgacguccgacaacuagaaccaguccucauaccccuccccgacguaagaaacaacuucuaccacuauaaccaaucaaacgacuccaccaucaaacuaauagccaugcucuacaccccacuacgcgcuaacaaugcuggagaagacgucuucacagucuccugccgcguccucacacgccccagccccgacuucgacuucaucuuccuaguuccacccacagucgaaucccgcaccaaacccuucaccguccccauccucacugucgaagagaugaccaacucccgauuucccauuccacucgaaaaacucuucaccggacccucaggagcauucguaguccagccacaaaacgggcgaugcaccaccgacggaguauuacucggcacuacacaacuuucacccgucaacaucugcacauuccgcggcgacgucacccacaucgccggcuccagaaacuacacuaugaaccuagccagccucaauuggaacaacuaugacccuaccgaggaaauccccgcaccccucggcaccccagacuucguaggcaaaauccaaggaaugcucacucaaacuaccaaaggcgacggcuccacaagaggacauaaagccacagucuacaccggaucagcuccauucacccccaagcucggcuccguacaauucucaaccgacacugaaaacgacuucgaaacacaccaaaacacaaaguucacacccgucggaguaauccaagacggaucgacuacacaccgcaacgagccccaacaauggguccuccccagcuacagcggcagagauguccacaacguccaccucgcaccagcagucgcacccacuuuccccggcgaacaacuacucuucuuccgaucaacaaugcccggcugcuccggcuaccccaacauggaccuugacugccuacucccacaagaauggguucaacacuucuaccaagaagccgcccccgcccaauccgacgucgcccuccucagauucgucaacccagacacaggccgcguacuauucgaaugcaaacuccacaaauccggauaugucaccgucgcacacaccggccagcacgaccucgucaucccacccaacggauacuuccgcuucgacuccugggucaaccaauuuuacacccuggcccccaugggcaacggcaccggccgccgacgcuaa

SEQ ID NO: 38628 - RNA, 1617 nt, Artificial Sequence
  derived and/or modified sequence opt11 from VP1__Norovirus_and/or_Norovirus-like__AB972519
augaaaauggcauccucagacgccaacccaagcgacggcuccgccgcuaaccucguacccgaagucaacaacgaagucauggcccuggaaccagucgucggcgccgccaucgcugcacccgucgcaggccagcaaaacgucauagaccccuggauccgcaacaacuucguccaagcccccggaggugaguucacagucagcccacgcaacgccccaggagaaauccuauggucagcaccccucggcccagaccuaaaucccuaccucucacaccuagcccgcauguacaacggauacgcaggcggcuucgaaguccaaguuauccucgccgguaacgccuucacagccggcaaagucaucuucgccgcaguucccccuaacuucccaaccgaaggacugagcccaucacaagucaccauguucccacacaucgucgucgacguccgccaacucgaacccguccuuaucccucuacccgacguccgcaacaauuuuuaccacuacaaccaaagcaacgacccaaccaucaaacuaaucgcaaugcuuuacaccccacuccgcgcaaacaacgccggcgacgacguauucaccgucagcugccgcguccuaacacgccccucgcccgacuucgacuucaucuuccuagucccacccacaguagaauccagaaccaaacccuucucuguccccguccuuacugucgaagaaaugaccaacucccgcuuccccauaccccucgagaaacucuucaccggcccaagcuccgccuucgugguccaaccccaaaacggccgcuguaccacagauggcguacuacucggaacaacccaacucucucccgucaacaucugcacauuccgcggcgacguaacacacauaaccggaucccgcaacuacacaaugaaccucgcaucacaaaacuggaacaacuacgauccaaccgaagaaauaccagccccacucggcacccccgacuuuguaggaaaaauccaaggcguccuaacacaaacaacacguacugacggauccacccgcggacacaaggccacagucuacacaggcucggcugacuucgcccccaaauuaggccgaguccaauucgaaacagacaccgaucacgauuucgaggccaaccaaaacaccaaauucacacccgucggcguaauacaagacggaggcacaacccaccgcaaugaaccacaacaauggguacuuccauccuacuccggucguaacaccccgaacguccaucucgcgccggcgguagcccccacuuuccccggagaacaacuacucuucuucagaucaaccaugccaggaugcuccggauacccuaacauggaccuggacugucuucucccacaagaguggguccaauacuuuuaccaagaagccgcccccgcacaauccgacgucgcccuccuacgcuucgucaaccccgacaccggccgaguacuauucgagugcaaacuccacaaauccggcuacgucacagucgcgcacacaggccaacaugaccucguaauacccccuaacggcuacuuccgauucgacucaugggucaaccaauucuacacacuagcacccaugggcaacggcacaggacgucgccguuag

SEQ ID NO: 38629 - RNA, 1617 nt, Artificial Sequence
  derived and/or modified sequence opt11 from VP1__Norovirus_and/or_Norovirus-like__AB972498
augaaaauggccagcuccgacgccaaucccuccgacggcucugccgccaaccucgucccggaagucaacaacgaagucauggcgcucgaacccguagucggcgccgcaaucgcagccccaguagccggccaacaaaacgucaucgacccuuggauccgcaacaacuucguucaagcccccggcggcgaguucaccgucuccccucgcaaugcccccggcgaaauccuauggucggcaccacucggucccgaccuaaacccauaccucucccaccucgcacgcauguacaacggauacgccggcggcuucgaaguccaagucauccucgcagguaacgcauucaccgccggcaaagucauauucgcagccgucccaccuaacuuccccaccgaaggacucucaccaucacaaguaacuauguucccccacaucguagucgacguccgccaauuagaaccaguacuaaucccacuaccagauguacgaaacaacuucuaccacuacaaccaguccaaugauccaaccauaaaacuuaucgccaugcucuacacaccacuccgcgcaaacaacgccggcgacgaugucuucacuguaucaugccgaguacucacccgacccucccccgauuucgacuucaucuuccucgucccucccaccguagaaucccgaacgaaaccauucucagucccaguacucaccgucgaagaaaugaccaacucccgcuuccccaucccacucgaaaaacucuucacggguccuucauccgcauuugucguccaaccccaaaacggacgcugcacuaccgacgggguacuacucgggacaacccaacuaucaccagucaacaucuguaccuuccgcggcgacgucacccacaucacuggcucccgaaacuacacaaugaaucucgccucacaaaacuggucaaacuacgaccccaccgaagaaauccccgccccacucgggacucccgauuucguaggcaaaauccaaggcguccucacacagaccacccgcaccgacggaagcacucgcggccacaaagccaccguauauaccggcucagccgacuucgccccgaaacuuggccgaguccaauucgaaaccgacaccgaccacgacuucgaagccaaccaaaauaccaaguucacccccgucggcguaauacaggacggcggcacaacccaccguaacgaaccacaacaguggguucuuccauccuacucaggccguaacacccccaacguacaccuagcccccgcaguagcccccaccuuccccggcgaacaacuccucuucuuccgcucaaccaugccaggcuguuccggcuacccaaacauggagcuugacugccugcuaccccaagaauggguacaauacuucuaccaagaagccgcacccgcccaauccgacgucgcccuuuuacgcuucgucaauccagacacaggccggguccuguucgagugcaaacuccacaaauccggcuacgucacugucgcccacaccggccaacacgaccuaguaauacccccaaacggcuacuucagauucgacucaugggucaaccaauucuacaccuuagccccuaugggcaacgguaccggccgcagaagauaa

SEQ ID NO: 38630 - RNA, 1617 nt, Artificial Sequence
  derived and/or modified sequence opt11 from VP1__Norovirus_and/or_Norovirus-like__AB972488
augaaaauggccuccuccgaugcaaaccccuccgacggcucggccgcuaaccucguccccgaagucaacaacgaagugauggcccucgaaccugucgucggcgcggcaaucgcagcccccgucgccggccaacaaaacgucaucgacccauggauccggaacaacuucguccaggcaccaggcggcgaguucaccgucucuccccgcaacgccccaggagagauccucugguccgcaccgcuagguccagaccuaaaccccuaccucucccaccuagcacggauguacaacggauacgcaggcggcuucgaaguccaggucauucucgccggaaacgccuucacagcuggcaaagucaucuucgccgccgucccacccaacuuccccacagaaggacucucccccucccaagucacaauguucccccacaucgucgucgacguaagacaacucgaacccguccucaucccacuaccagacguccgcaacaacuucuaccauuacaaccaaagcaacgacccuacaaucaaacucauagccaugcuauacacuccccuccgggcaaacaaugcuggcgacgacgucuucacaguaucuugccgaguacucacccgaccauccccagacuucgacuucauauuccuggucccacccaccgucgaaucccgaaccaagcccuucucuguccccguccuuaccgucgaagaaaugaccaacucacgcuuccccaucccccuagaaaaacucuucaccggacccuccucagccuucgucguacaaccucaaaacggacguugcaccaccgacggaguauuacucggaaccacgcaacucucaccaguaaauauaugcaccuuccgaggcgacguaacacacaucacaggcucaagaaacuacacuaugaaccucgcaucccaaaacugguccaacuacgaccccacagaagaaauccccgcgccucuaggcacccccgauuucgucggcaaaauccaaggaguacugacccaaaccacccgcacugacgggucgacccgcggacacaaagccacgguauacacagguuccgcagacuucguaccaaaacucggccgcguccaauucgaaaccgauaccgaucacgacuucgaagcaaaccaaaacaccaaauucacgcccguaggcgucauacaagacggauccaccacccacagaaacgaaccacaacaauggguccuacccagcuacuccggccgcaacacgcccaacguacacuuagccccagcgguagcccccaccuuccccggagaacaacuccucuucuuucgcucuaccaugcccggaugcuccggcuacccuaacauggaccuagacugccuccucccucaagaauggguccaauacuucuaccaagaagcagcccccgcacaaucagacguagcccuccuccguuucgucaaccccgacacaggacgcguacucuucgaaugcaaacuacacaaauccggauacgucacugucgcccauacuggccaacacgaccuuguaauucccccaaacggcuacuuucgauuugacuccuggguaaaccaauucuacacccucgcacccaugggaaacggcaccggcagaagacgauaa

SEQ ID NO: 38631 - RNA, 1617 nt, Artificial Sequence
  derived and/or modified sequence opt11 from VP1__Norovirus_and/or_Norovirus-like__AB972483
augaaaauggccuccuccgacgcaaaccccagcgacggcagcgcagccaaccucguacccgaaguuaacaacgaggucauggcccucgaaccagucgucggagcagccaucgcggccccagucgccggacaacaaaacgucaucgaccccuggauucgcaacaacuucguccaagcccccggaggagaguucaccgucucaccccgcaacgccccaggcgaaauccucugguccgccccucucggccccgaucucaacccguaccucucucaccucgccagaauguacaauggauacgccggaggcuucgaaguccaagucauccucgccggcaacgccuucaccgccggcaaagucaucuucgcagcaguaccaccuaacuucccaacugaaggccuuuccccaucccaagucaccauguucccccacauugucgucgacguacgccaacucgaacccguacuaauuccucuccccgacguacgaaacaauuucuaccacuacaaucaauccaacgaccccaccaucaaacucaucgccaugcuauacacaccccuccgcgccaacaacgccggcgacgacguauucacaguuuccugucgcguacucacccgacccucccccgacuuugacuucaucuuccuugucccucccacugucgaaucucgaaccaagcccuucuccguucccguccucacaguagaagaaaugaccaacucccgauuccccauaccccucgaaaaacuauucacaggacccuccuccgccuucgucguacaaccccaaaacggaagaugcaccacagacggaguacuacucggaacaacccaacucucccccgucaacauaugcaccuuccgcggcgacgucacccacaucaccggcuccagaaacuacacuaugaaccuagccagucaaaacuggaacaacuacgacccaaccgaagaaaucccagcaccccuaggcacacccgacuucgugggcaaaauccaaggaguccucacccaaacaacacguaccgacggcucaacccguggccacaaagccacaguauacaccggcuccgccgacuucgccccaaaacucggcagaguccaauucgaaaccgacaccgaccacgacuucgaaaccaaccaaaacaccaaauucacccccgucggcgucauccaagacggcggcaccacgcaccgaaacgaaccccaacaauggguacuccccuccuauuccggacguaacacacccaacguccaccucgcccccgccguugcacccaccuucccaggcgaacaacuucuauucuuccgcagcaccaugcccggaugcuccgguuaccccaauauggaccucgacugccuacucccccaagaauggguccaauacuucuaccaagaagccgcccccgcccaaucagacgucgccuuacuccgcuucguuaacccagacaccggacgcguacuauucgaaugcaaguuacacaaauccggauacguaacaguagcccacaccggccaacaugaccucguaaucccucccaacggcuacuuccgauuugacucaugggucaaccaauucuacacccucgcccccaugggcaacggaaccggacgccgucgauga

SEQ ID NO: 38632 - RNA, 1617 nt, Artificial Sequence
  derived and/or modified sequence opt11 from VP1__Norovirus_and/or_Norovirus-like__KP864106
augaagauggcauccucagacgcaaaccccucagacggcucagcagcaaaccuaguacccgaggucaacaacgaagucauggcacuugaacccguagucggagccgccaucgccgcccccguagccggccaacaaaacgugauagaccccuggaucagaaacaacuucguccaagccccagguggcgaauuuacugucucuccccguaacgcccccggcgaaauccuauggagcgcaccccucggacccgaccucaaucccuaccuuucacaucucgcaagaauguacaacggcuacgccggaggcuucgaaguucaagucauacuagcaggaaacgcauucaccgccggaaaagucauauucgccgcaguaccacccaacuuccccaccgaaggccucucccccucgcaaguaaccauguuuccccacauaguuguagacguuagacaacucgaacccguccucauaccacuccccgacguaagaaacaacuucuaccacuacaaccaauccaaugaccccacgaucaaacucauugcaaugcucuacacaccacuccgcgccaacaacgccggcgacgacguauucaccguuagcugccgcguacuaacccgccccucaccugacuucgacuucaucuuccucguaccucccacugucgaaucccgcacaaaacccuucuccguccccguccugacuguagaagaaaugacaaacagccgcuucccaaucccacuagagaaacucuucaccggccccucguccgcuuucgucguccaaccccaaaacggccgaugcaccaccgacggcguucuccuaggaacaacccaacucucacccgucaacaucugcacauuccgaggagacguaacucacaucaccggaucccacaacuacaccaugaaucuagccucacaaaacuggucaaacuacgaccccacagaggaaauccccgcaccccucggcacccccgacuucgucggcaaaauacagggcguccugacacaaaccacacgaaccgacggauccacccgcggccacaaagccaccgucuacacuggcuccgcugacuucgcaccaaaacucggucgaguccaauucgaaacagacaccgaccacgacuucgaagccaaccaaaacaccaaauucaccccaguaggcguaauccaagacggaggcaccacccaccgcaacgaaccacaacaauggguacuccccucauacucuggccguaauacccccaacguccaccuagcaccagccgucgcaccaaccuuuccuggcgaacaacuccucuucuuccgauccacaaugcccggcugcuccggcuacccaaacauggaccucgacugccucuuaccccaagaauggguccaauacuucuaccaagaagccgcccccgcucaauccgacgucgcccuccucagauucguaaacccagacaccggacgaguccuauucgaauguaaacuucacaaaagcggauacgucacaguagcccacacuggacagcaugaccucgucauaccacccaacggcuacuuccgauucgacucuugggucaaccaauucuacacccucgccccaaugggcaacggcaccggccgcaggcgauga

SEQ ID NO: 38633 - RNA, 1617 nt, Artificial Sequence
  derived and/or modified sequence opt11 from VP1__Norovirus_and/or_Norovirus-like__KR904216
augaaaauggccucaucagacgccaaccccucugacggcucaaccgccaaccucgcacccgaaguaaacaacgaaguaauggccuuagaaccuguugucggcgcggccaucgccgcccccgucgccggccagaaaaacgucaucgacccauggauucgaaacaauuucguccaagcuccuggcggcgaauuuaccguaucaccccgcaacgcaccuggagaaauccucugguccgcaccccucggacccgaccuaaaccccuaccucucccaccucgcccgcauguacaacggauacgccggcggcuucgaaguacaagucauccucgccggcaacgccuucaccgccggcaaaaucauauucgccgcagucccacccaacuuccccaccgaaggccugagccccucacaagucacuauguucccccacaucaucgucgacguacgacaauuagaaccuguacucauuccccucccagacguccgaaacaacuucuaccacuacaaccaauccaacgauccaaccauaaagcuaaucgcaaugcucuacacaccccuccgagccaacaacgccggcgacgacgucuucaccgucuccugccgaguccucacucgccccucacccgacuucgauuucauauuccucgugcccccaacagucgaaucccgaaccaagcccuucagcgcccccguccucacaguagaggaaaugaccaacucccguuuccccaucccccuggaaaaacuuuucacaggacccaguucagccuucgucguccaaccccaaaacggccgcuguaccacagacggcguccuucucgguacaacacaacuaucccccgucaacauaugcacauuccgcggcgacgucacccacaucucaggaucccguaacuacacaaugaaccucgccucacaaaacuggaacucuuacgauccaaccgaagagaucccagcuccccuuggcacccccgauuucgucggcaaaauccaaggagugcuuacucaaaccacccgcaccaauggcucaacacgcggacacaaagcuacugucuauaccggcuccgccgacuucucccccaaacuaggccgcguccaauucgccaccgacacagacaacgacuucgagacaaaccaaaacaccaaauucaccccuguaggcguaauacaagacggcuccacuacaccucgcaacgagccccaacaauggguacuacccuccuacuccggccgcaauacccacaacguccaccucgcccccgccguggcccccacauuccccggagagcaacuacuauuuuuccgcagcaccaugcccggcugcuccggcuacccuaacauggaccucgacugccuacucccccaagaauggguccaauacuucuaccaagaggccgccccagcccaauccgacgucgcacuccuucgcuucgucaauccugacacaggcagaguccucuucgagugcaaacuacacaaauccggauaugucaccguagcccacaccggccaaagagaccuugucaucccacccaacggauacuuccgauucgacucguggguaaaccaauucuacucccucgcacccaugggcaauggcaccggccgccgccgcuaa

SEQ ID NO: 38634 - RNA, 1617 nt, Artificial Sequence
  derived and/or modified sequence opt11 from VP1__Norovirus_and/or_Norovirus-like__AB933771
augaaaauggccuccuccgacgccaaccccucggacggauccaccgccaaucuaguaccagaaguaaacaacgaagucauggcccucgaaccugucguaggagccgccaucgcggcacccguagccggacaacaaaacguuauugacccguggauacgaaacaacuucguccaggccccaggaggagaguucacagucucaccccgcaaugcccccggcgaaauccucugguccgcuccccucggcccagaccucaaccccuaccucucucaccucgcccgcauguacaacggcuacgccggcgguuucgaaguccaagucauccucgccggaaacgcauucaccgccggcaagaucauauucgccgccguaccucccaacuuccccaccgaaggacuuucccccucacaagucaccauguucccacacaucauaguggacguccgccaacuagaacccgugcucauaccacuuccagacguccgaaacaacuuuuaccauuacaaccaguccaacgaccccaccauuaaacucaucgcaaugcucuacacaccacuccgcgccaacaacgccggagacgacguauucaccguuuccugucgcguccucacacgccccagccccgacuucgacuucaucuuccucguucccccaaccgucgaaucccgcaccaaaccauuuuccguuccaguccucaccgucgaagaaaugacaaacucccgcuuccccaucccccuggaaaaacucuucaccgggcccagcuccgcauucgucguacaaccucaaaacggacgaugcacaacagacggcguacuacucggaaccacacaacucucccccgucaacauauguaccuuccgcggcgaugucacccauauaaccggcagccgcaacuacaccaugaaccucgccucacagaacuggaacuccuacgacccaaccgaagaaaucccagccccucuuggcaccccggacuucgucgggaaaauccaagguguacucacccagaccacccgaaccaacggaucaacccgcggccacaaagcaaccguauacaccggcucagcagacuucucccccaaacucggcagaguccaauucgccacagacaccgacaacgacuucgaagcaaaccagaacaccaaauucacacccguaggcguuauccaagacggcuccacuaccccacgcaacgaaccccaacaguggguucuccccucauacucaggacguaacauccacaacgugcaucuagccccagccgucgcccccacauuccccggcgaacaacuacucuucuuccgcucaaccaugcccggaugcuccggcuaccccaacauggaccucgacugucuccucccccaagaauggguacaauacuucuaccaagaagcagcacccgcccaauccgacgucgcccuacuccgauucgugaacccagacaccggccgaguccucuucgaaugcaaacuccacaaaucaggauacgucaccgucgcccacaccggccaacacgaccucguuaucccacccaacggcuauuucagauucgacagcugggucaaccaauucuacacccucgcgccuaugggcaacggcaccggccggcgccgcuag

SEQ ID NO: 38635 - RNA, 1617 nt, Artificial Sequence
  derived and/or modified sequence opt11 from VP1__Norovirus_and/or_Norovirus-like__LC005732
augaagauggcauccuccgacgccaaccccuccgacggcuccgcagccaaccuagucccagaaguaaacaacgaagucauggcacuggaacccgucgucggugcagcaaucgccgccccagucgccggccaacagaaugucaucgacccuuggauacgaaacaacuucguacaagccccagguggagaguucaccgucagcccccgaaacgcuccgggagaaauccucugguccgcaccccucggccccgacuuaaacccauaccuaucccaccucgcccgcauguauaacggauacgcaggagguuucgaaguacaaguaauccucgcaggcaacgcauucaccgcuggaaaagucaucuucgccgccguuccuccuaacuuccccaccgaaggccucuccccaucccaaguaaccauguucccacacaucguagucgauguccgccaauuagaacccguccucauuccccuuccagacguccgcaacaacuucuaccacuacaaccaauccaacgacccaacuaucaaacuuauagccaugcucuacaccccacucagagcuaacaacgccggcgacgacguauucaccgucucaugccgcguccucacccgcccaucacccgacuucgacuucauuuuccuagucccacccaccguagaaucacguacgaaacccuuuucaguucccguccuuacagucgaagaaaugacaaacagccgauuccccaucccacucgagaaacuauucaccggccccuccagcgcauucguaguacaaccacaaaauggccgcugcaccaccgacgguguacuacucggaaccacccaacuaucccccgucaacauaugcacuuuccgcggcgacgucacccacauaaccggcucuagaaacuacaccaugaaccuagcaucacaaaacuggaacaacuacgacccgacagaagaaaucccggcuccacucggcacucccgacuucguaggaaaaauacaaggcguccucacacaaacuacccgaacagacggauccacccgaggacacaaagcaaccgucuacaccgguucagccgacuucgcacccaaacucggccguguccaauucgaaaccgacacggaccgcgacuucgaggccaaccaaaacaccaaauucacccccguaggagucauacaagacggaggaacaacccaccgcaacgaaccacaacaauggguccucccauccuacucaggacgaaacacccccaacguacaccucgccccugccgucgccccaaccuucccaggcgaacagcucuuauucuuccgcuccaccaugcccggcugcuccggcuacccaaacauggaccucgacugucuccucccacaagaauggguccaauacuucuaccaagaagccgcuccugcccaaucagacguugcacuucuacgcuucgugaacccagacaccggacgcguccucuucgaaugcaaacuccacaaaucuggcuaugcuacagucgcccacacaggccaacacgaccuagucaucccacccaacggauacuuccgcuucgauucauggguaaaccaauucuacacccuagcccccaugggcaacggcaccggcagacgccgcuaa

SEQ ID NO: 38636 - RNA, 1617 nt, Artificial Sequence
  derived and/or modified sequence opt11 from VP1__Norovirus_and/or_Norovirus-like__KP293591
augaaaauggccuccuccgacgcaaaccccucagauggcuccgcagcuaaccucguacccgaagucaacaacgaagucauggcacuagaaccagucgucggcgccgccaucgcagcccccguugccggccaacaaaacgucaucgaccccuggauccgcaacaacuucguccaagcccccggaggcgaguucacagucucuccccgcaacgcacccggcgaaauacucugguccgcaccccucggcccagaccucaaccccuaccucucccaccucgcccgaauguacaacggcuacgccggaggcuucgaaguccaagucauacucgccggaaacgcauucaccgccggcaaaguaauauucgcugccguaccacccaacuuccccaccgaaggucuaucccccucccaagucaccauguucccacacaucgucgucgacgucagacaacucgaacccguacucauaccccuuccagacguacgcaauaacuuuuaccacuacaaccaauccaaugauccuaccaucaaacucauagcuaugcucuacaccccacuacgcgcuaacaaugccggcgacgacgucuucacugucuccugccgaguccucacccgacccucucccgacuucgacuucauauuccuggucccacccaccguagaaucccgcacaaaacccuucucaguccccguacucacaguagaagaaaugaccaacucacgauuccccaucccccucgagaaacuuuucacaggccccucgagugcauucgucguccaaccccaaaauggccgcugcaccaccgacgggguucuccuaggaaccacccaacucucccccgucaacauuugcaccuuccgcggagacgucacccacauaaccggcuccagaaacuacaccaugaaccuagccucccaaaacuggaacaacuacgaccccacagaagaaauccccgcaccccuaggaacaccagacuucgucggcaaaauacaaggcaugcuaacccaaaccacaagagcagacggcucuacacgcggccauaaagccaccgucuacacuggcucagccaacuucgcccccaaacuaggccgcguacaauucgaaacagacaccgaccacgacuucgaagccaaccaaaacaccaaauucacacccgucggagucauccaagacggcagcaccacccaccgaaacgaaccccaacaauggguacucccuucauauucaggccgcaacaccccaaacguccaccuugcaccagccgucgcacccaccuuccccggggaacaacuccucuucuuccgcuccacuaugccaggcugcuccggcuauccaaacauggaccucgacugccuacuaccccaagaauggguccaauacuucuaccaagaagccgccccagcccaaucugacgucgcccuacuccgcuucgucaaccccgacaccggccgcguucuguucgagugcaaacuacacaaaucaggauacgucaccguggcucacaccggccaacaugaccucguaauuccacccaacggcuacuuccgcuucgacucaugggucaaccaauucuacacccucgcccccaugggcaacggaaccggacgccgacguuaa

SEQ ID NO: 38637 - RNA, 1617 nt, Artificial Sequence
  derived and/or modified sequence opt11 from VP1__Norovirus_and/or_Norovirus-like__KP176396
augaaaauggccuccuccgacgccaaccccuccgacggcuccgcagcaaaccucguccccgaaguuaacaacgaagucauggcccuagaacccguagucggcgcagcaauagcagcaccugucgccggacaacaaaacgucauagauccauggauccgaaacaacuucguucaggcccccggcggcgaauuuaccgucucaccccgaaacgcacccggagaaauacuuugguccgcaccccucggcccagaccucaacccguaucuaucccaccucgcacgcauguacaacggcuaugccggcgguuucgaaguacaagucauccucgcuggaaacgcuuucaccgcagguaaaguaaucuucgccgccgucccacccaacuuccccacagaaggacuaucacccucccaagucacaauguucccacacaucguaguagacguccgccagcucgaacccguacucaucccacuccccgacguacgcaacaacuucuaccacuacaaccaaucgaacgacccaaccaucaaacuaaucgccaugcuauacacaccccuacgagccaacaacgccggagacgaugucuucaccgucucaugccgaguccuaacccgcccgucacccgacuucgacuucaucuuucuuguacccccaaccauagaaucccgcaccaaaccauucuccgucccaguccucaccgucgaagaaaugaccaacuccagguuccccaucccacuagaaaaacuauucacaggccccucuuccgcauucgucguacaaccacaaaacggccgcugcacaaccgacggcguccuccucggaacuacccagcuaucccccguaaauauaugcacauuccgcggcgacgucacacacaucaccggcucgcgcaacuauacaaugaaccucgccucccaaaacuggaacaacuacgacccaaccgaagaaauaccagcaccccuaggcacacccgacuucgucggcaagauccaaggcguccucacacaaacaacacgcaccgacggauccacaagaggccauaaagccaccgucuacaccggaagcgcugacuuuucccccaaacuaggccgaguucaauucgaaaccgacaccgaccacgacuucgaagccaaccaaaacacgaaauucacacccgucggcguaauccaggacgguggcaccacccacagaaacgaaccccaacaauggguccuacccuccuacucaggccgaaacaccccaaacguacaccucgccccugcugucgcaccaaccuucccgggcgaacaacuccucuucuuccgcuccacaaugcccggcuguagcggcuaccccaacauggaccucgacugccuccuaccccaagaauggguucaauacuuuuaccaagaagccgcacccgcccaauccgacgucgcucuccuacguuucguaaaccccgauacaggucgcguacucuucgaaugcaaacuacauaaaucuggauacgucaccguugcccacacaggacaacacgaccuagucaucccacccaacggauacuuccgauucgauuccuggguaaaccaauucuauacacuagcacccaugggaaacggaacaggacgucgccgcuaa

SEQ ID NO: 38638 - RNA, 1617 nt, Artificial Sequence
  derived and/or modified sequence opt11 from VP1__Norovirus_and/or_Norovirus-like__KP176394
augaaaauggccuccuccgacgccaaccccuccgacggcuccgccgcaaaccuuguccccgagguaaacaacgaagucauggcccucgaaccugucguaggcgcagcaauugccgcucccgucgccggccaacaaaacguaauagaccccuggauccgaaacaacuucguccaggcccccggcggcgaguucaccgucucaccccgaaacgcccccggagaaauucucugguccgcaccccucgguccagaccucaaccccuaccuaucacaucucgcccguauguacaacggcuacgcaggcggcuucgaaguucaaguaauccucgcaggaaacgccuucaccgccgguaaagucauauucgccgcaguucccccaaacuucccaaccgaaggucucucccccucccaagucaccauguucccccacaucgucguugacguaagacaacuugaacccguccuuaucccccuccccgacgucaggaacaacuucuaccacuacaaccaaucuaacgaucccaccaucaaacucauagcaaugcucuacacaccacuacgagccaauaacgcaggagacgacgucuucacugucuccugucgaguucucacccgacccuccccagacuucgacuucaucuuccucgucccucccaccgucgaaagccgcaccaaaccauucuccguccccguccucacugucgaagaaaugaccaacuccagauuccccaucccccuagaaaaacucuucaccggacccagcucugccuucguaguccagccacaaaacggccgcugcaccaccgacggaguccuucuaggcacaacacaacuauccccugucaacaucugcaccuucagaggagacgucacccacaucacaggcucucauaacuacacgaugaaccuagccucccaaaacuggagcaacuacgaccccgccgaagaaauccccgcaccccuaggcacacccgacuucgucggcaaaauacaaggcguccucacccagaccacccgcacagacgguuccacacgcggccacaaggccacagucuacaccggcucugccgacuuugcccccaaacucggacgcguccaauucgaaacagacaccgaucgggacuucgaagccaaccaaaacaccaaauucacacccgucggcgucauccaagacggaggcaccacacaccgaaacgaaccucaacaauggguccuucccucuuauucaggccguaacaccccaaacguacaccuugcccccgccguagcccccaccuuccccggcgaacaacuccuauucuuccgauccaccaugcccggcugcuccggcuaccccaacauggaucuagacugucuucucccacaagaauggguacaauacuucuaccaagaggccgcccccgcccaaucagacgucgcacuacuccgcuucgugaaccccgacacuggccgcguauuauucgaaugcaaacuccacaaaucaggcuacguaaccgucgcccacaccggucaacacgaccucguaauacccccaaacggauacuuccgauucgacuccugggucaaccaguucuacacacucgcacccaugggaaacgguaccggacgccgacgcuaa

SEQ ID NO: 38639 - RNA, 1617 nt, Artificial Sequence
  derived and/or modified sequence opt11 from VP1__Norovirus_and/or_Norovirus-like__KP096348
augaaaauggcguccucagacgccaacccuuccgauggcuccgccgcaaaucucguccccgaaguaaacaacgaagucauggcccuugaaccaguagucggagccgccaucgccgcacccguggcagggcaacaaaacguaaucgacccauggauccgcaacaacuucguucaggcuccaggcggcgaguucacgguuuccccuagaaacgcccccggcgaaauacucuggucagcuccccucggccccgaccucaacccauaccuuucacaccucgcccgcauguacaacggguacgccggcggauucgaaguccaaguaauucucgccggcaacgcauucacagccggaaaaguaaucuucgccgccgucccacccaacuucccuacggaaggucucuccccaucccaagucaccauguucccccacaucguagucgacguccgccaacuagaacccguucuaaucccccuccccgacguccgaaacaacuucuaccacuacaaccaauccaacgaccccacaauuaaacuuaucgccaugcucuacacaccccucagagcuaacaacgccggcgaugacgucuucacaguuucaugccgaguccucacccgaccaucacccgacuucgacuucaucuuucucgucccacccacaguagaaucccgcaccaaacccuucagcguacccguacucacaguagaggaaaugaccaacucaagauucccaaucccacucgaaaaacucuucacaggccccuccuccgccuucgucguccaaccccaaaacggcagaugcaccaccgauggcguacugcucggcacaacccaauuaagccccgucaacauaugcaccuuccgcggagaugucacccacaucacaggcucccacaacuacaccaugaacuuagcaucacagaacuggucaaacuacgacccgaccgaagaaauccccgcaccccucggcacacccgauuucgucggcaaaauccaaggcguccuuacccaaacuaccagaacugacggcagcacacgaggacacaaagccaccgucuauaccggcucagccgacuucgccccgaaacuaggccgcguccaauucgaaaccgacaccaaccacgacuucgacgccaaccaaaacacaaaauuuaccccaguaggaguuauccaagacggugggaccacccaccgcaacgaaccacaacaauggguacuccccucauacuccggccgcaacacgcccaacguacaccucgcacccgcagucgcccccaccuuccccggcgaacaacuccuauuuuuccgcuccaccaugcccggcugcucaggcuaccccaacauggaucuagacugucuccucccucaagaauggguccaauauuucuaccaagaagcagcccccgcccaaucagacguagcacuccuccgauucguuaaucccgacacaggacgcguccuauucgagugcaaacuccacaaauccggauacgucacagucgcucacaccggacaacacgaccucguaaucccacccaacggcuacuuuagauuugacagcugggucaaucaauucuacacucuagcacccaugggcaacggcaccggccgccgccgcuag

SEQ ID NO: 38640 - RNA, 1617 nt, Artificial Sequence
  derived and/or modified sequence opt11 from VP1__Norovirus_and/or_Norovirus-like__KP096344
augaaaauggccucuuccgacgccaaccccagcgacggaagcgccgcaaaccuaguccccgaaguaaacaaugaggucauggcacucgaacccguuguuggcgccgccaucgccgcacccgucgccggccaacaaaacguaaucgaucccuggauacgcaacaacuucguccaagcacccggcggugaguucaccgucagcccccgcaacgccccuggagaaaucuuaugguccgcaccccucggccccgaccuaaaccccuaccuaucccaccuugcccgcauguacaacggcuacgccggcggcuucgagguccaaguaauccucgcuggcaacgccuucaccgcagguaaagucaucuucgccgccguacccccuaacuuccccacggagggccucucucccucacaagucaccauguucccccacaucgucgucgaugucagacaacucgagcccguccucauaccacuacccgacguccggaacaacuucuaccacuacaaccagucgaacgacccaacaaucaaacucaucgccaugcucuacacuccccuccgcgcgaacaacgccggagacgacgucuucacagucuccugccgcguccucacaagaccuucacccgacuucgacuuuaucuuccucgucccacccaccguagaaucccgcaccaaacccuucucaguccccguccuaaccguagaagaaaugaccaacucgcgcuuccccauaccccuagaaaaacucuucaccggccccucaagcgcauucguuguacaaccccaaaacggacguuguaccaccgacgguguccuucucggcaccacccagcuaucccccguaaacauaugcaccuuccgaggugacgucacccacaucacuggcucccgcaacuacaccaugaaccucgcuagccaaaacuggaguucauacgaccccaccgaagaaauccccgcuccccucggcacccccgacuucgucggaaaaauccaagggaugcucacccaaacuaccagaaccgacggcucaacacgaggccauaaggcaacuguauacaccggcagcgccgacuuugcccccaaacucggccgaguacaauucgaaaccgacaccgaccacgacuucgaagccaaccaaaacaccaaauucaccccaguaggcgucauacaagauggaucaaccacacaucguaacgagccccaacaauggguccuaccaagcuacuccggcagaaacaccccaaacguccaccucgccccugccguagcaccaacauuucccggcgaacaacuccuuuucuuccgcuccacuaugccaggcugcucaggcuaccccaacauggaccucgacugccuucuuccccaggaauggguacaauacuucuaccaagaagcagcccccgcacaaucagacguagcccuucuccgcuucguaaaccccgacaccggacgcguauuauucgaaugcaaacuucacaaaucaggcuacgucacagucgcccauaccggccaacacgaccuggucauaccaccaaacggcuacuuccgauucgacuccuggguaaaccaauucuacacccucgcacccaugggcaacggcaccggucgccgcagguaa

SEQ ID NO: 38641 - RNA, 1617 nt, Artificial Sequence
  derived and/or modified sequence opt11 from VP1__Norovirus_and/or_Norovirus-like__KM982946
augaaaauggcaucauccgacgcaaacccgucagacggcuccgccgccaaccuggucccagaagucaacaacgaagucauggcccucgaacccgucgucggagccgccauagcagcccccguagcagggcaacaaaacgucaucgacccauggauccgaaauaauuucguacaggccccaggaggcgaauuuacagucagccccagaaacgcacccggagaaauccucugguccgcaccacuaggccccgaccuaaaccccuaccucucccaucuagcuagaauguacaacggcuacgcaggcggcuucgaaguccaggucauacuagccggaaacgccuucaccgccggcaaaguaaucuucgcagcagucccacccaauuuccccaccgaaggacucucccccucccagguuacaauguucccccacaucguagucgauguccgccaacucgaacccguacuaauaccccucccagacguccggaacaacuuuuaccacuauaaccaauccaacgacccaacuauuaaacuuaucgccaugcucuacacaccccuccgagccaacaacgcaggcgacgacguauucaccgucucaugccgcguccucacgcgccccagcccagacuuugacuucaucuuccucguuccucccacaguagaaucccgaacaaaaccauucuccgucccaguacucacagucgaagaaaugacaaacucacgauuuccuauuccccucgaaaaacucuucacaggacccuccuccgcauucgucguccaaccccaaaauggacgcuguaccaccgacgguguccuacuaggcaccacgcaacuaagccccgucaauaucuguacauuccgaggcgacguaacccacauaaccggaucaagaaacuacaccaugaaccuagccagccaaaacuggucaaacuacgauccaacagaagaaauuccagccccucucggaacucccgacuucgucggcaaaauccaagguguccucacacagaccacccguacagacggcuccacccgugggcacaaagccaccgucuacaccggcuccgccgacuucgcccccaaacuaggccgcguccaauucgaaaccgacacagaccgcgacuucgaaaccaaccaaaacaccaaauucacccccguaggcguaauccaagacggcggaaccacccaccgcaacgaaccccaacaauggguacuccccuccuacuccggcagaaauacucccaacguccaccucgcacccgccgucgcacccacuuuccccggcgaacaacuccuuuucuuccgcuccacaaugcccggcuguucuggguacccaaacauggaccucgacugccuccucccccaagaauggguccaauacuucuaccaagaagccgccccagcccaauccgacgucgcccuccuacguuucgucaacccagacacuggacgcguccucuucgaaugcaagcuccacaaaucagguuacgucacaguagcacacaccggccaacacgaccucguaaucccacccaacggcuacuuccgcuucgauagcugggucaaccaauucuacacacucgcccccauggguaacggcaccggccgcagaagauga

SEQ ID NO: 38642 - RNA, 1617 nt, Artificial Sequence
  derived and/or modified sequence opt11 from VP1__Norovirus_and/or_Norovirus-like__KM514070
augaaaauggcuuccucagacgcaaaccccucagacggcuccgccgcaaaccuaguaccagaagucaacaacgaagucauggcccucgaaccagucgucggagccgcaauagcugcaccagucgcuggccaacaaaacgucaucgacccauggauccguaacaacuucguacaagcucccggaggugaguucaccgucucuccgcgaaacgccccuggcgaaauccuauggucugcaccacucggccccgaccuaaaccccuaccucucacaccuugcacgaauguacaacggauacgcaggcggauuugaaguccaagucauccucgccggcaacgccuucaccgcuggcaaagucaucuucgcugcaguuccacccaacuuccccaccgaaggacuaucacccucgcaagucacaauguucccccacauugucgucgauguccgccaacuagaacccguacucaucccacuccccgacguccgaaauaacuucuaccacuacaaccaaucaaacgaucccacuauaaaacuaaucgcaaugcuuuacacaccacuccgagcuaacaacgccggcgacgacgucuucaccgucucaugccgcguccuuacaagacccucccccgacuucgacuucauauuccucgucccucccaccgucgaaucccgcaccaaacccuucuccguccccguccuaacggucgaagaaaugaccaauagccgcuuccccauaccacucgaaaaacucuucaccggccccuccuccgccuucgucguacaaccccaaaacggccgaugcaccacagacggaguccuacucggcaccacacaacucucacccguaaacaucugcacauuccgcggagacguaacccacgucaccggcucucgaaacuauacgaugaaccuagcuucccaaaacugguccaacuacgacccaaccgaagaaaucccagcaccccucggcacccccgacuucgucggcaaaauccaaggcguccuuacccaaacaacccgcaccgacggcucaacccgcgggcauaaagccaccguauacacugguuccgccaacuucgcacccaaacucggcagaguccaauucgaaaccgacaccgaccacgacuucgaagcaaaucaaaacaccaaauucacuccagucggcgucauacaagacgguggaaccacccaccgcaacgaaccccaacaauggguccucccauccuacuccggccgaaacacccccaauguccaccucgcaccggcuguagccccaaccuucccaggcgaacaacuccucuucuuccgcuccaccaugcccggaugcagcgguuaucccaacauggaccucgacugccuacuaccucaagaguggguucaguacuucuaccaagaagcagcccccgcccaauccgacgucgcccuacucagauucguaaaccccgacacaggcagaguccuguucgaaugcaagcuacauaaauccggguacguaaccgucgcccauacaggccaacacgaccucgucauaccacccaacggcuauuuccgcuucgacuccugggucaaucaauucuacacccuagcaccaaugggcaacggaaccggccgucgccgcuaa

SEQ ID NO: 38643 - RNA, 1617 nt, Artificial Sequence
  derived and/or modified sequence opt11 from VP1__Norovirus_and/or_Norovirus-like__KM514061
augaaaauggccuccuccgacgccaaccccuccgacggaucagcagcuaaccucguuccggaaguaaacaacgaagugauggcacuagaaccaguaguuggcgccgccauagcggcgcccgucgcaggacaacagaacgucaucgaccccuggauccguaacaacuuuguccaagcucccggaggcgaguucaccgucucaccccgcaacgcccccggagaaauacuuugguccgcaccccucggccccgaucuaaacccauaccuaucacaccucgcacgcauguacaauggcuacgcaggcggcuucgaaguccaaaucauccuagccggcaacgccuucacagccggcaaagucaucuucgcugcgguacccccaaacuuccccaccgaaggccucucacccagccaagucacaauguuuccccacaucgucgucgacguaagacaacucgaacccguucucaucccccuaccagacguaagaaacaacuucuaucacuacaaccaauccaacgacccuaccaucaaacuuaucgccaugcucuacacaccccuacgcgcuaacaacgcaggagacgacguauucaccgucuccugucgaguccucaccagacccucuccagacuucgacuucaucuuucucguaccacccaccguagaaucgcgaaccaaaccuuuuuccgucccuguacucaccgucgaagaaaugaccaacucacgcuucccaaucccccuugaaaaacuuuucaccggacccucauccgccuucgucguacaaccccaaaacggccgaugcaccacagacgguguacuccucggcacaacacaacuaucccccguaaacauaugcacuuuccgcggcgacguaacccacauaacuggcucccacaacuacaccaugaaccucgcaucccaaaacugguccaauuacgaccccacggaagaaauacccgcuccccuaggcacccccgacuucguaggaaaaauacaaggcguacugacacaaaccacccgcaccgacggcucaaccagaggccacaaagccaccgucuacaccggcucagccgacuucgcccccaaacucggaagaguccaauucgaaaccgacaccgacagagauuucgaagcaaaccaaaacaccaaauucacccccgucggaguuauucaagacggcggcacaacccaucgcaacgaaccccaacaauggguccuccccuccuacucaggccgaaacaccccuaacguacaccucgccccugcagucgcgcccacauucccaggugaacaacuccuauucuuccgcuccaccaugcccggcugcucaggcuaccccaauauggaccucgacugccuucuaccccaagaauggguccaauacuucuaccaagaagccgcccccgcccaauccgacguagcccuccucagauucgucaacccagacacaggacguguccucuucgaaugcaagcuccacaaaagcggcuacguaaccgucgcccacaccggacaacacgaucucgucauaccaccaaacgguuacuuccgcuucgacuccugggucaaccaauuuuacacccucgcccccaugggaaacgguaccggacgucgccgauag

SEQ ID NO: 38644 - RNA, 1617 nt, Artificial Sequence
  derived and/or modified sequence opt11 from VP1__Norovirus_and/or_Norovirus-like__KM514060
augaaaauggcauccuccgacgccaaucccuccgacggcucggccgcaaaccuaguacccgaaguaaacaacgaaguaauggcucucgagcccgucguaggagccgccaucgccgcccccguagccggccaacaaaacguaauagacccguggauccgcaacaacuucguccaggcccccggcggagaguucaccguaucaccccgaaacgcacccggcgaaauacuuugguccgcgccccucggccccgaccucaacccauaccucucacaccuagcacgaauguacaacgguuacgccggagguuucgagguacaagucauacucgccggcaacgccuucaccgcaggcaaggucaucuucgcagccgucccacccaacuucccaacugaaggccucuccccuucacaagucaccauguucccccacauagucguugacguccgacaacucgagcccguccucaucccccuccccgacguccgcaacaacuucuaucacuacaaccaguccaacgaccccaccauaaaacucauagccaugcucuacacuccccucagggccaauaacgcgggcgaugacgucuucaccgucagcugccgcguucucacccgacccuccccagacuucgacuuuaucuuccuaguacccccaaccgucgaaucccgcaccaaacccuucuccgucccuguacucacaguagaagaaaugacuaacucccgcuuccccaucccccuagaaaaacuuuucaccggacccucauccgcuuucguuguccagccacaaaacggccgaugcacaaccgacggcguccuccucggaacuacccagcuuucccccgucaauaucugcacguuccgcggagacguaacccacauaacuggcucacgaaacuacaccaugaaccuagccucccaaaacuggaacaacuacgaccccacagaagaaauccccgccccacucggaacccccgacuucgucggaaaaauccaaggcguacucacacagacaacccgcaccgacggcuccacucgcggccacaaagcuaccgucuacaccggaucugcugacuucucacccaaacuuggccgaguccaauuugagaccgauaccgaucaugacuuugaagccaaucagaacaccaaauucacccccgucgguguuauccaggacggcggcaccacucacagaaacgaaccacaacaauggguucucccuucauacucaggacgcaacacccccaauguccaccucgcccccgccgucgcccccaccuucccaggcgaacaauuacucuucuuccguuccaccaugccaggcugcuccggauaccccaauauggaccucgacugucuucucccucaagaauggguccaauacuucuaucaagaagccgcccccgcacaaucagacgucgcacuucuacgcuucgucaacccagacacaggaagaguccucuucgaaugcaaacuacacaaauccggcuacgucaccguagcucacacaggccaacacgaccuaguaauacccccaaacggcuacuuccgauucgacucauggguuaaccaauucuacacacucgcccccaugggcaacggcgcaggccgccgucgcuag

SEQ ID NO: 38645 - RNA, 1617 nt, Artificial Sequence
  derived and/or modified sequence opt11 from VP1__Norovirus_and/or_Norovirus-like__KM268079
augaaaauggcaucauccgaugccaaccccuccgacggauccgccgcuaaccuuguacccgaagucaacaacgaaguaauggcccuagaacccguagucggcgcagccaucgccgcccccguagccggccaacaaaacgucaucgacccguggauccgcaacaacuuuguucaagcccccggaggcgaguucaccguaucaccccgcaaugcaccaggagaaauccuaugguccgccccacucggccccgaccucaaccccuaccucucucaccucgcacgaauguacaacggcuacgcuggaggcuucgaaguccaagucauccuagccggcaacgccuucaccgccggcaagauaaucuucgccgcgguaccacccaacuuccccaccgaaggccucucucccucacaagucaccauguucccccacaucguagucgacgugcgccaauuagaacccguucuuaucccacuccccgacgugcggaacaacuucuaccacuacaaccaaucaaacgaccccacaauuaagcucauagcuaugcucuacaccccacuucgagccaacaacgccggugacgacgucuucacugucuccugccgcguucugacccgccccucacccgacuucgacuucauauuccucguuccuccaaccguagaaucccgaaccaaacccuucucagucccaguuuuaacagucgaagaaaugacaaacucccguuuuccaaucccgcucgaaaaacuauucacaggcccuuccuccgcuuucgucguccaaccacaaaacggacgcugcaccaccgacggcguacuccuaggaacaacucaacucucccccgucaacaucugcaccuuccgaggcgacgucacacacauaaccggcucccgcaacuacaccaugaaccucgccucccaaaacugguccaacuacgaccccaccgaagaaauaccugcaccccucggcacccccgacuucgucggcaagauacaaggcguccucacccaaaccacccgaaccgacggcuccacacgcggccacaaagcaacggucuacaccggcuccgccgacuucgcccccaaacuaggacgcguccaguuugaaacagacaccgaccacgacuucgaagccaaccaaaacaccaaauucacccccgucggcguaauacaagacggcggcacaacccauagaaacgaaccacagcaauggguccucccauccuacucaggccgcaacacucccaacguccaccuagcgcccgcagucgcccccaccuuccccggcgaacagcuacucuucuuccgauccaccaugccuggcugcuccggcuaccccaacauggaccucgauugccuccuaccucaagaauggguacaauacuucuaccaagaagccgcccccgcccaauccgacgucgcccuccuccgcuucguaaacccagacaccggacgaguucucuucgaaugcaaacuacacaaauccggauaugucaccgucgcccacacaggccaacaugacuuaguaaucccgcccaacggcuacuuccgcuucgacagcuggguaaaucaauucuacacgcuagcccccaugggcaacggaaccggccguagacguuaa

SEQ ID NO: 38646 - RNA, 1617 nt, Artificial Sequence
  derived and/or modified sequence opt11 from VP1__Norovirus_and/or_Norovirus-like__KJ710247
augaaaauggcauccaacgacgcuaaucccuccgauggaucagccgcaaaucucguccccgaaguaaacaacgaagucauggcccucgaacccgucguaggcgcagcaaucgccgccccaguggccggccaacaaaacgucaucgaccccuggauccgcaacaacuucguccaagcacccggcggagaguucaccgucuccccucgcaacgcccccggcgaaauccuuugguccgcaccccucggcccugaccuaaaccccuaccucagccaccuugccagaauguacaacggcuacgccggcggguucgaaguccaagucauccucgccggaaacgccuucacagcuggcaaaauaauuuuugcagccgucccaccaaacuuccccaccgaaggccucagcccaucccaaguaacaauguucccacacaucaucgucgacgucagacaacucgaaccaguccuaaucccccuccccgacguucgcaacaacuucuaucacuacaaucaauccaacgacuccacaaucaaacuaaucgccaugcucuacacaccccuccgggccaacaacgccggcgacgacgucuucaccgucuccugccgcguccucacccgccccuccccagacuucgacuucauauucuuaguaccaccuaccgucgaaucccgcacaaaaccauucucuguacccguccucaccaucgaagaaaugaccaacucccgcuucccaaucccccucgaaaaacuuuucacaggccccuccagcgcauucgucguccaaccacaaaacggcagaugcaccaccgauggcguacuccuaggcaccacacagcucuccccagucaacauuugcacauuccgcggcgacgucacucacaucacaggcucacgaaacuacaccaugaaccuagcaucucaaaacuggaacaacuacgacccaacugaagaaauccccgcuccacucggcacccccgauuuugucggcaaaauacaagguaugcucacccaaacaacacgcacagacgggucaacccggggacacaaagcaacagucuacacaggaucugcagacuucgcaccuaaacucggcagaguccaguucgaaacagacaccgaccacgacuucgaagccaaucaaaacacaaaauucacccccaucggcguaauucaagacggcucuaccacccaccgcaacgaaccccaacaauggguccuccccucauauaguggccgcaauacccacaacguccaucuugcacccgcugucgcccccacauuuccuggggaacaacuccuauucuuccggucuaccaugccgggcugcucaggcuacccuaacauggaccucgacugccuccuuccccaagaauggguucaauacuucuaucaggaagcagcacccgcacaauccgacguagcccuacuccgauucgucaaucccgacaccggucgcguccucuucgaaugcaaacuccacaaaucgggcuacguaaccgucgcacacaccggccaacacgaccucguuauacccccaaacggcuauuuccgcuucgacucauggguaaaccaauucuacaccuuagcaccaaugggaaacggcacuggccgccgccgcuaa

SEQ ID NO: 38647 - RNA, 1617 nt, Artificial Sequence
  derived and/or modified sequence opt11 from VP1__Norovirus_and/or_Norovirus-like__KJ685405
augaaaauggccuccuccgacgccaaccccuccgacggaucgaccgccaaccucguuccagaaguaaacaacgaaguaauggcauuagaacccgucgucggcgccgccauagccgccccaguagccggccaacaaaacgucaucgaccccuggauccgcaauaacuucguccaagcacccgguggcgaguucaccgucucgccuagaaacgccccgggcgaaauacucugguccgcaccccucggacccgaccucaaccccuaccuuucucaccuggcccgcauguauaacgguuacgccggcggcuucgaaguucagacaauacucgccggcaacgccuucacagccggcaaaauaaucuucgcagccguucccccaaacuucccaaccgaaggacucucacccucucaggucaccauguucccccacauaauaguagacguacgccaacuagaacccguccucaucccccuaccugauguacgaaacaacuuuuaccacuacaaccaaacuaacgacccuaccaucaaacucaucgcaaugcucuauacaccccuucgcgccaacaacgccggagacgacgucuucaccgucucaugccgcguccucacccgccccucacccgacuucgacuucauauuccucgucccaccuacaguagaaucacgaaccaaacccuucucaguaccaguccucaccgucgaagaaaugaccaacucccgcuucccgauaccccuagaaaaacucuucaccggaccaucgucugccuucguuguacaaccccagaauggacgaugcaccaccgacggcguacuccuaggaaccacccaacucucccccguuaacauaugcaccuuccgcggcgacguaacccacaucucuggaucccguaauuacaccaugaaccuagccagccagaacuggaacucauacgaccccaccgaagaaauaccagcaccucucggcacccccgacuucgucggcaaaauccaaggaguccucacccaaacaaccagaaccgacggcagcacccgcggacacaaagccacagucuacaccggcucagcggacuucucccccaaacuuggcagaguucaauucgcgaccgacacggauaacgacuucgaaaccaaccaaaacacaaaauucacccccgucggcgucauccaagacgguggcaccacccaccgcaacgaaccccaacaauggguacuccccagcuacucaggccgcaacacacacaacguacaccucgcacccgccguugccccaaccuuuccuggcgaacaauuacuauucuuucgauccacaaugcccggaugcuccggauaccccaacauggaccuagauugccuccuaccccaagaguggguccaauacuucuaccaagaagcagcccccgcacaauccgacguagcccuccuccgcuuuguuaacccagacaccggccgaguccuauucgaaugcaaacuccacaaaucaggcuacgucacaguggcacacacaggccaacaugaccucguaaucccucccaacggguacuuccgcuucgacagcuggguaaaccaauucuacacacucgcccccaugggcaacgggaccggccgccgccgcuaa

SEQ ID NO: 38648 - RNA, 1617 nt, Artificial Sequence
  derived and/or modified sequence opt11 from VP1__Norovirus_and/or_Norovirus-like__KF429766
augaaaauggccuccuccgacgccaacccaagcgauggaucaaccgccaaccuaguaccagaagucaacaaugaaguaauggcccuagaacccguagucggagcugccaucgcagcccccgucgccggacaacaaaacgucaucgaccccuggauacgcaacaacuucguccaggcacccggcggcgaguucaccguaagcccacgcaacgcccccggcgaaauccuguggagcgcaccccuuggcccagaccugaaccccuaccuuucacacuuggccagaauguacaauggcuacgccggcggauucgaaguccaagucauccucgccggaaacgccuucaccgccgguaaaaucaucuuugccgcagucccacccaacuuccccaccgaaggccucucacccucccaaguaaccauguucccccacaucaucguagacguacgccagcuagaaccaguucucauuccucuccccgacguccgaaacaacuucuaucacuacaaccaaucaaaugacccaaccauaaaacucauagccaugcuuuacacuccccuaagagccaacaacgcaggagacgaugucuucaccguauccugccguguccuaaccagaccgucccccgacuucgacuucaucuuucuaguaccaccuaccgucgaaucccgcaccaaacccuucucaguaccaguccuaacaguagaagaaaugaccaauagccgauuccccaucccgcuagaaaaacuauucaccggcccuucauccgcauucgucguacagccccaaaacggacgcugcacuaccgacggaguccuccuaggaaccacacaacucucccccgucaacaucugcaccuucagaggcgacgucacacacaucuccggcucacgcaacuauaccaugaaccucgcuucacaaaauuggaacuccuacgaccccaccgaagaaauaccagcaccccucggaacucccgacuuugucggcaaaauacaaggcguccugacacaaacaacacgaaccgacggcagcacccguggacacaaagccaccgucuacaccggaagcgccgacuucucccccaaacuaggaagaguacaauucgcaacagauacggacaacgacuucgucauaaaccaaaauaccaaauucaccccugucggcgugauccaagacgggagcacaacaccccgcaacgaaccgcagcaauggguacuccccuccuacucaggccguaacacccacaacguccaccuagcaccagcagucgcuccaaccuuccccggcgaacaacuccuauucuuccgcucaaccaugccaggaugcuccggcuaccccaacauggaccucgacugccuccucccccaagaauggguccaauacuucuaccaagaagccgcucccgcucaaucagacguagcccuccucagguuuguuaaucccgacacaggccgcguacuauucgaaugcaaacuccacaaaucaggauacgucaccguagcucacaccggccaacacgaucucguaaucccacccaacggcuacuuccgcuucgacucaugggucaaccaauuuuacacucucgcacccaugggaaauggcaccggccgccgcagauaa

SEQ ID NO: 38649 - RNA, 1617 nt, Artificial Sequence
  derived and/or modified sequence opt11 from VP1__Norovirus_and/or_Norovirus-like__KF060009
augaaaauggcuuccuccgaugccaaccccucagacggcagcgcagcaaaccuagucccagaagucaauaaugaagucauggcccucgaacccgucguuggcgcagcaaucgcggcccccguagccggacaacaaaacgucaucgaccccuggauccgcaauaacuucguccaagccccaggcggagaauuuaccguaucaccccgcaaugcaccuggugaaauccucugguccgcaccccuuggccccgaucuaaaccccuaccuaucccaccucgcccguauguacaacggcuacgccggcggcuucgaaguccagguaauacucgcaggcaacgccuucaccgccggcaaggucaucuucgccgccgucccacccaacuucccuaccgaaggccuaucucccucccaaguaacaauguucccccacauagucgucgacguccgccaacuagaaccaguccuuaucccccucccagacguaagaaacaacuucuaccacuacaaccaauccaacgaucccacaaucaaacuaaucgcaaugcucuacaccccacuacgcgccaacaacgccggagacgacgucuucaccgucuccugccggguccuaaccagacccucaccagacuucgacuuuaucuuccucgucccacccacaguugaaagcagaaccaaacccuucuccguccccguccucaccgucgaagaaaugaccaacucacgauucccaaucccccucgaaaaacucuucacuggacccuccuccgcauuugucguccaaccccaaaauggccgcugcaccaccgacggcguacuccuaggcaccacccaacucagcccagucaacaucugcaccuuccguggcgauguaacgcacauuaccggaucacgaaacuacaccaugaaccuugccucccaaaauuggaacaacuaugacccaaccgaagaaaucccugccccgcucggcacucccgauuucguaggaaaaauccaaggcguccuuacacagaccacacgcacagacggcuccaccagaggucacaaagccaccgucuauaccgguucagcagacuuugcacccaaacucggacgcguacaauucgaaaccgacacagaccacgacuucgacgccaaccaaaacacaaaguucacacccguaggcguaauccaagacggcggaacuacccaccgcaacgaaccucaacaauggguacuaccaucauacuccggccgcaauacucacaauguccaccuggccccagcaguagcucccacuuucccgggagaacaacuccucuucuuccgcagcacgaugccuggcugcuccggcuaccccaacauggaccucgacugccuccucccacaagaauggguacaauauuucuaccaagaagccgcccccgcccaauccgacgucgcucuccuccgcuucguaaaccccgacaccggucgcguccucuucgaaugcaaacuccacaaaucuggcuacguaaccguagcacacaccggccaacacgaccucgucauacccccuaacggauacuuccgcuucgacuccuggguaaaccaauuuuacacacuagcccccaugggcaacggaaccggccgcagacgcuaa

SEQ ID NO: 38650 - RNA, 1617 nt, Artificial Sequence
  derived and/or modified sequence opt11 from VP1__Norovirus_and/or_Norovirus-like__KF059996
augaaaauggccucuucagacgccaaccccuccgauggcuccacggcuaaccucguaccagaaguuaacaacgaagucauggcccucgagcccguagucggcgccgcaaucgccgcacccgucgccggccaacaaaacgucauagaccccuggauacgcaacaacuucguacaggcacccggcggcgaguucacagugucaccccgcaacgcccccggcgaaauacucugguccgcaccccucggccccgaccucaaccccuaucucucacaccucgcccgcauguacaacggauacgccggaggcuucgaaguacaagucauccuugccggcaacgccuucacagccggaaaaaucauauucgccgcuguaccacccaacuuccccaccgaaggccuaucacccucccaagugaccauguucccccacaucaucgucgacguccgccaacuagaacccguucucaucccccucccggauguccgcaacaacuucuaccacuacaaccaauccaacgacccuaccauaaaacucauagccaugcucuacacaccccuccgcgccaacaacgccggagacgacguuuucaccgucuccugccguguccucaccagaccaucacccgacuucgacuucauuuuucucgucccucccaccgucgaaucacgaacaaaacccuuuucaguccccguccugaccgucgaagaaaugaccaacucccguuuccccaucccacucgaaaaacucuuuacaggccccucuagugccuucgucguucaaccucaaaacggacgcugcaccacugacggaguccuccuaggaacaacccaacucagccccgucaacaucuguaccuuccgaggugauguuacacauaucccuggaucccgcaacuacaccaugaaccuagcaucccaaaacuggaacucauacgaccccaccgaagaaauccccgcaccccucggaacaccagacuucguaggcaaaauccaaggaguccuaacucaaacaaccaaaaccaacggcucaacccgcgggcacaaagccaccgucuauaccggcuccgccgacuucucacccaagcuaggccgcguccaguucgccacagacacugacaacgacuucgaaaccaaccaaaacacaaaauucaccccagucggcgucauacaggacggcagcaccacaccccgcaacgaaccacaacaauggguucucccaucauacuccggccgcaauauacauaacguccaccuagccccagccguagcccccacauuucccggcgaacaacugcuauuuuuccgaucaacuaugcccggcuguucuggcuacccaaacauggaccucgacugccuacuaccccaagaauggguacaauacuucuaccaagaagccgcccccgcccaaucagacguggcacuacuccguuucgucaacccagacaccggccgcguucucuucgaaugcaaacuucacaaauccggcuaugucacagucgcacacacuggccaacacgaccuaguaaucccacccaacgguuacuuccgauucgacucaugggugaaccaauucuacaccuuagcucccaugggcaacggcacuggccgucgccguuaa

SEQ ID NO: 38651 - RNA, 1617 nt, Artificial Sequence
  derived and/or modified sequence opt11 from VP1__Norovirus_and/or_Norovirus-like__HF952130
augaaaauggccuccucagacgccaaccccucugacggcucaaccgccaaccuaguacccgaagucaacaacgaaguaauggcccuagaacccgucgucggcgccgccaucgcagcccccguagcaggccaacaaaacguuaucgaccccuggauucgcuccaacuucguacaagcccccggcggagaguucaccguuucaccccggaacgcccccggcgaaauccucugguccgcaccccuaggccccgaccucaacccuuaccuaucacaccuagccagaauguauaacggcuacgccggcggauucgaaguccaagucauccucgccggcaacgccuucacugccggaaaaaucauuuucgccgccgucccaccaaacuuccccaccgaaggacuaucacccucccaagucaccauguucccccacauuaucguagacguccgacaacucgaacccguccucauaccccuccccgacguccgcaacaauuuuuaccacuacaaccaauccaacgauuccacuaucaaacuaauugcuaugcuauacacaccccuacgcgccaauaacgccggugacgacguauucaccgucagcugccguguacucacccgccccucacccgacuucgacuucaucuuccucgucccacccaccgucgaaucccgaaccaaacccuucucaguacccguccucaccgucgaagaaaugaccaacuccagauucccuauaccccucgaaaaacucuucaccgggcccucaucagccuucgucguccaaccacaaaauggacguugcaccacggacggaguacuccucggcaccacacaacucucccccgucaacaucugcaccuuccgcggugacgucacccacauaucuggaucacgcaauuacacaaugaaccucgccucccaaaacuggaauagcuacgaccccaccgaagaaauaccagccccacucggcaccccagacuucgucgguaaaauccaaggagugcuuacccaaacaaccaaaacaaacggcuccacgcguggccacaaagccaccgucuacacuggcucagccgauuucucccccaaacuaggccgaguacaauucgccaccgacacagacaacgacuuugaaacaaaucaaaacaccaaauucacacccguuggcgucauccaagacggauccacaaccccucgaaacgaaccccaacaauggguccucccauccuauuccggacgcaacacacacaacguccaccuagccccggcaguugcacccaccuuucccggagaacaacuacucuucuuccgcucaaccaugccaggcugcucaggcuaccccaauauggaucucgacugccuacucccccaagaguggguccaguacuucuaccaagaagcagcuccagcccaaucagacgucgcucugcuaagauucguuaaccccgacacaggccgcguccuauucgaaugcaagcuccacaaaucaggcuacgucaccguagcucacaccggccaacacgaccuagucauuccacccaacgguuacuuccgcuuugacuccuggguaaaccaauucuacacccucgcacccaugggaaacggcaccggcaggcgccgcuaa

SEQ ID NO: 38652 - RNA, 1617 nt, Artificial Sequence
  derived and/or modified sequence opt11 from VP1__Norovirus_and/or_Norovirus-like__KC409302
augaaaauggcuuccagcgacgccaaucccucagacggcucaaccgcaaaccucguccccgaaguaaacaacgaaguaauggcccucgaacccgucgucggggccgccauugcagccccugucgccggacaacagaaugucauagaucccuggauccgcaacaacuucguccaggccccuggcggcgaguucaccgucagcccacguaaugccccaggagaaauacuaugguccgcaccccucggccccgaccuaaauccauaccugucacaccuagcccgaauguacaacggcuacgccggcggcuucgaaguccaagucauacuagccggaaacgccuucaccgcuggcaaaauaaucuucgccgcaguuccaccaaacuuccccacggaaggccuaucccccucucaagugaccauguucccccacauaaucgucgacguccgccaacucgaacccguccucauaccacuccccgacguacgcaacaacuucuaucacuacaaccaaucaaacgacccuaccaucaaacucaucgcaaugcucuacacuccccuccgagccaacaacgcuggugacgacgucuuuaccgucucaugccgcguacucacccgcccgucccccgacuucgacuucaucuuccucgucccucccaccgucgaaucacgcaccaaacccuucuccgucccaguacucaccguagaagaaaugaccaauucacgcuuccccaucccccucgaaaagcuauuuacuggccccuccuccgccuucgucguacaaccccaaaacggccgcugcaccacagauggcguccuacuaggcacaacccaacucucccccgucaacaucugcaccuuccgaggcgaugucacccacauccccggcucccgcaacuacacuaugaaccuagcaucacaaaacuggaacucauacgaucccacagaagaaaucccagcaccccuaggcaccccugacuucguggguaaaauccaaggcguacucacacagaccacccgaaccaacgguucaacgcguggacacaaagcaaccguauacacaggcuccgcugacuucucucccaaacucggccgaguccaauucgcaaccgacaccgacaacgacuucgaaauuaaccaaaacacuaaauucacccccguuggcgucauccaagacggcuccacuacuccccgcaacgaaccucaacaauggguccuaccauccuacuccggcagaaacauccacaacguccaccucgccccagccgucgcgcccaccuucccaggcgaacagcuacucuucuuccgcuccacaaugccaggcugcuccggauacccaaacauggaccuugacugccuucuaccacaagaguggguccaauacuucuaccaagaagcagcccccgcacaauccgacguagcccuccuucgcuucgucaaccccgacacuggccgcguccuauucgaauguaagcuacacaaauccggcuacgucaccgucgcccacacuggccaacacgaccuagucaucccucccaaugguuacuuccgcuucgacuccugggucaaccaauucuacacucucgcucccaugggcaacggcacaggccgccgccgcuaa

SEQ ID NO: 38653 - RNA, 1617 nt, Artificial Sequence
  derived and/or modified sequence opt11 from VP1__Norovirus_and/or_Norovirus-like__JX459908
augaaaauggcauccuccgaugccaaccccuccgacgguuccgcugcuaaccuagucccagaagucaacaacgaagucauggcccucgaaccugucgucggcgcagcaaucgccgcccccguagccggccaacaaaacgucauagaccccuggauacgaaacaacuucguacaagcccccggcggcgaguucaccgucucuccccgaaacgcccccggcgaaauccucugguccgcuccacuaggcccagaccucaaccccuaccuaucccaccuagcccguauguauaacgguuacgcaggcggcuucgaaguccagguaauucuagcaggcaacgcuuucaccgccggaaaagucaucuucgcugcaguucccccaaacuucccuaccgaaggccucuccccaucccaagucaccauguucccgcacauuguagucgauguacgacagcucgaacccguccuaaucccccuccccgacguccgcaacaacuucuaucacuacaaccaauccaacgaccccaccaucaaacucaucgccaugcuauacacaccacuccgugcaaacaacgccggcgacgacgucuuuacugucucaugccggguccucacacgucccagcccugacuucgacuucaucuuccuagucccacccacggucgaaucccgcacaaaaccauucuccgucccaguccuaacagucgaagaaaugacuaacucccgcuuuccgauaccccucgaaaaacucuucaccggccccuccucagccuuugucguucaaccccaaaauggacgguguaccacagacggcguccuccuuggaaccacacaacuuucacccgucaacaucugcaccuuccgaggggacguaacccacaucaccggcucccgcaacuacaccaugaaccuagccucccaaaacuggaacgacuacgaccccacagaagaaauccccgcaccccucggcacacccgacuucgucggcaaaauccaagguguacuuacccaaacuacccggaccgacggaucaacacgcggacacaaagccacaguauacaccggcucagccgacuuugccccaaaacucggccguguccaauucgaaaccgacaccgaccgcgauuucgaagccaaccaaaacaccaaauucacccccgucgguguuauccaagacggcggaacaacccacagaaacgaaccacagcaauggguacuucccucauacuccggacgcaacacacacaacguacaccuagcccccgccgucgcccccacauucccgggcgaacaacuccuauucuuccgcucaaccaugcccggcugcuccggcuaccccaacauggaccucgauugccuccuaccacaagaauggguccaauacuucuaccaagaggccgcaccagcucaguccgacguugcccuccuaagauucgucaaccccgacaccggccgcguuuuauucgaaugcaaacuacacaagucaggauacguaacagucgcccacaccggccaacacgaccucguaauaccgcccaacggcuauuuccgcuucgacuccugggucaaccaauucuacaccuuagcccccauggggaacggcaccggccgccgacguuaa

SEQ ID NO: 38654 - RNA, 1617 nt, Artificial Sequence
  derived and/or modified sequence opt11 from VP1__Norovirus_and/or_Norovirus-like__JX445166
augaaaauggcaagcuccgacgcaaaccccucugacggcagcacagccaaccucguaccagaaguuaacaacgaagucauggcacucgaaccagucgucggcgcagccaucgccgcccccgucgcuggccaacaaaacgucaucgacccauggauuagaaacaacuucguucaagcccccggcggcgaguucacagucucacccaggaacgcccccggagaaauacuauggucggcaccccucggccccgaccucaaccccuaccucucucaccuagccagaauguacaacggauacgccggaggcuucgaaguacaaguaauacucgccggcaacgccuucaccgccggaaaaaucaucuucgccgccgucccacccaacuuccccaccgaaggacucucaccaucacaaguaaccauguucccgcauaucaucgucgacguccgccaacuagaacccguccucaucccacuacccgacguaagaaacaacuucuaccacuauaaccaaucaaacgacccaaccauuaaacuaaucgccaugcucuacaccccucucagagccaacaacgcaggagacgacgucuuuacaguguccugcagaguccucacacgccccuccccagauuucgacuucaucuuccucgucccgcccacaguagaaucccgcacaaaacccuucucuguacccgugcucaccguggaagaaaugaccaacucacgauuucccauaccccucgaaaaacucuucacgggccccuccucggcauucgucguacaaccacaaaacggucgcugcaccaccgauggcguacuccucggcacaacccaacucucccccguuaacaucuguaccuuccgcggugacgucacccacaucccaggaucacacaacuacacaaugaaucucgccagccaaaacuggaacucuuacgaccccaccgaagaaauacccgcgccccucggaaccccagacuucguaggcaagauacaaggcguccuaacacaaaccacccgcaccaacggcuccacccgcggccacaaagccacuguauacaccggauccgccgacuucucccccaaacucggccgaguccaauucgcaaccgacaccaacaacgacuucgaaaccaaccaaaacacaaaauucacccccguaggcguaauccaagacggaucuaccacaccccgcaacgaaccacaacaauggguccucccaucauacagcggacgcaacacccacaacguccaccucgcucccgccgucgcccccaccuucccaggcgaacaacuccuauucuuccgcucaacaaugcccggcugcuccggcuaccccaacauggaccuugacugccuacuaccacaagaauggguacaauauuuuuaccaagaagcagcccccgcccaaucagaugucgcacuucuccgcuuuguaaaccccgauaccggccgcguacuauucgagugcaaacuccacaaauccggcuacguaacugucgcccacacaggccaacacgacuuagucaucccacccaacggcuauuuccgauucgacagcugggucaaccaauucuacacccucgccccaaugggcaacggaacuggccgccgccguuaa

SEQ ID NO: 38655 - RNA, 1617 nt, Artificial Sequence
  derived and/or modified sequence opt11 from VP1__Norovirus_and/or_Norovirus-like__HQ693090
augaaaauggcaucaaacgacgccaacccauccgauggauccgcugccaaccuugucccagaaguaaacaacgaagucauggcucuugaacccgucgucggcgccgccauagccgcccccgucgccggccaacaaaacgucaucgaccccuggauucggaacaacuucguccaagcccccggcggcgaguucgccguaucgccccgaaacgcaccuggcgaaauccucugguccgccccacuuggcccagaccuuaacccauaccucucccaccucgcacgaauguacaacggcuacgcuggcggcuucgaaguccaaguuauacucgccggcaacgcauucaccgcaggaaaaaucaucuucgcagccgucccacccaacuuccccaccgaaggccucucccccucccaaguaaccauguucccccacauaauagucgacguccgccaacucgaacccguccucauuccacuucccgacguccguaacaacuucuaccacuacaaccaauccaacgacucaacaaucaaacucaucgccaugcuuuacacaccccuccgcgcuaacaacgccggagaagacgucuucaccgucucaugccgcgugcucacccgcccaucccccgacuucgacuucaucuuccucgucccacccacagucgaauccagaaccaaaccauucaccguacccauucucacaguugaagaaaugaccaacucacgcuuccccaucccccuagaaaaacucuucaccggaccauccggcgccuucguaguacaaccccagaacggccgcugcacaaccgaugguguacuccuaggcaccacccaacucucacccguaaacaucugcaccuucagaggcgacguaacccacaucgcaggcucccgaaacuacacaaugaaccucgcgucacucaacuggaacaacuacgaccccaccgaagaaauccccgccccucuaggaacccccgacuucgucggcaaaauccaaggaguccuaacccaaaccacaaaaggcgacggcuccacgcgcggacacaaggcaacuguuuacacggguagcgcucccuucacaccaaaacucggcuccguccaguucuccaccgacacagaaaacgacuucgaaacucaccaaaacacgaaauucgccccaguaggaguuauucaagacggcucuaccacccaccgcaacgaaccccaacaguggguccuccccuccuacuccggcggaaacguccacaacguccacuuagcucccgccgucgcuccuacauuccccggcgaacaacuucucuucuuccgaucaacuaugcccggcugcuccggcuacccuaacauggaucuugacugccuccucccacaagaauggguccaacacuucuaccaagaagcagcaccagcacaaucggauguagcacuucuccgcuucgucaacccugacaccggccgcguacuuuucgagugcaaacuacacaagucaggcuacgucacagucgcacacaccggccagcacgaucuagucauacccccgaacggcuacuuccgcuucgacuccugggucaaccaauucuacacccuugcucccaugggcaacggaaccggccgccgacgcuga

SEQ ID NO: 38656 - RNA, 1617 nt, Artificial Sequence
  derived and/or modified sequence opt11 from VP1__Norovirus_and/or_Norovirus-like__JN400611
augaaaauggccucaaacgacgcuaaccccagcgacggcucagccgcaaaccucguucccgaaguaaacaacgaagucauggcacucgaaccaguagucggcgccgcgauagcagccccagucgccggccaacaaaacgugauagaccccuggauccgcaacaacuucguccaagcccccggcggagaguucaccgucucaccacgcaacgcccccggcgaaauucucugguccgccccauuaggccccgaucucaaccccuaccucucacaccucgcccguauguacaacggguacgccggcggauucgaaguccaaguaaucuuagccggcaacgccuucacagccggcaaaaucaucuucgcagccgucccgccaaacuuccccacagaaggccuaucccccucacaagucacaauguucccacacauaaucgucgacguccgccagcuagaacccguccucauuccccuucccgacguccguaacaacuucuaccacuacaaccaaucaaacgacuccaccaucaaacucaucgcuaugcuauacacuccccuccgagccaacaacgccggcgaagacguauucacaguaagcugccgcguucugacccgaccuucccccgacuucgaccuuauauuccuugucccacccaccgucgaaucacgaacaaaacccuucaccguccccauccucacaguugaagaaaugacgaacucacgcuuucccaucccacuagaaaaacuuuuuaccggucccuccggcgccuucgucguacaaccucaaaacggacgcuguaccaccgacggcguacuccuaggcaccacucagcucucccccgucaacaucugcaccuuccgcggagacguaacccacauagcaggcucgagaaauuacacuaugaaucuagcaucccuaaacuggaacaacuacgaccccaccgaagaaauccccgcaccccucgguacccccgacuucgucggcaagauacaagggguucucacccaaaccacaaaaggggacggauccacacgcggacacaaagccacaguauacaccggcggcgcccccuucacccccaaacucggcuccguccaauucucaaccgacacagaaaacgacuucgaaacacaccaaaacaccaaauucacaccaguaggcgucauacaagacggauccaccacccaccgcaacgaaccucagcaguggguacuacccucauacuccgguagaaacguccacaacguccaccuagcccccgccgucgcaccuacauuccccggagaacagcuccuuuucuuccgauccacaaugcccggaugcucgggcuaccccaacauggaccucgacugccuucucccucaagaauggguccaacacuucuaccaagaagccgcccccgcacaauccgacgucgcccuccuacgcuucguaaacccagacaccggccgaguccuauucgaguguaaacuacacaaaucaggauacgucaccgucgcacacacuggacaacacgaucuagucauaccacccaacggcuauuuccgauucgacagcuggguaaaucaauucuacacacuagcccccaugggaaacggaaccggacgccgacgauga

SEQ ID NO: 38657 - RNA, 1617 nt, Artificial Sequence
  derived and/or modified sequence opt11 from VP1__Norovirus_and/or_Norovirus-like__JN400609
augaagauggccagcaacgacgccaaccccucagacgguucagccgccaaccuaguacccgaaguaaacaacgaagucauggcccucgaacccguugucggagccgccaucgccgccccaguugccggccaacaaaaugucaucgaccccuggauccguaacaacuucguucaagcccccggaggcgaguucaccgucucuccccgaaacgcacccggcgaaauacucugguccgccccacuaggaccagaccuaaacccuuaccucucccaccuugcacgcauguacaacggauacgccggaggcuuugaaguacaagucauacucgcaggcaaugcuuucaccgccggaaaaaucaucuucgccgccguacccccaaacuucccaacagaaggccucggcccaucccaagucaccauguucccccacauaaucgucgacguacgucaacucgaacccguccuuauuccacuaccagacguccguaacaacuucuaccacuacaaccaaucaaaugacagcacaaucaaacucaucgccaugcucuacacaccacuaagagcaaacaacgcaggagaagaugucuucaccguuucuugccgcguacuaacacgcccaucccccgacuucgacuucaucuuccucgucccaccuaccgucgaaucccgcaccaaacccuucacaguccccauccucacagucgaagaaaugaccaacucccguuuccccaucccccuagaaaaacuuuucacaggacccucuggagccuucgucguacaaccacaaaacggccgcugcaccacagacgguguacuccucgguaccacccaacucucacccgucaacaucugcacguuccgcggugacguaacacauauugcaggaucccgcaacuacaccaugaaccucgccucccucaacuggaacaacuacgaccccacagaagaaauccccgcuccccugggaacccccgacuucgucggaaaaauccaaggcguccucacacaaaccacaaaaggcgacggcucuacccgcggacacaaggccaccgucuacacuggcggcgcccccuucacucccaaacucggaucuguccaauucagcacagacaccgaaaacgacuucgaaacccaccaaaacacaaaauuuacccccguuggcgucauccaggacggcucaaccacccaccgaaacgaaccacaacaauggguacuccccuccuacucaggccgaaacguacacaauguccaccucgccccagccguagcccccaccuuucccggagaacaacuccucuucuuccgaagcaccaugccaggcugcuccggcuacccaaacauggaccucgacugccuacucccacaagaauggguucaacauuucuaccaagaggccgccccagcgcaaucugacgucgcacuccuccgauucgucaaccccgacacgggacgaguucucuucgaaugcaaacuacacaaauccggcuacgucaccgucgcccacacuggccaacacgaccugguuauaccucccaacggauacuuccgauucgacuccuggguaaaccaauuuuacacccucgcucccaugggaaacggcaccggccgucgccgcuaa

SEQ ID NO: 38658 - RNA, 1617 nt, Artificial Sequence
  derived and/or modified sequence opt11 from VP1__Norovirus_and/or_Norovirus-like__JQ613517
augaaaauggccucauccgacgccaaccccuccgacggcucaaccgccaaccucguaccagaaguaaacaaugaagucauggcacuagaacccgucguaggcgcggcaaucgccgcaccgguagccggccaacaaaacguaauagaccccuggauccgcaacaauuucguacaagcucccgguggcgaguucaccgucucaccccgaaaugcccccggcgaaauccuaugguccgcaccacucggccccgaucuuaaccccuaccucucccaccucgcucguauguacaacuccuacgccggaggauucgaaguccaagucauccuagcuggcaaugccuuuaccgccggcaaaaucauuuucgccgccgucccucccaacuuccccaccgaaggacucucucccucacaagucaccauguucccacacaucauagucgacguccgacaacuagacccaguccucaucccccuacccgacguccgcaacaacuuuuaccacuacaaccaauccaaugacccuaccaucaaacugaucgccaugcuauacaccccacuacgcgcaaacaacgcuggcgacgacguuuucaccgucuccugcagagugcucacacgacccucccccgauuucgauuucauuuuccucguaccgcccaccgucgaaucccgaacaaaacccuucuccguacccauucucaccgucgaagaaaugaccaacucccgcuucccaaucccccuugaaaaacuauucaccggccccuccucagccuuuguaguacaaccccaaaacggacgcugcacuacugacggcguccuccucggcacaacccagcuaucacccgucaacaucugcaccuuccgcggcgacguaacccacaucgccggcacccaagaauacaccaugaaccuagcaucucaaaacuggaacaacuacgacccuacugaagaaauccccgcaccccuuggcacccccgacuucgucggaaaaauccaaggcguccuaacccagaccacacgcggcgacggcuccacccgcggccacaaagccaccguaucaaccggaagcguccauuucacccccaaacuaggccgcauccaguucucaaccgacacuagcaacgacuucgaaaccggucaaaauacacgcuuuacgcccguaggcgucguccaagacggcagcaccacgcaccagaacgaaccacagcaauggguauuaccuaacuacuccggccgcgacucccacaacguccaccuugcccccgccguagcccccuccuucccaggagaacaacuacucuucuuccguucuaccaugcccggcugcuccggcuaccccaacaugaaccucgacugccucuuaccccaagaauggguacagcacuucuaccaagaggccgcucccgcacaaagcgacgucgcacuccuacguuucgucaaucccgacacaggccguguccuauucgaaugcaaacuacacaaaucaggcuacgucacugucgcucacaccggccaacaugaccucgucaucccacccaacggauacuucagauucgacucaugggucaaccaauucuacacacucgcacccaugggcaacggcaccggccgccgucgcuaa

SEQ ID NO: 38659 - RNA, 1617 nt, Artificial Sequence
  derived and/or modified sequence opt11 from VP1__Norovirus_and/or_Norovirus-like__JQ478409
augaagauggccucaaacgacgccaaccccagcgacggcucagcagccaaccuagucccagaagucaacaacgaaguaauggcccuugaaccgguaguaggugccgccaucgcggcccccgucgcaggccaacaaaacgucaucgaccccuggauccgaaacaacuucguccaagcaccgggcggcgaguucaccgucucaccccguaacgcacccggcgaaauccucugguccgcaccccucggccccgaccuaaaccccuaccuaucccaccuagcccgcauguacaacgguuacgccggcgguuucgaaguacaagucauccuagccggcaacgccuucacagcaggcaaaauaaucuucgcagccgucccacccaacuuccccaccgaagggcuauccccaucccaaguaacuauguucccccacaucauagucgacguccgucaacuagaaccuguucuaaucccacuccccgacguacgcaauaacuucuaccacuacaaccaauccaacgauuccaccauaaaacucaucgcaaugcuauacacaccacuccgcgccaacaacgccggcgaagacgucuucaccgucuccugccgcguacuaacacgcccaucaccagauuucgacuucaucuuccucguaccucccaccgucgaaucucgcaccaaacccuucacaguucccauccuuacugucgaagaaaugacaaacucucguuuuccaaucccacucgagaaacuauucaccggccccagcggagcauucgucguucaaccccaaaacggccgaugcacaacagacgggguccuacuaggcaccacacaacucucccccgucaacaucuguacuuuccgcggagacguuacccauaucgccggcucccgcaacuacacaaugaaccucgccucacucaacuggaacaacuacgaucccacagaagaaauccccgcuccccuaggcaccccugauuucguaggaaaaauacaaggcguccuaacccaaaccacaaaaggcgacgguuccacccgcggccacaaagccaccgucuacaccggcucagcccccuucacccccaaacucggcagcguccaauucucaaccgacaccgaaaacgacuucgaaacccaccaaaacaccaaauucaccccagucggcgucauccaagacggcuccacuacccaccgcaacgaaccccaacaauggguccuccccucauauucgggacguaacguccacaacguacaccucgcccccgccguagcucccaccuucccaggcgaacaacuauuauucuuucgcuccaccaugcccggcugcucuggauaccccaacauggaccucgacugccuccuaccacaagaauggguccaacacuucuaccaagaagccgcacccgcacaauccgacgucgcacuacuccgauucgucaacccagacaccggccgaguacuauucgagugcaaacuacacaaauccggcuaugucaccgucgcccacaccggccaacacgaccucguaauucccccuaacggauacuucagauucgacagcugggucaaccaauucuacacucuagcaccaauggguaacggcacgggcggccgccgcuaa

SEQ ID NO: 38660 - RNA, 1617 nt, Artificial Sequence
  derived and/or modified sequence opt11 from VP1__Norovirus_and/or_Norovirus-like__GQ856460
augaaaauggccuccaacgacgccaauccguccgacggaucugcagcuaaucuagucccugaagucaacaacgaaguaauggcccuagaacccguagucggggccgccaucgccgccccugucgcuggccaacaaaacgucauagaccccuggauccgcaauaacuucguccaagcgccaggaggcgaauuuaccgucucaccccgcaacgcccccggagaaauccuuuggucagccccacucggacccgaccucaacccauaccucagccaucucgcaagaauguacaacggauacgccggcggcuucgaaguacaagucauccucgcaggcaacgcauucaccgccgguaagaucauauucgccgccguaccgcccaacuuccccaccgaaggucuauccccaucacaaguaaccauguucccccacauaaucgucgacguacgccagcucgaaccgguccucaucccccuccccgauguacgcaacaacuucuaccacuauaaccaauccaacgacucgaccauuaaacuuauagcuaugcucuacaccccacuccgagccaacaacgcuggcgaagacgucuucacaguuucaugccguguccucacccgcccuucccccgacuucgacuucauauuccucguuccacccacaguagaaucccgaaccaaacccuucaccgucccuauccucaccguagaagaaaugacuaacucccgcuuccccaucccccucgaaaaacucuucaccgaccccuccucagcauucgucguccagccccaaaauggucgcugcaccaccgacggcguccuacucggaaccacccaacucucccccgucaauaucugcaccuuccguggagacguaacucacaucgcagguucccguaacuacaccaugaaccucgcaucccucaacuggaacaacuacgaccccacugaagaaauccccgcuccccucggcaccccugacuucgucggcaaaauccaaggcguacucacccaaaccacgaaaggagacggauccacccgcggccacaaagccacuguauacaccggcuccgcccccuucacacccaaacuaggcucaguucaauucuccacagacacagaaaacgauuucgaaacacaucaaaacacaaaauucacccccguaggcgucauccaagacggcggcacaacacaccgcaacgaaccccaacaauggguccucccauccuauuccggacgcaacgucccaaacguccaccucgcccccgccgucgccccaaccuuccccggcgaacaacuccucuucuuccgauccaccaugcccggaugcucaggcuaccccaacauggaccucgacugcccacuaccgcaagaauggguccaacacuucuaccaagaagcagcccccgcacaauccgaugucgcccuccuacgcuucgucaacccugacaccggacgaguccucuucgaauguaaacuccacaaaucuggcuacgucaccgucgcacacaccggucaacacgaccuaguaauucccccaaacggauacuuccguuucgacucguggguuaaucaauucuacacccuagcacccaugggcaacggcacaggccgccgacgcuaa

SEQ ID NO: 38661 - RNA, 1617 nt, Artificial Sequence
  derived and/or modified sequence opt11 from VP1__Norovirus_and/or_Norovirus-like__GQ856449
augaaaauggccucaaacgacgcaaacccaucagacggauccgccgccaaccuuguccccgaagucaacaacgaagucauggcccuugaaccuguugucggcgcugccaucgcagcaccugucgccggccaacaaaacgucaucgaccccuggauccgcaauaacuucguccaagcucccggcggcgaguucaccgucucaccccgcaaugcacccggcgaaauccucugguccgcaccacuaggcccggaccuuaaccccuaccucucccaccuagcccgcauguacaacggcuacgcaggcggauucgaaguccaagucauccucgccggcaacgcauucacugccgguaaaaucaucuuugccgccguucccccaaacuuccccaccgaaggccucucacccucccaagucaccauguucccccacauaauugucgacguucgacaacuagaaccuguccucaucccccugcccgacguccguaacaauuucuaccacuacaaccaauccaacgacuccacaaucaaacucaucgccaugcuuuacacgccccuccgcgcaaauaacgccggagaagacgucuucaccgucagcugcaggguccucacacgacccucacccgauuucgacuucauauuucuugucccacccacagucgaaucacgcaccaaacccuucacuguacccauccucacaguugaagaaaugacaaacucacgcuuccccauaccacuagaaaaacuauucacuggccccagcuccgcauucguaguccaaccccaaaacggucgcugcacaaccgacggaguccuacugggaaccacccaacugucccccguaaauaucugcaccuuccgaggcgacgucacccacauagccggcacccacaacuacaccaugaaccuagccucucuuaacuggaacaacuacgaucccaccgaagaaaucccagcaccccuugggacccccgacuucgucgggaaaauccaaggaguucuuacccaaacuacuaaaggcgacggauccacacgaggacacaaagccaccgucuacaccggcuccgcccccuucacccccaaacucggcuccguccaauucucaacagacaccgaaaacgacuuugaaacccaucaaaauaccaaauucaccccaguaggcguaauacaagacggaagcacaacccaccgcaacgaaccccaacaguggguacuaccaucuuacucaggcggcaacguccaaaacguccaccuagcccccgccgucgccccaaccuucccaggagaacaacuacucuucuuccgcucaaccaugccaggcugcuccggcuaccccaacauggaccucgacugcuuacucccccaagaauggguccaacacuucuaucaagaagccgcccccgcccaauccgacguugcccuacuccguuucgucaaccccgauacaggacgcguccuuuucgaaugcaaacuacacaaauccggcuaugucaccguagcccacacuggccaacacgaccuagucauaccacccaauggcuacagccgcuucgaccccugggucaaccaguucuacacacucgcccccaugggcaacggaaccggccgccguagauaa

SEQ ID NO: 38662 - RNA, 1617 nt, Artificial Sequence
  derived and/or modified sequence opt11 from VP1__Norovirus_and/or_Norovirus-like__EU921344
augaaaauggcauccuccgacgccacccccucugacggcucuaccgccaaccuagucccagaaguuaacaacgaagucauggcacucgaacccgucgucggcgccgcuaucgcggccccagucgccggucaacagaacgucauagaccccuggauccgaaacaacuucguacaagcacccggcggcgaguucaccgucucaccccgcaacgccccaggagaaauccuauggucagcuccacuaggacccgaccucaacccauaccucucccaccucgcccgaauguauaacggauacgccggcggcuucgaaguacaagucauccucgcgggcaacgccuucaccgcaggaaaaaucaucuucgccgccguaccacccaacuuccccacagaaggacuaucccccucacaaguaacuauguucccccacauaauaguagacguacgccaacuagaacccguccucaucccacucccagacguccgaaacaacuucuaccacuacaaccaauccaacgauccaaccaucaaacucaucgcuaugcuuuauacgccccuucgcgcaaauaacgccggcgacgacgucuucaccgucuccugccgaguccuaacccgccccucccccgacuucgacuucaucuuucucguaccacccaccguugaaucacgcaccaaaccauucucaguaccaauccucaccguagaagaaaugaccaacucuagauuucccaucccccucgaaaaacuauucaccggucccuccucagccuucgucgugcaaccccaaaacggccgaugcaccaccgacggcguccuccucggaaccacccaacuuucaccuguuaacauaugcaccuuccgcggcgacgucacccacaucgccggcacacaaaacuacacaaugaaccucgcaagccaaaacuggaacaacuacgaccccaccgaagaaaucccugccccucuagguacaccagacuucguaggcaaaauucaaggcaugccaacccaaacaacccgcggagacggcagcacccgcggccacaaagccaccgucucaaccggaagcguacacuucacaccaaaacucggguccguccaauucuccaccgacacauccaacgacuucgaaaccggccaaaacacaagguucaccccagugggcgucguccaagacggauccacaacacaccaaaacgaaccucaacaauggguucuccccaacuacuccggacgugacucccacaacguccaccucgccccagcuguagccccuaccuuucccggagaacagcuccucuucuuccgcucaaccaugccaggaugcuccggauacccaaacaugaaccucgacugccuccugccucaagaauggguccaacacuucuaccaggaauccgcacccgcucaauccgacguagcccuccuccguuucgucaacccagacaccggacgaguccucuucgaaugcaaacuccacaaauccggcuacgucacagucgcccacaccggccaacacgaucucguaauaccucccaacggcuacuuccgcuucgacucaugggucaaccaauucuacacauuagcccccaugggcaacggcgccggccgacgcagauaa

SEQ ID NO: 38663 - RNA, 1617 nt, Artificial Sequence
  derived and/or modified sequence opt11 from VP1__Norovirus_and/or_Norovirus-like__AB541290
augaaaauggcauccaacgacgccaaccccuccgacggcucagccgccaaucucguucccgaaguuaacaacgaagucauggcccucgaacccgucgucggagccgccaucgcggcaccagucgcaggacaacagaacgucauugacccauggauuagaaauaacuucguacaagcaccuggcggagaguucaccguaucaccccguaacgccccgggagaaauacucugguccgcaccccucggacccgaccucaaucccuaccuaucccaccucgcccgaauguacaacggcuacgccggaggauucgaaguacaagucguacuagccggaaacgccuucaccgccggcaaaauaaucuucgccgccguaccacccaauuuccccacagaaggccuaucccccucccaagucaccauguucccccacauaauaguagacguccgccaacuagaacccgugcuaauaccccuucccgacguccgcaacaacuucuaccacuacaaucaauccaacgacuccaccaucaaacuuaucgcaaugcuauacacaccccugcgcgccaacaaugccggcgaagacgucuucacagucuccugccgaguccucacccgccccagccccgacuucgacuucaucuuccucguucccccaacuguugaaagccgcacaaaacccuucacuguuccaauccucaccguagaagaaaugaccaacucucgcuuucccauuccacuagaaaaacucuucaccggaccaucaggcgccuucguaguccaaccccaaaacggacgcugcaccaccgaugggguccuacuagggaccacccaauuaucccccgucaacauaugcaccuuccgaggcgacgucacgcacauagccggcucccgcaacuacaccaugaaccucgccucacucaacuggaacaacuacgaccccacugaagagauccccgcaccccuaggaacacccgacuuugucggcaagauacagggcguacucacccagaccacaaaaggcgacggaagcacacgaggucacaaagccaccgucuacaccggauccacccccuucaccccaaaacucggcagcguccaguucuccaccgacacugagaacgacuucgagaaccaccaaaacaccaaauucacccccguaggcgucauccaagacggaggaaccacccaccgaaacgaaccacagcaauggguacuacccuccuacucaggccgcaacguccagaacguccaccuagccccagccgucgccccgacauucccuggagaacaacuccucuucuuccgcuccacaaugccaggcugcuccggcuacccaaacauggaccuagacugccuccucccccaagaauggguccaacacuucuaucaggaagccgcccccgcgcaauccgacgucgcccuacuacgcuucgucaaccccgacaccggcagagucuuauucgaaugcaaacuccacaaaucaggcuacguaacugucgcccacaccggccaacacgaccuaguaauaccacccaacggcuacuuccgcuucgacagcuggguaaaccaauucuauacccucgcccccaugggcaacggaacaggccgacgacgauaa

SEQ ID NO: 38664 - RNA, 1617 nt, Artificial Sequence
  derived and/or modified sequence opt11 from VP1__Norovirus_and/or_Norovirus-like__GQ845322
augaaaauggccucaaacgacgccaaccccuccgacgguuccgcagcuaaccucguacccgaagucuccaacgaaguaauggcacuagagccaguaguaggcgccgccaucgccgcaccagucgcaggccaacaaaacgucaucgacccauggauacgaaacaacuucguccaagcucccggaggcgaguucaccgucagcccccgaaacgcccccggcgaaauccuaugguccgcccccuuaggucccgaccugaaccccuaccucucccaccuugcccguauguacaacgguuacgccggcggcuucgaaguucaagucauacucgccggcaacgcuuucaccgccggcaaaauaauauucgccgccgucccuccaaacuuccccacagaaggccucuccccaucacaaguaaccauguucccccacaucaucgucgacguccgccaacuagaacccguccuuauaccucuaccagacguccgaaauaacuucuaucacuacaaccaaucaaaugacagcaccaucaaauuaaucgcaaugcucuacacaccccuacgcgccaacaacgccggcgaagacgucuucaccguauccugccgaguauuaacccgcccaucaccagacuucgacuucaucuuccuaguuccacccacagucgaaucacgcacaaaacccuucaccguccccauccuaacuguagaagaaaugaccaacucacgcuucccuauaccccuagaaaaacucuucacuggccccucaggugcuuucgucguccaaccccaaaacggccgcugcacaacagauggaguacuccuaggaacaacccaacucagcccaguaaacauaugcaccuuccgcggcgacgucacccacaucgcaggcucccguaacuacaccaugaaccucgcaucccuuaacuggaacaauuacgaccccaccgaagaaauccccgccccucuaggaacccccgacuucgucggcaaaauccaagggguccucacccaaaccacaaagggagacggcuccacccgagggcacaaagcaacagucuacacaggauccaccccuuucacccccaaacucggcucuguacaauucucaaccgacaccgaaaacgacuucgaaacccaccaaaacaccaaauucacacccgucggcgucauccaggacggcucaacaacucaccggaacgaaccacaacaauggguccuacccucuuacuccgggcgcgacguccacaacguccaccuagcccccgcagucgcccccaccuucccaggcgaacaacuccucuucuuccgguccacuaugccuggcuguuccggcuacccaaacauggaucucgauugccugcuaccccaagaauggguccaacacuucuaccaagaagccgcuccugcucaauccgacgucgcccuccuccgcuuuguuaaccccgacaccggucgcguccucuucgaaugcaaacuccacaaauccggauacgucacagucgcccacacaggccaacacgaccuuguaaucccacccaacggcuacuuccgcuucgacucgugggucaaccaauuuuacacacucgcacccaugggcaacggcacuggccgacgccgauaa

SEQ ID NO: 38665 - RNA, 1617 nt, Artificial Sequence
  derived and/or modified sequence opt11 from VP1__Norovirus_and/or_Norovirus-like__AB220921
augaaaauggcaucaaacgacgcuucacccuccgacggaagcaccgccaaccucguccccgaaguaaacaacgaagucauggcccuagaacccguagucggcgccgccaucgccgcccccgucgccggacaacagaacguuaucgacccauggaucagaaccaacuucguucaagcuccaggcggcgaguucacagucucaccccguaacgcacccggagaaauccucugguccgcgccacugggccccgaccucaaucccuaccugucccaucucgcacgcauguacaacggauacgcaggcggauucgaaguccaagucauccuagcaggaaacgcauucaccgccggaaaaaucauauucgccgccguucccccuaacuuccccaccgaaggccuaucccccucacaagucaccauguuuccacacaucaucgucgacguacgccaacucgaacccguccucaucccccuccccgacguacgaaacaacuucuaccacuacaaccaaagcaaugauuccacgaucaaacuaaucgccaugcucuacacaccccuccgcgccaacaacgcaggcgacgacgucuucaccgucuccugccgaguccucacccgacccucccccgacuucgacuucauauuccuugucccucccaccgucgaaucccgcacaaaacccuucaccguacccauacuaaccguagaagaaaugaccaacucccgcuuccccaucccacucgaaaaacucuucaccggucccucuucugccuucgucguacaaccccaaaacggacguugcaccaccgacggcguucuccucggaacaacccaacuaucucccgucaacaucugcaccuuccgcggagacguaauacauauccccggaacccgcaccuaccgcaugaaucuagccucucaaaacuggaacaauuacgacccaacagaagaaauccccgcaccccuagguaccccagacuuuguaggaaaaauacaaggcaugcuaacccaaacaacaaaaggcgacggcucaacccgcggacauaaagccaccgucuccaccggcucagucgacuucaccccuaaacucgguagcguacaguucgcaaccgauaccgacaacgacuucgaaaccgggcagaacacgagauucaccccagucggaguaauccaggacggcuccucugcccaccgcaacgaaccccaacaauggguucucccagacuacuccggucguaccguucauaacguccaccucgccccagcagucgcccccacguuuccaggcgaacaacuccuauucuuccgcucaaccaugccaggcugcuccggcuacccuaauauggaccucgacugccuccucccccaagaauggguacaacacuucuaccaagaagccgcccccucucaaagcgacguagcccuccuacgcuucguaaaccccgacacgggucgcguacucuucgaaugcaaacuucacaaagcaggcuacgugaccguagcccacacaggacaacacgaccucguuauacccccuaacggauacuuccgauucgacuccuggguuaaccaguucuacacccuugccccaauggggaauggcgccggucgccgccgcuaa

SEQ ID NO: 38666 - RNA, 1617 nt, Artificial Sequence
  derived and/or modified sequence opt11 from VP1__Norovirus_and/or_Norovirus-like__KX514221
augaaaauggccuccaacgacgccaaccccuccgacggcuccgccgccaaccucguccccgaagucaacaacgaaguaauggcucucgaacccgucguuggcgccgccaucgccgcucccguagcaggccaacaaaacguaaucgacccauggauccggaauaacuucguccaagcaccuggcggcgaguucaccgucagccccagaaacgcccccggcgaaauccuuugguccgcaccacucggaccugaccuaaaccccuaccuaucacaccuagcacgcauguacaacggcuacgcaggcggcuuugaaguacaagucauccuugcagguaaugcguucacugccggcaaaauuauauucgcugccguacccccaaacuuccccaccgaaggccucuccccuucacaagucaccauguucccccacaucaucguagacguccgccaacucgaaccaguccucaucccccuacccgacguccgaaacaauuucuaccacuacaaccaauccaacgacuccaccaucaaacucauugccaugcuauacacuccccuuagagccaacaaccccggcgaugacguuuucaccgucuccugccgaguucuaaccagacccucccccgacuucgacuucaucuuccucgucccaccaaccgucgaaucccgcaccaaacccuucagcguacccauccuaacugucggcgaaaugacuaacucucguuucccagucaaccucgaaagacucuuuacaggccccagcucagcuaacgucguacaaccccaaaacggccgaugcacaaucgacggagaacuacuaggaaccacccaacucucauccgucaacauaugcacauuccgcggagacguaacccacauaggcuccacccaccacuggaccaugaaccuagcauccccaaacuggaacaacuacgauccaacagaagaaaucccagcaccccucggaacccccgacuuugucggcaaaauccaaggcaugcucacacaaaccacaaaaggugaaggaucaacccguggccaccgcgccacagucuacgucggcucugccaacuacgcccccaaacuaggccgcguacaauucgaaacugacaccaccaacgaccuugacgcccaccaaaacaccaaguucacuccagucggcgucguacaaggcggcgaaucaccccaaagauccgaaccacaacaauggguacucccauccuacucaggacgagauacaccaaacguacaccuagcacccgccguagcaccaacauucccaggcgaacaacuccuuuucuuccgcucuaccauacccggcugcgguggccaccccaacaugaaccuugacugucuacuaccucaagaauggguccaacacuucuaccaagaagcagccccagcacaaucagacgucgcccuccuucgcuucgucaaccccgauaccagccgaguacucuucgaaugcaaauuacacaaaucaggcuacguaaccguagcucacacaggccaacacgaccuagucauacccccaaacggcuacuuccguuucgacuccugggucaaccaauucuacacccucgccccaaugggcaacggcaccggccgcaaacgcuaa

SEQ ID NO: 38667 - RNA, 1617 nt, Artificial Sequence
  derived and/or modified sequence opt11 from VP1__Norovirus_and/or_Norovirus-like__KY486271
augaagauggccuccucggacgcaaaccccuccgacggcucagccgccaaccuaguccccgaagucaacaacgaagucauggcacucgagccaguagucggcgccgccaucgccgcccccgucgcgggacaacaaaacgucauugacccauggauccgaaacaacuucgugcaagcucccggaggagaguucaccgucuccccucgcaacgccccaggcgaaauccuuuggucggcaccccucggccccgaccucaaccccuaccucucacaccucgcccguauguacaacggauacgccggugguuucgaaguccaaguaauccucgccggcaacgccuucacugccggcaagguaauauuugccgcuguaccacccaacuuccccaccgaaggccucucccccucccaaguaaccauguucccccacaucguaguugacguacgacaacucgagccuguccucauaccccuccccgacguccggaacaacuucuaccauuacaaccagagcaacgaccccaccaucaaacucauagccaugcucuacaccccucuuagagccaacaacgccggugacgacgucuucaccgucuccugccgcguucuaacccgacccucaccagacuucgacuucauauuccucguaccacccacaguagaaucccgcacaaaacccuucucuguacccgucuuaaccgucgaagaaaugaccaacagccgcuuccccaucccccucgaaaaacuuuucacaggccccucaucagccuucgucguccaaccccagaauggcagauguaccacagacggcguccuacucggcacaacacaacugucaccagucaacauaugcacauuccgcggcgacgucacacacauuaccggcucacgcaacuacaccaugaacuuagccucucaaaacuggaacaauuacgaccccaccgaagaaauacccgcaccacuaggcacaccugacuucguagguaaaauccaaggcaugcuaacacaaacaacccgagccgaugggucaaccagaggacacaaagccacaguauacaccggcuccgccgauuucgcccccaagcucggaagaguccaauucgaaaccgacacagaccacgacuucgaagccaaccaaaacacaaaauucacucccgucggaguuauccaggacggcucuaccacacaccgcaacgaaccccaacaauggguccuccccuccuacuccggcagaaacacccacaacguccaucucgcccccgcagucgccccuacauuccccggagaacaacuccucuuuuuccgaucuaccaugccuggcugcucagguuacccaaacauggaucuagauugccuccuaccccaagaauggguacaauacuucuaccaagaagcagcacccgcacaauccgacgucgcccuccucagauucgucaaccccgacaccggccgcguacuauucgaaugcaaacuacacaaauccggcuacgucaccgucgcccacaccggacaacaugaccucguaaucccaccaaacggauacuuccguuuugacucguggguaaaccaauucuacacucucgcccccauggggaacggcacaggccgacgccgauaa

SEQ ID NO: 38668 - RNA, 1617 nt, Artificial Sequence
  derived and/or modified sequence opt11 from VP1__Norovirus_and/or_Norovirus-like__KP784692
augaaaauggccucauccgacgcuaaccccucagacggcuccacagccaaucuaguccccgaagucaacaacgaagucauggcccuugaacccgucgucggagccgcccuagccgcucccgucgccggacaacaaaaugucaucgaccccuggauccgcuccaacuucguccaagccccaggcggcgaauuuaccgucuccccucgcaacgccccaggcgaaauccucugguccgccccacucggcccugaccucaauccauaccuaucucaccuagcacgcauguacaauggcuacgccggaggauucgaaguacaagucauccucgcagggaacgcauucacagccggcaaagucaucuucgcagcagucccaccuaacuuccccaccgaaggccuauccccaucccaagucacaauguucccacacauaaucguugacgucagacaacucgaaccaguccuaaucccauuacccgacguacgcaacaacuucuaccacuacaaccaauccaacgaaucaacaaucaaacucaucgccaugcucuacaccccacucagagccaacaacgccggugacgacguauucacagucucaugccgcguccucaccagacccagccccgacuucgacuucauauuccuugucccgcccaccguugaaucaaggacaaaaccauucuccguucccauccugaccgucgaagaaaugacuaacucccgcuuccccaucccucuagaacgccuguucacgggccccucuucagccuucgucguacaaccacaaaacgguagaugcacaaccgacggaguccuccucggaaccacucaacugucucccguaaacaucugcaccuuccgaggcgacguaacucauaccacaggcucacacaauuacaccaugaaccucgccagccaaaacuggucaaacuacgaccccaccgaagaaauuccugcaccccuaggaacccccgacuucgucggcaagauacaaggaguccuaacccaaacaacccgcgccgacggauccacccgaggccacaaagccacuguauacaccggcuccgcagacuucacacccaaacucggccgaguacaauucgccaccgacaccgaccacgacuuugacaccaaccagaacacaaaauucacccccgugggcgucauccaagacggaagcaccacccaccgaaacgaaccccaacaguggguccuuccauccuacuccggucgcaacacccacaacguccaccucgccccagcagucgcacccaccuuucccggcgaacaacucuuguuuuuccgaucaaccaugccuggcugcuccggcuaccccaacauggaccucgacugccucuuaccccaagaauggguagcccacuucuaccaggaagccgcccccgcacaaucagacgucgcucuccugcgcuucgucaacccugacaccggacgcguccucuucgaaugcaaacuccacaaauccggcuacgucaccgucgcccacaccgggcaacacgaccucgucauacccccuaacggcuacuuccgcuucgacucauggguaaaccaauuuuacacccuagcccccaugggcaacggaacaggucgacgccguuaa

SEQ ID NO: 38669 - RNA, 1617 nt, Artificial Sequence
  derived and/or modified sequence opt11 from VP1__Norovirus_and/or_Norovirus-like__KX371604
augaaaauggccucguccgacgccaacccaucagacgguagcacugcaaaccuaguccccgaagucaacaacgaaguaauggcacucgaacccguaguaggcgccgcaauugccgccccuguagccggccagcaaaacgucauagacccauggauucgcaacaacuucguacaagcccccggaggugaauuuaccguuucccccagaaacgccccuggcgaaauccucuggucugcuccccucggccccgaccuaaacccauaccuaagccaccucgcccgcauguacaacgguuacgccgggggcuucgaaguccaagucauccucgccggcaacgccuucacugccggcaagauagucuucgcugcaguucccccaaacuucccaacagaaggacuuucccccucacaagucaccauguucccccacauuaucgucgacguccgacaacuagaacccgucuuaauaccccucccagacguccgcaacaacuucuaccauuacaaccaauccaaugacccaaccaucaaacuuaucgccaugcuauacacaccccuucgcgccaacaacgccggugacgacgucuucaccgucucaugucgaguacuaacacgaccaagcccagacuucgacuucauauuccucgucccuccaaccgucgaaucucgcaccaagccauucuccguaccuguucucaccgucgaagaaaugaccaacucccgcuuccccaucccccucgaaaagcuauucacugguccuuccagcgcauucguaguucaaccccaaaacggccgcuguaccaccgacgguguccuccugggcaccacucaacucucaccugucaacaucugcaccuuccgcggcgacguuacucacaucuccggcucccgcaacuacacuaugaaccuagccucacaaaacuggaacuccuacgaccccaccgaagaaaucccagcaccccucggcacucccgacuucguaggcaaaauccaaggaguccucacacaaacaacccgcacaaacggcucaacacgaggccacaaggccaccgucuacaccggcuccgccgacuucucaccaaaacuaggccgcguucaauucgccaccgacaccgacaacgacuucgaaacuaaccaaaacaccaaauucaccccagucggagucauccaagacggaaguaccaccccacgcaacgaaccccaacaauggguccuccccucauacuccggacgcaacauacauaacguccaccucgcaccagccauagcaccaacauucccaggcgaacaacuccuguucuuccgaucaaccaugcccggaugcucaggauacccaaacauggaccuagacugccuacuuccccaagaauggguccaauacuucuaccaagaagccgcaccggcccaaucagacgucgcacuacucagauucgucaacccagacaccggccgaguccuauucgaaugcaaacuccacaaauccggcuacgucacaguagcccauaccggccagcacgaccuugucaucccaccaaacggcuacuuccgauucgacuccugggugaaccaauucuacacccuagcacccaugggcaacggcaccggccgccgccgauaa

SEQ ID NO: 38670 - RNA, 1617 nt, Artificial Sequence
  derived and/or modified sequence opt11 from VP1__Norovirus_and/or_Norovirus-like__KX354079
augaaaauggccagcagcgacgcgaaccccucagacggcucaaccgccaaccucgugcccgaaguaaacaacgaaguaauggcccuugaacccguugucggcgccgcaaucgccgcacccguagcgggccaacaaaacgucauagacccauggauccgcaacaacuucguccaagcccccggcggcgaguucacagucucuccccguaacgcccccggcgaaauccuaugguccgccccacucggucccgaucucaacccauaccugucccaccuugcccgcauguacaauggcuacgccggcggauucgagguccaggucauacuagccggcaacgcauucaccgcaggaaaaauaaucuucgccgcuguaccacccaacuuccccaccgaaggacugucgcccucccaagucaccauguucccccacauaaucgucgacgucagacaacucgaacccguccuaaucccccuccccgacgucagaaacaacuucuaccacuacaaucaauccaacgauccaacaauaaaacuaaucgccaugcuauacacgccacuccgcgccaacaacgccggagacgacguauucaccgucuccugccgcguccucacccgccccucacccgacuucgacuucaucuuccuagucccacccacuguagaaucccgaacuaaacccuucucaguccccguccuaaccguagaagaaaugaccaacagccgguuccccaucccccuagaaaaacucuucacgggccccucuucagcauucgucguccaaccccaaaacggucgcuguaccaccgacgguguccuccuaggcaccacacaacucucaccaguaaacaucugcacuuuccgaggcgacgucacacacauaucuggcagccgcaacuacaccaugaaccucgccucccaaaacuggaacucauacgauccaaccgaagaagugccagcaccccuaggcaccccagauuucgugggcaaaauacaaggcguacuaacccaaacaacccgcaccgacggcuccacacgcggucacaaagccacagucuacaccggaucagccgacuucucccccaaacuaggccgcguccaauucgccacugauacagacaacgacuucgucgccaaccagaacaccaaauucaccccagucggcgucauccaagacggcucaaccacaccccgaaacgaaccacaacaauggguacugccaaguuacuccggcagaaacacucacaacguccaccuugcccccgccguagcacccacauucccaggcgaacaacuccuauucuuccgcucaaccaugcccggcuguuccgguuaccccaacauggaccuagacugucuacucccacaagaauggguccaauauuucuaccaagaagcagccccagcccaauccgacgucgcccuccuacgcuucguaaaccccgacaccggccguguccucuucgaaugcaaacuacacaaaucaggauacgucacagucgcacacaccggccagcacgaccuuguuaucccacccaacggcuacuucagauucgacuccugggucaaucaauucuacacccuagcccccaugggaucaggcaccggacgacgacgcuga

SEQ ID NO: 38671 - RNA, 1617 nt, Artificial Sequence
  derived and/or modified sequence opt11 from VP1__Norovirus_and/or_Norovirus-like__KX354028
augaaaauggcauccagcgacgccaaccccuccgacggcucagccgcgaaccucguccccgaaguaaauaacgaagucauggcccuggagcccguagucggcgcagccaucgcugcacccgucgccggccaacaaaaugucauagaccccuggauccguaacaacuucguccaagcccccggcggagaauuuaccgucuccccacgcaacgcucccggugaaauccugugguccgcuccccucggccccgaccuaaaccccuaccucucucacuuagcacgcauguauaacggcuacgccggaggcuucgagguacaaguaauccucgccggcaacgccuucacagcagguaaagucauauucgcagcaguacccccaaacuucccaaccgaaggccucucacccucacaagucaccauguucccacacaucgucguggacguccgccaacuagaaccagugcucauaccacuuccagacguacgaaacaacuucuaccacuauaaccaauccaacgacccgacaaucaaacuaaucgccaugcucuacacaccccuacgcgcaaacaacgccggcgacgacgucuucaccguguccugccgaguacuaacccgucccuccccagacuuugacuucauauuccuagucccucccaccgucgaaucccgcacaaagcccuucuccguccccguccucaccguggaagaaaugaccaauucuagauuuccaauaccacuagaaaaacucuucaccggccccuccagcgcauucgucguccaaccccaaaacggccgcugcacuaccgacggaguccuccucggcaccacccaacucucacccgucaacaucugcacauuccggggcgacgucacccacauaacggguucccgcaacuacacaaugaaccucgcuucccaaaacuggaacaacuacgaccccaccgaagaaaccccagcaccacucggcacucccgauuucguaggaaaaauacaaggcguacucacccaaaccacccgcaccgacggcucaacccgcggccacaaagccaccgucuacacaggcagcgcagacuucgcucccaaacucggccgaguccaauucgaaaccgacaccgaccacgacuucgaagccaaccaaaacacuaaauucacuccugucggaguaauccaagacggauccaccacacacagaaaugaaccacaacaauggguccuccccucauacuccggccgcaauacacacaacguccaccucgccccagcagucgcccccacauuccccggugaacaacucuuauucuuccgcuccacaaugccaggcuguucagguuaccccaacauggaccucgacugccuccucccacaagaauggguucaauauuucuaccaagaagccgcccccgcccaauccgacgucgcacuccuacgcuuuguaaaccccgacaccggucgcguccucuucgaaugcaaacuccacaaaucuggcuacguuacaguagcgcacaccggccaacacgacuuagucauuccacccaacggcuacuuucgauucgacucaugggucaaucaauucuacacucucgcuccgaugggcaacggaacagguagacgccgcuaa

SEQ ID NO: 38672 - RNA, 1617 nt, Artificial Sequence
  derived and/or modified sequence opt11 from VP1__Norovirus_and/or_Norovirus-like__KX353983
augaaaauggcaucaagugaugccaacccauccgacggauccaccgcaaaccuagucccggaaguaaacaacgaagucauggcccucgagccugucgucggcgcagccaucgccgccccagucgcaggucagcaaaaugucaucgaccccuggauaaggaauaauuucguccaagcacccggcggcgaguucacuguauccccaagaaacgcucccggcgaaauccucuggucugcaccccucggacccgaccucaaccccuaccucucccaccuagcccgcauguauaacggcuacgccggcggcuucgaagugcaaguuauacucgccggaaacgccuucaccgccgggaaaauuguuuucgccgccguaccacccaacuuccccacggaaggccuaucccccucccaagucaccauguucccccacaucauagucgacguccgacaacucgagcccguacuuaucccacuccccgacguccguaacaacuuuuaccacuacaaccaauccaacgacccaaccaucaaacucauugccaugcuguacacaccccuucgagccaacaacgccggcgacgacgucuucacagucuccugcagaguacugacccgcccaucacccgacuucgacuucauauuccuaguaccacccaccgucgaaucucgaaccaaaccauucucaguccccguccucacagucgaagagaugacaaacucacgcuucccaauuccccucgaaaaacucuucacagggcccucaucagcauucguaguacaaccccaaaacggccgcugcacaacggacggcguacuauuaggcacuacccaauuaucccccguaaacaucuguacauuccgaggagacgucacccacaucuccggcucacgaaacuacacaaugaaccucgcaucccaaaacuggaacucauacgaccccacagaagagauccccgcuccccucggaaccccugacuucgucgguaaaauccagggcguccucacccaaaccacacggacagacggcuccaccagaggccacaaagccacagucuacacagguucugccgacuucuccccaaaacuuggacguguacaguucgccaccgacaccgacaacgacuucguuacaaaccaaaacaccaaauucacccccguaggcguaauccaagacggauccaccacaccacgaaacgaaccccaacaauggguacuucccuccuacuccggacgcaacacccacaacguccaccuagcccccgccgucgcccccacguuccccggcgaacaacuccucuucuuccgcagcaccaugcccggaugcuccggcuaccccaacauggaccucgauugucuucucccccaagaauggguccaauacuucuaccaagaagccgcacccgcacaaagcgacgucgcccuucuccgcuucgucaaucccgauacuggccgcguacuauucgagugcaaacuccacaaaucaggcuacgucacagucgcccacacaggccaacacgaccuagucaucccgcccaacggcuacuuccgcuucgacagcugggucaaccaauucuacacccuugcaccaaugggcaacggcaccggacgccgccgcuaa

SEQ ID NO: 38673 - RNA, 1617 nt, Artificial Sequence
  derived and/or modified sequence opt11 from VP1__Norovirus_and/or_Norovirus-like__AB972511
augaaaauggccagcaaugacgccaaccccuccgacggacccgcugccaaccugguccccgaaguuaacaacgaagucauggcccuagaacccguuguaggagccgccaucgccgcaccugucgccggucaacaaaaugucaucgacccuuggauccgcaacaacuucguccaagccccuggaggugaguucacagucucuccacgaaacgcccccggugaaauccucugguccgcuccccucggccccgaccucaaccccuaccucucucaccucgcccgaauguauaacggcuacgccggaggcuucgaaguacaaguuauccuugccggaaacgccuucacagccggcaaaauuaucuucgccgccgucccacccaacuuccccaccgagggccucucacccucccaagucaccauguucccacacaucaucguugacguccgucaacucgaacccguccuuaucccccuccccgacguucguaacaacuucuaccacuauaaccaauccaacgacucuaccaucaaacucaucgccaugcucuacacuccccuccgcgccaacaacgcaggagaagacgucuuuacagucucuugccgaguucuaacccgccccucccccgacuucgacuucaucuuccucgucccgcccaccgucgaaucccgcacuaaacccuuuacaguaccaauccuaacggucgaagaaaugacaaacucccgcuuucccaucccccucgaaaaauuguucaccggccccagcuccgccuucguaguccaaccccaaaacggacgaugcacuacagacggcguccuucuaggcacuacccagcucucccccgucaacauaugcacauuccgcggcgacgucacccacaucgccggcucccgcaacuacaccaugaaccucgccagccucaauuggaacaacuacgaccccacugaagaaauccccgcaccccucggcaccccagacuucgucggcaaaauacaaggaaugcucacccaaaccaccaaaggagacggcuccacacgaggccacaaagccacuguuuacaccggcucugcgcccuucacccccaaauuaggcuccguccaauucgaaacagacaccgaaaacgacuucgaaacccaccaaaauaccaaauucacccccguaggcgucauccaagacggaggcacgacccaccgaaacgaaccacaacaguggguccuaccaagcuacucaggccgaaacguccccaacguccaccuagcgccagccgucgcccccaccuuccccggcgaacaacuacucuucuuccgcuccaucaugccaggcuguuccggcuaucccaacauggaccuagacugccuucuaccgcaagaauggguccaacacuucuaccaagaagccgcgcccgcacaaagcgacguagcccuacuccgcuucgucaaccccgacaccggacgaguucuauucgaaugcaaacuacacaagagcggauacgucaccguagcccacaccggccagcacgaccuaguaaucccaccaaacggcuacuuccgcuucgacuccuggguaaaccaauucuacacccucgcacccaugggcaacgguacaggccgccgccgcuaa

SEQ ID NO: 38674 - RNA, 1617 nt, Artificial Sequence
  derived and/or modified sequence opt11 from VP1__Norovirus_and/or_Norovirus-like__AB972478
augaaaauggcaagcucagacgcaaaccccaccgacggcucagcugccaaccucguaccugaagucaacaacgaagucauggcacuagaaccagucgucggggcagccauagccgcccccguggccggccaacaaaacgucauagaccccuggauacgcaacaacuucguccaggcaccgggcggcgaauuuaccguaucaccccgaaacgcuccaggagaaauccuuugguccgcaccccucggccccgaccucaaucccuaccuaucccaccuugccagaauguacaacggauacgcaggcggauucgaaguccaagucauccucgcaggcaacgccuucaccgcaggcaaagucaucuucgccgccgucccaccaaacuucccuaccgaagggcucagcccaucucagguaaccauguucccacacauagucguggacguccgccaacuugaacccguacucaucccucucccagauguccgcaauaacuucuaccacuacaaucaaucaaacgaccccaccaucaaacuaauagccaugcucuacacaccacuacgcgccaacaacgccggagacgacgucuucaccguauccugccgaguccuaacccgacccucccccgacuucgacuucaucuuccuuguaccuccaaccgucgaaucccgaacgaaaccauucuccguccccguccuaaccgucgaagaaaugaccaacucacgcuuccccaucccucucgaaaaacuuuucaccgggcccuccucagccuucgugguacaaccacaaaacggacgcugcaccaccgauggcguccuccucggcacaacucaacuguccccugucaacauaugcaccuuccgcggcgacgucacacacaucaccggauccagaaacuacaccaugaacuuagcaucacaaaacugguccaacuacgacccaaccgaagaaauacccgcaccccucggcaccccggacuucguaggaaaaauccaggggguacuaacccaaaccacacgcacugacggcuccacucgcggacacaaagccaccguauacacagguagcgccgacuuugccccaaaacucggaagaguacaauucgaaaccgacacagaccacgacuucgaagcaaaccaaaacaccaaauucacccccguaggcgucauccaagacggcucaacuacccaccgcaacgaaccccaacaguggguacuccccucauacuccggccgcaacacacccaacguucaccucgcacccgccguagcccccacauucccuggggaacaacuacucuucuuucgcucuaccaugccaggaugcuccggcuaccccaacauggaccuagacugccuccuaccacaagaauggguccaguacuucuaccaagaagccgcacccgcccaaucagacgucgcacucuuacgcuucgucaaccccgacaccggcagaguucucuuugaaugcaaauuacacaaauccggcuacguuacugucgcccacaccggacaacacgaccucguaaucccucccaacggcuauuuccgauucgacagcugggucaaccaauuuuacacccucgccccaaugggcaacggcaccggacgccgccgauag

SEQ ID NO: 38675 - RNA, 1617 nt, Artificial Sequence
  derived and/or modified sequence opt11 from VP1__Norovirus_and/or_Norovirus-like__KT780382
augaaaauggcauccuccgacgccaacccauccgacgguagcgccgccaaccuaguccccgaaguaaacaacgaagucauggcacucgaacccgucgucggcgccgccaucgccgcccccgucgccggccaacaaaacguaauagacccauggauccgcaacaacuucguacaagccccaggaggagaguucaccgucucaccacgcaacgccccaggugaaauccuaugguccgcaccccuaggacccgaucuaaaccccuaccucucacaccuagccagaauguacaacggauacgccggaggauucgaaguccaaguaauucucgccggcaaugccuucaccgccggcaaagucauuuucgcagccguaccacccaacuuccccaccgaaggacuaucccccucccaaguaaccauguucccccacauaguuguagacguccgacaacuagaacccguacuaaucccccuucccgacguccgaaacaacuucuaccacuauaaccaaagcaacgaccccaccaucaaacucaucgcaaugcuauacacuccucuccgcgccaacaacgcaggagacgacguauucacagucagcugccgcguccuaacccgccccagccccgacuucgacuucaucuuccucgugccucccaccguugaaucccguaccaaacccuucuccguacccgucuuaaccgucgaagaaaugacuaacucccgcuuccccaucccacuagaaaaacuauucaccggcccaucauccgccuucgucguacaaccacaaaacggccgaugcaccaccgacggaguccuccuaggaacaacacagcuaucacccgucaacaucugcacuuuccgcggcgacgucacacacaucacuggcucucgcaacuacacaaugaaucuagccucccaaaacuggucgaacuacgaccccaccgaagaaauuccugcaccacucggcaccccggacuucgucggaaaaauccaagguguccucacucaaaccacccgaaccgacggcucaacccgcggacacaaagcaacaguauacaccggaagcgccgacuucgcacccaaacucggacgaguucaguucgaaaccgauacugaccaugacuucgaagccaaccaaaauaccaaauuuaccccagucggagucauccaagacggaggcacaacacaccgcaaugaaccccagcaauggguccuacccucauacagcggccgaaacaccccaaacguccaccucgccccagcggucgcaccaaccuuccccggagaacaacuccucuuuuuccguagcaccaugcccggcugcagcggcuaccccaacauggaccucgacugcuuacucccccaagaauggguccaauacuucuaccaagaggcagcccccgcacaguccgacguagcccuccucagauuugugaaucccgacacaggacgaguccucuucgaaugcaaacuccacaaguccggcuacgucaccgucgcacacacaggccaacacgaccuagucaucccucccaacggcuacuuccgauucgauuccugggucaaccaauucuauacccucgcccccaugggaaacggcacaggaagacgccgcuaa

SEQ ID NO: 38676 - RNA, 1617 nt, Artificial Sequence
  derived and/or modified sequence opt11 from VP1__Norovirus_and/or_Norovirus-like__KT033905
augaaaauggccuccaacgacgcuaacccaucggacggcucagcagccaaccucguuccuaaagucaacaacgaaguuauggcacucgaaccaguaguaggagccgccaucgccgccccaguagcuggccaacaaaacgucaucgaccccuggauccgaaacaacuucguccaagcccccgguggaaaauucaccgucucuccacgcaacgcacccggcgaaauccucugguccgcaccccuuggccccgaccucaauccauaccuaucacaccuugcacgcauguauaacggcuacgcuggcggcuucgaagugcaagucauccucgccggaaacgccuucacagcaggcaaaaucaucuucgcagccguuccacccaacuucccaaccgaaggccucuccccaucccaagucaccauguucccacacaucaucguagacguccgccaacucgaaccaguacuaaucccccuacccgacguccgcaacaacuucuaucacuacaaccaauccaacgacuccacaauuaaacuaauugccaugcucuacacaccccuacgagcaaacaacgccggcgaagacguauuuaccgucucguguagaguccucacucgaccaucccccgacuucgacuucaucuuccugguacccccaaccguagaaucucgaacaaaacccuucacuguccccauccuuaccgucgaagaaaugaccaacucucgcuucccaaucccccucgaaaaacucuuuacggguccauccggugccuucgucguccaaccccaaaacggucgcugcaccaccgacggcguccuccuaggcaccacccagcuuucccccguaaacaucuguaccuuccgaggagacgucacccacaucgccggcucccgaaacuacacaaugaaccuagccucccuaaacuggaacaacuacgaccccaccgaagaaaucccagcaccccuaggcaccccagacuucgucggcaaaauacaaggaguccucacccaaaccaccaaaggcgacggcucaacacgcggccauaaagcgacagucuacaccggaucugcaccauucaccccaaaacugggcuccguccaauucuccacagacaccgaaaacgacuucgaaacccaccaaaacaccaaauucaccccuguaggaguaauccaagacggcggcaccacccaccgaaacgaaccccaacaauggguacuccccucauacuccggcagaaauguccacaauguccaccuugccccagccguagcccccaccuuccccggagaacagcuccucuuuuuccguucaaccaugccagguugcuccggcuaccccaacauggaccuugacugccuucucccccaagaauggguccaacacuucuaccaagaggccgcccccgcccaauccgacgucgcacucuuacgcuuugucaaccccgacaccggacgcguccucuucgaaugcaaacuccacaaauccggauacguaaccgucgcacacaccggccaacacgaccuagucaucccacccaacggcuacuuccgcuucgacucgugggucaaucaauucuacacccuugcccccauggguaacgggacaggccgccgccguuaa

SEQ ID NO: 38677 - RNA, 1617 nt, Artificial Sequence
  derived and/or modified sequence opt11 from VP1__Norovirus_and/or_Norovirus-like__KR904207
augaaaauggccucuucagacgccaaccccuccgacggcuccaccgccaaccucgucccugaagucaacaacgaagucauggcacucgaacccguaguaggcgccgcaauagccgcuccagucgccggccagcaaaacgucauugaccccuggauccgcaacaacuucguccaagcccccggcggcgaguucacagucuccccacgaaaugcccccggcgaaauccucuggucggcaccccucggccccgaccucaacccauaccuuucucaccucgcccgcauguacaacgguuacgccggcggauucgaaguccaagucauacucgcaggcaacgccuucaccgcuggcaaaaucaucuucgcugccgucccacccaacuuccccacugaaggccucucccccucacaagucaccauguuuccacacauaaucgucgacguccgacaacucgaacccgugcuaaucccccuaccagacguacgaaacaacuucuaccacuauaaccaaucaaaugauccaaccaucaaacucaucgccaugcuuuacacaccccuacgcgcaaacaacgccggcgacgaugucuucaccguuuccugucgaguccucacccggcccuccccagacuucgacuucaucuuucuugucccacccaccgucgagucccgcacuaaacccuucucaguaccgauccucaccgucgaagaaaugaccaacucacgcuuucccauuccccucgaaaaacucuuuacugguccuuccuccaccuucgucguucaaccccaaaacggccgaugcaccacagauggcguccuacucggcacaacccaacuaucgcccgucaacaucugcacuuuccgcggagacgucacccauaucgccggaucccacaacuacacuaugaaccuagccucccaaaacuggaacuccuaugaucccaccgaagaaauaccugcaccccucggcacaccagacuuugucggaaaaauccaaggcguccucacccagaccacccgaaccgacggguccacccgcggacacaaagcaacaguauacaccggcuccgccgauuccucaccaaaacuuggccgaguccaauucgccaccgacaccgacaacgacuucguagccaaccaaaacaccaaauucacacccguuggcgucauacaagacgguggaaccgcacaccgcaacgaaccucaacaauggguacuuccuucauacucaggccgaaacacccacaacguacacuuagcccccgcaguagcccccacauucccaggagaacaacuccuauuuuuccgauccacaaugccaggaugcuccggcuaucccaacauggaccucgacugccuccuaccacaagaauggguccaauacuucuaccaagaagccgccccugcacaaagcgacgucgcacuccuucgcuucguuaaccccgacaccggccgaguccuauuugagugcaaacuccacaaauccggcuacgucacccaagcacauaccggacagcacgaccucguuaucccacccaacgguuacuucagauucgacucauggguaaaccaauucuacacccucgcccccaugggcaacggaaccggccgccgccgcuaa

SEQ ID NO: 38678 - RNA, 1617 nt, Artificial Sequence
  derived and/or modified sequence opt11 from VP1__Norovirus_and/or_Norovirus-like__KJ678151
augaaaauggccuccucagacgccaaccccuccgacgguucagccgccaaccucguccccgaggucaacaacgaagucauggcccucgaacccguaguaggcgcagccaucgccgcccccgucgcuggucaacaaaacguaaucgaccccuggauucgaaacaauuucguccaggcacccggaggcgaguucaccgucucaccccgcaacgccccuggcgaaauacucugguccgcuccccugggcccagaccucaacccuuaccuaucccaccucgcccgcauguacaacggcuacgcaggcggcuucgaaguacaagucauccuugccggcaacgccuucaccgcagguaaaguuaucuucgcagccgucccaccuaacuucccuaccgaaggccuaagcccaucccagguuacgauguucccacacauaguaguugacguccgccaacuugaaccuguacuaaucccucuaccagacguccgcaacaacuucuaccacuacaaccaauccaacgaccccaccauuaaacuaaucgccaugcuuuacaccccacuccgugccaacaacgccggcgacgacguauucacagucagcugccgcguccucacccgccccucccccgacuuugacuucaucuuucuaguacccccaaccgucgaauccagaaccaaacccuucuccguccccgugcucacagucgaagaaaugacaaacucacgauucccaacaccacucgaaaaacuuuucaccggacccuccuccgccuuugucguacaaccacaaaacggccgauguaccaccgacggcgucuuacucggcacaacccaacucucucccguaaacaucugcacauuccgcggcgacgucacccauauuaccggaagccgcaacuacacaaugaaccuagccucccagaacugguccaacuacgaccccaccgaagaaauccccgcucccuuaggcacccccgauuucgucggcaaaauacaaggaguccuaacccaaacaacaagaacugacggcuccaccagaggccacaaagcaacuguauacacaggaagugccgacuucgcaccaaaacucgggcgcguccaauucgaaacagacaccgaccacgacuuugaaaccaaccaaaacaccaaauucacaccagugggcgucauccaagacggcucaaccacccaccgcaacgaaccccaacaauggguccuucccucauacuccggucgcaacacaccaaacguucaccucgcacccgccgucgcucccacuuucccuggcgaacaacuucucuuuuuccgcuccaccaugcccggcugcuccggcuaccccaacauggaccuggacugccuucucccacaagaauggguacaauacuucuaccaagaagccgcccccgcacaauccgauguagcccuucuacgauucgucaaccccgacaccggacgcguccuauuugaaugcaaacuacacaaaucaggcuacgucaccguugcccauaccggccaacacgaccucguaauaccacccaacggauacuuccgauucgacuccugggucaaucaauucuacacccucgcccccaugggaaacggcaccggacgccgaagauaa

SEQ ID NO: 38679 - RNA, 1617 nt, Artificial Sequence
  derived and/or modified sequence opt11 from VP1__Norovirus_and/or_Norovirus-like__KJ678143
augaaaauggccagcuccgacgccaaccccucugaugguucagccgcaaaccucguccccgaagucaacaacgaagucauggcacuagaacccguaguaggugcagccauagcagcacccguagccggucaacaaaacgucaucgaccccuggauucgaaacaacuucguccaagccccaggaggugaguucaccguaagcccacgcaacgcacccggcgaaauccuauggucagcaccccucggcccagaucuaaacccauaucuaucccaccuggcacggauguauaacggguaugccggcggcuucgaaguccaaguuauacucgcaggcaacgccuucaccgccggcaaagucauauucgcugccgucccacccaauuuccccaccgaaggccuuucccccucccaaguaaccauguucccccacaucgucguagacguacgccaacuagaacccguccucaucccacuuccggacguacgcaacaacuucuaccacuacaaccaaucaaacgaccccaccauaaaacucaucgccaugcuauacacgccacuccgcgcaaacaacgccggugacgacguuuucaccgucucaugccguguccuaacccgaccaucccccgacuucgacuucaucuuucucguacccccaacagucgaaucccgcacaaaaccauuuuccgucccuguccuuacugucgaagaaaugaccaacucaagauuccccaccccacuugaaaaacucuuuaccggccccucaucggcauucgucguccagccccaaaacggccgaugcacaacugacggcguccuacucggaaccacccaacucucccccguaaacaucuguaccuuccgcggcgacgucacccacaucaccggcucccgcaacuacacuaugaaccucgccucccaaaacugguccaacuaugacccaacagaagaaauccccgcgccucuuggcaccccagacuuuguagguaaaauacaaggcguccucacccaaacgacccgcaccgacggauccacccgcggccauaaagccaccgucuauaccggcuccgccgacuucgcccccaaacucggccguguacaauucgaaaccgacaccgaccaugacuucgaagccaaccaaaacacaaaauucacccccguuggcgucauccaagacggcucaaccacccacagaaaugaaccucaacaauggguccuccccucauacucgggaagaaauacaccaaacguccaccucgccccugccguagcccccacauuccccggcgaacaacuacuauucuuccgcagcaccaugcccggaugcucuggcuaccccaacauggaccucgacugccuccuuccccaagaauggguacaauacuucuaucaagaagcugcccccgcccaaagcgauguagcccuccuccgauucguuaaccccgacacuggcagaguccucuucgaaugcaaacuccacaaaucaggcuacguaaccgucgcccacacaggucaacacgaccuggucaucccuccaaacggcuacuuccguuucgacuccugggucaaucaauucuauacacucgcacccaugggcaacggcaccggccgcagacgauaa

SEQ ID NO: 38680 - RNA, 1617 nt, Artificial Sequence
  derived and/or modified sequence opt11 from VP1__Norovirus_and/or_Norovirus-like__KP698927
augaaaauggccuccuccgacgcaaaucccuccgacggcuccgccgcaaaccuaguaccugaaguuaacaacgaagucauggccuuagaacccgucgucggcgcggccauagccgccccaguagcaggccaacaaaacguuaucgaccccuggauccgcaacaacuucguccaagccccaggcggcgaguucaccgucucaccccgcaacgcccccggcgaaauccucugguccgcaccucuugggcccgaccuaaacccauaccucucccaccucgcacgcauguacaacggauacgcaggcggauucgaaguccaagucauccucgcaggaaacgccuuuacagccggaaaagucaucuucgcagccguucccccaaacuuccccaccgaaggccucuccccaucccaagucaccauguucccccacauagucgucgacguucgacaacucgaacccguccucauuccccuccccgaugucaggaacaacuucuaccacuacaaucaauccaaugaccccacgauaaaacucaucgccaugcucuacaccccacuuagagccaacaacgccggcgacgaugucuucacugucuccugccgcguccugacccgcccaucacccgacuucgacuucauauuccucgucccucccaccgucgaaucccgcaccaaacccuucucaguacccguacucaccgucgaagaaaugaccaacucacgcuucccaauaccccuagaaaaacucuucaccggcccauccuccgccuucgucguccaaccccaaaacggccggugcaccaccgacggcguucuccucggcacaacccaacuaucucccguaaacauaugcaccuuccgcggcgacgucacccacaucacaggaucacgaaacuacaccaugaaccuagccucccaaaacugguccaacuacgacccaacugaagaaauccccgcuccgcucggcacaccagacuucgucggcaaaauccaaggcgucuuaacccaaacaacucgcaccgacggcuccacacgcggucacaaagccacugucuacaccggaucagccgacuucgcccccaaacuaggccgcguccaauucgaaaccgacacagaccacgauuucggcaccaaccagaacacaaaauucaccccaguuggcguaauacaagacggaucaacaacccaccgaaacgaaccacaacaguggguacuccccuccuauuccggucgaaacacccccaacguccaccuagccccagcagucgccccaacauuccccggcgagcaacuccuauucuucagauccacaaugcccggcuguuccggauaccccaacauggaccucgauugccuacuaccccaagaguggguacaauacuuuuaccaagaagccgcccccgcccaaucagacgucgcucuccuacgcuuugucaaccccgacacugggcgcguacuauucgaaugcaaacugcacaaguccggcuacgucacaguagcccacacaggccaacacgaccucgucaucccacccaacggauacuuucgauucgacuccuggguaaaccaauucuacacacucgcacccaugggcaacggcacaggcagacgucgcuaa

SEQ ID NO: 38681 - RNA, 1617 nt, Artificial Sequence
  derived and/or modified sequence opt11 from VP1__Norovirus_and/or_Norovirus-like__LC005730
augaaaauggccuccagcgacgccaaccccagcgacggauccgccgcaaaccuaguccccgaagucaacaacgaaguuauggcccuagaacccguugucggcgcagcaaucgcugcacccgucgcuggccaacagaacguuauagaccccuggauccgcaacaacuucguccaagcccccggcggcgaguucacgguaucaccccgcaaugcacccggcgaaauccuuuggucugcaccccuagguccagaccucaacccauaucuaucccaccuagcucgcauguacaacggauacgccggaggcuucgaagugcaagucauccucgccggcaacgccuucaccgcaggcaaagucaucuuugccgccgucccaccaaacuucccaacugaaggccucuccccaucccaaguaacaauguucccacacauuguggucgacguacgacaacuagaacccguacuaauaccacucccagacguacgcaacaacuucuaccacuacaaccaaucaaaugaucccacgaucaaacucaucgccaugcucuacacaccccuacgagcaaacaaugccggagacgacguauuuaccgucuccugccgaguccucaccagaccaagccccgacuucgacuucauuuuccuugucccaccuaccgucgaaucccgcaccaagcccuucuccguacccguacuaaccguagaagaaaugaccaacagccgcuuuccaauaccccucgaaaaacucuucaccggccccuccuccgcauucgucguccaaccgcaaaacggacgaugcaccaccgacggaguccuacucgguacaacacaacucucacccguaaacaucugcaccuuccgcggcgacgucacccacaucaccggaucccgcaacuacaccaugaaucuagccucacaaaacugguccaacuaugaccccaccgaagaaauccccgccccacuaggcacucccgacuucguaggaaaaauccaaggcguccucacccaaaccaccagaaccgauggcuccacccgcggacacaaagccacagucuacaccggcuccgcagacuuugccccaaagcucggccgcguccaauucgaaaccgacaccgaccacgacuucgaagccaaccaaaauacuaaauuuacacccgucggagucauccaagacggaggaaccacacaccgaaacgaaccccaacaauggguccuccccucuuacucaggaagaaacacacacaacguccaccuugcccccgccgucgcaccaacauuccccggagaacaacuacucuucuuccgaucaaccaugccuggcugcuccggcuacccaaacauggaccucgacugccugcucccacaggaauggguccaauacuuuuaccaagaagccgcccccgcccaaucagacguagcacuccuccguuucgucaaccccgauaccggacgcguacuuuucgaaugcaaacuucacaaauccggcuacgucacugucgcccacacaggccaacacgaccucgucauuccacccaacgguuacuuccgcuucgacuccugggucaaccaauucuacacccucgcccccaugggcaacggaaccggccgcaggcgcuaa

SEQ ID NO: 38682 - RNA, 1617 nt, Artificial Sequence
  derived and/or modified sequence opt11 from VP1__Norovirus_and/or_Norovirus-like__LC005714
augaaaauggcaucaucugacgcaaaucccuccgauggcucugccgccaaccucguaccagaaguaaacaaugaagugauggcacuugaacccgucgucggagccgccaucgccgcgcccgucgcaggucaacaaaacgucaucgacccauggauccgcaauaacuucguccaagccccaggcggagaauuuaccgucuccccgagaaacgcccccggagaaauccucugguccgccccacuaggccccgaccuaaauccuuaccucucacacuuagcacgcauguacaacggcuacgcgggcggcuucgaaguacaagucauccucgcuggcaacgccuucaccgccggcaaaaucaucuucgccgccguuccaccaaacuuccccaccgaaggacuaucccccucccaaguuaccauguucccccacauaaucgucgacguccgacaacuagaacccguucuuaucccgcuacccgacguccgaaacaacuucuaccacuacaaccaauccaacgacucaaccaucaaacucauagccaugcucuacacuccccuacgagcaaacaaugccggagaagacgucuucaccguauccugccgcguacucacccgccccucccccgauuucgacuucauauuucuaguaccacccaccgucgaaucccgcaccaaacccuucacagucccaaucuuaaccgucgaagaaaugaccaacucccgcuuccccauaccucucgaaaaacucuucaccggcccauccagcgcauucguaguacaaccccaaaacggccgaugcacuacagacgguguccuccucggcaccacacaacuaucccccgucaacaucuguaccuuccgaggcgacgucacccacaucgccgguucccgcaacuacaccaugaaucucgccucccuaaacuggaacaacuacgaccccaccgaagaaauccccgccccacuagguacccccgacuucgucggcaagauccaagguaugcucacccaaaccaccaaaggcgauggcucaacccgcggacacaaagccaccguuuacacaggcuccaccccauucacacccaaacuaggcuccguacaguucucuaccgacaccgaaaacgauuuugaaacccaccaaaacacaaaauucacccccgucggcgucauccaagauggcuccacaacacaucgcaacgaaccacaacaauggguauuaccaagcuacucaggccgcaacgugcccaacguccaccucgcccccgccgucgccccaaccuucccaggcgaacaacuccucuucuuccgauccaccaugccaggcugcuccggcuaucccaauauggaccucgacugccuccucccccaagaauggguccaacacuucuaccaagaagccgccccagcccaaucugacgucgcccuacugcgcuucguaaacccggacacaggacguguacucuucgaaugcaaacuacacaagagcggauacgucacagucgcccacaccggucaacacgaucuggucauacccccuaacggcuacuuccgcuucgacucuugggucaaccaauucuacacccuagcuccuaugggcaacggcacgggccgcaggcgcuaa

SEQ ID NO: 38683 - RNA, 1617 nt, Artificial Sequence
  derived and/or modified sequence opt11 from VP1__Norovirus_and/or_Norovirus-like__KP241906
augaaaauggccuccuccgacgcaaauccuuccgaugguuccgcugccaaccucgucccagaagucaauaacgaagucauggcccuugaaccaguagucggcgccgcuauagcagcacccgucgcaggacagcaaaacguaaucgaccccuggaucagaaacaacuucguccaagccccugguggcgaguucaccgucucaccccgcaacgccccaggcgaaauacucugguccgcuccccuaggccccgaccuuaacccguaccuaucccaccucgcccgcauguacaacggcuacgccggcggcuucgaaguccaagucauccucgcuggcaacgccuucacugcaggcaaaguuaucuucgccgccguacccccaaacuucccaacagaaggccucucacccucucaagucaccauguucccgcacaucguagucgacguccgccaacucgaacccguccuaaucccacuccccgacguacgcaacaacuucuaccacuauaaccaauccaacgaccccaccaucaaacucaucgccaugcucuacacuccccuccgagccaacaaugccggcgacgacguauucaccgucucaugccgcguucucacacguccaucccccgacuuugauuucaucuuccucguaccaccuaccgucgaaucaagaaccaaacccuucuccgucccaguacuuaccguagaagaaaugaccaacucccgguuucccaucccucuagaaaaacucuucaccggaccaucuucugccuucguaguccaaccccaaaacggccgcugcacaaccgauggaguacuccuaggcaccacucaacuaucccccgucaacauaugcaccuuccgcggagacgucacacacaucacaggcucacggaacuacaccaugaaccuagccucccaaaacuggucuaacuacgaccccaccgaagagauccccgcaccccucggcacacccgacuuugucggcaagauucaaggcguacuuacacaaaccacccgaaccgacggauccacacgaggacacaaagccacuguauacacaggcuccgccaacuucgccccaaaacuuggccgaguccaguucgaaacagacaccgaccacgacuucgaagcaaaccaaaacaccaaauuuacccccgucggcgucauacaagacggcggcaccacccaccguaacgaaccacaacaauggguacuccccucauacucuggccgcaacaccccaaacguccaccucgcuccagccguagccccaaccuuccccggagaacaacuccucuucuuccgcuccacuaugcccgguugcucaggauaccccaacauggaccucgacugccuccugccacaagaauggguucaauacuucuaccaagaggccgcccccgcacaauccgacgucgcacuccuucgauuuguaaaccccgacaccggucgcguccuuuucgaaugcaaacuccacaaaucaggcuacgucaccgucgcucacaccggacaacacgacuuagucauaccacccaacggcuauuuccgcuucgacucaugggucaaccaauucuacacccuagcccccaugggcaacggaacuggccgccgccgauaa

SEQ ID NO: 38684 - RNA, 1617 nt, Artificial Sequence
  derived and/or modified sequence opt11 from VP1__Norovirus_and/or_Norovirus-like__KM982938
augaaaauggccucaucggacgccaacccguccgauggaucggccgccaaccuaguccccgaaguaaacaacgaaguaauggcccuagaaccagucgucggagcagcuauagccgcccccguagccggccaacaaaacgucaucgacccauggauacgcaacaacuucguccaggcccccggaggugaguucaccguauccccucgcaacgcccccggagaaauccucugguccgcaccccugggccccgaccuaaaucccuaccucucccaccucgcccgaauguacaacggcuacgccggcggcuucgaagugcaagucauccuagccgguaacgccuucaccgccggaaaagucauauucgccgccgucccacccaacuuccccacugaaggccuaucccccucccaagugaccauguucccccacaucguagucgacguccgccaacucgaaccggugcuaauaccacuacccgacguucgaaacaacuucuaccacuacaaccaaucaaacgaucccacaaucaaacucaucgccaugcucuacacaccccucagagccaacaacgccggcgacgacguauucaccgucucaugccgcguccuaacccgaccguccccagacuucgacuucaucuuucucgucccucccaccguagaaucaagaaccaaacccuuuuccguccccguauuaaccgucgaagaaaugaccaacucccgcuuccccauaccccucgaaaaacuauucaccggacccuccagugccuucgucguccaaccccaaaacggccgauguacaaccgacggacuccuccucggaacuacacagcuaucccccgucaacaucugcaccuuccgcggagacgucacccacauaaccggcagucgcaacuacaccaugaaccucgcaucacaaaacuggaguaacuacgaccccaccgaggaaauacccgcaccccuaggaacccccgacuucgucggcaaaauccaaggcguacuaacccaaaccacccgaacugacggcuccacacguggccacaaggccaccgucuacaccggauccgccgacuucgcaccaaagcuaggccgcguccaauucgaaacagacaccgaccacgacuucgaagcgaaucaaaacaccaaguucacacccgucggagucauccaagacggcggcaccacccaccgaaacgaaccucaacaauggguucucccaucauacagcggccgaaacacaccaaacguacaccuagcccccgccgucgcccccacuuuccccggugaacagcuccucuucuuucgauccaccaugccaggcugcuccggcuauccaaacauggaccucgacugcuuacuaccucaagaguggguccaauacuucuaccaagaagcagcuccagcccaaucagauguugcacuccuucgauucgucaacccugacacuggccguguacuauucgaaugcaaacuacacaaauccggauaugucacagucgcccacaccggccaacacgaccuaguuauacccccaaacggcuacuuccguuucgacucauggguuaaccaauucuacacccucgcccccaugggcaacggcaccggccgacgacgcuaa

SEQ ID NO: 38685 - RNA, 1617 nt, Artificial Sequence
  derived and/or modified sequence opt11 from VP1__Norovirus_and/or_Norovirus-like__KM514058
augaaaauggcauccagugacgccaacccuuccgacggcuccgccgccaacuuagucccugaagucaacaacgaaguaauggcacucgaacccgucguaggagcagcaauagccgcaccugucgccggccaacaaaaugucauagaccccuggauccgcaacaacuucguacaagccccaggcggagaauuuacaguauccccacgcaacgcccccggcgaaauccucugguccgccccucucggacccgaccucaacccauaccucucacaucucgcccguauguacaacgguuaugccggcggcuucgaaguacaagucauucuagccggaaacgccuucaccgccggaaaagucauauuugccgccgucccacccaacuuccccacagaaggccucucccccucccaagucacaauguucccccacauuguaguagacguacgacaacucgaacccguccucaucccccuucccgauguucguaauaacuucuaccacuacaaccaaucaaaugaccccaccaucaaacucaucgcaaugcuauacacaccccuccgcgccaacaacgccggcgaugacgucuuuaccgucucuugucgcguccucacacgccccucgcccgacuucgauuucaucuuccucguaccacccaccgucgaaucccgaaccaagcccuucuccguacccguccuaaccgucgaagaaaugacaaacagccguuucccuauaccccucgaaaaacuauucacuggccccucauccgcauucguaguccaaccccaaaacggccgaugcacuacugacggacugcuacuaggcacaacccaacucucccccgucaacaucugcacauuccgaggcgacgucacacacaucaccggcucucgcaacuacacaaugaaccucgccagccaaaacugguccaacuacgaccccaccgaagaaaucccagcaccccucggcacccccgacuucgucggcaaaauccaagguguacuaacccaaaccacccgcacugacgguuccacuagaggccacaaagccaccgucuauacuggaucagccgacuucgcccccaaacuaggccgaguacaauucgaaacagacaccgaucgcgacuucgaagcaaaccaaaacaccaaguucacccccgucggcguaauccaggacggcgggaccacccaccgcaacgaaccccaacaauggguccuccccagcuacucaggacgaaacacacccaacguacaccucgcacccgcagucgcacccaccuucccaggcgaacaacuccuuuucuuccgcucuaccaugccgggcugcucuggauauccaaacauggaccucgacugccuacucccccaagaauggguacaauacuucuaccaagaagcagcccccgcccaauccgacgucgcgcucuuacguuucgucaaccccgacacuggaagaguccuguucgaaugcaaacuccacaaauccggcuaugucaccgucgcccacaccggacaacacgaccuaguaauaccucccaacggauacuucagauucgacucaugggucaaccaauucuauacucuagccccaaugggaaacggcaccggccgucgacgcuaa

SEQ ID NO: 38686 - RNA, 1617 nt, Artificial Sequence
  derived and/or modified sequence opt11 from VP1__Norovirus_and/or_Norovirus-like__KM198580
augaaaauggccuccaacgaugcaaauccaaccgacggauccgcugccaaccuaguccccgaaguaucuaacgaagucauggcacucgaaccuguagucggcgccgccaucgccgcacccguagcaggccaacaaaacgucaucgaccccuggauccgaaacaacuuuguucaagcccccggaggagaguucaccguaagcccccgaaacgcccccggagaaauccugugguccgcuccccucggccccgaccuaaaccccuaccuuucccaccucgcccgaauguacaauggcuacgccggcggguucgaaguccaaguaauccucgcaggcaacgccuucaccgccggaaaaaucaucuuugccgccguacccccaaacuucccaaccgaaggccuaucacccucacaagucacaauguucccacacaucaucgucgacgucagacaacuagaaccaguacucaucccccuccccgacguccgcaacaacuucuaccacuacaaccagaccaacgauagcaccaucaaacuaaucgccaugcucuacaccccgcuacgcgccaacaaugcuggcgaagacgucuuuaccguaucaugccgaguucucacccguccuucuccagauuuugacuucaucuuccucgucccaccaaccgucgaaucccgcacaaaaccguucaccguccccauccucaccguagaagaaaugacuaacucacgcuucccuaucccacuugaaaaacuauucacggguccuuccggcgccuucgucguccaaccccaaaacggacgcugcaccacagacggaguccuacucggaaccacccaacuaucccccgucaacaucuguaccuuccgcggagacgucacccacaucgccggcagccgaaacuacaccaugaaccuagccagccucaacuggaacaacuacgacccaaccgaagaaauccccgcaccccuaggcacccccgacuucgucggcaaaauccagggaguccucacacaaacaaccaagggcgacggcuccacccgaggccacaaagcaaccgucuauaccggcucagcccccuucacccccaaacuaggcagcguccaauucucuacugacacagaaaacgacuucgaaacccaccaaaacaccaaauuuacaccagucggagucauccaagacggcggcaccacccaccgcaacgaaccccaacaauggguccuccccucauacagcggccgcgacguacacaacgugcaccucgcacccgccgucgcuccuaccuucccaggagaacaauuacuguucuuucgauccaccaugcccggaugcuccggcuacccaaacauggaccuagauugccuccucccccaagaauggguccaacacuucuaccaagaagccgcccccgcccaauccgacgucgcccuccuucgcuucguaaacccugacacuggccgaguccuauuugaaugcaaacuccacaaaagcggcuacgucaccguagcccauaccggccagcacgaccucgucauacccccaaacggauacuuucgauucgacucauggguaaaccaguucuauacccuagcccccaugggaaacggcaccggacgacgucgcuaa

SEQ ID NO: 38687 - RNA, 1617 nt, Artificial Sequence
  derived and/or modified sequence opt11 from VP1__Norovirus_and/or_Norovirus-like__KM198537
augaagauggcccccaacgacgcaaacccguccgacggcucugcagccaaucucgucccagaaguguccaacgaaguaauggcacuagaacccgucgucggagccgccauagccgcacccguggccggacaacaaaacgucauagaccccuggauacgcaacaacuucguccaagccccuggcggcgaguucaccgucucaccgcgcaacgccccaggagaaauccuauggggagcaccccucggccccgaccucaaccccuaccucucacaccucgcccgcauguacaacggauacgccggcggcuuugaaguccaaguaauacucgccggaaacgccuucacagccggaaaaaucaucuucgccgccgucccgcccaauuuccccacugaaggccuaucacccucacaagucacaauguuuccacacaucaucgucgacguccgccaauuagaaccaguccucaucccccuccccgacguucggaacaacuuuuaccacuauaaucaaaccaacgacuccacaauaaaacucaucgccaugcucuacaccccucuacgcgccaauaacgcaggcgaagacgucuuuaccgucucaugccgcguccucacaagaccaucaccugacuucgacuuuaucuuccucgucccacccaccgucgaaucccgcacaaaaccauucacugugccaauuuuaaccguagaagaaaugaccaacucacguuuccccauuccguuagaaaaacucuucaccggcccaucuggcgccuucgucguacaaccccaaaacggccgaugcaccaccgacggaguucuccucggcaccacccaacucuccccugucaacaucugcaccuuccgcggugacgucacacacauagccggcagccgcaauuacaccaugaaccuugccucccuuaacuggaacaacuacgacccaacugaagaaauccccgcaccccuaggcaccccggacuucguaggaaagauccaaggaguacugacccaaaccaccaaaggagacggcuccacccgcggacacaaagccacugucuacaccggcucagccccauucacccccaaacucggaucaguccaguuuuccaccgacaccgaaaacgauuucgaaacacaccaaaacaccaaauucacucccgucggcguaauacaagacggcggcaccacccaccgcaacgaaccccagcaauggguccuacccuccuauuccggacgcgauguacacaacguccaccucgcccccgcgguugccccuaccuuucccggcgaacaacuccucuucuuccgcucaaccaugcccggaugcuccggcuaccccaacauggaccucgacugccuccucccacaagaauggguccaacacuucuaccaagaagccgcccccgcccaaucagacguagcacuccuccgcuucgucaaccccgacaccggccgcguacucuucgaaugcaaacuacacaaaucgggcuacgucaccguagcccacaacggccaacacgaccucguaauaccucccaauggcuacuuccgauuugacucguggguaaaccaguucuacacgcucgcacccaugggcaacggcacagggcgacgccgcuaa

SEQ ID NO: 38688 - RNA, 1617 nt, Artificial Sequence
  derived and/or modified sequence opt11 from VP1__Norovirus_and/or_Norovirus-like__KF177450
augaaaauggccucauccgacgcaaauccauccgacggauccgccgcgaaccuuguacccgaaguaaacaacgaaguaauggcccucgaacccgucgucggcgccgccaucgccgccccagucgccggccaacagaacguuaucgacccauggauccgcaacaacuucguccaagcucccggcggcgaguucaccguaucaccccgaaacgccccuggcgaaauacuaugguccgccccacuaggccccgaccucaaccccuaccuaucccaccuugcccgcauguacaacggcuacgcaggcggcuucgaaguccaaguaauccucgccggcaacgcauucacagccggcaaagucaucuucgccgcagucccacccaauuuucccaccgaaggccucuccccaucccaagucacuauguucccccacaucgucguagacguccgccagcucgaacccguccuaauaccacuccccgacguacguaacaacuucuaucacuacaaccaguccaacgacccaacaaucaaacuaaucgccaugcuauauacaccucuccgagcaaacaacgccggagacgacgucuucaccguuucaugccgaguccuuacacgccccucaccagacuucgacuucauauuccuagucccacccaccguagaaucccgaaccaaaccauucuccgucccaguucucaccguagaagaaaugaccaacucccguuucccaauaccccucgaaaaacucuucacuggccccuccuccgccuucgucguccaaccacagaacggccgcugcacaacggacggaguucuacucggcaccacccaacucucccccgucaacaucuguacauuccgcggcgacgucacccacaucacaggcagccgcaacuacaccaugaaccucgccucucagaauuggaauaauuacgaccccaccgaagaaauccccgcaccccuaggcacccccgacuucgucggcaaaauucaaggcguacuaacccaaaccacacgcacugacggcuccacccgaggccacaaagccacaguauauaccggauccgccgacuucgcccccaaacuaggacgcguccaauucgaaacagacaccgaccacgacuucgaagccaaccaaaacaccaaauucacccccguuggaguaauccaggacggcgggacuacacaccgaaaugaaccccaacaauggguacuccccuccuacuccggccguaacacccacaacgugcaccuagcgccugcagucgcccccaccuuccccggcgaacaacuacuguuuuuccgauccacaaugcccggaugcuccggcuaccccaacauggaccuugacugcuuaauaccccaagaauggguccaauacuucuaccaggaagcagcccccgcccaaucugacgucgcacucuuacguuucgucaaccccgacaccggccgcguacuauucgaaugcaaacuccacaaaucaggcuaugucaccgucgcccacacuggccaacacgaccucguuauacccccaaacggcuacuuccguuuugacuccuggguaaaccaauuuuacacccucgcaccaaugggcaacggcaccggacgacgccgcuaa

SEQ ID NO: 38689 - RNA, 1617 nt, Artificial Sequence
  derived and/or modified sequence opt11 from VP1__Norovirus_and/or_Norovirus-like__KF008243
augaaaauggccuccuccgacgcaaaccccuccgacggcagugccgcgaaccucguccccgaaguaaacaaugaaguuauggcccuugaacccgucguaggagccgccauagcagcccccgucgccggccaacaaaaugucauagaccccuggauccgaaacaacuucguacaagcccccggcggcgaguucaccgucuccccacgcaacgcccccggugaaauccuauggagcgcuccccucggucccgaccuaaaccccuaucuaucccacuuagcccgcauguacaacggauacgccggcggcuucgaaguccaagucauccucgccggaaacgccuucaccgccggcaaaguaaucuucgccgcagucccacccaacuuccccacugaaggccuaagccccagccaagucacaauguucccccacaucgucguugauguccgccaacuagaacccguccucaucccccuccccgacguucgcaacaacuucuaccauuauaaccagucaaacgaccccaccaucaaacuaauagccaugcuauacacaccccuccgcgccaacaacgccggagacgacguauuuaccguuuccugccgaguacucacccgccccucacccgauuuugacuucaucuuccuagucccacccacugucgaaucccgaacgaaacccuucuccguccccguccucaccguugaagaaaugacaaacucacguuucccaauaccccucgaaaaacucuucacaggcccguccucugccuucgucguacaaccccaaaacggacgcugcacaaccgacggagucuuacuaggcaccacucaacuuucucccgucaacauaugcaccuuccgcggcgauguaacccacaucaccggcucucgcaacuauaccaugaaccuagccucacaaaacuggaacaacuacgacccuacugaagaaauacccgccccucucgggacccccgacuucguuggcaaaauucaaggcguccucacccaaacaacacguaccgacggcagcacacgcggccacaaagcuaccgucuacaccgguuccacagacuucgcccccaaacuaggccgaguacaauucgaaaccgacaccgaccacgacuucgaagccaaccaaaacaccaaauucacccccgucggcgucauccaagacggcagcaccacccaccguaacgaaccccaacaauggguccuaccaucauacuccggccguaacacacacaacguccaccucgccccagccguagcucccacuuuccccggcgaacaacuacuauucuuccgauccacaaugcccggaugcuccggcuacccaaacauggaccucgacugccuacucccacaagaauggguccaauacuucuaccaagaagccgcccccgcccaaagugacgucgcacuacucagauucgucaacccagacacaggccgcguucucuucgaaugcaaacuccacaagucagguuacgucaccgucgcccauaccggccaacaugaccucguuaucccacccaacggcuacuuccgcuucgacagcuggguaaaucaauucuacacucucgcccccaugggcaacgguacaggccgacgacgcuaa

SEQ ID NO: 38690 - RNA, 1617 nt, Artificial Sequence
  derived and/or modified sequence opt11 from VP1__Norovirus_and/or_Norovirus-like__KF429782
augaaaauggccuccuccgacgccaaccccagcgacggcuccaccgccaaccuuguccccgaaguaaacaacgaaguaauggcccucgaacccgucguaggagccgcaauagccgcucccgucgcaggccaacaaaacgucaucgacccauggauccgcaacaacuucguccaggcccccggaggcgaauuuacuguaucaccccgcaacgccccuggcgaaauccuaugguccgccccucucggaccagaccuuaacccauaccucucccaccucgcccgcauguacaauggcuaugccggcggcuucgaaguacaggucauccucgcaggaaacgccuucaccgcaggcaaaauuaucuucgccgcagucccucccaacuuccccaccgaaggccuuucccccucucaagucacaauguucccccacaucauagucgauguccgucaacucgaaccccuccuaauaccccuccccgacguacgcaacaauuucuaccacuacaaccaaucaaacgaccccaccaucaaauugaucgcgaugcuauacaccccucuccgcgcgaauaacgccggugacgacgucuucacagucuccugccguguccucacacggccauccccagacuucgacuucaucuuccucgucccacccacaguagaaucccgaaccaaaccuuucuccgucccaauccucaccaucgaagaaaugacaaacucccguuuccccauaccccucgaaaaacuauucacaggcccauccucugcauucgucguucaaccucaaaacggacgcugcaccaccgacggaguccuccuaggcacaacccaauuaucacccgucaacaucugcaccuuccgaggcgacguaacccauaucacaggaacucauaauuacgcaaugaaccuggccgcccaaaauuggaacuccuacgacccuaccgaagaaaucccagcaccccucggaacucccgacuucgucggcaaaauccaaggaguacucacccaaacaacaagagccgacggcucaacccgcgcccacaaagccacagucuacaccggaucugccgaguucgcccccaaacucggccgcguccaauucgccacagauacagacagcgacuucgacaccaaucagaacaccaaauucacuccugucggagucauccaagacggaaacacagcacaccaaaacgaaccacaacaguggguccuaccuuccuacuccggccguaacaaccacaacguacaucucgcccccgccguagcccccacauuccccggcgaacaacuccucuucuuccgcuccacuaugccaggcugcuccgguuaccccaacaugaaccucgacugccuucuaccccaagaauggguccaauacuucuaucaagaagccgccccagcacaauccgacgucgcccuacuucguuuugucaacccugacaccggccgcguccucuucgaaugcaaacuucauaaauccgguuacgucaccguagcccacacaggccaacacgaucucgucauuccucccaacggguacuuccgcuucgacucaugggucucacccuucuacacucucgcucccaugggcaacggcacaggccggcgccgauaa

SEQ ID NO: 38691 - RNA, 1617 nt, Artificial Sequence
  derived and/or modified sequence opt11 from VP1__Norovirus_and/or_Norovirus-like__KF060101
augaaaauggcaagcuccgacgcaaaccccucagacggcucaaccgccaaccuagucccugaaguuaacaacgaagucauggcccuagaacccguuguaggagccgccaucgccgccccagucgccggacaacaaaacguaauugaccccuggauccgaaauaauuuuguccaagccccaggcggcgaguucacaguaucuccccgcaacgcccccggagaaauacucuggagcgcaccccuagggcccgaccuaaaccccuaccucucccaccuagcccgaauguacaauggcuacgccggaggauucgaaguacaaguaauacuagcaggcaaugcauucaccgccggaaagaucaucuucgcagccgugcccccaaacuuccccaccgaaggacucucccccucacaaguaaccauguucccccacaucaucguagauguaagacaacuagaacccguacuaaucccccuacccgacguccgcaacaauuucuaccacuacaaccaauccaacgaccccaccaucaaauuaaucgccaugcuuuacaccccacuccgagcaaacaacgccggugacgacgucuucacagucagcugccgcguucucacgcgccccucccccgacuuugacuucaucuucuuaguaccacccacaguagaaagccgcaccaaacccuucucuguacccguccuuacaguagaagaaaugaccaacucccgauuccccaucccccuugagaaacuguucaccggacccucauccgccuucguuguacagccucaaaacggccgaugcaccacugacggaguccuccuaggcacaacacaacuaucccccgucaacaucugcaccuuucgcggcgacgucacccacauauccggcucccgcaacuacacuaugaaccucgccucacagaacuggaacuccuacgaccccaccgaagaaaucccugcaccccucggaacccccgacuucgucggcaaaauccagggaguccuaacucaaacaacccgcgccgacggcuccacccgcggccacaaagccaccgucuacaccggcagcgccgacuucucccccaaacucggccgcguccaauucgccaccgacacagacaacgacuucgucgcaaaccaaaacaccaaauucaccccagucggcgucauccaagacggcuccaccaccccacgcaacgaaccacaacaauggguccucccaucauacucaggucgcaacacccacaacguccacuuagccccagccguagcccccacuuuccccggagaacaacuacuauucuuucgcucuaccaugcccggaugcuccggcuaccccaacauggaccuagacugccuccucccccaagaauggguccaauacuucuaccaagaagccgcuccagcccaauccgacgucgcccuccuaagauucgucaaccccgacaccggccgaguccucuucgaaugcaaacuucacaaauccggcuacguuacaguagcacacaccggccaacacgaccucguuauaccucccaacggcuacuuccgcuuugauucauggguaaaccaauucuacacccuagcccccaugggaaacggcaccggcagacgacgcuaa

SEQ ID NO: 38692 - RNA, 1617 nt, Artificial Sequence
  derived and/or modified sequence opt11 from VP1__Norovirus_and/or_Norovirus-like__KF060096
augaaaauggccagcuccgacgcuaaccccucagacggaucagcugccaaccuuguccccgaagucaacaacgaggucauggcacucgaacccguaguaggcgccgcuaucgcagcacccguagccggccaacaaaacguuaucgacccauggauccgaaacaacuuuguccaagcccccggcggcgaguucaccguauccccgcgcaacgcccccggagaaauccuaugguccgcaccacuaggacccgaccucaacccauaccucagccaccucgcccgcauguacaacggcuacgccgguggcuucgaaguacaagugauucucgccggcaacgccuucacugcagguaaagucaucuucgcagcaguaccacccaacuuccccacugaaggucucagccccagccaagucaccauguucccccacaucguaguagacguucgccaacucgaacccguacucaucccacuccccgacguccgaaacaacuucuaucacuacaaccaguccaacgauccuaccauaaaacucauagccaugcuauacacaccccuccgugcaaacaacgccggggacgacguauuuaccguaucaugcagaguccucaccagaccuucucccgauuucgauuuuauauuccuaguacccccaacugucgaaucccgaacaaaacccuucucaguccccguacucaccguagaagaaaugacuaacagccgguucccaaucccacuagaaaaacuuuuuaccggccccagcagcgcauucgucguccaaccacaaaacggcagauguaccaccgacgguguacuccucggaaccacccaacucucacccgucaacauaugcacauuccgcggggauguaacacacaucaccggcucacgcaacuacaccaugaaccuagccucacaaaacugguccaacuacgaccccaccgaagaaauccccgccccacucggcacaccugacuucgucggcaaaauccaaggaguccuaacccaaaccacccgcacugacggaucuacccgcggccacaaagcaacugucuacacaggcuccgccguauucgcccccaagcuaggaagaguccaguuugaaacagacaccgaccacgacuucgaagccaaccaaaacaccaaauucacacccguaggagucauacaagacggcucaacaacacacagaaacgaaccccaacaauggguacuacccucauacagcggccgaaacacccccaacguacaccuugcacccgcagucgccccuaccuucccaggcgaacaacuccucuucuuccguagcaccaugcccggaugcuccggcuacccuaacauggacuuagauugccuucucccccaagaauggguucaauacuuuuaccaagaagcagccccugcccaaucggauguagcacugcuccguuucgucaaccccgacaccggccgcguacucuucgaaugcaaacuccacaaauccggcuacgucacagucgcccacaccggacaacacgaccuagucaucccacccaacggauacuucagauucgacuccugggucaaucaauucuacacccucgcucccaugggcaacggcacuggccgccgcagauag

SEQ ID NO: 38693 - RNA, 1617 nt, Artificial Sequence
  derived and/or modified sequence opt11 from VP1__Norovirus_and/or_Norovirus-like__KF060071
augaaaauggcaucuuccgacgccaaccccuccgacggcucaacagccaaccuaguacccgaggucaacaacgaagucauggcccuagagccagucguuggagcagccauagcagcacccguagcagggcaacaaaauguaaucgacccuuggauccgaaauaacuucguccaagcccccggcggcgaguucacagucucaccacguaacgcacccggcgaaauccuauggucggccccucuagggccagaucucaaccccuaccuuucccaccucgcccgcauguacaacggcuacgcaggcgguuucgaaguccaagugauacuagccggcaacgccuucaccgccggcaaaaucaucuucgccgccgucccgcccaacuuccccacugaaggccuaucccccucacaagucacuauguucccccacauaauagucgacguccgccaacucgaaccaguacuaaucccccuacccgacguccgcaacaacuucuaccacuacaaccaauccaacgaccccaccauaaagcuaaucgccaugcucuauacaccacuccgagccaacaacgccggcgacgacgucuucacaguauccugccguguccucacccgccccucacccgacuucgacuucauauuccucguacccccuacugucgaaagccgaaccaaacccuucuccgucccuguccucaccgucgaagaaaugaccaacagcagauuccccaucccccucgaaaaacuauucaccggccccagcucugccuucgucguccaaccucaaaacggacgcugcacaaccgacggaguccuacucgguaccacgcaacucucacccgucaacaucugcacauuccgcggagacguaacccacaucuccggcucccgaaacuacaccaugaaccuaguaucccaaaacuggaacucuuacgaccccaccgaagaaauacccgcaccauuaggaacaccagacuucguagguaaaauucaaggcguacucacccaaaccacacgcacaaacggcuccacacgcggccacaaggccacagucuacaccggcagcgccgauuuuucgccaaaacucggacgcguccaauucgcaaccgacaccgacaacgacuucgagaccaaccaaaacaccaaauucacccccgucggcgucauacaagacggauccacaaccccacgcaacgaaccacaacaauggguacuucccucauacagcggccgaaacauacacaacguccaccuugccccugccgucgcccccacauuucccggagaacaacugcuuuucuuccgaucaaccaugccuggcugcucgggcuaucccaacauggaccuagacugccuacucccccaagaauggguccaguauuucuaccaagaagcagcacccgcacaguccgacgucgcccuccuucgcuucgucaaccccgacaccggaagaguccuauucgaaugcaaacuacacaaauccggcuaugucaccgucgcccacacaggucaacacgaucuaguaaucccacccaacggcuacuuccgcuucgacuccuggguuaaccaauuuuacacccuagcacccaugggaaacgguacaggccgcagacgcuaa

SEQ ID NO: 38694 - RNA, 1617 nt, Artificial Sequence
  derived and/or modified sequence opt11 from VP1__Norovirus_and/or_Norovirus-like__KF060056
augaaaauggccucuuccgacgccaacccaucagacggcuccgccgccaaccuaguccccgaagucaacaaugaagucauggcacuagaacccguagugggcgcugccaucgccgcacccguagccggccaacaaaacguaaucgaucccuggauccguaacaacuucguccaagcccccgggggcgaguucaccgucuccccacgcaacgcccccggagaaauacuuuggagcgcaccccugggcccagaccuuaaccccuacuuaucccaccucgcccgcauguauaacggcuacgcaggcgguuucgaaguacaagucauccucgccggcaacgcuuucacagccggaaaagucauauucgccgccgugcccccaaacuuccccaccgaaggucucucacccucucaagucaccauguuuccccauaucgucguagacgucagacaacucgaaccaguccucauaccccuccccgacguucgcaacaacuucuaucauuacaaccaauccaacgaccccaccauaaaacucauagccaugcucuacaccccacuccgcgcuaacaacgcaggcgacgacgucuucaccgucagcugccgaguacuaacccgacccuccccagacuucgacuuuaucuuccuugucccacccacuguagaaucacgaaccaaacccuucucuguucccguucuaacaguagaagaaaugacaaacucccgcuucccaaucccccuagaaaaacucuucacaggccccucuuccgccuucguuguucaaccccaaaacggccguugcaccaccgacggcguccuccucggcaccacacaacucucccccguaaacauuugcaccuuccggggagauguaacacacaucaccggcucccgaaacuacacaaugaaccucgccagccaaaacuggaacaacuacgaccccacagaagaaauaccagcuccccucggcacccccgacuucgucggcaagauccaaggugugcucacccagaccacucgcaccgacggcucuacccgcggccauaaagccaccgucuacaccggcuccgccgacuucgcccccaaauuaggccgaguacaauucgaaacagacacugaccacgauuucgaagccaaucaaaacacaaaauucacccccgucggaguuauucaagacggaggcaccacccaccgcaacgaaccacaacaauggguucuccccuccuacuccggcagaaacacccacaacguacaccucgcaccagcagucgccccaacauucccaggagaacagcuccucuuuuuccgaagcacaaugcccggcugcuccggcuaccccaacauggaccucgacugccuacucccccaagaauggguccaauacuucuaccaagaagccgccccugcacaauccgaugucgcgcuccuacgcuucgucaaccccgacacaggacgaguccuauucgaaugcaaacuccacaagagcggauacgcaacggucgcccauacaggacaacacgaccuaguaaucccacccaacgguuacuuucgauucgacuccuggguaaaccaauucuacacccucgcccccaugggcaacggcaccggacgccgccgguaa

SEQ ID NO: 38695 - RNA, 1617 nt, Artificial Sequence
  derived and/or modified sequence opt11 from VP1__Norovirus_and/or_Norovirus-like__JX439836
augaaaauggccucauccgacgcgaaccccuccgacggcucaaccgccaaccuuguccccgaaguaaauaacgaagucauggcgcucgaaccagucgucggagccgccaucgccgcccccgucgccggucaacaaaacgucaucgaccccuggauucguaacaacuucguacaagcccccggcggcgaauuuacagucucaccccgcaacgccccaggugaaauccucugguccgccucacucggcccugaccucaacccauacuuaucccaccuagcccgcauguacaauggcuacgccggcggcuucgaaguccaagucaucuuagcaggcaacgcuuucacagcuggaaaaaucaucuucgccgcaguacccccaaauuucccuacugaaggccucucccccucacaagucaccauguucccacacaucaucgucgacguccgccaacucgaacccguccucaucccccuccccgacguacguaacaacuuuuaccacuacaaucaauccaaugaccccacuaucaagcucauagcuaugcuuuacaccccacugcgcgccaacaacgcaggcgaugacgucuucaccgucuccugccgcguacucacccgccccucaccagacuucgacuucaucuuccucgucccacccaccgucgaaucccgcaccaaaccuuucucugucccuguacucacaguagaagaaaugaccaacucccgauuccccaucccccuagaaaaacucuuuaccggaccauccucagccuucguaguacaaccgcaaaacggucgcugcaccaccgacggcguucuccuaggcacuacccaacuaucccccgucaauauaugcaccuuccguggcgacguaacccacauccccggcucacguaauuacaccaugaaccucgccucccaaaacuggaacuccuaugaccccaccgaggaaauacccgcaccccucggcaccccagacuuuguaggcaaaauccaagguguacuaacacagaccacccgcacaaacggcucaacccgcggccacaaagccaccgucuacaccgguucagccgacuucucacccaaguuaggacggguccaauuugccacugacacggacaacgacuucgaaacaaaccaaaacacaaaauucacaccagucggcguaauacaagacggcuccaccacaccccgcaacgaaccacagcaauggguccucccauccuacucaggacgaaauauacacaacguccaccuagcccccgcagucgccccaaccuuccccggcgaacaacuacucuucuuccgcucaaccaugcccggcugcucaggcuaccccaacauggaccucgacugccuccuaccccaagaauggguucaauacuucuaccaagaagcagcacccgcacaaucagacgucgcccuccuaagauuuguaaaccccgacaccggccggguccucuucgagugcaaacuccacaaaucaggauaugucaccgucgcccacaccggacaacacgaccucguaauaccacccaauggcuacuuccgauucgacucauggguuaaccaauucuauacacucgcccccauggguaacggcaccggacgccgcagauaa

SEQ ID NO: 38696 - RNA, 1617 nt, Artificial Sequence
  derived and/or modified sequence opt11 from VP1__Norovirus_and/or_Norovirus-like__HF952129
augaaaauggccuccuccgacgccaaccccuccgacggcuccacagcuaaccucgucccugaagucaacaaugaagucauggcacuagaacccgucgucggagccgccaucgcagccccugucgccggccaacaaaacgucauagaccccuggauccgcaauaacuuuguacaagcccccggcggcgaguucacaguaucucccagaaacgcccccggcgaaauacucugguccgcuccccucggcccugaucucaaccccuaccuaucacaccucgcacgcauguacaacggcuacgcgggcggcuuugaaguacaagucauacucgcaggcaacgccuucacagccggaaaaaucauauucgcugcagucccgcccaacuuccccacagaaggccuaucccccucacaagugaccauguucccacacauaaucgucgacguccgccaacuagaacccguccuaauuccccuccccgacguccgaaacaacuucuaccacuauaaccaaucaaaugacccuacaauaaaacuaaucgccaugcuauacacccccuuacgagcaaacaacgccggcgacgacguauucaccgucucaugccgcguccucacacgccccucacccgacuucgacuucaucuuccucgucccucccaccguggaaucccgaaccaaacccuucucaguccccauccucaccgucgaagaaaugaccaacucccgauuccccauaccccucgagaaacuuuuuaccggucccagcucagcauucguaguccaaccacaaaacggccgcugcaccaccgacggcguacuccucggcacaacacaacucuccccagucaacauaugcacauuccgaggugacguaacccacauccccggcucccacaacuacacuaugaaccuagccucccaaaacuggaacuccuacgaccccaccgaagaaauucccgcuccccucggcacucccgacuucgucggcaagauccaaggcguacucacccaaaccacacguaccaacggaagcacacgaggccacaaagccaccguauacacugguucugcugacuucuccccaaaacucggcagaguccaauuugccaccgacacugacaacgacuucgaaaccaaccaaaacacaaaauucacacccgucggaguuauacaagacggauccacaacuccccgaaacgaaccacaacaauggguccucccauccuacuccggccgcaacauccauaacguccacuuagcccccgccgucgcgccaaccuucccuggagaacaacuacucuucuuccgcagcaccaugccaggcugcuccggauaucccaacauggaccuagacugccuccucccccaagaauggguccaauacuucuaccaagaagccgcacccgcccaaucugacguugcacuccuacgcuucgucaacccagacaccggacguguccucuucgaaugcaagcuccacaaaucaggauacgucaccgucgcccacacaggacaacacgacuuaguaaucccaccaaacggcuacuuccguuucgacuccugggucaaucaauucuacacacuagcccccaugggaaacggaaccggccgccgccgcuga

SEQ ID NO: 38697 - RNA, 1617 nt, Artificial Sequence
  derived and/or modified sequence opt11 from VP1__Norovirus_and/or_Norovirus-like__KC409273
augaaaauggccuccaacgacgccaacccauccgacggauccgccgcaucccucguccccgaagucuccaacgaaguaauggcucuagaaccagucgucggagcagccaucgcagcuccaguagcaggacaacaaaacguaauagacccauggauucgaaacaauuucguccaagccccaggcggagaguucaccgucucuccacgaaaugcaccaggagaaauucucugguccgccccacucggccccgaccuuaaccccuacuuaucccaccucgcccgcauguacaacggcuacgccggcggauucgaaguacaggucauccuagccggcaacgcauucaccgccggcaaaauaaucuuugcagcaguaccacccaacuuccccacagaaggacuaucccccucacaaguaaccauguucccccacauaaucguagacguacgccaacucgaacccguacuaaucccccuccccgacgucagaaacaacuucuaccauuacaaccagaccaacgacuccaccaucaaacuaauagcuaugcuauacacaccacuacgcgccaauaacgccggagaagauguuuucacaguauccugccgcguccuuacccgacccucacccgacuucgacuucauauuccucgucccuccaaccgucgaaucccgcacuaaaccauucaccguccccauacucaccguagaagaaaugaccaacuccagauuccccauacccuuagaaaaacuauucacuggccccuccggagcauucgucguccaaccccaaaacggccguugcaccacagacggaguuuuacuaggaaccacccaacucucccccgucaacauaugcacauuccgcggagacgucacacacaucgccggcucccgcaauuacaccaugaaccucgccucccucaacuggaacaacuacgaccccaccgaagaaaucccagcaccccuuggaacccccgacuucguaggaaaaauacaaggaguccucacccaaaccaccaaaggcgacggcucuacacgaggucacaaagccaccgucuacaccggauccgcccccuucaccccuaaacuaggaucaguacaauucuccacagacaccgaaaacgacuucgaaacccaucagaacaccaaauucacacccguugguguaauucaagacggcggcaccacccaucgaaacgaaccccaacaauggguacucccuucauauucaggacgcgacguucacaauguccaccucgcccccgcagucgcccccaccuuccccggugaacaacuccuguucuuccggucaacaaugccaggcugcucuggcuaccccaacauggaccuagauugccuucucccccaagaauggguccaacacuucuaccaggaagcugcacccgcccaauccgacgccgcacuccuacgauuugucaacccagacaccggacgcguccucuucgaauguaaacuccacaaaagcgguuacgucaccguagcucacaccggccaacacgaccucgucauaccacccaacggcuacuuccgcuuugacucauggguuaaccaauucuacacccuagcccccauggguaacggcaccggccgccgccgcuga

SEQ ID NO: 38698 - RNA, 1617 nt, Artificial Sequence
  derived and/or modified sequence opt11 from VP1__Norovirus_and/or_Norovirus-like__KC409242
augaaaauggcauccagcgacgccaaccccuccgauggcucaaccgccaaccucguccccgaggucaacaacgaaguaauggcccuagaacccgucgucggcgccgccaucgccgccccaguugccggccaacaaaacguaauagaccccuggauccgcuccaacuucguacaagcccccggaggcgaauuuacagucagcccccgcaacgccccaggcgaaauccuaugguccgccccacucggacccgaccucaacccauaccuuucucaccucgcacgcauguacaacgguuacgccggcggcuucgagguccaagucauccuagcuggaaacgcguucacugcaggaaaaaucauauucgcugcagucccacccaacuucccaaccgaaggacuuucccccucucaagucacgauguucccccacaucauagucgacguccgccaacucgaaccaguccucaucccccuucccgacguccgcaacaacuuuuaccacuacaaccagaguaacgaccccacaauaaaauuaauugccaugcucuacacaccccuuagagccaacaaugccggcgacgacgucuuuaccgucuccugccguguccucacccgucccagccccgacuucgacuucaucuuccucguacccccuaccgucgaauccagaaccaagccuuucuccgucccaguccuaaccguugaagaaaugacaaacucaagauuuccaauaccccuagaaaaacucuucaccggcccuuccuccgccuucgucguacaaccccaaaacggccgaugcaccaccgacggcguccuacucggaaccacacaacucuccccaguaaacauaugcacuuuccgcggagacgucacccacauacccggcucccgcaauuacacaaugaaccucgccucccaaaacuggaacuccuacgaccccacagaagaaauacccgcaccccucggcacccccgacuucguuggcaagauacaaggcguucuaacacaaaccacacgcaccaauggcucaacccgaggccacaaagcuaccgucuauacuggcuccgcugauuucucucccaaacucggacgaguccaauucgccaccgacaccgacaacgacuucgaaaccaaucaaaauaccaaauucaccccagucggaguuauccaggauggcucaacuacaccccgcaacgaaccccaacaauggguacuacccuccuacucaggccgcaacauccacaacguccaccucgccccagccgucgcccccacauucccaggcgaacaacuccucuucuuccgauccaccaugccaggcugcagcggcuacccaaacauggaccuagacugccuccucccacaagaauggguacaauacuucuaccaagaagccgcccccgcccaaucagacgucgcccuccucagauucgucaaccccgacaccggccgcguccuuuucgaaugcaaacuccacaaaucaggcuacgucaccgucgcacacaccggacaacacgaccucguaauaccucccaacggcuacuuccgcuuugacucaugggucaaccaauucuacaccuuagcccccaugggcaacggcacuggacgccgccgcuaa

SEQ ID NO: 38699 - RNA, 1617 nt, Artificial Sequence
  derived and/or modified sequence opt11 from VP1__Norovirus_and/or_Norovirus-like__JX445167
augaaaauggccuccucagacgccaaucccucggacggaucgaccgccaaccuagucccagaggucaacaacgaaguaauggcccucgaaccaguaguuggagcagccauagcagcaccaguagccggacaacaaaacgucaucgauccauggauccgcaacaacuucguccaagcccccgguggagaauuuaccgucucaccccgcaacgcccccggagaaauccucugguccgccccacucggcccagaucuaaaccccuaccucucgcaccucgcccgcauguacaacgguuacgcgggcggcuucgaaguccagguaauccuagccggcaacgccuucacagcuggaaaaauaauauucgcugccgucccaccaaacuucccaacagaaggccucucacccucccaagucaccauguucccccacauuauagucgacguacgccaacuagaacccguccucaucccccuacccgacguacgaaacaacuucuaccacuacaaccaauccaacgacccaacaauaaaauuaauagcaaugcucuacacaccucuccgcgccaacaacgccggcgacgacgucuucaccguaucaugucgcguccucacccgccccagcccagacuucgacuucauuuuccuuguuccacccaccgucgaaucgcgaaccaaacccuucuccgucccagugcucaccgucgaagaaaugaccaacucccgcuuccccaucccccuugaaaaacucuucaccggcccauccuccgcauucguaguccagccccagaacggccgaugcacuaccgacggcguacuccugggcacaacccaacucagcccagucaacauuugcacuuuccgcggagacgucacccacauacccggcucccacaauuacacaaugaaccuagccucacagaacuggaacucauacgaccccaccgaagaaguccccgccccuuuaggcaccccagacuucgucgguaaaauccaaggcguccucacacagacaacccgaacaaacggcucuacaagaggccacaaagcaaccguauacaccggcuccgccgacuuuucccccaaacucggcagaguacaauucgcuacagacacaaacaacgacuucgaaacgaaccaaaacaccaaauucacaccaguuggagucauacaagacggcagcaccacaccccguaaugagccccaacaauggguccuaccauccuacucaggccgaaauacccacaacguacaccuagcccccgccguagcccccaccuuccccggcgaacaacuauuauucuuucgauccaccaugccagguuguuccggcuacccaaacauggaccucgauugccuucucccccaagaauggguucaauacuucuaucaagaagcugcccccgcccaaucagacgucgcccuacuccgcuucgucaacccagacaccggccgagucuuauucgaauguaaacuccacaaaucuggcuacguaaccguagcccacaccggccaacacgaccuagugauaccucccaauggcuacuuccguuucgacucgugggucaaucaauucuacacccucgcccccaugggcaacggaaccggccgacgccgcuaa

SEQ ID NO: 38700 - RNA, 1617 nt, Artificial Sequence
  derived and/or modified sequence opt11 from VP1__Norovirus_and/or_Norovirus-like__JX445156
augaaaauggcaucauccgacgcaaacccaagcgacggcuccacagccaaccuaguuccagaaguuaauaacgaagucauggcccuugagcccguuguaggagccgccaucgcagccccaguagccggccaacaaaaugucaucgaccccuggauaagaaacaacuucguccaagcccccggcggcgaguucaccgucuccccaagaaaugcccccggcgaaauacucugguccgccccacuagggcccgaucuuaaucccuaccucucccaccuugcccgaauguacaacuccuacgcgggaggcuucgaaguccaaguuauccuagcaggaaacgccuucacagcaggaaaaaucaucuucgccgccguucccccaaacuucccaaccgaaggcuuaucaccaucccaaguaaccauguucccccacaucauagucgacguccgccaacuugaacccguccuaaucccacuccccgacguccgcaacaauuucuaccacuacaaccaaucuaaugaccccacaaucaaauuaaucgccaugcuauacaccccacuaggcgcuaacaacgccggcgacgacguuuucaccguauccugccgcguccucacaagaccuucccccgacuucgacuucaucuuccucguacccccuaccgucgaaucccguaccaaaccauucuccgucccuauccuaaccgucgaagaaaugacaaacucucgcuucccaaucccccuagaaaaacucuucaccggccccuccuccgcauucguuguacaaccccaaaacggacgcugcacaacagacggcguccuacucgguaccacccaacuaagccccguuaauaucuguacauuccgaggugacgucacccacaucgccggaacccaagaguacaccaugaaccucgcaucccaaaacuggaacaacuacgaccccaccgaagaaauccccgcaccccucgguacccccgacuucgucggaaaaauccaaggcguccucacccaaaccacacgcagagacggcuccacacgcggccacaaagccaccguaucaacaggcuccguccacuucacccccaaacucggccgaauccaauucuccacagacacaagcaaugacuucgaaaccggccaaaacacccgcuucacccccguuggcgucguccaagacggcucaaccacccaccaaaacgaaccacaacaauggguccuacccaacuacuccggacgcgacucacacaacguacaccucgcccccgccguagcccccuccuuccccggcgaacaacuccuauuuuuccgcuccacaaugcccggcugcucgggcuaccccaacaugaaccucgacugccuacuaccucaagaauggguccaacacuuuuaccaagaagcagcuccagcccaauccgacguugcucuacuacguuucgugaacccagacaccggccgcguucuauucgaaugcaaauuacacaaguccggauacgucacugucgcccacaccggccaacacgaccuagucauuccacccaacggauacuuccgauucgacucaugggucaaucaauucuacacacuugccccaaugggaaacggcacaggccgccgccguuaa

SEQ ID NO: 38701 - RNA, 1617 nt, Artificial Sequence
  derived and/or modified sequence opt11 from VP1__Norovirus_and/or_Norovirus-like__GQ856458
augaaaauggccuccaacgacgcaaacccaagcgacggcuccgcagccaaccucguccccgaaguuaacaacgaagucauggcacucgaacccgucguuggcgcagcaauagccgccccagucgccggacaacaaaacgucauugaccccuggauccgaaauaacuucguccaagcccccggcggcgaguucaccgucucaccccgcaacgccccuggugaaauccugugguccgcaccccucggcccagaccuaaaccccuaucucagccaccuugcccgaauguacaacgguuacgccggcggauucgaaguccaagucauacuagccggcaacgcccucaccgccggcaaaaucauuuucgccgcuguaccacccaacuuccccaccgaaggccugucacccucucaagucacaauguucccccacauaauagucgacguacgccaacucgaacccguacucaucccccuccccgacguacgaaacaacuucuaccacuacaaccaaucaaacgacuccacaaucaaacucaucgcaaugcucuacacaccccuucgugcaaacaacgccggagaagacguauucaccguauccuguaggguacucacccgccccaguccagacuucgacuucaucuuccuaguuccacccaccguagaaucucgaaccaaacccuucacaguccccauacucaccguagaagaaaugaccaacucacgauuccccaucccacucgagaaacucuuuaccggacccucaucagccuucgucguccagccacaaaacggccgauguacaaccgacggaguccuacuaggaaccacccaacucucacccguaaacaucugcaccuuccgcggcgacgucacccacauagccggcagucgcaacuacaccaugaaccucgccagccucaacuggaacaacuaugaccccaccgaagaaaucccagcuccccucggcacccccgacuucguaggaaaaauccaaggaguacccacccaaaccacgaaaggcgauggcuccacacgaggacacaaagccacugucuacacaggcuccgcacccuucacccccaaacucggaucaguccaauuuuccaccgacacagagaacgauuucgaagcacaccaaaacaccaaauucacaccaguaggagucauucaggacggcggcaccacucaccgaaacgaaccccagcaauggguccuuccaucauacagcggacgcaacguccccaacguccaccuagccccugcuguagcccccaccuucccgggagaacagcuccucuucuucagaucaaccaugcccggcugcucugguuacccuaacauggaccucgacugccuacuaccccaagaauggguacaacacuucuaccaagaagccgcccccgcccaaucagacgucgcacuccuccgauucgucaacccagauacaggccgaguucuuuucgaaugcaaacuacacaaauccggauacgucaccguugcccauaccggacaacacgaccuaguaaucccgcccaacggcuacuuccgauucgacuccugggucaaccaauucuacacucucgcccccaugggaaacgguaccggcagacgccgcuaa

SEQ ID NO: 38702 - RNA, 1617 nt, Artificial Sequence
  derived and/or modified sequence opt11 from VP1__Norovirus_and/or_Norovirus-like__AB541299
augaaaauggcuucuaaugacgcuaaccccuccgacggcuccgccgccaacuuaguccccgaagucaacaacgaagucauggcccucgaaccaguuguaggagcugccaucgccgcccccgucgccggccaacaaaaugucauagaccccuggauccguaacaacuucguccaagcccccggcggcgaauuuaccgucucaccucgcaacgcccccggcgaaauacucugguccgcgccccuaggaccagaccucaaccccuaccuaucacaccucgcccgcauguacaauggcuacgcgggcggcuucgaaguccaaguaauccucgccggcaacgccuucaccgccggcaaaauaaucuucgccgccguacccccaaacuuccccaccgaaggacucucccccucccaagucaccauguucccacauauaaucgucgacguccgccaacucgaacccguccucauuccccuccccgacguccguaacaacuucuaccauuacaaccaauccaacgacucgacaaucaaacuaaucgccaugcucuauacaccucuccgagccaacaacgcaggcgaagacguauucaccguuucaugccgcguccuuacccgcccauccccagauuucgacuucauauuccucguaccucccaccgucgaaucccgcaccaaacccuucaccgucccaaucuuaaccgucgaagaaaugaccaacucccgcuucccuaucccacucgaaaaacuauucacuggucccucuuccgcuuucgucguccaaccccaaaacggccgcugcacaacugacggcguccuucuaggaaccacccaacucucccccgucaacaucugcacuuuccgaggcgacgucacccacaucgcaggcucacgaaauuacacaaugaaccuagcaucacuuaacuggaacaauuacgaccccaccgaagaaauccccgcaccccucggaacccccgauuucguagguaaaauccaagguguccucacccaaacaaccaaaggcgacggcucaacccgcggucacaaggcaacugucuacacaggcuccgcaccauucacccccaagcugggcuccguccaauucuccacagacaccgaaaaugacuucgaaacacaccaaaauaccaaguucacaccagucggaguaauccaagacggcggcaccacgcacagaaacgaaccacaacaauggguccuccccucuuacagcggacgcaacguccccaacguucaucuagccccugccgucgcccccaccuuccccggagaacauucgcucuacuuccgcucaaccaugcccggcugcucagguuacccaaacauggaucuagacugccuacucccgcaagaauggguccaacacuucuaccaagaagccgccccugcccaaucugacgucgcccuccucagauucgucaaucccgacaccggacguguacucuucgaaugcaaacuccacaaauccggcuacguaaccgucgcacacaccggacaacacgaccugguaaucccucccaacggcuacuuccgauucgacucguggguaaaccaguucuacacccucgcucccaugggcaacggcaccggcagacgccgcuag

SEQ ID NO: 38703 - RNA, 1617 nt, Artificial Sequence
  derived and/or modified sequence opt11 from VP1__Norovirus_and/or_Norovirus-like__AB541195
augaaaauggccagcuccgacgcaaaccccuccgacggcucagcagccaaccugguccccgaaguaaacaacgaaguaauggcccucgaaccugucguaggcgcagccaucgcagcacccguagccggccaacaaaacgugauagacccauggauccgaaacaacuuuguccaggcccccgguggcgaguucaccguaucaccccgaaacgcccccggcgaaauacucugguccgcaccgcucggccccgaccucaaccccuacuuaucccaccuagcccgaauguacaacggauacgcuggaggcuucgaaguacaagucauccucgcuggcaacgccuucaccgccggcaaaaucaucuucgccgccgucccacccaacuuccccaccgaaggccucuccccaucccaaguaacgauguucccccauaucauaguagacguucgccaacucgaacccguccucaucccccuacccgacgucagaaacaauuucuaccacuauaaccaauccaaugacucaacaaucaaacucaucgcgaugcuauacacaccacuccgugcaaacaacgccggagaagacguauucaccguauccugccgaguacuaacccgccccucacccgauuucgacuucaucuuccuugucccucccacagucgaaucccgcaccaagcccuucaccguacccauacucaccgucgaagaaaugacaaacuccagguuucccaucccccuagaaaaacuauucaccggcccaucaggcgcuuucguaguacaaccccaaaacggucgcugcacgaccgacggaguccuccucggcacaacccaacucucacccgucaacaucugcaccuuccgcggcgacgucacccacauagccggcucucguaacuacaccaugaaccuugccucccucaacuggaacaacuacgaccccacagaagagaucccagcaccccucggaacccccgacuuuguaggcaaaauccaaggcaugcuaacccaaacuacaaaaggggacggcuccacccgaggccacaaagccacagucuacaccggauccgcccccuucaccccaaaacuaggcaacguucaauuuagcacggacacagagaacgacuucgaaacccaccaaaacaccaaauucacccccgucggcguaauccaagacgggucaaccacccaccgaaacgaaccacaacaauggguucuccccuccuacuccggccgagacguacacaacguccaccuagcacccgccgucgccccaacauucccaggagaacaacuacuauucuuccguucuaccaugcccggcugcucuggcuacccgaacauggaccuagacugccuucuaccccaagaauggguccagcauuucuaccaagaagccgccccugcacagucagacgucgcacuccuccgcuucgucaacccugacaccggccgcgucuuauucgaaugcaaacuccacaaaucaggcuaugucacuguugcacacaccggacaacacgaccucgucauacccccaaacggcuauuuccgcuucgacucaugggucaaccaauucuacacccucgcccccaugggcaacggcaccggccgccgcagauaa

SEQ ID NO: 38704 - RNA, 1617 nt, Artificial Sequence
  derived and/or modified sequence opt11 from VP1__Norovirus_and/or_Norovirus-like__AB504322
augaaaauggccucuaacgacgccaacccaucagacggcucagcagccaaccuaguacccgaggucaacaacgaagucauggcucucgaacccguaguaggcgccgccaucgccgccccugucgccggacaacaaaauguaaucgacccauggauacgcaauaacuucguacaagcuccuggcggagaguucacagucagcccacgcaacgcacccggagaaauccucugguccgcaccccucggcccagaccuaaaccccuaccucucccaccuugcccgcauguauaacggcuacgccggaggauucgaaguccaaguuauccucgccggcaaugccuucaccgccggaaaaaucauauucgcagcagucccacccaacuuccccaccgaaggacucucccccucacaaguaacuauguucccccacauaaucgucgacguccgccaacuagaaccaguccucaucccccucccagacguccgaaacaacuucuaccacuacaaccaacucaacgacuccacaaucaaacuuauagccaugcucuauacuccccugagagcaaacaacgccggcgaagacgucuucacagucuccugccgcguccucacccgcccaucacccgacuuugacuucauauuccucgucccucccaccguagaaucccgcaccaaaccuuucaccguccccauacucaccgucgaagaaaugaccaacucccguuuccccaucccccucgagaaacuuuucacaggacccagcggagccuuugucguccaaccacaaaacggucgaugcacaaccgacggcguacuccucggcaccacccaacuaucccccgucaacaucugcaccuuccguggcgacguaacccacauagcgggaucccgaaacuacaccaugaaccucgccucacucaacuggaacaacuacgaucccacagaagaaauaccugcuccccuaggcaccccaggguucguaggcaaaauacaaggaguacucacacaaaccaccaaaggagacggcuccacccgcggacacaaagccacagucuacaccggcucugcaccuuucacccccaagcucggcagcguccaauucuccacugacacagaaaacgacuucgaaacacaccaaaacaccaaguucacccccguaggcguuauccaagacggcucaacuacccaccgcaacgaaccccaacaauggguacucccaagcuacucaggccgaaacguccacaacguccaccucgcacccgcugucgcaccaaccuuccccggcgaacaacuccucuucuuccgauccacuaugccaggaugcucaggcuauccaaacauggaucucgacugccuacucccccaagaauggguacaacacuucuaccaagaagcugcccccgcccaauccgacguugcacuccuaagauucgucaaccccgacacaggccgcguccucuucgaaugcaaacuacacaaauccggcuaugucaccgucgcccacaccggccaacacgaccuagucaucccacccaacggcuacuuccgcuucgacagcugggucaaccaauucuacacacucgcccccaugggcaacggcaccggucgccgcagauaa

SEQ ID NO: 38705 - RNA, 1617 nt, Artificial Sequence
  derived and/or modified sequence opt11 from VP1__Norovirus_and/or_Norovirus-like__EU876892
augaaaauggcuucaaacgacgcaaaucccuccgacgguuccgccgccaaccucguucucgagguuaacaacgaaguaauggcacuagaaccggucgucggcgccgcaaucgccgcccccguagcaggccaacaaaacgucaucgauccauggauccgaaacaacuucguccaagccccaggcggugaguucaccgucucuccccgaaacgcccccggagaaauccuaugguccgcaccccucggacccgaccuaaaccccuaccuaucccaccuugcccguauguacaacggauacgccggaggcuuugaaguccaagucauccucgcaggcaacgccuucaccgccggaaaaauaaucuucgcagcaguacccccaaacuuccccacagagggccuaucccccucccaggucacaauguucccccacaucaucgucgacguccgccaacuagaacccguacuuaucccccucccugacguacgcaacaacuucuaucacuacaaccaauccaacgacuccaccaucaaacuaaucgccaugcucuacacgccccuacgcgccaacaacgccggagaagacgucuucacagucucaugucgcgugcucacccgcccaucccccgacuucgacuucauauuccucguacccccaaccgucgaauccagaacaaaaccauucaccguccccauccugaccgucgaagaaaugaccaauucccgauuccccaucccccucgaaaaauuauucaccggcccauccggcgccuuugucguacaaccccaaaacggccgauguaccaccgaugguguccuccucggaaccacgcagcugucacccgucaacaucugcaccuuccgcggagacgucacccacauagcuggaucacgcaacuacacaaugaaccucgccucccuaaacuggaauaacuacgacccgaccgaagaaauccccgcuccccuagggaccccagacuucgucggcaaaauccaaggcguuuuaacucaaaccaccaaaggcgacggcuccacacguggccacaaagcaaccgucuacaccggauccgcccccuucacucccaaacucggcuccguccaauucuccaccgacacugagaacgauuucgaaacccaccaaaacaccaaauucacgcccgucggcgucauccaagacggcucaacaacccaccgcaacgaaccccaacaaugggucuuaccauccuacuccggccgaaacguacacaacguacaccucgcccccgcagucgcccccaccuuuccaggagaacaacuccuauucuuccgcucaaccaugcccggcugcuccggauaucccaauauggaccucgauugccuccucccacaagaauggguucaacacuuuuaccaagaagccgcgccagcucaaagcgacguagcccuacuucgcuucguaaaccccgacacuggacgcguccucuucgagugcaaacuccauaagucaggcuaugucaccgucgcccacacaggucaacacgaccucguaauaccacccaacggcuacuuccgcuucgacucauggguaaaccaauucuacacccucgcccccaugggaaacggcacuggcaggagacgcuaa

SEQ ID NO: 38706 - RNA, 1617 nt, Artificial Sequence
  derived and/or modified sequence opt11 from VP1__Norovirus_and/or_Norovirus-like__EU876891
augaaaauggccucaaacgacgcuaaccccuccgacggaucagccgcaaaccuaguucccgaagucucaaacgaaguaauggcacuagaacccgucguaggcgccgccaucgccgcccccguugccggacaacaaaacgucaucgaccccuggauacgcaacaacuuuguccaagcccccggcggagaguucaccguaucaccacgaaacgcacccggcgaaauccucuggucagcuccucucggucccgaccuuaaccccuaucucucccaccucgcccgaauguacaacggcuacgccggaggauucgaaguccaaguaauccucgcaggcaaugcauucaccgcaggaaaaaucaucuuugccgccguaccacccaacuucccaacugaaggacucucacccucccaagucaccauguucccucacauuaucguggauguaagacaacucgaacccguacucauaccccuucccgacgucagaaacaacuucuaccacuauaaucaauccaacgacucaacaauaaaacucauagccaugcucuauacaccacuucgcgccaacaacgccggcgaagacguauuuacagucucaugccgcguacucacaagacccucccccgacuucgacuucauuuuccuaguaccgcccaccgucgaaucucgcaccaaacccuucaccguucccauucuaacuguagaaaagaugaccaacucuagauuccccauaccccuagaaaaacucuuuaccggcccuucgggcgccuucgucguccaaccccaaaacggacgcugcacaacggacggaguacuccucggaaccacacaacucucccccguaaacaucugcaccuuccgaggcgacgucacccacaucgcaggaucccgcaacuacaccaugaaucucgccucacucaauuggaacaacuacgacccaacagaagaaauccccgcaccccuaggcacacccgacuucgucggcaaaauucaaggcguccuuacccaaaccacgaaaggagauggcuccacccgaggccacaaagcaacagucuacaccggcuccgcacccuuuaccccgaaacuaggauccguacaauucucaacugacaccgaaaacgacuucgaaacacaccagaacaccaaauucacuccugucggcgucauccaggacggauccacaacacaccgcaaugaaccacaacaauggguacuacccuccuacucaggccgcaacguccacaauguccaccucgccccagccgucgccccaaccuuccccggagaacaacuccucuucuuccgcagcaccaugccaggaugcucaggcuaccccaacauggaccucgacugccuccucccccaagaauggguccaacacuucuaccaagaagcagcaccagcccaauccgacguagcacuccuccgcuucguuaacccagacaccggccguguccuuuucgaaugcaaacuccacaaaagcggauacguaacggucgcccacacaggacagcacgaccucguaaucccucccaacggcuacuuccgauucgacuccugggucaaccaauucuacacacuagcccccaugggaaacggaacaggcagacgacgcuaa

SEQ ID NO: 38707 - RNA, 1617 nt, Artificial Sequence
  derived and/or modified sequence opt11 from VP1__Norovirus_and/or_Norovirus-like__AB294792
augaagauggccuccaacgacgcauccccuucugacgguuccaccgccaaccucguaccugaagucaacaacgaagucauggcauuagaacccgucgucggcgcagcaauagcagcacccguugccggccaacaaaacgucaucgacccguggauccgcaacaacuucguccaagcacccggcggagaguucacggucucaccccgaaaugcccccggagaaauacucugguccgcaccccuaggccccgaucuuaacccuuaucugucgcaccucgcccgaauguacaacggcuaugcaggcgguuucgacguacaagucauacucgcaggaaacgccuucaccgcaggaaaaauaaucuucgccgccgucccacccaauuuccccacagaaggccuuucccccucccaaguaaccauguucccccacaucaucgucgacguccgccaacuggaacccguccucaucccucuacccgacguucgaaacaacuucuaccacuacaaccaauccaaugacuccaccaucaaacucaucgccaugcuauacaccccacuacgcgccaacaacgcaggcgacgacgucuucaccgucuccugccgcguccucacccgacccucacccgacuucgacuucaucuuccuugucccacccacugucgaauccagaacuaagccguucaccguacccauacucacagucgaagaaaugaccaauuccagauuccccauuccccucgaaaaacucuucacaggccccuccucugccuucgucguccaaccccaaaauggaagaugcaccacagacggcguacuccuaggaacaacacaacucuccccagucaacauaugcacuuucagaggcgacgucacccacauccccggcacacgcaccuaccgcaugaaccucgcaucacaaaacuggaacaacuacgaccccacagaagaaauccccgccccacuuggcacucccgacuucguagguaaaauccagggcaugcuaacccaaaccaccaaaggagacgguucuacccgagggcacaaagcaacagucucaacagguuccgucgacuucaccccaaaacucggauccguccaauuugccaccgacaccgacaacgacuucgaaacaggccaaaacacccgauucaccccagucggcgucauacaagacggcuccucaacccaccgcaacgaaccccaacaauggguccuccccgacuacuccggccgcacaguccacaacguccaccucgcgcccgccgucgccccaaccuucccaggcgaacaacuccuauuuuuccgaucaacaaugcccggcugcucuggauacccaaacauggaccuagacugccuccucccccaagaauggguacaacauuucuaccaagaagccgcaccaucacaauccgacgucgcucuccuacgcuucgucaaccccgacacuggccgaguacucuucgaaugcaaacuccacaaagccggcuacgucaccguagcccacacuggccaacacgacuuaguuaucccacccaacggauacuucagauucgacuccuggguaaaucaauucuacacccucgcccccaugggcaacggugcaggccgccgucgcuaa

SEQ ID NO: 38708 - RNA, 1617 nt, Artificial Sequence
  derived and/or modified sequence opt11 from VP1__Norovirus_and/or_Norovirus-like__AB303932
augaagauggcauccaacgacgcaaacccuuccgacggcuccacagccaacuuaguccccgaaguaaacaacgaggucauggcacucgaaccugucgucggcgcagccaucgccgcacccgucgcaggccaacaaaauguaaucgacccauggauccgcaacaacuucguccaagcccccggcggagaguucacaguaucaccucgcaacgcacccggcgaaauccuauggucagcaccgcucggacccgaccucaacccauaccucagccaccuugcgcgaauguacaauggcuacgcaggcggcuucgaaguccaggucauccuugccggcaaugccuuuacagcaggcaaaauaaucuucgcagcugucccacccaacuuccccaccgaaggacucagcccaucacaagucaccauguucccccacauuauaguagacguacgccaacuggaaccuguacuaaucccccuaccagacguaagaaacaacuucuaccacuacaaccaauccaaugaccccacaauaaaacucaucgcaaugcuuuacacaccccuccgugccaacaacgccggcgaagacguuuucacagucuccuguagaguucucacacgcccaagcccagacuuugacuucaucuuccuagucccucccaccguugagucacgcacaaaacccuucaccguucccauacucaccgucgaagaaaugacaaacuccagauuccccaucccccucgaaaaacuauucaccggcccaucaggcgccuucguuguccaaccccaaaacggacgcugcaccaccgacggcguccuccucggcaccacccaacuuucgccaguaaacaucugcaccuucagaggugacgucacucacaucgccggcacccacaacuacaccaugaaccucgcaucccaaaacuggaacaacuacgaccccaccgaagaaauccccgcgccacucggaacccccgacuucgucggccgaauccaaggcaugcucacccaaaccacccgcggugacgggucaacacgcggccacaaagcaaccguauccaccggagacguccacuucacacccaaacuuggcuccguacaauucaacaccgacacaaacaacgacuucgagaccggccagaacacccgcuucacaccugucggcgucguacaagacggaaacggaacccaccaaaacgaaccccagcaauggguccucccauccuacucaggacgcacaggucacaacguccaccuagcacccgccgucgccccaaccuuccccggugaacaacuauuauucuuucgcuccacuaugcccggcugcuccggauaccccaacaugaaccucgacugccuccucccacaggaauggguccaacacuucuaccaagaggcagcccccgcacaaucagacguagcacuacucagauucgucaaccccgacaccggacguguacuauuugaaugcaaacuacacaagucaggauacguaacagucgcccacaccggacaacacgaccuagucaucccacccaacggcuacuuccgcuucgacuccugggucaaccaguucuacacccuggcccccaugggcaacggcacuggccgacgccgcuaa

SEQ ID NO: 38709 - RNA, 1617 nt, Artificial Sequence
  derived and/or modified sequence opt11 from VP1__Norovirus_and/or_Norovirus-like__LC177660
augaagauggccagcuccgacgccaaccccuccgacggaucugccgcuaaccuuguaccugaaguaaacaacgaagucauggcccucgaaccugucgucggcgccgccaucgccgcccccgucgccggacaacaaaacguaaucgaccccuggauccgaaacaacuucguacaagcacccgggggcgaguucacaguuuccccacgcaacgcccccggagaaauacuauggucagcaccccuaggccccgacuuaaacccauaccucucacaccuugcccgaauguacaacggauacgccgggggauucgaaguccaagucauccucgccggaaacgccuucaccgccggcaaagucaucuucgccgccguaccucccaacuuccccacagaaggacucuccccaucacaagucaccauguuuccccacaucgucgucgacguucgacaacucgaacccguccuaaucccacucccagacguccgaaacaauuuuuaccacuacaaccaaucaaacgaccccaccauuaaacucaucgcaaugcucuacacaccccuccgcgccaacaacgccggagacgacgucuucaccguaucaugccgaguccucacccgacccucccccgacuucgacuucauauuccucguaccucccaccgucgaaucaagaaccaaacccuucaguguccccguccucaccgucgaagaaaugaccaacucacgcuuuccaauaccccuagaaaaacuauucaccggacccagcuccgccuucguaguacaaccccaaaacggacgcugcaccaccgacggcguacuacucggaaccacacaacuaucccccguaaacaucugcaccuuccggggcgacguuacccacaucaccggcucgagaaacuacacuaugaaucucgcaagucagaacuggaacaacuaugaccccaccgaagaaauccccgcaccccucggcacccccgacuucguaggcaaaauccaaggcaugcuaacccaaacaacccguaccgacggauccacccgcggccacaaggcuaccgucuauaccggauccgcagacuucgcucccaagcuaggccgcguccaauucgagaccgacaccgaucaugacuucgaagcaaaccaaaacaccaaauuuaccccaguaggcguuauccaagacggauccaccacccaccguaacgaaccucaacaauggguucucccauccuacuccggacgcaauacacccaacguccaccucgcuccagccgucgccccaaccuuccccggcgagcaacuucucuuuuuccgaucaacaaugcccggcugcucaggcuaccccaacauggacuuagacugccuccucccacaagaauggguccaauauuucuaccaagaagccgcucccgcccaauccgacgucgcccuacuacgcuuugucaacccagacaccggcaggguccuauucgaauguaaacuucacaaacucggcuacgucaccguagcccacaccggccaacacgaucucgucauaccgcccaacggcuacuuccgcuucgacuccugggugaaccaauucuacacacucgccccaaugggcaacggcaccggccgccgccgcuaa

SEQ ID NO: 38710 - RNA, 1617 nt, Artificial Sequence
  derived and/or modified sequence opt11 from VP1__Norovirus_and/or_Norovirus-like__KX608866
augaagauggccucaucagacgcaaacccauccgacggcucaacagcaaaccuuguccccgaagucaacaacgaagucauggcccucgaaccagucgucggcgccgccaucgccgcccccgucgccggccaacaaaauguaaucgacccauggauacgaaacaacuucguccaagccccaggcggugaguucaccgucuccccacgaaacgcccccggugaaauccucugguccgcaccucucggaccagaucucaaccccuaccucucccaccucgcccguauguacaacggauacgcuggcggcuucgaaguacaagucauccucgcuggcaacgcuuucaccgccggaaaaaucauauucgccgccguaccacccaacuuuccaacugaaggacucucuccaucacaaguaacuauguuuccccacauuaucgucgacguccgacaacucgaaccaguccucaucccucuccccgacguccgcaacaacuucuaccacuacaaccaaucaaacgaccccacaaucaaauuaaucgcaaugcucuacacaccccuccgagcuaacaacgccggcgacgacguauucacaguauccugccgcguccuaaccagaccuucccccgacuuugacuucaucuuccucgucccacccaccgucgaaucacgcaccaaacccuucuccguccccguccucaccgucgaagaaaugacuaacucucgcuucccuaucccacucgaaaaacucuucacuggcccauccuccgccuucguaguccaaccccaaaacggccgcugcaccacugacggcguacuccucggcaccacacaacuauccccagucaacaucugcacauucagaggagacgucacccacaucucaggcagccgcaacuacaccaugaaccucgcaagccaaaacuggaacucuuacgaccccaccgaagaaauccccgcaccccuagguaccccggacuucgucgguaaaauccaagguguccucacccaaaccacccggaccgacggcucaacccgaggucacaaagcaaccguguacaccggcagcgcagauuucagccccaaacuaggccgcguccaauucgccaccgacacagacaacgacuucgucgcgaaccaaaacaccaaauucaccccagucggagucauacaagacggauccacaacaccccgcaacgaaccccagcaauggguccuccccuccuacuccggccgcaacacccacaacguucaccuugcccccgccgucgccccaaccuuccccggcgaacagcuccuauucuucagauccaccaugccaggcugcucuggcuaccccaacauggaccuagacugccuccucccacaagaauggguccaguacuucuaccaagaagccgccccagcccaaucugacgucgcccuccuccguuucguaaacccugacaccggacgcguucucuucgagugcaaacuccacaaguccggcuacgucaccgucgcacacacaggccaacaugaccucgucauacccccaaacgguuacuuucgcuucgacucuuggguaaaccaauuuuacaccuuagcccccaugggcaacggcacaggacgccgacgauga

SEQ ID NO: 38711 - RNA, 1617 nt, Artificial Sequence
  derived and/or modified sequence opt11 from VP1__Norovirus_and/or_Norovirus-like__KX371603
augaagauggcauccuccgacgccaacccuuccgacggcucaacugccaaccucguccccgaggucaacaacgaaguuauggcacucgaaccugucgucggcgccgcuaucgcagcccccgucgcaggccaacaaaacguaaucgaccccuggauccgaaacaacuuuguccaagcccccggcggcgaauuuaccgucagcccccgcaacgcccccggcgaaauacuaugguccgcaccucucggcccagaccucaaccccuaucucucccaucucgcccguauguacaacggcuacgccggcggcuucgaaguccaggucauccuagccggcaacgccuuuaccgcugguaaaaucaucuuugcagccgucccaccaaacuuccccaccgaaggccucuccccuucccaagucaccauguuuccccacaucauaguagacguccgccaacuugaacccguccuaaucccccuccccgauguccgcaacaacuucuaccacuauaaccaguccaacgacccaaccaucaaacucaucgcaaugcucuacacuccccuccgcgcuaacaacgccggagacgaugucuucaccguaucuugccgcguacucacacgacccuccccagacuucgacuucaucuuccuagucccacccaccgucgaaucacgaaccaaacccuucuccguccccguccuuacagucgaagaaaugaccaacucacgauucccaaucccccuugaaaagcuauuuaccggccccucaucagcauucgugguccaaccccaaaacggacguugcacuaccgacggcguccuccucggaaccacccaacuuuccccagucaacaucugcaccuuucgcggcgacgucacccacauccccggauccagaaacuauacuaugaaucucgccucccaaaacuggaacuccuacgaccccaccgaagaaauccccgccccacucggcacacccgacuucguugguaaaauccaaggaguccucacccaaaccacccgcaccaacggcagcacccgcggacacaaagcaaccgucuacacuggcuccgccgacuucuccccaaaacuaggccgaguacaauucgcuaccgacaccgacaaugacuucgaaaccaaccagaacacaaaauucaccccagucggcgucauacaagacggcuccaccaccccacgcaacgaaccccaacaauggguccucccaucguacuccggucgcaacauccacaacguccaucucgccccagcaguagcccccaccuucccaggcgaacaacuccuguucuuccgcucaacaaugcccgguugcucuggcuacccaaauauggaccucgacugccuccuaccccaagaauggguucaauacuucuaccaagaagccgccccagcgcaaucugacgucgcccuacuacgcuucgucaaccccgacacuggccguguacuuuucgaauguaaacuccacaaauccggcuacgucacaguagcccacaccggccaacacgaccuaguaauucccccuaacggcuacuuucguuucgacucaugggucaaccaauucuacacccucgcccccaugggcaacggcacaggacgcagacgauga

SEQ ID NO: 38712 - RNA, 1617 nt, Artificial Sequence
  derived and/or modified sequence opt11 from VP1__Norovirus_and/or_Norovirus-like__KX354086
augaaaauggcuucauccgacgcuaacccaucagacggcuccacagccaaccucguuccggaagucaacaacgaaguaauggcacuagaacccguugucggagccgccaucgccgccccaguagcaggccaacaaaacgucauugacccauggauccgaaacaacuucguacaagcccccggcggcgaauuuacugucagccccagaaacgcaccuggagaaauccucugguccgcuccccuuggccccgaucucaauccauaucucucacaccuugcucgaauguacaacggauacgccggcgguuucgaaguacaagucauacucgcaggcaacgccuucaccgcaggcaaaauaauauucgcagcgguuccaccuaacuucccaacagaaggccucucccccucccaaguaaccauguucccccacauaaucguagacguucgccaacucgaacccguacuaauaccccuccccgacguccgcaacaacuucuaccacuauaaccaaucuaacgacuccaccaucaaacucauagccaugcucuacacuccccuccgcgccaacaacgccggugacgacgucuucacagucucaugccgaguauugacccgccccucuccugacuucgacuucaucuuccucgucccacccacgguagaaucacgcacaaaaccuuucucaguccccauccuaaccgucgaagaaaugacaaacucccgcuucccuauaccacucgaaaaacuauucacuggccccuccucagccuucgucguucaaccccaaaacggccgaugcacuaccgacgguguacuccuuggcaccacucaacucucacccgucaacaucugcaccuuccgaggcgacgucacacacaucccgggcucacacaacuacaccaugaaccucgcaagccaaaacuggaacucauacgaccccacagaagaaauacccgcaccccucggcacccccgacuucgucggcaaaauucaaggaguccucacacaaacaacuuccaccaacggauccacccgaggacacaaagccaccguuuacacagggucugccgacuucucccccaaacucggccgcguccaauucgccaccgacaccaacgacgacuuugaaaccaaccaaaacacaaaauucacccccguaggcguaauccaagaugguuccaccacgccccgaaacgaaccccaacaauggguccuccccuccuacuccggacgcaacacccacaacguacaccucgcucccgccgucgcccccaccuuccccggagaacaacuacuuuucuuccgauccacaaugcccggaugcuccggcuacccaaacauggaccucgacugccuccucccucaagaauggguacaauacuucuaccaggaagcagcgcccgcccaauccgacgucgcccuccuacgcuucgucaaccccgacaccggucgaguauuauucgaaugcaagcuccauaaaagcggcuacguuaccguugcccacaccggccaacacgaucuagucaucccucccaacggcuacuuccgauucgacuccuggguaaaucaauucuacacccuagcccccaugggcaauggaacaggccgccgccgauga

SEQ ID NO: 38713 - RNA, 1617 nt, Artificial Sequence
  derived and/or modified sequence opt11 from VP1__Norovirus_and/or_Norovirus-like__KX354080
augaaaauggccucaucagacgcaaaucccucagacggcuccaccgccaaccuaguccccgaaguaaacaacgaagucauggcccucgagcccgucgucggcgccgccaucgcagccccagucgcaggacaacaaaacgucauugacccauggauacgcaacaacuucguccaagcccccggcggcgaguucacagucucaccccgcaacgccccaggagaaauccucugguccgcaccacucggccccgaccugaaccccuaccuaucucaccuugcccgaauguacaauggcuacgccggcggcuucgaaguccaagucauccucgcaggaaacgcauucacagccggaaaaauaauauucgccgcagucccucccaacuuccccacagaaggacuaagccccucccaaguuaccauguucccccacaucaucgucgacguaagacaacuugaacccguacucaucccccuacccgacguacgcaacaacuucuaccacuacaaccagucuaacgaccccaccaucaaacuaauagccaugcucuacacaccccuucgagccaacaacgcuggcgacgacgucuucaccgucuccugccgcguacucacccguccauccccagacuucgauuucaucuuccuugucccaccaaccgucgaaagccgcacuaaacccuucuccgucccaguacuaacaguagaagaaaugacuaacucacgcuuccccaucccacuggaaaaacuauucacaggccccucaucggccuucgucguucaaccucaaaacggacgaugcacaaccgauggaguucuccucggcacaacccaacucuccccaguaaacauuugcaccuucagaggagacgucacccacaucuccggcagccgcaacuacacuaugaaccuugccucacaaaacuggaacuccuacgacccaacugaggaaauccccgcaccacucggcaccccagacuucgucggcaaaauccaagguguacucacccaaaccaccagaaccgacggaucaacccgcggccacaaagcaaccgucuacaccggauccgcugacuuuagccccaaacucggacgcguccaauucgcaaccgacacagacaacgacuucgucacaaaccaaaacaccaaauuuacacccgucggcgucauucaagacggcuccacaaccccucgcaacgaaccccaacaaugggucuuacccucauauuccggaaggaacacacacaacguacaccuggcccccgccguugcccccacauucccaggagaacaacuccuuuucuuccgaucaaccaugcccggcugcucgggauacccaaacauggaucucgacugccuacuaccccaagaauggguccaauacuucuaccaagaggccgcccccgcgcaaucagacgucgcccuacuccgauucguaaacccagacaccggccgcguccucuuugaaugcaaacuacauaaaucaggcuacguaaccgucgcccacaccggacaacacgaccucguaaucccucccaacggcuacuuccgauucgacuccuggguaaaccaauucuacacccucgcacccaugggaaacggcacaggacgccgccgcuaa

SEQ ID NO: 38714 - RNA, 1617 nt, Artificial Sequence
  derived and/or modified sequence opt11 from VP1__Norovirus_and/or_Norovirus-like__KX354054
augaaaauggccuccucagacgccaaccccuccgacggauccaccgccaaccucguccccgaagucaacaacgaagugauggcccucgaacccguaguaggcgccgccauagccgcccccguagccggccaacaaaaugucaucgaccccuggauccgcaauaacuucguccaggcucccgggggcgaauuuaccgucuccccucgcaacgcacccggcgaaauccucugguccgcaccccucggccccgaccuaaauccauaccucucccaccuagcccgcauguacaacggcuacgcaggcggauucgaaguccaaguaauacucgcaggcaacgcauucacugccggaaaaauaauuuucgcagccguuccaccaaacuucccuacagaaggucucuccccuagccaaguuaccauguucccccacaucaucgucgacguccgacaacucgaacccguccuaauuccccuccccgacguacgcaacaacuucuaccacuacaaccaauccaacgacccaaccaucaaacucauagccaugcucuacacacccuuacgagccaacaacgccggugacgacguauucaccgucucaugccgaguccuaacacgcccaucacccgacuucgacuucaucuuccucguacccccaacagucgaaucacgcacaaaacccuucucaguacccgucuuaaccgucgaagaaaugaccaacucccgauuccccaucccacucgaaaaacuauucaccggaccauccuccgcguucguaguccaaccccaaaauggccgauguaccaccgauggaguacuacucggaaccacccaacuaucccccgucaacaucugcacauuccgaggagacgucacccacauuucaggauccagaaacuauacaaugaaccuagcaucccagaauuggaacuccuacgaccccaccgaagaaauccccgccccacuuggcacaccagacuucgucgguaaaauccaaggaguccucacacaaacaacccgcaccaacggcuccaccaggggccacaaagccaccguauacaccggaagcgccgacuucucccccaaacucggcagaguccaauucgccacggacacggacaacgacuucgaaacaaaccaaaacaccaaauucaccccaguaggcguaauccaagacggcucaacaacccccagaaaugaaccccaacaauggguucuccccuccuacuccggccgcaacauccacaacguccaccucgccccagccguggcacccacauuccccggcgaacaacuacucuucuuccgcuccaccaugcccggauguucuggcuaccccaauauggaccuggacugccuccucccccaagaauggguucaauacuuuuaccaagaagccgcaccagcacaauccgacguugcccuacuacgcuucgucaacccagacacagguagaguccucuucgaaugcaaacuccacaaaucaggauacgucaccguagcccacaccggccaacacgaccucgucauaccucccaacggcuauuuccgcuuugacagcugggucaaccaauucuacacacuagcccccaugggaaauggaaccggccgaagacgcuaa

SEQ ID NO: 38715 - RNA, 1617 nt, Artificial Sequence
  derived and/or modified sequence opt11 from VP1__Norovirus_and/or_Norovirus-like__KX354041
augaaaauggcuuccuccgacgccaacccuuccgacggcuccaccgccaaccucgucccagaggucaauaacgaagucauggcucucgagcccguagucggcgccgccaucgccgcccccguggccggccaacaaaacgucauagaccccuggaucagaaacaacuucguacaagcccccggaggagaguucacugucagcccccgcaacgcacccggugaaauacucugguccgccccacucggccccgaccuaaacccauaccuaucccacuuagcccgcauguauaauggcuacgccgguggguucgaaguccaagucauacucgccgguaacgcauucaccgccggcaagauaaucuuugccgccguacccccaaauuuucccaccgaaggccucucccccucccaaguaaccauguucccccacaucaucgucgacgucagacaauuagaacccguccuuauaccccugcccgaugucagaaacaacuucuaccacuauaaccaaucaaacgaccccaccauaaaacuaaucgcaaugcucuacaccccucuucgagccaacaacgcuggagacgaugucuuuacagucucaugcagaguacucaccagacccucccccgacuucgacuucaucuuccucguuccacccaccgucgaaucccgcacaaaacccuucucccuucccguacucaccgucgaagaaaugaccaacucucgcuuuccuaucccccuagaaaaacucuucaccggccccucuucagcauucgucguccaaccccaaaacggucguugcacaacagacgguguccuccucggcaccacacaacucuccccaguaaacaucugcacuuuccguggagacgucacccacauaagcggaucccgcaacuacaccaugaaccucgccucacaaaacuggaacucauacgaucccaccgaagaaauaccagcgccccucggcacuccagacuucgucggcaaaauacaaggcguccuaacccaaaccacccguacaaacggauccacacgaggacacaaagccaccguauacaccggcuccgucgacuucagccccaaacucggccgcguacaauucgccaccgacacugacaacgacuucgaaaccaaccaaaauaccaaauucacaccugucggcguaauccaagacggcucuaccacaccccgcaacgaaccccaacaauggguccuuccaucauacuccggccgcaacauacacaacguacacuuagccccagccguagcuccuaccuucccaggcgaacaacuccucuucuuccguuccaccaugcccgguugcuccggauaccccaacauggaccucgacugcuuacucccccaagaauggguucaauacuuuuaucaagaagcagcacccgcccaaagcgacgucgcacuccuucgauucgucaauccagacaccggacgcguccuuuucgaaugcaaauuacacaaauccggcuacguaaccgucgcccacaccggccagcacgaccuaguaauaccacccaacggcuacuuccgauucgacucuugggucaaccaauucuacacacuagcaccaaugggaaacggcaccggacgccgacgcuaa

SEQ ID NO: 38716 - RNA, 1617 nt, Artificial Sequence
  derived and/or modified sequence opt11 from VP1__Norovirus_and/or_Norovirus-like__KX354029
augaaaauggccucguccgacgccaaccccucagacggcucagcugccaaccucguacccgaaguuaacaacgaagucauggcacuugaacccgucgucggcgccgccauagcugcccccgucgcuggacaacaaaacguaauugacccauggauacgcaacaacuuuguccaagcccccggcggcgaguucaccgucucuccccguaacgcccccggcgaaauccuuugguccgcaccccucggccccgaucuuaaccccuaucucucccaccucgcccgcauguacaacggcuaugccggcggauucgaaguacaggucauccucgcaggaaacgcuuucacugccggcaaagucauauucgcagccgucccaccuaacuuccccaccgaaggacucucccccucacaagucaccauguucccacacaucgucgucgacguccgacaacucgaacccguauuaaucccccuccccgacguacgaaacaacuucuaccacuacaaccaaucaaacgaccccaccaucaagcugauagccaugcucuacaccccacuccgcgccaacaacgccggcgaugacgucuucaccgucuccugccgaguccucacacgcccuucccccgacuucgauuucaucuuccucgucccucccaccgucgaaucacgcaccaaacccuucuccguccccguacucaccguagaagaaaugaccaacucccgcuuccccauaccccucgaaaaacucuucaccggcccuagcucugccuucgucguccaaccccaaaacggccgaugcacaaccgauggaguccuucucgguacaacccaacuaucccccguaaauaucuguaccuuccgcggcgacguaacccacauaaccggaucccgaaacuacacaaugaaccucgccucccaaaacuggaacaacuacgacccaaccgaagaaacacccgcaccccucggcacaccagauuuugugggcaaaauacaaggcguccuuacacaaaccacccgaaccgacggcucaacacgaggacacaaagccaccguauacaccggaucagcagacuucgcccccaaacuaggccgaguucaauucgaaacagacaccgaccacgacuucgaagccaaucaaaacacaaaauucaccccugucggagucauacaagacgguuccaccacacaucgcaacgaaccccaacaauggguccuaccaucuuacuccggccgaaacacccacaacguccacuuagcacccgcgguagccccuaccuucccaggcgaacaacuccucuucuuucgcucuacaaugccaggcugcuccggauacccaaacauggaccuagacugccuucucccccaagaauggguacaauacuuuuaccaagaagccgcaccagcccaauccgaugucgcccuacuacgcuucgucaaccccgacaccggccgaguccucuucgaaugcaaauuacacaagucugguuacgucaccgucgcauacacuggccaacacgacuuaguaaucccacccaacggcuacuuccgauucgauaguugggucaaucaauucuauacccucgccccaaugggcaacggcacaggccgccgucgauaa

SEQ ID NO: 38717 - RNA, 1617 nt, Artificial Sequence
  derived and/or modified sequence opt11 from VP1__Norovirus_and/or_Norovirus-like__KX353977
augaaaauggcauccuccgacgccaaccccucagacggcucaaccgcgaaccucguccccgaagucaacaacgaagucauggcauuagaacccgucgucggagcagccaucgccgcaccaguagccggccaacaaaacgucauugacccauggauccguaacaacuucguccaagccccaggcggcgaguucaccgucucuccccgcaacgcaccgggagaaauccucugguccgccccacucgguccugacuuaaaccccuaccucucccaccucgcacgcauguauaacggcuacgcaggaggauucgaaguccaaguaauacuugccgguaacgccuucaccgccggcaaaaucauauucgccgcagucccaccaaacuuucccacagaaggccucuccccaucccaaguuaccauguucccccacaucaucgucgacguacgccaacucgaacccguccucaucccccuccccgacguacgcaacaacuucuaccacuacaaccaauccaacgaucccaccauuaaauuaaucgccauguuauacacuccccuacgcgccaacaaugccggcgacgacgucuuuaccgucuccugccgaguccuaacccgccccagcccagacuucgacuucaucuuccuaguaccacccaccgucgaaucacgaacaaaacccuucuccguacccguccuaacaguagaagaaaugaccaacucccgcuuuccaaucccccucgaaaaacucuucaccggaccauccagcgcguucgucguccaaccccaaaacgguagaugcacaacagacggaguccugcuaggcacaacccaacuaucccccguaaacaucugcacuuucagaggagacgucacccacaucuccggcucccgcaacuacaccaugaacuuagcaagccaaaacuggaacucuuaugaccccacagaagagaucccagcaccgcucggcacaccagacuucgucggaaaaauccaaggaguccucacccaaacaacacgcacgaacggcucaacacgcggccacaaagcuaccgucuacaccggauccgcagacuucucaccaaagcucggccgaguucaauucgccacugauaccgacaacgacuucgaaacaaaccaaaacaccaaauucacacccgucggcguaauacaagauggcggcaccacaccucgcaacgaaccacaacaauggguacucccuucauacucaggccguaacauccacaacguacaccuagccccagccgucgcucccaccuuccccggcgaacaacuccucuucuuccgcucuacaaugcccggcugcucaggcuaccccaacauggaccuugacugccuacuaccccaagaguggguacaauacuucuaccaagaagccgcccccgcccaaucagacguagcccuccuccguuucgucaaccccgacaccggacgcguccuguucgaauguaagcuccacaaauccggcuacguaaccguugcccacacaggccaacacgaucucgucauaccucccaacggauacuuccgguucgacuccugggucaaccaauucuauacucucgcucccaugggcaacggcaccggccgacgucgcuag

SEQ ID NO: 38718 - RNA, 1617 nt, Artificial Sequence
  derived and/or modified sequence opt11 from VP1__Norovirus_and/or_Norovirus-like__KX353965
augaaaauggcauccucagacgccaaucccagcgacggaucaaccgccaaccucguacccgaagucaacaacgaagucauggcacuggagccaguagugggagcagcaauagccgcccccguagccggacaacaaaacgucaucgaccccuggauccgcaacaacuucguccaagccccaggcggcgaguucaccguaagcccacgaaacgccccaggcgaaauucucuggucagcaccccucggacccgaccucaacccuuaccucagccaccuugccagaauguacaacggauacgccggaggcuucgaaguacaagucauccucgcuggcaacgccuucaccgcuggcaaaauaauauucgcugccgucccacccaacuuucccaccgaaggccucucucccucccaagucaccauguucccccacaucauugucgacguccgccaacucgaacccguacucaucccacuccccgacguccgcaacaacuucuaccacuacaaccaauccaacgaccccaccaucaaacucaucgcaaugcucuacacuccccucagagcuaacaacgccggcgacgacgucuucaccguauccugccgcguacuaacccgcccaucaccugacuucgacuucaucuuucucgucccacccaccgucgaaucccgcaccaagcccuucucaguccccguucucaccgucgaagaaaugaccaacucccgcuucccaauaccccucgaaaaacuauucaccggccccagcucagccuucguaguccaaccccaaaacggccgcugcaccaccgacggcguccucuuaggcacaacacaacucuccccaguuaacaucugcacauuccgcggagacgucacucacaccccaggaucccacaacuacacaaugaaccuagcgucccaaaacuggaacucauacgaccccaccgaagaaauccccgccccucucggcacacccgacuucgucggaaaaauccaaggcguccucacccaaaccacacgcacaaacggcuccaccagaggccauaaagccacuguauacaccggauccgcagacuucagccccaaacucggacgcguacaauucgccacugacaccgacaacgacuucgaaaccaaccaaaacaccaaauucacucccguaggcgucauacaagacggaucaaccaccccacgcaacgaaccccagcaauggguccucccauccuacucgggccgcaacauucacaacguccaccuagcccccgcaguugccccuacuuucccaggagaacaacuccuauucuuccgguccaccaugcccggaugcucaggcuacccuaacauggaucuugacugccuccucccccaggaauggguccaauacuucuaccaagaagcagcccccgcacaauccgacguagcccugcuaagauucgucaaucccgacaccggccgcguacucuucgaaugcaaacuacacaaaucaggcuacgucaccgucgcacacaccggccaacacgaccuagucaucccacccaacggcuacuuccgauucgacuccugggucaaccaguucuacacacuagcccccaugggcaacggcacaggccgacgccgauaa

SEQ ID NO: 38719 - RNA, 1617 nt, Artificial Sequence
  derived and/or modified sequence opt11 from VP1__Norovirus_and/or_Norovirus-like__KU311158
augaaaauggccuccuccgacgccaaccccucagacggcucagccgcuaaccucguacccgaagucaacaacgaaguaauggcccucgaacccgucgucggcgcagccaucgccgcccccgucgccggccaacaaaacgucaucgaccccuggauccgaaacaacuucguccaagcccccggcggcgaauuuaccgucucaccccgcaaugcccccggcgaaauccuuugguccgccccacuaggucccgaucucaaccccuaccucucacaccucgcccguauguacaacggauacgcaggaggauucgaaguacaaguaauccuagccggaaacgcauucaccgccggcaaagucaucuucgcagccgucccacccaacuuccccaccgaaggucucucccccucccaagucacuauguucccccacaucgucguugacguccgccaacucgaacccguacucaucccccuucccgacgucagaaacaacuucuaccacuacaaccaauccaacgaccccaccaucaaauuaaucgccaugcucuacaccccacuccgugcuaacaacgcaggcgacgacguuuucacugucuccugucgaguucucacccgccccuccccagacuucgacuucaucuuccucguaccucccaccguagaaucucgcacaaaacccuucucuguacccguacucaccgucgaagaaaugaccaacuccagguuccccauaccacucgaaaaacuauucacaggccccuccuccgccuucguaguacaaccccaaaacggccgcugcaccaccgauggaguccuucucggcaccacacaacucucccccgucaacaucugcacauuccgcggcgacgucacccacaucaccgguuccagaaauuauacaaugaaucucgcaucacaaaacugguccaauuacgaccccacggaagaaaucccagcaccccugggcacccccgacuucguagguaaaauucaaggcguccuaacccaaacaacacgcgcagacgguucaacacgcggccacaaagcaacaguauacaccgguuccgccgauuuugccccaaaacucggacguguccaauucgaaacagauacugaccacgacuucgaagccaaccaaaacacgaaguucacucccgucggagucauacaggacggcgguaccacacaccgcaacgaaccacaacaauggguucuccccucauauuccggacgaaacacgccaaacguacaucuagcaccagcagucgcccccacauuccccggugaacaacuccuauucuuccgcucaaccaugcccggaugcucaggcuaccccaacauggaccucgacugccuucuaccccaagaauggguacaauacuucuaucaagaagccgcacccgcacaaucggacgucgcccuacuccguuucgucaacccagacacaggccgcguauuauucgaaugcaaacuacacaaguccggcuacgucaccguugcacacaccggccaacaugaucucguaaucccgcccaacggcuacuuccgcuucgacagcuggguuaaccaauucuacacccucgccccaaugggaaacggcacgggccgacgucgcuaa

SEQ ID NO: 38720 - RNA, 1617 nt, Artificial Sequence
  derived and/or modified sequence opt11 from VP1__Norovirus_and/or_Norovirus-like__AB974408
augaagauggccuccucagacgcaaaccccucagacggcucugccgccaaccucguccccgaaguaaacaacgaagucauggcucuugaacccguagucggcgccgccaucgcagccccaguagcaggccaacaaaacgucaucgaccccuggaucagaaauaacuucguccaagcucccgguggcgaauuuacagucucccccagaaacgcccccggcgaaauccuaugguccgcaccccucggaccagaccucaaccccuaccucucccaccuagcccgaauguacaacggauaugccggcggauucgaaguccaaguaauccucgccggcaaugcauucaccgccggcaagaucaucuucgcagccgucccacccaacuuccccacagaaggccuaucgcccucccaagucacaauguucccccacauaauagucgacguccgacaacuagaacccguccucauuccacuccccgacguacgcaacaauuucuaccacuacaaccaaucaaacgauuccacaaucaaacuuaucgcuaugcucuacacuccccuccgcgcuaacaaugcuggagaagacgucuucaccgucucaugcagaguucucaccacccccuccccagacuucgacuucaucuuuuuagucccacccaccguagaaucucgcacgaaacccuucacaguccccauccucaccguagaagaaaugaccaacucccgauucccaaucccccucgaaaaacuuuucaccggacccuccucagcuuucguaguacaaccccaaaauggacguuguaccaccgacggcgucuuacuagguacaacucaacucagcccugucaacaucugcacauuccgaggcgaugucacccacauagcuggcucccgcaacuacacaaugaaccucgccucacuaaauuggaacaacuacgaccccaccgaagagauccccgcaccccucggcaccccggacuucgucggcaagauacaaggaaugcuaacucaaaccaccaagggggacggauccacccguggacacaaagcaacagucuacaccggauccgcaccauucacacccaaacucggcuccguucaauucuccacagacaccgaaaacgacuucgaaacccaccaaaacaccaaauucacaccagucggcgucauccaagacggcaacacaacucaucgcaacgaaccccaacaguggguccuacccuccuauuccggucgcaacgucccaaacguccaccuagcucccgcaguagcccccacauuccccggagaacaacuucucuucuuccgcuccacaaugccagggugcucaggcuacccaaacauggaccucgacugccuccucccacaagaauggguucaacacuucuaccaagaggccgcccccgcccaaucggacgucgcacuccuccgauuuguuaaccccgacaccggccguguccuauucgaaugcaaacuccauaaauccggcuacguaaccgucgcccauaccggacaacacgaccucguaaucccucccaacggcuacuuccguuucgauuccugggucaaccaauucuacacccucgcucccaugggcaacggaacaggccggcgccgauaa

SEQ ID NO: 38721 - RNA, 1617 nt, Artificial Sequence
  derived and/or modified sequence opt11 from VP1__Norovirus_and/or_Norovirus-like__KR904221
augaaaauggcauccuccgaugccaacccauccgacggcuccgcagccaaucucguacccgaagucaacaacgaaguaauggccuuagaaccagucgucggcgccgcaaucgcagcccccguagcaggccaacaaaacgucaucgaucccuggauccgcaauaacuucguucaggcacccggaggcgaguucacagucucuccccgcaacgcccccggcgaaauacuuugguccgccccacuaggccccgaccucaaccccuaccucucucaccucgcgcgaauguauaauggcuacgccggcggcuucgaaguccaaguaauccucgcaggcaacgccuuuaccgccggaaaaguaaucuucgccgcagucccaccgaauuucccaaccgaaggccucucucccucucaagucaccauguucccccacaucguaguugacguacgacaacucgaaccaguacugaucccucuacccgacguccgcaacaacuucuaccacuacaaucaauccaacgacccaaccaucaaacuaauugccaugcucuacacaccccuccgcgccaacaaugcaggcgacgacguauucaccgucucuugccgcguacuaaccagacccucccccgauuucgacuucaucuuccucguucccccuaccgucgaaucccggaccaaacccuucagcguccccguccuaaccguggaagaaaugaccaacucacguuucccaauaccccucgaaaaacuauucaccggacccuccuccgcauucguaguccaaccacaaaacggacgcugcaccacggacggcguccuccucggcaccacacaacucucacccguuaauauaugcaccuuuagaggcgacgucacccacauaacaggcucccguaacuacacuaugaaccucgccucucaaaauuggaacaacuacgacccaacagaagaaaucccagcgccccuuggcgcccccgacuucguugguaaaauacagggcaugcucacucaaaccacccgagccgacggauccacccgaggucacaaagccaccgucuacaccggcagcgcagacuucgcccccaaacucggccgaguucaauucgaaacugacaccgaccacgacuucgaagcaaaccaaaacaccaaauucaccccagucggcguaauccaagacggauccaccacccacagaaacgaaccccaacaauggguacuucccuccuacucaggccgcaacacccacaacguccaucucgcccccgccguagcccccacauuccccggcgaacaacuccuuuucuuccgcucaacuaugccaggaugcucaggcuacccaaacauggaccucgacugccuacuuccccaagaauggguucaauacuucuaccaagaagcagcccccgcacaauccgacgucgcccuucuccgauucgucaacccugacaccggccgcguccucuucgaaugcaaacuccacaaaucaggauacguuaccguagcccacacgggccaacaugaccuagucaucccacccaacggcuacuuccguuucgacuccuggguaaaccaauucuacacacucgcccccaugggcaacggagcaggaagacgacgauga

SEQ ID NO: 38722 - RNA, 1617 nt, Artificial Sequence
  derived and/or modified sequence opt11 from VP1__Norovirus_and/or_Norovirus-like__AB933765
augaagauggccucauccgaugcaaauccauccgacggaucuacagcaaaccucguccccgaagucaacaacgaagucauggcccucgaaccagucguaggcgccgccaucgccgcgccugucgccggccaacaaaacguaaucgaccccuggauaagaaacaacuucguucaggccccuggcggcgaguucacaguaagcccccgaaacgcucccggagaaauccucuggucagaaccccuaggccccgaccuaaaucccuaccuaucucaccucgcccgcauguacaacggcuacgccggaggauucgaaguccaagucauacuggcaggcaacgcauucacagcaggcaagaucaucuucgcggccgucccacccaacuuccccaccgaaggccuaucccccucucaagucacaauguucccacacaucauaguagacguccgccaacucgaaccaguacucauaccccuacccgacguacgaaacaauuucuaucacuacaaccaaucaaacgacuccaccaucaaacuuaucgcuaugcucuacacaccccuacgcgcaaacaaugccggcgacgacgucuucaccguaagcugucgcguacucacccgacccuccccagacuucgacuucauauuccucguacccccaaccgucgaaucccgcacaaaaccauucuccguccccguccucaccgucgaagaaaugacaaacucacgauuccccaucccccuagaaaaacuauucaccggacccuccuccgcauucgucguacaaccccaaaacggccgaugcaccacugacggcguccuccugggcacaacacaacucucccccgucaacaucugcacauuccgcggagacgucacccacaucccagguucacguaacuacacuaugaaccuagcaucccaaaacuggaacucauacgacccgacugaagaaaucccugcaccccuaggcacccccgacuucgucggcaaaauccaaggagucuuaacacaaacaacaagaacgaauggcucuacccgaggccacaaagccaccguauauaccggauccgcggacuucagccccaaacucggccguguccaauucgccaccgacaccgacaacgacuucgaaaccaaccaaaacacaaaauucacccccguaggcguaauccaagacggaggaacaacccaccgaaaugagccucaacaauggguccucccauccuacagcggccgcaacauccacaauguccaccucgcacccgccgucgcaccaaccuuccccggcgaacaacuacucuucuuccgaagcaccaugcccggcugcagcgguuaccccaacauggaccuagacugccuccuaccccaagaauggguccaauacuuuuaccaagaagcagccccagcacaauccgacguagcacuccuccgcuucgucaaccccgacaccggacgcguacuuuucgaaugcaaacuccauaaauccggcuacguaacuguagcccacacaggccaacacgaccucguaaucccacccaacggauacuuccgcuucgacagcugggucaaccaauucuacacccucgcucccauggguaacggaacaggccgccgacgcuaa

SEQ ID NO: 38723 - RNA, 1617 nt, Artificial Sequence
  derived and/or modified sequence opt11 from VP1__Norovirus_and/or_Norovirus-like__AB933761
augaaaauggccuccucagacgccaacccaucagacggcucaaccgccaaccucguacccgaagucaacaacgaagucauggcccucgaaccagucgucggcgccgcaauagccgccccugucgcuggucaacaaaacgucaucgaccccuggauacgaaucaacuucguccaagcccccggaggcgaguucacaguaucaccccgcaacgcacccggcgaaauccugugguccgccccacucggacccgaccuaaacccuuaucucucccaccucgcaagaauguacaacggcuacgcgggcggcuucgaaguccaagucauccucgccggaaacgccuucacagccggcaagaucaucuucgccgcuguuccacccaacuuccccacugaaggccucuccccaucacaagucaccauguucccccacaucaucgucgacguccgccaacucgaacccguacuuaucccccuacccgacguccguaacaacuucuaccacuacaaccaguccaacgaccccacuaucaagcucaucgcaaugcuauacacaccccuaagagccaacaacgccggagacgacguuuucaccguauccugccgcguacuuacacgcccaucccccgacuucgacuucauuuuucucguacccccuacugucgaaucccgcacaaaacccuucucaguccccguccucacuguagaagaaaugaccaacucccgcuuccccaucccacucgaaaaacuuuucacuggccccucaucggcauucgucguccaaccucaaaacgggcgaugcaccaccgacggcguauuacucggaaccacacaacucucacccguaaacauaugcaccuuccgcggcgacgucacgcacauccccggcucacguaacuacaccaugaaccucgcaucacaaaacuggaacucauacgacccuaccgaagaaauccccgcaccucucggcaccccagacuucgucgguaagauacaaggaguccuuacccagacuacccgcaccaacggcucaacccgcggacacaaagcuacagucuacaccggaucagccgacuucucccccaaacucggccgaguccaauucgccaccgacaccgacaacgacuuugagaccaaccaaaacaccaaauucacccccgucggagucauccaagacggcuccaccacuccccgaaacgaaccccaacaauggguccuacccucauacuccggccgaaacauccacaauguccaccucgcccccgccguagcacccacauucccaggggaacaguuacuguucuucagauccacaaugcccggaugcagcggcuaccccaacauggaccuagacugccuccucccccaagaguggguccaauacuucuaccaagaagcagccccugcccaauccgacgucgcccuacuacgcuucguaaaccccgacaccggccgcguacuauucgaaugcaaacuccacaaauccggcuacguaacuguagcccacaccggccaacacgaccucgucauacccccaaacggcuacuuucgcuucgacuccuggguaaaccaauucuacacccucgccccuauggggaacggcaccggccgccggcgcuaa

SEQ ID NO: 38724 - RNA, 1617 nt, Artificial Sequence
  derived and/or modified sequence opt11 from VP1__Norovirus_and/or_Norovirus-like__AB933748
augaaaauggcaucauccgacgcuaaccccagcgacggcucuacggccaaccuugucccagaagucaacaacgaaguaauggcacucgaaccaguagucggcgcagccaucgccgccccggucgccggccaacaaaacgucaucgacccauggauacgaaacaacuucguccaagccccaggaggagaguucaccgucucaccccgaaacgccccgggugaaauccucuggagcggcacccuaggcccagaccucaacccguaccucucccaucucgcccguauguacaacggcuacgccggaggcuucgaaguccaggucauccucgccggcaacgcauucaccgccggaaaaaucaucuuugcugcagucccacccaacuuccccaccgaaggccucucacccagccaagucacaauguuuccgcacaucaucgucgacguacgccaacucgaacccguacucauuccccucccugacguacgcaacaacuucuaccacuacaaccaaucaaaugaccccacaauaaaacucaucgcaaugcucuacacuccccuaagagcaaacaacgccggcgacgaugucuuuaccguguccugccgcguccuaacccgcccaucaccugacuucgacuucauauuccucguacccccaacagucgaaucacgcaccaaacccuucagcgucccaguccuaaccguggaagaaaugacaaauucccgcuucccaaucccacucgaaaaacucuuuaccggccccuccucagcauucguuguacaaccccaaaauggccgaugcacaaccgacggcguccuccucggcacaacccaacucucacccguuaacaucugcaccuuccguggagacgucacccacaucccaggaucccgaaacuacaccaugaaccucgccucccaaaacuggaacuccuacgaccccaccgaagaaaucccagccccacucggaacucccgauuucguuggcaaaauccaaggcguccucacccaaacuaccagaacaaacggaucuacacguggccacaaagccaccgucuacacaggcucagccgacuucucccccaaacuaggccgcguucaauucgccaccgacaccgacaacgacuucgaaacuaaccaaaacaccaaauuuacaccuguaggcgucauccaagacggcuccacuacaccccgaaacgaaccacaacaauggguccucccaucuuacucaggacgcaacauccacaacguucaucucgcacccgcaguagcaccaaccuuccccggcgaacaacuccucuucuuccgcagcacuaugccaggaugcucaggcuaccccaacauggaccucgacugcuuacucccccaggaauggguccaauacuucuaucaagaagcagcccccgcccaauccgacguugcccuccuccgauucgucaauccagauaccggacggguccuuuucgaaugcaagcuacacaaaucuggcuacgucaccgucgcacacacaggccaacacgaccucguaaucccacccaacggcuauuuccguuucgacuccugggucaaccaauuuuacacauuggcccccaugggcaacggcaccggccgccgaagauaa

SEQ ID NO: 38725 - RNA, 1617 nt, Artificial Sequence
  derived and/or modified sequence opt11 from VP1__Norovirus_and/or_Norovirus-like__EU921386
augaaaauggcauccaacgacgcaaacccaucagacggcuccgccgccaaccuaguccccgaaguauccaacgaagucauggcacuagaacccguagucggagccgccaucgcagccccagucgccggccagcaaaaugucauagaccccuggauccgaaacaacuucguucaagcccccggcggagaguucaccguuagcccccguaacgcccccggcgaaauccuauggagcgccccacucggcccagaccucaacccuuaccuaucacaccucgcacguauguacaacggcuacgccgggggauucgaaguccaagucauccucgccggaaacgcuuucacagccggcaaaaucaucuucgccgccgucccucccaacuuccccaccgaaggccucucgcccucccaagucacuauguucccccacauaaucguagacguacgucaacucgaacccguacucaucccgcuccccgacguucgcaacaacuucuaccauuacaaccaaucaaacgauucuaccaucaaacucauagccaugcuauacacuccccuacgugccaacaacgcaggcgaagacgucuucacaguauccugccgcguccucacacgucccuccccagacuucgacuucauuuuccucguacccccaaccgucgaaucccgaaccaaacccuucaccgucccaaucuuaacagucgaagaaaugaccaacucccgcuuccccaucccacucgaaaaacucuuuacaggccccuccggagccuucgucguccaaccccagaauggcagauguacaacugacggaguccugcucggcaccacacagcucucccccgucaacaucugcaccuuucgcggcgacgucauccacaucgccggcuccagaaacuacacuaugaaccuagcuucccucaacuggaacaacuacgaccccacugaagaaauccccgcaccccuaggcacaccagauuucgucggaaaaauccaaggaguauuaacccaaacaaccaaaggcgacggguccacacgaggccacaaagccacagucuacacaggcucagccccauucacucccaaacucgguuccguccaguucuccaccgauaccgaaaacgacuucgaagcccaccaaaacacaaaauucacaccaguaggcgucauccaagacggcggcacuacacaucguaacgaaccccaacaauggguauuaccauccuacuccggccgaaacguccacaacguccaccucgccccagccgucgccccaaccuucccaggcgaacaacuccucuucuuccgaucaaccaugcccggcugcucaggcuaccccaacauggaccuugacugcuuacuaccccaagaauggguccaacacuucuaucaagaagcagcccccgcccaauccgacgucgcccuacuacgguucgucaacccugacacaggccgaguccucuucgaauguaaauuacacaaaucaggcuacguaacagucgcucacaccggacaacacgaccucguaaucccacccaacggcuacuuccgauucgacuccuggguuaaccaauuuuauacacuugcacccauggggaacggcacaggacgacgucgcuaa

SEQ ID NO: 38726 - RNA, 1617 nt, Artificial Sequence
  derived and/or modified sequence opt11 from VP1__Norovirus_and/or_Norovirus-like__KP244321
augaaaauggccagcucagacgccaaccccucagacgggucaacagccaaccuaguuccggaagucaacaacgaagucauggcccuugagccagucgucggcgccgcaaucgcagcaccagucgcgggccagcaaaacgucauagaccccuggauaagaaacaacuucguccaggcucccggcggagaguucacagucucaccccgcaacgcucccggcgaaauacuauggucagcaccccuugggcccgaucugaaccccuaccucucccaccuagcccgcauguacaacgguuacgcaggaggcuucgaaguccaaguaauucuagccggcaacgccuucaccgcaggcaaaauaaucuucgccgccguaccacccaacuuccccacugaaggacucucacccucccaaguaaccauguucccccacaucaucgucgacguccgccaacucgaaccuguccucaucccccucccagacguccgcaacaacuucuaucacuacaaccagucaaacgacccaaccaucaagcucauagcaaugcuauacacaccacuacgcgccaacaacgccggcgacgacgucuuuacagucucaugccguguccugacccgcccuucucccgacuucgacuuuaucuuccuagucccacccacagucgaaucccgcacaaaacccuucuccguccccguccucaccgucgaagaaaugaccaacucacgcuucccaaucccccucgaaaaacuguucaccggaccauccuccgcauucgucguccaaccccaaaacggccguugcaccaccgacgguguccuacucggcaccacccaacucuccccagucaacaucugcacauuuagaggcgacgucacucacaucuccggcucccguaacuacaccaugaaccucgcaagccaaaauuggaacucauacgaccccaccgaagagauuccugccccucugggaacaccggacuucguuggcaaaauacagggcguccucacccaaacaacccgaacaaacggauccacaagaggucacaaagccaccgucuacacaggcuccgccgacuucucuccaaaacucggccgcguccaauucgccaccgacaccgacaacgacuucgaaacaaaccaaaacaccaaauucacacccguaggaguuauccaggacggcuccacaacacccagaaacgaaccccaacaauggaugcuccccucguacuccggccgaaacacccacaacguucaucuagccccagccguugcaccaacauucccaggcgaacaacuccucuucuuucgaucaaccaugcccggcugcuccggcuaccccaacauggaccucgacugccuacugccccaagaauggguccaauacuucuaucaagaagccgcccccgcccaauccgacgucgcccuccuccgauuuguaaaccccgacaccggccgcguccucuucgagugcaaacuacacaaauccggauacguaacagucgcccacaccgggcaacacgaccucgucaucccacccaacgguuacuucagauucgacagcuggguuaaccaauucuacacacuagcacccaugggaaacggcaccggccgacgacgauga

SEQ ID NO: 38727 - RNA, 1617 nt, Artificial Sequence
  derived and/or modified sequence opt11 from VP1__Norovirus_and/or_Norovirus-like__KP698923
augaaaauggccucuagcgacgcuaacccaucagacggauccgccgccaaccucguaccagaagucaacaacgaagucauggcccuagaaccagucguaggcgccgcuaucgccgcaccaguugccggccaacaaaaugucaucgaccccuggauccgcaauaacuucguccaagcucccggcggcgaguucaccgucucaccacgaaacgcccccggcgaaauccuaugguccgccccacuaggcccagaccucaacccauaccucucacaccucgcccgcauguacaacggcuaugccggcggcuucgaaguccaggucauacucgcaggcaaugcauucacagccggaaaagucaucuucgccgccguaccacccaacuuccccacugaaggccucucacccucccaagucaccauguucccccacaucgucgucgacguccgccaacuagaacccguccuaaucccccucccagacguacgcaacaacuucuaccacuacaaccaauccaacgaucccaccauuaaacucaucgcuaugcucuauacaccccuccgcgccaacaacgccggugacgacguauucaccgucagcugucgaguccuaacucgccccuccccugacuucgauuucauauuccucguuccacccaccguagaaucaagaacuaaacccuucucaguccccguacucacagucgaagaaaugacaaauucccgcuuccccaucccccucgaaaaacucuucaccggucccucaucagcauucgugguccaaccacaaaacggacgauguacaacagacggcguccuccuagguaccacccaacucucccccguaaacaucugcacauuccgaggagacgucacccacauaacaggaagccacaacuauaccaugaaccuagccucccagaacugguccaacuacgaccccacagaagaaauaccugcaccccucgguacccccgacuuuguuggcaaaauacaaggcguacucacacaaacaacccgaacggacggauccacccgcggccacaaagcuaccgucuacaccggcuccgcagauuucgccccuaaacuuggacgcguccaauucgaaaccgauacaaaccacgacuucgaagcaaaccaaaacaccaaauucacccccgucgguguuauccaagacggaggcacgacccaccgaaacgaaccacaacaauggguccuccccucauauuccggccgcaacacccccaacguccaccuugcacccgccgccgccccaacauuucccggagaacaacuccucuucuuccgcucaaccaugccaggcugcucaggauaccccaacauggaccuagacugccuccucccacaagaauggguccaauacuucuaccaagaagccgcccccgcacagucagacguagcccuucuacgcuucgucaaccccgacaccggccgcguccuuuucgaaugcaaacuucacaaaucaggcuacgucacagucgcccacacuggccaacacgaccuugucauacccccaaacggauacuuccgcuucgacucaugggucaaccaauucuacacccuugcccccaugggcaacggcaccggucgucgccgcuaa

SEQ ID NO: 38728 - RNA, 1617 nt, Artificial Sequence
  derived and/or modified sequence opt11 from VP1__Norovirus_and/or_Norovirus-like__KP241905
augaaaauggcaucauccgacgccaaccccucagacggcuccgccgcaaaccuaguaccggaaguaaacaacgaagucauggcacucgaacccgucgucggugcagcaaucgcagcccccgucgcaggccaacaaaacgucaucgaccccuggauacgaaacaacuucguacaagcccccggaggcgaauuuaccguauccccaagaaacgcccccggcgaaauccucugguccgcaccccucggccccgaccucaacccuuaccuaucccaccucgcccgaauguacaacggauacgccggcggauucgaaguccgaguaauacucgcuggcaacgccuucaccgccggaaaaguaaucuucgccgcaguacccccaaacuuccccacagaaggccucucaccaucucaagucacuauguucccccauaucgucguagacguccgacagcuagaacccguccuaauaccacucccagacguucgcaauaacuucuaucacuacaaccaguccaaugaccccacaaucaaacuuaucgcuaugcuauauacaccacuccgcgcuaacaacgccggcgacgacgucuucacugucuccugcagaguccucacucgaccauccccagacuucgacuucaucuuccuagucccacccaccgucgaauccagaacaaaacccuucucagugcccauccuaaccgucgaagaaaugaccaacuccagauucccaaucccccuagaaaaacucuucaccggacccuccucagccuucgucguacaaccucaaaacggcagaugcaccacagacggcguccuucuaggaaccacacaacucucaccugucaacaucugcaccuuccgaggagacgucacccacaucaccggcagccgcaacuacacaaugaaccucgccucccaaaacuggagcaacuaugacccuaccgaagaaauacccgccccucucggcauacccgacuucguuggaaaaauacaagggaugcucacccaaaccacccgcacagacggaucaacaagaggccacaaagcaacaguauacacaggcucagccgacuuugccccuaaacucggucgcguccaauucgagacagacaccgaccacgacuucgaagccaaccaaaacacaaaauucacacccgucggaguaauccaagacggcucaaccacccaccgcaaugagccacaacaauggguucuaccaucauacagcggacgcaacacccccaacguccaccucgcccccgcuguggcaccaaccuuccccggcgagcaacuacucuucuuccgcucaacaaugcccggaugcucaggcuacccaaacauggaccucgacugccuccuaccccaagaauggguucaauacuucuaccaagaagcagcaccagcccaauccgacguagcacuuuuacgcuuugucaacccagacacaggcagaguccucuucgaaugcaaacuccauaaauccggcuaugucaccguagcccacacaggccaacacgaccucgucauaccacccaacggauauuuccgauucgacagcugggucaaucaauucuacacccucgcccccaugggcaacggcacaggccgacgacgauaa

SEQ ID NO: 38729 - RNA, 1617 nt, Artificial Sequence
  derived and/or modified sequence opt11 from VP1__Norovirus_and/or_Norovirus-like__KP176393
augaagauggcauccuccgacgcuaaccccucugacggcagcgcugcuaaccuaguccccgaaguaaacaacgaagucauggcccucgaacccguuguaggagccgcuaucgcagcccccguugccggacagcaaaacgucaucgacccguggauccgaaacaacuucguccaagcuccaggcggcgaguucaccgucuccccacgcaacgcacccggcgaaauccuauggucagccccucuaggccccgaccucaaccccuaccucucacaccuugcacguauguacaacggauacgcaggcggauucgaaguccaagucauccucgccggcaacgcauucacagcaggaaaaguaaucuucgcggcugucccucccaacuuccccaccgaaggacuaucuccaucacaagucacuauguucccucacaucgucguagacguccgccaacucgaacccguacucaucccucucccagauguccgcaacaacuucuaccacuacaaccaauccaacgauccgaccaucaaacuaaucgcuaugcuauacaccccacuccgcgcuaacaacgccggcgacgacgucuucaccgucagcugccgcguccuuacccgcccaagucccgacuucgacuucauuuuccucguaccacccaccguggaaucccgcaccaaacccuucaguguacccguccucaccgucgaagaaaugaccaacucccgcuucccuauaccccuagaaaaacucuucaccggcccauccuccgccuucgucguacaaccccaaaacggacgaugcaccaccgacggcguacuacuuggcaccacccaacucucccccgucaacaucugcaccuuucgaggcgacgucacccacauaacaggcucacgcaauuacacaaugaaccucgcuucccagaacugguccaacuacgacccaaccgaagaaauccccgcaccccucggaacaccugacuucgucggcaaaauccaaggaguacuaacacagacaacccguacugacggcuccacucgcggccacaaagcaaccgucuacaccggaucagcagacuucgccccaaaacuuggacgcguccaguucgaaaccgacacggaccacgacuuugaagccaaccaaaacaccaaauucacacccgucggcguaauccaagacggcucaacaacccaucgcaacgaaccacaacaguggguacucccaagcuacucaggccgaaacacacccaacguccaccuggcccccgcuguagcccccaccuucccaggagagcaacuccuauucuuccgcuccaccaugcccggaugcucaggcuacccauccauggaccuugacugccuacucccacaagaauggguccaauacuucuaccaagaagcagcgccagcacaaagcgaugucgcccuacuacgauucgucaaccccgacaccggccgcguacuuuuugaaugcaaacuacacaaauccggcuacgucacagucgcacacaccggccaacaugaccucgucauaccacccaacggauacuuccguuucgacucaugggucaaccaauucuacacccuagcacccaugggcaacggaacaggccgacgccgauaa

SEQ ID NO: 38730 - RNA, 1617 nt, Artificial Sequence
  derived and/or modified sequence opt11 from VP1__Norovirus_and/or_Norovirus-like__KP096330
augaaaauggccucauccgacgcaaacccuuccgacggauccgcagcuaaccucguacccgaagucaacaacgaagucauggcccuagaacccgucguaggcgcagccaucgccgcccccgucgcgggucaacaaaacguuaucgaucccuggauacgaaacaauuucguccaagcucccggcggcgaguucaccgucucaccccgcaacgcacccggagaaauccucugguccgccccgcucggucccgaccucaauccauaccucucccaccuagcacgcauguauaacggauacgccggcggcuucgaaguccaagucauacucgccggaaaugccuucacagccggcaaaguaaucuucgcagccgucccacccaauuuccccaccgaaggucuaucccccucacaagucacaauguuuccccacaucguggucgacguacgccaacucgaacccguucuaaucccacucccagacguuagaaacaacuucuaccacuacaaccaauccaacgacccaaccauaaaacucauagccaugcuauacacaccccuucgcgcaaacaacgccggagacgacguauucaccgucuccugccgaguacucacccgccccuccccagacuuugacuuuaucuuccucgucccucccaccguagaaucccgcacaaaacccuucuccguccccguucuaaccguagaagaaaugacaaacucccgauuccccauuccccuagaaaaacucuuuaccggacccuccuccgccuucgucguccaaccccagaacggccgcuguaccacagacggcguacuucuugggacuacccaacucuccccagucaacauaugcacauuucgcggcgacgucacacacauaacuggcucccgaaauuacacgaugaaccucgccucccaaaacuggaguaacuacgaccccacugaggaaauccccgccccucuuggcaccccagacuucguaggcaaaauccagggcguacucacccaaaccacccgaaccgacggcagcacucgcggccacaaagccacugucuacacaggaucagccgacuucgcccccaaacuuggccgcguacaauucgaaaccgacaccgaccacgacuucgaagcaaaccaaaacacaaaauucacccccgucggcgucauacaagacggaggcacuacccaccgcaaugaaccccaacaauggguacucccaagcuacuccggccgcaacacaccaaauguccaccucgcacccgcugucgccccuacuuuccccggcgagcagcuccucuucuuccgcucuacuaugcccggcugcagcggauacccaaacauggaccucgacugccuacucccccaagaauggguccaauauuucuaccaagaagcagcacccgcacaaucagauguagcacuccuccguuucgucaacccugacaccgguagaguacuuuucgaauguaagcuccacaaaacaggcuaugucacagucgcccacaccggacaacacgaucucgucauacccccuaacggcuacuuucgauucgacuccuggguuaaccaauucuacacucucgcacccaugggcaacggcaccggccgacgaagauaa

SEQ ID NO: 38731 - RNA, 1617 nt, Artificial Sequence
  derived and/or modified sequence opt11 from VP1__Norovirus_and/or_Norovirus-like__KM982953
augaagauggccucaucagacgccaaccccucagacggcuccgccgcaaaccuugucccagaggucaacaacgagguuauggcacuagaacccguaguaggggccgcaaucgcagcccccgucgccggccagcaaaacgucaucgaccccuggauccguaacaacuucguccaagcccccggcggcgaguucacaguauccccacgaaacgcacccggcgaaauccuuuggucagcaccucucggacccgaccucaaccccuaccugucccaccuagcccgcauguacaacggcuacgcuggaggauuugaaguccaaguaauacucgccggcaacgccuucaccgccggaaaagucauauuugcagccguacccccgaauuuccccaccgaaggacucuccccaucucaagucaccauguucccccacaucgucgucgauguucgccaacucgaacccguccuuauacccuuacccgacguccgaaacaacuucuaucacuacaaccaaaccaacgacccuaccaucaaacucaucgccaugcuauacacaccccuucgcgcaaacaacgcaggcgaugacgucuucacaguauccugcagaguccuaacccguccaucccccgacuucgacuucaucuuucuagucccacccacaguagaaucacgcaccaaacccuuuuccguccccguccucacaguagaagaaaugaccaacucacgcuuccccaucccccuagaaaaacuauucaccgguccaucuucagcuuucguaguucaaccacaaaacggccgcugcacuaccgacggcguccuccucggcaccacccaacugucacccguaaacauaugcacauuccgcggcgacgucacgcacaucaccggcucacguaacuacaccaugaaucuagcaucucaaaacuggaacaacuacgaccccaccgaagaaaucccugccccacucgguauccccgacuucguaggcaagauccaaggaaugcucacccaaaccacccgaaccgacgguuccacacgcggacacaaagccacaguauacaccggauccguugacuucgcccccaaacucggccgcguccaauuugaaaccgauacagaccacgacuucgaagccaaccaaaacaccaaauucacacccgucggcgucauucaagacggauccacgacccaccguaacgaaccccaacaguggguacuccccucauacucaggucgaaacacacccaacguccaccuagcaccagcugucgcgcccacauucccaggcgaacaacuccucuucuuccgcuccaccaugcccggcugcucuggcuacccuaacauggaccuagacugccuccuaccccaagaauggguccaauacuucuaccaagaggccgcacccgcacaaucagacguugcccuccuccgauucgucaaccccgacaccggaagaguacucuuugaaugcaaacuacacaaguccggcuaugucaccgucgcacacaccggacaacacgaccuagucaucccacccaacggcuauuuccgcuucgacuccugggucaaccaauuuuacacacucgcacccaugggcaacggcaccggccggcgccgcuaa

SEQ ID NO: 38732 - RNA, 1617 nt, Artificial Sequence
  derived and/or modified sequence opt11 from VP1__Norovirus_and/or_Norovirus-like__KM982936
augaaaauggcuuccuccgacgcaaauccaucugacgguuccgccgccaauuuagucccagaaguaaacaacgaaguacucgcacuagaacccgucgucggcgccgcaaucgccgcccccgucgcuggccaacaaaacgucauagaccccuggauacgaaacaauuucguacaagccccaggcggcgaguucaccgucuccccacgcaaugcccccggcgaaauccucugguccgccccucuaggacccgaccucaacccauaccucucccaccucgcacgaauguauaacgguuacgccggcggauucgaaguucaagucauccucgccggcaacgcuuucacagcaggcaaagucaucuucgcagcaguaccacccaacuuccccacugaaggccuuucucccucucaggucacaauguucccccacaucgucguagacguucgccaacuagaaccaguccucaucccacuucccgacguccgcaauaauuucuaccacuacaaccaauccaacgaccccacaaucaaguugaucgccaugcucuacacgccacuccgggcaaacaacgccggagacgaugucuucaccguaucaugccgcguccucacccgccccucaccagacuucgacuuuaucuuccuugucccucccaccgucgaaucacgaaccaaacccuucuccguacccaucuuaacuguagaagaaaugaccaacucaagauuucccauuccacuggaaaaacuauucacgggccccucuuccgcauucgucguacaaccacaaaacggcagaugcacaacugauggcguccuccucgguaccacccaacucucccccguaaacaucuguaccuuuagaggcgacguaacccacaucacaggaucccacaacuacaccaugaaccucgccucccaaaacugguccaacuaugaucccaccgaagaaaucccagcaccccuaggcacacccgauuucgucggcaaaauccaaggcguacugacccagaccacacgaacagacggcuccacccgcggccacaaagccaccgucuacaccggcuccgcggacuucgccccaaaacucggacgcguacaauucgaaaccgacacagaccgcgacuucgaagccaaccaaaacacaaaguucaccccaguaggaguaauccaagacggcggaacaacucacagaaacgaaccucaacaguggguacuacccuccuacucaggccguaacaccccaaacguacaccucgcccccgccgucgcccccaccuuccccggcgaacaacuccuauucuuccgcucaacuaugcccggcugcuccggcuacccuaacauggaucuagacugccuacuaccacaagaguggguacaauacuucuaccaagaagccgcucccgcccaauccgacguugcacuccuacgcuucgucaacccggacacaggccgcgugcuauucgagugcaaacuccacaaauccggcuacgucaccgucgcccacaccggacaacacgaccuagucauacccccuaacggcuacuuccgcuucgauuccugggucaaccaauucuacacacucgccccaauggguaacggcaccggacgccgccgcuaa

SEQ ID NO: 38733 - RNA, 1617 nt, Artificial Sequence
  derived and/or modified sequence opt11 from VP1__Norovirus_and/or_Norovirus-like__KM514073
augaaaauggccagcagcgacgccaaccccuccgacggauccgcagcaaaccucguccccgaaguaaacaacgaaguaauggcccucgaacccgucguaggcgcugcuaucgcagcccccgucgcuggacaacaaaacgucaucgaccccuggauccgaaacaacuucguccaagcacccggcggcgaguucacaguaucuccccgcaacgcacccggagaaauccucugguccgcuccucucggccccgaccuaaacccauaccuaucccaccuugcccgcauguacaacggcuacgccggcggcuucgaaguacaaguucuacuugccggaaacgcauucaccgcaggcaaaguaaucuucgccgcaguaccacccaauuuccccacagaaggccugucccccucacaaguaacaauguucccccacauagucgucgacguccgccaacucgaaccaguccucauuccccucccugacguccguaauaacuuuuaccacuacaaccaauccaacgaccccaccauaaaacucauagccaugcucuacaccccacuccgugccaauaacgccggcgacgacgucuucaccgucucaugccgcguccuaacccgccccucccccgacuucgacuucaucuuucuaguaccaccaacagucgaaucccgcacuaaacccuucuccguccccguccugaccgucgaagaaaugacuaacucaagguucccgaucccacuagaaaaacuauucaccggccccuccucagcuuucgucguccaaccacaaaacggccggugcaccacagacggcguccuccuaggcacaacccaauuaucccccgucaauaucugcacauuccgcggcgacgucacccacaucaccggcucccguaacuacaccaugaaccuagccucucaaaacuggagcaauuacgacccaaccgaagaaauacccgcaccccucggcacccccgacuucgucggcaaaauccaagguaugcuaacccaaaccaccagaaccgacggauccacccgcggucacaaagccaccgucuauacugguucagccgacuucgcccccaagcucggccgcguccaauucgaaacagauacagaccacgacuuugaagccaaccagaacacaaaauucaccccgguaggaguuauccaagacggcuccacaacucaccgcaacgaaccccaacaauggguccuacccucauauucgggacgaaacacccccaacguccaccuugcccccgccguugcaccaaccuuccccggagaacaacuccucuucuucagauccaccaugcccggcuguuccggcuacccaaacauggaccuagacugucuacucccccaggaauggguucaauacuucuaccaagaagccgcccccgcacaauccgacgucgcccuacuccgcuucguuaacccugacacaggacgaguccuauucgaaugcaaacuucacaagucagguuacgucacagucgcacacaccggccaacacgaccuagucauaccacccaacggcuacuuccgcuucgacucuuggguaaaccaauucuacacccucgcacccaugggcaacggcacaggccgccgccgcuaa

SEQ ID NO: 38734 - RNA, 1617 nt, Artificial Sequence
  derived and/or modified sequence opt11 from VP1__Norovirus_and/or_Norovirus-like__KM268086
augaaaauggcuuccucagacgcaaaccccucugacggcuccgccgcaaaccucguacccgaagucaacaacgaagucauggcccuagaaccaguagucggggcagccauugccgcccccguagcaggccaacaaaacguaaucgaccccuggauacgcaauaacuucguccaagccccaggcggagaguucaccgucagcccccgaaacgcaccaggcgaaauccuaugguccgccccacucggccccgaccuuaaccccuaucucucccaccuugcccgcauguacaacggcuacgccggcggcuucgaaguccaagucauccucgcaggaaacgccuucacagccggcaaaguaaucuucgccgccguacccccaaacuuucccacggaaggccuaucucccucccaagucacaauguucccucacaucgucgucgacguacgccaacuagaaccaguccucaucccccuacccgacguccgcaauaacuuuuaucacuacaaccaaagcaacgaccccacaaucaaacucauagccaugcuuuacacaccccuacgcgccaacaacgcuggcgacgacguauucacagucuccugccgaguccucgcccgcccauccccagacuucgacuuuauauuccucgucccacccaccgucgaauccagaaccaaacccuucuccguacccguccuaaccgucgaagaaaugaccaacucccguuucccgauaccccucgaaaaacuauucacaggaccauccucagccuucgucguccaaccccaaaacggccgaugcaccaccgacggcguccuacucggaacaacucaacuaucuccugucaacauuugcacauuccgcggcgacgucacacacaucaccggcucccgcaacuacacaaugaaccuagccucacaaaacugguccaauuaugacccuacagaagaaauccccgcaccccucgguacccccgacuuugucggcaaaauacaggggguccucacucaaaccaccagaacagauggcucaacccgaggccauaaagcuaccgucuacaccggcuccgccgacuucgcacccaaacucggccgcguccaauucgaaacagacaccgaccacgacuucgaagcuaaccaaaauaccaaauuuacacccgucggcgucauacaagacggcucaacgacccaccgcaacgaaccucaacaauggguccuccccucuuacucaggacgaaauacaccgaacguccaccucgcccccgccguagcccccacguuccccggcgaacaacuacuauucuuccgcuccaccaugcccggcugcuccggcuaccccaacauggacuuagacugccuccucccucaagaauggguccaauacuucuaccaagaagcagcucccgcucaauccgacgucgcauuacuccguuucgucaacccugacaccggccgaguccuauucgaaugcaaacuccacaaauccggauacguaacagucgcacacaccggacaacacgaccucgucaucccucccaacgguuacuuccgauucgacucaugggucaaccaauucuacacccucgcacccaugggcaacggcacgggccgucgccgcuaa

SEQ ID NO: 38735 - RNA, 1617 nt, Artificial Sequence
  derived and/or modified sequence opt11 from VP1__Norovirus_and/or_Norovirus-like__KM198552
augaaaauggccuccaacgacgccaacccuuccgauggcucagccgcaaaccuaguccccgagguaucgaacgaagucauggcccucgaaccaguagucggcgccgcaauagccgcccccgucgcgggacaacaaaacguuaucgaucccuggaucagaaacaacuucguccaagcccccggcggcgaguucaccgucucacccagaaacgcccccggcgaaauccucuggucagcaccccucggaccagaccucaaccccuaccucucccaccucgccagaauguacaacggcuacgcuggcggcuucgaaguccaaguaauacucgccgggaaugcuuucaccgccgguaaaaucaucuucgccgccgucccacccaacuuccccaccgaaggccuuucaccaucccaagucaccauguucccccauaucauugucgacgucagacaacuagaaccagugcucaucccccuccccgacguacgaaacaacuucuaccacuacaaccaaacaaacgacuccaccaucaaacuaaucgccaugcuauacaccccacuccgcgcuaacaacgccggcgaagacguauucaccgucuccugccgaguacucacacgcccaucaccagacuucgacuucaucuuucuagucccucccacaguagaguccagaaccaaacccuucacaguccccauacuaaccguagaagaaaugaccaauucccgcuuccccauaccccuggaaaaacuauucacuggccccuccggcgcauucgucguacaaccccaaaacggccgcugcacaaccgacgguguacuacuagguaccacccaacucucaccugucaacaucuguacauuccgcggagacgucacacacauagcagguucccguaauuacaccaugaaccucgccucaauaaacuggaacaacuacgacccaacugaagaaaucccagcaccccuuggcaccccagacuucgucggcaaaauccaaggcguacucacacaaacuacuaaaggggacggcuccacacguggacacaaagccacaguguacaccggcagugcccccuucaccccuaaacuuggauccguccaauucuccacagacaccgaaaacgacuucgaaacccaccaaaacacaaaauucacacccgucggcgucauccaagacggaggcacaacacaccgcaacgaaccccaacaauggguacuucccuccuacagcggccgagacguccacaacguccaccucgccccagccgucgccccuacauuccccggcgaacaacucuuauucuuccgcuccaccaugccaggcugcuccggauaccccaacauggaccucgacugcuuacucccccaagaguggguucaacacuucuaccaagaagccgcccccgcccaaucagacgccgcacuucuccgcuucgucaaccccgacaccggccguguccucuucgaaugcaaacugcacaaauccggcuacgucacagucgcacacaccggacagcaugaccuaguuauaccacccaauggcuacuuccgcuucgacucaugggucaaccaauucuacacucucgccccaaugggcaacggaacgggccgccgccgauaa

SEQ ID NO: 38736 - RNA, 1617 nt, Artificial Sequence
  derived and/or modified sequence opt11 from VP1__Norovirus_and/or_Norovirus-like__KJ716358
augaaaauggcaucuuccgacgcaaaccccuccgacggcuccgcugccaaccucguaccagaaguuaacaacgaagucauggcccucgaaccagucguaggcgccgccaucgccgcuccagucgcuggccaacaaaauguaaucgacccuuggauccgaaacaacuucguccaagcccccggaggcgaguucacaguaucuccccgcaacgcccccggcgaaauacucuggucagcaccccucggaccagaucuaaaucccuaccucucccaccucgcccgcauguacaacggcuacgccggcggauucgaaguucaagucauucuugccggcaaugccuucaccgcuggcaaagucaucuucgccgccguacccccaaacuuccccaccgaaggacuuucucccucacaagucaccauguucccccauaucgucgucgacguccgccagcucgaacccguccucauaccccucccugacguacgaaacaacuucuaccacuacaaccaauccaacgacccgaccauuaaacucaucgccaugcucuacacuccccuccgagccaacaacgccggagaugacgucuucaccguuuccugccgaguacuuacccgccccucucccgacuucgacuucauauuccuagucccacccaccguugaaucccgcaccaaacccuucuccguccccguccuaaccgucgaagaaaugaccaauucgcgauuccccauaccccucgaaaaacuauuuaccggccccuccuccgccuucgucguacaaccccaaaacggccgaugcaccacagacgguguccuacuaggaaccacacaacuuucccccgucaacaucugcaccuuccgaggagccgucacccacauaacaggcucccgcaacuacacaaugaaccucgcaucgcaaaacugguccaauuacgacccaacugaagagauccccgccccacucggcaccccagacuucgucggcaagauccaaggcguacucacccaaacaacacgcacagacggcucaacacgcggccacaaagcaacagucuacaccggaucagcagacuucgcccccaaacuaggccgaguccaauucgaaaccgauacagaccgugacuucgaagccaaccaaaacacaaaauucacccccgucggcguuauacaagacggauccaccacccaccgaaacgaaccacaacaguggguccuccccuccuacuccggccgaaacacaccaaacguccaccucgcacccgcugucgccccaaccuuccccggcgaacaacuacucuucuuccgcucaauaaugcccggcugcucugguuaccccaauauggaccuagauugccuacucccucaagaauggguccaauacuucuaccaagaagccgcaccagcccaauccgacgucgcccuccuacgauucgucaauccagacacuggccgaguacucuucgaaugcaaacuucauaaauccgguuacgucacagucgcccacaccggccaacacgaccucgucauaccaccaaacggcuacuucagauucgacuccugggucaaccaauucuacacccucgcccccaugggcaacggcaccggccgacgccgcuaa

SEQ ID NO: 38737 - RNA, 1617 nt, Artificial Sequence
  derived and/or modified sequence opt11 from VP1__Norovirus_and/or_Norovirus-like__KJ649702
augaaaauggccuccuccgacgccaacccauccgacggaucagccgcaaaccucguacccgaagucaacaacgaaguuauggcccuagaacccguggucggcgccgcaaucgccgcccccgucgccggccaacaaaacgugauugacccauggaucagaaacaacuucguacaggccccaggaggggaauuuaccguuagcccacggaacgcacccggcgaaauccuaugguccgcuccccuaggacccgaccucaaccccuaccucucucaccucgcccgcauguauaacggcuacgccggcggauucgaaguccaagucauccuagcaggcaacgccuucacugccggcaaagucauuuucgccgccgucccacccaacuuccccaccgaaggacuaucucccucccaagucaccauguucccccacaucgucgucgacguccgccaacucgaacccguccuaauaccccucccagacguacguaacaacuucuaccacuacaaccaauccaacgaccccaccauaaaacucauugccaugcucuauacaccacuccgagcaaacaacgccggagacgauguauucaccgucuccugccgaguccucacccgccccucccccgauuucgacuucaucuuccucguacccccaaccgucgaauccagaacaaaacccuucagcguccccguccucaccgucgaagaaaugaccaauucccgauucccaauaccacuagaaaaauuauucacaggccccuccuccgccuucgucgugcaaccccaaaacggacgcugcacaaccgacggcgucuuacucggcacaacccaacucuccccugucaacaucugcaccuuccgcggcgacgucacccacauuacaggcucgcgaaacuacaccaugaaccucgcuucccaaaacugguccaacuacgaccccaccgaagaaauccccgcaccccucggcacgcccgacuucguuggcaaaauccaaggcaugcuuacccaaaccacucgcacagacggaucaacacgcggacacaaggccacaguauacacaggcagcgccgacuucgcaccuaaacucggccgcguucaauucgaaaccgacacagacagagacuucgaagccaaccaaaacaccaaauucacaccuguuggcgucauacaggacggcuccaccacccaccgcaacgaaccccaacaauggguccuccccucauacuccggccguaacacccccaacguccaccuagcacccgccgucgcccccacauucccaggcgaacaacuccucuucuuucgaucuaccaugcccggcugcuccggauaucccaauauggaccuagauugccuccucccacaagaauggguacaauacuucuaccaagaagcugccccagcccaaucagauguagcacucuuacgcuucgucaacccggacaccggccgcguacucuucgaaugcaaacuccacaaauccggauaugucacaguagcccacacaggacaacaugaccucgucauacccccaaaugguuacuuccgauucgacuccugggucaaucaauuuuacacacuagcacccaugggcaacggcaccggccgccgcagauaa

SEQ ID NO: 38738 - RNA, 1617 nt, Artificial Sequence
  derived and/or modified sequence opt11 from VP1__Norovirus_and/or_Norovirus-like__KF429778
augaaaauggcauccuccgacgccaaccccucagacgguucaaccgccaaucucguccccgaagucaauaacgaagucauggcccucgagcccguugucggcgccgcuaucgccgcaccagucgcaggccaacaaaaugucauagaccccuggauccgcaacaacuucguccaagcccccggcggcgaauuuacaguauccccacgcaacgcucccggcgaaauacucuggucagcaccccuaggccccgaccucaaccccuaucucucgcaccuagcccguauguacaacggcuacgccggcgguuucgaaguacaaguaauccucgcaggcaacgccuucacagcaggcaaaaucauauucgccgccgucccuccaaacuucccaaccgaaggccucucccccucacaaguaacaauguucccccauaucaucguagacgucagacaacuagaaccaguccucaucccacuccccgacguccgaaacaacuucuaucacuacaaccagagcaaugaccccacaaucaaacucaucgcuaugcucuacacuccccuacgcgcaaacaacgccggcgacgacgucuucacaguaucuugcagaguacucacacgccccucacccgacuucgacuucauauuccucguacccccaacugucgaaagccgaaccaaacccuucucaguaccaguccuuaccguagaagaaaugacgaacagccgauucccuaucccccuagaaaaacuauucaccggccccuccucagcauucgucguacaaccccaaaacgggcgcugcacaacagacggcguccuccucggcacaacccaauuaucacccguaaacaucugcaccuuccgcggcgacgucacccacauagccggcucccggaacuacaccaugaaccucgcgucacaaaacuggaacucauacgaccccacagaagaaaucccugccccacucggcacccccgauuucgucggaaaaauacaaggaguacuaacccaaaccacacgcaccgacggcuccacccgcggccacaaagcuaccgucuacaccggaagcgcagacuucucucccaaauuaggccgaguacaauucgccacagauaccgacaacgacuucgucaccaaccaaaacaccaaauucaccccuguaggcgucauccaagacggaggcaccacuccccgaaacgaaccacaacaauggguacuaccaucauacuccggccgcaacacccacaacguccaccuugcacccgccgucgcaccaaccuuccccggugaacaacuccucuucuuccgcuccaccaugcccggaugcucaggcuaccccaacauggaccucgacugccuucucccccaggaguggguccaauacuucuaccaagaagccgcacccgcccaauccgacguagcacuacuccgauucgucaaucccgacaccggacgaguucuauucgaaugcaaacuacacaaauccggauaugucaccguagcacauaccggccaacacgaccucgucaucccacccaauggcuacuuccgcuucgacuccuggguaaaccaauucuacaccuuagcccccaugggcaacggcaccggccgccgacgcuaa

SEQ ID NO: 38739 - RNA, 1617 nt, Artificial Sequence
  derived and/or modified sequence opt11 from VP1__Norovirus_and/or_Norovirus-like__KF060113
augaaaauggcguccucagacgccaaccccagcgacggcucggcagccaaccuaguccccgaagucaacaaugaagucauggcacucgaacccgucgugggagcagccaucgcugcccccgucgccggccagcaaaacguuaucgaccccuggauccgcaacaacuucguacaagcccccggcggugaguucaccguaucaccccgaaacgcccccggagaaauccucuggucagcaccccuuggacccgaccucaaccccuaccuaagucaccucgcccgcauguauaacggcuacgccgguggcuucgaaguacaaguaauccucgccggaaacgccuucaccgccggcaaagucaucuucgccgccguaccacccaacuuccccacagaaggccucucacccucgcaagugaccauguucccccacauuguugucgauguccgccaacucgaacccguacucauaccccuccccgacgucaggaacaacuucuaccacuacaaccaauccaacgaccccaccauaaaacuaauugcaaugcuauacaccccacuccgcgcaaacaacgccggcgaugacgucuucacagucucaugccgcguacuaacccgacccuccccagacuucgacuucauauuccucguucccccaaccgucgaaucccgagccaaacccuucucugucccuguccuaacggucgaagaaaugacaaacucgcgcuucccaaucccccuagaaaaacuauucaccggacccuccucagcauucguaguccaaccccaaaacggccgcuguacaaccgacgguguccuacucggcaccacccaacuaucucccgucaacauuugcaccuuccgaggagacguaacacacaucacaggcucacgcaacuacaccaugaaccucgcaucccaaaacugguccaacuacgacccaaccgaagaaauccccgcuccccucggcacccccgacuucgucggcaaaauucaaggcguccuaacccaaaccacccgaacagacggcagcacccgcggccacaaagccaccguuuacaccggcuccgcggauuucgccccaaaauuaggccgcguccaauucgaaaccgacacagaccacgauuucgaagccaaccaaaacacaaaauucaccccugucggcguaauccaagacgguuccaccacccacaggaacgaaccacaacaauggguccuucccuccuauagcggccgcaacacccccaacguacaucucgcacccgccgucgcccccacauucccgggcgaacaacuccucuucuuccgcucgacaaugccaggaugcucaggcuaccccaacauggaccucgacugccuccucccacaagaauggguccaauacuucuaucaagaagccgccccugcccaaagcgacgucgcccuacuccgauucguaaaccccgacacaggccgcguccucuucgaaugcaaacuccacaaaagcggcuacgucacugucgcacacaccggccaacacgaccuagucaucccacccaacggauacuuccgauucgacucauggguaaaccaguucuacacccuggcacccaugggaaacggaaccggccgucgccgauaa

SEQ ID NO: 38740 - RNA, 1617 nt, Artificial Sequence
  derived and/or modified sequence opt11 from VP1__Norovirus_and/or_Norovirus-like__KF060106
augaaaauggcaucguccgacgccaaccccuccgacggcuccaccgccaaccucguuccugaaguaaacaacgaagucauggcccuagaaccugucgucggcgccgccauagccgcaccagucgccggccaacaaaacguuauagauccuuggauccgcaacaauuucguacaagcccccggaggcgaguucaccguaagcccccgcaaugcuccaggcgaaaucuuaugguccgcaccccucggccccgaccuaaauccauaccuaucccaucucgcccggauguacaacggcuacgccggcggauucgaaguccaaguuguacucgccggcaaugcauucaccgccggaaaaauaaucuucgccgccgucccaccuaacuuccccacugaaggccucucccccagccagguaaccauguucccccacauaauaguagauguucgccaacucgaacccguacucaucccccuccccgauguacgcaacaacuucuaccauuacaaccaauccaacgacccaaccaucaaacuaauugccaugcucuacacaccccuacgcgcuaacaacgcaggcgacgacgucuucaccgucucaugccgaguccucacccgcccguccccugauuucgacuucauauuccucgucccaccaacagucgaaucccgcaccaaaccuuucuccgucccuguccugaccgucgaggaaaugacaaacucccgguucccaauuccccuugagaaacucuuuacaggccccagcuccgccuucgucguccaaccccaaaacggccgaugcacuaccgacggaguccuccucggaaccacacagcucucaccuguaaauauaugcacauuccgcggagaugucacacacaucucuggcucccguaauuacacaaugaaccuggcuucccaaaauuggaacuccuacgacccaacggaagaaauccccgccccacuaggcacacccgacuucguaggcaaaauacaaggcguccuaacccaaaccacccgcaccgacggcuccaccagaggccacaaagcaaccguauacaccgguuccgccgacuuuucacccaaacucggacgaguccaauucgccaccgacacggacaacgauuucgucacuaaccaaaacaccaaauucacccccgucggcguaauucaagacggcuccaccacaccccgcaacgaaccccaacaauggguccuccccuccuacucaggccgaaacacccacaacguacaccuagccccagcagucgccccaaccuucccaggcgagcaacuacucuucuuccgcuccacaaugcccggcugcucaggcuaccccaacauggaccuagacugccuacuuccacaagaauggguccaauacuucuaccaggaagccgccccagcccaaucagacgucgcucuccucagauucgucaaccccgacaccggacgcguccuuuucgaaugcaaacuccacaaauccgguuacgucacugucgcccauacaggccaacacgaccucgucauaccacccaacggcuacuucagauucgacucaugggucaaccaauucuacacccuagcccccaugggcaacggaaccggccgccgccgauaa

SEQ ID NO: 38741 - RNA, 1617 nt, Artificial Sequence
  derived and/or modified sequence opt11 from VP1__Norovirus_and/or_Norovirus-like__KF060100
augaaaauggccuccucagacgccaacccuucugacggcucaacagcaaaccuaguacccgaagucaacaacgaaguaauggcccuagaaccuguugucggcgcagcaaucgccgcccccgucgcaggacaacaaaacgucauagaccccuggauccguaacaacuuuguccaagcccccggcggagaauuuaccgucuccccacggaacgcacccggugaaauccucuggagcgcgccccugggccccgaccuaaacccuuaccucucacaccuggcccgcauguacaacggcuacgccggagguuucgaaguccaaguuauccucgccggcaacgccuucaccgcuggcaagaucaucuucgcagcagugccacccaacuuccccacagaaggccucucucccucacaagucacaauguucccccacaucauugucgacguacgccaacucgaacccguacucaucccacuccccgacguccgaaacaacuucuaccacuacaaccaguccaacgacccuacuauaaaacuaauagccaugcuauacacgccccuacgcgcaaacaaugccggagacgaugucuucaccgucuccugccgaguccucacccgccccucccccgauuucgauuucauauuccucgucccucccaccgucgaaucacgaaccaaacccuucuccgucccuguacucaccguagaagaaaugacaaacucccguuuccccaucccccucgaaaaacuguucaccggccccuccucugcuuucgucguacaaccccaaaacggcagaugcaccacagacggcguucuccucggcaccacacaacucuccccaguaaacaucugcaccuucagaggggacguaacccacauuucaggcagccacaauuacaccaugaaccuugcaucccaaaacuggaacuccuacgaccccaccgaagaaauccccgccccuuuaggcaccccggacuucgucggaaaaauccaaggcaugcucacacaaacaacccgcaccgacggauccacccgcggucacaaagccacagucuacacaggcucugucgacuucucccccaaacuuggccgaguccaauucacaacggacacagacaaugacuucgaaacaaaccaaaacacaaaauucacccccguuggcgucauccaagacggcuccacaacccaccgcaaugaaccacaacaauggguacucccuuccuacucuggccgcaacacccacaacguccacuuagcccccgccguagcaccgaccuuccccggcgaacaacuccuauucuuccgcuccaccaugcccggcugcucgggauacccgaacauggaccucgacugccugcuaccccaagaauggguccaauacuucuaccaagaagcagcccccgcccaaucagacgucgcccuacuccgauucgucaacccagacaccggccgcguccucuucgaaugcaaacuccacaaauccggcuacguuacuguagcccacaccggccaacaugaccucgucaucccacccaacggcuauuucagauuugauuccugggucaaccaauucuauacccucgcccccaugggcaacggcacaggucgacgacgauga

SEQ ID NO: 38742 - RNA, 1617 nt, Artificial Sequence
  derived and/or modified sequence opt11 from VP1__Norovirus_and/or_Norovirus-like__KF060069
augaaaauggccucaucugacgccaacccaucagacggcucgaccgccaaucucguacccgaaguaaacaacgaaguaauggcccucgaacccgucguaggagccgccaucgcagcccccguagccggucagcaaaacgucaucgaccccuggauucgcaacaacuuuguccaagcccccggcggcgaguucaccguguccccucgcaaugccccaggcgaaauucuuugguccgcaccccucggccccgaucucaacccauaccucucccaccucgcccguauguacaacggcuacgcuggcggcuucgaaguccaagucauccucgcaggaaacgccuucaccgccgggaaaaucaucuucgcagcgguucccccuaacuucccaaccgaaggacucucaccgucacaagucaccauguucccacacauaauagucgacguccgccaacucgaaccggugcuaaucccccuccccgacguacgaaacaacuucuaccacuacaaccaauccaaugaucccaccaucaaacucaucgccaugcucuacacaccacuccgagccaacaacgccggcgacgacgucuucacagucuccugccgcguguuaacccgcccaucuccugacuucgacuucauauuccuagucccacccaccgucgaaucccgcaccaaacccuucuccguacccguacucaccgucgaagaaaugacaaauucccgauuccccaucccccuagaaaaacucuucacaggccccucauccgccuucguagugcaaccccaaaacggccguugcaccaccgacggcguccuccucggcaccacacaacucucccccgucaacaucugcaccuuccgcggcgacgucacccacaucucaggaucccauaacuacacaaugaaccucgcaucccaaaacuggaacuccuacgacccaacugaagaaauacccgcaccccucggcaccccagacuucgucggcaaaauucaagguguccucacacaaaccacaagaacagacggauccacccgaggccacaaagccacagucuacacaggaucugccgacuucucccccaaacugggccgcguucaauucgccacagacaccgacaaugacuucguaaccaaucaaaacaccaaauucacccccgucggagucauacaagacgguuccacgacaccccgcaacgaaccacaacaguggguccuacccucuuacuccggccgcaacacccacaacguccaccucgcaccagccgucgcuccaacuuucccaggugaacagcuucuauucuuccgcuccaccaugccaggcugcuccggcuacccaaauauggaccuagauugccuccucccccaagaauggguacaauacuucuaccaagaagccgcaccagcccaauccgacgucgcucuccuacgcuucguaaacccggacaccggccgcguacucuucgagugcaaacuccacaaauccggcuacgucacugucgcccacaccggccaacaugaccuagucaucccucccaauggcuacuuccguuucgacucuugggucaaccaauucuacacucuagccccaaugggcaacggcacuggaagacgccgauga

SEQ ID NO: 38743 - RNA, 1617 nt, Artificial Sequence
  derived and/or modified sequence opt11 from VP1__Norovirus_and/or_Norovirus-like__KF060055
augaaaauggcaucaucugaugccaacccuucagacggcucuacagccaaccuuguacccgaaguaaacaacgaagucauggcacuagaaccagucguaggugccgccauagccgcacccguagccggacaacaaaauguaauugaccccuggauacgcaacaacuucguacaagcacccggcggcgaguucaccguaucaccccgaaacgcccccggcgaaauccucugguccgcuccccucggacccgaccuuaaccccuaccucucccaccucgcccgcauguacaacggcuacgccggaggcuucgaaguacaaguaauucuagccggaaacgcauucaccgccggcaaaaucaucuucgcagcugucccuccaaauuuccccaccgaaggccuaucaccaucacaagugacuauguucccccacaucaucguagacguacgccaacuugaaccaguccuaaucccccugcccgacguacgaaacaacuucuaccacuauaaccaguccuacgaccccaccaucaaauuaauagcuaugcucuacaccccucuccgcgccaacaacgcaggagacgacguauuuaccguaucgugccgaguacuaacacgccccagccccgacuucgauuucaucuuccuagucccacccaccgucgaaucccgcaccaagcccuucuccguccccguccucaccguugaagaaaugaccaacucacgcuuccccaucccccuggaaaaacuauucaccggccccucuagugccuucgucguccaaccccaaaacggacgcugcaccaccgacggaguccuccuaggaaccacccaacucuccccuguaaacauuugcaccuuccgcggcgacgucacccacauccccggaagccacaacuauacaaugaaccucgccucacaaaacuggaacucauacgaccccaccgaagaaauccccgccccacucggcaccccugacuuuguuggcaaaauucaaggcguacuaacccaaacuaccaaaaccaacggcuccacccgaggccacaaagccacagucuacaccggaucagccgacuucucacccaaacuaggcagaguccaauucgccacugacaccaacaacgacuucgaaacuaaccaaaacaccaaauucacucccgucggcguuauccaagacggauccaccacgccccgcaacgaaccccagcaaugggucuuaccaucguauuccggccgaaacauccacaacguacaccucgcacccgcagucgcacccaccuucccuggcgaacaacuccuauucuuccgauccaccaugcccggcugcucgggcuaccccaacauggaccucgacugccugcucccacaagaauggguccaauacuuuuaucaagaagccgcacccgcacaauccgacguagcccuucuccguuucgucaaccccgacaccggacgcguccucuucgaaugcaaacuccauaaaucaggcuacgucaccgucgcauacaccggccaacacgaccuagucauacccccaaacggcuacuuccgauucgacucuuggguaaaucaauucuauacccucgccccuaugggaaacggaaccggccgccgccgauaa

SEQ ID NO: 38744 - RNA, 1617 nt, Artificial Sequence
  derived and/or modified sequence opt11 from VP1__Norovirus_and/or_Norovirus-like__KF060028
augaagauggcaagcuccgacgcccaccccuccgacggcuccacagcaaaccucguccccgaaguaaacaacgaaguaauggcccuggaaccagucgucggcgccgcaaucgccgcccccgucgccggccaacagaacguaaucgaccccuggauccgcaacaacuucguccaagcccccgggggcgaguucaccguaucucccagaaacgccccuggugaaauucucuggucugcuccacuaggcccagaucuaaaccccuaccuuucucaccucgcccgaauguacaacggauaugcaggcggcuucgaaguccaaguaauccucgcaggcaacgcauucacagcaggcaaaaucauauucgccgccguacccccaaacuuccccaccgaaggccuaucccccucucaagucaccauguucccccacaucauugucgacguccgacaacucgaaccaguccuaauaccacuccccgacguccgcaacaacuucuaccacuacaaccaauccaacgacccaacaauaaaacucauagccaugcuuuacacuccacuccgcgccaacaacgccggugacgacgucuucaccgucuccugccgcguccuaacacgccccucucccgacuucgacuucaucuuccuggucccacccacaguagaaucccgcaccaaacccuucucuguacccguccuuaccguugaagaaaugaccaauuccagauuccccaucccccuagaaaaacucuucacuggccccuccuccgcauucguaguccaaccccagaacggaagauguacaacugacggcguccuccuaggcacaacccaacugucacccgucaacaucuguaccuuucgcggcgacgucacacacauauccggcagcagaaacuacaccaugaaccucgccagccaaaacuggaacuccuacgaccccaccgaagaaauccccgccccacuaggcaccccugacuucguuggcaaaauccaaggcguccuuacccagacuacacgcgccgacgguuccacccggggucauaaagcuaccguauacaccggcucagcagacuucucccccaaacuaggccgcguccaauucgcaacagacaccgacaacgacuucguagcaaaccaaaacaccaaauucacacccgucggugucauccaagacggcagcacaaccccacgaaaugaaccccaacaguggguccuaccaagcuauuccggucgaaacacacacaacguacaccucgccccagccgucgcccccacauuuccuggcgagcaacuccuauucuucagaucgaccaugcccggcugcuccggcuacccaaauauggaccuagacugccuacuuccccaagaauggguccaauacuucuaccaagaagccgccccagcccaauccgaugucgcacuccuccgauucgucaaccccgacacaggacgcguccucuucgaaugcaaacuacacaaaucaggcuacguaacagucgcacacaccggacaacacgaccucgucaucccucccaacggcuacuuccgauucgacuccugggucaaccaauucuacacucucgcccccaugggcaauggaaccggacgacgccgcuag

SEQ ID NO: 38745 - RNA, 1617 nt, Artificial Sequence
  derived and/or modified sequence opt11 from VP1__Norovirus_and/or_Norovirus-like__KF060022
augaaaauggccuccuccgacgcuaaucccucagacggauccaccgccaaccuaguaccagaagucaauaacgaagucauggcccuagaacccguugucggcgccgccauagccgcgccuguagccggccaacaaaacgucaucgacccauggauccgcaacaacuuuguccaagcucccggcggcgaguucaccgucucccccagaaaugccccaggcgaaauccuuuggucagcuccccuaggaccagaccucaaucccuaccucucccaccuugcucgcauguauaacggcuacgccggaggcuucgaaguacaagucauccuagcagguaacgccuucaccgcaggcaaaaucaucuucgccgccguaccucccaacuucccaaccgaaggccuuucaccuucccaaguaaccauguucccccacaucaucgucgauguccgccaacucgaacccguucucaucccccugcccgauguccgaaacaacuucuaccauuacaaucaaucuaaugaccccacaauaaaacuuauagcuaugcucuauacaccccuccgcgcaaacaacgccggugacgacgucuucaccguauccugucgaguccuuaccagacccucccccgacuucgacuucaucuuucucguucccccaaccgucgaaucacgcaccaaacccuucucagucccuguccuaaccguagaagaaaugaccaacucccgcuuccccaucccccucgagaaacuauucaccggaccauccuccgccuucgucguccaaccucaaaacggacguugcacuacagauggugucuuauuagguacuacccaacucuccccaguuaacaucugcgccuuccgaggugacguuacccacauuuccggaucucgcaacuauacaaugaaccuagccagccaaaacuggaacuccuacgaccccacagaagaaauccccgcaccuuuaggcacccccgacuuuguaggaaaaauccaagguaugcucacucaaaccacccgcaccgacggcuccacccgaggacacaaagccaccgucuacaccggcuccgccgacuucucucccaaacucggacgaguccaauucgccaccgacaccgacaacgacuucgucacaaaccaaaacaccaaguucaccccaguaggcgucauucaagacggcuccacaacaccccgcaacgagccacaacaauggguccuccccuccuacucaggacgcaacacccacaacguucacuuagcacccgccgucgcccccacauuccccggcgaacaacuccucuucuuccgcuccaccaugccuggcugcuccggcuaccccaauauggaccucgacugccuccucccccaagaauggguccaauacuucuaucaagaagccgccccggcacaauccgacgucgcucugcuccgcuuugucaaccccgacacaggccgcguccucuucgaaugcaaacuccacaaauccggauacguuaccgucgcccauaccggccaacacgaccuuguaaucccuccaaacggcuacuuccgcuucgacuccuggguaaaccaauucuacacacucgccccaaugggcaacggcaccggucgccgcagauaa

SEQ ID NO: 38746 - RNA, 1617 nt, Artificial Sequence
  derived and/or modified sequence opt11 from VP1__Norovirus_and/or_Norovirus-like__KC517376
augaaaauggccuccucugacgccaacccaagcgacggauccgccgccaaccucguccccgaagugaacaacgaagucauggcccucgaaccagucguaggggcugcaaucgcagcacccguagccggccaacaaaacgucaucgaccccuggauccgaaacaauuucguccaagcccccggcggcgaguucaccgucagcccccgcaacgcuccaggagaaaucuuauggucagcaccccucggcccagaccucaaccccuaccucagccaccucgcccgcauguacaauggcuacgccggcggcuucgaaguccaaguuauccucgccggcaacgccuuuacagccggcaaagucaucuucgccgcggucccaccaaacuucccaaccgaaggccucuccccaucgcaagucacaauguucccucacauaguuguagacguacgccaacucgaacccguucucauaccucuacccgacguccguaauaauuucuaccacuacaaccaauccaacgauccaaccaucaaacucaucgccaugcucuacacaccccuccgcgccaacaacgccggagacgacguauucacuguuuccugccgaguccuaacccgacccucacccgacuucgacuucaucuuccucgucccaccuacugucgaaucccgcacaaaaccuuucucaguucccguacuaacaguugaagaaaugaccaacucccgauuccccaucccccuggaaaaacuauccaccggccccuccuccgccuucgucguccaaccacagaacggccgaugcaccacagacggcguacuacucggaaccacccagcucucuccagucaacaucugcaccuuccgaggcgacgucacccacaucaccggaucgcgaaacuacaccaugaaccuggcaucacaaaacuggaacaacuacgacccaaccgaagaaaucccagccccucuuggcacacccgacuucgucggcaaaauccaagguguacucacccaaaccacccgcaccgacggaucaacccgaggacacaaagccacugucuacaccggauccgccgacuucgcccccaaacuaggccgcguccaguucgaaacagacaccgaccacgacuucgaagcaaaccaaaacacaaaauuuaccccagucggcguuauccaagacggcggaacuacacaccgcaacgaaccccaacaauggguacuccccucauacucaggcagaaacacccacaacguccaccuagcccccgcagucgcccccacauuccccggagaacaacuccuauucuuccgcuccaccaugcccggcugcuccggcuaccccaacauggaccuagacugccuccucccccaagaauggguccaauacuucuaccaagaagcagccccagcccaauccgacguagcccuacuccgcuucguaaacccagacaccggccguguccucuucgaaugcaaacuccacaaauccggcuacguaacuguugcccauaccggucaacacgaccuagucauuccucccaacggcuacuuccgauuugacagcuggguaaaucaauucuacacccuugcacccaugggaaacggaaccggccgacgacgcuaa

SEQ ID NO: 38747 - RNA, 1617 nt, Artificial Sequence
  derived and/or modified sequence opt11 from VP1__Norovirus_and/or_Norovirus-like__KC517374
augaaaauggcauccucagacgccaaccccuccgacggcuccgcagccaaccucgucccugaagucaacaacgaagucauggcccucgaacccguagucggcgccgcaauugcagcacccgucgccggccagcaaaaugucauagacccauggauucgcaacaacuucguacaagcccccggcggugaguucaccgucucuccccgaaacgcccccggugaaauccuguggucagcaccccuaggccccgaccuaaaccccuaccuaucucaccuugcccgcauguacaacggcuacgcuggcggcuucgaaguccaagucauacucgcaggcaacgcauucaccgccggcaaagucaucuuugccgccgucccacccaacuuccccacagaagggcucucccccucucaagucaccauguucccucacauuguagucgacgucagacaacucgaacccguacucaucccccuacccgacguacgaaacaauuucuaccacuacaaccaguccaacgaccccacuaucaaacuuauagccaugcuauacaccccauuacgagcuaacaacgccggagacgacgucuucaccgucuccugcagaguacucacacgacccuccccugacuucgacuucaucuuccuagucccucccaccguagaaucccgaaccaaacccuucaguguccccguccucacagucgaagaaaugaccaacucccgcuuccccauaccccuagagaagcuauuuaccggccccucaagcgcauucgugguacaaccccaaaacggccguugcacaacugacggaguccuccuaggaacaacccaacucucacccgucaacaucugcaccuuccgaggcgacgucacacacauaaccggaucccgaaauuacacaaugaaccuagccucgcaaaauuggaauaacuacgacccaacagaagagacaccagcuccccuagguacccccgauuucguaggcaaaauccaaggcguacuaacccaaaccacacgaaccgacgguucaacccgaggucacaaagccaccgucuacaccggaucagccgacuucgcaccaaaacucggccguguccaauucgaaaccgacaccgaccacgacuucgaagccaaccaaaauaccaaauucacccccguaggagucauccaagacggagggaccacccaccgcaaugaaccccaacaauggguucucccuucauacagcggccgcaacacacacaacguccaccuugcucccgccguagcccccacauuccccggagaacaacuucucuucuuccgaucaacaaugcccggauguuccggcuaccccaacauggaccucgacugucuccucccacaagaauggguccaauacuucuaccaagaagccgcccccgcccacucagacgucgcacuucuccgcuucgucaacccugacacaggacguguccucuucgaaugcaagcuccacaaaucaggauacgucaccguugcccacaccggacaacacgaccucguaaucccuccaaacggcuacuuccgcuucgacucaugggucaaccaauucuacacccuagcacccaugggauccggaaccggcagacgccgauaa

SEQ ID NO: 38748 - RNA, 1617 nt, Artificial Sequence
  derived and/or modified sequence opt11 from VP1__Norovirus_and/or_Norovirus-like__KC409308
augaaaauggcauccaacgacgcuaaccccuccgacggcucugccgccaaccugguccccgaagucuccaacgaagucauggcacuagaacccgucguaggcgccgcaaucgcggcccccgucgcaggacaacaaaaugucauugaccccuggauccgcaacaauuuuguucaagcccccggaggcgaauuuaccgucagcccccgcaacgcaccuggugaaauacugugguccgcaccccucggucccgaccucaauccauaucuaucacaccucgcccggauguacaacggcuacgcuggcggcuuugagguccaaguuauccuagccggaaacgccuuuaccgcaggcaaaauaauauucgcagcugucccaccaaacuuucccaccgaaggccucucccccucccaaguaacaauguucccacacaucauaguugacguccgccaacucgaaccuguucucaucccacuaccagauguccggaacaacuucuaccauuacaaccaaaccaacgacucuaccaucaaacucaucgccaugcuauacacaccccucagggccaacaacgcaggcgaagacgucuucaccgucuccugccgcguacucacccgccccagcccagacuucgacuucauauuccucgucccacccaccgucgaaucucgaaccaaaccauucaccguucccauccuaacagucgaagaaaugaccaacucacgcuuccccaucccccuugaaaaacuuuucaccggccccucaggcgcauucgucguacagccccaaaacggacgcugcaccaccgacggcguccuccuaggcaccacacaacucucccccguaaacaucugcacauuccgaggcgacguaacccacaucgccggcucccgcaacuacacaaugaaucucgcaucccucaacuggaacaacuacgauccaacagaagagauacccgcaccccuugguacccccgacuucgucggcaaaauccaaggcguacucacccaaacaacgaaaggagacggcucaacgcguggucacaaagccaccguauacacagggagcgccccauucaccccaaaacuaggcuccguccaauucuccacagacaccgaaaacgauuucgaaacccaccaaaacaccaaauucaccccagucggcguaauccaagacggcggcaccacccaccgcaaugaaccccaacaauggaugcucccauccuacuccggacgcgauguccacaacguacaccucgcaccagccgucgcccccacauucccuggagaacagcuccuuuucuuccgcuccaccaugcccggcugcuccggcuacccaaacauggaccucgacugucuacucccucaagaauggguccaacacuucuaccaggaagccgcacccgcucaaucagacgucgcacuacuacgcuucgucaaccccgauaccggaagaguccuauucgaaugcaaacuacacaaaucaggauacgucacagucgcccacaccggucaacacgaccuagucauacccccgaacggcuacuucagauucgacucuugggucaaccaauucuacacacucgcgcccaugggcaacggcacaggcagaagacgauaa

SEQ ID NO: 38749 - RNA, 1617 nt, Artificial Sequence
  derived and/or modified sequence opt11 from VP1__Norovirus_and/or_Norovirus-like__KC175393
augaaaauggccucaaacgaugcaaaccccuccgacggcuccgcagcgaaccucguccccgaaguauccaacgaagucauggcacucgaacccguagucggcgccgcaauugcagccccaguggccggccaacaaaacguaaucgaccccuggauaagaaacaacuucguccaagcccccggcggagaguucacagucucuccccgaaacgcaccuggcgaaauucuaugguccgccccucuaggaccagaucuaaacccauaccucucccaccucgcccgcauguacaacggcuaugccggaggcuucgaaguccgcguaauccucgcaggcaacgccuucaccgcaggcaaaaucaucuuugccgccgucccacccaacuuucccacagaaggccuuucacccucccaagucaccauguucccccacaucaucguagacguccgccaacucgaacccguccuaaucccccucccagacguccgcaauaacuucuaccacuauaaccaaaccaaugacucaaccaucaaacucaucgccaugcucuacacaccccuucgugccaacaacgccggcgaagacgucuucaccgucuccugccgcguccuaacccgcccaucuccagacuucgacuucauauuccucgucccgccaaccgucgaaucccgcaccaaacccuuuaccgucccaauccuaaccgucgaagaaaugacaaacucccguuuccccaucccacucgaaaaacucuucacaggacccuccggcgccuucgucguccaaccccaaaacggccgcugcaccacagacggcguccuccuaggcacuacgcaacuaagcccagucagcaucugcaccuuccgcggcgacguaacccauaucgcaggcuccagaaacuacaccaugaaccucgccucccuaaacuggaacaacuacgaccccaccgaagaaaucccugccccgcucggcaccccggacuucguaggaaaaauacaagguguucucacacaaacaaccaaaggagacggcucgacccgcgggcauaaagccaccguauacaccggcucugcccccuucacccccaaacuuggaucaguacaauucagcaccgacaccgaaaacgauuucgaaacccaccaaaacaccaaauucacccccgucggcgucauacaagacggcggaacaacccacagaaacgaaccacaacaauggguacucccauccuacucaggccgagacguacauaacguccaccucgcccccgcagucgcccccacauuuccuggagaacaacuccuauucuuccgcagcaccaugcccggcugcucaggauacccaaacauggaucuugacugccuccucccccaagaauggguccaacacuucuaccaagaagccgcccccgcccaauccgacguagcacuauuacgguucguaaaccccgacacaggccgcguccucuucgaaugcaaacuccacaaaucaggcuacguaacugucgcgcacacaggccaacacgaccuagucauaccacccaacggcuacuuccgcuuugacuccugggucaaccaauucuacacccucgccccgaugggaaacgguacaggcagacguagauaa

SEQ ID NO: 38750 - RNA, 1617 nt, Artificial Sequence
  derived and/or modified sequence opt11 from VP1__Norovirus_and/or_Norovirus-like__JX459623
augaaaauggccucaaacgaccccaaccccagcgacggcucagcagcaaaccuaguacccgaaguaaacaacgaagugauggcacucgaacccgucguaggagccgccauagcugccccagucgccggccaacaaaacgucaucgaccccuggauacgaaacaacuuugugcaagccccaggcggcgaguucaccguaagcccccgcaacgcccccggcgaaauacucugguccgcuccccucggccccgaccucaacccuuaccuaucacaccuagcccguauguacaacggauacgccggcggcuucgaaguccaagucauacucgccggaaacgccuucacggcuggaaaaaucaucuucgccgccguacccccaaacuucccaaccgaaggacuaaguccaucccaagucaccauguucccacacaucaucgucgacguccgacaacucgaaccaguccucaucccucuccccgacguacguaacaacuucuaccacuacaaccaauccaacgacuccaccaucaagcucaucgccaugcucuauacaccccuccgagccaacaacgccggagaggacguauucacggucucaugcagaguacuaacucgaccuucaccagacuucgauuucaucuuccuagucccacccaccgucgagucacgaaccaagcccuucaccguacccauccucaccgucgaagaaaugaccaacucccgcuucccaauuccccuagaaaaacucuucacaggaccaucaggagcauucgucguccaaccccaaaacggacgcugcacaaccgacgguguucuccucggaaccacgcaacucucccccgucaacaucugcaccuuccgcggcgacguaacccacaucgccgguacccgcaauuacaccaugaaccuagcuucccuuaacuggaacaacuaugaccccaccgaagaaaucccagccccacuaggcacacccgacuucguaggaaaaauccaaggcguccuaacccagaccaccaaaggagacggcuccacccgcggucacaaagcaaccguauacacuggcuccgcacccuucacccccaaacuuggaagcguccaauucuccacugacacagagaacgacuuugaaacacaccaaaacaccaaauucaccccaguuggcgucauccaagacggcggcaccacgcaccgcaacgaaccccaacaauggguccuacccuccuauuccggccgaaacguucauaauguacaccuagcccccgcugucgcacccacauuccccggagaacagcuccucuucuucagaucaaccaugccaggcugcuccggauaucccaacauggaccucgacugccuacuaccccaagaauggguccaacacuucuaccaagaagccgcacccgcccaauccgacgucgccuuaaugcgguucgucaaccccgacaccggccggguccuuuucgaaugcaaacuccacaaauccggcuacguuacagucgcccacacaggccaacacgaccuaguuaucccucccaacggcuacuuccgcuuugacuccugggucaaccaauuuuacacacuugcccccauggguaacggaacgggacgacgacgcuaa

SEQ ID NO: 38751 - RNA, 1617 nt, Artificial Sequence
  derived and/or modified sequence opt11 from VP1__Norovirus_and/or_Norovirus-like__JQ798158
augaaaauggccuccaacgacgcaaacccuucagacggcucaacagcaaaccuagucccagaagucaacaacgagguaauggcccuagaacccgucgucggggccgcaaucgccgcaccugucgccggucaacaaaacguaauagaccccuggauacgcaacaacuucguccaggccccaggaggugaguucaccguaucaccccgaaacgcacccggugaaaucuuaugguccgcuccccucggacccgaccucaauccauaucuagcccaccuugcacguauguacaacggcuacgccggcggcuuugaaguacaagucauacucgcaggcaaugcauucaccgcuggcaaaaucaucuucgccgcaguaccaccaaacuuccccacagaaggacuaucccccucccaggucacuauguucccccacauagucgucgacgugcgacaacucgaacccguacucaucccccuucccgacguaggaaauaacuucuaccacuacaaccaauccaacgaccccaccaucaaacuaaucgcaaugcuauacacaccccuucgagccaacaacgcaggcgaagacgucuucacggucuccugcagaguacucacccgaccuagccccgacuucgacuucaucuuccuuguucccccaaccgucgaaucccgaaccaaacccuucaccgucccgauccuuaccgucgaagaaaugaccaacucccgcuuccccauaccccucgaaaaacucuucaccggaccguccggagccuucgucguccaaccacaaaauggacgcugcaccaccgacggcguccuacuagguaccacccaacucucccccguuaauaucugcaccuuccgcggagacgucacucacaucgcaggcacccacaacuacaccaugaaccucgccucccagaacuggaacaacuacgacccaacagaagagaucccggccccacuaggaacccccgacuucgucggccguauccaaggcaugcuuacccaaaccacgcgcggcgacggcucuacaagaggccacaaagcaacagucucuaccggagacguacacuucacacccaaacuagggucaauacaauucaacaccgacaccaacaacgacuucgaaaccggccaaaacaccaaauucacccccguaggaguaguccaagacggaaacggcgcccaccaaaacgaaccccaacaauggguccuccccagcuacagcggccgcaccggccacaacguccaccucgcacccgccgucgcgcccaccuucccaggugaacaacuacuauucuuccgcuccaccaugcccggcugcucagguuaccccaacaugaaucucgauugccuacucccccaagaauggguccaacacuucuaccaagaagccgccccagcccaauccgacgucgcacuacuacgcuucgucaaccccgacacuggccgaguccucuucgaaugcaagcuccacaaauccggcuacgucacagucgcacacaccggccaacaugaccucgucaucccucccaacggauacuuccgcuucgacuccuggguaaaucaauucuauacucucgcccccauggguaacgguaccggccgccgccgauaa

SEQ ID NO: 38752 - RNA, 1617 nt, Artificial Sequence
  derived and/or modified sequence opt11 from VP1__Norovirus_and/or_Norovirus-like__JQ613566
augaaaauggcgagcucagacgccaaccccuccgacggcuccaccgccaaccucguaccagaaguuaacaacgaagucauggcccucgaaccugucgucggcgcugccaucgccgcccccguagccggccaacaaaacgucauagacccauggauccgcaacaacuucguacaagcaccaggcggcgaguucacagucagcccgcgcaacgcccccggcgaaauccucugguccgcaccccucggccccgaccucaacccauaucucagccaccuugcccgaauguauaacggcuacgccggcgguuucgaaguccaggucauccuagccggcaacgccuucacagcaggaaaaaucauauucgccgccguaccacccaacuucccaacagaaggccucuccccuagucaagucaccauguucccccacauuaucguagacguccgucaacuagaacccguccucauacccuuacccgacguccgcaacaacuucuaccacuacaaccaaucaaacgaccccaccaucaaacucaucgccaugcuauacaccccacuacgugccaacaacgcaggagacgacgucuucacaguauccugccguguccucacacgaccaagccccgacuucgacuucauuuuccucgucccacccaccgucgaaucgagaaccaaacccuucuccguccccguccucaccgucgaagagaugaccaacucacgcuucccaguuccacucgaaaaacuauucaccggacccucauccgccuucgucguccaaccacaaaacggacgaugcaccacagacggcguccuccucggcacaacucaacuaagccccguaaacaucuguaccuucagaggugacgugacacauauaccaggcuccagaaacuacaccaugaaccuagcaagccaaaacuggaacuccuacgacccaacugaagaaaucccagcccccuuaggaacccccgacuucguaggcaagauucaaggcguucuuacccaaaccacgcgcaccaacggcucuacccggggccacaaggcaaccgucuacacaggcucagcagacuucuccccaaaacuaggccgcguacaguucgcaaccgacaccgacaacgacuucgaaacuaaccagaacaccaaauucacccccguuggcgucauccaagacgguuccacaaccccgcgcaacgaaccccaacaauggguccuaccaucauacucgggcagaaauauacacaacguccaccucgcccccgcugucgcccccaccuuccccggagaacaacuccucuucuuccgcuccaccaugcccggcugcucaggauauccaaacauggaccucgacugccuccucccacaagaguggguccaauacuucuaucaagaagccgcccccgcccaaucagaugucgcccuccuucgauuugucaaccccgacaccggacgcguacucuucgaaugcaaacuacacaaauccgguuacguaaccgucgcacauaccggacagcacgaccuagucauaccacccaacggauacuuccgcuucgacucuuggguuaaccaauucuacaccuuagcacccaugggcaacggcaccggacgccgccgcuag

SEQ ID NO: 38753 - RNA, 1617 nt, Artificial Sequence
  derived and/or modified sequence opt11 from VP1__Norovirus_and/or_Norovirus-like__AB541287
augaaaauggccuccaacgaugccaaccccuccgacggcuccgcggcuaaccucguccccgaagucaauaacgaaguaauggcccucgaaccaguagucggcgccgcuaucgccgccccugucgcaggacagcaaaacgucaucgaccccuggauccgcaacaacuucguccaagcccccggaggagaauuuaccgucucaccccgcaacgcccccggagaaauacuaugguccgccccacugggccccgaccucaaccccuaccucucccaccuagcaagaauguacaacggcuacgccgggggcuucgaaguccaagucguucuagccggaaacgcauucaccgccggcaaagucauauucgccgccgugccucccaacuuccccacagaaggacucagccccucccaagucaccauguucccccacaucaucgucgacguaagacagcucgaaccuguccugaucccacucccagacguccgcaacaacuucuaccacuacaaucagucgaacgacuccaccauaaaacuaaucgcaaugcuauacacaccacuccgcgcaaauaacgccggcgaagacgucuucaccgucuccugccgaguacucacacgccccucgcccgacuuugacuucaucuuccucguucccccaaccguagaaucucgcacaaaaccauucaccguccccauacuaaccgucgaagaaaugaccaacagccgguuccccaucccccucgaaaaacucuucacaggccccuccggcgccuuugucguucaaccccaaaaugggcgcugcaccacugacggcguccuacucggaacaacccaauuaucccccgucaacaucugcaccuuccgaggcgacguuacccauauagccggcucccgaaacuacaccaugaaccuugccagccuuaacuggaacaacuacgaccccaccgaagaaauaccagccccacuaggcacccccgacuucguaggcaagauccaaggcguccucacucaaaccaccaagggcgacggauccacacgcggccacaaagccaccguauacaccggaucaacaccauucacccccaaacucggcucaguccaauucucaaccgacaccgaaaacgacuucgaaaaccaccaaaacacuaaauucacucccgucggagucauccaagacggcggcacaacccaucgcaacgaaccgcaacaauggguccuacccucuuacagcggccgcaacguacaaaacguccaccuagcccccgccguagcaccaaccuuccccggagaacaacuccucuucuuccgaucuacaaugccgggcugcucaggcuaccccaacauggaccucgacugccuacucccccaagaauggguacaacacuucuaccaagaagcggcccccgcacaaagcgaugucgcccucuugcgcuucguaaaccccgacacaggccgcguacuauucgaaugcaaacuacacaaaucaggauacgucacaguagcacauaccggacaacacgaccuagucauacccccgaacggcuacuuccgcuucgacuccuggguaaaccaauucuacacacucgcacccauggguaacggcacuggaagacgcagauaa

SEQ ID NO: 38754 - RNA, 1617 nt, Artificial Sequence
  derived and/or modified sequence opt11 from VP1__Norovirus_and/or_Norovirus-like__AB504320
augaaaauggccuccaacgacgcaaauccauccgacggcuccgcugccaaccuaguacccgaagucaacaacgaagugauggcacuggaaccugucgcuggagccgcuauagccgcccccgucgccggacaacaaaacguaauagaccccuggauccgcaacaacuuuguccaagcacccgguggcgaguucaccgucucaccccgcaaugcccccggcgaaauccucugguccgcaccccucggaccagaccuaaaccccuaucuaucccaccuagcccgcauguacaacggcuacgccggaggauucgaaguacaagucauccucgccggcaacgccuucacagccggcaaaaucaucuucgcagccgucccacccaacuuccccaccgaaggccuaucucccucccaaguaacaauguucccacacauaaucguagacguccgccaacuagaaccaguccuaauaccccucccagacguacgcaacaauuucuaccacuacaaccagucaaaugacagcacuaucaaacucaucgccaugcucuacacuccccuccgggccaacaaugccggagaagacgucuucaccgucucaugccgcguccucacccgccccucaccagacuucgacuucauauuccucgucccacccacuguagaaucccgcaccaaacccuucacaguccccauccucaccguagaagaaaugacgaacucccgauuccccauuccccuagagaaacucuuuaccggccccuccggcgccuucgucguccaaccccaaaacggccgcugcaccaccgacggcguccuacucggcacaacccaacucucccccgucaacaucugcacauuccgaggagacgucacccacauagcagguacacgcaacuacacaaugaaccuagccucccucaacuggaacaacuacgaccccacagaagaaauccccgcaccucucggcacacccgacuucgucggcaaaauucaaggaguccucacacaaaccaccaaaggcgacggcucaacacgaggucacaaagccaccguauauaccgguucagcaccauucacccccaaacuaggcuccguacaauucuccacagacaccgaaaacgacuucgaaacccaucaaaacacaaaguucacaccaguuggagucauccaggacggcggaaccacccacagaaacgaaccccaacaauggguccucccaucuuacuccggucggaacguacacaacguacacuuagccccagcaguagcaccaaccuuccccggcgaacaacuacucuucuuccgaucgacgaugccaggcugcuccggcuaccccaacauggaccuugacugucuccuuccucaagaauggguccaacauuucuaccaagaagcagcacccgcccaauccgaugucgcccucaugcgauucgucaaucccgacacaggccgaguccuuuucgaaugcaaacuccacaagucaggcuacgucaccguagcccacacaggccaacacgaccucgucaucccaccaaacggcuacuuccgcuucgacagcuggguuaaccaauucuacacccuagcacccaugggcaacggaaccggacgacgacgguaa

SEQ ID NO: 38755 - RNA, 1617 nt, Artificial Sequence
  derived and/or modified sequence opt11 from VP1__Norovirus_and/or_Norovirus-like__KU683739
augaagauggccucuuccgacgccaacccaucagacgguucagcagccaaccucgucccagaaguaaacaaugaagucauggcccucgaaccagucgucggcgccgccaucgcagcacccgucgcuggacagcaaaacgucaucgaccccuggauccgcaacaacuucguccaagcaccggguggagaguucacagucucuccaagaaacgcaccaggcgaaauacuauggucagcaccccucgggccagaccucaaccccuaccucucucaucucgcacgcauguacaacggcuacgccggcggcuucgaaguccaagucauccucgccggaaaugccuucacagccggaaaagucauauuugccgcgguucccccaaacuuccccaccgaaggccuuucccccucgcaagucaccauguuuccccacauagucgucgacguccgccagcucgaacccguccucaucccacuaccagacguccgcaacaacuucuaccacuacaaucaaucuaacgaccccaccaucaaacucaucgccaugcuuuacacaccccuacgagcaaacaacgcuggugacgacguauucaccgucuccugucgcguccucacccgccccucuccagacuucgacuucauauuccuuguacccccaaccgucgaaucacguaccaaacccuucagcguccccguccucaccgucgaagaaaugaccaacucacgauuccccaucccccucgaaaaacuauucacaggccccuccuccgcuuucgucguccaaccccaaaacggccgaugcaccacagacggaguccuacucggcacaacccaacucuccccagucaacaucugcaccuuccgaggcgaugucacccacaucacaggcucaagaaacuacaccaugaaucuagccucccaaaacugguccaacuacgacccaaccgaagaaaucccagcaccccuaggcacccccgacuucgucggcaaaauccaaggaaugcuaacccaaaccacccggaccgauggaagcacccgaggccauaaagccacagucuacaccggcucugccgauuucgcccccaaacucggucgcguccaauucgaaacugacaccgaccacgacuucgaagccaaccaaaacacaaaauuuacacccgucggagucauccaagacgguaguacuacccaccguaacgaaccacaacaauggguucuacccuccuacuccggucgcaauaccccuaacguccaccucgcacccgcaguugcccccacauuccccggagagcaacuccucuucuuccgcuccaccaugcccgguugcucaggcuacccaaacauggaccucgauuguuuacugccacaagaauggguccaguacuucuaccaggaagccgccccugcucaaucagacgucgcucugcuccgauuugucaaccccgacacaggccgcguccuuuucgaaugcaagcuccauaaauccggauauguuaccguagcacacaccggccaacacgaccuaguaaucccucccaacggcuacuuccgauucgacuccugggucaaccaauucuacacccucgcgcccaugggcaacggaaccggccgccgccgauaa

SEQ ID NO: 38756 - RNA, 1617 nt, Artificial Sequence
  derived and/or modified sequence opt11 from VP1__Norovirus_and/or_Norovirus-like__KX354146
augaaaauggccagcuccgacgccaaccccucugacggcucggcugccaaccuaguacccgaaguuaacaacgaagucauggcccucgaacccgucguaggggcagccaucgccgcccccguagccggccaacaaaaugucauagaccccuggauacguaacaacuucguccaagcacccggaggagaauuuaccgucagcccccgcaacgcccccggugaaauacuaugguccgcaccccucggacccgaccucaaccccuaccuaucacaucuagcacgaauguacaacggcuaugccggcggauucgaaguccaagugauccuagccggcaacgcuuucaccgcaggcaaaaucaucuucgccgccguaccucccaacuuccccaccgaaggacucucuccaucacaagucacuauguucccccacaucauagucgacguuagacaacuggaaccaguccucaucccgcuccccgacguccgcaacaacuucuaccacuacaaccagucaaacgaccccacuaucaaacuaaucgccaugcuuuacacaccccuacgcgccaacaacgccggagacgacgucuucaccgucuccugccgcguacucacccgcccaucaccagacuucgacuucaucuuccuagucccucccacagucgaaucccgaacaaaacccuucucaguacccguccucaccgucgaagaaaugacaaacucucgccuaccaaucccccucgaaaaacucuucaccggacccucauccgccuucgucguccaaccucaaaacggucgcugcaccacagacggaguccuccucggcaccacacaacuaucccccgucaacaucuguaccuuccggggcgacgucacacacauuacaggaucccgcaacuacaccaugaaccucgccucacaaaacuggaacaacuacgacccuacagaagaaaucccagcgccccuaggcacuccagacuucgucggaaaaauccaagguaugcucacccaaaccacccgaaccgacggcuccacccgcggucauaaagccaccgucuacacaggcuccgccgacuucgccccaaagcucggacgaguccaauucgaaaccgacaccgaccacgacuucgaagccaaccaaaacaccaaauuuacccccgucggcgucauccaagacggaucuaccacccaccgaaacgaaccccaacaauggguacuacccagcuacuccggacgcaauacccacaacguccaccucgccccagccguagccccgaccuuccccggugaacaacuccuguucuuccgauccaccaugccuggcugcuccggcuaccccaacauggaucucgacugcuuacucccucaagaauggguacaauacuucuaccaagaagccgcccccgcucaaucggacguagcccuccuccgauucgucaaccccgacacaggccgaguucuauucgaaugcaaacugcacaaauccggauacgucacuguagcacacaccggacagcacgaccucguaauaccucccaacgguuacuuccgauucgacuccugggugaaccaauucuacacgcuagccccaaugggcaacggcaccggccgccgacguuaa

SEQ ID NO: 38757 - RNA, 1617 nt, Artificial Sequence
  derived and/or modified sequence opt11 from VP1__Norovirus_and/or_Norovirus-like__KX354075
augaaaauggcuucaucagacgccaaccccuccgacggauccaccgccaaccucguccccgaagucaacaacgaaguaauggcccucgaacccgucguaggagccgccaucgccgcacccgucgcuggucaacaaaacguaaucgacccauggaucagaaacaacuucguccaagcccccggcggagaguucaccgucuccccacgcaacgcccccggagaaauccucuggucagcaccccuuggcccagaccugaaccccuaccuaucacacuuagcucgcauguacaacggcuacgccggaggauucgaaguacaagucauacuagcagguaacgcauucacagcaggcaaaaucaucuucgccgccguuccaccaaacuuccccacagaaggccucucccccucccaaguuacaauguucccacauaucauugucgacguacgccaacucgaacccguacucauaccccuacccgacguacgcaacaacuucuaccacuacaaucaaucaaacgacccaaccaucaaauuaaucgccaugcuauacacaccccuccgagcaaauaacgccggggacgacgucuucaccgucuccugccgaguacuuacccgccccuccccugacuucgacuucaucuuccucgucccacccacuguugaaucccgcacaaaaccuuucucaguccccguccuaacuguagaagaaaugaccaacucccgcuuccccaucccccucgaaaaacucuuuaccggaccaucgucagcauuugucguccaaccccaaaacggacguugcacaacagacggaguccuacucggaaccacccaacuauccccugucaacaucugcacauuccgaggcgacgucacccacaucagcgguucccgaaacuacacaaugaaccucgcaucccaaaacuggaacuccuacgacccuacagaagaaauaccagcuccccucggaacuccagacuucguaggcaaaauccaaggcguucucacgcaaaccacccgcaccgacggcuccacucgcggccacaaagccacugucuacaccggcucugccgacuucucacccaaacucggccgcguccaauucgccaccgacaccgacaacgacuucguaaccaaccaaaacacaaaauucaccccagucggcgucauacaagacggcuccaccacaccccgaaacgaaccccaacaauggguucucccauccuacucuggacguaacgcccacaacguucaccucgcuccggccguagcccccaccuuccccggcgaacaacuccucuucuuccgcucaaccaugcccggcugcucagguuauccuaacauggaccucgacugccuucucccccaagaauggguccaauauuucuaccaagaagccgccccggcucaauccgacguagcucuccuccgcuucgucaaccccgacaccggccgcgugcuguuugaauguaaacuacacaaaucaggcuacgucaccgucgcccacaccggccaacacgaccuggucaucccucccaacggcuacuuccgauucgacuccugggucaaccaauucuacacccuagcccccaugggcaacggaaccgggcgccgacgcuag

SEQ ID NO: 38758 - RNA, 1617 nt, Artificial Sequence
  derived and/or modified sequence opt11 from VP1__Norovirus_and/or_Norovirus-like__KX354072
augaaaauggcauccaacgacgcuaacccauccgacggauccgcagcaaaccuagucccggaaguaaacaacgaagucauggcccucgaacccgucguaggcgccgccaucgccgcccccguagccggccaacagaacguaauagaccccuggaucagaaauaacuuuguccaagcucccggcggcgaguucaccgucucaccccgcaacgccccaggugaaauccucugguccgcuccccuaggaccagaccucaaccccuaccugucccaccucgcccgaauguacaaaggcuacgcaggcggcuucgaaguccagguuauccucgcuggcaacgcauucaccgccggaaaaaucaucuuugccgccguaccucccaauuucccaaccgaaggccuaucccccucccaaguaacaauguucccucacauaauagucgauguccgccaacucgaacccguucucauaccccuccccgacguccgaaacaacuucuaccacuacaaccaaagcaacgacucuacaaucaaacucaucgcuaugcucuacaccccaccccgugccaacaacgccggcgacgacgucuucaccgucucuugccgaguccucacccgccccucgcccgacuucgacuucaucuuccucgucccacccaccguugaaucccgcaccaaaccauucacaguccccauccugacagucgaagaaaugacaaacucccgcuucccaaucccacuugaaaaacucuucacaggccccuccuccgcuuucgucguacagccccaaaacggccgcugcacaacugacggcguacuacuaggcacaacccaacugucccccgucaacaucugcacauuccgaggcgacguaacacacaucgccgguucccgcaacuacacaaugaaucucgcaucacucaacuggaacaacuacgaccccacagaagaaaucccagcaccccuaggcaccccagacuucgucgguaaaauacaaggcguccucacgcaaaccaccaaaggcgacggauccaccagaggccacaaggccacaguauacaccggauccgccgacuucacccccaaacuuggcucaguccaauucgccacagacaccgaaaacgacuucgaaacccaccagaacacccgauucacccccgucgguguuauacaagacggcuccaccacacaccgcaacgaaccccaacaauggguccuaccaucauacucuggccgcaacguccacaauguccaccuagcccccgccguugcacccaacuuccccggcgaacaacuccucuucuuccgaucaaccaugcccggcugcuccggauacccaaacauggaccuagacugccuacucccccaagaauggguucaacauuuuuaccaagaagcggcaccagcccaauccgacgucgcccuacuccgauucgucaaucccgacacaggaagaguccuuuucgaaugcaaacuacacaagucaggauacguaacugucgcacacacaggccagcacgaccucgucauaccacccaacggauauuuccgcuucgacagcugggucaaccaauucuauacucucgccccaaugggcaacggcaccggccgccgacgcuaa

SEQ ID NO: 38759 - RNA, 1617 nt, Artificial Sequence
  derived and/or modified sequence opt11 from VP1__Norovirus_and/or_Norovirus-like__KX354060
augaaaauggccuccucagacgccaaccccucugacggaucaaccgccaaccucguaccagaagucaacaacgaagucauggcucuagaaccaguaguaggcgccgccaucgcagccccagucgcaggccaacaaaacgucaucgaccccuggauccgcaacaacuucguccaggcccccggcggggaguucaccgucucgccaagaaacgccccaggcgaaauccuaugguccgccccucuuggcccugaucuaaaccccuaccuuucacaucuugcacgaauguacaacggauacgcgggcggcuucgaaguccaaguaauccucgccggcaacgcauucaccgccggcaagaucauuuucgccgcagucccacccaacuuccccacugaaggacucucccccucccaagucaccauguucccccacauaaucgucgacguccgccaacuugaacccguccucaucccccucccagaugucagaaacaauuucuaccacuacaaccaauccaacgacucaacaauaaaacucauugcaaugcucuacacaccccugcgagccaacaacgccggcgacgacgucuucacagucucgugccgaguacucacccgacccucucccgacuucgauuucaucuuccuugucccucccaccgucgaaucccgcaccaaacccuucucagucccuauccugacagucgaagaaaugacaaacucccgauuccccaucccccuagaaaaauuauuuaccggccccuccuccgcauucgucguacaaccacaaaacggccgcugcaccacagacggcguccuuuuagguacaacccaacucuccccagucaacauuuguacuuuccgcggugacguuacccacauccccggaagccacaacuacacaaugaaccucgcaucccaaaacuggaacagcuacgaccccacagaagaaaucccagcaccccuaggaacccccgacuucgucggaaaaauacaaggaguauuaacacaaacaacuucaacaaauggcuccacccgcggacacaaagccacagucuacaccggcucagccgacuuuucacccaaacucggccgcguacaauucgcaaccgacaccaacaacgacuucgaaaccaaucaaaacaccaaauucacccccguaggagucauacaagacggcucuaccaccccuagaaacgaaccacaacaauggguacuccccucuuacuccggacgcaacauacacaacguacaucuagccccggccgucgccccaaccuuccccggagaacaacuccucuuuuuccgauccacaaugccaggcugcucaggcuaccccaacauggaucucgauugccugcucccacaagaauggguacaacacuuuuaccaagaagccgccccagcacaauccgacgucgcccuccuacgcuucgucaaccccgacacaggccgcguccuauucgaaugcaaacuacacaaauccggcuacgucaccgucgcccacaccggccaacacgaccuaguuauaccuccaaacggauacuuccguuucgacagcuggguaaaccaauucuacacccucgccccuaugggaaacggcaccggacgccgccguuaa

SEQ ID NO: 38760 - RNA, 1617 nt, Artificial Sequence
  derived and/or modified sequence opt11 from VP1__Norovirus_and/or_Norovirus-like__KX353959
augaaaauggccagcagcgacgccaaucccucggacggaucaaccgcuaaccuaguccccgaagucaacaacgaagucauggcccucgaacccgucgucggcgccgccaucgccgcucccgucgccggccaacaaaacgucaucgacccguggauccgcaacaacuuuguacaggccccuggaggcgaguucacaguaucccccagaaacgcccccggagaaauccucuggucagccccacuuggccccgaccuaaaccccuaccucucccaccuagcccgcauguacaacgguuacgccggaggauucgaaguccaagucauccuagccggcaacgcauucaccgcaggaaaaauuauauucgccgccguucccccaaacuuccccaccgaaggccucucacccucccaagucacaauguuuccccacaucaucguagacguccgacaacucgaacccguacuaauaccccuccccgauguccgcaacaacuucuaccacuacaaccaaucaaacgaccccaccaucaagcuaaucgcaaugcucuacacaccccuccgagcaaacaaugccggcgacgauguauucacagucuccugcagaguccucacccgucccagcccagauuucgacuucauauuccuagucccacccaccguagaaucccgcacaaaacccuucuccguccccguacucaccgucgaagaaaugacgaacucccgcuuccccaucccccuugaaaaacucuucaccggacccuccagcgcguucguaguccaaccacaaaacggacgaugcaccaccgauggaguccuccuaggcacaacccaacucuccccaguuaacaucugcacauuccguggagacgucacccacaucccaggcucucgcaacuacacaaugaaccucgcuucccagaauuggaacucauacgaccccacugaagaaauucccgcaccccuuggaacacccgacuucgucggaaaaauacaaggaguacucacucaaaccacacgcaccaacggcucaacacgcggccacaaagccaccguuuacaccggcagcgcagacuucagcccaaaacucggccgcguacaauuugcuaccgacacagacaacgauuucgaaaccaaccaaaacaccaaauucacucccguaggcgucauacaagacggcuccgccacaccucgaaacgaaccccaacaauggguacuccccuccuacuccggacgaaacauccacaacguccaccuagccccagccguugcccccacauuccccggggaacaacuccuuuucuuucgcucaacuaugccaggcugcuccggcuacccgaacauggaucuggacugccuacucccacaagaauggguccaauacuuuuaccaagaagcagcgcccgcacaauccgacgucgcccuacuccgauucguaaaccccgacaccggacgcguacucuucgaauguaaacuacacaaaucaggcuacgucacagucgcacacaccggacaacacgaccuagucaucccuccaaauggcuacuuccgcuucgauucuuggguaaaccaauuuuacacacuagcccccaugggcaacggcaccggcagacgccgcuaa

SEQ ID NO: 38761 - RNA, 1617 nt, Artificial Sequence
  derived and/or modified sequence opt11 from VP1__Norovirus_and/or_Norovirus-like__KX353954
augaaaauggccuccucagacgccaacccguccgacggcucaacagccaacuuaguccccgaaguaaacaacgaagucauggcacuagaacccguagucggcgccgcaaucgccgcacccgucgccggccaacaaaacguuaucgaccccuggauccgcaauaacuucguccaagcccccggcggagaguucaccguuucacccagaaacgcucccggcgaaauccucugguccgcaccccuaggccccgaccuaaacccauaccucucccaccucgcccggauguacaacgguuacgccggcggcuucgaaguccaagucauccuggcuggcaacgccuucaccgcaggcaaaaucaucuucgccgccguacccccaaacuuccccacugaaggacucucaccaucccaaguaacgauguucccccacaucaucguagacguccgacaacucgaaccgguccuaaucccacuccccgacguccgaaacaacuucuaccauuacaaccaauccaacgaccccaccauaaaacuaaucgccaugcucuacaccccuuugcgagccaacaacgccggcgacgacgucuucacagucucaugccgagucuuaaccagaccaucaccagacuuugacuucaucuuccuagucccacccacaguugaaucccgcacuaaacccuucagcguccccgucuugaccguagaagaaaugaccaacucacgcuuucccauaccccucgaaaaacucuuuaccggacccagcucagccuuuguaguccaaccacaaaacggccgcugcaccaccgacggcguccuacucggaaccacacaacuuucacccguaaacaucugcacauuccgcggggacguaacccacaucccaggcucucgcaacuacacaaugaaccucgccagccaaaacuggaacucauacgaccccacagaagaaauccccgcuccucuuggcacccccgacuucgucggcaagauccaaggaguccucacccaaaccacucgaaccaacgguucaacccgaggacacaaagccaccgucuacacaggaucagccgacuucagcccaaaacuuggacguguccaauucgccaccgacacagacaacgacuucgaaaccaaccaaaacacaaaauuuaccccagucggcgucauacaagacggcagcacaacuccacgcaacgaaccccaacaauggguccuccccucauacucaggacgcucaauacacaacguacaccuagcaccagccguagcacccacauucccaggcgaacaacuacuauucuuccgcuccaccaugcccggcugcucuggcuaccccaacauggaccuugacugccuacucccccaagaauggguccaauacuucuaccaagaagcagcccccgcccaguccgacguagcccuucuacgcuucgucaacccagauaccggacgcguccucuucgaaugcaaacuccacaaauccggauacguaacggucgcccacaccggccaacacgaccuagucauucccccaaauggcuauuuccgauucgacuccugggucaaccaauuuuacacccucgcaccaauggguaacggaaccggccgccgccgauaa

SEQ ID NO: 38762 - RNA, 1617 nt, Artificial Sequence
  derived and/or modified sequence opt11 from VP1__Norovirus_and/or_Norovirus-like__AB972529
augaaaauggccagcuccgacgcaaaccccuccgacggcuccgccgccaaccucgucccagaagucucaaacgaaguuauggcucucgaaccagucguaggagccgcaaucgcugcccccguagccggccaacaaaacgucaucgaccccuggaucagaaauaacuucguccaagcacccggcggcgaguucacagucagcccccguaacgcccccggcgaaauccucugguccgcaccccucggccccgaccucaaccccuaucugucccaccuagcccgaauguacaacggcuacgccggcggcuucgaaguccaagucauccuagccggcaacgccuuuacagccgguaagguaaucuuugccgccguacccccuaacuuccccaccgaaggccucucccccucccaaguuaccauguucccccacaucguugucgacguucgccaacuagaacccguccucaucccccuacccgacguaagaaacaacuucuaccacuacaaccaauccaacgacccaacaaucaaauuaauagccaugcuauacaccccgcuacgcgccaacaacgccggcgacgacgucuucacagucuccugccgcguccuaacacgacccucccccgacuucgacuucauuuuccucgucccaccaaccguagaaucccgcacaaaacccuuuucggucccaguacucacaguagaagaaaugacuaacucccgcuuccccaucccccuagaaaaacuauucaccgguccuuccucagccuucgucguccaaccucaaaacggucgcugcaccaccgacggcguacuacucggcacgacccaacuaagccccgucaacaucuguacauuccgcggcgacgucacccacaucacaggcucccgcaacuacacuaugaaccucgccucacaaaacuggucuaacuacgacccaacagaagaaauacccgcaccacucggaaccccagacuucguaggcaaaauacaaggcguccuaacccaaaccacacgcaccgacggcucuacccgcggccacaaagccacaguauacaccggcuccgcagacuucgcacccaagcucggccgcguucaauucgaaaccgacacagaccgggacuucgaagcaaaccaaaacaccaaauucacaccaguuggcgucauccaagauggcuccaccacacaucgcaacgaaccacaacaauggguccuaccgagcuacucaggccgaaauaccccaaacguccaccuagcaccagccgucgccccuaccuuccccggcgagcaacuacuauucuuccgcucaacaaugcccggaugcuccggcuaucccaacauggaccucgacugccugcucccacaagaauggguccaauacuucuaccaagaagccgcacccgcucaauccgacgucgcccucuuacgcuucgucaaccccgacaccggacgcguauuauucgaaugcaaacuccacaaauccggcuacguuaccgucgcccacaccggccaacacgaccuagucauuccacccaacggcuauuuucgcuuugauuccuggguaaaccaauucuacacacucgcccccaugggaaacgguaccggccgucgccgcuaa

SEQ ID NO: 38763 - RNA, 1617 nt, Artificial Sequence
  derived and/or modified sequence opt11 from VP1__Norovirus_and/or_Norovirus-like__AB972504
augaaaauggcauccagcgacgcuaacccuuccgacggauccgccgcaaaccucguccccgaagucaacaacgaagucauggcccuggaacccguugucggcgccgcaaucgccgcaccagucgccggccaacaaaacguuaucgaccccuggauacgaaacaacuucguacaagccccaggcggugaguucacaguaucaccccgaaacgcccccggagaaauccucugguccgcaccucucggcccagaccucaaccccuaccucagccaccucgcccgcauguauaacggauacgccggcggauucgaaguacaagucauccucgccggcaacgccuucacagcagguaaagucaucuucgccgccgucccaccuaacuucccuaccgaaggccuaucccccucccagguaacaauguucccgcacaucguuguugacguacgccaacuagaacccgugcuuaucccccuaccagacguaagaaacaacuucuaucacuacaaucaauccaacgacccaaccauaaagcucaucgcaaugcucuacaccccacuacgcgccaacaacgccggagacgacgucuucaccguauccugucgaguucucacaagacccucgccagacuucgacuucaucuuccuaguacccccaacaguagaaagccgcacaaaacccuucuccguacccguacucacaguagaagaaaugaccaacucacguuuccccaucccccucgaaaaauuguuuaccgguccuagcucagcuuucgucguccaaccccaaaacggccgcuguacaaccgacggcguccuucugggcacuacccaacuauccccagucaacaucugcaccuuccguggcgacgucacacacauuacugguucccgcaacuacaccaugaaucucgccucccagaacuggucaaauuacgacccuaccgaagaaacacccgcaccacucggcacaccagacuucgucggcaaaauccaaggcguucucacacaaacaacacgcaccgacggauccacccgcggccauaaagccacagucuacaccggauccgccgacuucgcccccaaacucggccgcguucaauuugaaacugacacagaccacgacuucgaagccaaccaaaacaccaaauucaccccaguaggagucauccaagacggcucaacaacacacagaaacgaaccccaacaauggguccuccccucuuacucaggccgaaacacccccaacguacaccucgccccagcaguagcgcccaccuucccuggcgagcaacuccucuucuuccgcuccaccaugcccggaugcucaggcuacccaaacauggaccucgacugccuccuaccucaagaauggguccaauacuucuaccaagaagcagcccccgcccaauccgaugucgcacuacuccgcuucguuaacccagacaccggccgcguccucuucgaaugcaaauuacacaaauccggcuacgucacagucgcccacacaggucaacacgaccucgucauacccccaaacggcuacuuccgauucgacucaugggucaaccaauuuuacacccucgccccgaugggcaacggcaccggcagacgacgcuaa

SEQ ID NO: 38764 - RNA, 1617 nt, Artificial Sequence
  derived and/or modified sequence opt11 from VP1__Norovirus_and/or_Norovirus-like__AB972503
augaaaauggcaucauccgacgccaacccauccgacggcuccgcagccaaucucguccccgaagucaacaacgaaguuauggcacuagaaccagucgucggcgccgccaucgccgcacccgucgccggccaacaaaacguaaucgacccauggauccgcaacaacuucguccaagcccccggaggcgaguucaccgucucaccacgcaacgccccaggagaaauccucugguccgcccccuuaggccccgaccuaaaccccuaccucucccaccucgcacgaauguacaacggcuacgcuggcggcuucgaaguacaagucauccucgccggaaacgccuucaccgcagguaaagucaucuuugcagcaguacccccuaacuuccccacugaaggccugucccccucccaagucaccauguucccucacaucguagucgacguaagacaacucgaaccuguccuaauaccccucccagacguaagaaacaacuucuaccauuacaaccaauccaacgaccccaccaucaaacucauagcaaugcucuacacuccccuccgcgccaacaacgccggcgacgauguauucaccgucuccugccgcguccucacacgcccauccccggacuucgacuucauuuucuuagucccacccaccgucgaaucccgaaccaaaccuuucucagucccaguccucaccgucgaagaaaugaccaacucccgcuucccaauuccccucgaaaaacucuucacagguccaucaucugcguucguuguccagccccaaaacggacgcugcaccacagacggaguccuccuaggcaccacccagcuaucccccguuaacaucugcaccuuccgcggcgacgucacucacaucaccggcucccgcaacuacacuaugaaccucgccucccaaaauuggucaaacuaugaccccacagaagaaacccccgccccucuaggcacacccgacuuugucggcaaaauccaaggcguacuuacccaaaccacccgcaccgacggaagcacccgcggacacaaagcgaccgucuacaccggcuccgccgacuucgcccccaaacuaggccgcguacaauucgaaaccgacaccgaccgcgacuucgaagccaaccaaaacacuaaauucacaccagucggcgucauccaggacggcucaacaacacaccgcaaugaaccccaacaauggguccuccccucauacuccggccgaaacaccccaaacguccaccucgcaccagccguagccccaaccuucccaggcgaacaacuacuauucuuccgcuccacaaugcccggcugcucaggauaccccaacauggaccucgacugccuccuaccccaggaauggguacaguacuucuaccaggaagcagcuccugcccaaucagacguagcacuacuccgauucguaaaccccgauaccggucgcguccucuucgaaugcaagcuccacaaaucaggauacgucacaguagcacacacuggucaacacgaccuagucaucccacccaacggauacuucagauucgacuccuggguaaaccaauucuacacccucgcaccaaugggaaacggcacaggccgccgccgauaa

SEQ ID NO: 38765 - RNA, 1617 nt, Artificial Sequence
  derived and/or modified sequence opt11 from VP1__Norovirus_and/or_Norovirus-like__KP244322
augaaaauggccuccuccgacgccaacccauccgacggcuccaccgcaaaccucguucccgaagucaacaacgaagucauggcucucgaacccguaguaggagccgccaucgccgcccccguagccggacagcaaaacgucauagaccccuggauccgcaacaauuucguccaagccccgggcggcgaguucacagucucccccagaaacgccccaggagaaauccuuugguccgcaccccuuggaccagaccucaaccccuaccucucccaccuagcccgcauguacaacggcuacgccggcggauucgaaguccaagucauacuagccgguaacgccuucaccgccggcaaaauuaucuucgccgccguacccccuaacuuccccacagaaggccuuucccccucacaagucaccauguucccacacaucaucgucgacguccgucaacuagaaccuguccucauaccccuccccgauguccgaaauaacuucuaccacuacaaccaaucaaacgaccccaccauaaaacucaucgccaugcucuacacaccucuacgagccaacaacgcccgcgacgacguauucaccgucuccugccgaguccucacaagacccucccccgacuucgacuuuaucuuccuagucccacccaccgucgaaucacgcacaaaacccuucucaguacccguccuuaccgucgaagaaaugaccaacagccgcuuccccaucccacucgaaaaacucuucacaggccccucuucagccuucgucguacaaccccaaaacggccgcuguacaaccgacggcguacuccucggcacaacccagcuaucucccgucaacaucugcaccuuucgcggcgacgucacccauaucuccggcucucguaacuacacaaugaaccucgcuucccaaaacuggaacuccuacgaucccaccgaagaaauccccgccccacucgguacccccgauuucguuggcaaaauccaagggguacucacccagaccaccagaacagacggcuccacccgcggccacaaagccacagucuacaccggcuccgccgacuucuccccaaaauuaggccgcguacaauucgccaccgauaccgacaacgacuuugaaaccaaccagaacacaaaauucaccccaguaggcgucauccaagacggaggcaccacccaccgcaacgaaccccaacaauggguacuacccaacuacuccggacgcaacacacacaacguccaccucgcccccgcagucgcacccaccuuccccggcgaacaacuucucuucuuccgcucaacaaugcccggcugcucaggcuaucccaacauggaccucgacugccuucucccccaagaauggguccaauacuucuaccaagaagcagcccccgcucaguccgauguagcccuccugcgauucguaaaccccgacaccggacgcguccuauuugaaugcaaacuacacaaaucaggcuaugucaccgucgcacacaccggccaacacgaccucgucaucccaccuaacggcuauuuccgcuucgacuccugggucaaccaauuuuacacccuagcucccauggguaauggcacaggacgccggcgcuaa

SEQ ID NO: 38766 - RNA, 1617 nt, Artificial Sequence
  derived and/or modified sequence opt11 from VP1__Norovirus_and/or_Norovirus-like__LC018706
augaaaauggccagcuccgacgccaaccccucagacggcucagccgccaaccucguccccgaaguaaacaacgaagacauggcacucgaaccaguagucggcgccgccaucgccgcccccgucgcaggacaacaaaacgucauugacccauggauccgcaacaacuucguccaagcccccggcggcgaguucacagucucaccacgcaacgccccuggcgaaauccuaugguccgcaccccucggaccagaccuaaaccccuaucucucccaccuagcccgcauguacaacggcuacgccggaggcuucgaaguccaagucauccuugcuggcaacgcauuuacagcaggcaaagucaucuucgcagcaguacccccuaauuucccaacagaagggcucucucccucccaagucaccauguucccccacauaguagucgacguuagacaacuagaacccguucucaucccccuccccgacguacgaaacaacuucuaccacuacaaccaauccaacgaccccaccaucaagcuaaucgcaaugcuauacacaccccuucgagccaacaacgccggcgacgacgucuucaccgucuccugccgcguacucacccguccaucccccgacuuugacuuuauauuccucguaccacccaccguagaaucccgaaccaaacccuucagcgucccaguccuaaccguagaagaaaugaccaacucccgauuucccauaccccucgaaaaacuguucaccggccccuccuccgccuuuguaguacagccacaaaacggucgaugcacaaccgacggaguccuccucggaacaacccaacuaucccccguaaacauaugcaccuucagaggcgacguaacccacaucaccggcucucgcaacuacacaaugaaucucgcuagccaaaacuggaacaacuacgacccgacagaagaaauccccgcaccccucggaacccccgacuucguaggaaaaauccaaggcguccuuacacagaccacccgcaccgacggcuccacccgcggccacaaagccaccgucuacaccggcuccgccaacuucucccccaaacugggacgaguccaauucgagaccgacaccgaccacgacuucgaaguaaaccaaaacacaaaauucacuccagucgguguaauccaggacggcggaacaacacaccguaacgaaccccaacaauggguccuaccuucauacuccggccgcaauacacccaacguucaccucgcccccgcaguagcucccaccuuccccggagaacaacuccucuucuuccgauccaccaugcccgguugcuccggauaccccaauauggaccuggacugccuucucccccaggaauggguccaauacuucuaccaagaagcagcccccgcccaaucagacgucgcgcuacuccgauucgucaaccccgacacaggcagaguccucuucgaaugcaaacuacacaaauccggcuacguaaccguggcccacaccggccaacacgaccucgucauaccacccaacggcuacuuccgcuucgacucgugggucaaccaauucuacacacucgcccccaugggcaacggaaccggcagacgacgauaa

SEQ ID NO: 38767 - RNA, 1617 nt, Artificial Sequence
  derived and/or modified sequence opt11 from VP1__Norovirus_and/or_Norovirus-like__KP096345
augaaaauggccucaucugacgccaaccccucagacggcuccgccgcaaaccuagucccagaagucaacaacgaaguuauggcccuugaaccagucguaggcgcagcuaucgcagcacccguagccggacaacaaaaugucaucgauccauggauacgaaacaauuucguccaagccccugggggagaguucaccgucucaccccgcaacgcccccggcgaaauacucuggucagcaccccuagguccagaccuuaaccccuaccugucccaccucgcccgaauguacaacggcuacgccgggggauucgaaguacaggucauacucgccggcaacgccuucacggccggcaaagucaucuucgccgcuguuccucccaauuuccccaccgaaggccucucccccucccaaguaacaauguucccccacaucguugucgauguccgccaacucgaaccaguccucauuccacuccccgacguacgcaacaacuuuuaccacuacaaccaauccaacgaccccaccaucaaacucaucgccaugcucuacacuccccuccgcgcaaacaacgcuggcgacgacgucuucaccgucagcugccgaguccuaacccgccccucaccugacuucgacuucaucuuccucguaccaccaacugucgaaucucgcacuaaacccuucucagucccaguccucaccgucgaagaaaugaccaacuccagauuccccaucccacuagaaaaacucuucaccggacccuccagcgccuucgucguccaaccacagaacggacgcuguaccaccgacggcguacuacuaggaaccacacaacuauccccagucaacaucugcaccuuccgaggagacgucacccacaucaccggguccagaaacuacaccaugaaccucgcaagccaaaacuggggcaauuacgauccaacugaagaaauccccgcgccccugggaacccccgacuucgucggcaagauccaaggcguacucacccaaaccacacgcaccgacggauccacacgcggacacaaagccacagucuacacaggcuccgccgacuucgccccaaaacucggccgaguccaauucgaaaccgacacagaucacgacuuugaagcuaaccaaaacaccaaauucacccccgucggcguaauccaagacggcuccacuacucaccgaaacgaaccacaacaaugggucuuacccuccuauuccggccgcaacaccccaaacguacaccuagccccagccguagcccccaccuuccccggcgaacaacuacuauucuuccgauccaccaugcccggcuguuccggcuacccgaacauggaccucgacugccuccucccacaagaauggguccaauacuucuaccaagaagccgcacccgcccaaucagacguagcacuucuccgcuucgucaacccugacaccggacgcguccuauucgaaugcaaacuucacaaguccggauacgucacuguagcacauaccggccaacacgaccucguaauaccucccaacggauacuuccguuucgacagcugggucaaccaauucuacacccuagcccccauggguaacggcaccggacgcagacgguaa

SEQ ID NO: 38768 - RNA, 1617 nt, Artificial Sequence
  derived and/or modified sequence opt11 from VP1__Norovirus_and/or_Norovirus-like__KM982939
augaaaauggcauccuccgacgcaaaccccucagacgguuccgcggccaaucuagucccagaggucaacaacgaagucauggcccucgaacccguaguuggcgccgccaucgcagccccagucgccggccaacaaaacgucaucgaccccuggauccgcaacaacuuuguacaagcucccggcggcgaguucaccgucucaccacgaaacgcccccggugaaauccucuggucagcaccccucggccccgaccuaaaucccuacuuaucacaccuagcacgcauguauaacgguuacgccggaggauuugaaguccaagucauacuagcgggcaacgccuucacagccggaaaaguaaucuucgccgccgucccgccaaacuuccccaccgaaggccuaucccccucccaagucaccauguucccccacaucguagucgauguccgccaacuggaacccguccucaucccccuuccugacguccgcaacaacuucuaccacuacaaccaauccaacgacccaaccaucaaacuaauagccaugcucuacaccccguugcgagcaaacaacgcaggcgacgacgucuucaccguuucuugcagaguccucacccgcccgucccccgacuucgacuucauauuccuaguuccacccacaguagaaucccgcaccaaacccuucuccguccccguucucacagucgaagaaaugaccaacucccgcuuccccaucccccucgaaaaacuguucacaggccccagcuccgccuucguuguacaaccccaaaacggucgcugcaccacugauggaguacuccuaggcaccacacaacuaucacccgucaacaucugcaccuucagaggagacgucacccacaucaccggaucccgcaacuacaccaugaaccuggccucccaaaacugguccaacuacgacccaaccgaagaaauccccgcaccccucggcacacccgacuucgucggcaaaauacaaggcaugcucacccaaaccacccguaccgacggcagcacccgcggccacaaagccacugucuacaccgguuccgccgacuucgcacccaaacucggccgaguacaauucgaaacagacaccgaucacgacuucgaagccaaccaaaacacaaaauucaccccaguaggcgucauacaagacggaucaaccacccaccgcaacgaaccacaacaauggguccuuccauccuacuccggccgcaacacaccaaacguccaccucgcccccgcagucgccccaacauuccccggcgaacaacuccuauucuucagaagcaccaugcccggcugcagcggcuacccaaauauggaccuagacugcuuacucccccaagaauggguccaauacuucuaccaagaagccgcccccgcgcaaucagaugucgcccuacuccgauucgucaaccccgacacaggacgcgucuuauucgaaugcaaacuccauaaaucggguuacgucaccgucgcauacaccggccaacacgaccuagucaucccuccaaauggauacuucagauucgacucaugggucaaccaauucuacacccuugcuccuaugggcaacggcaccggacgacgaagauaa

SEQ ID NO: 38769 - RNA, 1617 nt, Artificial Sequence
  derived and/or modified sequence opt11 from VP1__Norovirus_and/or_Norovirus-like__KM198588
augaaaauggcuucuaacgacgcaaacccauccgacggauccgcggccaaccucguccccgaagucuccaaugaaguuauggcccucgaacccguaguuggcgccgccauagccgccccagucgccggccaacaaaacguuauagaccccuggaucagaaacaacuucguccaagcccccgggggagaguucacaguaucaccgcgcaacgcaccaggagaaaucuuauggucagccccacucgggcccgaccuaaaucccuaccuuucacaccuagcccgaauguacaauggcuacgcaggcggcuucgaagugcaagucauccucgcaggaaacgccuucaccgcagguaaaaucauauucgcagcaguaccacccaacuuucccacagaaggccucucccccucccaaguaaccauguucccccacauaaucgucgacguccgacaacucgaaccaguccucauaccccuccccgacguccgcaacaacuucuaccacuauaaccaaaccaacgacuccaccaucaaacucaucgccaugcuauacacaccccuacgcgcaaacaacgccggcgaagaugucuuuaccgucuccugccgcguccucacccgucccucccccgacuucgacuucauauuccuaguacccccaaccgucgaaucucgcaccaaaccauucaccguccccauccuaacaguagaagaaaugaccaacucacgauuccccauuccccucgaaaaacucuucaccggccccuccggagcauucguaguccaaccccaaaauggccguugcacaaccgacggcguccuccucggaaccacacaacuaagcccggucaacaucugcaccuuccgcggcgacgucacccacaucgccggaucccgcaacuacaccaugaaccucgcuucacucaacuggaacaacuacgacccaaccgaagaaauacccgccccacuugggaccccugacuucguaggaaagauccaaggaguacucacucaaaccaccaaaggugacggcucuacucgcggccacaaagccaccgucuacaccggcuccgcacccuucacccccaaacucggcagcguccaauucuccaccgacaccgaaaacgacuuugaaacccaccaaaacacuaaauucacccccgucggcguaauacaggauggcggcacaacacaccgaaacgaaccccaacaaugggcccuaccgagcuacuccggccgagacguacacaauguacaccucgcacccgccguagcacccaccuuccccggcgaacaauuacucuucuuccgauccacaaugccuggaugcucaggcuaccccaacauggaucuugacugccuuuuaccacaggaauggguacagcacuucuaucaagaagcagcacccgcucaaucagaugucgccuuacucagauucguuaacccugacacaggccgcguccucuucgaaugcaaacuccacaaaucaggcuacgucacagucgcacacaccggucaacacgaccuugucauaccacccaacggauacuuccgcuucgauucaugggucaaccaauucuacacccucgcccccaugggcaacggcaccggccgccgccgauaa

SEQ ID NO: 38770 - RNA, 1617 nt, Artificial Sequence
  derived and/or modified sequence opt11 from VP1__Norovirus_and/or_Norovirus-like__KM198544
augaaaauggccagcucagacgccaaucccucugacggauccacagcuaaccucguccccgaagucaacaacgaaguuauggcccuagaaccagucgucggcgcagcuaucgccgcccccguagcuggacaacaaaacguaauagacccauggauccgcaacaacuucguccaggcgcccggcggcgaguucacuguaagcccucgcaaugcacccggagaaauccucugguccgccccacuagggccagaccuaaacccauaccucucccaccuagcccgaauguacaacggguacgcgggcggauucgaaguucaagucauccucgccggaaacgccuucacagccggcaaaauaaucuucgcagccguacccccaaacuucccuaccgaaggucucuccccaagccaagucaccauguucccccaccucaucguagacguccgacaacucgaaccaguccucauaccacuccccgacguucgcaacaacuucuaccacuacaaccagucaaacgacccgaccaucaaacuaauagccaugcucuacacaccccuccgugccaacaacgccggcgacgacgucuucaccgucucaugccgcguccucacccggcccagccccgacuucgacuucaucuuccucgucccucccaccgucgaaagccgaaccaaacccuucuccgucccgguccucacagucgaagaaaugacgaacucccgauucccuauuccacucgaaaaacucuucaccggccccuccuccgccuuugucguccaaccacaaaacggccgcugcaccaccgauggcguuuuauuaggaaccacccaacuaucgcccguaaacaucugcaccuuccgcggcgacgucacccacaucucaggcucccgcaauuacaccaugaaccuagcaucccaaaacuggaacucauacgacccaaccgaagaaaucccagcaccccuaggcacccccgacuuuguuggcaaaauccaaggcguccuaacacaaacaacacgaacuaacggcuccacccgcggccacaaagccacagucuacacugguucagccgacuucucacccaaacuaggacgcguccaauuugccacagauacagacaacgacuucgaaaccaaccaaaacacaaaauucacaccggucggcguuauccaagacggcucaaccacuccccgaaacgaaccccaacaauggguccuaccuuccuacagcggucgaaacauccauaacguccaccucgcccccgccgucgcccccacauucccuggcgaacaacuacuguuuuuccgcucuaccaugccagguugcuccggcuaccccaacauggaucuugacugccuacuaccccaagaauggguccaauacuucuaccaagaagccgcacccgcacaauccgacguagcccuccuacgcuucgucaauccagacacgggcaggguacuauucgaaugcaaacuccacaaauccggauacgucacggucgcccacaccggccaacacgaccucguaaucccucccaacggcuacuuccgguucgacuccuggguaaaccaauucuacacccucgcacccaugggcaacggcaccggccgccgacgauaa

SEQ ID NO: 38771 - RNA, 1617 nt, Artificial Sequence
  derived and/or modified sequence opt11 from VP1__Norovirus_and/or_Norovirus-like__KM198522
augaaaauggcuuccaacgacgcgaaccccucagauggcucagccgcgaaccucguaccagaagucuccaacgaaguaauggcccucgaacccguagucggcgccgccauagccgcccccguagcagggcaacaaaacgucaucgacccuuggauccgaaacaauuucguccaggcaccaggaggagaguucacagucagcccccgaaaugcccccggcgaaauacucuggagugcaccacucggaccugaccucaacccauaccucucacaccuagcccgaauguacaacggcuacgcaggcggauucgaaguccgcguuauacucgccggcaacgcguucacagccggaaaaaucaucuucgcagccgucccacccaacuuccccaccgaaggacucuccccuucacaaguaacaauguucccccacaucaucguggacguacgacaacucgaacccguccuaauaccacuaccagacguccgaaauaacuuuuaccacuacaaccaaaccaacgacuccacaaucaaacucauagccaugcuuuacaccccacuccgagccaacaaugccggcgaagacgucuucaccgucuccugucgaguccucacccgcccaucaccagacuucgacuucaucuuccucgucccacccacaguagaaucccgaaccaaacccuucacgguccccauccucacgguugaagaaaugacaaacucccgauuccccaucccccucgaaaaacucuucaccggcccaucaggcgccuucguaguacaaccccaaaacggacgcugcaccaccgacggcguccuacucggcacaacccaacuaucaccuguaaacaucugcacauuccgaggcgacguuacacacaucgccggcucccgcaacuacacaaugaaccucgccucacucaacuggaacaacuacgacccaacugaagaaauaccagcacccuuaggcacacccgacuucgucggaaaaauacaaggaguccucacccaaaccaccaaaggcgacggcuccacccgcggccacaaagcaaccguauauacuggcucugcuccauucacccccaaacuuggcagcguccaauucucaaccgacacagaaaacgacuucgaaacccaccaaaacacuaaauuuacaccagucggcgucauccaagacggcggcacaacccaccgcaacgaaccacaacaauggguccuccccuccuacuccggccgagacguucacaacguucaccucgcacccgcgguagcacccacauucccaggugaacaacuucuuuucuuccgcuccaccaugccaggcuguuccggcuaccccaacauggaccuagacugccuacucccccaagaauggguccaacacuucuaccaagaagcagcccccgcacaaucagacgucgcccuacuacgcuuuguaaaccccgacaccgggcgcguccucuucgaaugcaagcuccacaaauccggcuacgucaccgucgcccacaccggacaacacgaccuggucaucccuccaaauggcuacuuccgcuuugacuccugggucaaccaauucuacacgcuagcccccaugggaaacggcaccggacgaagacgcuag

SEQ ID NO: 38772 - RNA, 1617 nt, Artificial Sequence
  derived and/or modified sequence opt11 from VP1__Norovirus_and/or_Norovirus-like__KM198508
augaaaauggccucaaacgacgccaaccccucugacggcuccgccgccaaccucguaccagaagucuccaaugaagucauggcguuagagcccgucguuggagccgcgaucgcagcccccgucgcaggccaacaaaacgucaucgaccccuggauccgcaacaacuuuguccaagcgcccgguggugaguucaccgucagcccacgaaacgcacccggcgaaauccucuggucagccccacucggucccgaccucaacccauaccucagccaccucgcccgcauguacaacgguuaugcaggaggauucgaaguucaaguaauccucgccgguaaugcauucaccgcgggcaaaaucauuuucgccgcggucccacccaacuucccaaccgaaggccucucaccaucgcaaguaacaauguucccccacaucaucguagacguccgccaacuagaacccguccucaucccccuccccgacguacguaacaacuucuaccacuacaaccaaaccaacgacuccacgauuaaacucaucgcaaugcucuacacaccacuucgcgccaacaaugccggcgaagacgucuucaccgucuccugcagaguccucacacgacccuccccagacuucgacuucauauuccuuguaccacccacagucgaaucccgcacaaaacccuuuacggucccaauacuaacagucgaagaaaugacaaacucccgcuuccccauaccccuagaaaaacuuuucaccggaccauccggcgccuucgucguacaaccacaaaacggacgaugcaccacagacggaguauuacucggcaccacacaacucagccccgucaacaucugcaccuuccgaggagacgucacccacaucgccggcucacgcaacuacaccaugaaucucgcaucacuaaauuggaacaacuacgacccaacagaagaaaucccagccccgcucggaacacccgacuucgucggcaaaauccaaggcguucucacgcaaaccacaaaaggagacggaagcacccgaggacacaaagccaccguauauaccggcuccgcaccuuucacccccaaacucggaucaguacaauucuccacugacaccgagaacgacuucgaaacccaccaaaacaccaaauucacccccgucggcguaauccaagacggaggcaccacccaccgcaacgaaccccaacaauggguauuacccuccuauucaggacgagacguacacaacguacaccuagccccagcuguagcccccaccuucccaggagaacaacuccuauucuuuagauccaccaugcccggcugcuccggauaccccaacauggacuuagacugucuccucccccaagaauggguccaacacuucuaccaagaagccgcacccgcacaaucagacgccgcacuccuccgcuucgucaaccccgacacugggagaguacuauucgaaugcaagcuccacaaaagcggcuaugucaccgucgcccacaccggccaacacgaccucgucauaccaccaaacggauacuuccgauucgacuccuggguaaaccaauucuacacccucgcaccaaugggaaacggcaccggccgccgacguuaa

SEQ ID NO: 38773 - RNA, 1617 nt, Artificial Sequence
  derived and/or modified sequence opt11 from VP1__Norovirus_and/or_Norovirus-like__KJ716367
augaaaauggccagcuccgacgccaaccccuccgacggcuccgccgcaaaccuagucccugaagucaacaacgaaguaauggcacucgaaccaguggugggcgccgcuaucgcagcacccgucgccggccaacaaaacguaaucgacccuuggauccgaaacaacuucguacaagcccccggaggcgaguucacagucagcccccgcaacgcccccggagaaauccuuugguccgcuccacucggccccgaccuaaaccccuaccucucucaccucgcacgcauguacaacggauacgccggcggcuuugaaguacaagucauacucgccggcaacgccuucaccgcgggaaaggucaucuucgccgccguacccccuaacuuccccacugaaggccucuccccaucacaagucacaauguucccacacauugucgucgacguccgacagcuugaacccguccucaucccccuacccgauguccguaauaacuucuaucacuacaaccaaucaaacgaccccaccaucaaacugaucgccaugcucuacacuccccuacgagccaauaacgcaggcgaugacgucuuuaccgucuccugccgcguccucacccgucccuccccagacuucgacuucaucuuccucguacccccgaccgucgaaucacgaacuaaacccuucuccguccccguucuuaccgucgaagagaugaccaacucucgauuccccauaccccucgaaaaacucuucaccggcccaucauccgccuucgugguacaaccccaaaacggccgcuguacuacggacggcguccuucuuggcaccacacaacuaucacccguaaacaucugcaccuuccggggcgaugucacccacaucacuggaucacgcaauuacacaaugaaccuagccucccaaaacuggucaaacuacgaccccaccgaagaaauccccgcaccccucggaaccccagauuucgucggcaaaauccaaggaguccuaacccaaacaacucgaacagacggcagcacuagaggucacaaagccacagucuacacuggcuccgccgacuucgcccccaagcuaggcaucguccaauucgaaaccgacaccgaccacgacuucgaagcaaaccaaaacaccaaauucacccccguaggcgucauccaagacgguagcaccacccaucgcaacgaaccccaacaauggguccucccaagcuacaguggccgcaacacccccaauguacaccucgcccccgcugucgccccaacauuccccggagaacaacuccuguucuuccgcucaaccaugcccggcugcuccggcuaccccaacauggaucucgacugccuacuuccccaagaguggguccaauacuucuaccaagaagcagcacccgcucaauccgacguagcccuccuccguuucgucaaccccgauaccggccgcguacuuuucgaaugcaaacuccacaaaucuggcuauguuacagucgcacacaccggccaacacgaccuaguaaucccacccaacgguuacuuccgcuucgacuccugggucaaccaauucuacacccuagcacccauggguaacggcaccggccgucgccgcuaa

SEQ ID NO: 38774 - RNA, 1617 nt, Artificial Sequence
  derived and/or modified sequence opt11 from VP1__Norovirus_and/or_Norovirus-like__KF177440
augaaaauggcauccuccgacgccaacccuucagacggcagcgcugcaaaccucguccccgaagucaauaacgaagucauggcacucgaacccguagucggcgcagccaucgcagcccccguagccggccaacaaaacgucauagaccccuggauacgaaacaacuucguccaagcccccggcggcgaguucacagucucuccccgaaacgcccccggugaaauccucuggucugcaccccucggccccgaccucaacccauacuuaucccaccuagcccgaauguacaauggcuacgccggcggcuucgaaguacaagucauccucgcgggaaacgcuuucacagccggcaaaguaaucuuugcagccgucccacccaacuucccaaccgaaggacucucccccucacaagucaccauguucccacacaucgucgucgacguucgacaacucgaacccguccuaaucccacucccagacguccguaacaacuucuaccacuacaaccaauccaacgaccccacaaucaaacucaucgcaaugcucuacacuccacuccgagccaacaacgccggcgacgauguauucacagucuccugucgaguacuaacacgccccucacccgacuucgacuucauauuccuagucccaccaaccgucgaaucccgaaccaaacccuucuccguccccguccuaaccgucgaagaaaugaccaacucucgcuuccccaucccccucgaaaaacuuuucaccggaccaagcagcgccuucguuguccaaccacaaaacggacgcugcacaacagacggcguacuacuagguaccacacaacuaaguccggucaauaucuguaccuuccgcggcgacgucacccauauuaccggcucgcgcaacuacaccaugaaccucgccucccaaaauuggaacaacuacgacccaaccgaagaaaucccagcuccccuaggcacaccugacuucgucggaaaaauccaaggcguccuaacccaaaccacccgcaccgacggcucaacucgcggacacaaagccaccgucuacacgggcucagccgacuucgcccccaaacucggccguguacaauucgaaacagacaccgaccacgacuuugaagccaaccaaaauacuaaauucacacccgucggugucauccaagauggcggcaccacccauagaaacgaaccucaacaauggguccuccccuccuacucuggacgaaacacuccaaacguccaccuagcccccgccguugcaccaacauuccccggcgaacaacuccucuucuucagauccaccaugccaggaugcuccggcuacccaucaauggaccuagacugccuccuuccacaggaauggguacaauauuucuaccaggaagccgcacccgcacaauccgacgucgcacuccuucgcuucgucaaccccgacacaggucgaguucucuucgaaugcaaacuucacaaaucugguuacguaaccgucgcccauaccggccaacacgaccuagucauaccacccaacggcuacuuccgcuucgacuccugggucaaccaauucuacacccucgcccccaugggcaacggcaccggacgcagacgcuag

SEQ ID NO: 38775 - RNA, 1617 nt, Artificial Sequence
  derived and/or modified sequence opt11 from VP1__Norovirus_and/or_Norovirus-like__KF060117
augaagauggccucaucagacgcacacccaucagacggauccaccgcaaaucucgucccagaagucaacaacgaaguaauggcacucgaacccgucgucggagccgcaauagcagcccccguagccggacagcaaaacgucauugacccauggauacgcaacaacuucguccaagcacccggcggcgaguucaccgugucaccacgaaaugccccaggagaaauacucugguccgcaccccuaggccccgaccucaacccauaucucucccaccucgccaggauguacaacggcuacgccggcggauucgaaguccaaguaauccuugccgguaacgcauucaccgcaggcaaaaucaucuucgccgccgucccacccaacuucccaacagaaggacuaucaccuucacaagucaccauguucccccacaucauaguagaugugcgacaacuugagcccguccucauaccucucccagauguccgcaacaacuucuaccacuacaaccaaucaaacgaccccaccauaaaacucauagccaugcucuacacgccccuccgugcaaacaacgccggcgacgaugucuuuaccgucucaugccgaguccuaacacgccccucacccgauuucgacuucauauuccuaguacccccaacagucgaaucccgaacaaaaccauucucaguccccguccuaaccgucgaagaaaugaccaauucacgauucccaaucccacucgaaaaacucuucaccggcccauccagcgcauucgucguccaaccacaaaacggaaggugcaccaccgacggcguccuacuuggcacaacccaacuaagcccugucaacaucugcaccuucagaggcgacgucacccauaucucaggaucccgcaauuacaccaugaaucuagccagccaaaacuggaacucauacgaccccaccgaagaaaucccagccccacugggaacacccgacuucgucggcaaaauccaaggcguccucacccaaacaacccgcaccgacggaucaacccgcggccacaaagccaccguuuacaccggcuccgccgacuuuucccccaaacuuggccgcguccaauucgcaaccgacaccgacaacgacuucgucacaaaccaaaacaccaaauuuacuccagucggagucauccaagacggcucaaccacaccccguaacgaaccccagcaauggguccuucccuccuacucaggccguaacacccacaacguccaccuagcacccgcuguagccccuaccuuccccggugaacaacuccucuucuuccgaucaaccaugcccgggugcucuggcuaccccaauauggaucucgacugccuacuaccccaagaauggguccaauacuuuuaccaagaagccgcucccgcacaauccgacgucgcccuccuccgcuuuguuaaccccgacacaggccgcguccucuucgaaugcaaacuacacaaauccggcuacgucaccgucgcucacacaggccaacacgaccuagucaucccacccaacggauacuuccgcuucgacagcugggucaaccaauucuacacacucgcccccaugggaaacggcaccggccgccgucgguga

SEQ ID NO: 38776 - RNA, 1617 nt, Artificial Sequence
  derived and/or modified sequence opt11 from VP1__Norovirus_and/or_Norovirus-like__KF060104
augaaaauggccagcuccgacgccaaucccuccgacggcucaaccgccaaccucguacccgaaguaaacaaugaagucauggcacuugaacccgucgucggcgcagcaauagccgccccugucgccggacaacaaaacgucaucgaccccuggauucgcaacaauuucguccaagcccccggcggcgaguucacagucucaccaagaaacgcccccggcgaaaucuuaugguccgcaccccucggcccagaccuaaacccauaccucucacaccuugcccgcauguacaacggauacgccggcggauucgaaguacaagucauacucgccggcaacgccuucaccgcuggaaagaucaucuucgcagccgucccgcccagcuuccccacagaaggucucucccccagccaagucaccauguucccccacauaauagucgauguaagacaacuagaaccagucuuaauaccucuccccgacguacgcaacaacuucuaccacuacaaccaauccaacgaccccaccaucaaacugaucgcaaugcucuacacccccuuacgcgcuaacaacgcuggcgacgacgucuucaccguaucaugccgcguccuaacacgccccuccccugacuucgacuucauuuuccuugucccacccacagucgaaucccgaacaaaacccuucucaguccccguccuuacagucgaagaaaugacaaacucccgauuccccauaccccucgaaaaacucuucacaggcccaucuuccgccuucgucguccaaccccaaaacggccgcugcaccaccgacggcguccuccucggaacaacccaacuuucacccgucaacaucugcaccuuccgcggagaugucacacacauauccggcagccgcaacuacaccaugaaccucgccagccaaaacuggaacucauacgaccccaccgaagaaauccccgcuccacucggaacacccgacuucguaggcaaaauccagggaguacuaacucaaaccacucgaaccgacggcucuacccgcggccacaaagccaccgucuacacaggaucagccgacuucucacccaaacucggccguguccaauucgcaaccgacaccgacaacgacuucgucacaaaccaaaacaccaaauucacccccgucggaguaauccaagacggauccaccacaccccgcaacgaaccccaacaauggguccuccccuccuacuccggccgaaacacccacaacguucaccuggcccccgccgucgcuccaaccuucccaggcgaacaacuccucuucuucagaucuaccaugccaggcugcuccggcuaccccaacauggaccucgacugccuccugccccaagaauggguccaauacuucuaccaagaggccgccccagcgcaauccgaugucgcccuccucagauucguuaaccccgacacaggccguguccucuucgaaugcaaacuccacaaauccggcuacgucaccgucgcccacaccggacaacacgaucuggucaucccacccaacggcuacuuccgauucgacuccugggucaaccaauucuacacacuagccccaaugggaaacggcaccggacgcagacgcuga

SEQ ID NO: 38777 - RNA, 1617 nt, Artificial Sequence
  derived and/or modified sequence opt11 from VP1__Norovirus_and/or_Norovirus-like__KF060095
augaaaauggccucuuccgacgcaaaccccuccgacggaucuacagccaaccuaguccccgaagucaauaacgaagucauggcccuagaacccgucgucggagccgccaucgccgcacccgucgccggccaacaaaacguaaucgaccccuggauccgaaauaacuucguccaagcccccggaggcgaguucaccguauccccacguaacgccccaggagaaauacucuggucagcaccccucggcccggaccucaaccccuaucucucccaccucgcccggauguacaacggcuacgccggcggcuucgaaguccaggucauccucgccggcaaugccuucacugcuggaaaaaucaucuucgccgccgucccacccaacuuccccaccgaagggcuaucacccagccaagucaccauguucccacauaucaucguugacgucagacaacuagaaccaguccucaucccccuacccgacguccgcaacaauuucuaccacuacaaccaaucaaacgaccccaccaucaaacuaauagccauguuauacacuccucuucgcgcaaacaacgccggugacgacguguucacaguauccugccgcguccuaacacggccuucccccgacuucgacuucaucuuccucgucccacccaccgucgaaucaagaaccaaacccuuuucaguccccguccucaccgucgaagaaaugaccaacuccagauucccaaucccacucgaaaaacucuucacaggucccuccggcgccuuugucguucaaccccaaaacggccgaugcacaacagacggaguccuccuuggaacaacccaacucucccccgucaacaucugcacauuccgcggcgacguaacccacauauccggcagccgcaacuacaccaugaaccuugccucccaaaacuggaacucauacgaccccaccgaagaaaucccagcaccucuagguacacccgacuucgucggcaaaauccagggaguccuaacccaaaccacccgcaccgacggauccacccgcggccacaaagccaccgucuacacaggcucagccgacuucucacccaaacuaggccgaguccaauuugcaaccgacaccgacucagacuucgucaccaaccaaaacacaaaauucacacccguaggcguaauccaagacggcucgaccacaccccgcaacgaaccccaacaaugggucuuaccaucauacuccggacguuccacccauaauguacaccucgcacccgccguagcacccaccuucccaggugaacaacuccucuucuuccgcucaaccaugcccgguugcucaggcuaucccaauauggaccucgacugucuccucccccaagaauggguacaguacuucuaccaagaagcggccccagcacaauccgacguagcccuccuccgauucgucaaccccgacacaggccgagucuuauucgaaugcaaacuccacaaaucaggauacguuacugucgcccacacuggccaacaugaccucgucaucccacccaacggcuacuuccgcuucgauuccugggucaaccaauucuacacacucgcacccaugggcaacggaacaggcagacgccguuaa

SEQ ID NO: 38778 - RNA, 1617 nt, Artificial Sequence
  derived and/or modified sequence opt11 from VP1__Norovirus_and/or_Norovirus-like__KF060084
augaaaauggcauccucggaugcaaacccaagcgacggcucaacagccaaucuagucccagaaguaaauaacgaaguuauggcccuagaacccgucguaggugccgccaucgccgccccagucgccggccaacaaaacgucaucgaucccuggauccgcaacaacuucguacaagcccccggaggagaguucaccgucuccccucgaaacgcuccaggcgaaauucuauggucagcaccccucggccccgaucucaaccccuacuugucacaccuagcccgcauguacaacggguacgccggcggcuucgaaguccaagucauccucgccggcaacgcauucaccgcaggcaaaaucauauucgcagccguaccuccaaacuuccccaccgaaggacuuucccccagccaagucaccauguucccccacauaaucgucgacguaagacaacucgaacccguccuaauaccccuuccagacgugaggaacaacuucuaccacuacaaccaauccaacgaccccaccaucaaacucauagccaugcucuacacuccccuccgcgccaacaacgcaggagacgacgucuucaccguauccugccgcguucucacccgcccuucacccgacuuugacuucaucuuucuaguacccccaaccguagaaucccgcacaaagccauucagcguccccguccucaccgucgaagaaaugaccaacucaagauuccccaucccccucgaaaaacuauucaccggaccuuccuccgcauucgucguccaaccacaaaacggccgcugcaccaccgacggcguacuccucggcacaacccaacuuucaccaguaaacauauguacauuucgaggcgacgugacccacaucucaggaucacgcaacuacaccaugaaccucgccucccagaacuggaacuccuacgaccccacagaagaaauaccugcaccccucggcacccccgacuucguaggcaaaauccaagguguacucacccaaaccacacgcacugacggaagcacucgaggccacaaagccaccguauacaccggcuccgcagacuucucacccaaacuaggcagaguccaauucgccacagacaccgacaaugacuucgucaccaaccaaaacaccaaauucacaccagucggagucauacaagacggcuccaccaccccucgaaacgaaccccaacaauggguacucccauccuauuccggucgcaacacccacaacguccaccucgcccccgcaguagcccccaccuuccccggagaacaacuacuuuucuuccgaucaaccaugcccgguugcuccggcuacccaaacauggaccucgacugccuacuaccccaagaauggguucaauacuucuaccaggaagccgccccagcacaaucagacgucgcacuacuacgcuucgucaaccccgacacgggucgaguccucuucgaaugcaaacuccacaaauccggguacgucaccguagcccacacagggcaacacgaccuagucauucccccaaacggauauuucagguucgacucuuggguaaaccaauucuacacucuagcccccaugggaaacggagccggccgccgccgcuga

SEQ ID NO: 38779 - RNA, 1617 nt, Artificial Sequence
  derived and/or modified sequence opt11 from VP1__Norovirus_and/or_Norovirus-like__KF060082
augaaaauggcauccucugacgcgaacccauccgacggcucaaccgccaaccucguccccgaggucaauaacgaaguaauggcccucgaacccguagucggcgcagcgaucgccgcaccuguagccggccaacaaaacgucauagaccccuggauacgcaacaacuucguacaagcucccggcggagaguucaccgucucaccccgaaacgcgccuggcgaaauccucugguccgcaccacucggccccgaccucaaccccuaccucucccaccuagcccgaauguacaacggcuacgccggcggauucgaaguacaggucauccuugcaggcaacgccuucaccgccggcaaaaucaucuuugcggcuguacccccaaacuuccccaccgaaggccucucccccucccaagucaccauguucccacacaucaucgucgacguccgacaacucgaaccaguccucaucccacuaccagacguccgaaauaacuucuaucacuacaaccaauccaacgacccuacaaucaaacucaucgccaugcucuacacaccacuccgcgcuaacaacgccggcgacgacgucuucaccguauccugccgaguccuaacccguccauccccagacuucgacuucauauuccuaguacccccaaccguagaaucccgcacuaaaccauucuccguaccaguccucacaguagaagaaaugaccaacucacgcuucccaauaccacucgaaaaacucuucaccggacccucaucugcauucgucguccaaccacaaaacggccgcugcaccacugacggaguccuccucgguaccacccaacugagccccgucaacaucugcaccuuccgaggcgacgucacacacauacccggcagccguaauuacaccaugaaccuagccucacaaaacuggaacucauacgaccccaccgaagaaauccccgccccucucggaacccccgacuucguaggaaagauccagggaguccucacacaaacuacacgcaccaacgguuccaccagaggccacaaagccacagucuacaccggcagcgcagauuucucaccaaaacuaggccgcguucaauucgccaccgacaccgacaacgacuucgaaaccaaccaaaacacaaaauucacccccgucggcgucauacaggacggaucuaccacccccagaaacgaaccccaacaauggguacucccaagcuacucaggacgcaauauccacaauguccaccucgcccccgccgucgcacccaccuuccccggagaacaacuccuauucuuccgcucuaccaugccaggcugcuccggcuacccaaacauggaccuggacugccuccucccccaggaauggguccaauacuucuaccaggaagccgcccccgcgcaauccgacgucgcgcuacuccgcuucgucaacccugacacaggccgcguccuauuugagugcaagcuacauaaaucaggcuauguaaccguagcacacaccggacaauacgaccuagucaucccgcccaacggcuacuucagauucgacuccugggucaaccaauucuacacccuagcccccauggguaacggaaccggccgcagacgcuaa

SEQ ID NO: 38780 - RNA, 1617 nt, Artificial Sequence
  derived and/or modified sequence opt11 from VP1__Norovirus_and/or_Norovirus-like__KF060079
augaaaauggccucauccgacgcaaaccccucagacggauccaccgcaaacuuagucccagaagucaacaacgaagucauggcccucgaacccguagucggcgccgcaaucgccgcaccaguagcuggccaacaaaacgucauugacccuuggauccgcaauaacuucguccaagcacccggcggcgaguucaccgucucaccccgcaacgcuccaggcgaaauacuaugguccgcuccccuaggccccgaccucaaccccuaccucucccaccuagcacggauguacaacggguacgcaggaggauucgaaguucaagucauccuagccggcaaugccuucacagcaggcaaaaucaucuucgccgcaguacccccuaacuucccaacagaaggccuuucccccucacaagucaccauguucccgcacaucaucgucgacguccgccaacucgaaccaguccucaucccccuccccgacguccgcaacaacuucuaccacuacaaccagucaaaugaccccaccaucaagcuaauagccaugcucuacacaccccuccgagccaauaacgcaggcgaugacguauucaccguaucaugccgaguccucacccgcccaucccccgacuucgacuucaucuuccucgucccacccaccgucgaaucccgcaccaaacccuuuucaguacccguccuaacaguagaagaaaugaccaacucgcgcuucccaauaccccuagaaaaacucuucacaggccccuccuccgcauucguaguccaaccacaaaauggucgcugcaccacagacggcguccuacucgggacaacccaacucagccccgucaauaucugcacauuccgcggagacguaacucacauuuccggcucccguaacuacaccaugaaccuagccucccaaaacugguccaguuacgaccccaccgaagaaauccccgccccucucggcacaccugacuucguaggcaaaauccaaggaguacuaacccaaacuacucgaacagacggaucaacacgcggccacaaagccaccgucuacaccggauccgccgacuucagcccaaaacucggcaggguccaauucgcgaccgacaccgacaacgacuucgucaccaaccaaaacaccaaauucacacccguaggcgucauccaagacggcucgacaacaccacgaaacgaaccacaacaauggguccuacccuccuacuccggccgcaacacccacaacguacaccuugccccagcugucgcucccaccuuucccggcgaacaacuacuauucuuccguagcacaaugccuggcugcucuggcuaccccaacauggaccucgacugccuccucccccaagaauggguccaguacuucuaccaagaagccgcgcccgcacaaagcgacgucgcccuucuccgcuucgucaaccccgacaccggccgcguccucuucgaaugcaaacuacacaaguccggauacguaaccgucgcucacacaggccaacacgaccucgugauacccccuaacgguuacuucagauucgacuccuggguuaaccaauucuacacccuugcuccaaugggaaacggcaccggccgacgucguuga

SEQ ID NO: 38781 - RNA, 1617 nt, Artificial Sequence
  derived and/or modified sequence opt11 from VP1__Norovirus_and/or_Norovirus-like__KF060058
augaaaauggccucaucugacgcaaaccccuccgacggauccacagccaaccuaguucccgaagucaacaacgaagucauggcccuagaaccaguuguaggcgcagccauugcagcccccgucgccggccaacaaaaugucauagacccguggauccguaacaacuuuguccaagcaccgggcggcgaauuuacaguuucaccccguaacgcuccuuccaccauccuuugguccgcaccccucggccccgaccucaacccauaccucucacaccuagcacgcauguacaacggcuacgccggcggauucgaaguccaggucauccucgccggcaacgcauucaccgcuggcaaaaucauauucgcugcaguacccccaaacuuccccacagaaggacucucacccucacaagucaccauguucccacauaucaucguugacguucgccaacucgaacccguccucauaccccuccccgacguacgaaacaacuucuaccacuacaaccaaagcaacgacccuacaaucaaacucaucgcaaugcuguacacgccccuucgcgcuaacaacgccggcgacgauguauucaccgucuccugccgcguccucacccgccccuccccagacuucgacuucaucuuccucguaccacccaccguagaaucccguaccaaacccuucuccguacccguucucaccguagaagaaaugaccaacucaagauuccccaucccccuagaaaaacucuucaccggacccuccuccgccuucgucguacaaccccagaacggacgcugcaccacugacggaguccuccucggcaccacacaacucucccccgucaacaucugcaccuucagaggcgacguaacccacaucucaggcucccgcaauuacaccaugaaccucgcaucccaaaacuggaacucguaugaccccaccgaagaaaucccggcaccccuuggcaccccagacuucgucggaaagauacaaggaguccucacccaaaccacccgaaccgacggauccacgcgcggccacaaggccaccgucuacaccggauccgccgacuuuuccccuaaacucggacguguccaauucgccaccgacacagacaacgacuucguuaccaaccaaaacaccaaauucaccccaguaggaguaauccaagacgguaguaccacucccagaaacgaaccacaacaauggguccuacccucuuacuccggucgcaacauccacaacguccaccuagcccccgcugucgcccccaccuuccccggagaacaacuccucuucuuucgauccacaaugcccgggugcuccggauaccccaacauggaccuagauugccugcucccccaagaauggguacaauacuucuaccaagaagccgcucccgcacagucagacguagcccuccuccgauucgucaaccccgacacaggaagaguccucuuugaaugcaaacuccacaaauccggcuacgucaccguagcccacacaggacaacacgaccucgucaucccucccaauggauacuuccgcuucgacuccugggucaaccaauucuacacacucgcccccaugggcaacgguacaggacgccgccgcuaa

SEQ ID NO: 38782 - RNA, 1617 nt, Artificial Sequence
  derived and/or modified sequence opt11 from VP1__Norovirus_and/or_Norovirus-like__KF060039
augaaaauggccagcucagacgccaacccuagcgacggcuccaccgccaaucucguccccgaagucaacaacgaaguaauggcccucgaaccaguuguaggcgccgccaucgcagcuccggucgccggccaacaaaauguuauugaccccuggauucgcaacaacuucguacaagccccaggcggcgaauuuacagucagcccccguaacgcccccggcgaaauccucugguccgcaccccuuggcccugaccucaaccccuaccuuucacaccucgccagaauguacaacggcuacgccggaggauuugaaguacaagucauccucgccggcaacgccuucacagccggaaagaucauuuucgcagcuguuccacccaacuuucccacagaaggacuuucaccuucacaagucaccauguucccccauauaaucgucgacgucagacagcuagaacccguccucauaccccucccagacguccgaaacaacuucuaccacuacaaccaaaguuccgacccaaccauaaaacucaucgccaugcucuacacaccccuccgcgccaacaacgcuggcgacgacgucuucacaguguccugccgaguucuaacccgccccucuccagacuucgacuucaucuuucuaguaccucccaccgucgaaucacgcaccaaacccuucucaguccccguccuaaccgucgaagaaaugacaaacucccgcuuuccaauaccccuugagaaacucuucacgggacccucaucagcauucguaguccaaccccaaaacggcagaugcacuacagacggaguccuccuaggaacaacccagcucagccccgucaacauuugcaccuuccgaggagacgucacccacaucucaggcucacgcaacuacaccaugaaccuagcgucccaaaacuggaacuccuacgacccaacagaagagauccccgccccacuagguacucccgacuucgucggaaaaauccaaggcguauugacccaaaccacccgcaccgacggauccacccgcggacacaaagcuacaguauacaccggcuccgccgacuucucaccaaaacuaggacgaguccaauucgcaaccgacaccgacaacgacuucguaacaaaccaaaacaccaaauucacaccagucggagucauccaagacggcuccaccacaccacgaaacgagccacaacaauggguccucccuucuuacuccggccgaaacacccacaacguacaccucgcccccgcaguagcccccaccuuccccggcgaacaacuacuauucuuccgcagcacaaugcccgguugcagcggcuaccccaacauggaccucgacugccuacucccacaggaauggguacaauacuucuaccaggaagcagcccccgcccaauccgacgucgcccuccuucguuucguuaaccccgacaccggccgaguccucuucgagugcaaacuccacaaauccggcuacguaacuguagcucacacaggccagcacgaccucgucauaccacccaacggauacuuccgcuucgacuccugggucaaucaauucuacacacucgcccccaugggcaauggcacuggccgccgccgcuaa

SEQ ID NO: 38783 - RNA, 1617 nt, Artificial Sequence
  derived and/or modified sequence opt11 from VP1__Norovirus_and/or_Norovirus-like__KF060030
augaaaauggccuccuccgacgccaaccccucagacggcuccgccgcaaaccuuguccccgaagucaacaacgaagucauggcccucgagcccgucgucggcgcagcaaucgccgcacccgucgcaggccaacaaaacgucaucgaccccuggauccgaaauaacuucguacaggccccaggaggcgaguucacagucucaccccguaacgcccccggcgaaauacucuggaacgcaccgcuaggccccgaccuaaaucccuaccuaucacaccucgcacguauguacaacggcuacgccgguggauucgaaguucaagucauacucgccggcaacgccuucaccgccgguaaagucaucuucgcugcagucccuccuaacuuccccacugaaggccucagccccucccaaguaaccauguucccccacauagucguagacguacgccaacuagaaccaguccucaucccacuaccagacguacgcaacaauuucuaccacuacaaccaauccaacgacccaacaauaaaacuaauagccaugcucuacacaccccuccgcgccaacaaugcaggcgacgacgucuuuacagucucgugccgcguccucacacgccccucacccgacuucgacuucaucuuccucguaccacccacagucgaaucacgaaccaagcccuucuccguacccguccucacagucgaagaaaugaccaauucccgcuuccccaucccccucgaaaaacucuuuacaggccccuccuccgccuucgucguccaaccccaaaacggccgcugcaccaccgauggaguccuccucggaaccacccaacucucccccgucaacaucugcaccuuccgcggcgacgucacccacaucacaggcucccgcaacuacacaaugaaucucgcuucacaaaacuggaauaacuacgaucccacagaagaaauccccgccccacuuggaaccccggacuucguaggcaaaauccagggaguacuuacccaaaccacacgaaccgacggcucaacccgaggccacaaagccaccgucuacacaggcuccgcagacuucgccccaaaacuuggccgcguccaauucgaaacagacaccgaccacgacuucgaagccaaccaaaacaccaaauucacacccguuggagucauccaagauggcggcacaacccaccgcaacgaaccucaacaauggguccucccauccuacucuggcagaaacacccacaacguccaucuugcucccgcagucgcaccaaccuuccccggcgaacaacuacucuucuuccgauccaccaugcccggaugcuccggcuacccuaacauggaccucgacugccuacuuccucaagaguggguucaauacuucuaccaagaagccgcaccagcccaaucagacgucgcccuccuacgcuucgucaaccccgauacaggccggguccuuuucgagugcaaacuucacaaauccggcuaugccacagucgcccauaccggccaacacgaccucgucauaccaccaaacggcuauuuccgauucgacuccugggucaaccaauucuauacccuagcccccaugggcaacggaaccggccgccgccgauga

SEQ ID NO: 38784 - RNA, 1617 nt, Artificial Sequence
  derived and/or modified sequence opt11 from VP1__Norovirus_and/or_Norovirus-like__JX439829
augaaaaugggauccaacgacgcaaaccccucagacggcucaacugccaaccuaguacccgaagucaacaacgaaguaauggcccuugaacccgucguaggcgcagccauagcugccccugucgcaggccaacaaaacgucaucgacccauggauccgcaacaacuucguccaagcuccagguggcgaauuuaccguaucaccccgaaacgcccccggagaaauacuauggucugcaccccucggacccgaccucaacccauaccuaucccaccucgcccgaauguacaacggcuacgccggcggcuucgaaguccaagucauccuagcaggcaacgcauucacugccggcaaaaucauuuucgcugcaguaccgcccaacuucccuaccgaaggccuaagcccaucccaaguaaccauguucccccacaucauagucgacguccgccaacucgaacccguacucaucccacuccccgacguccguaacaauuucuaccacuacaaccaauccaacgaccccacaaucaagcucauagcaaugcuauacaccccauuacgcgccaacaaugcaggagacgacguauucacagucuccugccgaguccucacacgacccucaccagacuucgacuucauauuccucgucccucccaccgucgaaucccgcacuaaaccuuucuccguacccguacucaccguugaagaaaugacuaacucccgcuuccccaucccgcucgaaaaacucuucaccggccccuccucugccuucgucguacaaccccaaaacggucgcugcaccaccgacggcguacuucucggaacaacccagcucucacccgucaauaucugcaccuuccggggcgacgucacucacauccccggcucacgcaacuacacuaugaaccucgccucccaaaacuggaacuccuacgacccaaccgaagaaauaccagccccacucggaacccccgacuucgucggcaaaauacagggaguacucacccaaaccacucgaaccaacggcuccacccgaggacacaaagcaaccguauacaccggcucagcggacuucucccccaaacuaggccgcguccaauucgccacagacaccgacaaugacuucgaaacgaaccaaaacacaaaauucacacccgucggcgucauacaagacggcagcacgacaccccgaaacgaaccccaacaauggguccuccccuccuacucaggacguaacauacacaacgugcaccucgccccagccgucgcaccaaccuuccccggcgaacaacuacucuucuuccgcucaaccaugcccggaugcuccggcuaccccaacauggaccucgacugucuacucccccaagaauggguacaauacuucuaucaagaagccgcccccgcccaauccgacgucgcacuccuucgauucgucaaucccgacacaggccgaguacuuuucgaaugcaaacuacacaaaucagguuacgucaccgucgcccacaccggccaacacgaccucgucauuccaccaaacgguuacuuucgauucgacuccuggguaaaucaauucuacacccuugccccaaugggaaacgguaccgggagacgacgcuaa

SEQ ID NO: 38785 - RNA, 1617 nt, Artificial Sequence
  derived and/or modified sequence opt11 from VP1__Norovirus_and/or_Norovirus-like__KC409282
augaaaauggccucaaacgacgcgaacccauccgacggcuccgccgccaaccuaguacccgagguuucaaacgaagucauggcacucgaaccugucgucggcgccgcaauagcagcgcccgucgcaggacaacaaaacgucaucgaccccuggauccgaaacaacuucguccaagcccccgggggcgaauuuacugucuccccacgcaacgccccuggcgaaauccucuggucagcgccccuuggaccagaccucaacccuuaccucucacaccuugcccgcauguauaacggauaugccggaggcuucgaaguacaagucauacucgccggcaacgcauucaccgcgggcaaaaucauauucgccgcaguaccacccaacuuucccacagaaggacuaucacccucacaggucaccauguucccccacaucauugucgacguccgucaacucgaacccguucuaaucccccuccccgacguccgcaacaacuucuaccacuacaaccaaaccaacgacucaacuauuaaacuaaucgcaaugcucuauacuccccuaagagccaacaacgcaggcgaagacgucuucaccguauccugccgcguacucacccgcccauccccugacuucgacuucaucuuccucgucccgcccaccguagaaucccgcaccaaacccuucaccguccccauacuuaccgucgaagaaaugaccaacucucgcuuccccauuccccucgaaaaacuauucaccggccccagcggcgccuucgucguccaaccccaaaacggccgcugcaccacagacggcguccuucuaggaaccacccaacucucucccgucaacaucugcaccuuccgaggcgacguaacccacaucgcagguuccagaaacuacaccaugaaccucgccagccucaacuggaacaacuacgaucccacagaggaaacacccgccccacuaggaaccccugacuucguuggcaaaauccagggcguccucacccaaacaaccaaaggcgacggcuccacacgcggucacaaagccaccgucuacaccggcucagcucccuucaccccaaaacuagguuccguacaauucucuacggacacugaaaacgacuucgaaacccaccaaaauaccaaguucacaccagucggcgucauacaagacggcggcaccacacauagaaacgaaccgcaacaauggguacuccccuccuacuccggacgagacguccacaacguccaccuugcacccgccgucgcccccaccuucccuggcgagcaacuccucuucuucagguccacuaugccaggaugcucaggcuaccccaacauggaccuagacugccuccucccccaagaauggguccaacacuucuaccaagaagccgccccagcacaauccgacgucgcucuacuacgcuucgucaacccagauacuggccgaguucucuuugaaugcaaacuccauaaaucaggauacguaacagucgcccacacaggacagcacgaccucgucauuccucccaacggcuacuuccgcuucgacuccuggguaaaccaauucuacacacuagcccccauggguaacggcaccggccgacgccgcuag

SEQ ID NO: 38786 - RNA, 1617 nt, Artificial Sequence
  derived and/or modified sequence opt11 from VP1__Norovirus_and/or_Norovirus-like__KC409259
augaaaauggcuucaaacgacgccaaccccuccgaugguagcgccgccaaccuaguacccgaaguuucaaacgaagucauggcccucgaacccguagucggagcagccaucgcagccccagucgccggacaacaaaacgucauagaccccuggauccgaaacaacuucguccaagccccuggaggagaguucaccguaucgccccgcaacgcaccaggagaaauacucuggagcgccccucucggucccgaccucaaccccuaucucucccacuuagcccgcauguacaacggcuacgccggcggauucgaaguccaaguaauccucgccggcaaugccuucaccgccgggaaaauaaucuucgccgcagucccacccaacuuccccaccgaaggacucucacccucccaagucaccauguucccccauauaauagucgacguccgccaacucgaaccgguucuaauuccccuccccgauguccgaaacaacuucuaccacuacaaccaaacaaacgauuccaccauaaaacucauagccaugcucuacacaccccucagagccaacaacgcaggcgaagacgucuucaccgucucaugccgaguacucacccgaccaucccccgacuucgacuucaucuuccucgucccaccaaccguagaaucucgcaccaaacccuucacaguaccaauccucacagucgaagaaaugacuaacucccgauuccccauuccccucgagaaacucuucacgggucccucuggagcauucguaguccaaccccaaaacggccgaugcaccaccgacggcguacuccuagguaccacacaacucucccccgucaacaucugcaccuuccgcggagacguaacccacaucgccggcucccgaaacuauaccaugaaccucgcaucacuaaacuggaacaacuacgaucccacagaagaaauccccgcaccacucggcaccccagacuuuguuggcaagauccagggaguccuaacucagaccacaaaaggagacggcucuacacgcggccacaaagccaccgucuacaccggcagcgcccccuucacccccaaacucggaucuguucaauucuccaccgacacagaaaacgacuucgaaacacaccaaaacaccaaauucacacccguuggcgucauccaagacggcgguaccacccaccgcaacgaaccacaacaauggguucucccauccuauuccggacgagacguucauaacguccaccucgcccccgccgucgccccaacguucccaggagaacaacuacucuucuuccgaucaacaaugcccggcugcuccgguuaccccaacauggacuuagacugccuccucccacaagaauggguacaacacuucuaccaagaagccgcuccagcccaauccgacgucgcacuccuacguuuugucaaccccgacaccggccgcguccucuucgaaugcaagcuccacaaacccggcuacguuaccgucgcucacaccggacaacacgaccucgucaucccuccaaacggauacuuccgauucgacucuuggguaaaucaauuuuacacccuagcccccaugggcaacggaaccggccgacgccguuaa

SEQ ID NO: 38787 - RNA, 1617 nt, Artificial Sequence
  derived and/or modified sequence opt11 from VP1__Norovirus_and/or_Norovirus-like__JX459659
augaaaauggccuccuccgacgccaaccccagcgacggcuccacagccaaccuugucccagaagucaacaacgaagucauggcccuugaaccagucguaggggccgcuaucgccgcaccagucgcaggccaacaaaacguaauugaucccuggauccgaaacaacuucguacaagcacccggaggugaguucacaguuucaccacgcaaugcaccuggcgaaauacucuggucagccccacuaggcccugaccuaaaccccuaccucucacaccucgcccgcauguacaacggcuacgcaggcgguuucgaaguucaagucauacucgccggaaacgccuucaccgccgguaaaaucauauucgccgcagucccucccaauuuccccaccgaaggacucucacccucacaaguuacaauguucccacacaucgucgucgacguccgacaacuagagcccguccugauaccacucccagacgucagaaacaauuucuaccauuauaaccaauccaacgaccccacaaucaaacuuaucgcaaugcuuuacacaccccuccgcgccaacaacgccggcgacgacgucuuuaccgucuccugccgcguucuaacccgccccucucccgacuucgacuucauauuccucguaccacccacagucgaaucccgcacaaaaccauucuccguacccguccucacuguagaagagaugaccaacucccgcuuccccaucccacucgaaaaacuauuuaccggccccucaucagcauuugucguacaaccccaaaacggccguugcaccaccgacggaguacugcuagguaccacccaacucucucccgucaacaucugcaccuucagaggugacgucacccacaucuccggcagccggaacuacaccaugaaccuagcaucacaaaacuggaacaguuacgaccccacagaagaaaucccagccccacucggaacacccgacuucguaggcaaaauucaaggaguccuuacccaaacaacccgcaccgauggauccacccguggccacaaagcaaccgucuacaccggcuccgcagacuuuucucccaaacuaggaagagugcaauucgccaccgacaccgacaacgacuucguaaccaaccagaacacaaaauucacucccgucggcgucauccaagacggcucaaccaccccaagaaacgaaccacaacaauggguccuccccuccuacucaggacgcaacacccacaacguacaccucgccccugccguugcccccacauuccccggcgaacaacuccucuucuuccgcuccacuaugcccggaugcucaggauaccccaacauggaccuagacugccuucucccccaagaauggguccaauacuucuaccaagaagccgcaccagcacagagcgacgucgcccuacuccgcuucguaaaccccgacacgggacgcguccucuucgaauguaaacuccacaaauccggcuacgucaccguagcccacaccggucaacacgaccucgucaucccacccaacggcuacuuccgauucgacagcugggucaaccaauucuacacccucgccccaaugggaaacggaacaggacgacgcagauaa

SEQ ID NO: 38788 - RNA, 1617 nt, Artificial Sequence
  derived and/or modified sequence opt11 from VP1__Norovirus_and/or_Norovirus-like__JX459658
augaaaauggcaucguccgacgccaacccauccgacggcucaacugcaaaccuaguccccgaagucaauaacgaaguaauggcccucgaacccgucgucggcgcagcuaucgcagcccccguagccggccaacaaaaugucaucgaccccuggauacgaaacaacuucguccaagccccaggcggugaguucacaguaucccccagaaacgccccaggggaaauccuaugguccgcaccccuaggccccgaccuaaacccuuaccuaucucaucucgcccgcauguacaacggauacgcgggcggcuucgaaguccaagugauucuggccggaaacgcauucaccgccggaaaaaucaucuucgcagcaguacccccaaacuucccaacagaaggacucucccccucccaggucaccauguucccccacaucaucgucgauguccgccaacucgaacccguccucauuccacucccagacguccgcaacaauuucuaccacuacaaccaauccaacgacccaaccaucaaacuaauagccaugcuuuacacaccccuacgcgccaacaacgcaggagacgacgucuuuaccgucagcugccgcguccuuacccgcccaucacccgacuucgauuucaucuuccuagucccaccaacaguagaaucccgcaccaaacccuucucugucccaguccucacuguagaagaaaugacaaacucacguuuccccaucccccucgaaaaacuuuucaccggacccagcuccgccuucaucguacaaccacaaaacggccgcugcaccaccgacggaguacuauuagguaccacacaacuaucacccguuaacaucugcaccuuccguggcgacgucacacacaucucugggucaagaaacuacacaaugaaccucgcgucacaaaacuggaacagcuacgacccaacagaagaaaucccagcaccccucggcacuccagacuucguaggcaaaauacaagguguccuaacacaaaccaccagaacagacggcucuaccagaggucacaaagccaccguauacacaggcuccgccgacuucucucccaaacucggccgcguccaguucgcaaccgauacagauaaugacuucgucaccaaccagaacaccaaauucacacccgucggagucauccaggacggcucaacgacuccacgaaacgaaccccagcaauggguccuaccauccuacagcggcagaaacacccacaacguacaccucgccccagcuguagcccccaccuucccaggagaacaacuacuauucuuccgaucaaccaugcccgguugcucgggcuaccccaacauggaccuagacugccuccuaccacaagaauggguccaauacuucuaccaggaggcagcccccgcccaauccgacguggcccuacuccguuucguaaaccccgacaccggacgaguccucuucgagugcaaacuccacaaaucaggcuacgucaccgucgcccacacuggccaacacgaccuuguaauacccccaaacggcuacuuccgauucgacagcugggucaaccaauuuuauacacucgcccccaugggaaacggaaccggacgacgacgauaa

SEQ ID NO: 38789 - RNA, 1617 nt, Artificial Sequence
  derived and/or modified sequence opt11 from VP1__Norovirus_and/or_Norovirus-like__JX459595
augaaaauggccuccaacgacgcaacccccucagacgguuccaccgcaaaccucguacccgaagucaacaacgaagucauggcucucgaacccgucgucggcgcagcuaucgccgcaccagucgccggccaacaaaacgucauugauccauggauccgaaacaacuuuguccaagcacccggcggcgaguucacaguaagcccccggaacgcccccggugaaauccucugguccgcaccccucggccccgaccuaaaccccuaccuaucccacuuagcccgcauguauaacggauacgccggcggcuucgaaguucaagucauacucgcaggcaacgccuucacagccggaaaaaucauauucgcagccgucccacccaauuuccccaccgaaggccucucccccucacaagucaccauguucccucacaucaucgucgacguacgccaacucgaacccguacuaaucccacuucccgauguacgcaacaacuucuaccacuacaaccaauccaacgacuccaccaucaaacucauucccaugcucuacacaccccuccgcgccaacaacgccggcgacgacgucuucaccgucagcugccgcguccucacccgccccucucccgacuucgacuucaucuuccucgucccucccaccguagaaucucgaaccaaaccuuucuccguacccauccuaaccguagaagaaaugaccaauagcagauuccccaucccccucgaaaaacucuucaccggacccuccuccgcauucgucguccaaccccaaaacggccgcugcaccaccgacggcguccuccucggcacaacccaacucucacccguuaacauuugcacauuccgcggcgacguaacccacaucgccggaacccaauccuacaccaugaaccucgccagccagaauuggaacaacuacgaccccaccgaagaaauacccgcaccccucggaacacccgacuucgucgguaaaauccaaggcguccuaacccaaacuacccgcggcgacggaagcaccagaggccacaaagcaaccgucuccacaggauccguucacuucacaccaaaacuuggcucaguccaauucuccaccgacacuuccaacgacuucgaaaccggccaaaacaccagauucacccccgucggcguaguucaagacggauccaccacacaccaaaacgaaccacaacaauggguacuucccaacuacagcggucgagacagccacaacguccaccucgcacccgcugucgcuccaacauucccuggcgaacaacuacuuuucuuccgauccaccaugcccggaugcuccggcuacccaaacaugaaccuugauugccuccucccccaagaauggguacaacacuucuaccaagaauccgcccccgcccaguccgacgucgcccucuuacgcuucgugaaccccgacaccggccgaguccucuucgaaugcaaacuccacaaaucaggcuacguaaccgucgcucacaccggccaacacgaccucgucauacccccaaacggcuacuuccgguucgacuccugggucaaccaauucuacacacuagcacccaugggcaacggagcaggccgccgacgcuag

SEQ ID NO: 38790 - RNA, 1617 nt, Artificial Sequence
  derived and/or modified sequence opt11 from VP1__Norovirus_and/or_Norovirus-like__JQ613560
augaagauggccucuucagacgccaaccccuccgacggcagcaccgccaaucucgucccagaagucaacaacgaagucauggcccucgaacccgucguuggcgccgcaaucgccgcacccgucgcaggccagcaaaaugucaucgaucccuggauucggaacaacuucguccaagcacccgggggagaguucacagucuccccacgaaacgcccccggcgaaauccuaugguccgcaccccuaggcccagacuuaaacccauaccuaagccaccuagcccgcauguacaacggcuacgcaggcggcuucgaaguccaggucauccucgccggcaacgccuucacagccgggaaaaucaucuucgccgcagucccacccaacuuccccaccgaaggccuaucccccucccagguuacuauguucccccacaucauagucgacgugcgccaacucgaacccguccucauaccccuccccgacguucgaaacaacuucuaccacuacaaccaaucaaacgaccccaccauaaaacucaucgccaugcucuacacaccccuccgagccaacaacgccggcgacgacgucuuuaccguauccugucgaguuuuaacacgccccuccccugacuucgacuucaucuuccucguaccaccaaccgucgaaucgcgaaccaagcccuucucuguccccguccuuaccgucgaagaaaugaccaacucccgcuuccccauaccccucgaaaaacucuucaccggacccucaagcgccuucgugguacaaccccaaaacggccgcugcaccaccgacggcguacuacucggcaccacacaacucuccccggucaacauaugcaccuuccgcggggacgucacccacauacccggcucccgcaacuacaccaugaaccuagcaucccaaaacuggaacucauacgaccccaccgaagaaauacccgcuccacuaggaacccccgacuucgucggcaaaauucaaggaguacucacacaaaccacaagagcaaacggauccacccgcggacauaaagcaacagucuacacaggauccgccgacuucagccccaaacuaggacgaguccaauucgccacagacaccgacaacgacuucgaaaccaaucaaaacaccaaauucacccccgucggcgucauacaagacggcuccacgaccccacgaaacgaaccccaacaauggguccucccaucauacuccgggcgcaacauccacaacguacaccuagcccccgcagucgcccccaccuucccaggcgaacaacuccucuucuuccgcuccaccaugcccggcugcuccggauacccaaacauggaucucgacugccuccucccacaagaauggguccaauacuucuaccaagaagccgcccccgcucaauccgacguagcacuucuccgauuuguaaacccagacaccggccgcguacuguucgaaugcaaacuccacaaaucaggcuacguaacagucgcucacacaggacaacaugaccucguaauacccccaaacggcuacuuccgauucgacagcuggguaaaccaauucuacacucucgcccccaugggaaacggcacgggccgccgacguuaa

SEQ ID NO: 38791 - RNA, 1617 nt, Artificial Sequence
  derived and/or modified sequence opt11 from VP1__Norovirus_and/or_Norovirus-like__JQ613545
augaaaauggccucaucagacgccaaccccucugacggaucuacagccaaccucguucccgaaguuaacaacgaagucauggcccucgaacccgucgucggagccgccaucgccgcccccgucgccggacaacaaaacgucaucgacccguggauccgcaacaacuucguacaagccccaggcggagaguucaccguauccccaagaaacgcccccggcgaaauccucugguccgcaccccucggccccgaccuaaaccccuaccuaucacaccucgcucgcauguacaacggcuacgccgguggauucgaaguccaagucauccucgcaggcaaugccuucaccgccggcaaaaucauuuucgcagccguaccucccaacuuccccacagaaggacuaagccccucgcaagucacaauguucccccacaucaucgucgauguccgacaacucgaacccguacucaucccccugcccgacguccgcaacaauuucuaucauuacaaccaaucaaacgaccccaccaucaaacucaucgcaaugcucuacaccccacuacgcgcaaacaacgccggcgacgacgucuucacagucagcugucgcguucucacccgccccucccccgacuuugacuucauauuccucguaccacccaccgucgaaucacgaaccaaacccuucagcguccccguccucaccguagaagaaaugaccaacucacgcuucccgaucccccucgaaaaacuauucaccggccccucauccgccuucguuguccaaccacaaaacggccgaugcacaacagauggcguccuccuagguaccacacaacucucacccguaaacaucugcaccuuccgaggcgacgucacccacauccccggcagccgcaauuacacaaugaaccucgccucccaaaacuggaacaacuacgacccaaccgaagaaauccccgccccacucggcaccccagacuucgucggcaaaauccaaggcguucuaacccaaacaacgcgcacuaacggauccacccgaggccacaaagccaccguauacaccggaagcgcagacuucuccccuaaauuaggccgcguccaauucgcuaccgacaccgacaacgacuucgaaacaaaccaaaacaccaaauucacccccgugggcgucauccaagacggauccacaaccccacgcaacgaaccacaacaauggguacuccccagcuacucaggccgcaauauacacaacguucaccuugcacccgcaguagcaccaacauuccccggcgaacaacuacuauucuuccgcuccacaaugcccggaugcuccgguuaccccaauauggaccuagacugccuacuaccacaagaauggguccaauacuucuaccaagaagccgccccagcacaauccgacguagccuuacuccguuuugucaaccccgauacgggccgaguacucuucgaaugcaaacuccacaaauccggguacgucaccguagcacacacaggccaacacgaccucguuauacccccaaacggcuacuuccgauucgacagcugggucaaccaauucuauacccuugcacccaugggcaacggcacgggacgccgacgauaa

SEQ ID NO: 38792 - RNA, 1617 nt, Artificial Sequence
  derived and/or modified sequence opt11 from VP1__Norovirus_and/or_Norovirus-like__AB541288
augaaaauggccuccaacgacgcaaaccccucagacggcucagccgccaaucucgucccugaagucaauaacgaagucauggcccuugaaccagucgucggagcugccaucgccgcccccgucgccggccaacagaacgucaucgaccccuggauccgcaacaacuucguccaagcucccggcggcgaguucaccgucuccccacgcaacgcacccggagaaaucccauggucagcaccacucggcccagacuuaaaccccuaccucucacaccuagcccgcauguacaacggauacgcuggcggcuucgaagugcaagucguacucgccggcaacgcauucaccgccggaaaagucaucuucgccgccgucccacccaacuuccccaccgaaggucuuucccccucccaagucaccauguucccccacaucaucgucgacguccgccagcuagaacccguacuaaucccccuccccgacguccgaaauaacuucuaccacuauaaccaauccaacgacucaaccaucaaacucauagccaugcuuuacacaccacuacgagccaacaacgcaggcgaagacgucuucaccguauccugcagaguucuuacacgccccucacccgacuucgacuucaucuuccuaguacccccaacagucgagucccgaaccaaacccuucaccgucccaauccuaaccgucgaagaaaugacaaacucacgauucccaaucccacuagaaaaacuauucacaggcccaagcggcgccuucgucguccaaccacaaaauggccgcugcacaacagacggcguccuauuaggaacgacccaacucuccccagucaacaucugcaccuucagaggagacgucacccauaucgccggaucacgcaauuacacaaugaaucuagcaucacucaacuggaacaacuacgaccccacagaagaaauccccgcaccccuaggcacccccgacuucgucggcaaaauacaaggagucuuaacacaaaccaccaaaggcgacggcucaacacgcggccacaaagccaccgucuacacaggcagcacccccuucacccccaaacuaggaagcguacaauucagcaccgauacagaaaacgacuucgaaaaccaccaaaacacaaaauucaccccagucggcguaauccaagacggcggcacaacccacagaaacgagccacaacaauggguacuccccuccuacucaggcagaaacguccaaaauguccaccucgcccccgcaguagcccccacauucccaggcgaacaacuccuauucuuccgaagcaccaugcccggcugcucagguuaccccaacauggaccucgacugccuccucccacaagaauggguucaacauuucuaucaagaggcagccccagcccaaagcgacgucgcacuacuacgauuugucaacccugacaccggccgcguacucuucgaaugcaaacuacacaaauccggcuacguaaccgucgcccacaccggacaacacgaccucgucauacccccuaacggguacuuccgcuucgacagcuggguaaaccaguucuacacacuagcucccaugggcaacggaacaggccgccgucgauaa

SEQ ID NO: 38793 - RNA, 1617 nt, Artificial Sequence
  derived and/or modified sequence opt11 from VP1__Norovirus_and/or_Norovirus-like__AB541247
augaaaauggcaucaaacgacgccaaccgcuccgacggcucugccgccaaccuuguacccgaagucaacaacgaagucauggcccucgaacccgucgucggcgcagcuaucgccgcccccgucgcuggccaacaaaacguaaucgaccccuggauacgcaacaacuucguccaagcaccaggcggcgaguucaccgucucuccccgcaacgcccccggagaaauccucuggagcgcuccccuaggccccgaccucaaccccuaccuaucccacuuagcccguauguacaacggcuacgccgguggguucgaaguccaagucauccuagccggaaacgccuucacagccgguaaaaucaucuuugccgccguucccccaaauuuccccaccgaaggacucucccccucacaagucaccauguucccacacaucaucguugacguacgacaacuagaaccaguucuaaucccccucccagacguccgaaacaacuucuaccacuacaaccaguccaacgacuccacaaucaaacucaucgcaaugcuuuacacaccccucagggcaaacaaugcaggagaagacgucuucaccguaucuugccgaguccuaacccgccccucccccgauuuugacuucaucuuccuagucccacccaccguugaaucccgaacaaaacccuucaccguccccauccucacggucgaagaaaugaccaacucucgcuuccccauaccccuagaaaaacucuucaccggacccuccucagccuucgucguacaaccccaaaacggccguugcaccaccgacggaguacuccucggcacaacacaacuaucacccgucaacauauguacguuccgaggugacguaacccacaucgcuggaucccgaaacuacaccaugaaccuugccagccuaaacuggaacaacuacgaccccacugaagaaauccccgccccucuagguacccccgacuucgucgguaaaauccaaggcguccucacucagaccaccaaaggagacggcuccacccgaggucacaaagccacagucuacaccggauccgcacccuuuacccccaaacucggcagcguacaguucuccaccgacacagaaaacgacuucgaaacccaccaaaacaccaaauucacccccgucggcgucauccaagacggaucuaccacccaccguuccgaaccccaacaaugggugcuacccuccuacucaggacgcaacguccccaauguccaccucgcucccgccguggcaccaaccuuccccggagaacaacuccuauucuuucgcucaacaaugccaggcugcuccggcuaccccaacauggaccucgacugucuacucccccaagaauggguccaacacuucuaccaagaagccgcccccgcacaaucagacguagcccuccucagauucguaaacccagauaccggccgaguccuauucgaaugcaaacuccauaaauccggauacgucaccguagcccacaccggccaacacgaucucgucauuccacccaacggcuauuuccguuuugauucauggguuaaccaauucuacacccuagcccccauggggaacggaacaggccgccgacgcuaa

SEQ ID NO: 38794 - RNA, 1617 nt, Artificial Sequence
  derived and/or modified sequence opt11 from VP1__Norovirus_and/or_Norovirus-like__EU839585
augaaaauggccagcaaugacgccaaccccuccgacggcuccaccgccaaccuuguccccgaagucaacaaugaagucauggcccuugaacccguagucggagccgcuauagccgccccugucgcuggccagcaaaacguaaucgacccuuggauacgcaacaacuucguccaagcacccggcggagaguucacagucucaccccgcaacgccccuggagaaauccugugguccgccccacucggccccgaccucaaccccuaccucucacaccuggcccgaauguacaacggguacgcaggcggcuucgaaguacaggucauccucgcaggcaacgccuucacagccggcaaaaucaucuuugcagccgucccgcccaacuuccccacagaaggccuaucucccucccaagucacaauguucccccacaucaucgucgacguccgacaacuagaacccguacucaucccccuacccgacguccgaaacaacuucuaccacuacaaccaauccaacgacuccacuaucaaacugaucgcaaugcuguacacaccacuacgcgcgaacaacgccggcgacgaugucuucacagucucuugccgcguccucacucgcccaucacccgacuucgacuucaucuuccucgucccacccaccgucgaaucacggacuaaacccuucaccguuccuauccuuaccguagaagaaaugaccaacucccgauucccaaucccacucgaaaaacuauucacaggccccuccuccgcauucguaguccaaccccagaacggccguugcacaacugauggaguccuccucgguaccacgcaacucucacccguaaacauauguacauuucgaggcgacgucacccacaucccagguacccgcaccuaccguaugaaccuagccucccaaaacuggaacaacuaugacccaacagaagaaaucccugcaccacucggcacccccgacuucgucggcaaaauacaaggcaugcucccacaaacaaccaaaggcgacgguucgacaagaggccacaaggccaccgucuccaccggcucaguagacuucacacccaaacuaggcuccguacaauucgccaccgauaccgacaacgacuucgaaacgggccaaaacaccagauuuacccccguaggcgucauacaagacggcuccucaacccaccgcaacgaaccccaacaauggguacuccccgacuacuccggccgcaccgucuacaacguccaccuagccccagcugucgccccaaccuucccaggcgaacaacuccucuucuuccgcucaaccaugcccgguugcucaggcuaccccaacauggaccucgacugccuccucccucaagaauggguccaacacuucuaccaagaagccgccccaucacaauccgacgucgcacuccuacgauuuguaaaccccgacaccggacgcguccuauucgaaugcaaacuucacaaagccggauacguaaccguagcgcacacaggccaacacgaccucgucauaccucccaacggauacuuccgauucgacaguugggucaaucaauucuacacacucgcacccaugggaaacggcgccggcaggcgacgauaa

SEQ ID NO: 38795 - RNA, 1617 nt, Artificial Sequence
  derived and/or modified sequence opt11 from VP1__Norovirus_and/or_Norovirus-like__AY588021
augaaaauggccuccaacgacgccaaucccuccgauggcagcacagccaaccuaguccccgaggucaacaaugaaguaauggcccucgaacccgucgucggcgcagcaauugccgcacccgucgccggacaacaaaacgucauagaccccuggaucagaaacaacuucguccaagcccccggcggugaguucacugucucaccccgcaacgccccaggcgaaauccucugguccgcaccccucggacccgaccucaacccauaccucucacaccucgcccgcauguauaacggguacgccggaggcuucgaaguccaagucauccucgcggguaacgccuucacugccggcaaaaucauauucgcagcagugcccccaaacuuucccacagaaggccucucacccucucaagucaccauguucccccacaucauagucgacguacgccagcuagaacccguacuaauaccccucccugacguucgcaacaacuucuaccacuacaaccaauccaacgaccccaccauaaagcugaucgccaugcucuacaccccacuacgcgcaaacaacgccggcgaagauguauucacggucucuugccgcguacuaacacgccccuccccugacuucgacuucauauuccuagugcccccaaccgucgaaucacggacuaaacccuuuacaguccccauccucacggucgaagaaaugacaaacagccgauucccuaucccccucgaaaaacucuucacaggccccuccggcgcauuuguaguacaaccacaaaacggccgcugcaccaccgacggaguacuacuaggaaccacacaacucagcccagugaacaucugcacauuccgaggagacgucacccacaucgccggaacacacaacuauacuaugaaccucgcaucccaaaacuggaacaacuacgaucccaccgaagaaaucccagccccacuaggaacaccugacuuuguaggccguauccaaggaaugcuaacucaaaccacacguggcgacggcucaacaagaggccacaaagccacagucucgaccggugauguccacuucacccccaaacuaggauccauccaguucaacaccgacacaaacaacgacuucgaaaccggucaaaacacacgauucacccccgucggcgugguccaagacggcaacggcacccaccaaaacgaaccccaacaauggguacugcccuccuacuccggccgcaccggccacaacguccaccucgcccccgcugucgcccccaccuuccccggcgaacaacuccuauucuuccgaucaaccacaccaggaugcucuggauaccccaacaugaaccucgacugccuccuaccccaagaauggguccaacacuucuaccaagaagcagccccagcucaauccgacgucgcucuccuccgcuucgucaaccccgauaccggccgaguacuauucgaaugcaagcuacauaaaucgggcuacguaaccgucgcacacaccggacaacacgaccucguuaucccacccaacggcuacuuucgcuucgauagcugggucaaccaauucuacacccucgcaccgaugggcaacggcacuggacgccgccgcuga

SEQ ID NO: 38796 - RNA, 1617 nt, Artificial Sequence
  derived and/or modified sequence opt11 from VP1__Norovirus_and/or_Norovirus-like__KX514188
augaaaauggccuccaacgacgccaacccauccgacgguuccgcggccaaccuaguaccagaaguaaacaacgaaguaauggcacucgaacccgucgucggcgcagccauagccgcccccguugcgggccaacagaacgucauagaccccuggauccgaaacaacuucguccaagcaccaggcggagaguucacugucucaccccgaaacgccccuggagaaauccucugguccgcuccccuaggccccgaccuuaaccccuaccuuucccaccucgccagaauguacaacggauacgccggcggcuucgaaguccaagucauacucgcaggcaacgcauucaccgcaggaaaaaucaucuucgccgccgucccgcccacauuccccaccgaaggccucuccccaucccaagucacaauguucccccauaucaucguagacguucgccaauuagaacccguccucaucccccucccagacguccgcaacaacuucuaccacuacaaccaauccaacgacuccaccaucaaacucaucgccaugcucuacacaccccuccgcgccaacaaccccggcgacgacgucuucaccguauccugccgaguccuaacccggccaucccccgacuucgacuucauauuccucgucccacccaccgucgaaucccgaaccaagcccuucuccguccccauccuaaccgucggcgaaaugacaaacuccagauuccccaucaaucuggacaaacucuucaccggacccagcuccgccaacguaguccaaccccaaaacggcagaugcaccauagacggagaacuacucggaaccacccaguuguccccuguaaacaucugcaccuuccgcggcgacgucacacacccccgcgacagccaaauauacacaaugaaccuagccucccccaacuggaacaacuacgaccccaccgaagaaaucccugcuccccuaggcacacccgacuucgucggcaaaauccaaggcaugcuuacucaaaccaccaaaggagaaggcucgacccgcggccaccgagccaccgucuacguaggauccgcaaauuacgcacccaagcucggacgcguccaguucgaaaccgacacaacaaacgaccuagacgcccaccaaaacacaaaauucacccccgucggcgucguucaaggcggcgaaucaccaaaaggcagcgaaccacagcaauggguccucccauccuacuccgggcgcgacacccccaacguccaccucgcacccgcaguugcaccuaccuucccaggugaacaauuauuauucuuccgaucaaccauccccggaugcgggggccaccccaacaugaaccucgacugccugcuaccucaagaguggguacaacacuucuaccaagaagcugcccccgcccaaucagacgucgccuuacuacgcuucguuaacccagacaccagcaggguacucuucgaaugcaaacuacacaaaucaggauacguaaccgucgcacacaccggccaacacgacuuaguaaucccuccaaauggauacuuccgauuugacuccugggucaaccaauuuuacacacuagcuccaaugggcaacggcacaggacgaaaacgauga

SEQ ID NO: 38797 - RNA, 1617 nt, Artificial Sequence
  derived and/or modified sequence opt11 from VP1__Norovirus_and/or_Norovirus-like__KX354101
augaaaauggccagcucggacgccaaccccucugacggcuccgcagccaaccucguccccgaagucaacaacgaagucauggcccucgaacccgugguuggcgccgccaucgccgccccaguagccggccagcagaacgucaucgaccccuggauccgcaacaacuucguacaggcacccggaggagaauuuaccguuucuccccgcaaugccccgggcgaaauacuauggucagcaccucucggccccgaccucaaccccuaucucucucaccucgcacgcauguacaacggcuacgcuggcggcuucgaaguacaagucauccuagccggcaacgccuucaccgccggaaaagucaucuucgccgcagucccucccaacuuccccacagaggggcuaucccccucccaagucaccauguucccccauaucgucgucgacguccgacaacucgaacccguccucauaccccuccccgacgugcgaaacaacuucuaccacuacaaccaauccaacgaccccacaaucaagcucaucgcaaugcuuuacacuccccuccgcgcaaauaacgccggcgacgacgucuucaccgucucuugucgcguccuuacccgccccucacccgauuucgacuucauuuuccuagucccacccacuguugaaucucgcaccaaacccuucucuguccccguccucaccguagaagaaaugaccaacuccagauucccuaucccacuggaaaaacuuuucaccggccccuccuccgccuucgucguccaaccccaaaacggucgcuguaccaccgacggcguacuacucggaacuacccaacuauccccaguuaacaucugcaccuuccgcggcgauguuacccacauuaccggcucucgaaacuacaccaugaaccuagccucccaaaacuggaacaacuacgauccaacugaagaaaccccagccccucuaggcaccccugacuucgucggcaaaauacaaggcguccuuacccaaaccacacgcaccgacgguuccacccgaggacacaaagcaacagucuacaccggcuccgcagacuuugcccccaaacuaggccgaguccaauucgaaaccgacaccgaccgcgacuucgaagcaaaccaaaacacaaaauucaccccugucggcguaauccaagacggcggaaccacccaccguaacgaaccccaacaauggguccuccccuccuacuccggccguaacacacacaacguacaucucgcaccagccgucgcacccacauuccccggcgaacagcuccuauucuuccgcuccacaaugcccggcugcucuggcuaccccaauauggaccuagauugucuacucccucaggaauggguacaauacuucuaccaagaagccgcccccgcccaaagcgacguagcccuccuccgcuucguaaaccccgacacuggccgcguccuuuucgaaugcaaacuacacaaauccggcuacgucaccguagcccacaccggucaacacgacuuagucauucccccaaacggcuacuuccgcuucgacuccugggucaaccaauuuuacacccucgcccccaugggaaacggcaccggucgccgccgguaa

SEQ ID NO: 38798 - RNA, 1617 nt, Artificial Sequence
  derived and/or modified sequence opt11 from VP1__Norovirus_and/or_Norovirus-like__KX354023
augaaaauggccagcucagacgccaaccccuccgacggcucagccgcaaaccuaguccccgaagucaauaacgaagucauggcacucgaaccagucgucggagcagcaauagcagcccccguagcaggacaacaaaacguaauagacccauggauccgaaacaacuucguacaagcccccggaggagaguucaccgucagcccccgcaacgccccaggugaaauacucugguccgcaccuuugggccccgaccuaaacccauaccucucccaccucgcccgaauguacaacggauacgcaggcggauuugaaguacaaguaauccucgcaggcaacgccuucacagccggcaaagucaucuucgccgccgucccacccaacuucccaacagaaggccuauccccaucccaagucaccauguucccccacaucguaguagacguccgccaacuagaacccguccuuauaccccuucccgacguccguaacaacuucuaccacuacaaccaauccaacgaccccaccauaaaacucaucgcaaugcucuacacaccccuccgcgccaacaacgccggagacgacgucuucaccguguccugucgcguccucacacgacccucacccgacuuugacuucaucuuccucgucccacccaccgucgaaucccgcaccaaacccuucucuguccccguacucacagucgaagaaaugacaaacucaagauuccccaucccacucgaaaagcuguucaccggaccgucguccgccuucgucguccaaccccaaaacggccgcuguacaacugacggaguccuccucgguacaacccaacucucaccugucaacaucugcaccuuccgcggagacgucacccacaucaccggauccagaaacuacaccaugaaccucgcaagccaaaacuggaacaacuaugaccccaccgaagaaauccccgcaccccucggcacccccgacuucguugguaaaauccaaggcaugcucacccaaaccacccgcgccgacggcuccacucgcggucacaaagccaccguauacacaggcuccgccgacuucgccccaaaacucggccgcguacaauucgaaaccgacacagaccaugacuucgaagcgaaccaaaacaccaaauucacacccgucggcgucauccaagacggguccacaacacaccgcaacgaaccacaacaauggguacuacccucauauuccggaagaaacacccacaauguccacuuagccccacccguugcucccacauuccccggcgaacaacuucucuucuuccgcuccacaaugcccggcugcuccggcuaccccaauauggaccuagacugccuccuaccacaggaauggguccaguacuucuaucaagaagccgcuccagcccagucagacguagcccuccuucgcuucgucaaccccgacaccggacgcguucucuucgaaugcaaacuacacaaaagcggcuacgucaccgucgcccacaccggccaacacgaccucgucaucccacccaacgguuacuuccgguucgacuccugggucaaucaauucuacaccuuagccccaaugggcaacggcacaggccgacgcagauaa

SEQ ID NO: 38799 - RNA, 1617 nt, Artificial Sequence
  derived and/or modified sequence opt11 from VP1__Norovirus_and/or_Norovirus-like__KX353979
augaaaauggccuccucggacgccaacccaucagacggcucaacagccaaccuaguccccgagguuaacaacgaagucauggcccucgagccaguugucggcgccgcuaucgccgccccugucgcaggccaacaaaacgucaucgaccccuggauuagaaacaacuucguccaagcacccggcggagaguucacaguauccccacgaaacgcuccaggcgaaauccucugguccgccccacucggacccgaccuaaacccauaucuaucccaccuagcccguauguacaacgguuacgcaggcggcuucgaaguacaaguuauacucgccggaaacgcauucaccgcaggcaaaauuauauucgccgcugucccucccaacuuccccacagaaggccucagccccucccaaguuaccauguucccccacaugaucguagacguacgacaacucgaacccguccuaauaccccuccccgacguaagaaauaacuucuaucacuacaaucaaagcaacgaccccaccaucaaacucaucgcaaugcucuacacaccccuccgcgccaacaaugccggcgacgacguauucaccguaucaugccgcguccucacccgcccaucccccgauuuugacuucaucuuucucguuccaccaaccguagaaucccgcacuaaacccuucuccguccccguccucaccguugaagaaaugacaaacucccgauuccccaucccccucgaaaaacucuucaccggccccuccuccgccuucgucguccaaccgcaaaacggccgaugcaccaccgacggaguccuccucggcaccacccaacucucccccgucaacaucugcaccuuccggggcgacguaacccacauaagcggcucccgcaacuacaccaugaaccucgccucccaaaacuggaacuccuacgaccccaccgaagaaaucccagcuccccucggcacaccggacuucgucggcaagauccaaggcguacuaacacaaaccacaagaacgaacggcucaacccgcggucacaaagccaccgucuacaccggcuccgcagacuucucgcccaaacucggccguguccaauucgccaccgauaccgacaacgacuucgaaacaaaccaaaacacaaaauucacaccugucggcgucauccaggacgguagcacaacaccccgaaacgaaccccaacaauggguccuccccuccuacucaggccgcaacauccacaacguccaccuagcacccgcugucgcacccaccuucccaggagaacaacuccuauuuuuccgcuccaccaugcccggcugcuccggauaccccaacauggaccuagacugccuccucccucaagaauggguucaauacuucuaccaagaagcagcccccgcccaaagcgacguagcucuacuccgcuucgucaacccagacacaggcagaguccucuucgaaugcaaacuccacaaaucaggauauguuacagucgcccacaccggccaacacgaccuagucaucccacccaacggcuacuuccgcuucgacucauggguaaaccaauucuacacacucgcuccaaugggaaauggcacgggaagacgcagauaa

SEQ ID NO: 38800 - RNA, 1617 nt, Artificial Sequence
  derived and/or modified sequence opt11 from VP1__Norovirus_and/or_Norovirus-like__AB972491
augaaaauggccucauccgacgccaauccaagcgacggcuccgcagcaaaccucguccccgaagucaacaaugaagucauggcacucgaacccgucgucggagcagccauagcagcccccguagccggccagcagaacguaauagacccauggauccguaacaacuucguccaagcacccggcggcgaauuuaccgucucccccagaaacgccccgggcgaaaucuuaugguccgcaccccucgggcccgaccucaaccccuaccuaucucaccucgcccgcauguacaacggauaugccggcggauucgaaguacaagucauucuggccggaaacgccuucaccgccggcaaaguaaucuucgccgccgucccuccuaacuucccaaccgaaggccucucccccucccaaguuaccauguucccccacauuguaguagacguccgucaacucgaaccuguccucauaccacuccccgacguccgaaacaacuucuaccacuacaaccaaucaaacgaucccacaauaaaauuaaucgcaaugcucuacacaccccuaagagcaaacaacgccggagacgacgucuucacagucuccugccgaguccucaccagacccucccccgacuucgacuucaucuuccuaguacccccaaccgucgaaucucgcaccaaaccauucagcguccccguccucaccguagaagaaaugaccaacucccgauuucccauaccacuagaaaaacuauucaccggaccuuccagcgccuucguaguccaaccccaaaauggccgcugcaccaccgacggcguccuacuaggcaccacccaacucucaccugucaacaucugcacuuuccgaggcgacgucauccacauuaccggcucccgcaacuauacaaugaaccucgcaucacagaacugguccaacuacgacccaacagaagaaauacccgcaccacucggcacaccagacuucgucggaaaaauucaaggcguacuaacccaaaccacacgcacagauggcuccacccgcggacacaaagccaccguauacacuggcucagccgacuucgcuccaaaacucggucgcguccaauucgaaacagacacagaccacgacuucgaagccaaucaaaacaccaaauucaccccuguaggcgucauccaagacggaagcacaacccaccgcaacgaaccccaacaauggguacucccaagcuacuccggacgcaacaccccaaacguacaccucgcaccagccguagcacccaccuucccaggcgaacaacuccucuucuuccgcuccacuaugcccggaugcucaggcuaucccaacauggaccucgacugccuacucccacaagaauggguccaauacuucuaccaagaagccgcgcccgcccagucagaugucgcccuacuacgcuucguuaaccccgacacaggucgcguacucuucgaaugcaaacuccacaaaucgggcuacgucacagucgcccacacaggccaacacgaccucguaaucccacccaacggcuacuuccgauucgacuccugggucaaccaauucuacacccucgccccuaugggcaacggcaccggacggcgucgcuaa

SEQ ID NO: 38801 - RNA, 1617 nt, Artificial Sequence
  derived and/or modified sequence opt11 from VP1__Norovirus_and/or_Norovirus-like__AB972469
augaaaauggcuuccucagacgcaaaccccagcgauggauccgcagcuaaccuuguccccgaaguuaacaacgaagucauggccuuagaacccguggucggggcugcuaucgccgcccccgucgcaggccaacaaaaugucaucgaccccuggauccgaaacaacuucguccaagccccuggaggcgaguucaccguaucaccccgcaacgcacccggcgaaauccuuugguccgcuccccucggccccgaccuaaaucccuaccucucccaccuugcccggauguacaacggcuacgccggaggcuucgaaguacaggucauccucgccggcaacgccuucaccgcaggcaaagucaucuucgccgccguaccacccaauuuccccaccgaaggacuuucacccucccaagucaccauguucccccacaucguugucgacguucgccaacuagaacccguccucauaccccucccagacguacgaaacaacuucuaucacuacaaccagucaaacgacccuacaauaaaacuuauugccaugcucuacaccccacuucgcgccaacaacgcaggcgacgacgucuucaccguauccugccgcguccucaccagacccucaccagacuuugacuucaucuuccucguuccacccaccgucgaaucucgaacaaaacccuuuucaguacccguccucaccguagaagaaaugaccaacucccguuuccccaucccccuugaaaaacucuucaccggaccuucaagcgccuucgucguccaaccccaaaacggacguugcaccacagacggcguccuccucgguaccacccaacucucccccguaaacaucugcacccucagaggcgacgucacccacaucacgggaucacgaaacuacacaaugaaccucgccucucagaacugguccaacuacgaccccacagaagaaauccccgcaccccuuggaaccccagacuucguuggcaaaauccaagggguccuaacacaaaccacccgaaccgacggcuccacccgaggucauaaagccaccgucuacacaggcuccgccgacuucgcaccaaaacucggacggguccaguucgaaaccgacaccgaccgagacuucgaagcuaaccaaaacaccaaauucacccccgucggagucauccaagacggcagcacuacccacagaaacgaaccacaacaauggguauuacccuccuauucaggacgcaacacaccaaacguccaccucgcccccgccgucgcucccacuuuccccggcgaacaacuccucuucuuuagaucaacaaugcccggcugcuccgguuaccccaacauggaccuagacugccuacucccacaagaauggguucaauacuucuaccaagaggccgccccugcccaaucagacgucgcccuccuacgguucgucaaccccgacaccggccgaguccucuucgaaugcaaacuccacaaauccgguuacgucaccgucgcccacaccggccaacacgaccuagucaucccacccaacggcuacuuccgauucgacuccugggucaaccaauuuuacacccuagcccccaugggaaacggcaccggccgaagacgcuaa

SEQ ID NO: 38802 - RNA, 1617 nt, Artificial Sequence
  derived and/or modified sequence opt11 from VP1__Norovirus_and/or_Norovirus-like__LC101819
augaagauggccucuaacgacgacaaccccuccgacggcucagccgcaaaccucgucccagaagucaacaacgaagucauggcccuagaaccagucgucggcgccgccauagccgcaccagucgccggccaacaaaacguaaucgacccauggauccgcaauaacuucguucaagcucccggaggcgaguucaccgucucaccccgaaacgcuccaggugaaauccucugguccgccccacucggaccagaccucaaccccuaccuaucccaucucgcccgcauguacaacggcuacgcuggaggauucgaaguccaagucauccucgccggaaaugcguucaccgcaggaaaaguuauauucgccgccguaccacccaacuuccccaccgaaggccuauccccuagccaggucaccauguucccccacaucgucgucgacguccgccaacuggaacccguucuuauuccccuccccgacguccgcaacaacuucuaccacuacaaccaaucuaacgaccccaccauaaaacucaucgcaaugcuauacacaccccuucgcgccaacaaugcaggcgacgacguauucaccgucuccugccgcguccucacacgaccaucacccgacuucgacuucaucuuccucgucccacccaccgucgaaucccgcaccaagcccuucuccguacccgucuuaacagucgaagaaaugaccaacucccgcuuccccauaccccucgaaaaacucuucaccgguccuuccuccgccuucguaguccaaccccaaaacggcagaugcacuaccgacggaguacuacucggcaccacacaacucucccccguaaacaucugcaccuuccgcggcgaugucacccauaucaccggcucacgaaacuauacuaugaaccuagcaucccaaaacuggaacaacuacgaccccaccgaagaaauccccgcaccccuuggcacccccgacuucgucggaaagauccaaggcguccuaacacaaaccacucguaccgacggcuccacccggggacacaaagccaccgucuacaccgguucagccgacuucgcaccaaaacucggccgaguacaauucgaaaccgacacagaccacgacuucgaagccaaccaaaacaccaaauuuacccccgugggcgucauccaagacgguggcacaacacacagaaacgaaccucaacaauggguauuacccagcuacuccggccgggauacacauaacguccaccucgcccccgccgucgcccccaccuuuccgggcgaacaacuccuuuucuuccgaucaacaaugcccggcugcuccggauacccaaacauggaccucgacugccuccuaccacaagaauggguccaauacuucuaccaagaagcugccccagcccaaagugacguagcacuccuacgauucgucaacccugacaccggccgcguccuauucgaaugcaaacuccauaaaucaggauacgucaccgucgcacacacuggccaacacgaccucgucauaccacccaacggauacuuccgauucgacuccugggucaacaaauucuacacccuagcccccaugggaaacggaaccggcagacgacgcuaa

SEQ ID NO: 38803 - RNA, 1617 nt, Artificial Sequence
  derived and/or modified sequence opt11 from VP1__Norovirus_and/or_Norovirus-like__KT202795
augaaaauggcuuccuccgacgcgaacccauccgacgguucagcagccaacuuaguacccgaagucaauaacgaagucauggcccucgagccaguagucggagcagcaaucgccgcccccgucgcaggccaacaaaacgucauugaccccuggauccgcaacaacuucguccaagccccaggcggcgaguucaccgucucaccacgcaacgcacccggcgaaauccucugguccgcuccccuaggcccagaucucaauccauaccuaucccaccuugcccgcauguacaacggcuacgccggcggcuuugaaguccaaguuauccuagcaggaaacgccuucacagccggcaaagucauuuucgcagccguaccgcccaauuuucccaccgaaggccucucccccucccaaguaaccauguucccccacauaguagucgacguccgccaacuggaacccguccuaaucccccuccccgacguccgcaauaacuucuaccacuacaaccaaucaaacgaccccaccauuaaacucaucgccaugcuguacacuccccuccgcgcuaacaacgccggagacgaugucuucaccguaagcugccgcgucuuaaccagaccgucccccgacuucgacuucaucuuccuugugccacccaccguagagucucgcaccaaacccuucuccguacccguccucaccgucgaagaaaugacuaacagccguuuucccauaccacuagaaaaacuuuucaccggacccuccucagcauucguuguccaaccccaaaacggccgcugcaccaccgacgguguacuacucggaacaacccaacucuccccaguaaauaucugcacuuuccgaggcgacgucacccacaucaccgguucccgaaacuacacaaugaaccuugccucacaaaacugguccaacuacgaccccaccgaagaaauccccgcaccccucggcacucccgacuuuguaggcaagauccaaggcguccucacccaaaccacccgcacagacggcucuacccguggccacaaggccaccgucuacacaggcuccgccgacuucgccccaaaacucggucguguacaauucgaaacagacacagaccgcgacuucgaagcaaaccaaaauaccaaauucacccccgucggugucauacaagacggcggaaccacacaccgcaaugaaccacagcaauggguccuccccuccuacuccggccggaacauccccaauguacaccucgcccccgcagucgcccccaccuucccuggcgaacaacuucucuucuuccgauccaccaugccuggcugcucaggauacccuaacauggaccuugacugccuccucccucaagaauggguacaauacuucuaccaagaagccgcccccgcccaauccgacguggcacuccuccguuucgucaaccccgacaccggccgcguacuuuucgaaugcaaacuccacaaauccggcuacguaaccgucgcacacacaggacaacacgaucucguaaucccucccaacggcuacuucagauuugacuccugggucaaucaauucuacacccuugcacccaugggaaacggcaccggacgccgacgauaa

SEQ ID NO: 38804 - RNA, 1617 nt, Artificial Sequence
  derived and/or modified sequence opt11 from VP1__Norovirus_and/or_Norovirus-like__AB933742
augaaaauggccagcuccgaugcaaaccccucugacggcuccaccgcaaaccucgucccagaaguaaacaacgaaguaauggcccucgaaccaguagucggcgccgcuaucgccgcccccgucgccggccaacaaaacguaaucgaccccuggauccgaaacaauuucguucaagcaccaggaggagaauuuaccguauccccacgcaaugcucccggcgaaauccucuggagcgcaccccucgguccagaccuuaaccccuaccuaucucaccucgcccgcauguacaacggcuacgccgguggauucgaaguacaagucauacucgcaggaaacgccuucacugccggcaaaaucauauucgcagccgucccacccaacuuccccaccgaaggccuaucccccucccaaguaacgauguucccccacaucauagucgacguccgccaacucgaaccuguccucaucccccuccccgacguaagaaacaacuucuaccacuacaaucaauccaacgacccuaccauaaaacuaauagcaaugcucuacaccccucuacgagcaaacaaugccggugaugaugucuucacagucagcugccgcguccuaacccgaccaucccccgacuucgacuucaucuuccuaguaccacccacaguagaaucacgcaccaaacccuucagcguccccguccugacuguagaagaaaugacaaacucacgguuccccaucccccucgaaaaacuauucaccgggcccuccucagcauucguaguccaaccucaaaacggacguugcaccaccgacggcguacuccuuggcacaacccaacucucaccagucaacauaugcacauuccgcggcgacgucacccacauaccugguucacgcaauuacacaaugaaccucgccucacaaaacuggaacuccuacgauccaaccgaagaaauacccgcuccacuaggcacccccgacuucgucggaaaaauccagggaguucucacccaaaccacacgcacuaacggcucaacccgcggccacaaagccaccgucuacacaggauccgcagacuucucacccaaacuaggccgcguacaauucgccacggacaccgacaaugacuucgaaaccaaccaaaacaccaaauucacccccgucgguguuauccaagacggcuccaccacaccccgcaacgaaccccaacaauggguccucccuuccuacuccggacgcaacauccacaacguccaccuagcccccgccguggcccccaccuuccccggcgaacaacuacuauucuuccgaucaacuaugcccggaugcucaggcuaccccaacauggaccucgacugccuccucccucaagaauggguccaauacuucuaccaagaagccgccccagcccaaucagacgucgcacuccuucgcuucgucaaccccgacaccggccgcguccucuucgaaugcaaacuacauaaauccggcuacgucacagucgcacacacaggacaacacgaccugguaauaccacccaacggcuacuuucgauucgacuccuggauaaaccaauucuacacccucgcacccaugggcaacggaacaggccgacgccgauaa

SEQ ID NO: 38805 - RNA, 1617 nt, Artificial Sequence
  derived and/or modified sequence opt11 from VP1__Norovirus_and/or_Norovirus-like__AB933722
augaaaauggccucaucagaugcuaacccauccgacggauccgccgccaaccucguccccgaagucaauaacgaagucauggcccucgaacccgucgucggcgccgccaucgccgcccccgucgccggccaacaaaacguuaucgacccauggauacgcaauaacuucguacaagcccccggaggcgaauuuaccgucagcccccgcaacgccccaggcgaaauucucugguccgccccauuaggccccgaucuuaacccauacuuaagccaccuagcccgcauguacaauggcuacgcaggaggcuucgaaguccaagucauccucgccgguaacgcauucacagccggaaaaaucauauucgccgccguacccccuaacuuucccaccgaaggccucucacccucccaagucacaauguucccccacaucaucgucgacguccgccaacuagaacccguccugaucccccucccugacguccgcaacaacuucuaccacuacaaccaaucaaacgacucuaccauaaaacuaaucgcuaugcucuacacaccucuacgcgcaaacaacgccggcgaagacgucuucaccguuagcugcagaguacucaccagacccucccccgacuucgacuucauauuccuaguaccacccacggucgaaucccgggccaaacccuucaccguccccauccucaccguagaagaaaugaccaacucccgcuucccaaucccacuugaaaaacucuuuacagggcccucuuccgcauucgucguccagccacaaaacggacgcugcacaacagacggcguccuucuaggcacaacccaacuauccccuguuaacauuugcaccuuccgaggagaugucacccacaucgccggcagccgcaacuacaccaugaacuuagcuagccccaacuggaacaacuacgaccccacagaagagauccccgcaccccucgguaccccagacuucgugggcaaaauccaaggaaugcuaacccaaaccacaaaaggcgacggcucaacacgcggacacaaagcaacagucuacaccggcuccgcacccuucacgccaaaacuugggucuguccaauucuccacagacaccgaaaaugacuucgaaacccaccaaaacacaaaguucacuccuguaggaguaauacaagacggcuccaccacccaccgcaaugaaccccaacaauggguccucccaagcuacuccggccgcaacguccccaacguccaccuagcccccgccgucgcaccuaccuuccccggcgaacaacuauuauucuuccgcucuaccaugccuggcugcuccggcuaccccaacauggaccucgacugccuccucccacaggaauggguacaacacuucuaccaagaagccgcccccgcccaaucugacguugcccuacuccgauuuguuaaccccgacaccggcagaguacucuuugaaugcaaacuucacaaaucaggcuacgucaccgucgcccacaccggccaacacgaccuagucauaccacccaacggcuacuucagauuugauuccugggucaaccaauucuacacucucgcccccaugggcaacggcacgggucgccgccgauga

SEQ ID NO: 38806 - RNA, 1617 nt, Artificial Sequence
  derived and/or modified sequence opt11 from VP1__Norovirus_and/or_Norovirus-like__KJ678138
augaagauggcauccuccgacgccaaccccuccgacggcagcgccgccucacucguccccgaagucaacaacgaagucauggcccuagaaccggucgucggugccgcaaucgccgcacccguagccggccaacaaaacgucaucgaccccuggaucagaaacaacuucguccaagcccccggcggcgaguucacagucucaccccgcaaugcccccggcgaaauccuaugguccgcaccccuaggcccugaccucaaccccuaccuuucacaccucgccagaauguacaacggcuacgccggcggauucgaaguccaaguaauccucgcaggaaacgccuucacagcaggcaaagucaucuucgccgccgucccacccaacuuccccaccgaaggccugucaccuucccaaguuacaauguucccccacaucgucgucgacguaagacaacuagaacccguccuaaucccgcucccagacguacgaaauaacuucuaucacuacaaccaauccaacgaccccaccaucaaacucauagcuaugcucuacacuccccucagagcaaacaacgccggagacgacguauucaccguaucaugccgaguucucacacgacccucccccgacuucgacuucauuuuccugguaccacccaccgucgaaucccgcacaaaacccuuuucgguccccguccucaccgucgaagaaaugaccaacucccgcuuuccaaucccacucgaaaaacucuucacagggcccucuucggccuucguaguccaaccacagaacggccgaugcaccaccgacgguguacuccucggaacgacccaacuuagccccgucaacaucugcacauucagaggagacguuacacacauaaccgguuccagaaacuacacaaugaaccucgccucacaaaacuggagcaacuaugaccccaccgaagaaaucccagcaccucucggaacccccgacuucguaggcaaaauucaaggaguacuuacccaaacgaccagaacagacgguuccacccgaggccacaaagcaacagucuacauuggcuccgcggacuucgcgcccaaacucggacgcguacaauucgaaaccgacaccgaccaugacuucgaagccaaccaaaacacgaaauucaccccugucggcguaauccaagacgguuccacaacccaccgcaacgaaccucaacaauggguccuacccuccuacagcggccgcaacaccccaaacguacaccucgcacccgcaguugccccuacauuuccaggcgaacaacugcuauucuuccgcagcaccaugccuggcugcucaggauaccccaacauggaccuggacugccuccucccacaagaauggguccaauacuucuaccaagaagccgccccugcccagagugacgucgcucuccuacgcuucguaaaucccgacaccggccgcguccucuucgaaugcaaacuccacaaauccggauacguaacagucgcucacaccggccaacacgaccuagucaucccacccaacggauacuuccgcuucgacucauggguaaaccaauucuacacacucgcccccaugggcaacggcaccggccgacgacgauag

SEQ ID NO: 38807 - RNA, 1617 nt, Artificial Sequence
  derived and/or modified sequence opt11 from VP1__Norovirus_and/or_Norovirus-like__KP244317
augaaaauggcauccucagaugcaaaccccagcgacggcuccaccgccaaccuaguccccgaagucaacaacgaaguaauggcccuagaacccguaguaggggccgcaaucgccgcccccguagccggccaacaaaacguaauagacccauggauccgcucaaacuucguccaagcacccggaggggaauuuaccgucuccccacgcaacgccccaggagaaauacucugguccgcaccacucggcccugaucuaaaccccuaccuaucccaccucgcccgcauguacaacggcuacgcaggcgguuucgagguccaaguaauccucgccggcaacgccuucacagcuggaaaaaucaucuucgccgccgucccucccaacuucccaacagaaggucugucccccucucaaguaaccauguucccccauaucaucgucgaugucagacaacuagaacccguccucaucccccucccagacguccgcaacaacuucuaccacuacaaccaaucuaacgaccccacaaucaaacuaaucgcacgacuuuacacuccccuucgcgcaaacaacgccggagacgacguuuucaccgucucuugccguguacucacccgaccaucccccgacuucgauuucauauuccucguacccccaaccguugaaucacgaaccaaacccuuuuccguacccguccuuaccgucgaagagaugaccaacucacgcuucccaauaccccucgaaaaacucuucaccggacccagcuccgcuuucguaguucaaccccaaaacggccguugcacaaccgacggcguccuccucgguacaacccaacuaucacccgucaacaucugcaccuuccgcggcgacgucacccacaucuccggcucccgaaacuacaccaugaaccuagccucucaaaacuggaacucauacgaucccacagaggaaauccccgccccacucggaacacccgacuucgucggcaaaauccaaggcguucuaacccaaaccacaaaaacuaacggcuccacccgcggucacaaagccaccgucuacaccgguuccgccgacuucucacccaaacuuggccgcguacaauucgccacagacaccgacaacgauuucgaaaccaaccagaacacaaaguucacgcccgucggcgucauccaagacgguuccacuacuccccgcaaugaaccacaacaguggguacuccccuccuacucuggacgcaacacccacaacguccaccucgcacccgcugucgcccccaccuuuccaggcgaacagcuccucuucuuccgcuccaccaugcccggcugcagcggcuauccuaauauggaccuagacugccuccugccccaagaauggguccaauacuucuaucaggaagccgcacccgcccaauccgacgucgcccuacuccgcuucgucaacccugacaccggccguguccucuucgaaugcaaacuccauaaauccggcuacguaacagucgcucacacuggccaacacgaccuuguaaucccacccaacggcuacuuccgauucgacuccugggucaaccaauuucacacccucgcccccauggguaacggcaccggccgaagacgcuaa

SEQ ID NO: 38808 - RNA, 1617 nt, Artificial Sequence
  derived and/or modified sequence opt11 from VP1__Norovirus_and/or_Norovirus-like__KP698925
augaaaauggccucgucggacgccaaccccuccgacggcuccgccgccaaccucgucccugaaguuaacaacgaaguaauggcccuagaacccguagucggcgccgcuauagccgcccccgucgccggacaacaaaauguaaucgaccccuggauccguaauaacuucguccaagccccuggcggcgaguucacagucucuccccgcaaugcccccggcgaaauccucugguccgccccacucggacccgaccuaaaucccuaccucucccaccuagcccguauguacaacggcuacgccggcggcuuugaaguacaagucauccucgccggcaacgcauucaccgccggaaaaguaaucuucgccgccguacccccaaacuucccaacagaaggauuaucacccucccaagucaccauguuuccccacaucgucguagacguccgccaacuugaacccguucuaauaccacuucccgacguucgaaacaacuucuaccacuacaaucaaucaaacgaccccaccauaaaacucaucgcaaugcucuacacaccccuucgagccaacaaugccggagacgacgucuucaccguuucuugccgaguccuuacccgacccucacccgacuucgauuucauauuccuaguacccccaaccgucgaaucccgcacaaaaccguucucgguccccguccucaccgucgaagaaaugaccaauucacgauucccaaucccccucgaaaaacuauucacaggcccaagcagcgcauucgucguccaaccucaaaacggccgaugcaccaccgacggcguccuccucggcacaacccaacucuccccuguaaacauuuguaccuuccgaggcgacgucacccacaucacuggaucccgcaacuacaccaugaaccuagcaagccaaaacuggucaaacuacgaccccacggaagaaaucccagcaccccugggcacccccgacuucguaggcaaaauacaaggaguccuaacccaaacaacccguaccgacggcuccacacgaggccacaaagccacaguauacaccgggucugcugacuucgcccccaaacucggccgaguccaauucgaaaccgacaccgaccacgacuucgaaaccaaccaaaacacgaaauucacacccgucgguguaauccaggacggcucuaccacacaccgcaaugaaccucaacaauggguacuccccuccuacuccggccgcaacacccccaacguucaccuagccccagccguagccccgaccuuccccggagaacaacuccucuucuuccgaucaacaaugcccggaugcucgggcuaccccaacauggaccucgacugccuauuaccacaagaauggguacaauaccuauaccaagaagccgccccagcccaauccgacguggcccuacuacgauucguaaacccagacaccggccgcguccucuucgaaugcaaacuccacaagucuggauacguaaccguagcccacaccggccaacacgaccuagucauacccccaaacggauacuuccgcuuugacucaugggucaaccaauucuauacacuagccccaaugggcaacggaaccggccguagacgauga

SEQ ID NO: 38809 - RNA, 1617 nt, Artificial Sequence
  derived and/or modified sequence opt11 from VP1__Norovirus_and/or_Norovirus-like__LC005727
augaagauggcaucauccgaugccaaucccccugacggcuccgcagccaaccucguccccgaagucaacaacgaaguuauggcacucgaacccguagucggcgccgccaucgcagcacccgucgccggacaacaaaaugucaucgacccguggauccgcaacaacuuuguccaagcacccggcggcgaguucacaguaucaccucgaaacgccccuggcgaaauccucugguccgcuccucucggccccgaccuuaauccuuaccucucacaccuggccagaauguacaacggauacgccgguggguucgaaguccaggucauacuagcaggcaacgccuucaccgcaggcaaaguaaucuucgcagccguacccccaaacuuccccaccgaaggccucucgcccucacaagucaccauguucccccacaucgucgucgauguacgccaacucgaacccguccuaaucccccuccccgauguccgcaacaacuucuaccacuacaaccaauccaacgaccccaccaucaaacucaucgcgaugcuauacacaccacuacgcgcuaacaacgccggcgacgauguauucaccguauccugccgagucuuaacccgaccauccccagacuucgacuucauauuccucguacccccaacugucgaaucuagaacaaaacccuucuccguccccguccucaccguagaagagaugacaaacucccguuuccccaucccacucgaaaaacucuucacaggccccucuucagccuucgucguacaaccacaaaauggccgaugcacaaccgacggcguacuucucgguacaacccaacucucccccgucaauauaugcacuuuccgcggcgacgucacccacauaaccggcucccauaauuacacaaugaacuuagccucucaaaauuggaacaacuacgaccccacggaagaaauccccgccccgcuaggcacaccagacuucgucggcaaaauccaagggguccugacccaaaccacaagaacugacggaagcaccaggggacacaaagcaaccgucuauaccggcuccgccgacuuugccccuaaacuuggcagaguacaauucgaaaccgacacuaaccacgacuucgaagcaaaccaaaacaccaaauucacccccgucggcguaauccaggacggaggaaccacccaucgcaacgaaccccaacaauggguccuccccuccuacucaggacgcaacacccauaacguucaccucgccccagccgucgcaccaacauuucccggcgaacaacuacuauucuuccgcuccaccaugcccggcugcuccgguuaccccaacauggaccucgacugccuacuaccccaagaauggguccaguacuucuaccaagaagccgcacccgcccaaucugacguagcccuacuucgcuucgucaacccagacacagguagaguacuuuucgaaugcaaacuccacaaaucaggauacgucaccgucgcccacaccggccaacacgaccucguaaucccucccaacgguuacuuccgauucgacuccugggucaaccaauucuacacccucgccccuaugggaaacggaaccggacgacgccgcuaa

SEQ ID NO: 38810 - RNA, 1617 nt, Artificial Sequence
  derived and/or modified sequence opt11 from VP1__Norovirus_and/or_Norovirus-like__LC016603
augaaaauggccucaaacgaugccucccccuccgacggcuccacagccaaccuaguccccgaagucaacaacgaagucauggcacuagaaccagucgucggagccgccaucgcugcccccgucgccggccaacaaaacguaaucgaccccuggauccgcaacaacuuuguccaagcccccggcggcgaauuuacagucucaccccgcaacgcccccggagaaauccucugguccgcgccacucggacccgaccuaaaccccuaccuaucgcaccucgcacgaauguacaacggcuacgccggaggauucgaaguacaagucauccucgccggaaacgcauucacagccggcaaaaucaucuucgccgcggucccacccaacuucccaaccgaaggucuaucgcccucacaaguuaccauguucccccacaucauagucgauguccgccaacuagaaccuguccuaauaccccuacccgaugucagaaacaacuucuaccacuacaaccaaucaaacgauucaaccaucaaacucauagcaaugcucuacacaccacuacgagccaacaacgcgggcgaugacguauucacagucucaugucgcguacucacccgccccucccccgacuucgacuuuaucuuccucgugcccccaaccgucgaaagccgaacaaaaccuuucacaguccccauccucaccgucgaggaaaugaccaacucacgcuucccaaucccccucgaaaaacucuucaccggacccucauccgccuucgucguccagccccaaaacggacgcugcacaaccgacggaguccuacucggcaccacccaacuaucacccgucaacauuugcaccuuucgcggagacgucacacacauuucaggaaccuccaccuaccgcaugaaccuagccucccaaaacuggaacaacuacgaccccaccgaagaaauacccgcaccccucggaacacccgacuuugucggcaaaauccagggcaugcuaacucaaacaacaaagggcgacggcucgaccagaggacacaaagccacagucagcaccggcucagucgacuucacacccaaacuuggcucaguccaauucgccacagacacagacaacgacuucgaaaccggacaaaacacacgcuucaccccagucggagucauccaggacgguucaggcgcacaccgcaacgaaccacagcaauggguccuacccgacuacucaggcaaaaccguccacaacguccaccuugccccagccguagcccccaccuuccccggagaacaacuccucuucuuccgcuccaccaugccaggaugcagcggauaccccaacauggacuuagacugccuccucccacaagaauggguacaacacuucuaccaagaagcagccccagcccaaucagacgucgcccuccucagauuugucaaccccgacaccggccgcguccucuucgaaugcaaacuccacaaaaccggcuaugucacagucgcacacacuggccaacacgaccuugucauacccccaaacggcuacuuccgcuucgauaguuggguaaaccaguucuauacucuggccccaaugggcaacggcgccggccgccgccgauaa

SEQ ID NO: 38811 - RNA, 1617 nt, Artificial Sequence
  derived and/or modified sequence opt11 from VP1__Norovirus_and/or_Norovirus-like__LC016599
augaaaauggccuccaacgacgccucccccuccgacggcagcaccgccaaccucguaccagaaguaaacaacgaagucauggcccuagaacccguagugggagccgccaucgccgccccugucgcaggucaacaaaacguaauagacccauggauaagaaacaacuucguacaagcucccggaggagaguucaccgucucaccccgaaacgcucccggcgaaauacucugguccgcaccucucgggcccgaccucaaccccuacuuaucccaccucgccagaauguacaacggcuaugccggcggcuucgaaguccaagucauccucgcgggaaacgccuucaccgccgguaaaaucaucuucgcagccguaccucccaacuuccccaccgaaggccuaucacccucccaagucacaauguucccccacaucaucgucgacgucagacaacucgaaccuguccucaucccucucccagacguccgcaacaauuucuaccacuauaaccaauccaacgacucaaccauuaaacugauagcaaugcucuacacaccucuacgagcaaacaacgccggugacgaugucuucaccgucuccugccgcguccucacccguccaucccccgacuucgacuucaucuuccucguacccccaaccgucgaaucacgaaccaaacccuucacaguccccauccucaccgucgaagaaaugacaaacucgcgcuuccccauuccacuugaaaaacucuucacaggccccucuuccgcauucgucguccaaccccaaaacggucguugcaccacagacggaguccuccucggcaccacccaacuaucucccgucaacaucugcacguuccgaggcgacguaacucacauccccucaacacgaacauaccguaugaaccucgccagccaaaacuggaacaacuaugaccccacagaagaaauccccgcaccccuagggaccccagacuuuguaggcaaaauccaaggaaugcuaacccaaacaaccaaaggagacggauccacccgcggucacaaagccaccgucuccaccggcuccgucgacuucacacccaaacucgguuccguccaauucgccaccgacacagacaacgacuucgaaaccggccaaaacacacgauucaccccggucggcguaauacaagacggauccagcgcccaccgaaacgaaccccaacaauggguacuccccgacuauucaggcagaaccguccacaacguacaccucgcacccgcagucgcuccaacuuuccccggcgaacaacuccuauucuucagauccaccaugcccggcugcucaggauacccaaacauggaccucgacugccuccucccccaagaguggguccaacacuucuaccaagaagccgcacccgcccaaucagacgucgcccuccuccgauucguuaaccccgacaccggccgaguccuauucgaaugcaaacuccacaaaaccggguaugucaccguagcccacaccggacaacacgaccucgucaucccacccaacggcuacuuccgcuucgacuccugggucaaccaauucuacacccuagccccuauggggaacggcgccggccgccgacgcuaa

SEQ ID NO: 38812 - RNA, 1617 nt, Artificial Sequence
  derived and/or modified sequence opt11 from VP1__Norovirus_and/or_Norovirus-like__KP293587
augaagauggccucauccgacgcaaauccauccgacggaucagcagccaaccucguccccgaagucaacaacgaaguaauggcucuagaacccgucgucggcgcagccaucgcagccccuguagccggccaacaaaacguaaucgacccauggauccgcaacaacuucguccaagcccccggcggagaauuuaccgucuccccacgcaacgcccccggcgaaauccucuggucggcaccccuaggccccgaccuaaaccccuaucuaucccaccuugcccgcauguacaacggcuacgcaggaggcuucgaaguccaagugauccuagccggcaacgccuucaccgccggaaaaguuauauucgcagccgucccacccaacuuccccaccgaaggccuuucucccucccaaguaaccauguucccacacaucgucgucgacguucgucaacugaaaccuguccucauuccccuucccgacguccgcaacaacuucuaucauuacaaccaauccaacgacccaaccauuaaacucauagccaugcucuauaccccacuccgugccaacaacgcuggcgacgacgucuucaccgucuccugccgaguccuaacacgccccucccccgacuucgauuucaucuuccucgucccacccaccgucgaaucacgcacaaaacccuucucuguacccguucucacagucgaagaaaugaccaacucacgauuccccaucccccucgaaaaacuauucacaggacccucuuccgccuucgucguacaaccccagaacggucgaugcaccaccgacggcguccuccucggcacaacccaacuuuccccaguaaacauaugcaccuuccgcggagacgucacacacaucaccggcucccauucauauacuaugaaccucgcuucacaaaacugguccaacuacgaccccaccgaagaaaucccagcaccccucggcaccccagacuucguaggaaaaauccaaggaguacuaacacaaaccacccgaaccgauggaucaacccgcggccacaaagcaacagucuacaccggaucugcugacuucgcccccaaacucggccgcguacaauucgaaacagacacuaaccaugauuucgaagccaaccaaaacacaaaauucacccccguaggcgugauucaagaugguagcacaacccaccgaaacgaaccccaacaauggguccuccccucauacucaggccgaaacacacccaacguccaccucgcccccgcaguagcccccacguucccaggcgaacaacuccuauucuuccgaucaaccaugcccggaugcuccggcuacccaaacauggaucuagacugccuccucccccaagaauggguccaguacuucuaccaagaagcugccccagcccaaucagacgucgcacuccuccguuuugucaaccccgacacagggcgcguccucuucgaaugcaaacuccacaaauccggcuauguaacaguagcccacacuggacagcacgaccucgucaucccaccuaacggcuacuuccgcuucgacuccugggucaaccaauucuacacucuagcaccaaugcgcaacggcaccggccgccgacgauaa

SEQ ID NO: 38813 - RNA, 1617 nt, Artificial Sequence
  derived and/or modified sequence opt11 from VP1__Norovirus_and/or_Norovirus-like__KP176402
augaaaauggccuccucugacgccaaccccucagacggcuccgcugcaaaccucgucccagaagucaacaaugaagucauggcccuugaacccgucgucggcgccgcaaucgccgcacccgucgcaggccaacaaaacguaauugacccguggauucgcaacaaccucguccaagcccccggcggugaguuuacaguaucuccccgcaacgcccccggagaaauccucuggucagcaccacucggcccagaauuaaacccauaccucucucaccuugcaagaauguacaacggcuacgccggaggcuucgagguacaagucauccuagccggcaacgccuuuaccgcuggcaaagucauauuugccgccgucccacccaauuuccccaccgaaggccucucccccucacaaguaaccauguucccccacaucgucgucgacguucgccaacucgaacccguacucaucccccuccccgacgucagaaauaacuucuaccacuacaaccaauccaacgaccccacaaucaaacuuaucgcaaugcucuauaccccucuccgugccaacaacgccggugacgacguauucaccgucuccugucguguacucacccguccuagcccagacuucgacuucaucuuccuagucccacccaccguagaaucccgaacaaaacccuucucuguacccguccuuacagucgaagaaaugacaaacucccgcuuccccaucccucuagaaaaacuguucaccgggccauccucagccuucgucguucaaccccaaaacggccgcugcaccaccgacggcguccuacuuggcacgacucaacuuucccccguaaacaucuguaccuuccgaggcgacgucacucacaucacagguucacgcaacuacaccaugaaccuggcuucccaaaacugguccaacuacgauccuaccgaagaaauucccgcuccccuaggcacccccgacuucgucggcaaaauacaaggcguacucacccaaacaacccgcacagacggaucaacacgcggccacaaagccaccguauacacgggcuccgccgacuucgcccccaaacuuggccgcguacaauucgaaaccgacaccgaccgcgauuucgaagccaaccaaaacaccaaauucaccccaguaggcgucauacaagauggcucaaccacccaccguaacgaaccacaacaauggguccuccccucguacuccggcagaaacaccccuaacguccaccucgcccccgcaguagcuccaaccuuccccggagaacaacuccuuuucuuccgcuccacaaugccaggaugcuccggauacccaaacauggaccucgacugccuccucccucaagaauggguucaauacuucuaccaagaagccgccccagcccaaucagacguugcccuccuccgauucguaaacccagacaccggccgcguacuuuucgaaugcaaacuucacaaaucuggcuacguaaccguggcccacaccggccaacacgaccucgucauacccccaaacggcuacuuccgcuucgauuccuggguaaaccaauucuacacccucgcaccuaugggcaacggcacaggacgacgucgauaa

SEQ ID NO: 38814 - RNA, 1617 nt, Artificial Sequence
  derived and/or modified sequence opt11 from VP1__Norovirus_and/or_Norovirus-like__KJ196287
augaaaauggcuuccagcgacgccaaccccucagacggcucaaccgccaaccucguccccgaagucaacaacgaaguaauggcacucgaaccugucguuggcgcagccaucgccgcacccgucgccggucaacaaaacguaaucgaccccuggauccgaaacaacuucguccaagcccccggcggugaguucacugucucuccacgcaaugcccccggcgaaauccucugguccgcaccccucggacccgacuuaaaccccuaccucucccaccucgccagaauguacaacggucacgcuggaggcuucgaaguccaagucauccucgccggcaacgccuucaccgccggcaagauaaucuucgccgccguaccacccaauuuccccaccgaaggucucuccccaagccaaguaaccauguucccccacaucaucguagauguccgccaacuagaacccguccucauaccccuccccgacguccgaaacaacuucuaccacuacaaucaauccaacgacuccaccaucaaacucauagccaugcuauacacaccccuccgcgccaacaacgcuggugaagacguauucaccgucucaugccgcgugcuaacacguccaucacccgacuucgacuucaucuuccuaguacccccuacagucgaaucccgcaccaaaccauuuaccguuccuauccuaaccgucgaagaaaugacaaacagccgcuuccccauaccccuagaaaaacuauucacaggccccuccuccgccuucgucguccaaccucaaaacggccgcugcaccaccgacggcguccugcuaggaaccacccaacuaagccccgucaacauauguaccuuccgcggugacgucacccacauugccggcucccgaaacuacaccaugaaccuggccucccuaaacuggaacaacuacgaccccacagaggaaauaccagcaccacucgguacccccgacuucguaggcaaaauacaaggcguccucacccagacaaccaaaggcgacggcucuacccgaggacacaaagccacuguauacaccggcucagcaccguucacgccaaaauuagguucaguccaauucuccaccgacaccgaaaacgacuucgaaacacaccaaaacacaaaauucacacccgucggcgucauccaagacggcggcaccacacacagaaacgaaccccaacaguggguacuucccagcuacagcgggcgaaacguccacaacguccacuuagcacccgccgucgccccaaccuuccccggcgagcaacuacucuucuucagauccacaaugcccggcugcuccggcuacccaaauauggaucuagacugccuacuaccccaagaauggguccaacacuucuaccaagaagccgcccccgcccaauccgacgucgcccuccuccgauucgucaaccccgacacaggccgaguccuauucgaaugcaaacuccacaaauccggauacguaaccguagcgcacaccggacaacacgaccuagucaucccaccaaacggcuacuucagauucgacagcuggguaaaccaauucuacacccucgccccuaugggcaacggcaccggucgacgcagauag

SEQ ID NO: 38815 - RNA, 1617 nt, Artificial Sequence
  derived and/or modified sequence opt11 from VP1__Norovirus_and/or_Norovirus-like__KM198480
augaaaauggcaucuaacgacgccaacccaagcgacggcucagccgccaaccucguucccgaaguaagcaacgaagucauggcccucgaacccgucgucggcgccgcuauugcagccccagucgcaggucaacaaaaugucaucgaccccuggauccgcaacaacuucguccaagcccccggcggugaguucaccgucuccccacgaaacgcccccggcgaaauacuauggucugccccacucggccccgaccugaacccauaccucucacaccucgcccgaauguacaacgguuacgcaggaggcuucgaaguccagguuauccucgcaggaaacgccuucaccgccggcaaaauuauauucgccgccgucccacccaacuuccccaccgaaggccucagccccucgcaagucacuauguucccacacaucauaguagacguccgacaacucgaacccguuuuaauaccccuccccgacguccgcaacaacuucuaccacuacaaccaaaccaacgacuccaccaucaagcucauagcgaugcucuacacaccccuacgcgcuaacaacgccggcgaagacguauucaccguaagcugucgcguccucaccagacccuccccggacuuugacuucauauuccuaguacccccgaccgucgaaucacgcacuaaaccuuucacaguacccauccuaacagucgaagaaaugacaaauucccgcuuccccaucccucuugaaaaacucuucacaggcccauccggugcuuucguaguccaaccucaaaacggacgcugcacaaccgacggaguccuccuugguacaacacaacucucccccgucaacaucugcaccuucagaggcgacguaacccacauugccggcucccgcaacuacacaaugaaccucgcgucccuaaacuggaacaacuacgaccccacagaagaaaucccagcgccccucggcacacccgacuucguagguaaaauccaaggaguucuaacccaaaccaccaaaggcgacggauccacacguggccacaaagccacagucuacacaggcagcgccccauucacgccaaaacucggcucaguacaauucuccaccgacaccgaaaaugacuucgaaacucaucaaaacacaaaauucacuccaguuggaguaauccaagacggcggcaccacccaccgcaacgagccacaacaauggguccuccccagcuacucaggccgcgacguccauaacguccaucuagcaccagccgucgccccaacguuccccggcgagcaacuccuuuucuuccgaucaacaaugcccggcugcuccggauacccaaacauggaccuagacugucuccucccacaagaauggguccaacacuuuuaccaagaagccgccccagcccaauccgacgucgcccuccuccgcuucguaaaucccgacaccggcagaguccucuucgaaugcaaacucuacaaauccggguacgucacugucgcccacaccggccaacacgaccucgucaucccacccaacggauacuuucguuucgacuccugggucaaccaauucuacacccucgcuccaaugggaaacggcacaggacgacgucgcuaa

SEQ ID NO: 38816 - RNA, 1617 nt, Artificial Sequence
  derived and/or modified sequence opt11 from VP1__Norovirus_and/or_Norovirus-like__KJ716357
augaaaauggccuccucagacgccaaucccuccgacggcuccgcagcgaaccucguacccgaagucaacaacgaaguaauggcacuugaaccaguagucggagccgcaaucgccgcaccagucgcaggccaacaaaacgucaucgaccccuggauccggaacaacuucguacaagccccagggggcgaguucaccgucucacccagaaacgcccccggcgaaauccuauggucagcaccccuuggccccgaccucaaccccuaccucucacaccucgcccggauguacaacggacaugccggcggcuucgaaguucaagucauucucgccggcaacgccuucaccgcagguaaagucaucuucgccgccguacccccaaacuuucccacagaaggauuauccccaucccaagucacgauguuuccucacaucgucgucgacguccgccaacuagaacccguacuaauuccccuaccugacguccgcaacaacuucuaccacuacaaccaauccaaugacccaaccauaaaacuaaucgccaugcucuacacgccccuucgugccaacaacgccggcgacgacguauucacugucuccugccgcguacucacccgccccucacccgacuucgacuucauauuccucgucccacccaccgucgaaagccgcaccaagcccuucucuguacccguccucaccgucgaagaaaugacaaacucccgcuuccccaucccacuugaaaaacucuucaccggaccauccuccgccuucguuguucaaccacagaacggucgcugcaccacagauggcguccuacucggcacaacccaacucucacccgucaacaucugcaccuucagaggagacgucacacacauaacuggcucccgaaacuauaccaugaaccuagcaucacaaaacuggaacaauuacgacccaaccgaagaaauccccgcaccccuaggcacacccgacuucguuggaaaaauucaaggcguccucacccaaaccacccgaaccgacggcucuacucgcggccacaaagccacuguuuacacaggcucagcagacuucgcccccaaauuaggccgaguccaauucgaaacagacacagaucacgacuucgaagcaaaucaaaacacuaaauucacacccgucggcguaauccaagauggcggaacuacccaucgaaacgaaccacaacaauggguccuccccuccuacuccggccgaaacacccauaacguccaccuugcacccgccgucgcccccaccuuccccggcgaacaacuacucuucuuccguuccaccaugcccggaugcuccggauaccccaacauggaccucgacugcuuacucccacaagaauggguacaauacuucuaccaggaagccgccccagcccaaucggacguugcccuccuccgauucgucaaccccgacaccggacgcguauuauucgaaugcaaacuacacaaauccggcuacgucaccgucgcccacacuggccaacacgaccucguaauaccacccaauggcuauuuccgcuucgacucaugggucaaccaauucuacacccucgcacccaugggaaacggaacaggacgccgcagauaa

SEQ ID NO: 38817 - RNA, 1617 nt, Artificial Sequence
  derived and/or modified sequence opt11 from VP1__Norovirus_and/or_Norovirus-like__KJ716354
augaaaauggcauccuccgacgccaaccccuccgacggcuccgcugcaaaucucguccccgaaguaaacaacgaagucauggcauuagaacccguaguaggcgccgccaucgccgccccagucgcaggccagcaaaacgucaucgaccccuggauacgcaauaacuucguacaggcccccggaggcgaguucacaguauccccacgcaacgcucccggcgaaauccucugguccgcaccccuaggcccagaccucaaccccuaccucucacaccucgcccgcauguacaacggauacgccggcggcuucgaaguccaaguaauccuggcaggaaaugccuucacagcaggcaaagucaucuucgccgccgucccacccaacuuccccaccgaaggccucucccccucccaagucaccauguucccacacaucgucgucgacgugcgccaacucgaaccagucuuaauuccgcuccccgacguucgcaacaacuucuaccacuacaaccagagcaacgacccaacuaucaaacuaauagcaaugcucuacaccccgcuaagagccaacaacgcuggagacgacgucuucaccgucuccugccgcgugcucacccgccccucccccgacuucgacuucauauuccucgucccacccacagucgaaucccgcacaaaacccuucuccgucccaguacucaccguagaagaaaugaccaacucccgcuuccccaucccccuugaaaaacuauucaccggacccucaucugccuucguuguccaaccacaaaacggccgaugcaccaccgacggcgucuuacuaggcacaacccaacucucccccgucaacaucugcaccuucagaggcgacgucacccacaucacaggaucucgcaacuacaccaugaaccucgccucacaaaacuggaacaacuacgaccccacugaagaaauaccagcccccuugggcacacccgacuucguaggcaaaauccagggcguccucacacaaaccacgcguacagacggcuccacccgcggccacaaagcaaccgucuauauaggcucagccgacuucgcccccaaacuaggccgcguccaauucgaaaccgacacagaccacgacuucgaagccaaccaaaacacuaaauucacacccguagguguuauccaagacggcgguaccacccaccguaacgaaccacaacaauggguacuacccuccuacucaggccgaaacacccacaacguccacuuagcccccgcaguagcacccacuuuccccggagaacaacuccuguucuuucgcucaacaaugcccggcuguuccggguaccccaacauggaccuagacugccuacucccucaagaauggguucaauauuucuaccaagaagccgccccugcccaaucagacgucgcccuccuaagauucgucaacccagacaccggaagagugcucuuugaaugcaaacuucacaagucuggauacgucaccgucgcacacacaggccaacacgaccucgucauacccccaaacggcuacuuccgauuugacuccugggucaaccaauucuacacccucgcaccaaugggcaauggcacagggcgcagaagauaa

SEQ ID NO: 38818 - RNA, 1617 nt, Artificial Sequence
  derived and/or modified sequence opt11 from VP1__Norovirus_and/or_Norovirus-like__KJ685403
augaagauggccucgucagacgccaacccaucagacggcuccacagccaaccuggucccagaagucaacaacgaagucauggcucuagaacccguugucggagcagcaaucgccgcaccagucgccggacaacaaaauguaaucgauccauggauucguaauaacuucguccaagcccccggcggagaguucaccguuucccccagaaacgccccaggagaaauacuuuggucagcaccccuaggccccgauuuaaacccauaccuaucccaccuagcccgaauguacaaugguuacgcuggcgguuucgaaguacaaguaauccucgccggcaacgcauucaccgccggaaaaauaaucuucgccgccgucccucccaacuuccccacagagggacucucacccagccaagucaccauguucccccacaucaucguugacguccgacagcucgaacccguccuaauuccccuccccgacguccgcaacaacuucuaccacuacaaccaauccaacgacccuacaaucaaacucaucgcaaugcucuacacaccccuccgcgcuaacaacgccggcgacgacguauucaccgucucaugccgcguccucacucgccccagucccgacuucgacuucaucuuccuagucccucccaccgucgaaucccgcaccaaacccuucuccguccccguccuaaccguagaagaaaugaccaacucaagauuccccauuccccuggaaaaacucuucaccggacccuccuccgcauuuguaguccaaccccaaaacggccgauguaccacagacgguguccuccucggcaccacacaacucucccccgucaacauauguaccuuccgaggcgaugucacacacaucuccggaucccgcaacuacaccaugaaccuagccucgcaaaacuggaacuccuacgaccccacugaagaaaucccagcaccccuaggcacccccgacuucguaggcaaaauccaaggcguccuaacacaaaccacccgaacagacggcuccaccagaggacacaaagccacugucuacaccggaucggcagacuucucucccaaacuuggacgcguacaauucaccaccgacaccgacaacgacuucguaacaaaucaaaauaccaaauuuacacccgucggcgucauccaagacggcuccacuacgccccgcaacgaaccccaacaauggguccuccccuccuacucaggacgaaacacccacaacguccaccucgcccccgccgucgcccccaccuuucccggagaacaacuacucuucuucagaucaacuaugccuggcugcucuggcuaccccaacauggaccuugacugccuucucccccaagaauggguccaauacuucuaccaagaagcagcccccgcacaaucagacgucgcacuacuccgcuucguaaaccccgacaccggccgcguccucuucgaaugcaaauuacacaaauccggcuacguaacaguagcccacacaggccaacacgaccucgucauaccacccaauggauacuuccgcuuugacucauggguaaaccaauuuuacacccucgcucccaugggaaacgguaccggccguaggcgauga

SEQ ID NO: 38819 - RNA, 1617 nt, Artificial Sequence
  derived and/or modified sequence opt11 from VP1__Norovirus_and/or_Norovirus-like__KF060108
augaaaauggccucaucagacgccaaccccucagauggcuccagcgcuaaccuaguacccgaggugaacaacgaagucauggcccucgaacccguugucggugcagccaucgccgcccccgucgccggccaacaaaacgucauugaccccuggauacgcaacaacuucguacaagcucccggcggagaguucaccgucuccccacgcaaugcaccaggagaaauccucugguccgcaccccucggaccugacuuaaaccccuaccucucccaccuagcucgcauguacaacggcuacgccggcggcuucgaaguccaagucaucuuagcaggaaacgccuucacagccggaaaaaucaucuucgccgcagugcccccaaacuucccaaccgaaggccucucucccucacaagucaccauguucccccacaucaucgucgacgucagacaacuagaacccguacuaauaccucuccccgacguccguaauaauuucuaccacuacaaccaaagcaacgaccccaccaucaaacucaucgcaaugcucuacaccccucuccgugcaaacaacgccggcgacgaugucuuuacagucuccugccgaguccuaaccagacccuccccagacuucgacuucauauuccuagucccucccacagucgaaucccgaacaaaacccuucagcgucccaguccuaaccgucgaagaaaugacuaacucgcgguucccaauaccccucgaaaaacuuuucaccggacccuccagcgccuucgucguccaaccacaaaacggacguugcacaacugacggcguccuacucggaaccacccaacuuuccccaguaaacauaugcacauuccgcggagacgucacccauaucuccggcucacgcaacuacaccaugaaccucgccagccaaaacuggaacuccuacgacccgaccgaagaaauuccagcuccccugggcacacccgacuucguuggcaaaauccaaggcguacucacccaaaccacacgcaccgacggcuccacuagaggccacaaagccaccgucuauaccggcagcgccgacuucucacccaaacucggacguguccaauucgccacagacaccgacaacgacuucgucacaaaccaaaacaccaaauucacccccguaggagucauccaagacggcucaacaacaccccgaaacgaaccacaacaauggguccuaccuaguuacuccggccgcaauacccacaacguccaccucgcccccgcaguagccccaaccuuccccggcgaacaacuccuauucuuccgcuccaccaugcccggaugcucaggauaccccaacauggaccuagacugccuccuaccccaagaauggguccaauacuucuaccaagaagccgcacccgcacaaucagacguggccuuacuacgcuucgucaaccccgacaccggccgcguacuauucgaaugcaaacuccacaaauccggcuacguaaccguugcccacacaggccaacacgaccuaguuaucccacccaacggauacuuccgcuucgacuccuggguaaaccaauucuacacccuagcccccaugggcaacgguaccggccgaaaacgcuaa

SEQ ID NO: 38820 - RNA, 1617 nt, Artificial Sequence
  derived and/or modified sequence opt11 from VP1__Norovirus_and/or_Norovirus-like__KF060099
augaaaauggccuccuccgacgccaaccccuccgacggcagcaccgccaaccuagucccggaagucaauaaugaaguaauggcacuagaaccagucgucggagccgccaucgccgcccccguagccggccaacaaaacgucaucgaccccuggauccgaaacaacuucguacaagcccccggcggcgaauuuacagucucaccccgcaacgcucccggcgaaauccuaugguccgccccacuaggcccagaccucaaucccuaccucucacaucucgccagaauguacaacgguuacgccggcggcuucgaaguacaagucauacucgccggcaacgcuuucacagccggaaaaaucaucuucgccgccgucccucccaacuuccccaccgaaggucuuucgccaucccaagucacaauguucccccauaucaucgucgacguucggcaacucgaacccguccucauuccccucccagacguccgcaacaacuucuaucacuacaaccaauccaacgaccccacaaucaaacuaaucgccaugcucuacacaccgcuacgcgcaaacaacgccggugacgacgucuucaccgucucaugccgcguccucaccagacccucccccgacuucgacuucaucuuccucguaccaccaaccgucgaaucccgcacuaaacccuucucuguccccguccuaacaguugaagaaaugacuaacucccgauucccuaucccccucgaaaaacucuucaccggacccucuucagccuucgucguacaaccccagaacggccgcugcacaacagacggcguccuacuagggaccacacaacuaucucccguaaacauuugcacauuccgaggcgacgucacucacauccccggcagccgcaacuacaccaugaaccucgccucacaaaacuggaacuccuacgacccuaccgaggaaauccccgccccacuuggaacacccgacuuugucggcaaaauccaaggaguccucacacaaaccacccgcacagacggaucaacccgcggccacaaagccaccgucuacacuggauccgcugacuucucccccaaacucggacgcguacaauucgccacagauacugacaacgacuucguaaccaaccaaaacaccaaauuuacuccagugggaguaauccaagacggcuccaccacaccccgaaacgaaccacaacaauggguacucccauccuacuccgguagaaacacccacaacguacaccucgcgcccgcagucgcaccaaccuuccccggcgaacaacuccucuucuuccgauccacaaugcccggaugcucaggcuaccccaacauggacuuagacugccuccucccccaagaauggguccaauacuucuaccaagaggccgcccccgcccaaagcgauguagcccuccucagauucguuaaccccgacaccggucguguccucuuugagugcaaacuccacaaauccggauacgucaccgucgcccacaccggacaacaugaccucgucauaccaccuaacggcuacuuccgcuucgacucauggguaaaucaauuuuacacccucgccccaaugggcaacggcacuggacgccgccgauag

SEQ ID NO: 38821 - RNA, 1617 nt, Artificial Sequence
  derived and/or modified sequence opt11 from VP1__Norovirus_and/or_Norovirus-like__KF060004
augaaaauggccagcucagacgccaaccccucagacggcuccgucgccaaccuuguccccgaagucaacaacgaagucauggcacucgaacccgucguaggagccgccaucgcagcccccguagccggucaacaaaacguaaucgaccccuggauucgcaacaacuucguucaagccccaggcggcgaguucaccgucagcccccgcaacgcacccggcgaaauccuaugguccgcaccccucggcccagaccuuaaccccuaccucagccaccucgcccgcauguacaacggcuacgccggaggguucgaaguucaaguaauccucgccggcaaugccuucaccgccggaaaggucaucuucgccgccgucccacccaacuuccccaccgaaggccucuccccuucccaaguaaccauguucccgcauauagucgucgacguucgacaacuagaaccuguacucaucccacuacccgacguccguaacaauuucuaccacuacaaccaauccaacgaccccaccaucaaacucaucgcaaugcucuacacgccacuucgagccaacaacgccggcgacgacgucuucaccgucuccugcagaguacuuacucgacccagcccagacuuugacuucauauuccucgugcccccaaccgucgaaucccgcaccaaaccauucucugucccaguccuaacagucgaagaaaugaccaacucccgcuuccccaucccccuagaaaaacucuucaccggcccaucauccgcauucguaguccaaccccagaacggacgcugcaccaccgacggcguacuccucggcacaacccaacugucuccagucaacaucugcacauuccgaggcgacguaacacacauuaccggcucccgaaacuacacuaugaaucuagccucccaaaacuggaacaacuacgaccccacggaagaaauaccagcaccacuagguacacccgacuucgucggcaaaauacaagguguacugacccaaacaacccguaccgacggcucgacacgcggccacaaagccaccguauacaccgguagcgccgacuucgcccccaaauuaggccgcguccaauucgaaaccgacaccgaccacgacuucgaagccaaccaaaauacaaaauucacccccgucggaguaauccaggacggcggaaccacccaccgcaaugaaccgcaacaauggguccuccccuccuauuccggcagaaacacccauaacguacaccuagcaccagcaguugcacccaccuucccaggagaacaacuacucuucuuccgauccaccaugcccggaugcagcggcuacccuaacauggaccuagacugccugcugccccaagaauggguccaauacuucuaccaagaagccgcaccagcucaauccgacgucgcccuccuucgauuugucaacccagacaccggccggguccuuuucgaaugcaagcuccacaaaucaggcuacguuaccgucgcccacaccggccaacacgaccuagucauucccccaaacggcuacuuccguuucgacucauggguaaaccaauucuacacccuugcacccaugggaaacgguaccggucgacgccgcuaa

SEQ ID NO: 38822 - RNA, 1617 nt, Artificial Sequence
  derived and/or modified sequence opt11 from VP1__Norovirus_and/or_Norovirus-like__KF060006
augaaaauggcuuccucugacgcuaacccaucugacggcuccaccgccucccuaguccccgaaguaaacaacgaagucauggcccucgaacccgucgucggcgccgccaucgccgccccagucgccggacaacaaaacgucaucgacccauggauccgcaacaacuucguacaagcccccggaggagaguucacagucuccccucgcaacgcccccggagaaauacuuugguccgcaccccuaggccccgaccucaacccuuaccucucacaccuagcccgcauguacaacucauacgccggcggauuugaaguccaaguaauccuggccggcaacgccuuuaccgccgguaaaaucaucuuugcagccgucccacccaacuucccaacagaaggacuuucccccucccaaguaacaauguucccacacauaauuguagacguacgccagcucgaacccguccucaucccacuaccggacguacgaaacaauuucuaccacuacaaucagagcaacgaccccaccaucaaacucaucgccaugcucuacacaccccuccgcgcaaacaacgccggcgacgacgucuucaccguauccugccggguccuaacccgucccucacccgacuucgacuuuauauuccuugucccacccaccgucgaaucacgcacaaaacccuuuuccguacccguacucacugucgaagaaaugacuaacagccgcuuccccauaccccucgaaaaacucuuuaccgggcccuccuccgccuuuguaguccagccccaaaacggccgaugcaccacagacggaguccuacuaggcaccacccaacuuagcccaguaaacauuugcacauuccgaggcgacgucacucauauauccggaagccacaauuacaccaugaaccuugccucccaaaacuggaacucauacgacccaacugaagaaaucccagcuccccuagguacccccgacuuuguuggaaaaauacaaggcguccuaacccaaacaaccagaauuaacggaagcacccgcggccauaaagccacggucuacaccggcuccgccgacuucuccccaaaacucggccggguccaauucgcaaccgacacagacaacgacuucgaaaccaaccaaaacacuaaauucacccccgucggaguuauacaagacggauccacaacaccccgaaacgaaccccaacaauggguacuucccuccuacuccggacgaaacacccacaacguacaccuagcacccgccgucgcccccaccuuccccggcgagcaacuccuauucuuccgcuccaccaugccuggcugcuccggguaccccaacauggaccucgacugccuacuuccccaagaauggguccaauacuucuaucaagaagcagcccccgcccaaucggacguagcacugcuccgcuucgucaaccccgacaccggucgaguccuauucgaaugcaaacuccacaaaucaggcuacgucacagucgcacacaccggccaacacgaccucguaauaccacccaacggguacuuucgcuucgauucauggguuaaucaauucuacacccuugcacccauggggaacggcaccggccgacgacgauaa

SEQ ID NO: 38823 - RNA, 1617 nt, Artificial Sequence
  derived and/or modified sequence opt11 from VP1__Norovirus_and/or_Norovirus-like__KC517371
augaaaauggccuccaacgaugccaacccuuccgacggauccgccgccaaccucguuccagaggucgacaacgaagucauggcccuagagcccgucguaggagcagccaucgccgcccccguggccggacaacaaaacguaauagauccauggauccgaaacaacuucguacaggcccccggcggcgaguucaccguaucaccccgaaacgcccccggcgaaauccucugguccgccccacucggucccgaccucaacccauaccuaucccaccucgcucgcauguacaacgguuacgcaggcggcuucgaaguccaagucauucucgccggcaacgccuucacugccggcaaaaucauauucgccgccgucccucccaacuucccaacagaaggacucuccccaucccaaguuaccauguucccccacaucauagucgauguucgccaacucgaaccuguccuaaucccccuccccgacgucagaaacaauuucuaccacuacaaccaauccaacgacuccacaauaaaacucaucgccaugcucuacacaccacuccgagccaacaacgcaggcgaagacguguucacagucucgugccgcguccucacacgaccauccccagacuucgacuucauuuuccucgccccacccaccgucgaauccagaacaaaacccuucaccguccccauacuaacagucgaagaaaugacuaacagccgauucccaauaccacucgaaaaacucuucaccggccccucaucagccuucgucgugcaaccccaaaacggccgcugcaccacagacggaguccuccucggaacaacccaacuaucaccggucaacaucugcaccuucagaggcgacgucacccacauagcaggaucacgaaacuacacaaugaaccucgccucacuaaacuggaauaacuacgaccccaccgaagaaaucccugcuccacucggaaccccagacuucguaggcaaaauccaaggcaugcucacccaaaccaccaaaggagauggaucaacucgcggccacaaggccaccgucuacaccggcucagccccauucacaccuaaacucggcuccguccaauucgaaacagacacagaaaacgacuucgaaacacaccaaaacaccaaauucacacccgucggagucauccaagacggcggcacaacccaccgaaacgaaccccaacaauggguccuccccuccuacucagguagaaauguccccaacguccaccucgcaccagcugucgcacccaccuuccccggagaacaacuccucuucuuccgcuccaccaugcccggcugcucugguuaccccaacauggaccucgacugccuccucccccaagaauggguccaacacuucuaccaagaagccgcacccgcccaaucagacgucgcacuccuccgcuucgucaaucccgacaccggaagaguacuuuucgaaugcaaacuacacaaauccggcuacgucacagucgcccacaccggccagcacgaccucguaauaccacccaacggcuacuuccgcuucgacucaugggucaaccaguucuacacccucgccccaaugggcaacggcacugggcgcagacgcuaa

SEQ ID NO: 38824 - RNA, 1617 nt, Artificial Sequence
  derived and/or modified sequence opt11 from VP1__Norovirus_and/or_Norovirus-like__JX459657
augaaaauggcaucauccgacgcccaccccuccgacggauccaccgcaaaccucguaccagaagucaacaacgaggucauggcccucgaaccaguaguaggagcugcaaucgccgcacccguugccggccaacaaaacgucauagauccuuggauacgaaacaacuucguccaggccccuggaggcgaguucaccgucuccccacggaacgccccuggugaaauacucuggucagcuccccucggccccgaccucaacccauaccucucccaccucgcacgaauguacaacggauacgccggcggcuucgaaguccaagucauccucgcaggcaacgccuucacugccggcaaaaucaucuucgcagccgucccacccaacuuccccacagaaggucucucucccucccaggucaccauguucccacacaucguaguagacguccgccagcucgaacccguccucauaccccuccccgacguccgaaacaacuuuuaccacuacaaccaaucaaaugaccccaccaucaaacucaucgccaugcuauacacaccccuacgugccaacaaugcaggagacgacgucuucaccgucuccugccgcguccucacccgacccagcccugacuucgacuucaucuuccuugucccacccaccgucgaaucccgcaccaagcccuucucagucccagugcucacaguagaagaaaugaccaacucacgcuuccccaucccccucgaaaaacuauucaccgggcccucaucagccuucguaguccaaccccaaaacggcagaugcaccacugacggaguacuacuaggcaccacccaacucuccccaguaaacauaugcaccuuucguggugacgucacccacauuuccggaagccggaacuauaccaugaaccucgccucccaaaacuggaacucauacgaccccacugaagaaauacccgccccucucggcacccccgacuucguuggcaaaauccaaggcguccucacacaaaccacucgcaccgacggcucgacuagaggacacaaagccacaguauacacaggauccgccgacuuuucacccaaacucggcagaguccaauucgccaccgacacagacaacgacuucgucaccaaccaaaacaccaaauucacccccguaggagucauccaagacggcuccacaacaccacgcaacgaaccccaacaguggguccucccuagcuacuccgguagaaauacccacaacguccaccucgcccccgccgucgccccuaccuuucccggcgaacaguuacuauucuuccgcuccaccaugcccggcugcuccggauacccuaacauggaccuagacugccuacucccccaagaauggguccaauacuucuaccaggaagcugcacccgcccaaucugacgucgcccuacuacgcuucgucaacccugacaccggccgaguccuuuucgagugcaagcuccacaaaucuggcuauguaacugucgcacacacaggccaacacgaccucguaauacccccaaacgguuauuuccgcuucgacuccuggguaaaccaguucuacacccucgccccaaugggcaaugguacaggccgccgacgcuaa

SEQ ID NO: 38825 - RNA, 1617 nt, Artificial Sequence
  derived and/or modified sequence opt11 from VP1__Norovirus_and/or_Norovirus-like__JX459656
augaaaauggccucaagcgacgcucaccccucagacggcuccacugccaaccucguacccgaagucaacaacgaagucauggcccuagaacccguggucggcgcagccaucgccgcccccgucgccggccaacaaaacguuaucgaccccuggauccgcaacaacuucguccaagccccaggaggagaguucacggucucuccccgcaaugcaccuggcgaaauacucugguccgcuccccucggacccgaccuaaacccuuaccucucucacuuggcccgcauguacaacggcuacgccggcggauucgaaguacaaguaauccucgccggcaacgccuucacagccggaaaaauaauauucgccgccguaccaccaaacuuucccacagaaggacucucacccucccaaguaaccauguucccccacauaaucguagacguucgacaacucgaaccaguucuuaucccacugcccgacguccgaaacaacuucuaucacuacaaccaauccaacgaccccacaaucaaacuaauagccaugcucuacacaccccuccgagccaacaacgccggugacgauguauucaccgucuccugccgcguccuaacccgaccaagccccgacuucgacuucaucuuccucgucccacccaccguggaaucacgcaccaaaccauucuccguccccguccuaacagucgaggaaaugaccaacucccgauuucccaucccacucgaaaaauuauucaccggacccuccucagcauucguuguacaaccucaaaacggccgcugcaccaccgacggcguccuccucggaaccacacaacuaucacccgucaacaucugcaccuuccgcggcgacguuacucacaucccuggaagccgaaacuacacaaugaaccucgcaucccaaaacuggaacuccuacgacccaaccgaagaaaucccagcaccucuaggaacccccgacuucgucggcaaaauccaaggcguccuaacacaaacuacccgaaccaacggauccacacgaggccacaaagcaaccgucuacacaggcucugccgacuuuucccccaaacucgguagaguccaauucgccacagacacagacaacgacuucgaaaccaaccaaaacacgaaauucaccccaguaggagucauacaagacggcuccacaacaccccgcaacgaaccacaacaauggguacuccccucuuacuccggccgaaacauacacaacguucaucucgcacccgccgucgcccccaccuucccaggagaacaacuccucuucuucagauccaccaugcccggcugcuccggauaccccaacauggaucucgacugccuccuaccccaggaauggguccaauacuucuaccaagaagccgcacccgcccaguccgacgucgcucuacuccgcuuuguuaaccccgacaccggccguguccucuucgagugcaaacuucacaaauccggcuacgucaccgucgcccacaccggccaacacgaccuagucaucccucccaacggcuacuuccgcuucgauucuugggucaaccaauucuacacgcucgcccccaugggcaacggaaccggccgacgccgcuaa

SEQ ID NO: 38826 - RNA, 1617 nt, Artificial Sequence
  derived and/or modified sequence opt11 from VP1__Norovirus_and/or_Norovirus-like__JX445152
augaaaauggccucaaaugacgccaacccauccgauggcucuaccgcaaaucucguccccgaagucaacaaugaagucauggcccucgaaccaguagucggagccgccaucgccgccccagucgcuggccaacaaaacgucauugacccauggauccgcaacaacuucguccaagcccccggcggagaguucacagucagcccacgaaacgcccccggagaaauccucuggucagcgccacucgguccagaccuuaaccccuaccuuucccaccuagcacgcauguacaauggcuacgccggcggauucgaaguccaagucauccuagccggaaacgccuucacagccggaaaaauaauauucgcagccguucccccaaacuucccaaccgaaggccucagccccucccaagucacaauguuuccacacauaaucgucgacguccgccaacuugaacccguccucaucccccuccccgacguccgcaacaacuucuaccacuacaaccaauccaacgaccccacaauaaaacuaauagccaugcucuacacaccccuccgcgccaacaacgccggagaagacgucuucaccgucucuugccguguccucacccgacccucacccgacuucgacuucaucuuccucgucccacccacaguagaaucacgaaccaaacccuucaccguccccaucuuaacagucgaagaaaugaccaacucacgauuccccauaccccuagaaaaacucuucaccggccccaguggcgccuucgugguccaaccccaaaacgguagaugcaccaccgacggcguccucuuagguacuacccaacuaagcccaguuaacaucuguaccuuccgcggugacgucacccacaucgccgguacccacaacuacacaaugaaccucgcgucacaaaacuggaacaacuaugauccaacagaagagauccccgcaccccucggcacucccgacuucgucggccguauacaaggaaugcuuacacaaaccacccgaggcgacgguagcacgcgcggacacaaagccaccguauccacaggagacguacauuucacacccaaacucggcucaauccaauucaacaccgacacaaacaacgacuucgaagccgggcagaacaccaaauuuacccccgacggcgucguccaagacggaaacggcacccaccagaacgaaccccaacaguggguccucccauccuacucaggccgaaccggccacaacgugcaccucgccccagccauugcccccacauuccccggcgaacaacuacucuucuuccgaagcaccaugcccggcugcuccggauaccccaacaugaaccuagacugccuacuaccccaagaauggguacagcacuucuaccaagaagccgcucccgcccaauccgacguagcccuacuccgcuucgucaacccugacaccggacgcguacucuucgaaugcaagcuacacaaaucaggauacgucacugucgcccacacuggccaacacgaccuagucauaccucccaacggcuacuuucgauucgauuccugggucaaccaauuuuauacgcuagcucccaugggcaacggcacaggacgccgaagauga

SEQ ID NO: 38827 - RNA, 1617 nt, Artificial Sequence
  derived and/or modified sequence opt11 from VP1__Norovirus_and/or_Norovirus-like__JQ613553
augaaaauggccuccucugacgccaaccccucagacggcuccaccgcgaaccuuguccccgaaguaaacaacgaagucauggcccuggaaccagucgucggcgcagccauugccgcaccagucgccggccaacaaaacguaauagauccauggauccgcaacaacuucguccaagcccccggcggcgaguucaccgucuccccacggaacgccccaggagaaauccuaugguccgccccacucgggcccgaccuaaaccccuaccucucacaccuagcccgaauguacaacggcuacgccggcggcuucgaaguacaagucauccuagcaggcaacgccuucaccgccggaaaaaucauauucgccgccguacccccaaacuucccaacagaaggccuaucccccucccaagucacaauguucccccacauuauagucgacguccgccaauuagaacccguccuaaucccacuaccagacguacguaacaacuuuuaccacuacaaccaaagcaacgacccuaccauaaaacuaaucgcaaugcuauauacuccacucagagccaacaacgccggcgacgacguauucacagucuccugccgcguccucacgcgucccagccccgacuucgacuucauauuccucguacccccaacugucgaauccagaacaaaacccuucucuguccccguccucaccguucaagaaaugacuaacucgcgcuuccccaucccccucgaaaaacucuucaccggaccauccuccgcuuucgucguucaaccccaaaacggacgcuguaccaccgacgggguacuacucggaaccacacaacuuuccccgguaaacauaugcacuuuccgcggagacguaacacacauacccggcucccguaacuacaccaugaaccucgcaucacaaaacuggaacucauacgacccaaccgaagaaaucccugccccacuaggaacucccgacuucguagggaaaauccaaggaguccuaacccaaacaacacgaacaaacggcagcacccgcggacacaaagccaccgucuacaccggaucagcggacuucucccccaaacucggacggguccaauucgccacggacaccgacaaugacuucgaaaccaaucaaaacaccaaauucaccccaguaggaguaauccaagacgguucaacaacaccccgcaacgaaccccaacaauggguacucccaucauacucaggcagaaacauacauaacguccaccucgcccccgcagucgcccccaccuuccccggugaacaacuccucuucuuucgcucuaccaugcccggcugcuccggcuacccuaacauggaccucgacugcuuacucccccaagaauggguccaauacuucuaccaggaagccgcccccgcccaaucagacguagcccuccuacgguucgucaaccccgacaccggacguguucuauucgaaugcaaacuacacaaaucaggauacguaaccgucgcccacaccggacaacacgacuuaguaaucccacccaacggauacuuccgcuucgacuccuggguaaaccaauucuacacccuagcacccaugggcaacgggaccggccgucgcagauaa

SEQ ID NO: 38828 - RNA, 1617 nt, Artificial Sequence
  derived and/or modified sequence opt11 from VP1__Norovirus_and/or_Norovirus-like__JQ613521
augaaaauggccuccaacgacgccaaccccuccgacggcucggccgccaaccucguccccgaaguauccaacgaagucauggcccuagaacccguagucggagcagccauagccgcccccgucgcaggccaacaaaacgucaucgacccuuggauacguaacaacuucguccaagcccccggcggcgaguucaccguaucaccccgcaacgcucccggagaaauccuaugguccgccccacuagguccagaccucaacccauaucucagccaccucgcccguauguacaacggauacgcuggcggcuucgaaguccaggucauccucgccgguaacgccuucaccgccggcaaaauaauauucgcagccguaccaccaaacuuccccaccgaaggcuuauccccaucccaaguaaccauguucccccacaucaucgucgacguacgacaacucgaacccguacucaucccacuacccgacguucgaaacaauuucuaccacuacaaccaauccaacgacagcacaaucaaacuaauagccaugcucuacacaccccuaagagccaacaacgccggagaagacgucuucaccguauccugccggguccuaacccgacccucccccgacuucgacuucaucuuccuaguuccucccacagucgaaucccgcaccaaacccuucaccguaccaauauuaacaguagaagaaaugaccaacucacgauuuccaaucccccucgaaaaacucuucacgggccccuccggcgccuucgucguccaaccccaaaacggacgcugcaccaccgacggaguccuacuaggcacuacucaacuaucccccgucaauaucugcacauuucgcggcgacgucacacacaucgccggcagccgagacuacaccaugaaccuugcaucccuaaacuggaacaacuacgaccccaccgaagaaacaccggccccacucggcacacccgacuucgucggcaaaauccaaggcaugcuuacccaaaccacaaaaggcgacgguagcacccgcggucacaaagcaaccgucuacacagguucagcuccauucaccccaaaacuuggaucaguccgcuuuagcacagacacagagaacgacuucgaaacccaccaaaacaccaaauucacaccaguuggcgucauccaagacggcucaacaacacacagaaacgaaccccaacaauggguccuaccauccuacaguggucgagacguccacaacguccaccucgcacccgcaguagcaccaaccuuccccggcgaacaacuccucuucuuccgaagcaccaugccgggcugcucaggcuacccaaacauggaccucgacugccuccuaccccaagaauggguacaacacuucuaucaagaagccgcccccgcucaaagugacguagcccuacuucgcuuugucaaccccgacaccggacgagucuuauucgaaugcaagcuacacaaauccggcuacguaaccguggcccauaccggccaacacgaccucgucaucccgcccaacggcuacuuucgcuucgacuccugggucaaccaauucuacacccuagcccccaugggcaacgguacuggccgccgacgcuaa

SEQ ID NO: 38829 - RNA, 1617 nt, Artificial Sequence
  derived and/or modified sequence opt11 from VP1__Norovirus_and/or_Norovirus-like__HQ005298
augaaaauggcauccuccgacgccaacccauccgacgguuccaccgcaaaucuagucccagaagugaacaacgaagucauggcacuagaacccgucgucggugccgcaaucgccgcccccgucgcaggccaacaaaacgucaucgaccccuggauccgcaacaacuucguccaagcccccgguggcgaguucaccgucucaccccgcaacgcaccuggagaaauccuaugguccgccccacuaggccccgaccuuaacccauaccuaucccaccuaucccgcauguacaacggcuacgccggaggauucgaaguccaagucauacuagccggcaaugccuucaccgcuggcaaaaucaucuucgcagccgucccacccaacuuccccacugaaggccucucccccucccaagucaccauguucccccacaucauaguagacguccgacaacucgaacccguucucaucccccuccccgacguccgaaacaacuucuaccacuacaaccaaagcaacgaccccaccauaaaauuaaucgccaugcucuacacuccccuccgcgcaaacaacgccggugacgacgucuuuaccguuuccugucguguacuaacccgccccuccccagauuuugacuucaucuuccucguaccacccaccguagaaucccgaaccaaacccuucucaguccccguucucacaguagaagaaaugaccaacucacgcuuccccaucccccuagaaaaacucuucacuggccccucauccgccuucguuguacagccccaaaacggccgaugcacgaccgacggagucuuacuaggcaccacccagcucuccccagugaacauaugcaccuuccgcggcgacgucacacauaucuccggcuccagaaacuacaccaugaaccuugccagccaaaacuggaacuccuacgauccgacagaagaaauacccgcaccccucggaacuccugacuuugucggcaagauacaaggcguacucacccaaaccacccgcaccaauggcuccacccgaggacacaaagccaccgucuacacuggcuccgccgacuucagccccaaacuuggccgaguccaauucgccacagacaccgauaacgacuucgaaaccaaccaaaacacaaaauucacccccgugggcgucauucaggauggcucaaccacuccccgcaacgaaccacagcaauggguccuucccuccuacucgggucguaacauacacaauguccaccucgcccccgcugucgccccuaccuuuccaggagaacaacuacucuucuuccgcucaaccaugcccggcugcuccggcuaccccaacauggaccuagacugccuccucccacaagaauggguccaauacuucuaccaagaagccgcccccgcccaauccgacgucgcccuccuacgcuucguaaaccccgacaccggccgaguccuguucgaaugcaagcuccacaaauccggcuacguaaccgucgcccacaccggccaacaugaccucgucaucccaccuaacggcuacuuccgauucgacucuugggucaaucaauucuacacccucgccccaaugggcaacggcacaggacgacgccgcuaa

SEQ ID NO: 38830 - RNA, 1617 nt, Artificial Sequence
  derived and/or modified sequence opt11 from VP1__Norovirus_and/or_Norovirus-like__HQ005296
augaaaauggccuccucagacgccaacccauccgacggauccaccgcuaaccuaguacccgagguaaacaacgaggucauggccuuagaaccagucgucggcgccgccaucgccgccccuguagccggccaacaaaacguaaucgaucccuggauucgcaacaacuucguccaagcuccaggaggagaguucaccgucagcccccgaaaugcacccggcgaaauccucuggagugcaccacugggacccgaccuaaacccauaccuaucccaccucucccgaauguacaacggauacgccggcggcuucgagguacaagucauccucgccggcaacgcauuuaccgccggaaaaauaauauucgcagcaguaccacccaacuuccccacugaaggucuaagcccgucccaagucaccauguucccucacaucaucgucgacguccgccaacuugaaccaguccugauaccacugcccgacguccgcaacaacuucuaccacuauaaccaauccaacgaccccacaaucaaacucauagcaaugcucuauacuccccuccgagccaauaacgccggagacgacguuuucaccgucucaugccgcguccuuacuagaccaucaccagacuucgacuucauauuccucguaccacccaccgucgaaucacgcaccaaaccauucuccgugccaguccugaccguagaagaaaugacuaacucaagauucccuaucccccucgagaaacucuuuaccggcccaucuuccgcauucgucguacaaccccagaacggccgcugcaccacagacggcguccuacuaggcaccacgcaacuaucacccguuaauaucugcaccuuccgcggcgacguuacccacauccccggcucacgcaacuacaccaugaaccuagcuucacaaaacuggaacuccuacgaccccaccgaagaaauccccgcaccucucggcacgcccgacuucguuggaaaaauccaaggcguacucacccaaaccacccggaccaacggcucaacccgcggccacaaagccaccguauacacuggauccgccgacuucagcccuaaacucggccguguacaauucgccaccgacaccgacaacgacuuugagacaaaucaaaacaccaaauucacccccguaggaguaauccaagacggauccacaacaccacguaacgaaccccagcaauggguacucccuuccuacagcggccgaaacacccacaacguccaucuagccccagccguagcccccacauuccccggcgaacaacuccucuucuuucgauccacaaugcccggcugcucuggcuaccccaacauggaccucgacugccuacuaccacaagaauggguccaauacuucuaccaagaagccgcccccgcccaauccgacgucgcccuccuacgauuugucaacccagacacuggccgcgugcuuuucgaaugcaagcuccacaaauccggauacgucaccgucgcacacaccggccaacacgaccuagucaucccuccaaacggcuacuuccgcuucgacuccugggucaaccaauucuacacauuagccccaaugggaaauggaaccggccgccgccgcuga

SEQ ID NO: 38831 - RNA, 1617 nt, Artificial Sequence
  derived and/or modified sequence opt11 from VP1__Norovirus_and/or_Norovirus-like__HM802555
augaaaauggcaucaaacgacgccuccccaucagacggauccaccgccaaccucgucccagaaguaaacaacgaagucauggcucuagaaccaguagucggcgccgccaucgcagcacccgucgccggacaacaaaacguuauugacccuuggauucgaaacaacuucguccaagcucccgggggcgaguucaccgucuccccacgcaacgcccccggagaaauccucugguccgcccccuuaggcccagaccuaaacccauacuuaucacaccuagcacgaauguacaacggcuacgccgguggcuuugaaguccaaguaauauuagccggaaacgccuucaccgccggcaaaaucaucuucgccgccgucccaccaaacuucccaaccgaaggacucucacccucccaagucaccauguucccccauaucaucguagacguucgccaacucgaacccguacucauaccacuccccgacguucgcaacaacuucuaccacuacaaccaguccaacgacucuacaauaaaacuaaucgcuaugcucuacaccccacuccgcgcaaacaacgcaggcgacgacgucuucaccgucuccugccgcguacucaccagacccucccccgacuucgacuucaucuuuuuagucccaccaaccguagaaucacgcaccaaaccauucacugucccaaucuuaacuguagaagaaaugacgaacucccgcuuccccauaccccucgaaaaacuauucaccggucccucauccgccuucgugguacaaccacagaacggucgaugcaccacagacggcguccuccucggcaccacacaacucucccccguaaacaucuguacauuccgaggcgacgucacccacauaccaggcaccagaaccuaccguaugaaccucgcaucacaaaacuggaacaacuacgaccccaccgaagaaauccccgcaccccucggaacucccgacuucguaggcaaaauccaaggaaugcucacacaaaccaccaaaggcgacggcuccacccggggacacaaagccacagucuccacaggcuccgucgacuucacccccaaacuaggaucaguccaauucgcaaccgacacugacaacgacuucgaaacaggccaaaacacccguuucacccccguaggcguuauccaagauggcagcucagcacaccgcaacgaaccacaacaauggguccuucccgacuauucaggacgcaccguccacaacguucacuuagcaccggccgucgcccccaccuucccaggcgaacaacuccuuuucuuccgauccacaaugcccggcugcuccggcuaccccaacauggaucuagacugccuccucccccaagaauggguccaacacuucuaccaagaggcugcccccgcccaaucagacguagcccuccuccgcuucgucaacccagacaccggccgcguacucuucgaaugcaaacuccauaaaaccggcuacgucaccguagcucacaccggacaacacgaucucguaaucccaccaaacggcuacuucagauucgacuccugggucaaucaauucuacacccucgcccccaugggcaacggugcaggacgccggcgcuga

SEQ ID NO: 38832 - RNA, 1617 nt, Artificial Sequence
  derived and/or modified sequence opt11 from VP1__Norovirus_and/or_Norovirus-like__GQ246801
augaaaauggcauccuccgacgcccaucccuccgacggcuccaccgcuaaccuaguacccgaagucaacaacgaagucauggcccucgaacccgucgucggcgccgccaucgccgcccccguagccggacaacaaaacgucaucgaccccuggauccguaacaacuucguccaagccccaggcggcgaauuuaccgucucaccccgaaacgcccccggcgaaauucuaugguccgcaccccuaggcccugaccuuaacccauaccucucccaccuagcccgcauguacaacggcuacgccggaggcuucgaaguccaaguaauucucgccggaaacgccuucaccgcagggaaaaucaucuucgcagcaguaccacccaacuuucccacagaaggguuaucccccucccaagucacaauguuuccccauaucaucgucgauguccgccaacuagaacccguccuaauaccucuccccgacguccgcaacaauuucuaccacuacaaccaauccaacgaccccaccauaaaacuaaucgccaugcucuacaccccacuacgcgccaacaacgccggcgaugacguuuucacgguauccugucgcguccucacccgacccucucccgacuucgacuuuaucuuccuaguacccccaaccgucgaaucccguaccaaacccuucuccguccccguccucaccgucgaagaaaugacuaacagcagauuccccauaccucucgaaaaacucuucaccggccccuccuccgcuuucguaguucaaccccagaacggacguugcacaaccgacggcguucuccucgguaccacacaacucucaccugucaacauaugcaccuuccguggugacgucacccacaucccuggaucccgcaacuacacuaugaaccuugccucccaaaauuggaacuccuacgacccaacagaagaaaucccagccccacucggaacacccgacuucgucggcaaaauccaaggcguccucacccaaacuacccgcacgaacggauccacccgcggucauaaagccacagucuacaccggauccgccgacuucuccccaaaacucggucgcguccaauuugccacugauacagacaacgauuucgaaacgaaccaaaacaccaaauucaccccagucggcguaauccaagacggcuccaccacgccacgcaaugaaccccaacaauggguccuccccuccuacuccggacguaauauacacaacguacaucucgcucccgcaguagcccccacguuccccggcgaacaacuucucuuuuuccgcucaaccaugccuggcugcuccggcuaccccaacauggaccucgacugccuacucccccaagaauggguccaauacuuuuaccaagaagccgcaccggcccaaucugacgucgcucuccuacgcuucgucaaccccgauacaggacguguccucuucgaaugcaaacuacacaaguccggcuacgugacaguagcguacacaggccaacacgaccuaguuaucccacccaacggcuacuuccgcuucgacuccuggguaaaccaauucuauacacuagcccccaugggcaacggcaccggcagacgacgcuga

SEQ ID NO: 38833 - RNA, 1617 nt, Artificial Sequence
  derived and/or modified sequence opt11 from VP1__Norovirus_and/or_Norovirus-like__AB504308
augaaaauggccucaaacgacgccagccccagcgacggcuccacagccaaccucguucccgaaguuaacaacgaagucauggcccuagagccaguagugggcgccgccauugccgcccccguugcaggccaacaaaacguaaucgacccauggauacguaacaacuucguccaagccccgggcggcgaguucacuguaucaccacgcaacgcccccggagaaauacucuggucugccccacugggcccugaccuaaaucccuaucucucccaccuagccagaauguacaacggauacgccggaggcuucgaaguccaagucauccucgccggcaacgcauucacagcaggcaaaaucaucuucgcagccgucccacccaacuuccccacagaaggccucucucccucccaagucacaauguucccacacauaaucguagacguacgccaacuagaacccguccucaucccccuccccgauguccguaacaacuucuaccacuacaaccaguccaaugacuccaccaucaaacuaaucgccaugcucuauacaccccuccgcgccaacaacgcaggcgacgacguauucaccguauccugcagaguccucacccggcccucccccgacuucgacuucauauuucuaguuccacccaccgucgaaucucgcacaaaaccuuucacagucccaauacuaaccgucgaagaaaugaccaacucccgcuucccaauaccucucgaaaaacucuucaccggcccuuccuccgccuucguaguucaaccccaaaacggccgcuguaccaccgacggcguccuacuaggcaccacccaacuaagccccguaaauaucugcacauuccgcggcgacgucacccacaucccaggaacucgcacauaccgaaugaaccucgccucacagaacuggaacaacuacgauccaaccgaagaaauccccgcaccccugggaaccccggacuucguaggcaaaauacaaggcaugcucacgcaaaccaccaaaggcgacggauccacacacggccauaaagccacaguaucaacaggcucagucgauuucacaccaaaacuagguuccguacaauucgccacagacacagacaaugacuucgaaaccggacaaaacacacgcuucacaccugucggaguaauccaagacggauccuccgcccaccggaacgaaccccaacaauggguccuccccgacuacucaggaagaacaguccacaauguccaccuagccccagccgucgcucccaccuuccccggcgaacaacuccuauucuuucgcucaaccaugcccggcugcuccggauaucccaacauggaccuagacugccuccuaccacaagaauggguccaacacuucuaccaagaagccgcccccgcacaauccgacguagcccuccugcgcuuugucaacccagacacuggccgcguacucuucgaaugcaaacuacacaaaaccggcuacgucaccgucgcccacaccggccaacacgaccucgugauaccacccaauggauacuuccgcuucgacuccuggguaaaccaguuuuacacacucgcccccaugggcaacggcgccggccggcgccgguga

SEQ ID NO: 38834 - RNA, 1617 nt, Artificial Sequence
  derived and/or modified sequence opt11 from VP1__Norovirus_and/or_Norovirus-like__DQ369797
augaaaauggcccccaacgacgccucccccucagacggcucgaccgcaaaccucguuccugaagucaacaacgaagugauggcccuggaacccgucguaggcgccgccauagccgcccccguggcaggacaacaaaacguaaucgaucccuggauccgcaacaacuucguacaagccccagggggagaauuuaccguaucuccccgaaacgccccaggugaaauccucugguccgcaccccucggcccagaccuaaacccauaccuaucacaccucgcccgcauguacaacggcuacgcaggcggcuucgaaguccaagucauccucgccgguaacgccuucaccgccggcaaaauaaucuucgccgcugucccaccaaacuuccccacugaaggccucucccccucucaaguaaccauguucccccacauaauagucgauguccgacaacuugaaccuguccucaucccccuacccgacgugcgcaacaacuuuuaccacuacaaccaaucuaacgacucgaccauaaaacucaucgcaaugcucuauacuccacuccgcgcaaauaacgcaggagacgacgucuucacggucuccugccgaguccuaacccgccccuccccagauuucgacuucaucuuccugguaccuccuacagucgaaucacgaaccaaacccuucaccguaccaauccucacagucgaagaaaugaccaacagccguuucccaaucccccucgaaaaacucuuuaccggcccaagcucagccuuugucguacaaccccaaaacggccguugcaccacugacggcguccuccucggcaccacccaacucuccccagucucuaucuguaccuuccgaggagacgugacacacauucccggcacccgcaucuaccgaaugaaccuagccucccaaaauuggaacaauuacgaccccaccgaagaaauccccgcaccccucggcacaccagauuucgucgguaaaauucaaggcaugcuaacacaaacaaccaaaggcgacggcucaacccgaggacacaaagcuacagucuccaccggcuccgucgauuucacacccaaacuaggcucgguccaauucgccacggacacagauaacgacuucgaaacgggccaaaacacccgauucacccccguaggcguaauccaagacggcuccucagcucaccgcaacgaaccccaacaauggguacuaccagacuacuccggacggacaguccacaacguacaccucgcccccgccguagcucccacauuccccggcgaacaacuacucuucuuccgauccaccaugcccggaugcucagguuaccccaacauggaccucgacugccuacuaccacaagaauggguccaacacuucuaccaagaagccgccccaucccaaucagacguagcccuacuccgcuucgucaaccccgacacaggccgaguccuauucgaaugcaaacuccacaaagccggauacgucaccgucgcccacaccggacaacacgaccuagucaucccacccaacggauacuuccgcuucgacuccuggguaaaucaauucuacacccuagcacccaugggcaauggcgcaggccgccgacgcuaa

SEQ ID NO: 38835 - RNA, 1617 nt, Artificial Sequence
  derived and/or modified sequence opt11 from VP1__Norovirus_and/or_Norovirus-like__LC177661
augaaaauggccucuagcgacgcaaacccgagcgauggcucagccgccaaccucguaccagaagucaauaaugaaguaauggcccucgaaccaguagucggcgcagccaucgcugcccccgucgcaggccagcaaaaugucauagaccccuggauccgcucaaauuucguucaagccccaggaggagaguucacaguaucccccagaaacgcccccggagaaauccucuggucugcaccccucggaccagaccucaaccccuaccucagccaccucgcacgaauguacaacggcuacgccggaggcuucgaaguccaagucauacucgcaggcaacgcauucaccgcuggcaaagucaucuucgccgccgucccaccaaacuuccccacugaaggccuuuccccaucacaaguuaccauguucccccacaucgucgucgacguacgucaacucgaacccguacucauaccacuccccgacguacggaacaacuucuaucacuacaaccaaucuaacgaccccaccaucaagcucaucgccaugcuauauacaccccuacgcgccaacaacgcaggggacgacguauucaccgucuccugcaggguccuaaccagacccuccaccgacuucgacuucauauuccucguaccucccaccgucgaaucacguaccaaacccuucuccguccccguccucaccguagaagaaaugacaaacucacgauuuccuaucccccucgaaaaacuuuucaccggcccuuccagcgcauucgucguacaaccccaaaacggacgaugcaccaccgacggcguccuacuaggcacuacccaacuaucacccguaaacauaugcaccuuccguggcgacgucacccauaucacaggcucacgaaacuacaccaugaaccucgcgucccaaaacuggaacaauuacgacccaacggaagaaauacccgccccacuaggaacccccgacuucgucggcaaaauucaaggcaugcucacacaaaccacccgaacagacggcucaacccgcggccacaaagcaaccgucuacaccggcagcgcagacuucgcuccaaaacucggccgaguccaauucgaaaccgacacugaucacgacuucgaagcaaaccaaaacacaaaauucaccccggucggcgucauacaagacggcuccacuacacaccguaacgaaccccaacaauggguccuccccucauacucaggccgcaacaccccaaacguacaccucgcaccagccgucgccccuacauucccaggagaacaacuccucuucuuccgaucaaccaugcccggcugcucaggauacccgaacauggaccucgacugccuacucccccaagaauggguccaauacuucuaccaagaagcagcacccgcacaauccgacgucgcacuccuucgguucgucaaccccgacacuggccgcgugcuuuucgaaugcaaacuacacaaaucaggcuacgucaccgucgcccacacaggucaacaugaccucgucaucccacccaacggcuacuucagauucgacuccuggguaaaccaauucuacacucuugcccccaugggcaacggcacgggccgccgacguuaa

SEQ ID NO: 38836 - RNA, 1617 nt, Artificial Sequence
  derived and/or modified sequence opt11 from VP1__Norovirus_and/or_Norovirus-like__LC175468
augaaaauggccagcuccgacgccaaccccuccgauggcuccgcggcaaaccucguacccgaagucaacaacgaaguaauggcccuagaacccgucguaggagccgccauagccgcacccguagccggccaacagaacgucaucgaccccuggaucagaaacaacuucguccaagcucccggcggcgaguucaccguaucaccccgaaacgcccccggagaaauccucugguccgcaccacucggacccgaccuuaaccccuaccuaucccaccucgcacgcauguacaacggcuacgccggcgguuucgaaguacaagucauauuagccggaaaugccuucacugccggcaagaucaucuucgccgcagucccuccaaacuuccccaccgaaggucucuccccaucccaagucaccauguucccccacaucaucguagacguccgccaacuagaacccguccuaaucccacuccccgacguccgcaacaacuucuaccacuacaaccaauccaaugacuccaccaucaaacuaaucgccaugcucuacacuccacuaagagcaaacaaugcaggcgaugauguauucaccgucucuugccgcguccucacacgucccucccccgacuucgacuucauauuccucgucccuccaacagucgaaucucgcaccaaacccuucuccguccccguacucaccguagaagaaaugaccaacucccgcuucccaaucccccucgaaaaacucuucacuggccccucauccgcauucguaguccaaccccaaaacggaagaugcaccacagauggcguacuacucgguaccacccaacuaucacccguaaacaucugcaccuuccgaggcgacgucacccacauaaccggaucccgcaacuacacaaugaaccucgccagucaaaacuggaacaacuacgaccccacagaagaaauacccgcaccccucggaaccccagacuucgucggcaagauacaagguaugcuaacccaaacaaccagaaccgacggcuccacccgcggccacaaagccaccgucuacacaggcagcgccgacuucgcccccaaacuaggccgaguacaauucgaaaccgacacagaccacgauuucgaggccaaccaaaauaccaaauucacucccgucggagucauccaggacggauccaccacacaccgcaacgaaccacaacaauggguccugcccuccuacuccgggcgaaacacacacaacguucaccucgcucccgccguggcgccuaccuuccccggagaacaacuucuauucuuccguucuaccaugcccggcugcuccggcuacccuaacauggaccucgacugucuccuuccccaagaauggguucaguacuucuaucaagaagcagcuccagcccaauccgacgucgcacuacugcgauucguuaacccagacaccggacgcguacucuucgaaugcaaacuacacaaauccggcuacgucacaguagcccacacuggacaacacgaccuaguaauaccgccaaauggauacuucagauuugauagcuggguaaaccaauucuacacacuagcacccaugggcaacggaaccggccgaaggagauaa

SEQ ID NO: 38837 - RNA, 1617 nt, Artificial Sequence
  derived and/or modified sequence opt11 from VP1__Norovirus_and/or_Norovirus-like__KX354137
augaaaauggcauccuccgacgccaaccccucagacggaucagcugcuaaccucguacccgaaguaucaaacgaaguaauggcccuugaacccguagucggcgcugcuaucgcagccccaguggcaggccaacaaaacauuaucgacccguggauccgcaacaacuucguccaagcccccggcggcgaauuuaccgucaguccacgaaaugcuccaggcgaaauccuauggucagccccucuaggacccgaccucaacccauaccucucacaccucgccagaauguacaacggcuacgcaggcggcuucgaaguucaagucauccuagcuggcaaugcauucacagcaggaaaaaucauauucgccgccgucccacccaacuuccccacggaaggccucucccccucccaagucaccauguucccacacauaaucguagacguccgacaacuugaacccguccuuaucccccugcccgacguccgaaacaacuucuaccacuauaaccaaagcaacgacccaaccaucaaacucaucgccaugcucuacacgccccuccgcgccaacaacgccggcgacgacguuuuuaccgucucaugccgcguccucacccgacccucuccagacuucgacuuuauuuuccuuguaccacccacuguagaaucccguacaaaacccuucuccguaccaauacuaaccguagaagaaaugaccaacucucgcuuccccaucccacucgaaaaacucuucaccggacccucauccgccuuuguaguccaaccccaaaacggucgaugcacuaccgacggcguccuccuaggcacaacccaacuaucccccgucaacaucugcacauuccgaggagacguuacccacauaacaggcucccacaacuacaccaugaaucucgcaucacaaaacuggaacaauuacgacccaacugaagaaaucccugcuccccuaggaaccccagacuucguaggcaaaauccaagguguccuaacccaaacaacccguuccgacgggucaacccgcggacacaaagccaccgucuacacaggaucagccgacuuugcuccaaaacuuggccgcguacaguucgaaacagacaccgacagagacuucgaaaccaaccaaaacaccaaauucacuccugucggcgucauccaagacggcacuaccgcucaccgcaaugaaccacaacaaugggugcucccaucauacagcggccgaaacauccacaacguacaucuagcccccgccgucgcacccaccuuccccggcgaacaacuacucagcuuccgauccaccaugccaggcugcucaggauacccaaacauggaccucgacugccuccucccgcaagaauggguccaauacuuuuaccaagaagcagcccccgcgcaauccgacgucgcccuacuucgcuuugucaacccagacacaggcagaguccuauucgaaugcaaacuccacaaaucuggcuauguaacaguagcacacaccggacaacacgaccucguaaucccgcccaacggcuacuuccgcuucgacuccugggucaaccaauucuacacacuagcccccaugggaaauggcacaggccgacgccgcuaa

SEQ ID NO: 38838 - RNA, 1617 nt, Artificial Sequence
  derived and/or modified sequence opt11 from VP1__Norovirus_and/or_Norovirus-like__KX354036
augaaaauggcaagcucagacgccaaccccucagauggauccaccgcaaaccucguccccgaagucaacaacgaagucauggcccucgaacccgucgucggcgccgccaucgcagcccccgucgccggacagcagaacguuauagaccccuggauccgaaacaacuucgugcaagccccaggaggcgaguucaccgucucaccccgcaacgccccaggcgaaauacucugguccgcaccacucggcccagaccucaaccccuaccucucacaccuagcacgcauguacaacgguuacgcaggcggcuucgaaguacaagucauucucgccggcaaugcuuucaccgcaggaaaaaucaucuucgcugcaguucccccaaacuucccuacagaaggacucucaccuucccaaguuaccauguucccacacaucauagucgacguccgccaacucgaacccguucuaauaccccuacccgacguccgcaacaacuucuaccauuacaaccaaagcaacgaccccaccauaaaauuaaucgcaaugcuuuacaccccucuacgcgccaacaaugccggugacgauguuuucacaguauccugccgcguacucacccgccccucccccgacuucgacuucauauuccuaguacccccgaccgucgaaucccgcacaaaacccuucuccgucccaguccucacagucgaagaaaugacaaacagccgcuuccccauaccucuugaaaaacucuucaccggcccauccucggccuucgucguccaaccccaaaacggucgauguacuacagacggaguccuccucggcacaacccaauugagccccguaaacaucugcaccuuuagaggcgacguaacgcauauaccgggaucuagaaacuacacuaugaaccucgcaucucaaaauuggaacuccuacgaccccaccgaggaaauccccgccccacuaggcucccccgacuucguaggcaagauacaaggcguccuaacucaaaccacgcgcacaaacggcagcacccgaggccauaaagcaaccgucuacaccggaucagcugauuuuagccccaaacucggcagaguccaauucgcaaccgauaccgauaaugacuucgaaacaaaccaaaauaccaaauucacccccgucggaguaauacaggacggcuccaccacaccucgaaacgaaccccaacaauggguccuacccagcuacuccggccgcaacauacacaacguacaccucgcacccgccguagccccaaccuuccccggcgagcaacuacuauucuuccgaagcaccaugccaggcugcucugguuacccaaacauggaccucgacugccuucucccacaagaauggguccaauacuucuaccaagaagcagcccccgcgcaauccgacguugcacuucuccgcuucgucaacccggacacaggccgcguccucuuugaaugcaaacuacacaaauccggauaugucaccguagcccacacaggccaacacgaccuugucaucccucccaacggcuacuuccgcuucgacucuuggguaaaucaauucuacacacuugcccccaugggcaacggcacaggacgccgacgauaa

SEQ ID NO: 38839 - RNA, 1617 nt, Artificial Sequence
  derived and/or modified sequence opt11 from VP1__Norovirus_and/or_Norovirus-like__KX354011
augaaaauggccucaucggacgcuaaccccuccgacggcagcaccgccaaccucgucccagaaguaaacaacgagguaauggcacucgaacccguagucggcgcugccaucgcugcccccgucgccggccaacaaaacguaauugacccauggauccgcucaaacuucguacaagcccccggcggugaguucaccgucucaccccgcaacgccccuggagaaauccucugguccgcaccccucggacccgaccuaaaccccuaccuuucacaccuagcccgcauguacaacggcuacgcaggcggguucgaaguccaagucauccuugccggcaacgccuucacagccggcaaaaucauauuugcugcaguacccccaaacuuccccaccgaaggacuauccccuucacaaguuacuauguucccccacauaaucguagauguccgccaacuugaaccaguccucaucccccuaccugacguacgcaacaacuuuuaccacuacaaccaauccaacgacuccaccauaaaacugaucgccaugcuauacacaccccuccgugccaacaacgccggcgaugacgucuucaccguguccugccgaguccucacccgccccucccccgacuucgacuucaucuuccucguacccccaaccgucgaaucccguaccaaacccuucuccguccccauccucaccgucgaagaaaugaccaacucccgcuuccccaucccccucgaaaaacucuucaccggccccucauccgccuucguaguacagccccaaaacggccgaugcaccaccgacgguguccuccucggcacaacccaacuuucccccgucaauauaugcaccuuccgcggcgacgucacacacauaccuggaucgcacaacuacaccaugaaccucgcgucccaaaauuggaacuccuacgacccaaccgaagaaaucccagcaccccucggaacaccggauuucgucggcaagauccaaggcguccucacccagaccacauccacgaaugggucgacacgaggccacaaagccaccgucuacaccggcuccgccgauuucagcccaaaacucggaagaguccaauucgccaccgacaccaacaacgacuucgaaaccaaccaaaacacaaaguucacucccgucggagucauccaagacggaaguaccacaccccgcaacgaaccccaacaguggguacuccccuccuacucaggacgaaacauccacaacguacaccucgcccccgccguagcccccaccuuccccggcgaacaacuucucuucuuccgauccaccaugcccggcugcucaggcuacccaaacauggaccuagacugucuccuuccacaagaauggguacaauacuucuaccaagaggcagcccccgcccaaucagacguagcccuucuacgcuucguaaauccagauaccggucgaguccucuucgaaugcaaacuccacaagucgggauacgucaccgucgcccacacuggccaacacgaccuagucauucccccaaacggcuacuuccgcuucgacuccugggucaaucaauucuauacucucgccccaaugggaaacggaaccggccgccgccgcuaa

SEQ ID NO: 38840 - RNA, 1617 nt, Artificial Sequence
  derived and/or modified sequence opt11 from VP1__Norovirus_and/or_Norovirus-like__LC153122
augaaaauggcaagcucagacgcuaacccuucggacggaucagccgccaaccucguacccgaagugaacaacgaagucauggcccucgaaccaguaguaggcgccgcaaucgccgcucccgucgccggccaacaaaaugucaucgaccccuggauacgcaacaacuucguacaagccccugguggcgaauuuacagucaguccccgcaacgcacccggcgaaauccucugguccgcaccccucggaccagaucucaaccccuaccucagccaucucgcacgaauguacaacggauacgccggcggcuucgaaguccaaguaauacuagcgggaaacgccuucacagcaggcaaaauaauauucgccgcagucccacccaacuuccccacagaaggccucucacccucccaaguuaccauguucccccacauaaucgucgacgugcgacaacucgaacccgugcuaauccccuuacccgacguacgaaacaacuucuaccauuacaaccaauccaacgacuccaccaucaaacuuauagcaaugcucuacaccccacuacgagccaacaacgcaggcgacgacgucuucaccguaucaugccgcguccucacacguccaucacccgacuucgacuucaucuuccuaguuccacccaccgucgaaucacgaacgaaacccuucucaguccccguacucacagucgaagaaaugaccaacucacgauucccaaucccccuagaaaaacucuucaccggcccauccagcgcauucgucguccaaccccaaaacggcagaugcaccaccgacggcgucuuauuaggcaccacacaacucucccccgucaacaucugcaccuuccgcggcgacgucacccacauaaccggcucacgaaacuacacaaugaaccuugucucacagaacuggaacaacuacgaccccacagaagaaauccccgccccucucggcacaccagauuucguaggaaaaauacaaggcaugcucacacaaaccacacgcaccgacggaucaacccgcggccacaaagccacaguauacacaggcuccgccgacuucgcacccaagcuaggccggguccaauuugaaaccgacaccgaccacgacuucgaagcaaaucaaaacacaaaauucacccccguaggcguuauccaagacggcuccacaacacacagaaacgaaccacaacaauggguccuaccauccuauucaggccgcaacacccacaacguccaccuagcccccgccgucgccccaacuuuucccggcgaacaacuccuguucuuccgaucaaccaugcccgguugcuccggauaccccaacauggaccucgacugccuccucccccaagaauggguacaauacuucuaccaagaagccgcacccgcccaauccgacgucgcccuccuacgcuucgucaaccccgacacaggacgcguccucuucgaaugcaaacuccacaaauccggauacgucaccgucgcccacaccggacaacacgaccucguuaucccucccaacggcuacuuccgauucgauucaugggucaaccaauucuacacccucgcccccaugggcaacgguaccggacgccgccgcuga

SEQ ID NO: 38841 - RNA, 1617 nt, Artificial Sequence
  derived and/or modified sequence opt11 from VP1__Norovirus_and/or_Norovirus-like__KR131777
augaagauggcauccuccgacgcaaacccaagcgacggaucaacagcuaaccucguacccgagguaaacaacgaagucauggcccuagaacccgucgucggcgccgccaucgccgcacccgucgcagggcaacaaaacgucaucgaccccuggauaagaaacaauuucguccaagcaccaggaggagaguucaccguuagcccccgcaacgcucccggcgaaauccucugguccgccccacucggaccagaccuuaaccccuaccuuucacaccuagcccgcauguacaacggauacgccggcggcuucgaaguccagguaauccucgccggcaacgccuuuaccgccggcaagaucaucuucgcagccguaccacccaacuucccaaccgaaggccugucacccucacaaguaaccauguucccccacauuaucgucgacguacgacaacucgaacccguccugauccccuuacccgacguccgcaacaacuucuaccacuacaaccagaguaacgaccccaccauaaaacuuaucgccaugcucuacaccccacuccgagcuaacaacgccggcgacgaugucuucaccgucucuugccgaguccucacccgaccaucccccgacuucgacuucaucuuccuagucccuccaacugucgaaucccgaacuaaacccuucucgguacccguccucacagucgaagaaaugaccaacaguagauucccaaucccccuagaaaaacucuucacaggaccauccuccgccuucgucguacaaccccaaaacggccgcugcacaaccgacggcguccuccucggaaccacccaacucagccccgucaacaucugcaccuuccgaggcgacgucacccacauccccggcucacguaacuacacaaugaaccuagcaucacaaaacugguccucauacgacccaacagaagaaauacccgcaccccucggcaccccggacuucgucggcaaaauacaaggaguccuaacccaaacaacacgaacaaacggcucuacccgcggacacaaagccacugucuacacaggcuccgccgacuucuccccaaagcucggccguguccaauucgccacagacaccgacaacgacuucgaaacaaaccaaaacaccaaauucacccccgucggcguuauacaagacggcucuaccacaccucgcaaugaaccucaacaaugggucuuaccauccuacucaggccgcaacauacacaacguucaccuugccccagccgucgccccgaccuucccaggcgaacaauuacucuucuuccgaucaacaaugccagguugcaguggcuacccaaauauggaccuugacugccuccucccccaagaauggguccaguacuuuuaccaagaagccgcucccgcucaaucagaugucgcccuacucagauucguuaacccagacaccggcagagucuuauucgaaugcaaacuucacaaguccggcuacguuacagucgcucacaccggccaacacgaccucgucauacccccaaacggcuacuuccgcuucgauucuugggucaaccaguuuuacacacucgcacccaugggcaauggcacaggccgccgccgauaa

SEQ ID NO: 38842 - RNA, 1617 nt, Artificial Sequence
  derived and/or modified sequence opt11 from VP1__Norovirus_and/or_Norovirus-like__AB933764
augaaaauggcauccagcgacgcaaaccccuccgacggcucuaccgcaaaucuugucccagaagucaacaacgaaguaauggcccuagaaccagucguaggagccgccaucgccgcaccaguugccggccaacaaaacguaauagaccccuggauucgcaacaacuucguccaagcccccggaggggaguucaccguaucaccccgcaacgcccccggcgaaauccuaugguccgcuccccuuggccccgaccucaaccccuauuuaucucaccuugcacgaauguacaacggcuacgccgguggcuuugaaguccaagucauacucgcaggcaaugcauucaccgccggcaaaaucauuuucgccgccguaccucccaacuuccccaccgaaggccucucacccagccaaguaaccauguucccccacauaaucguagacgucagacaacucgaacccguccuaauuccccuccccgacguacgcaacaacuucuaccacuacaaccaacuaaaugaucccaccauuaaacuaauagccaugcuauacacaccccuacgagcaaacaaugccggugacgauguuuucaccgucuccugccgcguucucacccgucccuccccugacuucgacuucauuuuccucgucccaccaaccgucgaaucccgaaccaaaccuuucucgguacccguccuuaccgucgaagaaaugacaaacucgcgcuucccaaucccacuugaaaaacucuucacuggccccagcuccgcauucgucguccaaccccaaaacggccgcuguacaacugacggaguacuccuugguacaacccaauuaagcccugucaacauaugcaccuuccgcggagacgucacccacauccccgguucccgcaacuacacuaugaaccuugcaucccagaacuggaacuccuacgaccccacagaagaaauccccgcuccccuuggcacccccgacuucgucggcaagauccaaggaguccuaacccaaaccacaagaacaaacggauccacccgcggccacaaagccaccguauacaccgggucagccgacuucucuccuaaauuaggaagaguccaauucgccacagacaccgacaacgacuucgaaaccaaccaaaacacaaaauucacccccgucggcguaauccaagacggcuccacaacccccagaaacgaaccccaacaguggguccuacccagcuacagcggccgaaacauccacaacguccaccuagcucccgcagucgccccaacauuccccggagaacagcuccucuucuuccgaucuacaaugcccggcugcuccggcuaccccaacauggaccucgacugccuccuaccccaagaauggguccaauacuucuaccaagaagccgcccccgcccaaucugacgucgcccuccuccgauucgucaaccccgacaccggccguguccucuucgaaugcaaacuccacaaaucaggcuacgucaccgucgcccacacuggccaacacgaccuagucaucccacccaacggcuacuucagguucgacucauggguaaaucaauucuacacccucgcccccaugggcaacgguaccgggcgacgacgcuaa

SEQ ID NO: 38843 - RNA, 1617 nt, Artificial Sequence
  derived and/or modified sequence opt11 from VP1__Norovirus_and/or_Norovirus-like__LC016600
augaagauggccuccaacgacgccucccccucagacggcucuacagcaaaccucgucccagaagucaacaacgaaguaauggcacucgaaccaguugucggcgccgccauagcagccccaguagccggacaacaaaacguaauagaccccuggauccgaaacaacuucguccaagcccccggcggagaguucaccguaucacccagaaacgcccccggcgaaauccuuugguccgcgccacucggacccgaccuuaacccuuaccuaucacaccuagcucgaauguacaacggcuacgccggcggcuucgaaguccaagucauccucgccgggaacgccuucaccgccggcaaaaucauauuugccgcagucccacccaauuuucccacugaaggccuaucccccucccaagugaccauguucccccacaucauuguagacguaagacaacucgaaccaguacucaucccccucccagacguacgcaauaacuuuuaccacuacaaccaauccaacgacucaaccaucaaacucaucgccaugcuuuacacaccccuccgcgcaaacaacgccggagacgacgucuucaccgucucaugccgcguucuaacccgccccucacccgacuuugacuucaucuuccuagucccacccacuguagaaucccgcaccaaacccuucacuguccccauccuaaccguagaagaaaugaccaacucccgcuuccccaucccacucgaaaaacucuucaccggcccauccucugcauucgucguacaaccccaaaacggcagaugcaccacagacggcguacuccuuggcacuacacaacucucaccagucaacauuugcaccuuccgcggcgacgucacacacaucccaggcaccuccaccuaccguaugaaccucgcaucacaaaacuggaacaacuacgacccaacagaagaaauacccgccccacucgguacccccgacuucguaggcaaaauccagggcaugcucacccagaccaccaaaggagacgguuccacccgcggccacaaagccacagucucaacaggcucagucgacuucaccccaaaacucggcuccguacaauuugccacagacacagacaacgacuucgaaaccggacaaaacacccgauucacacccgucggcgucauccaagacggcucaggagcccacagaaacgaaccucaacaauggguccucccaaacuacuccggcagaaccguccacaacguccaccuagcaccagccguagccccaaccuuccccggagaacaacuacucuucuuccgauccaccaugcccggcugcucaggauaccccaacauggaccuggauugccuucucccccaagaauggguucaacacuucuaccaagaagcagcccccgcccaaagcgacgucgcccuccuccgauuugucaaccccgacaccggccgcguacucuucgaauguaaacuccauaaaacaggcuacguaacgguagcccacaccggccaacacgaccuugucaucccgcccaacggcuacuuccgcuucgacucuuggguuaaccaguucuacacacuugcccccaugggcaacggcgcaggccgacgccgauaa

SEQ ID NO: 38844 - RNA, 1617 nt, Artificial Sequence
  derived and/or modified sequence opt11 from VP1__Norovirus_and/or_Norovirus-like__KJ433970
augaagauggccuccucagacgccaaccccucagacggcuccgccgcaaaccucguccccgaagucaacaacgaagucauggcccucgaacccgucgucggcgccgccauagccgcaccaguagcaggccaacagaacgucauagacccauggaucagaaacaacuucguccaagcaccaggaggcgaauuuacaguaagcccccgcaacgcccccggcgaaauccuaugguccgccccacucggccccgaccucaaccccuaccucucccaccuagccagaauguacaacggcuaugccggcggauucgaaguccaagucauccucgccggaaacgccuucacagcaggcaagguuauuuucgccgccgucccacccaacuuccccaccgaaggacuaucccccucacaagucacaauguucccccacauaguuguagacgugcggcaacucgaacccguccugaucccccuucccgacguccgaaacaacuucuaucauuacaaccaaucaaacgaccccaccauaaaacuaauagccaugcucuacacuccccuccgcgccaacaacgcuggcgacgacgucuucaccgucuccugccgcguccuaacccgccccagccccgacuucgacuucaucuuccuaguaccacccaccgucgaaucacgcaccaaacccuucuccguccccguccucacagucgaagaaaugacaaacucacguuuccccaucccccucgaaaaacucuucacaggccccucaucagccuucgucguucaaccacaaaauggaagaugcacaaccgacggaguccuacucggcaccacccaacuuagcccagucaacauaugcaccuuccgcggagacgucacccacaucacaggaagccgaaacuacacaaugaaucuagcaucccaaaacuggucaaauuacgaccccacagaagaaauccccgcaccacucggcacccccgacuucguaggaaaaauccaaggcguacucacccaaacaacccgcaccgacggaaguacgcgaggccacaaagcuaccgucuacacuggguccgccgacuucgccccaaaacuaggaagaguccaauuugaaacagacacagaccacgauuucgaagccaaccaaaacaccaaauucacaccugucggcgucauccaagacggcuccaccacccaccgaaacgaaccacaacaaugggugcuaccauccuacagcggccgcaacacacccaacguccaccuagcaccagcaguagcccccacauuuccuggagaacaacuccuguuuuuccgauccaccaugccaggaugcuccggcuaccccaacauggaccuagacugccuacuaccccaagaauggguccaauacuucuaccaagaagcagcccccgcacagagcgacgucgcacuccucagauucgucaaccccgacacuggcagagugcuuuucgaaugcaaacuacauaaaucccgauacgucaccguagcccacaccggucaacacgaccuagucaucccacccaacggcuacuuccgcuucgacucaugggucaaucaauucuacacccucgcccccaugggcaacggcaccggacgucgacgcuaa

SEQ ID NO: 38845 - RNA, 1617 nt, Artificial Sequence
  derived and/or modified sequence opt11 from VP1__Norovirus_and/or_Norovirus-like__KP176395
augaaaauggcauccuccgacgcaaaccccucagacgguagugccgccaaccuagucccagaagucaacaacgaaguaauggcccucgaaccaguagucggagcagccauugccgcccccguggcaggccaacaaaacgucauugaccccuggauccgcaacaacuuuguccaagcccccggaggcgaguucaccgucucaccccgcaacgcacccggcgaaauacucugguccgccccucuaggucccgaccuaaaccccuaccuuucccaucucgcccgcauguauaacggcuacgccggcggcuucgaaguacaaguaauccuagccggaaacgccuucaccgccggcaaggucauauucgcagccgucccacccaacuuccccaccgaaggccucucccccucccagguaacuauguucccacacaucguuguggacguacgccaacuugaacccguccuuaucccccuccccgacguccgaaacaacuucuaccacuacaaccaauccaacgaccccacaaucaaacucaucgccaugcuuuauaccccacuacgagccaacaacgccggugacgacguauucaccgucuccugccgcguacucacucgccccuccccugacuucgacuucaucuuccucguaccacccaccguagaaucccgcaccaaacccuucuccguccccguccucaccgucgaagaaaugacgaacucccgcuuccccaucccccucgaaaaacucuucaccggccccucauccgcauucgucguccaaccccaaaacggacgcugcaccaccgacggcguucuccucggaaccacacaacucagcccagucaacauuugcacauuccgaggcgacgucacccacaucacaggcucccgaaacuauaccaugaaccuagcaucacaaaacugguccaacuacgaccccacggaagaaauacccgcuccccucggaacaccagacuucgucggaaaaauccaaggcguccuuacccagacaacucgaaccgacggauccacucgaggucacaaagccaccguauacaccggcucugucgacuucgccccaaaacuaggccgaguacaauucgaaaccgacaccgaccacgacuucgaagcaaaucaaaauacuaaauucacacccgucggcguaauccaagacggcagcaccacccaccguaacgaaccccagcaauggguccucccuagcuauuccggaagaaacacccccaacguacaccucgcgccagccguggcucccacauucccgggcgaacaacuacuauucuuucgcuccaccaugcccgggugcuccggauacccaaacauggaccucgacugucuccuaccacaagaauggguccaauacuucuaccaagaagcagcaccagcccaauccgacgucgcccuccuccgcuucgucaaccccgacaccgggagaguccucuucgaaugcaaauuacauaaauccggcuauguaacagucgcccacacuggucaacacgaccuagucaucccacccaacggauacuuccgauucgacuccugggucaaccaauucuacacccucgcacccaugggcaacggcaccggccgccgacgcuaa

SEQ ID NO: 38846 - RNA, 1617 nt, Artificial Sequence
  derived and/or modified sequence opt11 from VP1__Norovirus_and/or_Norovirus-like__KM982947
augaaaauggcgucaagcgacgccaauccaucagacggaucagccgccaaccucguucccgaagucaacaacgaagucauggcccuggaacccgucgucggcgccgccauugccgcccccgucgccggacaacaaaacgucaucgacccauggaucagaaacaacuucguacaagccccaggcggggaguucacagucucaccccgcaacgcccccggcgaaauccuaugguccgcuccccuaggaccugaucuaaacccauaccucucacaccuagcccgcauguacaacggcuacgccggagguuucgaaguccaagucauccuagccggcaacgccuucaccgccggcaaaguaauauucgcagccguaccacccaacuuccccaccgaaggacuaucucccucacaaguaaccauguucccccacauagccgucgacguccgccaacuugaaccuguccucauaccccuacccgacguccgaaacaacuuuuaucauuauaaccaauccaacgaccccacaaucaaacuuaucgcaaugcucuacaccccacuacgcgccaacaacgccggcgacgacgucuucaccguaagcugccgcguccuuacucgcccuucccccgacuucgacuucauuuuccuagucccacccaccguagaaucccgcacaaaacccuucucaguucccguccuaacaguugaagaaaugacaaacucacgauuccccaucccccuagaaaaacuauucaccggucccuccuccgccuucgucguccaaccucaaaacggcagaugcaccaccgacgguguccuccucgguaccacccaacuuuccccagucaacaucugcacauuccgaggcgaugucacucacauaacaggcucccgaaacuacaccaugaaccucgccagccagaauugguccaacuacgaccccacagaagaaauccccgccccacuuggcaccccagauuucgucggcaaaauacaaggaguccucacccaaaccacccgcaccgacggaucaacccgcggccacaaggccaccgucuacaccggcuccgccgacuucgcccccaaacucggccgcguccaauuugaaaccgacacagaccacgacuucgaagccaaccaaaacaccaaauucacucccguaggcguaauccaagacggcgguacaacccaccgcaacgaaccccaacaauggguccuccccuccuacucaggccgcaacacacccaacguccaccucgcccccgcaguagcucccaccuuccccggagaacaacuacucuuuuuccgcucuacaaugcccggcugcuccggcuacccaaacauggaccucgacugcuuacuaccccaagaauggguacaauacuucuaccaagaagcugcccccgcccaauccgacgucgcccuacuacgauuugucaaccccgauacuggacgcguccuuuuugaaugcaaacuucacaaaagcggcuaugucaccguugcccacaccggccagcacgaccuagucaucccacccaacggcuacuuccgauucgacuccugggucaaccaauucuacacccucgcacccaugggcaacgguaccggccgacgccguuga

SEQ ID NO: 38847 - RNA, 1617 nt, Artificial Sequence
  derived and/or modified sequence opt11 from VP1__Norovirus_and/or_Norovirus-like__KJ685414
augaaaauggcauccuccgacgccaacccuuccgacggcuccaccgcaaaccuuguccccgaagucaacaacgaagucauggcucuagaacccgucguaggcgcagccaucgcagccccagucgccggacaacaaaacgucaucgacccauggauccgaaacaacuucguccaagcacccggaggcgaauuuacggucuccccacgaaacgcccccggcgaaaucuuaugguccgccccacuaggcccagacuuaaauccauaccucucccaccucgcccgaauguacaacggcuaugccggcggauucgagguacaaguuauccuagcaggcaacgccuucaccgccggcaagaucaucuucgcagcagugccacccaacuucccuacagaaggccucucccccucccaaguaacaauguucccccacaucaucgucgacguccgacaacucgaaccuguacucaucccacuccccgacguacgaaacaacuuuuaccacuacaaccaaagcuccgacccgacaaucaaacuaaucgcuaugcucuacaccccacuacgcgcuaacaacgcaggcgacgaugucuucaccguaucaugucgcguccucacacgccccucccccgauuucgacuucaucuuucucguacccccaaccgucgaaucccguaccaaacccuucagcgucccaguccuaaccguagaagaaaugacuaacaguagauuccccauuccucucgaaaaacucuucaccggaccauccucagccuuugucguacaaccccaaaacggucgcugcacaaccgacggcguacuccuuggcaccacccaacuuucgcccguuaauaucugcaccuuccgcggagacgucacacacauacccggaucccgcaacuacacaaugaaucuagcaucacaaaacuggaacucguacgaccccaccgaagaaaucccagccccacucggcacccccgacuucgucggaaaaauccaaggaguccucacccagaccacccgcacaaacggcuccacccgcggccacaaagccacugucuacaccggcuccgccgacuucucccccaagcucggccgcguccaauucgcaacagacacagacaacgacuucgaaaccaaucaaaacacaaaauucacccccgucggcgucauacaagacggauccaccacaccccgcaacgaaccccaacaauggguccuaccguccuacuccggccgcaacauacacaacguccaccuagcccccgccguagccccaaccuuccccggagaacaacuacuguucuucagaucaaccaugccuggcugcucaggcuacccgaauauggaccucgacugucuccucccccaagaauggguacaauacuucuaccaagaagcugcccccgcacaaucugacguagccuuacuccgcuucgucaaccccgacaccggccguguccucuucgaaugcaaacuacacaaauccggcuacgucaccgucgcgcacaccggccaacacgaccucgucauacccccaaacggauacuuccgauucgacuccuggguaaaccaauucuacacccuagccccaaugggcaacggcacuggacgccgacgauaa

SEQ ID NO: 38848 - RNA, 1617 nt, Artificial Sequence
  derived and/or modified sequence opt11 from VP1__Norovirus_and/or_Norovirus-like__KF060093
augaaaauggcauccuccgacgccaauccuucagauggauccaccgcaaaccucguccccgaagucaacaacgaagucauggcccucgaacccguugucggcgccgccauugcagcuccaguagccggccaacaaaacgucaucgaccccuggaucagaaacaauuucguccaagcccccggcggcgaguucaccgucucgccccgcaaugcaccaggcgaaauccucugguccgccccacucggcccugaucucaaccccuaccuuucacaccuagcccgcauguacaacggcuacgccggaggauucgaaguacaagucauccucgccggcaacgcauuuacagcaggcaaaauaaucuucgccgcaguuccacccaacuuccccaccgaaggacucagccccucccaagucaccauguucccccacauaaucguugacguccgccaacucgaacccguucucaucccccuucccgacguacgcaacaacuucuaccacuacaaccaauccaacgacccaaccaucaagcugaucgcaaugcucuacacaccccuccgcgcuaacaacgcuggagacgacgucuuuaccguauccugucgaguccucacucgaccaucccccgacuucgacuucaucuuccucguuccacccaccguggaaucccgcacaaaacccuucucugucccaguucucaccgucgaagaaaugacuaacucccgcuucccaaucccacucgaaaaacucuucaccggcccauccagcgcauucgucguccaaccccaaaacgguagaugcaccaccgacggcguacuccucggcacaacucaacuaucccccguaaacaucugcaccuuccgcggagacgucacccacaucucaggcucccgcaacuacacaaugaaccucgccucccaaaacuggaacaguuacgaccccacagaggaaauccccgcaccccucggcacccccgacuucgucggcaaaauccaaggcguacucacacagacaacucgcaccgacggcuccaccagaggacacaaggccacagucuacaccggcucagccgacuucucccccaaacuuggccggguccaauucgccacagauaccgacaacgacuucguuaccaaucaaaacaccaaauucacaccagucggcgucauacaagacggaaacacaacuccccgaaacgaaccccaacaauggguccuccccuccuacuccggccgcaacacccacaacguccacuuagcccccgccgucgcccccaccuucccaggcgaacaacuccuauucuuccgcucaaccaugccaggcugcuccggauaccccaacauggaccuugacugccuacucccccaagaguggguccaauacuucuaccaagaagccgcccccgcccaaucagacguagcccugcuacgcuucguuaaccccgacaccggucggguucucuucgaaugcaaacuacacaaaccaggauaugucacaguugcccacacgggccaacacgaucucgucauacccccaaacggauacuuccgcuucgacucuugggucaaccaguuuuacacccucgcccccaugggaaacggcacaggccgccgccgcuaa

SEQ ID NO: 38849 - RNA, 1617 nt, Artificial Sequence
  derived and/or modified sequence opt11 from VP1__Norovirus_and/or_Norovirus-like__KC456070
augaaaauggcaucaagcgacgccaaccccuccgacggcuccgccgcaaaccuaguucccaaaguaaacaacgaaguaauggcccuagaacccgucgucggagccgcuaucgccgcccccgucgccggccaacagaacguaaucgaccccuggaucaagaacaacuucguccaagcuccaggcggcgaguucaccguaucccccaaaaacgcccccggcgaaauccuaugguccgcaccucucggacccgaccucaauccauaccucucccaccuagccaaaauguacaacggauacgcaggcggcuucgaaguccaagucauacucgcaggcaacgccuucaccgccggaaaaguaaucuucgccgccgugcccccaaacuucccuaccgaaggccuuucaccuagccaagucaccauguucccacacauugucgucgacguacgacaacuagaaccugucuuaaucccacuaccagacguacggaacaacuucuaccacuacaaccaauccaacgacccgaccaucaaacucauagccaugcucuacacaccccuccgagccaacaacgccggugacgacgucuucaccgucuccugccgcguauuaacccgacccuccccugauuucgacuucaucuuccucguaccacccaccgucgaaucccgcaccaaaccuuucucaguuccaguccucacagucgaagaaaugacaaacucacgauucccaauaccacuagagaaacucuucacuggaccuucauccgcauucgucguccaaccccaaaacggccguugcaccaccgacggcguccuucuuggcaccacccaacuuucccccguuaacaucuguaccuucagaggcgacgucacacacaccaucggcucccgcaacuacacuaugaaccucgccucccaaaacuggaacaacuacgaccccacagaagaaauacccgcaccccucggcacccccgacuucgucgguaaaauccaaggcguacucacccaaacaacacgcaccgauggcuccacucgcggccacaaggccacuguauacaccggcuccgccgacuucgcccccaaacucggccgaguccaauucgaaacagacaccgaccacgacuucgaagccaaccaaaacaccaaauucacccccgucggcgucauacaagacggcagcaccacacaccgaaacgaaccccaacaauggguccuaccauccuacuccggccgcaacacucacaacguccaccucgcacccgccgucgccccaaccuucccaggcgaacagcuucuauuuuuccgaucaaccaugcccggcugcuccggcuacccaaauauggaccucgacugccuacucccccaagaauggguccaauacuucuaccaagaagccgccccagcacaaucagacguagcccuccuccgcuucguaaacccagacacaggcagaguccucuucgaaugcaaacugcacaagucaggcuaugucaccgucgcccacacaggccaacacgaccucgucauacccccaaacggcuacuuccgcuucgacuccuggguuaaccaauucuacacccuagcccccauggguaauggcacaggucgacgccgauaa

SEQ ID NO: 38850 - RNA, 1617 nt, Artificial Sequence
  derived and/or modified sequence opt11 from VP1__Norovirus_and/or_Norovirus-like__KC409299
augaaaauggccucaucugacgcaaaccccucugacggcuccacugcaaaccucgucccagaaguaaacaacgaagucauggcucucgaacccgucguaggcgcagccaucgccgcccccgucgccggccaacaaaacguaaucgaccccuggauccgcaacaacuucguccaagcucccggcggagaguucacagucucuccccgaaacgccccaggcgaaauccucugguccgccccacucggcccagaccucaacccauaucucucccaccucgcacgcauguacaacggauacgcaggaggauucgaaguccaagucaucuuagccggcaacgccuucaccgccgguaaaaucauauuugcagcagucccacccaauuuccccacagaaggccucucacccucucaagugaccauguuuccccacaucaucguagacguccgccaacucgaacccguccucauuccccuccccgacguccgcaauaacuucuaucacuacaaccaaucgaacgaccccacaaucaaacuaaucgccaugcucuacacaccccucagagccaacaacgcaggcgacgacguauucaccgucuccugccgcguccucacccgcccuucccccgacuucgacuucaucuuccucguaccucccaccguagaaucccgcaccaaacccuucuccguucccguacuuacuguagaagaaaugaccaacucacgauuccccaucccccuagaaaaacucuucaccggccccucuaacgccuucgucguccaaccacaaaacggccgcugcaccaccgacggaguacuucugggaaccacucaacuuucacccguaaacaucugcacuuuucgcggcgacgucacccacauccccggaucccgcaacuacaccaugaaccuagccucacaaaacuggaacuccuacgaccccacagaagaaaucccggcaccucucggcacccccgacuuugucggcaaaauacaaggcgucuuaacccaaaccacacgaaccaacggauccacacgaggccauaaagcuacaguauacaccggcuccgccgacuuuucuccaaaacucggacgcguacaauucgcaaccgacacagacaacgacuucgaaacuaaccaaaacacaaaauucacgcccguaggaguuauccaagacggcucuaccacaccccgcaacgaaccacaacaauggguccuaccaucauacucaggcagagacguacacaacguacaccucgcccccgccgucgcccccacuuuccccggcgaacagcuccuauucuuccgcuccacaaugccuggcugcucaggcuacccaaacauggacuuagacugccucuugccucaagaauggguccaauacuucuaccaagaagccgcacccgcccaauccgacguugcccuucuccgcuucguaaaucccgacacaggccgcguacuguucgaaugcaaacuccauaaauccggauaugucacagucgcccacaccggacaacacgaccucgugauaccaccaaacggcuauuuccgcuuugacuccugggucaaccaauucuacacccuagcccccaugggaaacggaacaggccgcaggagauaa

SEQ ID NO: 38851 - RNA, 1617 nt, Artificial Sequence
  derived and/or modified sequence opt11 from VP1__Norovirus_and/or_Norovirus-like__JX984947
augaaaauggccagcaacgacgcaaacccauccgacggauccgccgccaaccucguucccgaaguaaacaacgaagucauggcacucgagcccgucgucggcgccgcaaucgcagccccagucgccggccaacaaaacguaaucgaccccuggauccgaaacaacuuuguccaagccccaggaggagaguucacagucucccccagaaacgcacccggcgaaauauuaugguccgcaccccuaggacccgaccucaaccccuaccuaucacaccuagcccgaauguacaacggauaugcuggcggcuucgaaguccaagucauacucgccggcaacgccuucaccgccggaaagaucaucuucgccgcaguuccacccaacuuucccacggaaggacuuucacccucucaagucaccauguucccacacauaaucgucgauguccgucaacucgaaccaguuuuaauaccccuccccgacguacgcaacaacuucuaccauuacaaccaguccaacgacuccacaaucaaacucaucgcuaugcuauauacaccccucagagcuaacaacgccggcgaagacgucuucaccgucuccugccgcguccucacccgccccuccuccgacuuugauuucaucuuccucguaccacccaccgucgaaucacggaccaaacccuucacaguccccauacucacagucgaagaaaugaccaacucuagauuccccaucccccuagaaaaacucuuuacaggacccucuuccgcauucguaguacaaccccaaaacggccgcugcacuacagacggaguccuccucggcaccacccagcuuuccccggucaauacaugcaccuuccgaggcgacgucacacacaucgccgguucucguaacuacaccaugaaccucgcuucacuuaacuggaacaacuacgaccccaccgaagaaauccccgcaccucuaggaaccccagacuucguaggcaaaauccaaggcguccuaacacaaacaaccaagggcgacggcagcacccgaggccacaaagccacgauauacaccggaucagcccccuucacccccaaacucggcucuguacaauucaauacagacaccgaaaacgauuucgaaacccaccaaaacaccaaauucacucccguaggcgucauccaagacgggggcaccacacaccgcaacgaaccccaacaauggguacuaccauccuacucuggccgcaacauccccaacguccaccucgcccccgccgucgcccccaccuuccccggagaacaacuccuuuucuuccgcuccaccaugcccggcugcuccgguuaccccaauauggaccuagacugccuccuaccccaagaauggguccaacauuucuaccaagaagcugccccugcccaauccgacguugcacuccuacgcuucgucaaccccgacaccggcagaguacuauuugaaugcaaacuccacaaaucaggauaugucacuguggcgcacacaggacaacacgaccucgucauaccacccaacggguacuuccgcuucgacuccugggucaaucaauucuacacccuagcucccaugggaaacggcacuggcagacgccgcuga

SEQ ID NO: 38852 - RNA, 1617 nt, Artificial Sequence
  derived and/or modified sequence opt11 from VP1__Norovirus_and/or_Norovirus-like__KC175385
augaaaauggccuccuccgacgccaaccccuccaacgguucaacagcaaaccuagucccugaaguaaacaaugaagucauggcccuagaacccguagucggcgccgcaauagccgccccaguagccggacaacagaacgucaucgaccccuggaucagaaacaacuucguacaagcccccggaggcgaguuuaccgucaguccccgaaacgccccuggugaaauccucugguccgcgccccuuggacccgaucucaaccccuaccucucccaccuagcccgcauguacaauggauacgccggcggcuucgaaguccaaguaauacucgccggaaacgcauucaccgccggaaaaaucaucuucgccgcuguaccucccaacuucccaaccgaaggccugagcccaucacaggucacaauguucccccacaucaucgucgacguccgccaacuagaacccguacuaaucccacucccugacguccgcaacaacuucuaccacuacaaccaauccaacgaccccaccaucaaacuuauagccaugcucuacacaccacuccgcgccaacaacgccggcgacgauguuuucaccguaucaugccguguccuaacccgccccucccccgacuuugacuuuaucuuccucguaccaccaaccgucgagucacgaacaaaacccuucuccgucccuguacucacagucgaagaaaugaccaacucccgcuuccccaucccucuagaaaaacuauuuaccgggcccucaucagccuucgucguacaaccccaaaacggccgcugcaccaccgacggaguccuccucggcaccacccagcuuucaccgguaaacaucugcaccuucagaggcgacguuacacacauacccuccucccacaacuacaccaugaaccuggcaucccaaaacuggaacucauacgaccccacagaagaaauccccgcaccccuaggaacacccgacuucguaggaaaaauccaaggcguucucacccaaaccacccgcacagacggcucaaccagagggcacaaagccacaguauacaccggcucagccgacuucuccccaaaacucggccgcguccaauucgcaaccgacacggacaaugacuuccaaacaaaucaaaauaccaaauuuacaccaguaggcgucauucaagacggcucaaccacaccccgaaacgaaccucaacaauggguccuacccuccuacucaggucgcaacauacacaacguccaccucgccccugcaguagcccccaccuuccccggcgaacaacuacucuucuuccgcuccaccaugcccggauguuccggauaucccaacauggaccucgacugccuacucccccaagaauggguacaauacuuuuaccaagaagcugcccccgcccaguccgacguugcauuacuccgcuucgucaaucccgacaccggucgaguccucuuugaaugcaaacuacacaaguccggauacgucacaguagcccacaccggccaacacgaccucgucaucccuccgaacggcuacuuccguuucgacuccugggucaaccaauucuacacccucgccccaaugggaaacggcaccggacgcagacgauag

SEQ ID NO: 38853 - RNA, 1617 nt, Artificial Sequence
  derived and/or modified sequence opt11 from VP1__Norovirus_and/or_Norovirus-like__JQ613563
augaaaauggccuccuccgacgccaaccccuccgacggcuccaccgcaaaccucguacccgaagucaacaaugaaguuauggcccucgaacccgucgucggcgcagccaucgcagcccccguugcuggccaacaaaacguaaucgaccccuggauccgcaacaacuucguccaagcucccggcggcgaguucaccguaucgccccgcaacgccccaggcgaaauccucugguccgcaccccucggccccgaccuaaaccccuaucucucccaccuagcccgaauguacaacggcuacgccggaggcuucgaaguccaagucauccuagccggaaacgccuucaccgccggcaaaaucaucuucgccgcaguacccccuaacuucccaaccgaaggucucucccccucccaagucaccauguucccccacaugauagucgauguccgccaacucgaacccguccucauaccccuccccgacguccgcaacaauuuuuaccauuauaaccaaucaaacgaccccacaaucaaacucauagccaugcuauacacaccccuccgugccaacaaugccggagacgaugucuucaccgucucgugucgcguacucacacgucccucaccugauuuugacuucauauuccuagugcccccaaccgucgaaucucgaacaaaacccuucuccguccccguccuaaccgucgaagaaaugacaaacuccagauuccccauuccacuagaaaaacuauucaccggcccauccucagccuucgucguccaaccccaaaacggccguugcaccacagacggaguccuucucggcaccacccaacucucccccgucaacauaugcacauucagaggcgacgucacccacacccccggcucacacaacuacaccaugaaucucgccagccaaaacuggaacuccuacgaccccaccgaagagaucccugcuccccuaggaacccccgacuucgucgggaaaauacaagguguacucacccaaacuacacgaacaaauggcagcacacgcggccacaaagccaccgucuacaccggcuccgccgacuucucuccaaaacucggccgcguccaauucgccacagacacagauaaugacuucgaaaccaaccaaaauaccaaauucacccccguaggcgucauacaagauggcagcaccacaccccgcaacgaaccccagcaauggguccuaccaucauacuccggccgcaacauccauaacguucaccucgcaccagccguagcucccaccuuccccggcgaacaacuccucuucuuccgcucaaccaugcccggcugcucaggcuacccaaacauggaccuagacugccuccucccccaagaauggguucaauacuucuaccaagaagcagcccccgcacaauccgacgucgcccuccuacgauucgucaaucccgauaccggccgaguccucuucgaaugcaaacuacacaaaucgggcuacguaaccgucgcccacacaggacaacaugaccucgucaucccacccaacggcuacuuccguuucgacucauggguaaaccaauucuacacccucgcccccaugggaaacggcaccggcagacgccguuaa

SEQ ID NO: 38854 - RNA, 1617 nt, Artificial Sequence
  derived and/or modified sequence opt11 from VP1__Norovirus_and/or_Norovirus-like__JQ613558
augaaaauggcaagcuccgacgccaacccauccgacgguucaaccgccaaucuuguccccgaagucaacaaugaaguaauggcucucgaacccguagucggcgccgccaucgccgcacccgucgcuggccaacaaaacgucaucgaccccuggauccgaaacaacuucguccaagcucccggaggcgaguucacggucucaccccgaaacgcccccggcgaaauccuuugguccgcuccccuaggcccggaccucaacccauaccuuucccaccuugcacgcauguacaacggcuacgccggaggauucgaaguccaaguaauccucgccggcaacgccuucaccgccggcaaaauaauauuugccgccguucccccuaauuucccaaccgaaggacucucucccucccaagucaccauguucccccacauuaucguagacguccgccaacuagaacccguacuaauaccacuccccgaugugcgcaacaauuucuaccacuacaaccaauccaacgaccccacuauuaaacucauagccaugcuauacacaccccuacgcgccaacaacgcgggagacgaugucuucacggucuccugccgcguccucacucgccccucccccgacuucgacuuuaucuucuuagucccacccaccgucgaaucccgcaccaagccauucuccguccccguacucaccgucgaagaaaugaccaacucccgauucccaauuccucucgaaaaacucuucaccggcccaucauccgcauucguaguccaaccccaaaacggacgcugcacgaccgacggaguccuacucggaacaacccaacuuucaccagucaacaucugcaccuuccgcggcgaugucacccacaucccaggcucccgaaacuacaccaugaaccuagcaucccaaaacuggaacucauacgaucccaccgaggaaauccccgccccucuaggaacacccgacuucgucggcaaaauccaaggcguacuaacucaaacuacccgaaccaacggcagcacccgcggccacaaagccaccgucuacaccggcuccgccgacuucucucccaaacuagguagaguccaauucgccacagacaccgacaacgacuucgaaacaaaccaaaacaccaaauucacccccgucggcgucauacaagacggcuccaccacgccucgcaacgaaccacaacaauggguacuccccucauacuccggccgaaacauucacaacguacaucuagcacccgcagucgcccccacuuucccaggcgagcagcuccuguucuuccgcuccaccaugccaggaugcuccggauacccaaacauggaccuagacugccuacucccucaagaguggguacaauacuucuaccaagaagccgcaccggcccaauccgacgucgcccuccuccgauucguaaaccccgacaccggccgcguccucuucgaaugcaaacuccacaaaagcggcuacgugacagucgcacacaucggacaauacgaccucgucauacccccaaauggcuacuuccgcuucgacuccuggguuaaccaauucuacacccuagcccccaugggaaacggcaccggccgucgucgcuaa

SEQ ID NO: 38855 - RNA, 1617 nt, Artificial Sequence
  derived and/or modified sequence opt11 from VP1__Norovirus_and/or_Norovirus-like__GQ856451
augaaaauggcauccaacgacgcaaaccccuccgacggcucaguugccaaccuaguccccgaagucaacaaugaagucauggcacucgaacccgucgucggugcagcaaucgcagcccccguagccggccagcaaaacgucaucgacccauggauacgaaacaacuucguccaagcacccggaggcgaauuuaccguaucaccccguaacgccccaggcgaaauccucugguccgcaccccucggccccgaccucaaucccuaccucucacaccuagcccgcauguacaacggauacgccggcggcuucgaaguccaagucauacucgccggcaacgccuucaccgccggcaagauuaucuucgccgccgucccucccaacuuccccacagaaggccucucccccucacaagucacaauguucccccacaugaucguagacguuagacaacucgaacccguacucaucccccucccagacguccgcaacaacuucuaccacuacaaccaaucuaacgacaguacuaucaaacucaucgccaugcucuacacaccccuccgagccgauaacgccggugaagacguauucaccguauccugccgcguacucacccgccccucacccgacuucgacuucaucuuccucguaccucccaccguagaaucaaaaaccaaacccuucaccguccccauccugaccguagaagaaaugacuaacucacgcuuccccaucccccuagaaaaacucuucacaggucccucaucaaccuucgucguccaaccccaaaacggacgcugcacaacggaugguguccuucucggcaccacccaacucuccccaguuaacaucugcaccuuccgcggcgacgucacccacauugccggcucgcgcaacuacaccaugaaccucgccuccuuaaacuggaacaacuacgaccccaccgaagaaauccccgcgccccuaggcaccccagauuucguaggaaaaauccaagggguacuaacacaaacuaccaaaggcgacggcuccacacgcggccacaaagccaccguuuauaccggaucagcaccauucacccccaaacucggauccguacaauucuccacagacaccgaaaacgacuucgaaacacaccaaaauaccaaauucacccccguuggagucauucaagacggcagcacgacacaccgaaacgaaccacaacaguggguccugcccuccuacucaggucguaacgugcacaacguccaccucgcacccgccgucgcccccacauuuccuggcgaacaacuccuguucuuccgaucaaccaugcccggcugcucuggauaccccaacauggaucuugacugccuccucccucaagaauggguccaacacuucuaccaagaagccgcccccgcccaaucugacgucgcacuacuacgauucguaaaccccgauacaggccgcguucuguucgaaugcaaacuccacaaaagcgguuacguaaccguagcccacaccggucaacacgaccucgucaucccacccaacggauacagccgcuucgacucaugggucaaccaauucuacacacucgcacccaugggcaacggcacaggccgccgcagauaa

SEQ ID NO: 38856 - RNA, 1617 nt, Artificial Sequence
  derived and/or modified sequence opt11 from VP1__Norovirus_and/or_Norovirus-like__DQ419908
augaaaauggcaagcaacgacgccuccccauccgacggcuccacagccaaccuagucccagaagucaacaacgaagucauggcccuugaacccgucgucggcgccgccaucgcugccccagucgccggccaacaaaacgucaucgaccccuggauacgcaacaacuucguucaagcccccggcggagaauuuaccguaucuccccgcaacgcccccggcgaaaucuuaugguccgcaccccucggcccggaccucaacccuuaccucucccaccuugcccgcauguacaacggauaugccggcggauucgaaguccaagucauacucgccggaaacgcauucacggcaggaaaaauaaucuucgcagccgucccacccaacuuccccaccgaaggauuaucgcccucccaagucaccauguucccccacaucaucgucgacguccgacaacucgaaccaguacuuaucccucuaccggacguccgcaacaacuucuaccacuauaaccaauccaacgacuccacgaucaagcucaucgcaaugcucuauacaccacuccgagccaacaacgccggcgacgacgucuucacagucuccugccgcgucuugacuagacccagccccgacuucgacuucauuuuccucguacccccaacaguagaaucacgcacaaaaccauucacaguccccauccucaccgucgaagaaaugacuaacucacgcuuccccauaccacucgaaaaacuauuuacaggaccauccucagccuucgucguacaaccacaaaacggacgcugcacgaccgacggcguccuacuaggcacaacccaacucucccccguaaacauaugcacauuccgaggcgacgucacccacauccccggaacccgcaccuaccggaugaaccucgcaucccaaaacuggaacaauuacgacccaacagaagaaauacccgcuccccucggcacccccgacuucguagggaaaauacaaggaaugcuaacccagaccaccaaaggagauggaucaacccgcggucacaaagcgaccgucucaaccggcucagucgacuuuacccccaaacucgacagcguacaauucgccaccgacacagauaacgacuucgaaacaggccaaaacacucgcuucacccccgucggcgucauccaagacggcuccuccgcacaccguaacgaaccccaacaauggguccuccccgacuauuccggccgcaccguccacaacguucaccucgcccccgccguagcacccacauuccccggagaacaacuccucuucuuccgcuccacaaugcccggcugcagcggauaccccaacauggaccucgacugccuccuaccccaagaauggguccaacacuucuaccaagaagcagcccccucccaaucugaugucgcccuccuucgcuucguaaacccagacacaggccgcguccuauucgaaugcaaacuucacaaagcaggcuacgucaccgucgcccacacaggccaacaugaccuaguuaucccacccaacggcuauuuccguuucgacucaugggucaaucaauucuacacccuagcccccaugggcaacggagccggccgacggcgauga

SEQ ID NO: 38857 - RNA, 1617 nt, Artificial Sequence
  derived and/or modified sequence opt11 from VP1__Norovirus_and/or_Norovirus-like__KX514354
augaaaauggcauccaacgacgcaaacccaagugauggcuccgcagccaaccuagucccugaagucaacaacgaaguuauggcucucgagcccguagucggagccgccaucgccgcccccgucgcaggccaacaaaacguaaucgaccccuggauccgcaauaacuucguacaggccccaggcggcgaauuuaccguaagcccccgaaaugccccaggcgaaauccucugguccgcaccccucggccccgaccucaaccccuaccucucccaccuugcccgcauguacaacggcuacgccggaggauuugaaguccaagucauccucgccggcaacgccuuuacagccggcaaaaucauauucgccgccguacccccgaacuuccccacagaaggccucucccccucccaagucacaauguucccccacaucaucguugacguacgucaacucgaaccaguacucaucccccuccccgacguacguaacaacuucuaccauuacaaccaauccaacgacuccacuaucaaacuaaucgccaugcuuuacaccccacuucgcgcaaacaacgccggagaugaugucuucacagucuccugucgcguacuaaccagaccaagcccagacuucgacuucauauuccucguacccccaaccgucgaauccagauccaaacccuucagcguccccguacuuacaguccaagaaaugaccaacucacgcuucccagccacacuugacaaacuauucaccggaccauccucaacccuugucguccaaccccagaacggccgauguaugaucgacggcguacuccucggaacuacacaacucucccccgucaacaucugcaccuuccgaggagacgucacccacagccgcgacucuacuaucuacacaaugaaccucgcaucaccaaacuggaacaacuacgaccccaccgaagaaauccccgccccacuaggaacaccugacuucguaggcaaaauccaaggcguacucacccaaaccacaaaaggagaaggauccaccagaggccaccgugccaccgucuacgucggcagcgccaacuacacaccaaaacuaggaaaaguacaauucgaaacaaacaccaccaacgaccuuuacgcacaucaaaacacucgauucacccccguaggaguaguacaaggcggcgaauccgcccaccgcuccgaaccacaacaaugggugcuccccucuuacucaggccgugacacacccaauguccaccucgcuccugcaguugccccaaccuuccccggcgaacaacuccucuucuuucgcucgacgauccccggcugcggcggccaccccaacauggaccuggacugccuacucccccaagaauggguucaacacuucuaccaagaagcggcccccgcccaauccgacgucgcccuccuccgcuucgucaacccugacaccucucgcguccuauucgaaugcaagcuccacaaaucaggcuacgugaccgucgcccacacuggccaacacgaccucgucaucccgcccaacggcuacuuucguuucgacuccugggucaaccaauucuauacccuugcacccauggguaacggaaccggccgcaaacgcuga

SEQ ID NO: 38858 - RNA, 1617 nt, Artificial Sequence
  derived and/or modified sequence opt11 from VP1__Norovirus_and/or_Norovirus-like__KX354062
augaaaauggcgucaucagacgccaacccaagcgauggauccacagccaaccuaguccccgaagugaacaacgaagucauggcccucgaaccagucgucggcgccgccauagcagcaccagucgcaggccaacaaaacgucaucgaccccuggaucagaaacaacuuuguccaagcccccggcggagaguucacagucucaccccgaaaugcaccaggcgaaauccucugguccgcaccacuaggccccgaccuaaaccccuaccucucacacuuagcccgcauguacaacggauacgcaggcggcuucgaaguacaaguaauacuagccggcaacgccuucacugcaggcaagaucaucuucgccgccguaccaccaaacuucccaacagaaggacuaucacccucccaagucaccauguucccccacaucaucguggacguccgccaacucgaacccguacuaaucccccuccccgacguccgaaacaauuucuaccacuacaaccaauccaacgacuccacaaucaaauuaaucgccaugcucuacacaccacuucgcgccaacaacgcaggcgacgaugucuuuacagucuccugcagaguccucacacggcccuccccagacuucgacuucauauuucucguaccucccaccguggaaucccgcaccaaacccuucucaguacccauccucaccguggaagaaaugacaaacucccgcuucccaaucccccucgaaaaacucuucaccggccccuccucagcauucguaguacaaccgcaaaacggacgcugcaccaccgacggcguccuucucggcaccacccaacucagccccgucaacauuugcaccuuccgaggcgacgucacucacauccccaacucccacaacuacacaaugaaccucgccucccaaaacuggaacuccuacgaccccaccgaagaaaucccggccccacucggcaccccagacuuuguaggcaaaauacaaggcguccuaacccagacaaccagcaccaauggcagcacccgaggccacaaggccacaguauacacaggcucugcugacuucagccccaaacucggccgcguacaguucgccaccgacaccaacaacgacuucgaaaccaaccaaaacaccaaauucacucccguaggcgucauucaagacggcucaaccaccccucgcaacgaaccacaacaauggguacuccccagcuauucaggacguaacauacacaacguccaccucgcacccgccguagcccccaccuuccccggagaacaacuacuuuucuuccgcuccacuaugcccgggugcuccggauaccccaacauggaccucgacugucuacucccccaagaauggguacaauacuucuaccaagaagccgcccccgcacaaucggacgucgcccuacuccgcuucgucaacccagauaccggacguguccuauucgaaugcaaacuccacaaaucuggauacguaacugucgcccacacuggccaacacgaccuagucaucccacccaacggauacuuccgauucgacuccugggucaaccaguucuacacccuggccccaaugggaaacggcaccggccgccgccgcuga

SEQ ID NO: 38859 - RNA, 1617 nt, Artificial Sequence
  derived and/or modified sequence opt11 from VP1__Norovirus_and/or_Norovirus-like__AB972532
augaaaauggcaagcucagaugcaaaccccuccgacgguucugcggccaaccuugucccagaagucaacaacgaggucauggcucucgaaccaguagucggcgcagccauagccgcccccgucgccggacaacaaaacguaaucgacccauggauaagaaauaacuucguacaagcccccggcggcgaguucaccgucucuccccguaaugcacccggagaaauccucugguccgccccucucggacccgaccucaaccccuaccucucccaccucgcccgaauguauaacggcuacgccgguggcuucgaaguacaagucauccuagccggcaacgcguucaccgccggcaaagucaucuucgccgccguuccacccaacuucccaaccgaaggccuguccccaucacaaguaaccauguuuccucacaucgucguagacguccgacaacucgaaccaguacuaauaccccuacccgauguccgcaacaacuucuaccauuacaaccaaagcaacgacuccacaaucaaacuaauagcuaugcuauacacuccccuacgcgccaacaacgccggcgacgacguauucaccguauccugccgcguacuaacccgccccuccccagacuucgacuucaucuuccuagucccaccaaccguugaaucucgcaccaaaccauucuccguaccaguacucaccgucgaagaaaugaccaauucccgcuucccaauccccuuagaaaaacucuucacaggccccuccucagccuucguaguacaaccccaaaacggacgauguaccaccgacggaguccuccucggcaccacucaacuaucucccgucaacaucugcaccuuccgcggagacguaacucauaucaccgguucaagaaacuacaccaugaaucuagccucccaaaacuggucuaacuacgaccccaccgaagaaauccccgcaccccucggcacccccgauuucgucggaaagauacaaggcguccuuacacaaacaacccgcacagacggaucuacccgcggccacaaagcaacaguuuacacaggcagcgccgauuucgcucccaaacuuggccgaguacaguucgaaacugacaccgaccacgacuucgaagccaaccaaaauaccaaguucacccccgucggcguaauacaagacggcagcaccacacaccgcaacgaaccacaacaauggguccuccccuccuacucaggccgcaacaccccaaacguacaccucgcacccgccgucgccccgacuuuccccggugaacaacuacuguucuuccgcuccaccaugccaggaugcucaggcuacccaaacauggaccucgacugccuacucccccaagaauggguccaguacuucuaccaagaagccgcacccgcucaauccgacguagcuuuacuccgguucguaaaccccgacacaggacgcguccucuucgaaugcaaacuccacaaauccggcuacguaaccgucgcccacaccggccaacacgaccucguaauaccucccaauggcuauuuccguuucgacuccuggguuaaccaauucuacacccucgccccaauggguaacggaacaggacgccgucgcuaa

SEQ ID NO: 38860 - RNA, 1617 nt, Artificial Sequence
  derived and/or modified sequence opt11 from VP1__Norovirus_and/or_Norovirus-like__KT202796
augaaaauggcaagcucagacgcaaaccccucugauggcuccgcugcaaaccucgucccagaagucaacaacgaagugauggcacucgaacccgucgucggcgccgccaucgccgcaccagucgccggccaacaaaacguaaucgaccccuggauccgaaacaauuucguccaagcccccggcggagaauuuaccgugucaccccgcaacgcccccggcgaaauccucugguccgcaccccuuggccccgaccuaaaccccuaccuaucccaccuagcccgcauguauaacggcuacgcaggaggcuucgaaguacaagucauccucgcaggcaacgcauucacugccggcaaaguuaucuucgccgccguacccccgaacuuccccaccgaaggccuuucaccaucccaagucacaauguucccccacauaguuguagacguacgccaacucgaaccuguccucaucccccuccccgacguccgcaacaacuucuaccacuacaaccaauccaacgaccccacuaucaaacuaauagcaaugcucuacacaccccuacgggcuaacaacgccggcgaugacguauucaccgucucaugccgaguccucacccgccccuccccagacuuugacuucaucuuccucgucccacccaccguagaaucucgcaccaaacccuucuccguccccguacucacuguagaagaaaugacaaacucuagauuccccauaccacuagaaaaacucuuuaccggcccaucuuccgcauucgucguacaaccccaaaacggccgcugcaccaccgacggcguacuccucggcacaacccaacucucacccguaaacaucugcaccuucaggggcgacgucacccacauaacaggaucacgcaauuacaccaugaaccucgcaucgcagaacuggucaaacuacgaccccacugaagaaauccccgcaccccucggcacacccgacuucgucggcaaaauccagggaguccuaacacaaaccacccgaaccgacggaucaacccgcggccauaaagccacagucuacaccggauccgccgacuucgcccccaaacuaggacgcguccaguucgaaacugacaccgaccacgacuucgaagccaaccaaaacaccaaauucacccccguaggugucauacaagacggaggaacgacacacaggaacgaaccacaacaauggguccuacccagcuacucaggacgaaacacccccaacguccaccuagcacccgccgucgccccaaccuuccccggcgaacaacuccuauucuuccgaucgaccaugcccggcugcuccggauaucccaacauggaccucgacugccuccucccucaagaauggguacaauacuucuaccaagaugccgccccagcccaaucagacgucgcccuacuccgauucgucaacccagacaccggucgaguucucuucgaaugcaaacuccacaaaagcggcuacguaaccgucgcccacaccggacaacacgaccucgucaucccuccaaacggauacuucagauucgacuccuggguaaaccaauucuacacccucgcccccaugggcaacggaaccgguagacgccgcuaa

SEQ ID NO: 38861 - RNA, 1617 nt, Artificial Sequence
  derived and/or modified sequence opt11 from VP1__Norovirus_and/or_Norovirus-like__AB933751
augaagauggccuccucugaugccaaccccagcgacggauccaccgcaaauuuaguccccgaagucaacaacgaagucauggcccucgaacccgucgucggcgccgcaaucgccgcccccguagccggccaacagaacgucauagaccccuggauccgcaacaacuucguccaagcccccggaggcgaauuuacugucucaccccgcaacgcacccggcgaaauccucugguccgccccacucggcccagaccuaaacccauaccucucccaucucgcccggauguacaacggcuacgcaggaggguucgaaguccaagucauccucgccggcaacgcauucaccgccggcaaaaucauuuucgcagccguaccacccaacuucccgaccgaaggacuaucaccaucccaagugaccauguucccacacaucaucgucgacguccgccaacucgaacccguccuaauaccccuaccugacguccgcaacaacuucuaccacuacaaccaaagcaacgaccccaccaucaaacucaucgccaugcucuacacaccccucagagcaaacaacgcaggcgacgacguuuucacugucuccugcagaguccuaacacgcccuucccccgacuucgacuucaucuuccucgucccgcccaccgucgaaucgcgcacaaaaccauucagcgucccaguccucacaguagaagaaaugaccaacucucgcuuccccaucccccucgaaaaacucuucaccggaccaagcuccgcauucguaguccaaccacaaaacggucgcugcaccacugacggcguccuacucggaacuacacaacuauccccaguaaacaucugcacauuccgcggugacgucacacacauaccgggcucccgcaacuacaccaugaaccucgccucccaaaacuggaacagcuacgacccaacugaagaaauaccugcaccccucggaaccccagacuucguaggcaaaauacaaggcguccucacccaaacuacacgcacaaacggcuccacccgcggacacaaggccacagucuacacaggaagcgccgacuucucccccaaacuaggccgcguccaauucgcaaccgacacagacaacgacuucgaaaacaaccaaaacacaaaauucacaccagucggcgucauacaagacggcucuaccacccccagaaacgaaccacaacaauggguccuuccauccuacagcggccgcaacauccacaacgugcaccuagcacccgcaguagcccccaccuuccccggcgaacaacuccuauucuuccgcucuaccaugccaggcugcaguggauacccuaacauggaccucgacugccuacuaccucaagaauggguccaauacuucuaccaagaagcugcacccgcccaauccgacgucgcacuccuccgcuucgucaaccccgacaccggacgcguccuauucgaaugcaaacuccauaaauccggcuacgucacaguagcccauaccggccaacacgaccuagucaucccacccaauggcuacuucagauucgacucaugggucaaccaauucuacacucucgcccccaugggcaacggaacaggcagacgccgguaa

SEQ ID NO: 38862 - RNA, 1617 nt, Artificial Sequence
  derived and/or modified sequence opt11 from VP1__Norovirus_and/or_Norovirus-like__KM514078
augaaaauggcauccuccgacgcuaaccccucugacggcuccgccgccaaucucguccccgaaguaaacaacgaaguccucgcacuagaaccagucgucggcgccgccaucgcggcccccguggccggccaacaaaacgucaucgaucccuggauccgaaacaacuucguccaagcccccggaggcgaguucaccgucucaccccguaacgcucccggcgaaauacuaugguccgcaccccucggacccgaccucaaccccuaccuuucccauuuggcacgcauguauaacggcuacgccggcggauucgaaguccaaguaauccucgcaggcaacgcuuucaccgccggcaaaguuaucuucgccgccguuccacccaacuuccccaccgaaggucuaucccccagucaaguuacaauguucccgcacaucgucgucgacguccgccaacucgaacccguacucaucccacucccagacguccgcaacaacuucuaucacuacaaccaauccaacgauccuaccaucaaacucaucgccaugcucuacaccccacuccgcgccaacaacgccggugacgacgucuucaccguaucaugccguguccuaacucgaccaucccccgacuuugacuucauauuccucgucccacccaccgucgaaucgcgcaccaaacccuucucaguacccguccucacagucgaagaaaugaccaacucacgauuccccauaccccuugaaaaacucuucacaggccccucuucagccuucgucguccaaccccaaaacggacgaugcaccaccgacggaguccuucuaggaacaacacaacucucccccgucaacaucuguaccuuccgcggcgacguuacccacaucaccggcucucgcaacuacaccaugaaccuagccucccaaaacugguccaauuacgaccccacagaagaaauacccgcaccccucggcacaccagacuucguaggcaaaauucaaggcaugcucacccaaaccacccgcacagacgguucuacgcgaggccacaaagccaccguauacaccggcucagcagacuucgcccccaaacucggucgcguccaauucgaaaccgauaccgaccacgauuucgaagccaaccaaaacacaaaauucacacccgucggagucauccaagacggcucaacaacccaucgcaacgaaccccagcaauggguccuccccagcuacucgggacgcaacacccccaacguucaccuagccccagcagucgccccgacuuuccccggcgaacaacuacucuucuuccgauccaccaugcccggcugcuccggauaccccaacauggaucuggacugccuacuaccacaagaauggguucaauauuucuaccaagaagccgcgcccgcccaaucagauguagcacuccuccgauuuguaaaccccgacacuggccgcguccucuucgaauguaaauuacacaaauccggauacgucaccguugcccacaccggccaacacgaccuagucauacccccaaacgguuacuuccgcuucgacucauggguaaaccaauucuacacccucgcucccaugggaaacggcaccggacgccgccgcuag

SEQ ID NO: 38863 - RNA, 1617 nt, Artificial Sequence
  derived and/or modified sequence opt11 from VP1__Norovirus_and/or_Norovirus-like__KM198569
augaaaauggccuccaacgacgccaaccccucugacggcucugccgcuaaccucguucccgaagucucaaacgaagucauggcccucgaacccgucgcaggagccgccaucgccgcccccguggccggacaacagaacguuaucgacccuuggauccgcaacaacuucguacaagcccccgguggagaauuuaccgucucaccccgcaacgcacccggcgaaauccucugguccgcaccauuaggccccgaucucaacccuuaccucucccaccuagcccgcauguacaacggauacgccggagguuuugaaguacaaguaauccucgccggcaacgccuucacugcaggcaaaauaaucuucgcagccgucccgcccaauuuccccacagaaggacuuuccccuucacaagucacaauguucccccauauaaucgucgacgucagacaacucgaacccguccucaucccccuccccgauguccgcaacaacuucuaccacuacaaccaaaccaaugacuccacuaucaaauuaaucgccaugcucuacaccccacuccgcgccaacaacgccggcgaagacguauucacaguuuccugccgcguccucacccgaccaucccccgacuucgacuucauauuccuuguaccacccacuguagaaucccguaccaaacccuucacaguccccauccuuaccgucgaagaaaugaccaacucccgcuucccaauaccccuagagaaacucuucacuggccccuccggagccuucgucguucaaccccaaaacggccgcuguacaaccgacggaguucuacuaggaacaacacaacucuccccaguaaacaucugcacauuccguggcgaugucacucacauagccggcucccggaacuacaccaugaaucucgccucccucaacuggaacaauuacgaccccaccgaagaaauccccgcgccccuaggcacccccgacuucgucggaaaaauccaagguguccugacccaaacgaccaaaggcgacggauccacccgcggacacaaagccacagucuauacuggauccgcccccuucacccccaaacucggcuccguccaauucuccaccgacaccgaaaacgacuucgaaacccaccaaaauacuaaauucacccccgucggcgucauacaagacggcggcaccacacaccgaaacgagccccaacaauggguacugcccuccuacuccggccgagacguacacaacguccaccucgcccccgccgucgcucccaccuuccccggcgaacaacuccucuucuuccgcucuaccaugccaggaugcuccggguacccaaacauggaccucgacugccuccuaccacaagaauggguccaacacuucuaccaagaagcagcacccgcacaaucagacgucgcccuccuucgcuuugucaaccccgacacaggucgcguacucuucgaaugcaaacuacacaaaucaggauacgucacugucgcccacaccggccaacacgaccucguaauaccacccaacggcuauuuccgauucgacucuugggucaaccaauucuacacucucgcccccaugggcaauggaaccggacgccgccgcuaa

SEQ ID NO: 38864 - RNA, 1617 nt, Artificial Sequence
  derived and/or modified sequence opt11 from VP1__Norovirus_and/or_Norovirus-like__KF768522
augaaaauggccagcuccgacgcaaaccccuccgacggcucaaccgccaaccuaguucccgaagucaacaacgaaguaauggccuuggaacccgucgucggugccgccauagcagcacccgucgccggacaacaaaacgucaucgaccccuggauccgaaacaacuucguacaagccccaggaggcgaguucacagucagcccacguaacgcacccggcgaaauucucuggucggcaccccucggacccgaccucaauccauaccuaucacaccuagcacgaauguacaacggcuacgccggcggcuucgaaguacaagucauacucgccggcaaugccuucaccgccggaaaaauaaucuucgcugccguacccccuaauuuccccaccgaaggccucucacccucacaaguuaccauguucccucacaucaucgucgacguccgccaacuagaacccguccucaucccccucccugacguaaggaacaacuucuaccacuacaaucaauccaacgacccuacaaucaaacuaaucgcgaugcucuacaccccacuccgcgccaacaacgccggcgacgacgucuucaccguaucuugccgcguacucacacgcccauccccugacuucgacuucaucuuccucguaccgcccaccgucgaaucgagaaccaaacccuucucgguacccguccucacagucgaagaaaugaccaacucacguuuccccaucccccucgaaaaacucuucaccggaccauccuccgcauucguaguccaaccccagaacggccgcugcaccaccgacggcguacuccuaggcaccacccaacuaagccccguaaacaucugcaccuuccgcggcgaugucauccacaucucaggcucccgcaacuacacaaugaaccucgccucacaaaauuggaacuccuacgaccccaccgaagaaauacccgcaccccucggcacccccgacuucguaggcaagauccaaggaguccucacacaaaccacacgcacaaacggcuccacccgaggacacaaggccacuguauacaccggguccgccgacuucucaccaaaacucggccgcguccaauucgccaccgacaccgacaacgacuucgaaaccaaccaaaacaccaaauucacccccguaggcgucauacaagacggcucuaccacccccagaaacgaaccccagcaauggguucuccccuccuacuccggccgcaacauccacaacguacaccuagcucccgcaguugcccccaccuuccccggcgaacagcucuuauucuuccguuccacaaugcccggcugcuccggauaccccaacauggaccuagauugccuccucccgcaagaauggguccaauacuucuaccaagaagcagcacccgcacaauccgacgucgcacuacuccgcuucgucaaucccgacacaggcagaguccuauucgaaugcaaacuacauaaaucaggcuacguaaccguagcccacacaggacagcacgaccuagucaucccacccaacggcuacuuccgcuucgacuccuggguaaaccaauucuacacacucgcucccaugggcaacggcacaggccggcggcgcuaa

SEQ ID NO: 38865 - RNA, 1617 nt, Artificial Sequence
  derived and/or modified sequence opt11 from VP1__Norovirus_and/or_Norovirus-like__KF060120
augaaaauggccuccucugacgccaaucccucagacggcucaaccgccaaccucgucccagaagucaacaacgaagucauggccuuagaacccgucguuggcgccgccaucgccgccccagucgcaggacaacaaaacgucauagaccccuggauccgcaacaacuucguacaagccccuggaggagaguucaccguauccccacggaaugccccuggcgaaauccucuggaacgcaccccucggccccgaccucaaccccuaccucucacaccucgcccgcauguacaauggguacgcaggggguuucgaaguacaggucauccucgccggaaacgccuucaccgcaggcaaaaucaucuucgcagcagucccucccaacuuccccaccgaaggccuaucccccucucaaguaacaauguuuccacacaucaucguggacguacggcaacuagaaccaguccucauuccccuuccagacguacgaaacaacuucuaucacuacaaccaauccaaugacccaacuaucaaacucauagcuaugcucuauacaccccuucgcgcuaacaacgccggcgacgacgucuucaccgucuccugucguguucuaacacggcccuccccagauuucgacuucaucuuccucgugcccccuacaguugaaucacgaacaaaacccuucuccgucccuguacuaaccgucgaagaaaugacaaacucccguuucccuauaccccucgaaaaacucuuuacaggccccucaucagcuuucguaguccaaccccaaaauggcaaauguaccaccgacggcguccuccucggcaccacgcaacuuuccccaguaaacaucugcaccuucagaggcgacgucacccacauaccaggcucccgcaacuacaccaugaaccucgcuagccagaauuggaacucauacgaccccaccgaagaaauucccgcaccccucggaaccccagacuucguaggcaaaauccaaggaguccuaacccaaacaacacgaaccaacggauccacacgcggucacaaagccacaguauacaccggcagcgccgacuucucacccaaacuaggacguguccaguucgcaacagacacagacaacgauuucgaaaccaaccaaaacacaaaauucacgcccgucggugucauccaagacgguucuaccacaccccgcaacgaaccccaacaauggguccucccauccuacucuggccgcaacauccacaacguccaccuagcacccgccguugcccccaccuucccaggagagcaacuccucuuuuuccgcuccaccaugcccggaugcuccggcuaccccaacauggaccuagacugccuccuaccccaagaauggguacaauacuucuaccaagaagcagcacccgcccaauccgacguugcacuucuccgcuucgucaacccagacaccggccgcguccucuucgaaugcaaacuccacaaauccggcuacgucacuguagcccacaccggccaacacgauuuagugaucccucccaacggauacuuccgauucgacucaugggucaaucaauucuacacacucgcacccaugggaaacgguacaggccgucgccgcuaa

SEQ ID NO: 38866 - RNA, 1617 nt, Artificial Sequence
  derived and/or modified sequence opt11 from VP1__Norovirus_and/or_Norovirus-like__KF060102
augaagauggccagcucagacgccaauccaucagacggcucagccgccaaccucguaccagaagucaauaaugaaguuauggcauuagaacccgucguaggcgcagccaucgccgcccccguagcaggacaacaaaacguaauagacccauggauccggaauaauuucguccaagcacccggcggcgaguucaccguuucaccccgcaaugcacccggcgaaauacucugguccgcaccccucggccccgaccuaaacccauaccuaucccaccuagcccgcauguacaacggauacgccggaggcuucgaaguacaagucauccucgccggcaacgccuucaccgcuggaaaaguuauuuucgccgccguacccccgaauuucccaacagaaggccuaucacccucacaagucaccauguucccacacaucgucgucgacguaagacaacucgaacccguccucauaccccuccccgacguccgcaacaacuucuaccacuacaaucaaucaaacgacccaacaaucaaacuaauagcuaugcucuacacgccccuucgagccaacaacgcaggagaugacguauucacagucucaugccguguacucacacgacccucgcccgacuucgacuucaucuuccucguacccccgacaguagaaucacguaccaaaccauucucaguccccguccucaccguagaagaaaugaccaacucacgauuccccaucccacucgaaaaacucuuuaccggcccauccucagccuuuguaguccaaccccaaaacggccgcugcaccaccgacggaguacucuugggcaccacucaacugucacccgucaacaucugcaccuuccgcggaaacgucacccacaucaccggcucacggaacuauacaaugaaccuugcaucacaaaacuggaacaacuacgacccuacggaagaaauccccgcaccacucggcacacccgacuucgucggaaaaauacaaggaguccuaacccaaacaacucgcaccgacggcuccacucgcggucacaaggccaccgucuacaucggcucagccgacuucgcccccaaacucggccgcguacaguuugaaaccgacaccgaucacgacuuugaagcaaaccaaaacacaaaauuuaccccagucggcgucauacaagacggaggaaccacacaccgcaacgaaccccaacaauggguacuccccucuuauuccggccgaaacacccacaacguccaccucgcacccgccgucgcccccacauuccccggagaacaacuccuauucuuccggucaaccaugccaggaugcuccggcuaucccaacauggaccucgacugccuacucccucaagaauggguccaauacuucuaccaagaagcagccccagcccaaucagacguagcauuacuucgcuucgucaaccccgacacaggccgcguccucuucgaaugcaaacuccacaaaucagguuacgucacagucgcccacaccggccaacacgaccucguaauaccacccaacggauacuuccgcuuugacucuugggucaaccaguucuauacccucgcccccaugggcaacggaaccggccgccgccgcuaa

SEQ ID NO: 38867 - RNA, 1617 nt, Artificial Sequence
  derived and/or modified sequence opt11 from VP1__Norovirus_and/or_Norovirus-like__KF060088
augaaaauggccucaucagacgcaaacccauccgacggcucaaccgccaaccucguccccgaagucaacaacgaaguaauggcccucgaaccaguagucggcgcugccaucgccgcacccgucgccggacaacaaaacguuaucgaccccuggaucagaaacaacuuuguccaagcucccggcggcgaauuuaccguaucaccccgcaacgcacccggagaaauacucugguccgcaccccuaggccccgaccucaacccauaucucagccaucucgcccgaauguacaacggcuacgccggcggauuugaaguucaagucauccuagcaggcaaugcuuucaccgccggcaaaaucaucuuugcagccguaccucccaacuuccccacagaaggccuaucacccucccaaguaacaauguucccccacauaaucgucgacguacgccaacuugaaccaguccucauaccccuccccgacguccgcaacaacuucuaccacuacaaccaguccaacgaccccacaauaaaacucaucgcuaugcucuauacaccccuacgcgccaacaacgccggagacgacgucuucaccguauccugccguguccucacccgccccagcccagacuucgacuucaucuuccucgucccucccacugucgaaucacgcaccaaacccuucuccgucccuguccucacaguagaagaaaugacaaacucccgcuucccuaucccccuagaaaaacucuucaccggcccaucuucugccuucgucguccaaccccaaaacggccgcugcaccaccgacggcguucuucuaggcacaacucaacuuuccccgguaaacaucugcaccuuccguggagacgugacccauauuucuggaucacgcaacuacaccaugaaucucgccucccaaaacuggaacuccuaugacccuaccgaagaaaucccagcaccccuagguacacccgacuucgucggaaagauacaagguaugcucacacaaacaacgagaaccgacggaucaacccgaggccacaaggccaccguauacaccggcucugccgacuuuucccccaaacuaggcagaguacaauucgcuaccgacacagacaacgacuucgucaccaaucagaacaccaaauucaccccagucggcgucauccaagacggauccaccaccccucgaaacgagccccaacaauggguacuccccuccuacucaggaagaaacacacacaacguccaccuggcccccgccguagcacccaccuuccccggcgaacaacuccucuucuuccgauccacaaugccaggaugcagcggauacccuaacauggaccuagacugccuccucccccaagaauggguccaauacuucuaccaagaagccgcccccgcacaaucugacgucgcgcuacuccgcuucguuaacccugacacaggucguguccuauucgaaugcaaacuucacaaauccgguuacguaacagucgcacacaccggccaacacgaccucgucaucccucccaacggauacuuccgauucgacuccugggucaaccaauucuacacacucgcccccaugggcaacggaacaggccgccgccgcuaa

SEQ ID NO: 38868 - RNA, 1617 nt, Artificial Sequence
  derived and/or modified sequence opt11 from VP1__Norovirus_and/or_Norovirus-like__KF060025
augaaaauggccucauccgacgcaaaccccagcgacggcuccaccgccaaccucguccccgaaguaaacaacgaaguaauggcucuagaacccguuguaggcgcagcaaucgcagccccagucgccggccaacaaaacguuaucgaccccuggauccgcaacaacuucguacaagcucccggaggcgaauuuacaguaagcccccgcaacgccccaggcgaaauacucuggucagcaccccucggacccgaccucaaccccuaccucucccaccuugcacgaauguacaacggauacgccgguggcuucgaaguccaagucauccuugcgggaaacgccuucaccgcuggcaaaauuaucuucgcagccguacccccuaacuuucccacugaaggccucucccccucccagguaaccauguucccccacaucauagucgacguacgccaacucgagcccguacuaaucccacuccccgacguccgcaacaacuucuaucacuacaaccaauccaacgacccuacuaucaaauuaauagccaugcuauacacccccuuacgcgccaacaacgccggcgacgauguauucaccgucucaugccgcguacucacccgaccaucccccgacuucgacuuuauuuuccuaguaccacccaccgucgaauccaggaccaaacccuucuccgucccaguucucaccguagaagaaaugacgaacucacgcuuccccauaccucucgaaaaacuauucaccggacccucauccgccuucguaguccaaccccaaaacggccgcugcaccaccgacggaguccuucuuggaacaacacagcuaucccccgucaacaucugcaccuuccgcggggacguaacccauaucagcgguucccguaacuacacaaugaaccucgccucacaaaacuggaacucauacgacccaaccgaagaaauuccagcaccccuaggcacccccgacuucgucggcaaaauucaaggcguccucacccaaaccacccgcacagacggcucaacccgcggacacaaagccaccguuuacacgggcuccgcagacuucucucccaaacuaggccgcguccaauucgccaccgacaccgacaacgacuucgucgcagaccaaaacacuaaguucacacccgucggagucauccaagacggcuccaccacaccccgcaacgaaccccaacaauggguccuacccuccuacuccggccguaauacccacaacguucaccucgcccccgcugucgccccuaccuuccccggcgaacaacuacuauucuuucgauccaccaugcccgguugcucaggauacccaaacauggaccucgacugccuccuaccccaagaauggguccaauacuucuaccaagaagccgccccagcccaauccgacgucgcccuacuccgcuuugucaaccccgacaccggccgcguccucuucgaaugcaaacuccacaaaucuggauauguuaccgucgcccacaccggccaacacgaccuagucaucccucccaacggcuacuuccgcuucgauucauggguaaaccaauucuacacccuagcacccaugggcaacgggacaggccgccgucgcuaa

SEQ ID NO: 38869 - RNA, 1617 nt, Artificial Sequence
  derived and/or modified sequence opt11 from VP1__Norovirus_and/or_Norovirus-like__KC517378
augaaaauggccuccuccgaugcaaaccccuccgauggaucugccgccaaccucguaccagaagucaacaacgaagucauggcacucgaacccgucguaggcgcagcaaucgccgcccccguugccggccaacaaaacgucaucgauccauggauccgcaacaacuucguccaagcacccggcggcgaguucacaguaaguccccgcaacgcccccggagaaauacucugguccgccccucuaggcccagaucuuaaccccuaucucucccaccucgcccgcauguauaacggcuacgcaggcggcuucgaaguccaaguaauacuagcagguaaugccuucaccgccggcaaaguaauauucgccgcagugcccccaaacuuccccaccgaaggccucucuccaucccaagucacuauguucccacacaucgucgucgacguccgacaacucgaacccguccucauaccccucccagacgucggcaacaacuucuaccacuacaaccaaagcaacgacccaacaaucaaacuuauagccaugcuuuacacuccccuccgagccaacaacgcuggagacgacgucuucaccgucuccugccgcguacucacccgccccuccccagacuuugacuucaucuuucuagucccucccaccgucgaaagccgaaccaaacccuucucuguccccguccuaaccguagaagaaaugaccaacucacgcuuccccauaccucucgaaaaacucuucaccggccccagcuccgccuucguaguccaaccccaaaacggccgcugcacuacagacggcguacuacuagguacaacccaacucuccccagucaacaucuguaccuuucgcggugacgucacacacaucaccggaucucgaaacuacaccaugaaucucgcuucccaaaacuggaacaacuacgaccccacugaagaaauacccgcaccccucggcaccccugacuuugucggcaaaauccaaggaguccuuacccaaacaacacgcacugacggcuccacacgcggucacaaagcaacagucuacacaggcucagccgacuucgcccccaaacucggccgaguccaauucgaaacggacacagaccacgacuucgaagccaaccaaaacacaaaauucacccccguuggagucauucaagacggaggcaccacccauagaaacgaaccccaacaauggguucugcccagcuacucaggcagaaacacccacaacguacaucuagccccagccgucgcccccaccuucccaggcgaacaacuccuauucuuccgauccacuaugcccggaugcuccggcuaccccaacauggaccuagacugccuacucccacaagaauggguccaauacuucuaccaagaagccgcccccgcccaaucugacgucgcgcuccuccgauucgucaaccccgacacuggccgcguacuauucgagugcaaacuucacaaguccggauacguaaccgucgcccacacaggccaacacgaccuagucauaccacccaacgguuacuuccgcuucgacucauggguaaaccaauuuuacacacucgcuccaaugggcaacggaacgggccgccgccgcuaa

SEQ ID NO: 38870 - RNA, 1617 nt, Artificial Sequence
  derived and/or modified sequence opt11 from VP1__Norovirus_and/or_Norovirus-like__JX459640
augaaaauggccuccuccgacgccaaccccuccgacggcuccaccgcccaccuaguacccgaaguaaacaacgaagucauggcacucgaacccguaguaggcgccgcaaucgccgccccagucgccggccaacaaaacgugauagaccccuggauccgcaacaacuucguccaagccccaggaggcgaguucacagucagcccccgaaacgcaccgggcgaaauccucugguccgcaccccuaggccccgaccuaaaucccuaccucucccaccucgcccgcauguacaauggauacgccggcggcuucgaaguccaagucauccucgccggcaaugccuucacagccggaaagauaaucuucgccgccgucccacccaacuuccccaccgaaggccucucccccucacaggucaccauguucccccauaucauagucgacguacgacaacuagaaccaguccucauaccucuccccgacguucgcaacaacuucuaccacuauaaccaauccaacgaccccaccaucaaacucaucgccaugcuauacacuccccuacgagccaacaacgccggcgacgaugucuucaccgucagcugucgaguccucacacgaccauccccugacuuugacuucaucuuccucgucccaccaaccgucgaaucucgcaccaaaccauucucuguccccguccuaaccguugaagaaaugacaaacucacgcuuccccaucccacucgaaaaacuauucacaggccccuccagcgccuucgucguucaaccccaaaauggccgcugcacaacagauggcguccuccucggcacaacacaacuuagccccguaaacaucugcaccuuccgcggugacgucacccacauacccggcucacgcaacuacaccaugaaccucgcaucccaaaacuggaacuccuacgaucccacugaagaaauacccgccccacugggcacacccgacuuugucggcaaaauccaaggaguacucacccaaaccacccgcaccaacggcucaacacgcggccauaaagcaaccgucuacaccgggucagccgacuuuucccccaaauuaggccgcguccaauucgcaaccgacacugacaacgauuucgaaaccaaucaaaacaccaaauucacccccgucggcguuauacaagacgguuccaccaccccacgcaacgaaccccaacaauggguccuccccucguauucaggacguaacauacacaacguacaccucgccccagccguagcacccacauuccccggcgaacaacuacuguucuuccgauccaccaugccuggcugcuccggcuaccccaacauggaccucgacugccuccucccacaagaauggguccaauacuucuaccaagaagcagcccccgcccaauccgacgucgcccuacuccguuucgucaacccagacaccggcagaguccucuucgaaugcaaacuucauaaaucaggcuacgucacaguagcccauaccggccaacacgaccuuguaaucccacccaacgguuacuuccgauuugacuccugggucaaccaguuuuacacucucgcccccaugggaaacggcacgggacgccgccgcuaa

SEQ ID NO: 38871 - RNA, 1617 nt, Artificial Sequence
  derived and/or modified sequence opt11 from VP1__Norovirus_and/or_Norovirus-like__JQ613512
augaaaauggccuccuccgacgccaaccccucagacggcucgaccgcaaaccuaguccccgaaguaaacaacgaagucauggcccuugaacccgucgucggcgccgccaucgcugcaccaguagccggucagcaaaauguaaucgaccccuggauccgaaacaacuucguccaagccccuggcggugaguucacaguaucaccacgaaacgcccccggugaaauccucuggagcgcaccccuaggaccagaccuaaauccauaccuaucucaccuagcccgcauguauaacggcuaugccggaggcuucgaaguccaggucauccuagccggcaaugccuucacagcuggaaaaaucauauucgccgccguaccucccaacuuccccacagaagggcucucaccaagccaagucacaauguucccccacaucaucgucgacgucagacaacucgaaccaguccucaucccccuacccgacguccguaacaacuucuaccauuauaaccaauccaacgacucaaccaucaaacucauagccaugcucuacacaccccuccgagccaacaacgccggcgaagacgucuucaccguauccugccgcgucuuaacacgcccaucucccgacuucgacuucaucuuucuaguacccccaaccguggaaucaagaaccaaaccauucaccgucccuauucuaaccguagaagaaaugacuaacucccgcuucccaauuccccuagaaaaacucuuuaccggcccauccggagccuucguaguccaaccccaaaacggacgcuguacaaccgacggaguacuucucggcaccacacaacucuccccugucaauaucugcaccuuccgaggggacgucacccacauugccggcucccgcaauuacaccaugaaccucgccucucucaacuggaacaacuacgaucccaccgaagaaauccccgcaccccuaggcacccccgacuuuguaggaaaaauucaaggcguccuuacacaaaccaccaaaggagacggauccacccguggccacaaagccaccguauacaccggcucagcccccuucaccccaaaacucggcuccguccaauucuccaccgacaccgaaaacgacuucgaaacacaccaaaacacaaaauucacccccgucggaguaauccaggauggcuccacgacccaccgcaaugaaccucagcaauggguccuuccauccuacuccggacgaaacguccacaacguccaccucgcccccgccgucgccccuacauuccccggcgaacaacuccucuucuuccgauccaccaugcccggcugcuccggcuacccuaauauggaccucgacugccuccucccccaagaauggguacaacacuucuaccaagaagcagccccagcucagucagacguagcccuacugcgauucgucaaucccgacaccggccgcguacuauucgaaugcaagcuccauaaauccgguuacgucacaguagcccacaccggccaacacgaccucgucauaccacccaacggcuauuuccgcuucgaugcaugggucaaccaguucuacacccucgcacccaugggcaacggcacaggucgcaaacgcuaa

SEQ ID NO: 38872 - RNA, 1617 nt, Artificial Sequence
  derived and/or modified sequence opt11 from VP1__Norovirus_and/or_Norovirus-like__HQ005299
augaaaauggcaucauccgacgcaaacccauccgauggcuccaccgcaaaccuaguacccgaagucaacaacgaaguuauggcccuggaacccguagucggcgccgcuauagccgcucccguagcaggacaacaaaacgucaucgaucccuggauacgcaacaacuucguacaggcacccggcggagaauucaccguuuccccacguaacgccccaggcgaaauccucugguccgccccccuaggacccgaucucaacccauaccucucccaccucuccaggauguacaacggcuaugccgguggguucgaaguccaaguaauccucgcuggaaacgccuucacggccggaaaaauuauauucgccgcaguacccccgaacuuccccacagaaggccuaucgccuucccaaguaaccauguucccccacauuaucguggacguccgccaacuagaacccguccucaucccccugccugacguacgaaacaacuucuaccacuacaaccaaucaaacgacccaacaaucaaacucauugccaugcucuacaccccccuucgcgcaaacaacgcaggcgacgacgucuucacagucuccugccgcguccuuacccgacccucaccugacuucgacuucaucuuccucguaccccccacugucgaaucucgcacaaaaccauucucggugcccguccuaaccgucgaagaaaugacaaacucccgauuccccauaccccuagaaaaacucuucacaggcccaucuagcgcauucgucguccaaccccaaaacggccgcugcaccaccgacggaguccugcuaggcaccacccaacucucaccagucaacauaugcaccuuccgcggcgacgucacccacauaccaggcucccgaaacuacaccaugaaccucgccucccaaaauuggaacucuuaugaucccacagaagaaauacccgccccccuaggcaccccagacuucgucggcaagauccaaggcguccucacucaaacgacacgcaccaacggcuccacccgcggccacaaagcaaccgucuacaccggcucugccgacuucuccccaaaacuaggcagaguucaauucgccaccgauaccgauaacgacuucgaaaccaaccaaaacaccaaauucacacccgucggcguaauccaagacggauccacaacuccacgcaacgaaccucaacaauggguccuccccucauacucuggccguaacauccacaacguacaccucgccccagccgucgcccccaccuucccaggugaacaacuccuauucuuccggucaaccaugccgggcugcucaggcuacccuaacauggaccucgacugccuacucccacaagaauggguccaauacuucuaccaagaagccgcaccagcccaauccgacguagcccuccuacgauucgucaacccagacaccgggcgcguacuauucgaaugcaagcuacacaaauccggcuacgucacagucgcccacaccggccagcacgaccucgucaucccacccaacggcuacuuccgauucgacuccuggguaaaccaauucuauacacucgcuccaaugggaaacggcacaggacgcagacgcuaa

SEQ ID NO: 38873 - RNA, 1617 nt, Artificial Sequence
  derived and/or modified sequence opt11 from VP1__Norovirus_and/or_Norovirus-like__AB541312
augaagauggcuucauccgacgccaacccauccgacggcucaacagccaaccuaguuccagaagucaacaacgaagucauggcccuagaacccgucgucggagccgcaaucgcggccccaguagcaggccaacaaaacgucauugacccauggauccgaaacaacuuuguccaagccccgggaggagaauuuaccgucucaccccgaaacgcccccggcgaaauccuaugguccgcaccucucggccccgaccuaaacccauaccucagccaccuggcccgaauguacaacggcuacgccggcggauucgaagugcaggucauccucgccggcaacgcuuucaccgcaggaaaaaucaucuuugcagccguuccacccaacuuccccacagaaggccuuuccccuucccagguuaccauguucccccacaucaucgucgacguccgacaacucgaaccaguacucaucccccucccagacguccgcaacaacuucuaccacuacaaccaaucaaacgaccccaccaucaaacuaaucgccaugcucuacacccccuuaagagccaacaacgcuggugacgacgucuuuacagucucaugccgaguacuaaccagaccuuccccagacuucgacugcauccuugaucucccucccacuguugaaucccguacaaaacccuucuccguaccaauccuaaccguagaagaaaugaccaacucacgauucccaauaccccucgaaaaacuuuucacaggccccuccuccgcauucgucguacaaccacaaaacggccgcuguacuaccgacggcguccuacuagguaccacccaacuaucacccgucaacaucugcaccuuccgcggcgacgucacacacaucaccggcucccgcaacuacaccaugaaccuugcuacacaaaacuggaacuccuacgaucccacugaggagaucccagcaccccuaggcacccccgacuucgucggcaaaauacaagguguccucacucaaacaacccgcgccgacggcagcacacgaggccacaaggccaccgucuacaccggaucagccgacuucgcccccaaacuaggacguguccaauucgccaccgauacagauaacgacuucgaugccaaccaaaacacuaaauucaccccuguaggagucauccaagacggcgacaccgcacaccgcaacgaaccccaacaguggguucuacccuccuacucuggccgaaacucccacaacguccaccucgcccccgccgucgccccaacauuccccggcgaacaacuccucuucuuccgcucaaccaugcccggaugcucuggauaucccaacauggacuuagacugccuccucccccaggaauggguucaauacuucuaccaagaagccgcacccgcacaaucugacgucgcccuccuucgauucgucaacccagacaccggccgcguauuauuugaaugcaagcuccacaaauccggcuacgucacagucgcacacacaggccagcacgaccuugucauaccacccaacggcuacuuccguuucgacucaugggugaaccaauuuuacacccucgcccccaugggcaacgguacaggcagacgccgcuaa

SEQ ID NO: 38874 - RNA, 1617 nt, Artificial Sequence
  derived and/or modified sequence opt11 from VP1__Norovirus_and/or_Norovirus-like__AB541275
augaaaauggcuuccuccgacgccaaucccccagacggcuccgcagcuaaccuuguccccgaaguaaacaacgaaguaauggcucuugaaccaguaguaggagccgcaaucgccgcacccgucgccggucaacaaaacgucaucgaucccuggaucagaaacaacuucguacaagcacccggaggcgaguucaccguaucaccccgcaacgccccaggugaaauacuuugguccgccccucucggaccugaucuaaacccauaccucucccaccuggcacgcauguacaacggcuacgccggcggcuucgaaguccaaguaauccuagccggcaacgccuucaccgccggcaaaauaaucuucgcugcaguaccaccuaacuuccccaccgaaggccucucccccucccagguuaccauguucccccauauuaucgucgacguccgccaacuggagcccguucuuaucccccugccagacguacgcaacaacuucuaccacuacaaccaauccaacgacuccacaaucaaacuaauagccaugcuuuacaccccacuccgagcuaacaacgcaggcgaagacgucuuuaccguaucaugccgaguccuaacccgccccucacccgacuucgauuucaucuuccucguuccacccaccgucgaaucccgcaccaaacccuucaccgucccaauccuaacagucgaagaaaugaccaacucacgauuucccaucccccuagaaaaacucuucaccggcccauccggagcauucguuguccaaccccaaaacggccgcuguacaaccgacggcguucuccuaggcaccacacaacucucaccagucaacauaugcacauuccgaggcgacgucacacacauagcagguucccgcucauacacuaugaaccucgcaucccucaacuggaauaacuacgacccgaccgaagagauccccgccccacuaggcacccccgacuucguuggcaaaauccaaggcauguuaacccaaaccacaaaaggugacggcucaacccgaggucacaaagcaaccgucuacacagguuccgcacccuucacccccaaacucggaucaguccaauucuccaccgacaccgaaaacgacuuccaaacucaccaaaacaccaaguucaccccugucggagucauccaagacggaucuaccacucaccgcaacgaaccccaacaauggguccuccccucauacuccggccgcgacguccacaacguacaccucgcccccgccgucgccccaacguucccaggcgaacaacuacuauucuuccgcuccaccaugccaggcugcuccggauaccccaacauggaccucgacugccuccuaccccaggaauggguacaacacuucuaccaagaagccgcccccgcccaauccgacguagccuugcuacguuucgucaaccccgacaccggccgaguccucuucgaaugcaaacuacacaaauccggcuacgucacaguagcccacacaggacaacacgaccuaguaaucccacccaacggauacuuccgguucgacagcugggucaaccaauucuacacucucgcacccaugggaaauggaaccggccgacgccgcuaa

SEQ ID NO: 38875 - RNA, 1617 nt, Artificial Sequence
  derived and/or modified sequence opt11 from VP1__Norovirus_and/or_Norovirus-like__AB303930
augaaaauggccuccaaugaugccacacccuccgacgggucaaccgccaaccuaguccccgaagucaacaacgaaguaauggcacuagaacccguuguaggcgccgcuauagccgcucccgucgccggacaacaaaacguaaucgaccccuggauccgcaauaacuucguccaagcacccggcggcgaguucaccgugucccccagaaaugcacccggcgaaauccuuugguccgcaccccuaggcccagaccuaaaccccuaccucucacaccucgccagaauguacaacggcuacgccgguggcuucgaaguccaaguaguacuagcuggcaacgccuuuacagccggaaaaauaaucuucgcagccguacccccgaacuuccccaccgaaggacuuucuccaucccaggucaccauguucccccacaucauagucgacguccgccaacucgaacccguccuaauuccccucccagacguccgcaacaaccucuaucacuacaaccaauccaaugaccccaccauuaaacucauugccaugcuguacaccccacuucgcgccaacaacgccggcgaagacgucuucaccgucuccugccguguccucacccgacccucacccgacuucgacuucauauuccucguaccacccacagucgaaucacgcaccaaacccuucaccguccccauacuuacaggcgaagaaaugacaaacucccgcuuccccaucccccucgaaaaacucuucacaggucccuccggcgccuucgucguacaaccccaaaacggacgcugcaccacagacggcguccuacucggcaccacccaacuucuuccagucaauaucuguaccuuccgaggcgacgugacccacaucgccgggacccacaacuauaccaugaaucuagcaucccaaaauuggaacaacuacgaccccacagaagaaaucccggcaccccucggaaccccagacuucgucggacgcauacaaggcaugcuuacccaaaccacccgcggcgacggcuccacccgaggucacaaagcuacggucuccacaggcgauguacacuucacaccaaaacucggcuccauccaauucaacacagacacaaacaacgacuuugaaacaggucaaaacacaaaauucaccccagucggagucguccaagacggaaacggcacccaccaaaaugaaccccaacaauggguacuccccagcuauucaggucgcaccucccacaacguccaccuagcccccgccgucgccccaacuuuccccggcgagcaacuacucuucuuccgaucaaccaugccuggcugcucuggcuaccccaacaugaaccucgacugucuucuaccccaagaauggguucaacacuucuaccaagaagccgcacccgcccaaagcgacgucgcccuacuacgauucgucaacccugacacaggcagaguccucuucgaauguaaacuccacaaauccggcuacgucacaguagcccauacaggucaacacgaucuugucaucccacccaacggcuacuuccgauucgacuccuggguuaaccaauucuacacccuagcacccaugggaaauggaaccggccgccgacgauaa

SEQ ID NO: 38876 - RNA, 1617 nt, Artificial Sequence
  derived and/or modified sequence opt11 from VP1__Norovirus_and/or_Norovirus-like__AY485642
augaaaauggccuccaacgacgccaaccccuccgacggcucaacagccaaccucguucccgaagucaacaacgaagucauggcccuagaacccguuguaggcgccgccaucgcggccccagucgccggccagcaaaacgucaucgaccccuggaucagaaacaacuucguccaagccccaggaggcgaguucaccguguccccucgcaacgcacccggcgaaauccuuugguccgccccacucggccccgaccuaaaccccuaccuaccccaccucgcucgcauguauaacggauacgcuggcggcuucgaaguccaaguaauacucgcuggcaacgccuucacggcaggcaaaaucauauucgcggccguucccccuaacuuccccacagaaggacuaucccccucccaagucaccauguuuccucacaucauagucgacguccgccaacucgagccaguccuaaucccccuuccugacguccguaacaacuucuaucauuacaaccaaucaaacgacccaaccaucaaacucauugccaugcucuacacaccccuaagagccaacaacgcaggcgaagacgucuucaccgucucgugccgcguccucacccgcccaucccccgacuucgacuucauauucuuagucccucccaccguagaaucccgaacaaaacccuuuacaguccccauccuuaccguagaagaaaugaccaacagccgauucccaauuccccucgaaaaacucuuuaccggccccucaggagcuuucguaguccaaccccaaaacggucguugcaccaccgacgguguacuccucggaaccacccaacucucuccagucaacaucugcacauuccgcggugacguuacccacaucgcuggcacccacaacuacaccaugaaccucgcaucccaaaacuggaacaacuacggacccaccgaagaaauacccgcaccccucggcacgccagacuucgucggccgaauccaaggcaugcucacccaaaccacccgaggggacggcucaacccgcggccacaaagcaaccgucucgacaggagacguucacuucacccccaaacuaggcuccauccaauucaacaccgacaccaacaacgacuucgaaaccggacaaaacaccaaauucacacccguuggcgucguacaagacggaaacggcacccaccaaaacgaaccccaacaauggguucuccccucauacucaggcagaaccggccacaacguccaccucgcacccgccguagccccuacguuccccggagaacaacuccucuucuuccgauccaccaugcccggcugcuccggauaccccaacaugaaccucgacugccuccucccccaagaauggguacaacacuucuaccaagaggccgcacccgcgcaauccgacguagcccuacuccgcuucgucaaccccgacaccggucgcguacucuucgagugcaaacugcacaaauccggcuacgucacgguagcccacaccgggcaacacgaccuagucauaccacccaacggcuauuuccguuuugacuccuggguaaaccaauucuacacccucgcacccaugggaaacggcaccggccgacgccgauaa

SEQ ID NO: 38877 - RNA, 1617 nt, Artificial Sequence
  derived and/or modified sequence opt11 from VP1__Norovirus_and/or_Norovirus-like__KX514343
augaagauggcaucaaacgacgcaaaccccucagauggauccgcagcaaaccugguccccgaaguaaacaaugaagucauggcccucgaaccagucgucggcgccgcaaucgccgcacccguagccggccaacaaaacgucaucgaccccuggauacgcaacaacuucguacaagcacccggcggcgaguucaccgucucaccccgcaacgcucccggagaaauacuaugguccgcuccccuuggccccgaccucaaccccuaccuuucccaccucgcccgcauguacaacggcuacgccggaggcuucgaaguacaaguaauccucgccggcaacgccuucaccgccggaaaaauaaucuucgccgcaguuccacccaacuuucccacagaaggacucucacccucccagguuaccauguuuccacacauaaucgucgacguucgacaacucgaacccguccuaaucccacuccccgacguccgaaacaacuuuuaccacuacaaccaauccaacgauuccaccauaaaacucaucgcuaugcucuacacaccccuccgaaccaacaacgccggcgacgacgucuucaccgucagcugccgcguccucacccgccccagccccgacuucgauuuuaucuuccucgucccacccacagucgaaucccgcucaaaacccuucucuguccccguccucaccguagaggaaaugaccaacucccgcuucccugcaacacucgacaaacucuucaccggucccucguccacauucgucguucaaccccaaaacggacgcugcaugaucgacggaguccuacuaggcacuacccaacuaucccccgucaacaucugcaccuuccgaggugacgucacccaauccggcaacacaaaaaucuacaccaugaaccucgccagccccaacuggaacaacuacgaucccaccgaagaaaucccggccccucucggcaccccagacuucgucggaaaaauacaaggcaugcuaacccaaaccaccaagggcgaggguucaacccgcggccaccgagccaccguuuacgucgguagcgcaaacuacgcucccaaacuagggcgcguccaauucgaaacagacacaaccgacgaccucgacgcccaccaaaauacaaaauucacaccaguuggcgucguccaauccggagagucaccaaaaggcucugaaccucagcaauggguacuccccuccuacucaggacgagacacccccaacguccaccucgcccccgccgucgcuccaaccuuccccggcgaacaacuccucuuuuuccgauccacaauccccggcugcggaggccacccuaacaugaaccucgacugccuccucccccaagaguggguccaacauuucuaccaagaagccgcccccgcacaauccgacguagccuuauuacgauucgucaaccccgacaccagccgcguacucuucgaaugcaaacuccacaaauccggauaugucaccgucgcccacacaggacaauacgaccucguccuacccuccaacggcuacuuccgcuucgacucaugggucaaccaauucuacacccuagccccaauggguaacggaacaggccgccgucgcuaa

SEQ ID NO: 38878 - RNA, 1617 nt, Artificial Sequence
  derived and/or modified sequence opt11 from VP1__Norovirus_and/or_Norovirus-like__KX514274
augaagauggccaguaacgacgccaaccccucugacggcuccgccgccaaccucgugcccgaagucaauaacgaaguaauggcccuagaacccgucgucggcgccgccauagcagccccgguagccggccaacaaaacgucauagaccccuggauccgcaacaacuucguccaagcccccggaggugaguucaccgucucuccaagaaacgcacccggcgaaauccucugguccgcaccacuaggacccgaccuaaaccccuaucuaagccaccucgcucgaauguacaacgguuacgcgggcggcuucgaaguccaagucauccucgccggcaacgcauucaccgccggaaaaauaauauucgcugccguaccucccaacuuccccacugaaggccuaucccccagccaagucacuauguuuccccacaucauaguugacguccgccaacucgaacccguacucaucccccuacccgauguccgaaacaauuucuaccacuacaaccaaucaaaggacuccaccauaaaacucaucgcaaugcucuacacaccccuccgagccaacaacgccggugacgaugucuuuaccgucucaugccgcguccucacccgccccucacccgacuucgacuucauauuccucguuccacccaccgucgaaucccgaagcaaacccuucuccgugcccguacucacagucgaagaaaugaccaacucccgcuuccccgucacacuagacaaacucuucacaggacccuccuccaccauagucguccaaccccaaaauggccgguguaccauagacggcguccuacuaggaaccacccaacucucacccguaaacaucugcacauuccgcggcgacguaacccacccccgugauuccacaaucuacacgaugaaccuugcaucaccuaacuggaacaccuacgaccccaccgaagaaauccccgcaccacucggcacacccgacuuuguaggaaaaauccaaggcaugcucacccaaacuaccaaaggcgccggcuccacccguggccaccgagccacagucuacgucggcucugccaauuacgcaccaaaacucggucgcguccaauucgaaaccaacaccucugacgaccuagacgcacaccaaaacaccaaauucaccccagucggcguuauccaagguggcgaauccgcccaccgauccgaaccucaacaauggguccuaccaucauacucaggacgcgauauuccuaacguacaccuagcccccgcggucgcacccaccuuccccggggaacaacuacuauucuuccgcucaaccauccccggcuguggaggccacccaaacauggaccuagacugucuucucccccaagaguggguacaacacuucuaccaagaagccgccccagcccaguccgacgucgcccuccucagauucgucaaccccgacaccagccgaguccuauuugaaugcaaacugcacaaaucaggcuacgucacuguagcccacaccggccaacacgaccucguaauacccccuaacggcuacuuccgcuucgacuccuggguaaaucaauucuacacacucgcgcccaugggaaacggcaccggacgcaaacgauag

SEQ ID NO: 38879 - RNA, 1617 nt, Artificial Sequence
  derived and/or modified sequence opt11 from VP1__Norovirus_and/or_Norovirus-like__KX514175
augaaaauggccucuaacgaugccaaccccagcgacggcuccgccgcuaaccuuguccccgaagucaauaacgaagucauggcacuugaaccagucgucggcgcagcaaucgccgcaccagucgccggacaacagaacgucaucgacccauggauaagaaacaacuucguccaagcccccggaggcgaguucaccgucucuccccgcaacgcacccggcgaaauccucugguccgcaccucuaggacccgaccuaaaccccuaccucucccaccuugcccgcauguacaacggauacgccggaggauucgaaguacaaguaauccuggccggaaacgcauucaccgccggcaaaauaaucuucgccgccgucccacccaacuuccccaccgaaggacucucacccagccaggucaccauguucccacacaucauagucgacguacggcagcuagaacccguccuaauuccccuaccugauguacgcaacaacuucuaccauuacaaccaauccaaugacuccaccauaaaacucaucgccaugcucuauaccccacuccgcgccaacaacgccggugacgacguauucacugucucaugccguguccuaacacgcccaucccccgacuucgacuucauauuccugguaccacccacaguggaaucccgauccaaaccuuucagcguccccguccuuaccguagaagaaaugacaaacagccgauuccccgccacccuagacaaacuauucaccggccccucauccacauucgucguccaaccccaaaacggccguugcaugaucgacggcgucuuacucggcaccacccaacuaagccccguaaacauaugcacuuuccguggcgacguaacccacccucgcgacuccaaaaucuacacaaugaaccuugcuucccccaacuggaacaacuacgaccccaccgaagaaauccccgcgccacuaggcaccccugauuucgucggaaaaauccaaggaaugcuaacccaaacaaccaaaggcgaagguucaacacgcggccaucgcgccaccgucuacgucggcuccgcuaacuacgcacccaagcucggccgaguccaauucgaaaccgacaccacagaugaccucgacgcccaccaaaacaccaaauucacacccgucggcguaguccaaggaggcgaaagcccuaaaggcuccgaaccccaacaauggguccuacccucauacucaggcgcaaacacauucaauguccaccuagcccccgcaguugcccccaacuuccccggcgaacaacuccucuucuuccgcucaacacuccccggcugcggcggccaccccaacauggaccucgauugccuacuaccccaagaauggguccaacacuucuaccaagaggcugcaccggcccaaucugauguagcccucuuacgauucguaaaucccgacaccucacgcguccucuucgaaugcaaacuccacaaauccggcuacgucaccgucgcccacaccggacaacacgaccucguuaucccucccaacggcuacuuccgcuucgacucauggguaaaucaauucuacacacucgcacccaugggcaacggcaccggccgaaagcgcuga

SEQ ID NO: 38880 - RNA, 1617 nt, Artificial Sequence
  derived and/or modified sequence opt11 from VP1__Norovirus_and/or_Norovirus-like__KX354093
augaaaauggccuccuccgacgcaaaccccucagacggcuccaccgcuaaccucguccccgaagucaacaacgaaguaauggcacucgaacccgucguaggcgccgcaaucgccgcccccgucgcuggccaacaaaauguaaucgaccccuggauccgaaacaacuucguccaagcccccggcggcgaguucaccgucucaccccgaaacgcccccggagaaauccuaugguccgcuccacucggcccugaccucaaccccuaccucucgcaucucgcccgcauguacaacggauacgccggcgguuuugaaguccaaguaauccuagccggcaacgccuucaccgcagggaaaaucaucuucgcagcagugccgcccaacuuccccacagaaggacuaucccccagccaaguaacaauguucccccacaucaucgucgacguccgccaacucgaacccguccucauaccccuacccgacguccgcaacaauuucuaucacuacaaccagucaaacgacucaacaauaaaacuaaucgcuaugcucuacacaccacuaagagccaauaacgccggagacgacguauucacugucuccugcagaguacucacacgccccucacccgacuucgacuucaucuuccugguacccccaaccgucgaaucacgcaccaaaccauucuccguccccauacucacagucgaagaaaugacaaacucacguuuccccauuccccucgaaaagcuauucacuggaccaucaucagcauuugucguacaaccccaaaauggccgaugcaccacagacggcgucuuacucggcaccacgcaacucucaccagucaacaucugcacauuccggggugacgucacccacauucccggcucccacaacuacacaaugaaccuugccucacaaaacugguccucauacgaccccaccgaagaaaucccugcuccgcuaggcaccccagacuucgucggcaaaauccaaggaguacuuacccaaacuacuucaaccaacggcucaacccgaggccacaaagccacggucuacacuggcuccgcagacuucucccccaaacuuggccgcguacaauucgccaccgauacaaacaacgacuuugaaaccaaccaaaacacuaaauucacccccguaggcgucauccaagacggcucaacaaccccucgaaacgagccccaacaauggguccuccccuccuacucaggccgcaacauccacaacguacaccuggccccugccgucgcaccaaccuuuccaggagagcaacuccucuucuuccgauccaccaugcccggcugcucaggauacccaaacauggaccuggacugccuccucccccaagaauggguucaauacuucuaccaagaggccgccccagcccaauccgacgucgcccuacucagauucgucaaccccgacaccggccguguccucuucgagugcaaacuucacaaauccggcuacgucaccgucgcacacaccggccaacacgaccucgucaucccacccaacggcuacuuccgcuuugacagcuggguuaaccaauucuacacccucgcacccaugggaaacggcaccggccgccgacgcuaa

SEQ ID NO: 38881 - RNA, 1617 nt, Artificial Sequence
  derived and/or modified sequence opt11 from VP1__Norovirus_and/or_Norovirus-like__KX354003
augaaaauggcaucaucagacgcuaaccccuccgacgguucgacagccaaccucgucccagaagucaacaacgaaguaauggcccucgaacccguuguaggcgccgcaaucgccgccccugucgccggacaacaaaacguuaucgaccccuggauccgaaacaauuucguacaagcacccggcggcgaauuuacagucucuccccguaacgccccaggcgagauccucugguccgcaccccuaggccccgauuuaaaccccuaccucucccaccuugcccguauguacaacggauacgccggcggcuucgagguacaagucauacuagcuggaaacgccuucaccgccgggaagauaaucuucgccgccguuccacccaacuuucccacagaaggacuaucccccucccaagucaccauguucccccacaucauagucgacguccgccaacucgaaccaguccucaucccccuccccgauguucgcaauaauuucuaccacuacaaccaauccaacgacuccaccaucaaacucaucgccaugcucuacacuccccuccgagccaacaacgccggcgacgacgucuuuaccguuucaugccgcguccucacccgccccucaccagacuuugacuucaucuucuuagucccucccaccguagaaucacgcaccaaacccuucagcguacccguccuaaccgucgaagaaaugaccaacucccgcuuccccauccccuuggaaaaacucuucaccggcccauccuccgcguuugucguccaaccacaaaacggccgcugcaccaccgacggaguacuccuagguacaacccaacucagccccgucaacauaugcacauuccgcggggacgucacccacauacccggcucccgcaacuacaccaugaaccuugccagccaaaacuggaacucauacgaccccaccgaagaaauccccgccccucucggcacccccgacuucguaggcaaaauacaagguguccuaacccaaaccacccgcaccaacggaucaacccgaggccacaaagccaccguauacacgggcucagcagacuucucucccaaacucggccggguccaauucgccacugacacagacaacgacuucgaaacaaaccaaaacacgaaauucaccccugucggagucauccaagacgguagcaccaccccacgcaacgaaccccaacaauggguccuccccucguacuccggucgcaacacccacaacguacaccucgcucccgccguagcacccacauuccccggagagcaauuacuauucuuccgauccaccaugcccggcugcuccggauacccaaacauggaucucgacugucuccucccccaagaauggguccaauacuucuaccaagaagccgcccccgcccaaucagacgucgcccuccuacgauucgucaaccccgacaccggccgaguacucuucgaaugcaaacuccacaaaucuggcuauguaaccgucgcccauacuggccaacacgaccuaguaauacccccaaauggauacuuccgcuucgacuccugggucaaccaauucuacacuuuagccccuauggguaauggcacaggccgccgccgcuaa

SEQ ID NO: 38882 - RNA, 1617 nt, Artificial Sequence
  derived and/or modified sequence opt11 from VP1__Norovirus_and/or_Norovirus-like__KR131778
augaaaauggcuucauccgacgccaaccccucagacggcuccaccgccaaccuuguaccggaaguaaacaacgaagucauggcacucgaaccagucgucggcgccgccauagcugcacccgucgccggccaacaaaacguaaucgaucccuggauucgcaacaacuucguccaagcacccggcggcgaguucacaguuuccccucgcaacgcccccggcgaaauccuuuggucugccccacucggcccagaccucaacccauaucuuucccaccucgccagaauguacaauggauacgccggcggauuugaaguccaaguaauccucgcuggaaacgccuucaccgcaggcaagaucaucuuugcagccguacccccuaauuuccccacugaaggacucucacccucccaggucaccauguucccacacauaaucgucgacguccgccaacucgaacccguccucaucccccuccccgacguacguaacaacuucuaccacuauaaccaauccaacgacccaaccaucaaacucaucgcgaugcucuacacaccccuccgagcgaacaaugccggcgacgacgucuucaccguuuccugccgaguccuuacccgcccauccccagauuucgacuucaucuuccucgucccacccaccguagagucucgcaccaaacccuucagcguccccguacuaaccguagaagaaaugaccaacucccgauucccaaucccccucgaaaaacuauucaccggccccuccuccgcauucguagugcaaccgcaaaauggccgcugcaccaccgacggcguccuccucggcaccacccaacucuccccaguaaacaucugcaccuuccgaggcgacgucacccacauuagcggcucacgcaacuacaccaugaaccuagccucgcaaaacuggaacuccuacgaccccaccgaagaaauccccgcaccacucgguacccccgauuucgucggcaaaauccaaggcguccucacacaaaccacacgcacagacggcuccacccgcggacacaaagccaccgucuacacuggcuccgccgacuucaguccaaaacuaggccggguccaauucgccaccgacaccgacaaugacuucgucaccgaccagaauacuaaauuuaccccuguaggcgucauccaagacggcuccacaaccccacgcaaugaaccccaacaauggguacucccaucauacucaggccgcaauacacauaacguccaccucgcccccgccgucgcacccacguuuccaggcgaacaacuccucuucuuucgauccaccaugcccggcugcuccggcuacccuaacauggaccucgacugccuccuaccucaagaauggguccaauacuucuaccaagaagccgcccccgcccagucagacgucgcccuccuucgauucgucaacccggacacaggucgcguacucuucgaaugcaaacuacacaaauccggcuauguaaccguagcacacaccggccaacacgaccucguaaucccucccaacggauacuuccgcuucgacucgugggucaaccaguucuacacacuugcacccaugggcaacggcaccggccgccgccgauaa

SEQ ID NO: 38883 - RNA, 1617 nt, Artificial Sequence
  derived and/or modified sequence opt11 from VP1__Norovirus_and/or_Norovirus-like__AB972468
augaaaauggccuccucagacgccaaccccucagacggcuccgccgccaaccucguacccgaagucaacaacgaagucauggcacucgaacccgucgucggcgccgccaucgccgcaccaguagcaggccagcaaaacguuaucgaccccuggauucgcaacaauuucguccaagcacccggcggcgaguucaccguaucuccccgcaacgcccccggcgaaauacucugguccgcaccacucggcccggaccucaacccguaccucucccaccucgcaaggauguacaauggauacgcaggcggcuucgaaguccaagucauccucgccggcaacgcuuucacagcgggcaaagucaucuucgccgccgucccacccaacuuccccaccgaaggucuaucccccucccaaguaaccauguucccacacauagucgucgacguccgccaacuagaaccaguccucaucccucuccccgacguccgcaacaacuucuaucacuacaaccaauccaacgacuccaccauuaaacucauagccaugcuauacacaccccuccgcgccaacaacgcaggagacgacgucuucaccguuagcugccgaguccuaaccagaccauccccugacuucgacuuuaucuuccucgucccucccacagucgaaucucgcaccaaacccuucuccguacccguccuaaccguagaagaaaugaccaacucacgauuccccauacccuuagaaaaauuauucaccggccccuccucagcuuucgucguacaaccccaaaacggccgaugcacaacagacggaguccuacucggcaccacccaacucucaccagucaacaucugcaccuuccgcggcgacguaacccacaucaccggcucacgaaacuacacaaugaaccucgccucccaaaacuggucaaauuacgaccccacagaagaaauaccugcaccauuagggacccccgacuucgucggaaaaauacagggaguccucacucaaacuacccguaccgacggauccacacgcggacacaaggccacggucuacaccggcuccgcagauuucguccccaaacuaggacgcguucaauucgaaacggacacagacagagacuucgaagcaaaccaaaauaccaaauucacccccgucggagucauccaagacggauccacaacacaccgcaacgaaccgcaacaauggguccuccccuccuacucaggccgaaacaccccaaacguccaccucgcccccgccguagcuccuacuuucccaggugaacaacuccuauuuuuccgcagcacaaugccaggcugcucaggcuaccccaacauggaccuagacugccuacucccccaagaauggguucaguacuucuaccaagaagccgcccccgcacaaucagacgucgcccuacuccgauucgucaacccugacaccggccgcguacuauucgaaugcaagcuccacaaaucuggcuacgucaccguagcacacaccggccaacacgaccuaguuauaccaccaaacggcuacuuccgauucgacucuugggucaaccaauucuacacacucgccccuaugggcaacggaacuggccgccgacgguaa

SEQ ID NO: 38884 - RNA, 1617 nt, Artificial Sequence
  derived and/or modified sequence opt11 from VP1__Norovirus_and/or_Norovirus-like__KR904222
augaaaauggcaucaagcgacgcaaaccccagcgacggaucugcagcaaaccuaguccccgaagucaacaacgaaguaauggcccuagaacccguugucggagcugcgauugccgccccaguugccggccagcaaaaugucaucgaccccuggauacgcaacaacuucguccaagcccccggcggcgaguucaccgucucaccccgaaacgcaccaggagaaauccugugguccgcaccacucggccccgaccuaaaccccuaccuaucacaccuggcccgcauguauaacggauacgcaggaggcuuugaaguacaagucauuuuagcuggcaacgcauucaccgcaggcaaaauaaucuucgcggccgucccaccuaacuuccccacagaaggccucuccccaucacaagucacaauguucccacacauaauagucgacguacgccaacucgaacccguacucaucccacucccugacguccgcaacaacuucuaucacuauaaccaaagcaacgacuccaccauaaaacucaucgccaugcucuacacaccccuucgcgcaaacaacgccggcgacgacguuuucaccguaucaugcagaguccucacccgaccaucacccgacuucgacuucaucuuccuaguacccccaacagucgaaucccgaacaaaaccuuucucaguaccaguccuaaccgucgaagaaaugacaaacucccgcuuccccauaccccuagaaaaacuauucaccggccccucauccgccuucguaguacagccccagaacggccgcuguacaacugacggcguccuccucggcacuacacaacuuucacccgucaauaucuguaccuuccgaggcgacguuacccacauaacaggcucucgaaacuacacaaugaaccuagcaucacaaaacuggaacaacugcgaccccacagaagaaauccccgcaccccuaggcacaccagacuucgucggaaaaauccaaggcaugcucacccaaacaacccgaacagacggaucaacccgcggccacaaggccaccgucuacacuggcuccgccgacuucgccccaaaacucggcagaguccaauucgaaaccgacacagaccacgacuucgaagccaaccaaaacaccaaauucacacccgucggcguaauccaggauggcucaaccacccaccgcaacgaaccccaacaauggguccuacccuccuacuccggccgcaacacccacaacguccaccuagcccccgccguggcaccuaccuucccaggagaacaacuucuuuucuuccgcuccaccaugcccggaugcuccgguuaccccaauauggaucucgacugccuccuaccccaagaauggguccaauacuucuaccaagaagccgcaccagcccaauccgacgucgcacuccuacguuucguaaaccccgacacaggccgcguccuauucgaaugcaaauuacacaaauccggcuacgucacugucgcacacacuggccaacacgacuuagucaucccgcccaauggcuacuuccgcuucgacagcugggucaaccaauucuacacacucgcccccaugggcaauggaacaggacgcagacgcuaa

SEQ ID NO: 38885 - RNA, 1617 nt, Artificial Sequence
  derived and/or modified sequence opt11 from VP1__Norovirus_and/or_Norovirus-like__KP244320
augaaaauggccuccuccgaugccaaccccucugacggcuccacugcaaaccuaguacccgaagucaacaacgaagucauggcucucgaacccgucgucggagcauccauagcagcacccguagccggccaacagaaugucauagaccccuggauccgcaacaauuucguccaggccccaggaggagaguucacuguaucaccccgcaacgccccuggcgaaauccucugguccgcaccccuaggcccagaccucaaccccuacuuaccccaccuagcccgaauguacaacggcuaugccggaggcuucgaaguccaagucauccuagccggcaaugccuucacagcaggcaaaaucaucuucgccgccgucccuccuaacuuccccaccgaaggccucagccccagccaagucacaauguucccccacauaaucguugacguccgccaacuagaacccguccucauaccccugcccgacguucgaaacaacuucuaccacuacuaccaauccaaugaccccaccauuaaacuaaucgccaugcuauacacaccccuccgcgccaacaaugccggcgacgacgucuuuaccgucucaugccgugugcucacgcgccccucccccgacuucgauuuuaucuuucuuguacccccuaccgucgaaucccgcaccaaacccuucucagucccaguccuaacaguagaagaaaugaccaacucacgauuccccaucccacucgaaaaacucuucacaggccccuccucggccuucguuguacaaccccaaaacggccgcugcacgaccgauggcguacuccucggcaccacccaacucuccccuguaaacaucugcaccuuccgcggcgacgucacgcauauaucaggcuccagaaacuacacaaugaaccucgcaagccaaaacuggaacuccuacgaccccaccgaagaaauccccgcaccccuagguacacccgacuucguagggaaaauucaaggcguacuaacacaaaccacccgcaccaacggcucgaccagaggccacaaagccaccguuuacaccggaucagccgacuucucccccaaacuaggcagaguacaauucgcaacugacaccgacaacgacuucgaaacgaaccaaaacaccaaauucacccccgucggagucauccaagacggcucaacaaccccucgcaacgaaucccaacaauggguccucccuucauacuccggacgcaacacccauaacguccaccuagcaccagccguagccccaaccuuccccggagaacaacuacucuucuuccgaucaaccaugccaggcugcucaggauaccccaacauggaccuagacugccuccucccccaagaauggguucaauacuucuaccaagaagcugcccccgcccaauccgacgucgcccuccuccgcuucguuaaccccgacacaggacgcguccuauucgagugcaaacuccacaaaucugguuacgucacaguugcccauacuggccaacacgaccucgucauacccccaaacggcuacuuccgcuucgacucaugggucaaccaauucuacacccuagccccaaugggcaacggcaccggacgccgacgcuag

SEQ ID NO: 38886 - RNA, 1617 nt, Artificial Sequence
  derived and/or modified sequence opt11 from VP1__Norovirus_and/or_Norovirus-like__KP244315
augaaaauggccuccucagacgcaaacccuuccgacggcuccacagccaaccucguccccgagguaaacaaugaaguuauggcccucgaaccagucgucggcgccgccaucgccgcuccagucgccggccaacaaaacgucaucgaucccuggauacgcuccaacuuuguccaagcacccggcggagaauuuaccguuucaccccgcaaugcccccggcgaaauccucugguccgcaccccugggccccgaccucaaccccuaccucucccaccuugcacgcauguacaacggcuacgccgguggcuucgucguucaaguaaucuuagccggcaacgccuucaccgcaggcaaaaucaucuucgccgcagucccacccaacuuccccacagaaggacuaucucccucacaagucacaauguucccccacaucaucgucgacgcccgccaacucgaacccguccucauaccccuccccgacguccgcaacaacuucuaccauuacaaccaaucuaacgaccccacaaucaaacucaucgccaugcucuauacaccccuucgagcaaacaacgccggcgacgacgucuucaccguauccugccgaguccucacccgacccucccccgauuucgacuucaucuuccuaguuccucccaccgucgaaucccgaacuaaacccuucuccgucccuguacuaacagucgaagaaaugacaaacucccgcuucccaaucccccucgaaaaacuauuuaccggccccucuuccgcguucguaguccaaccucaaaauggacguugcacuacagacggaguccuccucggaacgacucaacuuucgcccgucaauauaugcaccuuucgaggugacgucacccacaucuccgguucccgcaacuacaccaugaacuuagcaucccaaaacuggaacuccuacgacccaaccgaagaaauacccgcaccccucggaacccccgacuucgucggcaaaauccaaggcguccuaacacaaaccaccaaaaccgauggcucaacacgaggccacaaagccacaguauacaccggcuccgccgacuucucaccuaaacucggacguguccaauucgcuaccgauacagacaacgacuucgagacuaaccaaaacaccaaauucacccccgucggcguuauucaagacggaucaaccacuccccgcaacgaaccccaacaauggguacuccccuccuacuccggccgcaacacccacaacguacaccucgccccagccgucgcccccacauuucccggcgaacaacuccuuuucuuccgcuccaccaugcccggauguuccggauacccuaacauggaccucgauugccuccucccccaagaauggguacaauacuucuaccaagaagccgcccccgcucaaagcgacguugcacuccuucgcuucguaaaccccgacaccggacgaguccuguucgaaugcaaacuccauaaauccggcuacgucaccguagcccacacuggacaacacgaccucgucauaccucccaacggcuacuuccgcuuugacuccugggucaaccaauuuuacacacuugcaccuaugggcaacggcaccggcagacgaagauaa

SEQ ID NO: 38887 - RNA, 1617 nt, Artificial Sequence
  derived and/or modified sequence opt11 from VP1__Norovirus_and/or_Norovirus-like__KP244314
augaaaauggcaagcagcgacgccaaccccucagacggcuccaccgccaaccucguaccagaagucaacaacgaagucauggcgcucgaacccguaguaggcgccgccaucgccgcacccgucgccggccaacaaaacgucauagaccccuggauccgcaacaauuucgugcaagcucccggcggcgaguucaccguaagcccccgcaacgcccccggagaaauccucugguccgcaccccuaggccccgaccucaacccuuaccuaucccaccucgccagaauguacaacgguuacguaggcggcuucgaaguucaagucauacucgcuggcaacgcuuucaccgccggaaaaaucaucuucgccgccguaccaccuaacuuccccaccgaaggccucucccccucacaaguaaccauguucccccauaucaucguagacguccgccaacuagaacccguucucauaccccuccccgacguccgcaacaacuuccaccacuacaaccaaucaaaugaccccaccaucaaacuaaucgcaaugcucuacacccccuugcgcgccaacaacgccggcgacgacgucuucaccgucucuugucgcguacucacccgccccucaccagacuuugacuucaucuuucuaguucccccaacagucgaaucccgcacaaaaccauucuccguccccguccucaccgucgaagaaaugaccaacucccgauuccccauaccccucgaaaaacuauucaccgggcccuccucagcauucgucguccaaccccaaaacggccgcuguaccaccgacggcguccuacucggaaccacccaacucucccccgucaacaucugcaccuuuagaggagacguuacccacauccccgguucccgaaauuacacaaugaaucucgcuucccaaaacuggaacagcuacgaccccacagaagaaauuccagcaccccucggaaccccagacuucgucggcaaaauacaaggcguccucacccaaacaacccgaaccaacggcucuacacgcggccacaaggcaacuguauauaccggguccgccgacuucucgccaaaacucggccguauucaauucgccaccgacacagacaacgacuucgaaacuaaccaaaacaccaaauucacuccaguaggcguaauucaagacggaucuaccacaccccgcaacgaaccccaacaauggguacuacccuccuacucuggacgcaacacccacaacguccaccuagcccccgcaguugccccaaccuucccuggcgaacaacuacucuucuuccggucgaccaugcccggcugcuccggcuaccccaacauggacuuagacugucuucuaccucaagaauggguacaauacuucuaucaggaagccgccccagcccaauccgacgucgcccuucuacgcuucguaaacccugacaccggccgcguccucuucgaaugcaaacuacacaaauccggcuaugucaccguagcccacaccggccaacacgaccucguaauaccacccaacggcuauuuccgauuugauagcugggucaaccaauucuacacccucgcaccuaugggcaacggcaccggccgacgcagauaa

SEQ ID NO: 38888 - RNA, 1617 nt, Artificial Sequence
  derived and/or modified sequence opt11 from VP1__Norovirus_and/or_Norovirus-like__KM268078
augaaaauggccuccuccgacgcaaacccuuccgacggcucagccgcaaaccucguacccgaagucaacaacgaaguaauggcccucgaacccguaguaggcgccgccaucgccgcccccgucgcaggccaacaaaacgucaucgacccuuggauacguaacaacuucguacaagcccccggcggagaguucaccgucucaccccgcaacgccccaggugaaauccuaugguccgccccacucggacccgaccucaacccauaccucucccaccuagcccgcauguacaacggauaugcaggaggcuucgaaguccaagucauacuagccggcaacgccuucaccgccggcaaaguaauauucgcugccgucccacccaacuuuccaaccgaaggccucucacccucccaagucacuauguucccccacauuguagucgaugucagacaauuggaacccguucuuaucccccuacccgacguacgaaacaacuucuaccauuacaaucaauccaacgacuccacaaucaaacucaucgccaugcuuuacaccccacuccgagcaaacaaugcaggggacgacguauucaccgucucaugccgcguccuaacccgcccaucccccgauuucgacuucaucuuccuugucccuccuaccgucgaauccagaacaaaaccauucuccguacccguucuaaccguagaagaaaugaccaacucucguuuccccaucccccucgaaaaacuauucaccggcccaucuuccgccuucguaguccaaccucaaaacggccgcugcacuacugacggcguccuccucggcaccacgcagcuauccccaguaaacaucugcaccuuccguggcgacgugacacacaucacaggcucucgcaacuacacuaugaaccuagccagccaaaacugguccaacuacgacccuaccgaagaaauacccgcaccccuaggcacacccgacuucguaggcaaaauccaaggaguucuaacccaaacaacucgaaccgacggcuccacccgaggccacaaggccacaguauauacaggauccgcagacuucgcacccaaacugggccgaguacaauucgaaaccgacaccgaccacgacuucgaagcaaaccaaaacaccaaauucacacccgugggcgucauccaagacggcggcacuacccaccgaaaugaaccacaacaauggguccucccauccuacuccggcagaaacacccccaacguccaccuagccccagccgucgcacccacauuccccggagaacaacuccucuucuuccgcuccaccaugccaggcugcuccggcuaucccaacauggaccucgacugccuccucccccaagaauggguccaauacuucuaccaagaagcagcacccgcacaaucagacguagcccuauuacgcuucgucaacccggacaccggacgaguauuauucgaaugcaaacuucacaaauccggcuaugucaccgucgcacauaccggccaacacgaccucgucaucccaccuaacggcuacuucagauucgacuccugggucaaccaauucuacacccuugccccaaugggcaacggcaccggacgcagaagauaa

SEQ ID NO: 38889 - RNA, 1617 nt, Artificial Sequence
  derived and/or modified sequence opt11 from VP1__Norovirus_and/or_Norovirus-like__KM198555
augaaaauggccagcuccgacgcuaaucccagcgacggaucuacagccucccuaguucccgaagucaacaacgaagucauggcccucgaacccgucgucggggccgccaucgccgcccccgucgccggccaacaaaacgucaucgaucccuggauccgcaauaacuucguccaagccccgggcggagaguucaccgucucaccccgcaacgccccaggcgaaauccucugguccgcacccuuaggccccgaucucaaccccuaccucucccaccuagcccgcauguacaacggcuacgcuggaggauucgaaguacaagucguccucgccggcaaugccuuuaccgcaggcaaaaucaucuucgcagcugucccacccaacuuccccaccgaaggacuaucccccucccaagucaccauguucccacacaucaucguagacgugcgccaacuagaacccguccucaucccccucccagacguacgcaauaacuucuaucacuacaaccaauccaacgacccuacgauaaaacucaucgccaugcuauacacaccccuacgcgccaacaacgccggcgaugacgucuucaccguaucaugccguguccucacacgccccuccccagacuucgacuucauuuuccuagucccacccaccgucgaaucccgaaccaaacccuucuccguacccguccuaacaguagaagaaaugacaaacucccgcuuccccaucccacucgaaaaacucuucaccgguccuucaucugcauucgucguccaaccacagaacggccgcuguaccacagacggaguacuacuaggcacaacacaacucucacccguuaacaucugcaccuuccgaggcgacgugacccacaucucaggcuccagaaacuacacuaugaaccuagcgucccaauccuggaacuccuacgaccccacggaagaaauccccgcaccccucggaucccccgacuucguaggcaaaauacaaggcguucuaacccaaaccacacgaacuaacgguucaacccgcggucacaaagccaccgucuacacaggcuccgccgacuucucccccaaacucggacgcguccaauucgccaccgauaccgacaacgacuucgaaaccaaccaaaacaccaaauuuacacccgucggagucauccaagacggauccaccacaccccgcaacgaaccccaacaauggguccuuccauccuacuccggucgaaacauccacaacguccaucucgccccagccguagcacccaccuucccaggcgagcaacuccucuucuuccggucaaccaugccaggaugcucuggauacccaaauauggaccuagauugccuacucccccaagaauggguucaauacuucuaccaagaagccgcacccgcccaaucagacgucgcccuccuccgauucgucaaccccgacaccggccguguccuauucgaaugcaaacuccauaaauccggauacgucaccgucgcccacacuggacaacaugaccucgucauaccgccaaauggcuacuucagauuugacuccugggucaaccaauucuacacccucgcccccaugggcaacggcaccggccgccgccguuaa

SEQ ID NO: 38890 - RNA, 1617 nt, Artificial Sequence
  derived and/or modified sequence opt11 from VP1__Norovirus_and/or_Norovirus-like__KF060115
augaaaauggcuucuuccgacgccaaccccuccgacggcuccaccgccaaccucguccccgagguaaacaacgaagucauggcucucgaaccagucgucggcgcagcaaucgcagcaccaguugcaggccaacaaaacgucaucgaccccuggauccgaaacaacuucguccaagcacccggaggcgaguucacagucucuccccgaaacgccccaggagaaauccucugguccgcaccccucggccccgaucuuaacccauaccucucccaccuagcccgcauguacaacggauacgcuggaggcuucgaaguacaaguaauccucgccggcaacgccuucaccgccggcaaaaucaucuucgccgcagucccacccaacuuccccacugaaggccucucccccucccaagucacaauguucccccacaucaucgucgauguccgacaacucgaaccaguccucauaccccuucccgacguacgaaacaacuucuaccacuacaaccaauccaacgaccccacuaucaaacuaaucgccaugcuauacacaccccuccgcgccaacaacgccggcgaugacgucuucaccgucuccugccgcguccuaacccgccccucacccgacuucgacuucaucuuccucguacccccaaccgucgaaucaagaaccaaaccuuucuccguaccaguccucaccgucgaagaaaugaccaacucacguuuucccaucccccuagaaaaacucuuuaccggccccuccuccgcuuucguaguccaaccccaaaacggccgcugcaccacugacggaguccuuuuaggaacaacccaacuauccccugucaacaucuguacauuccgcggcgacguuacccacauacccggcucacgaaacuacaccaugaaccuggcaucccaaaacuggaacuccuacgaucccaccgaagaaauuccagcaccucucggcacccccgacuucgucggcaaaauccaaggcguucucacccaaaccacccgcacaaacggcuccacucgaggccauaaagcaacgguauacacaggcucagcagacuuuucacccaaacucggccgcguacaauucgcuaccgacaccgacaacgacuucgaaaccaaccaaaacacaaaauucaccccaguaggugucauccaagacgguuccaccacaccacgcaacgaaccccagcaauggguccuaccauccuacuccggccgcaacauccacaacguccaccuagcaccagccguagcucccacauucccaggugaacaacuucuauucuuccgaucuacaaugcccgguugcucuggauacccaaacauggaccucgacugccuccuaccccaagaauggguccaauacuucuaccaagaggcagcccccgcacaauccgacgucgcacuccuccgcuuuguuaaccccgacaccggccgcguccucuucgaaugcaagcuccacaaaccaggauacgucaccgucgcccacaccggacagcaugaccucgucauaccacccaauggauacuuccgcuuugacucaugggucaaccaauucuacacacucgcgcccaugggaaacggcacaggccgccgccgcuaa

SEQ ID NO: 38891 - RNA, 1617 nt, Artificial Sequence
  derived and/or modified sequence opt11 from VP1__Norovirus_and/or_Norovirus-like__KF060018
augaaaauggccuccucggacgccaaccccuccgacggauccacagccaaccuaguuccugagguuaacaacgaagucauggcacucgagccuguagucggugcagcaaucgccgcccccgucgccggccagcaaaacgucaucgacccguggaucagaaacaacuucguucaagcucccggaggcgaauuuaccgucuccccacgcaacgcccccggcgaaauccucugguccgccccacucggcccagaccuaaaccccuaccucucgcaccucgccagaauguacaacuccuacgccggcggcuucgaaguccaaguaauacucgccggcaacgccuucacagcgggcaaaaucaucuucgcagccguaccacccaauuuccccacagaaggccuaucuccaucacaaguaaccauguucccacacauaaucgucgacguacgccaacuagagccaguccuaauaccacuacccgacguccgcaacaacuucuaccacuacaaccaauccaacgaccccaccauaaaacucaucgccauguuauacacgccccuccgagcuaacaacgcaggcgacgacgucuuuaccgucuccugccgaguccucacccgaccauccccagacuucgacuucauauuccuagucccacccaccguugaaucaagaacaaaacccuucuccguccccguccucacagucgaagagaugacaaacucucgcuucccaaucccccuugaaaaacucuucaccggcccuuccucagccuucgucguccaaccccaaaacggccgcugcacuacggauggaguccuacucggcaccacccaacuaucccccgucaacaucugcaccuuccgcggcgacguaacccacaucuccggaucccgcaacuacaccaugaaccucgcaucccaaaacuggaacucauacgaccccacagaagaaauccccgcaccccuugggacacccgacuucguuggcaaaauccaaggcguucucacacaaacuacacgcaccgacggaucaaccagagggcacaaagccaccguauacaccggcucagccgauuucagcccuaaacucggccgcguccaauucgccacugacaccgacaacgacuuugucaccaaccaaaacaccaaauucacaccuguaggcguaauccaagacggcuccacaacaccucgcaacgagccacaacaauggguacuccccaguuacucuggacgcaacacccacaacguccaccuagcccccgcaguagccccaaccuucccaggagaacaacuccucuucuuccgcucaaccaugccaggaugcuccggcuacccaaacauggaccucgacugccuccucccacaagaauggguacaauauuucuaccaggaagcugcccccgcccaaucagacgucgcccuacucagguucgucaaccccgacaccggaagagugcuauucgagugcaaacuacacaaaucugguuacgucaccgucgcccacacaggacaacacgaccuaguaauaccacccaacggcuacuuccguuucgacucauggguuaaucaauucuacacccuagccccaaugggcaacggcacgggccgcagacgcuaa

SEQ ID NO: 38892 - RNA, 1617 nt, Artificial Sequence
  derived and/or modified sequence opt11 from VP1__Norovirus_and/or_Norovirus-like__KC517365
augaaaauggccuccaacgacgccaaucccagcgacggauccgccgccaaccuaguccccgaagugaacaaugaagucauggcucuagaacccgucgucggagcagccaucgccgcaccugucgccggccaacaaaacgucaucgaccccuggauccgcaauaacuucguccaagccccaggcggagaauuuacagucucgccccgcaacgccccaggcgaaauccucugguccgccccacuaggcccagaccucaaccccuaccucucacaucucgcccgaauguacaacgguuacgccggcggcuucgaaguccaggucauccucgccggcaacgccuucacagccggcaaaaucaucuucgccgccguacccccuaacuuccccacggaaggacuuucacccucucaagucaccauguucccccacaucaucguugacgugcgccaacucgaacccgugcucaucccacuccccgacguccgaaacaacuucuaucacuacaaccaaagcaacgacuccaccaucaaacuaauagccauguuauacacaccccuucgcgccaacaacgccggcgaagacgucuuuaccgucucaugccguguucucacccgccccucccccgacuucgacuuuaucuuccuaguuccacccaccgucgaaucgcgcaccaaaccauucacuguccccauacuaaccgucgaagaaaugacuaacucacgcuucccaauuccccucgaaaaacucuucacaggccccuccuccgcauucguuguccagccccaaaauggccgcuguacaacggacggcguccuacuagauacaacccaacuaagccccgucaacauaugcaccuucagaggcgacgucacacacaucgccggaucccgcaacuacaccaugaaccucgcuagccucaauuggaacaacuacgacccuacagaagaaauaccagccccacugggaacccccgacuuugucgguaaaauucaaggaaugcuaacucagaccacaaagggagacggcuccacacgcggccacaaagcaacaguauacacaggcuccgcccccuucacccccaaacuaggaucgguccaguucgaaaccgacacugaaaacgacuucgaaacccaccaaaacaccaaauucacacccguaggggucauccaagacggcggcaccacccaccgaaacgaaccccaacaauggguccuccccuccuacuccggccgaaacguaccuaaugcccaccucgcacccgccguagcccccaccuuccccggagaacaauuacucuucuuccgaucaacaaugcccggaugcuccggauaucccaauauggaccucgacugccuccuaccccaagaauggguucaacacuucuaccaagaagccgcaccggcccaaucagacguugcccuccuacgcuucgucaacccagacaccggucgaguacucuucgaaugcaaacugcauaaauccggauacguaaccgccgcccacacaggacaacacgaccuagucaucccacccaauggcuacuuccgauucgacuccugggucaaccaauucuacacucuggcacccaugggcaacggaaccggacgccgucguuga

SEQ ID NO: 38893 - RNA, 1617 nt, Artificial Sequence
  derived and/or modified sequence opt11 from VP1__Norovirus_and/or_Norovirus-like__KC517360
augaaaauggccuccaacgacgccuccccguccgacggcuccgccgccaacuuagucccugaagucaacaacgagguaauggcacuagaacccgucgucggcgccgccaucgccgcccccguggccggacaacaaaacgucaucgacccauggauccgcaauaacuucguccaagcuccagguggcgaguucacaguaucaccacgcaacgccccaggcgaaauacucugguccgcuccccucggccccgaccucaaccccuaucucucccaccucgcccguauguacaacggauacgccggcggauucgaaguccaagucauccucgcaggcaacgccuuuacagcuggcaaaaucauauucgccgccguaccacccaacuuccccaccgaaggccucucccccucccagguaaccauguucccccauaucaucgucgacguccgacaacucgagcccguacucaucccccuacccgacguacgcaacaacuucuaccacuacaaccaaagcaacgacucaaccaucaaacuaaucgccaugcucuauaccccacugcgcgccaacaacgccggcgaagacgucuuuacaguauccugccgaguccucacacgacccuccccagacuuugacuucaucuuccucguaccacccacagucgagucacgcaccaaacccuucaccguucccauccuuaccgucgaagaaaugaccaacucacgauuccccaucccccucgaaaaauuauucaccggccccucaucggcuuuugucguacaaccccaaaacggacgauguaccacagacggcguccuacucgguacaacccaacucucacccguuaauaucugcaccuuccgaggagacgucacacacaucgccggaucccgcaacuacacaaugaaccuugcuagccucaacuggaacaacuacgacccuaccgaagaaaucccagcaccucucggcacuccagacuuugucggaaaaauucaaggcaugcucacccaaacagcaaaaggagacggcagcacccgcggccacaaggcaaccguuuacacaggcuccgcacccuucacacccaaacuuggaucaguacaauucgaaaccgacacagaaaacgacuucgaaacccaccaaaauacaaaauucacccccguaggcgucauacaagacggcggcacaacacaccgcaacgaaccccaacaauggguccucccauccuacuccggacgcaacguacccaacguacaccucgcccccgccgucgcccccacauuucccggcgaacaacuccucuucuuccgcagcacaaugccuggaugcuccgguugcccugacauggaucucgacugccuccucccccaagaauggguccaacacuucuaucaagaagccgcccccgcccaaucugacgucgcacuacuccguuuuguaaacccagacaccggaagaguccuauucgaaugcaaacuccacaaauccggcuacgucaccgucgcacacacgggccaacacgaccuaaucauacccccaaacggcuacuuccgcuuugacuccugggucaaccaguuuuacacccuugccccuaugggaaacggaaccggccgccgccgcuaa

SEQ ID NO: 38894 - RNA, 1617 nt, Artificial Sequence
  derived and/or modified sequence opt11 from VP1__Norovirus_and/or_Norovirus-like__JX846928
augaaaauggcuucaucagacgcaucacccagcgacgguuccacugcaaacuuaguccccgaagucaacaacgaagucauggcccucgaacccguagccggcgcugccaucgcagcccccgucgccggccaacaaaauguaaucgacccauggauccgcaauaacuucguccaggcgccaggcggagaguucaccgucucaccgcgcaacgcacccggagagauccuuugguccgcaccccucggcccagaccucaaccccuaccuaagucaccuagcccgaauguacaacggauacgccggcggcuucgaaguccaagucauccuagcgggcaaugcauuuaccgccggcaaaaucaucuucgcagcaguacccccaaacuucccaacggaaggccucucacccucccaagucaccauguucccacacaucaucgucgacguccgccaacucgaacccguccucauuccccuacccgauguccgcaacaacuucuaccauuacaaccaacuaaacgacccaaccaucaagcucaucgcaaugcuauacacaccucuacgagccaacaacgccggcgaugacgucuuuaccgucuccugccgaguccuuacccgccccucccccgacuucgacuucauauuucucguaccucccaccgucgaaucucgcaccaaacccuucucagucccaguauuaaccguagaagagaugaccaacucccgcuucccaauuccccucgaaaaacucuucacaggccccuccuccgcauuugucguacagccccaaaacggaagaugcaccaccgacgguguacuccuaggaacaacacagcucucaccagucaacaucugcacauuccgcggggacgucacccacauauccggaucccgcaacuacaccaugaaccuagcgucacaaaauuggaacucauacgaccccaccgaagaaauccccgcaccccucggaacaccagacuuuguagguaaaauccaaggcguccuaacucagacaacucgaaccaacggcucaacccgcggccacaaagccaccgucuauaccggcuccgccgacuucucacccaaacuaggccguguccaauucgccaccgacaccgacaacgacuucgaaaccaaccaaaacacuaaauucacacccguaggcgucauccaagacggcaacaccacaccccguaacgaaccccaacaauggguuuuaccuuccuacucaggacgaaacauccaaaacguccaccuagcccccgccguagcccccaccuuccccggagaacaacuacuguucuuccgcuccaccaugcccggaugcuccgguuaccccaauauggaccuagacugccuccucccacaagaauggguccaauacuucuaccaagaagccgcccccgcccaguccgauguugcccucuuaagguucgucaaccccgacacaggcaggguacuuuucgaaugcaaacugcacaaauccggcuacgucaccgucgcacacaccggacaacacgaccucguaauacccccaaauggcuacuuccgcuucgacucaugggucaaccaauuuuacacacuggcccccaugggcaacggcaccggccgucgccgauaa

SEQ ID NO: 38895 - RNA, 1617 nt, Artificial Sequence
  derived and/or modified sequence opt11 from VP1__Norovirus_and/or_Norovirus-like__JX459904
augaaaauggcaagcuccgacgcaaaccccagcgacggcuccaccgccaaccucguacccgaagucaacaacgaagucauggcacucgaacccguagucggcgccgccaucgccgcccccguagccggacaacaaaacgucaucgaccccuggauccgcaacaacuucguccaagcccccggcggcgaguucaccguuagcccacgcaacgcaccaggagaaauccucuggucagcaccacucggcccagaccucaaccccuaccucucccaccucgcacgcauguacaacggcuacgccggcggauucgaaguacaaguaauucucgccggaaacgccuucaccgcaggcaaaauaaucuuugcugcugucccacccaacuuccccaccgaaggccucucccccucccaggucacaauguucccccacauaaucgucgauguucgccaacucgaacccguccuuauaccccuccccgacguacgcaacaacuucuaccacuacaaccaaagcaacgaccccacaauaaaacucaucgccaugcucuacacaccccucagagccaauaaugcaggcgacgacgucuucaccguaucaugccgcguccucacccguccaucuccagacuucgacuucaucuuccucguaccacccacuguagaaucccgcacaaaacccuucucaguacccguccuaaccgucgaagaaaugaccaacucccgcuuccccauaccccuagaaaaacucuuuaccggccccucaucggccuucguaguccaaccucagaacggacggugcacaacagacggcguccuucucggcaccacccaacuaucaccaguaaacaucuguaccuuccgaggcgacgucacucacaucucaggaucccgcaacuacacaaugaaccucgccucccagaacuggaacucauacgaccccaccgaagaaauccccgcuccacuuggcacccccgacuucguaggaaaaauacaaggcaugcucacccaaaccacccguaccgacggcuccacccgcggccacaaagccacagucuacacuggcuccgcugacuucucuccgaaacuaggucgaguccaauucgcuaccgacacagauaaugacuucgucaccaaccaaaacaccaaauucacccccgucggcguaauccaagacggcuccaccacuccccgaaacgaaccccaacaauggguacuacccuccuacuccggccgcaacacccacaacguccaccucgcccccgccgucgccccaaccuuucccggcgaacaacuacucuuuuuccgcuccaccaugccaggcugcucgggauaccccaacauggaccucgacugccuccucccacaggaauggguccaauacuucuaucaagaagcagcccccgcacaauccgacguagcccuccuccgcuucguaaaccccgacaccggccgggucuuauucgaaugcaaacuccacaaaacaggcuacguuacagucgcacacacuggccaacacgacuuagucauucccccuaacggauacuuccgcuucgacuccugggucaaccaguucuacacccuugcacccaugggcaauggcaccggccgucgccgcuag

SEQ ID NO: 38896 - RNA, 1617 nt, Artificial Sequence
  derived and/or modified sequence opt11 from VP1__Norovirus_and/or_Norovirus-like__JX459649
augaaaauggcauccuccgacgccaaccccagcgacggguccaccgccaaccuugugccggaagucaacaacgaaguaauggcacucgaaccagucgucggcgcagccaucgccgcucccgucgccggacaacaaaauguuaucgaccccuggauccgauccaacuucguccaagcccccggaggagaauuuacugucucuccccgcaacgccccaggagaaauccuuugguccgccccacuuggccccgaccuaaaccccuaucucucccaccuagcccgaauguacaacggauacgcaggaggcuucgaaguccaagucauacucgccggcaacgccuucaccgccggaaaaauaaucuucgccgccguacccccaaacuucccaaccgaaggccucuccccaucacaagucacaauguucccucacaucauagucgacguccgccaacuagaaccaguccucaucccccucccagacguccguaacaacuucuaccacuacaaccaaucaaacgaccccacuaucaaacuaaucgccaugcuuuacacuccccuacgcgcuaacaacgcaggcgacgacgucuucaccgucucaugccgcguccucacccguccaucacccgacuucgacuucaucuuucucguacccccaacugucgaaucccgcaccaaacccuucucuguccccguccuuaccgucgaagaaaugacaaacagccgcuucuccauuccccucgaaaaacuauucaccggccccuccuccgccuucgucguccaaccccaaaacggccgcugcacaaccgacggcguccuccuaggcaccacccaacuaagcccagucaacaucugcacuuuccggggagacguaacccauaucccaggaucacguaacuacaccaugaaccuagccucacaaaacuggaacucauacgaccccacugaagaaauccccgcaccccuuggcacacccgacuucgucggcaaaauccaaggaguacucacccaaaccacacgcaccaacggcuccacccgcggccacaaagccaccguauacaccggcucagccgacuucuccccaaagcucggccgaguccaauucgcuaccgauaccgacaacgacuucgaaacaaaucaaaacacaaaauucacccccguaggcguuauacaagacggcucaaccaccccacgcaacgaaccccaacaguggguacuccccucuuacuccggccgcaauauacacaauguccaucuugcccccgccgucgcaccaaccuuuccaggcgaacaacuccucuucuuccgcagcacaaugccaggcugcucaggcuaucccaacauggaccuugacugccucuuaccccaggaauggguacaauacuucuaccaagaagcagcccccgcccaaucagacguagcccuccuccgcuucguaaaccccgacaccggccgcguccucuucgaaugcaaacuccacaaaucuggauauguaaccguagcccacacaggccaacacgaccucguaauacccccaaacggcuacuuccgauucgacagcuggguuaaccaauucuauacccuugccccaaugggaaacggcaccggccgacgccgcuaa

SEQ ID NO: 38897 - RNA, 1617 nt, Artificial Sequence
  derived and/or modified sequence opt11 from VP1__Norovirus_and/or_Norovirus-like__JX459643
augaaaauggcauccuccgacgccaaccccuccgacggaucuacagccaaccucguccccgaagucaacaacgaagucauggcccucgaacccgucgucggggcagcaauugccgcacccgucgcaggccaacaaaacguaauagauccauggauccgcaacaauuucguucaagccccaggcggcgaguucacuguaucaccacgcaacgccccuggcgaaauucucugguccgccccacucggccccgaccucaacccauaccucucccaccucgcccgcauguacaacggauaugccgguggcuucgaaguccaaguaauccucgccggaaacgcauucacagccggcaaaaucaucuucgcagcaguaccacccaacuucccaacagagggacucucccccucacaagucaccauguuuccccauaucauaguagacguccgucaacuugaacccguccuaaucccccuccccgacguccgcaacaacuucuaccacuauaaucaaagcaacgacccaacaaucaaacuuaucgccauguuauacaccccucugcgagcaaacaacgccggagacgacgucuucaccguauccugccgcguccuaaccagaccaucgcccgauuucgauuuuauuuuccuaguacccccuaccgucgaaucccgcaccaaacccuucucaguccccguccuuacugucgaagaaaugacaaacucccgcuuccccaucccacuagaaaaacucuucaccggacccucuagcgccuucgucguccaaccccaaaacggccgcugcaccaccgacggaguccuacucggaacaacccaacucuccccggucaacauaugcaccuuccgcggcgacgucacccauauccccgguucucgcaacuacacaaugaaccuagccagccaaaacuggaacuccuacgauccuacugaagaaaucccagccccgcucggcaccccagauuucgucggcaaaauacaaggaguccuuacacaaaccacaagaacaaacggauccacccgcggccacaaagcuacaguauacaccggcagcgcagacuuuucccccaaacuuggccggguagaauuugccaccgacaccgacaacgacuucgagaccaaucaaaacacaaaauucacacccgucggugucauucaagacggcuccacaacaccccgcaacgaaccacaacaguggguccuacccuccuacuccggucgcaacauccacaacguacaucucgcacccgcuguagccccuacauuccccggcgaacaacuacucuucuuccgcucuaccaugcccggcugcucaggauacccaaacauggaccucgacugccuccuaccccaagaauggguccaauacuucuaccaagaagccgcccccgcacaaucagauguugcccuccuacgcuucguaaaccccgacaccggccgcguccucuucgaguguaaacuccacaaguccggcuacgucaccgucgcacacaccggccaacacgaccucguaaucccacccaacggcuacuuccgauucgacuccugggucaaccaauuuuacacucucgcccccaugggcaacggcaccggccgacgacgauaa

SEQ ID NO: 38898 - RNA, 1617 nt, Artificial Sequence
  derived and/or modified sequence opt11 from VP1__Norovirus_and/or_Norovirus-like__JX459602
augaaaauggcuucaaaugacgccaacccauccgacggaucagcagcuaaccuaguccccgaagucaacaacgagguaauggcccuagaaccaguagucggagccgccaucgcagcacccgucgcgggccaacaaaacgucaucgaccccuggauccgcaauaacuucguccaagccccuggaggagaguucaccgucagcccucgaaacgccccaggcgaaaucuuauggucagccccacucggccccgaccuuaaucccuaccuaagccaccucgcccgcauguacaacggcuacgcaggcggauucgaaguccaaguaauccuagccggcaacgcauucacagccggcaaaaucaucuucgcagccgugcccccaaacuuccccaccgaaggccucucacccucccaaguaaccauguucccccacauaaucgucgacguacgucaauuagaacccguccucauaccccuaccugacguacgcaacaacuucuaccacuacaaccaauccaaugacuccaccauaaaacucaucgccaugcuauacaccccacuccgcgccaauaacgccggcgaagacguauucacagucuccugccgugucuuaaccagacccucccucgacuucgacuucaucuuccuugucccacccacggucgaauccagaacaaaacccuucacaguccccauccucaccguagaagaaaugaccaacucucgcuuccccaucccccucgaaaaacuuuucaccggccccuccggcgccuucgucguacaaccacaaaacggacgcugcaccaccgacggcguccuacucggaacaacccaacucucacccgucaacauaugcacauuccgaggcgacgucacccacaucgccggcucccgaaacuacacuaugaaccucgccucgcucaacuggaacaacuacgacccaaccgaagaaacacccgcuccccuaggcacccccgacuucgucgguaaaauacaaggcguucuuacacaaacaacaaaaggcgacggcuccacacgcggccacaaagcaacggucuacaccggcucagccccauucacccccaaacucggaagcguccaauucucuaccgacaccgaaaaugacuucgaaacccaccaaaacaccaaauucacacccguaggagucauccaagacggcggaaccacacaccgaaacgaaccccaacaauggguccuccccuccuacuccggccgcaauguccacaacgugcaucuagccccagcagucgccccaaccuuccccggugaacaacuccuauucuuccgaucaacgaugcccggaugcucaggcuaccccaacauggaccucgacugccuacugccacaagaauggguccaacacuucuaccaagaagcagcaccagcccaaucagaugucgcacuucuccgcuucguaaauccagacacaggacgcguacucuucgaaugcaaacuccacaaauccggcuacguaacagucgcccauaccggccaacacgaccuagucaucccacccaacggcuacuuccgcuucgauuccuggguaaaccaauucuacacccucgccccaaugggcaacggaaccggacgccgccguuaa

SEQ ID NO: 38899 - RNA, 1617 nt, Artificial Sequence
  derived and/or modified sequence opt11 from VP1__Norovirus_and/or_Norovirus-like__LC177655
augaaaauggccucaucagaugcaaaccccuccgacgguagcgccgcuaaccugguccccgaaguaaacaacgaagucauggcccucgaaccugucgugggagcugccauagcugcccccgucgccggccaacaaaaugucauugaccccuggauccgcaacaacuucguccaggcucccggcggagaauucacagucuccccccgaaacgcacccggggaaauccucuggcgcgccccccuaggacccgacuuaaacccauaucuaagccaccucgcacgcauguauaacggcuacgccggaggcuucgaaguacaagucauccucgcuggcaacgcauucaccgccggcaaggucaucuucgccgcaguccccccaaacuuccccaccgaaggccugucccccucccaaguaaccauguucccacacaucgucguagacguacgccaacucgaacccguacuuauaccacucccagacguccgcaacaacuucuaccacuacaaccaauccaacgaccccaccauaaaacucaucgcuaugcucuacaccccccuccgcgccaacaaugccggagaugacgucuucaccguauccugccgcguacuaaccaggccuucccccgacuucgacuucaucuuccucguaccaccaaccgucgaaucccgaaccaaacccuucuccguacccguacuaaccgucgaagaaaugaccaacucccguuuccccaucccacuagaaaagcuuuucaccggcccuuccucggccuucguuguccaaccacaaaacggacgcuguacuaccgacggaguacugcuagggaccccccaauuaucaccaguaaacaucuguaccuuccgcggcgacgucacccacaucaccggcucacgcaacuacacaaugaaccuagcaagccaaaacugguccaauuacgaccccaccgaagaaaucccugcaccccucggaaccccagacuucgucggaaaaauccagggcguccuuacccaaacaacucgaacugacgguagcacccgcggccacaaagccaccguauacaccggcucagccgacuucgcacccaaacucggacgcguacaauucgaaacagacacggacagagacuucgaagccaaccaaaacaccaaauucaccccagucggagucauacaagacggcuccacaacccacagaaacgaaccccaacaauggguccucccauccuacucaggucgaaacacccccaacguucaccucgcacccgcaguagccccaaccuucccuggcgaacaacuacuauucuuccgcuccaccaugcccggaugcuccggcuaccccaacauggaccucgacugccuacucccccaagaauggguucaauacuucuaccaagaagccgcccccgcucaaucagacguagcacugcuccgcuucguaaaucccgacacaggccgcguccucuucgaaugcaaacuccacaaauccggcuacgucacaguagcccacaccggccaacacgaccucgucaucccaccuaauggcuacuuccgcuucgacagcuggguuaaccaauucuauacccuagcacccaugggcaacggaaccggccgucgacgcuga

SEQ ID NO: 38900 - RNA, 1617 nt, Artificial Sequence
  derived and/or modified sequence opt11 from VP1__Norovirus_and/or_Norovirus-like__KP784698
augaaaauggcaucauccgaugccaaccccagcgauggaucaacagcaaaccuuguuccugaaguaaacaacgaagucauggcacuugaaccaguagucggcgccgccauagccgcccccgucgcaggccaacaaaaugucaucgacccauggauacgcaauaacuucguucaagccccaggcggcgaguucaccgucaguccccguaacgcccccggagaaauccucugguccgcuccccuaggccccgaccucaacccauaccugucccaccucgcccgcauguauaacggcuacgcaggcggauucgaaguccaagucauccucgcuggcaacgccuucaccgcugguaaaauaaucuucgcugcugucccacccaacuuccccaccgaaggccucucccccucucaagucaccauguuuccgcacauuauuguugacguccgacaacuagaaccaguccucauuccacuacccgacguccgcaacaauuucuaccauuacaaccaauccaacgacuccaccaucaaacucaucgccaugcucuauacuccccuacgcgcaaacaacgccggcgacgacgucuuuaccgucuccugccgcguccucacccgcccaagcccagacuucgacuucauauuccucguuccucccaccguagaaucccgcacgaaacccuucuccgucccaguccucaccgucgaagaaaugaccaacucccgcuuccccaucccacucgaaaaacucuucacaggcccuagcagcgccuucgucguccaaccacaaaacggccgcuguaccacagacggcguccuccuaggcaccacacaacucucccccguuaacaucugcaccuuccgcggcgacgucacacacaucucuggcucccgcaacuacacaaugaaccucgcgucccagaacuggaacuccuacgaucccaccgaagaaauccccgcuccccuagguacacccgacuucguggguaaaauacagggaguacucacacaaacaacccgcaccgacggcuccacccgcggccacaaagccaccgucuacacaggcuccgccgacuuuaccccuaaacucggcagaguccaauucgcaaccgauaccgauaacgacuucguaaccaaccaaaacacaaaauucacacccguaggcgucauacaggacggcuccacaaccccacguaacgagccccaacaauggguccuucccuccuauuccggccguaacacacacaacguccaccucgccccagccgucgcccccaccuuccccggagagcaacuccuauucuuccgcuccacuaugcccggcuguuccgguuaccccaacauggaccucgacugccuccuaccccaagaauggguccaguauuuuuaccaagaagccgcccccgcccaaagcgacgucgcacuucuccgcuucgucaacccggacaccggacgcguccucuucgaaugcaaacuacauaaauccggcuacgucaccgucgcccacaccggacaacacgaccuagucaucccacccaaugguuacuuccgcuucgacuccuggguaaaccaauucuacacccucgcaccaaugggaaacggcacaggccgccgccgcuga

SEQ ID NO: 38901 - RNA, 1617 nt, Artificial Sequence
  derived and/or modified sequence opt11 from VP1__Norovirus_and/or_Norovirus-like__KX354104
augaaaauggccucaagcgacgcaaaccccuccgacggcucagccgccaaccucgucccugaagucaacaacgaagucauggcacucgaaccagucguaggcgcagccauagccgcgcccguugccggacaacaaaacguuauugaccccuggauccgcaacaauuucguccaagcacccggcggagaguucaccgucuccccacgcaacgcccccggugaaauccucugguccgcccccuuaggucccgaccucaaccccuaccuaucccaccuagcgcgaauguacaauggcuacgccggaggcuucgaaguucagguuauccuagccggcaacgcauucaccgccggaaaagucauauucgcagccguacccccaaacuucccuaccgaaggccucucaccaucacaagucacaauguucccacacauugucgucgacguccgccaacucgaaccuguccuaauaccccuccccgacguacgcaacaacuucuaucacuacaaccaauccaacgacccaaccauuaaacuaaucgcgaugcucuacacgccccuccgcgccaacaacgcaggcgaugacgucuucaccguauccugcagaguccucaccagacccagccccgacuucgauuuuaucuuucucgucccacccaccgucgaaucgcgcaccaaacccuucuccguccccguccuaaccguugaggaaaugaccaacagccgcuucccgauaccccuagagaaacuauucaccggcccuuccuccgccuucguaguucaaccccaaaacggccgcugcaccaccgacggaguucuccucggaacaacccaacuaucucccgucaacaucugcaccuucagaggcgacguaacccacauuaccggcuccagaaacuacaccaugaaccucgccagccaaaacuggucuaacuacgaucccaccgaagaaauacccgcaccccucggcaccccggacuucgucggcaaaauccaagguguccuaacacaaaccaccagaacagacggaucaacccgcggccacaaagccaccguauacauaggcucagccgacuucgccccuaaacucggccgcguccaauucgaaacagacaccgaccaugacuucgaggccaaccaaaacacaaaauucacccccgucggcgucauccaagacggaggcacaacccaccgaaacgagccccaacaauggguccuaccauccuacucaggccgcaacaccccuaacguucaccucgcccccgccguugccccaaccuucccuggagaacaacuccuauucuuccgaucaaccaugccagguugcucaggcuaccccaacauggaccucgacugccuacucccacaggaauggguccaauacuucuaccaagaagccgcccccgcccaaucagacgucgcacuauuacgguucgucaaucccgacacagggagaguccucuucgaaugcaaacuacacaagucuggcuauguaaccgucgcccacacaggccaacacgaucuaguaaucccacccaacggcuacuuccgauuugacuccugggucaaccaauucuacacacucgcaccaaugggcaacggaaccggacgccgccgcuaa

SEQ ID NO: 38902 - RNA, 1617 nt, Artificial Sequence
  derived and/or modified sequence opt11 from VP1__Norovirus_and/or_Norovirus-like__KR904211
augaaaauggcaucaucagacgcaaaccccucagacggcuccaccgccaaccuugucccagaagucaacaacgaagucauggcccuagaacccguugucggugcugccaucgccgccccugucgccggacaacaaaacgcuauagacccauggauccgcaauaacuucguccaagcacccggaggcgaguucaccguaucccccagaaacgccccaggcgaaauccucuggucggcaccgcucggaccagaccucaacccauaccucucgcaccuagcccgcauguacaacggcuacgccggcggauucgaaguccagguaauucuagcaggcaacgcauucaccgccggcaaaauaaucuucgcagccgucccaccaaacuucccaaccgaaggccuauccccaucacaaguaaccauguucccccacaucaucgucgacguccgccaacucgaacccguccucaucccccuccccgauguacgcaacaacuuuuaccacuacaaccaauccaacgauuccaccaucaaacuaaucgcuaugcucuacacaccccuccgcgcaaacaacgcuggcgacgacguuuucaccguaucaugccgcguccucacacgcccaucacccgauuucgacuucauauuccuuguuccgccaacagucgaaucacgcaccaaacccuucuccguaccaauccucaccguagaagaaaugaccaacucccgguucccuaucccccucgaaaaacucuucaccggcccauccuccgcauucguaguucaaccccagaacggccgcugcacaacagacggcguccuucuaggcaccacccaacuuucccccguuaacauaugcaccuuccgcggcgacguuacccacauagcaggcucaagaaacuacaccaugaaccucgcaucucaaaacuggaacuccuacgacccaacagaagaaauccccgcgccacucggcacuccagauuucgucggcaaaauccaaggcguccuaacccagacaaccagaaccgacggaagcacacggggccacaaagccaccgucuacacuggaagugccgacuucucacccaaacucggccgcguccaguuugccacagacaccgacaacgacuucgacgccaaccaaaacaccaaauucacacccguaggaguaauccaagacggcggaacaacccaucgcaaugaaccccaacaaugggucuuaccuagcuacucgggacgcaauauacacaacguacaccucgcccccgccgucgccccaaccuuccccggagaacaacuucucuuuuuccggucuaccaugccuggcugcucaggauaucccaacauggaccuagacugccugcucccucaagaauggguucaauauuucuaucaagaagccgccccagcccaauccgacguagcccuccuccgcuucguaaacccagacaccggccgcguccucuucgaauguaaacuccacaaaucaggcuacgucaccguagcccacaccggccaacaugaucuugucauaccucccaauggauauuuccgcuucgacucauggguuaaccaauucuacacacucgcccccaugggaaacggcacaggccgccgcagauaa

SEQ ID NO: 38903 - RNA, 1617 nt, Artificial Sequence
  derived and/or modified sequence opt11 from VP1__Norovirus_and/or_Norovirus-like__AB933743
augaaaauggccucaucagaugccaaccccagcgacggauccaccgcaaaccucguacccgaaguuaacaaugaagucauggcccuugaacccguaguaggagccgccaucgcggccccgguagcaggccaacaaaauguuaucgaucccuggauccgaaacaacuucguccaagccccuggcggcgaauuuaccgucaguccccgcaacgcacccggcgaaauacuuugguccgccccacucggacccgaccuaaaccccuaucucucccaccucgcccgcauguacaacggcuacgccggcggcuucgaaguacaagucauccucgcaggcaacgccuucaccgccggcaagaucaucuucgcagcagucccacccaacuuccccaccgaaggacucucgcccucucaagucacaauguucccccacaucaucguugacgucagacaacuugaacccguucucaucccccuccccgacguaagaaacaacuucuaccacuacaaccaauccaacgacucuaccaucaaacuuauagccaugcucuauacuccccuccgagccaacaacgccggcgacgauguauucaccgucucuugccgaguccuaacccgccccucacccgacuucgacuucaucuuccuagucccucccaccguagaaucccgcaccaaacccuucuccguacccguccuaaccgucgaagaaaugacaaacucucgcuuucccaucccccuagaaaaacuauucacaggucccucauccgccuucguaguacagccccaaaacggacgcugcaccaccgacggaguacuccucggcaccacacaacucucaccagucaacaucuguaccuuccgcggcgacgucacacacaucuccgguucacgcaauuacacgaugaaccuggcgucucaaaacuggaacucuuacgacccaacagaagaaauccccgcaccccuaggaaccccugacuuugucggcaaaauccaaggagucuuaacccaaacaacccgcacaaacggauccacccgaggccacaaagccaccgucuacaccggcuccgccgacuucuccccuaaacucggccgcguacaauucgcuaccgacacagacaacgacuucgaaaccaaccagaacaccaaauucaccccagucggagucauccaagacggauccacuacuccccgcaacgaaccccaacaauggguccuccccuccuacuccggccgcuccauacauaacguacaccuagcccccgccgucgcaccuaccuuccccggcgaacaacuccucuucuucagguccaccaugcccggcugcuccgguuacccaaacauggaccucgacugucuccucccccaggaauggguccaauauuucuaccaagaagccgcccccgcccaaucggacgucgcccuccuccgcuucgucaaccccgacaccggccgcguccucuucgaaugcaaacuccacaaauccgguuaugucaccguagcacacacaggucaacaugaccucgucaucccacccaauggcuacuuccguuucgauuccuggguaaaccaguucuacacccucgcaccaaugggcaacggcacaggucgccgccgauaa

SEQ ID NO: 38904 - RNA, 1617 nt, Artificial Sequence
  derived and/or modified sequence opt11 from VP1__Norovirus_and/or_Norovirus-like__LN854572
augaaaauggcaagcucugacgcuaaccccucagacggcuccacagccaaucucguccccgaaguuaacaacgaagucauggcccucgaaccagucgucggcgcagcuaucgcagccccaguugcaggacaacaaaacgucauugacccauggauacguaacaacuucguacaagcacccggcggugaguucaccgucucaccccgaaacgccccaggcgaaauccucuggucagccccacucggccccgaccuaaauccauaucuaucucaccuagccagaauguacaacgguuacgccggcggauucgaaguccaagucauccuggccggcaacgcauucacugccggcaaaauaauuuucgccgcaguacccccaaauuuccccacagaaggccucucucccucucaagucacaauguucccccacauaaucgucgacguccgccaacuagaaccaguacucaucccccuacccgacguucgcaauaacuucuaccacuacaaccaauccaacgacccuaccaucaaacucaucgccaugcuuuacaccccacuucgcgccaacaacgcuggcgacgacguauucacggucuccugccgaguccucacccgccccucucccgauuucgacuucaucuuccuuguaccacccaccgucgaauccagaacaaaacccuucuccguccccguucugacagucgaagaaaugaccaacucaagauuccccaucccccuagaaaaacucuucaccggccccuccagcgcauucguuguccaaccccaaaacgguagaugcacaacugacggaguccuguuaggaacaacccaacuaucccccguaaacauaugcaccuuccgaggcgacgucauccacaucccaggcucccgcaacuauacuaugaaccuagcaucccaaaacuggaacuccuaugaccccacagaagaaaucccagcaccccucggaaccccagacuucgucggcaagauccaaggcguacuaacacaaaccacccgcaccaacggaucaacccgcggacacaaggccaccgucuacaccggcucugcagacuucucucccaaacuuggucgcguccaguucgccacagacaccgacaaugacuucgaaacgaaccaaaacacuaaauucacacccguaggcgucauccaagacggaucuaccacaccccgaaacgaaccucaacaauggguccuaccuuccuacuccggucgaaacauccacaacguacaccucgcccccgcaguagcgcccaccuucccaggcgaacaacuccuauuuuuccgauccaccaugcccggcugcuccggcuaccccaacauggaccucgacugccuccucccccaagaauggguacaauacuucuaccaagaagcagcccccgcccaauccgacgucgcccuccuacgcuucguaaacccagacaccggacgcguccuuuucgaaugcaaacuccauaaauccggauacgucaccgucgcccacaccggucagcacgaccucguaaucccacccaacggauacuuucgguucgauuccugggucaaccaauucuacacccuagcccccaugggcaacgguaccggccgucgccgcuaa

SEQ ID NO: 38905 - RNA, 1617 nt, Artificial Sequence
  derived and/or modified sequence opt11 from VP1__Norovirus_and/or_Norovirus-like__KP244319
augaaaauggccuccuccgacgcaaaccccucugacggcucuaccgccaaccucguaccagaagucaauaacgaaguaauggcacucgaaccagucgucggagccgcaaucgccgcccccgucgccggacaacaaaacgucauagaccccuggauccggaacaacuucguacaagcacccggaggagaguucacagucagcccccgaaacgccccaggcgaaauccuauggagcgccccucuaggccccgaccucaacccauaccucagccaccucgcacgcauguacaacggauacgcuggaggauucgaaguacaaguaauccuagccggaaacgcuuucaccgccggaaaaaucaucuucgcagccguacccccaaacuucccaaccgaaggacucucacccucccaagucaccauguucccccacaucauagucgacguccgccaacuagaacccgucuccauuccccuuccagacguccgaaacaacuuuuaccacuacaaccaaucaaacgaccccacuauuaaacucaucgcaaugcucuacacccccuuacgcgccaacaacgccggcgacgaugucuuuacagucucaugccgcguccucacccgccccagcccggauuucgacuucaucuuucucgucccacccaccguugaaucacgcacaaagcccuucucaguacccguccucaccguagaagaaaugacaaacucccgcuuccccaucccauuagaaaaauuauucaccggccccucuuccgcauucguaguccaaccccagaauggucguugcaccacagacggcguccuacucggcaccacacaauuaucacccgucaacaucugcacauuccgcggagacgucacacauauucccggaucacgcaacuacaccaugaaucuagccucgcaaaacuggaacuccuacgaccccaccgaagaaauacccgcaccccuuggcacccccgauuucguaggcaaaauccaaggcguccucacacaaaccacccgcgccaacggcagcacccgagggcacaaagccacagucuacaccggcucugccgacuucagcccaaaacucggacgcguccaauucgccaccgacacagacaacgacuucgaaacuaaccaaaacaccaaauucacucccgucggcgugauccaagacggcuccaccaccccacgcaacgaaccccagcaauggguacuaccuuccuauagcggccgcaacauccauaacguccaccucgcccccgccgucgcacccacauuucccggagaacaacuacucuuuuucagaucaaccaugcccgggugcuccggcuaccccaacauggaccuugacugccuccuaccccaagaauggguccaauacuucuaucaagaagccgccccagcccaauccgacgucgcccuccuacgauucguaaaccccgacacaggccgcguacucuucgaaugcaaacuacauaaauccggcuacguaacuguagcccacacaggacaacacgaccuaguuaucccaccuaacggauacuucagauucgacucuugggucaaccaauucuacacacuagcacccauggguaacggcacaggccgccgccgauaa

SEQ ID NO: 38906 - RNA, 1617 nt, Artificial Sequence
  derived and/or modified sequence opt11 from VP1__Norovirus_and/or_Norovirus-like__KF768470
augaaaauggcaucuucagacgcaaaccccagcgacggauccaccgcaaaccucgucccugaagucaacaacgaagucauggcccucgaaccgguagucggcgcagccaucgcugcccccguagccggccaacagaacgucauugaccccuggauacgaaacaacuucguccaagccccuggcggagaauuuaccgucuccccucgcaacgcccccggcgaaauacucuggucagcgccccucggccccgaccucaaccccuaccucucccaccuugcacguauguacaacggcuaugcaggaggauucgaaguccagguuauccuugccgguaacgccuucaccgccggaaaaaucauauucgccgccguucccccuaacuuccccaccgaaggccucucacccucacaagucacaauguucccccacaucaucguggacguacgacagcucgaacccguccuaauaccccuacccgacguccgcaacaacuucuaccacuacaaccaaucaaacgacuccaccaucaaacucaucgccaugcucuacacaccccugcgcgcaaacaacgccggagacgacguauucaccguauccugcagaguccuuacccgacccucaccagacuucgacuucaucuuccucguaccacccacuguagaaucucgcacaaaacccuucuccguccccguccucaccgucgaagagaugacaaacucacgcuuccccauaccacucgaaaaacuauucacaggcccauccuccgccuuugucgugcaaccucaaaacggccgcugcaccacugacggaguacuccucggcaccacacaacuaagccccgucagcaucugcaccuuccgcggugacgucacacacauccccggcucccacaacuacaccaugaaucuagccucccaaaauuggaacucauacgaccccaccgaagaaauccccgcaccccucggaaccccugacuucgucgggaaaauccaaggaguccucacccaaaccacucgcacuaacggaucaacccgcggccacaaagccaccguauacaccggcuccgccgacuuuaguccuaaacucggccgcguccaauucgccaccgacaccaacaacgacuucgaaaccaaccaaaacacgaaauucaccccagucggcgucauacaagacggcuccaccacaccccgcaacgaaccccaacaauggguccuccccucauacucuggccgcaacauccacaacguccaucucgcccccgccgucgcacccaccuuuccuggcgaacaauuacucuucuuccgcucaaccaugcccgguugcucaggcuaccccaacauggaucucgacugccuccucccccaagaauggguacaauacuucuaccaagaagccgcaccagcccaauccgacguagcccuccuaagauucgucaaccccgacaccggccgcguccuauucgaaugcaaacuacauaaaucaggcuacgucaccguagcacacacaggacaacaugaccucguuaucccgcccaacgguuacuuccgcuucgacagcuggguaaaccaauucuacacacucgcccccaugggcaacggcaccggccgccgcagauaa

SEQ ID NO: 38907 - RNA, 1617 nt, Artificial Sequence
  derived and/or modified sequence opt11 from VP1__Norovirus_and/or_Norovirus-like__KC456073
augaaaauggcauccuccgaugcgaacccauccgauggcuccgccgcaaaccuaguccccaaaguaaacaacgaagucauggcccuagaaccaguugucggugcagcaaucgcagcccccgucgcuggccaacaaaacguaaucgaccccuggaucaaaaauaacuucguacaagcccccggcggagaguuuaccguauccccuaaaaacgcacccggugaaauacucugguccgcaccacucggcccugaucuuaauccguaccuaucccaccucgccagaauguacaacggcuacgcaggcgguuucgaaguccaagucauacuugccggcaacgccuucacagcugguaaagucaucuucgccgccgucccgcccaacuuccccaccgaaggccuaucaccaucacaaguaaccauguucccccacaucgucgucgacguccgacaacucgaacccgucuuaaucccccuccccgauguccgcaacaacuucuaccacuacaaccaaucaaacgaccccaccauaaaacucauagccaugcucuacacaccccuccgggccaacaaugccggcgacgacguauucaccguaucaugccgaguacuaacccgacccucaccagacuucgacuucaucuuucucgucccacccaccgucgaaucccgcaccaaacccuucucaguacccguccucacagucgaagagaugaccaacucccgcuuccccauaccccuagaaaaacuguucaccggccccucuuccgccuuuguuguacaaccccaaaacggucgcugcaccacugacggaguacuccucggcaccacccaacuuucccccgucaacaucugcaccuuccgaggagacgucacccacauaacuggcucucgaaacuacacuaugaaucucgccagccaaaacuggaacaacuacgaucccaccgaagaaauacccgccccucucggaaccccugauuucgucggaaagauccagggcguccucacccaaaccacccgaacagacggcuccaccagaggccacaaagcaaccguguacaccggauccgcagacuucgcacccaaacucggucgcguccaguucgaaacugacaccgaccacgacuucgaagcuaaccaaaacaccaaauucacacccgucggagucauacaagacggcggaaccacacaucggaacgagccccaacaguggguccuccccucauacucaggccgcaauacacacaacguccaccuagcccccgccgucgcuccaaccuucccaggagaacaacuacucuucuuccgaagcacaaugccaggcugcuccgguuaccccaacauggaccucgacugccuccuaccgcaagaauggguccaauacuuuuaccaagaagccgcacccgcccaaucagacgucgcacuccuaagauuugucaaccccgacaccggacgcguccucuuugaaugcaaacuccacaaauccggcuacguaacaguagcccacaccggacaacacgaccucgucauacccccuaauggcuacuuccgcuucgacagcuggguaaaccaauucuacacccucgcacccaugggcaacggaacagguagacgccgcuga

SEQ ID NO: 38908 - RNA, 1617 nt, Artificial Sequence
  derived and/or modified sequence opt11 from VP1__Norovirus_and/or_Norovirus-like__KC456072
augaaaauggccuccuccgaugccaacccauccgacggcuccgcggcuaaccucgucccaaaaguaaacaacgaagucauggcacucgaacccgucguuggugccgccaucgccgcccccgucgccggccaacaaaacgucauugaucccuggaucaaaaacaacuuugugcaagcaccaggaggagaguucaccgucucgcccaaaaaugccccgggcgaaauacucuggucagccccucucgguccugaccuaaaccccuaccuuucacaccucgcccgaauguacaacggcuacgccgggggcuucgaaguccaagucauacuagcaggaaacgcguucacagccggcaaagucauauucgccgccgucccaccaaauuuccccaccgaaggccucuccccgucccaaguuaccauguucccccacauuguugucgacgugcgccaacuagaacccguccuuaucccacuccccgacguccgaaacaacuucuaccacuacaaccaaucaaaugacccaaccaucaaacucauagcuaugcucuacacaccccuacgagccaauaacgccggagacgacgucuucaccgucuccugccguguccugacccgaccaagcccagauuucgacuucauauuccuaguaccucccaccgucgaaucacguaccaaacccuucuccgucccagucuuaaccgucgaagaaaugaccaacagccguuuccccaucccccucgaaaaacucuucaccggccccuccucugccuucguaguacaaccacaaaacggacgcugcaccacugacggcguacuucuuggcacaacccaacuuucacccguaaacauuugcacauuccgcggcgacgucacccauauaacaggaucccgaaauuacaccaugaaccuugcaagucaaaacugguccaacuacgaccccaccgaagaaaucccagcaccccucggcacaccagacuucgucggaaaaauacaaggcguccucacccagaccacccgcaccgacggcuccacccgcggccacaaagcaacagucuacaccggcuccgccgacuucgcccccaaacucggccgaguucaauucgaaaccgacaccgaccgggacuucgaagccaaccaaaacacaaaauucaccccugucggcgucauccaagacggaucaaccacacaccgcaacgagccccagcaauggguacuacccuccuacucuggccgaaacacacccaacguccaucucgcccccgccguugccccaaccuuccccggcgaacaacuacucuucuuccgaucuacuaugccaggcugcuccggauacccaaacauggaccucgacugccuccuaccccaagaguggguccaauacuuuuaccaagaagccgcccccgcccaaucagauguagcccuccuccgcuucguuaaccccgauaccggaagaguccucuucgaaugcaaacuccacaaauccggauacguaacuguagcucacacaggccaacacgaccucguaauaccacccaacgguuacuuccgcuucgacuccugggucaaccaauucuacacacuagcccccaugggcaacggaaccggucgccgccgguaa

SEQ ID NO: 38909 - RNA, 1617 nt, Artificial Sequence
  derived and/or modified sequence opt11 from VP1__Norovirus_and/or_Norovirus-like__JX459622
augaaaauggcauccaacgacgcacaccccucagacggcucagccgcgacccuaguccccaaaguaaacaacgaaguaauggcccuagaaccaguagugggcgccgcaauagccgccccagucgccggccaacagaacgucaucgacccauggauccgcaacaacuucguccaagcacccggcggcgaauuuaccguuucaccccgcaacgcccccggagaaauccuaugguccgccccucuaggcccagaucucaaccccuaccuuucccauuuagcacgaauguacaacggauacgcaggcggcuucgaacuccacguccuacucgccggaaacgccuucaccgccggcaaaaucaucauagcugccguaccacccaacuuucccaccgaaggucucucccccucucaagucacaauguucccccacaucaucgucgacgucagacaacucgaacccguacuaaucccccuaccagacguucggaacaacuucuaccacuacaaccaaucaaacgacucaacaaucaaacucaucgccaugcuauacacaccccuccgagcaaacaacgccggcgaagacgucuucacagucucaugccgcguccuaacacgccccucccccgacuuugacuucaucuuucuggucccacccaccguagaaucccguacaaaacccuuuacuguccccauacucacagucgaagaaaugaccaacagccgcuuccccauaccccuagaaaaacuauucacaggcccaucuggugccuucguaguccaaccccaaaacggccgaugcacuaccgacggcguccuccucggaaccacccaacuuucucccgucaacaucugcaucuuccgcggagacguaacccacaucgcaggaucacgcaacuacacaaugaaccucgccgcacucaacuggaacaacuacgaccccacagaagaaauacccgcaccccucggcacgccagacuucgucggaaaaauccaagguguccucacccaaaccaccaaaggggacggcucaacccgcggccacaaggccaccguauacacuggauccgccgacuucaccccaaaacuaggcuccguccaauucucaaccgacacagaaaacgacuucgaaacccaccaaaacacuaaauucacccccguaggagucauacaagacggauccaccacccaucgaaacgaaccccaacaauggguccuccccucauacuccggaagaaacguccacaacguucaccucgcccccgccgucgccccaacauuccccggagaacaacuccucuucuuuagguccaccaugccgggcugcucaggcuaccccaacauggaccuagacugccuacuuccccaagaauggguacaacacuucuaucaagaagccgcucccgcccaaucugacgucgcccuccuccgcuucguaaaccccgacacaggcagaguccuauucgaaugcaaacuccauaaaucaggguacguuaccguagcccacaccggacaacacgacuuagucaucccacccaacggcuacuuccgcuucgacuccugggucaaccaauucuacacacuggcccccaugggcaacggcacaggucgcagacgcuaa

SEQ ID NO: 38910 - RNA, 1617 nt, Artificial Sequence
  derived and/or modified sequence opt11 from VP1__Norovirus_and/or_Norovirus-like__KX514290
augaaaauggcauccaacgaugccaaccccuccgacggcuccgccgccaaccucguccccgaagucaacaacgaagucauggcccuagaacccguagucggcgccgccaucgccgcucccgucgcuggccaacaaaacgucaucgaccccuggauacgcaacaacuucguccaagcacccggcggugaguucaccgucucuccccggaacgccccuggcgaaauacucugguccgcaccccucggaccagacuuaaaucccuaccucucccaccuagcccguauguacaacggcuaugccgguggcuucgaaguccaaguaauccuggcaggcaacgcauucaccgcuggcaaaaucaucuuugccgcagucccucccaacuuucccaccgaaggccucucccccucacaagucaccauguucccccacaucauugucgacguacgacaacucgaacccguccucauuccucuuccugacgucagaaauaacuucuaucacuacaaccaauccaacgacucaaccaucaaacuuauagccaugcucuacacuccccuccgagccaacaacgccggcgacgacgucuucaccgucucuugccgcguacucacccgcccaucaccagauuucgacuucauuuuccuuguaccgcccaccgucgaaucccgcuccaagcccuucuccguucccauccucacugucggcgaaaugaccaacucccgcuuccccaucaaccucgaacgccuuuucaccggccccuccagcgccaaugucguccaaccccaaaacgguagaugcaccaucgacggagagcuccuaggaaccacccagcuauccucaguaaacaucugcacuuuccgcggagacguaacucacaucggcucaacccaccacuggacaaugaaccuagccucccccaacuggaacaacuacgacccaaccgaagaaaccccagccccacucggaacccccgauuucgucggcaaaauccacggaaugcucacacagaccacacaagaaaauggcuccaccagagcccaccgagcuacaguauacgucggcucagccgacuucaccccuaaacucggcaaaguccaauucgagacugacacgacgaaugaccucgacgcgcaccaaaacaccaaguucacuccaguaggcguaguccaaggcggcgaauccccaaaaggauccgagccccaacaauggguccuacccuccuacuccggccgcgacacccccaacguucaccuagcccccgccgucgcccccacuuuccccggagaacaacuccucuucuuccguucgaccauacccggcugcggcggccaccccaacaugaaccucgacugucuucuaccccaagaauggguccaacacuucuaccaagaagcagcccccgcacaaagcgacgucgcccuccucagauucgucaaccccgacaccucccgaguccucuucgaaugcaaacuacauaaguccggcuacguaaccgucgcccauaccggacaacacgaccuaguaaucccgcccaacggauacuuccgauuugacagcugggucaaccaauucuacacacucgcucccaugggcaacgggaccggccgaaaacgcuga

SEQ ID NO: 38911 - RNA, 1617 nt, Artificial Sequence
  derived and/or modified sequence opt11 from VP1__Norovirus_and/or_Norovirus-like__KP784695
augaaaauggccuccuccgacgccaaccccucagacgguuccacagcaaaccuaguucccgaaguuaacaacgaaguaauggcacuugaacccgucguaggcgcagccaucgcugcccccgucgcuggacaacaaaacgucaucgaccccuggauacgcaacaauuucguccaggcucccggaggcgaauuuacaguaucuccccgaaacgccccuggagaaauccuuugguccgccccacucggucccgaccuaaaccccuacuuaucccaccucgcccgaauguacaacggcuacgccgggggauucgaaguucaagucauacucgccggcaacgccuucaccgccggcaaaaucaucuucgccgccguacccccaaauuuccccaccgaaggccucucccccucccaagucaccauguucccccacaucaucgucgacguccgccaacucgaacccguacucauaccacuccccgacguccgcaacaacuucuaucacuacaaucaguccaacgacuccacuaucaaacucauagccaugcucuacacaccacucagagccaacaacgcaggcgacgacgucuucaccguauccugccgaguccuuacccgccccuccccagauuucgacuucaucuuccuagucccgcccaccguugaaucccgcacaaaaccauucuccguccccguccucaccgucgaagaaaugaccaacucccgauucccaaucccacucgaaaaacuauucaccggcccauccucugcuuucgucguccaaccacaaaacggccgaugcacaacagacggcguauuacucggcacaacccaauuaucccccgugaauaucugcacauuccgcggagacgucacacacauauccggcucccgcaauuacacuaugaaccuugccucccaaaacuggaacuccuacgaccccacagaagaaaucccagcuccacucggcacccccgacuucgucggcaaaauacaaggcguacuuacccaaacaacccgaaccgacggcucaacucgaggccacaaagccaccgucuacaccggauccgccgacuucucaccaaaacucggccgcguacaauucgccaccgacaccgacaacgacuucguaaccaaccaaaacacuaaauucacaccagucggcgucauacaagacggcaacacaacaccccgcaaugaaccccaacaauggguccuccccuccuacucaggccgcaauacccauaacguacaccuagcaccagcuguagccccaaccuuccccggagaacaacuucuuuucuuccgcucaaccaugccggguugcuccggcuacccaaauauggaccuagacugccuccucccacaagaauggguacaauauuucuaccaagaagcugccccagcccaaucggacgucgcucuacuucgcuucguaaaccccgacaccggacgcguccuauucgaaugcaaacuacacaaauccggcuacguaaccguagcccacaccggccaacacgaccuaguuaucccucccaacggauacuuccgcuucgacuccuggguaaaccaauucuacacacucgcacccaugggaaacggaacuggccgacguagguaa

SEQ ID NO: 38912 - RNA, 1617 nt, Artificial Sequence
  derived and/or modified sequence opt11 from VP1__Norovirus_and/or_Norovirus-like__KX608865
augaaaauggcauccucagacgcaaaccccucagacggcucaaccgccaaucucguaccagaagucaacaacgaagucauggcccuagaaccugucguaggcgcagccauugccgcccccgucgccggccaacaaaacguaauugacccauggauccgaaacaacuucguccaagcccccggcggggaguucacaguuucgccccgaaacgcuccaggagaaauucuaugguccgccccacuaggccccgaccuaaaccccuaccucucccacuuagcccguauguacaacgguuacgccggcggcuucgaaguccaagugauccucgcaggcaacgccuucaccgccggcaagaucaucuuugccgcaguaccacccaacuuccccaccgaaggccuaucaccaucucaagucacuauguuuccccacaucaucguagacguccgccaacucgaacccguccuaauaccccuccccgacguacgcaacaacuucuaccacuacaaccaauccaacgacucgaccaucaaacucauagcaaugcuauacacaccccuccgcgccaacaacgccggcgacgacgucuucacaguaagcugucgaguccucacacgccccagcccagacuuugacuucaucuuucucguaccacccaccgucgaaucccgcaccaagccuuucucuguccccguauugacaguagaagaaaugaccaacucccgcuucccaauuccacucgaaaaacucuucaccggacccucaagcgcuuucgucguccaaccccaaaacggccgaugcacaaccgacggaguccuccucggcaccacacaacucucaccagucaacaucugcaccuuccgaggggaugucacacauaucgccggcucccgcaacuacaccaugaaccucgccucccaaaacuggaacuccuacgaccccaccgaagaaauccccgcacccuuaggaacccccgacuucgucggaaaaauucaaggcguccugacccaaacuacacgaacugacggcuccacccgaggccauaaagcaaccgucuacaccggcucagcugacuuuucacccaaacugggccgcguccaauuugccaccgacaccgacaacgacuucgucaccaaccaaaacaccaaguucaccccagucggcgucauucaagauggaucaaccacuccccgcaaugaaccccaacaauggguacucccaagcuacuccggccgcaacacccacaacguucaccucgcccccgccguagcaccaaccuucccuggagaacagcuccucuucuuccgaagcacaaugcccggaugcuccggcuacccuaacauggauuuagacugccuccuaccucaagaauggguccaauacuucuaccaagaagcagccccagcccaauccgacguagcccuacuccgcuucgucaacccagacaccggccgcgucuuauucgaaugcaaacuccauaaauccggcuacgucacagucgcccacacaggacaacacgaccuagucauaccucccaacggcuacuuccgcuucgacuccuggguuaaucaauucuacacgcucgcccccaugggcaacggcaccggcaggcgccgauaa

SEQ ID NO: 38913 - RNA, 1617 nt, Artificial Sequence
  derived and/or modified sequence opt11 from VP1__Norovirus_and/or_Norovirus-like__AB972500
augaaaauggcaucauccgacgccaacccaucagacggcuccaccgcaaaccuaguacccgaagugaacaacgaaguaauggcacuagaacccguugucggcgccgcgaucgccgccccagucgcaggacagcagaacgucaucgacccauggauccgcaacaacuucguccaagcccccggaggcgaauuuacgguaucaccccgcaacgcccccggugaaauccuuugguccgcaccccucggacccgaccuuaaccccuaccucucccaucucgcccguauguacaacggcuacgccggaggcuucgaaguccaagucauccucgccggcaacgccuucacagccggcaagauaauauucgccgccguaccucccaacuuccccaccgaaggucuaucccccucccaaguaaccauguucccucacaucauagucgacguacgccaacucgaaccaguccuaaucccccuaccugacgugcgaaacaauuucuaccacuacaaccaauccaaugacuccaccauaaaacuaaucgccaugcucuauaccccgcuuagagccaacaacgcaggagacgacgucuuuacagucuccugccgcguccucacccgccccuccccggacuucgacuucauauuccuagucccacccaccgucgaaucacgcaccaagcccuucuccguccccguccuaacagucgaagaaaugacaaacucccgcuuccccaucccccuagaaaaacuauucacaggacccuccuccgccuucgucguccaaccccaaaacggccgcugcaccaccgacggcguccuccuaggcaccacccaacuaucccccgucaacaucuguacguuccgaggcgacgucacacacaucucuggcucccgcaacuacaccaugaaccuagcuucccaaaacuggaacuccuacgacccuacagaagagauccccgcaccccucggcacacccgacuuuguaggcaaaauccaaggaguacuaacucaaaccacccgaaccaacggauccacccgcggccacaaagccaccgucuacacaggcagcgcugacuucucaccaaaacuaggacguguccaauucgcaacggacaccgacaacgauuucgaaaccaaccaaaacacuaaauucaccccagucggcgucauccaagacggcuccaccacuccacgaaacgaaccccaacaauggguccuacccucuuacuccggccgcaauauccauaacguccaccucgcaccggcggucgccccuaccuuccccggagaacaacucuuauuuuuccgcuccaccaugccaggcugcuccggcuaccccaacauggaccuagacugccuccucccccaagaauggguccaauacuucuaccaagaagccgccccagcacaaucagacgucgcccuccuacgcuucgucaacccagacacgggccgcguucuguucgaauguaaacuccacaaauccggcuacgucaccgucgcgcacaccggccaacacgaccuaguaauacccccaaacggcuacuucagauucgacagcugggucaaccaguucuacacccucgcuccuaugggcaacggcaccggccgccgcagauga

SEQ ID NO: 38914 - RNA, 1617 nt, Artificial Sequence
  derived and/or modified sequence opt11 from VP1__Norovirus_and/or_Norovirus-like__KT033902
augaaaauggccuccucagacgcuaacccauccgauggcaguaccgccaaccucauccccgaaguaaacaacgaaguaauggcccucgaaccugucguaggcgcagccaucgcugcccccgucgccggccaacaaaacgucauugaccccuggauacgcaacaacuucguccaagcccccgguggcgaguucacugugucaccccgaaacgccccaggcgaaauacucugguccgcgccccucggaccagaccucaaccccuaccucucccaccuagcccgaauguacaacggcuacgccggaggcuucgaaguccaaguaauccucgccggcaacgccuucaccgccggcaagaucauuuucgccgccgucccacccaacuuccccacagaaggacucucuccaucccaaguuacaauguuuccccacauaaucguagacguccgacagcucgaacccguccuaauaccccucccagacguacgcaacaacuucuaccacuauaaccagagcaacgacucaaccauaaaacuaaucgccaugcuuuacaccccacuccgcgccaacaacgcaggcgacgacauauuuacagucagcugccgcguauuaacccgacccucacccgauuucgacuucaucuuccucguacccccaaccgucgaaucacguaccaaacccuuuucugucccaguccucaccgucgaagaaaugaccaacucacgauuccccaucccccuagaaaaacucuucaccggacccucaagcgcccucgucgugcaaccacaaaacggccgcuguacaaccgacggagucuuacucggaaccacacaacucucaccaguaaacaucuguacauucagaggcgacguaacacacaucccaggcuccagaaacuacacaaugaaccucgcuagccaaaacuggaacucuuaugaccccaccgaagaaauccccgcaccacucggcacacccgacuucgucggcaaaauacaaggcguccuaacccaaacaacccgcaccaacggaagcacacgcggccacaaagccaccguauacaccggcuccgcagauuucagccccaaacuaggacguguccaauucgccacagacaccgauaacgacuucgaaaccaaccaaaacaccaaauucaccccagucggcgucauccaagacggcuccacuaccccacgaaacgaaccgcagcaauggguucucccguccuacuccggacgcaacauccacaauguccaccuugcccccgcaguagcaccgacauuccccggcgaacagcuauuauucuucagaucaaccaugcccggcugcucaggcuaucccaacauggaccucgacugccuacuaccccaagaauggguucaauacuucuaccaggaagccgccccagcccaauccgacguagcccuccuccguuucgucaacccggacacaggccggguccuuuucgaaugcaaacuacacaaauccggcuacguaacgguagcccacaccggccaacacgaccucgucauacccccaaacggcuacuuccgcuucgacucaugggucaaccaauucuacacccucgccccaaugggcaacggcaccggccgaagacgcuaa

SEQ ID NO: 38915 - RNA, 1617 nt, Artificial Sequence
  derived and/or modified sequence opt11 from VP1__Norovirus_and/or_Norovirus-like__KR904220
augaaaauggcaucaucagacgcaaacccauccgacggcuccacagccaaccucguaccagaagucaacaacgaagucauggcacuugaacccgucgucggcgcagcuaucgccgccccagucgcaggacaacaaaacgucauugaccccuggauccgcaacaacuuuguccaagcaccaggcggcgaauuuacagucucaccccgcaacgcacccggcgaaaucuuaugguccgcuccacucggcccagaccuaaaccccuaccugucccaccuagcccgcauguacaacggauacgcaggcggcuucgaaguacaagucauccuaguaggaaacgcauucaccgccggcaaaauaauauucgccgccgucccucccaacuuccccaccgaaggucugucccccucacaaguaaccauguucccccauaucaucguugacguccgccaacucgaaccuguauuaaucccccuccccgacguccgaaacaacuucuaccacuacaaccaauccuccgacucaacaaucaaacucaucgcaaugcucuacaccccacuccgcgcaaacaacgcaggcgacgacguuuucaccgucuccugccgcguucucacccgucccucaccagacuucgacuucauuuuccuaguacccccuacagucgaaucucgcaccaaacccuucuccguccccguauuaaccgucgaagaaaugaccaacucccgcuuccccauuccacuagaaaaacucuucaccggacccuccucagcauucgucguccaaccacagaauggccguugcaccacagacggaguacuccucggcaccacccagcugucacccgucaacauaugcaccuuccguggagacguaacucacaucuccggcucccauaacuacaccaugaaccuagccucucaaaacuggaacucuuacgaccccacagaagaaauaccugcaccccuaggaacaccagacuucgucggcaagauacaaggagucuuaacccaaaccacccgcaccgauggauccacccguggacacaaagccaccgucuacaccgguucaaccgacuucacccccaaacuuggccgcgcccaguuugccacagacacagauaacgacuucgaaaccaaccaaaauacaaaauucaccccaguaggcgucauccaagacggcggcacaacccaccguaacgaaccccagcaauggguccuacccuccuacuccggacgaaacacccacaacguccaucuagccccugccgucgcccccaccuuccccggcgaacaacuccuuuucuuccgcagcaccaugcccggcugcuccggcuaccccaacauggaccuagacugucuucucccgcaagaauggguacaauacuucuaccaagaagccgccccagcgcaaucagacguagcccuacucagauucgucaaccccgauaccggccgcguacuauuugaaugcaagcuccacaaauccggcuacgucaccguagcacauaccggccaacacgaccucgucauacccccaaacggauacuuccgauucgacucauggguaaaccaauucuacacacucgccccaaugggcaacggcacaggccgucgccgcuga

SEQ ID NO: 38916 - RNA, 1617 nt, Artificial Sequence
  derived and/or modified sequence opt11 from VP1__Norovirus_and/or_Norovirus-like__LN854566
augaaaauggccuccuccgacgccaaccccuccgacggcuccgcggccaaccuuguccccgaaguuaacaacgaaguuauggcccuagaacccguuguaggcgccgccaucgccgcccccguugccggccaacaaaacguuaucgaccccuggauccgcaacaacuucguccaagcacccggcggagaguucaccguuuccccuagaaacgcccccggcgaaauccucugguccgccccacucggcccugaccucaaccccuaccucucccaccucgcccgcauguacaacggauacgccgguggcuucgaaguacaaguuauccucgcaggcaacgcuuucaccgccggaaaaauaaucuucgcugcaguuccacccaacuuccccacagaaggccuauccccuagccaaguuaccauguucccccacauaauagucgacguacgccaacucgaacccguccucaucccucucccagacguacgcaacaauuucuaccacuauaaccaaucaaacgacagcaccauaaaacucaucgccaugcuauacaccccacuccgcgcaaacaacgccggcgacgacguauuuacagucuccugccgaguccugacccgcccuucacccgacuuugacuuuaucuuccuaguaccaccaaccgucgaauccagaaccaaacccuucuccguacccguccuuacagucgaagaaaugaccaacucccgauucccaaucccgcuagaaaaacuauucaccggccccucuuccgcauucgucguccagccccaaaacggccgaugcacuaccgacggcguacuacuaggcaccacccaacuaucccccgucaacaucugcaccuucagaggcgacguuucccauauaaccggaucaagaaacuacacaaugaaucucgccucccaaaacuggaacaacuacgaccccacagaagagauccccgccccacucggaacccccgacuucguaggcaaaauccaaggcaugcuuacccaaacaacccgcgccgacggcucaacccgaggacacaaggcaaccguauacaccgguucugcugacuuugcccccaaacuaggccgcguccaauucgaaacagacacagaccacgacuuugaagccaaccaaaacaccaaauucacccccgucggcguaauccaagacggcuccaccacgcaucgaaaugaaccccaacaauggguccucccaucauacagcggucgaaauacccacaacguccaccucgcacccgcaguagcgccaacauuccccggcgaacaacuccucuucuuccgcuccaccaugccaggcugcucaggguaccccaacauggaccuugacugccuccucccccaagaauggguccaauacuucuaucaagaagccgccccggcccaaagugacgucgcacuccuccgauucguuaaccccgacaccggccgcguucucuucgaaugcaaacugcacaaauccgguuacgucaccguugcccacaccggccaacacgaccucgucaucccacccaacggcuacuuccgcuucgacagcugggucaaccaauucuacacgcuagcucccauggguaacggaaccggccgccgacgcuag

SEQ ID NO: 38917 - RNA, 1617 nt, Artificial Sequence
  derived and/or modified sequence opt11 from VP1__Norovirus_and/or_Norovirus-like__KP244313
augaaaauggccucaucagacgccaaccccuccgacggcucaaccgcaaaucucgucccagaaguaaacaacgaaguaauggcucucgaacccgucgucggagccgcaaucgcagcucccguagccggccaacaaaacgucaucgaccccuggaucagaaacaacuucguccaagcacccggaggcgaguucaccguaucgccccgaaacgcacccggagaaauucucuggucagcaccccuuggaccagaccucaacccauaccucucccaccuagcccgcauguacaacggcuacgccggcggcuucgaaguccaagucauacucgccgguaaugccuucacagccggcaaaauaaucuucgcagcagucccacccaacuuccccacagaaggccuaucacccucgcaagucaccauguucccucacaucaucguagacguacgccaacuagaaccaguccuuaucccacuaccagacguacgaaacaauuucuaccacuacaaccaaagcaacgacucaaccaucaaacuaauagcuaugcucuacaccccucugcgcgccaacaacgccggcgacgacgucuucacagucagcugccgcguacucacacgcccaucaccagacuucgacuucauauuucucguaccacccaccgucgaaucccgcacaaagcccuucagcguaccaguccuuaccgucgaagaaaugaccaacucacgcuucccgaucccccuggaaaaacucuucaccggccccuccagcgcauucguaguccaaccccaaaauggcagaugcacaaccgacggcguccugcugggaacaacccaacuaagccccgucaacaucugcacauuccgcggagacgucacucacaucuccggaucuagaaacuacaccaugaaccuagccucccaaaacuggaacuccuacgacccaacagaagagauacccgccccacuaggcacacccgacuucgucggcaaaauccaaggaguacugacccaagcuacccgcaccaacggcucaacucgcggccacaaagcaaccgucuauaccggcucagcagacuucuccccaaaacucggcagaguccaauucgccacagacacagacaaugauuucgagaccaaccaaaacaccaaauucaccccagugggugucauccaagauggcuccaccacuccacgaaacgaaccccaacaauggguccucccguccuacucaggccgcaacauccacaacguccaccucgccccugccgucgcccccacauuccccggcgaacagcuccucuucuuccgcuccaccaugcccggaugcuccggcuacccaaacauggaccucgacugccuacucccacaagaauggguccaauauuucuaccaagaagccgccccagcucaguccgacguagcacugcuacgauucgucaacccagacaccggacgaguacucuucgaaugcaaauuacacaaaucaggauacguaaccgucgcucacacaggacagcacgaccuggucauaccacccaacggcuacuuccgauucgacucauggguaaaccaauucuacaccuuagcccccaugggcaacgguaccggccgccgccgcuaa

SEQ ID NO: 38918 - RNA, 1617 nt, Artificial Sequence
  derived and/or modified sequence opt11 from VP1__Norovirus_and/or_Norovirus-like__KP096342
augaaaauggccucauccgaugccaaccccucagacggcucagcagccaaccucguacccgaaguauccaacgaagucauggcccucgaacccgucgucggcgcugccaucgccgccccaguagcaggccagcaaaacgucaucgacccauggauacgaaacaacuucguacaagcccccggcggcgaauuuaccgucucuccacgcaacgcccccggcgaaauccucuggagcgccccacuaggcccugaccuaaaccccuaccucucccaccuagcccggauguacaacggcuacgcaggaggcuucgaaguccaagucauucucgccggcaacgcauucaccgccggcaaaguaauuuucgccgccguaccaccaaacuucccaaccgaaggacuaucccccucacaagucacaauguucccccacaucgucguagacguacgccaacuagaacccguccucaucccccucccugacguccgaaacaacuucuaccacuacaaccagucaaacgacccaacuauaaaacuaauagccaugcucuacacuccccucagagcaaacaaugccggugacgacgucuucaccgucagcugucgaguccucacccgacccuccccggacuucgacuucaucuuucucgucccacccaccguagaaucccgcaccaaacccuucucaguccccguacuuaccgucgaggaaaugacaaacucccgcuuccccaucccccucgaaaaacuauucaccggccccaguuccgccuucgucguacagccccaaaacggccgcugcacuacugacgguguccuccugggcaccacacaacuaucccccgucaacauauguaccuuccgaggcgacgucacccacaucacuggaucccgcaauuacaccaugaaccuugcaucacaaaacuggagcaacuacgaccccacagaagaaauaccggcaccccucggcaccccagacuucguuggcaaaauccaagguaugcucacccaaaccacccgaacagauggcuccacccgcggacacaaagccacagucuacaccggcuccgccgacuucgcccccaaacucggucgcguccaguucgagaccgacaccgaccacgacuucgaagccaaccaaaacacaaaauucacccccgucggcgucauccaagacggcuccacaacucaccgcaacgaaccacaacaauggguccuacccuccuacuccggccgcaacacacccaauguccaccuagcacccgccgucgcccccacuuucccaggcgaacaauuacucuucuucagauccacuaugcccggcugcuccggcuacccaaacauggaccucgacugccuccuuccacaggaauggguccaauacuucuaccaagaagcggcaccagcucaguccgacguagcccuccuacgauucguaaacccugacaccggacgcguacucuuugagugcaaacuccacaaauccggcuacgucacuguagcacacacaggucaacacgaucucgucaucccacccaacggcuacuuccgcuucgacuccuggguaaaccaauuuuacacccuugcccccaugggaaauggaaccggccgcaaacgauaa

SEQ ID NO: 38919 - RNA, 1617 nt, Artificial Sequence
  derived and/or modified sequence opt11 from VP1__Norovirus_and/or_Norovirus-like__KM514067
augaaaauggccagcuccgacgccaacccgucggacggcuccgccgccaaccucgucccagaaguaaacaaugaagucauggcccuugagcccguagucggcgcugccaucgccgcacccguagccggucaacaaaacgucaucgaccccuggauccgcaacaacuuugugcaagcaccaggcggcgaauuuaccguaucaccacgaaacgcccccggagaaauccuauggucagcuccccuaggaccagaucuuaacccguaccucucacaucucgcccgcauguacaacggcuacgccggaggcuucgagguccaaguuauccucgcgggcaaugcauucaccgccggaaaagucaucuucgccgcaguaccaccuaauuuccccaccgaaggacucucaccaucacaagucacaauguucccacacaucguaguagacguccgacaacucgagccugucuuaaucccccuacccgacguacgcaacaacuucuaccacuauaaccaauccaacgaccccaccaucaaacucaucgcuauguuauacacaccccuacgagccaacaacgccggcgacgacgucuucaccgucaguugccgcguccucacccgacccucacccgacuucgacuuuaucuuccucguacccccaaccgucgaaucacgcaccaagcccuucuccguaccaguacuaaccguagaggaaaugaccaacucccgcuuccccaucccccucgaaaaacuauucaccggacccuccucagcauucguuguccaaccccaaaacggacgcugcacaacugacggcguucuccucggcaccacccaacuauccccugucaacaucugcaccuuccgcggcgacguaacccacaucaccggcucccgcaacuacaccaugaaccucgccucccaaaacugguccaacuacgaccccaccgaagaaauccccgcaccccuuggaacccccgauuucgucggcaaaauccaaggaguacuuacccaaacaacccgcacagauggcucaacacgcggccauaaagccacaguuuauacaggguccgccgauuucgcccccaaacucggccgcguccaauucgaaaccgacaccgaccacgacuucgaagccaaccaaaacaccaaauuuacccccgucggcgucauccaggauggcgggaccacacaucgcaacgaaccucaacaauggguacuccccucauauuccggccgcaacacucccaacguacaccucgcuccagcagucgccccaacauuccccggcgaacaacuacuauucuuucgcuccaccaugcccggaugcucaggauaccccaacauggaccucgacugccuccucccucccgaguggguacaauacuucuaucaagaagccgcacccgcacaauccgacgucgcccuacucagauucgucaaccccgacacaggcagaguccucuucgaaugcaaacuccacaaguccggauacgucaccgucgcacacaccggccaacacgaucucgucaucccacccaacggcuacuuccgauucgacuccugggucaaucaguucuacacacucgcccccaugggcaacggcaccggucgacgucgauaa

SEQ ID NO: 38920 - RNA, 1617 nt, Artificial Sequence
  derived and/or modified sequence opt11 from VP1__Norovirus_and/or_Norovirus-like__KF060049
augaaaauggccuccuccgacgcaaacccaucagacggaucuaccgcuaaccuaguacccgaaguaaacaacgaaguaauggcccuagaacccgucgucggcgccgccaucgcagccccaguagccggacaacaaaauaucauagaccccuggauccgaaacaacuucguccaagcacccggcggcgaauuuaccgucuccccuagaaacgcccccggcgaaauccuuuggucugcgccccucgggccugaccucaacccauaccuuucacaccucgcccggauguacaauggauacgccggcggcuucgaaguccaagucauucucgcgggcaaugcauucaccgcaggcaaaaucauauucgcagcagucccucccaacuucccuacagaaggacuaagucccucccaggucacaauguucccccacauuaucgucgacguccgccaacuagaaccaguccucaucccacuacccgacguccgcaauaacuucuaccacuauaaccaauccaacgacagcaccaucaagcucaucgcaaugcuauacacccccuuacgcgccaacaacgccggagacgauguauucaccgucuccugccgaguccucacccgccccuccccagacuucgacuucauauuccuaguaccacccaccgucgaaucucguaccaaacccuucuccguccccguacucaccgucgaagaaaugaccaauucccguuucccuaucccccuugaaaaacucuuuacaggccccucaucagcauucguaguacaaccccaaaauggacgcugcacaaccgacggcguacuccucggcaccacacaacucucuccugucaacaucugcaccuuccgcggcgacguaacacacaucuccggcucgcgaaacuacacaaugaaccucgccucacaaaacuggaacucauacgaucccaccgaagaaauacccgccccucucggaacccccgacuucguugguaaaauccaaggcguccucacacagacaacucgaacagacggcucaaccagaggacacaaggccaccgucuacaccggcucagccgacuucucgcccaaacucggcagaguacaauucgccaccgacaccgacaacgacuucguaacaaaccaaaauacuaaauucacccccgucggcguuauccaagacggauccacaacuccccgaaacgaaccacaacaauggguccucccaucuuacuccggccgcaacacccacaacguccaccuugcacccgccgucgccccuacauucccaggagaacaacuccuuuucuuccgcuccaccaugcccggcugcuccggauaccccaacauggaccucgacugccuccucccccaagaauggguccaauacuucuaccaagaagcagcaccagcacaaucggacgucgcccuacuccgcuucgucaacccagacaccggccgcguccucuucgaaugcaaacuacacaaaucaggcuacguaaccgucgcccacacaggccaacacgaccuagucaucccucccaauggauacuuccgcuucgacucaugggucaaccaauucuacacacuagcccccaugggcaauggcaccggccgacgacgauaa

SEQ ID NO: 38921 - RNA, 1617 nt, Artificial Sequence
  derived and/or modified sequence opt11 from VP1__Norovirus_and/or_Norovirus-like__KF059998
augaaaauggccuccuccgacgccaaccccucagacggcucaaccgcaaaccuagucccagaaguaaacaacgaaguaauggcacucgaacccgucgucggcgccgccauagccgcaccugucgcaggucaacagaacguaaucgaccccuggauccgcaacaacuucguccaagcacccggaggagaguucaccgucucacccagaaaugcucccggcgagauccucuggucagcaccccucggacccgaucucaaccccuaccucagccaucucgcccgaauguacaacggcuacgcuggaggcuucgaaguccaagucauccucgccggcaacgccuucaccgccgguaaaauaaucuucgccgcugugcccccaaacuuccccaccgaaggccuuucccccucccaagucacaauguucccccacaucaucgucgacguucgucaacucgaaccaguccuaauuccccuccccgacguccgcaacaacuucuaccacuauaaccaauccaaugacucgacaaucaaacucaucgcaaugcucuacacaccccugcgcgccaacaacgccggcgaugacguauuuaccgucucuugccgcguucucaccagaccaagccccgacuuugacuucauauuccucguacccccaaccgucgaaucccgcacaaaacccuucuccguccccauacuaacagucgaggaaaugacuaacucacgcuuccccauuccccucgagaaacuauucaccggcccauccuccgccuucgucguucaaccacaaaacggacgcugcaccacugacggcguccuccucggcaccacccaacucagcccugucaacaucuguacauuccgcggugacgucacccacauacccggaucccacaacuacacuaugaaucuagcuucgcaaaacuggaacuccuacgaccccaccgaagaaauaccugccccucuaggcacuccugacuucgucggcaaaauccaaggaguacucacucagacaaccucagccaacgguucaacgagaggccacaaagccacugucuauacuggauccgccgacuucucccccaaacuuggcaggguccaauucgcaacagacaccaacaaugacuucgaaaccaaccaaaacacaaaauucacuccaguaggcguaauccaagauggcaacaccacaccccgcaacgaaccacaacaauggguccuccccucauauagcggccgcaacauccacaacguccaccuagcccccgccgucgccccaaccuucccuggcgaacaacugcuuuucuuccgcuccaccaugcccggaugcucuggauaccccaacauggaccucgauugccuccuuccacaagaauggguacaauacuucuaccaagaggcagcacccgcccaauccgacguagcccuccuacgcuucgucaacccagacaccggccgcguccucuucgaaugcaaacuccacaaauccggcuacguaaccgucgcccacaccggacaacaugaccucgucaucccacccaacggcuacuuccgauucgacucuugggucaaccaauuuuacacacuagcccccaugggcaacggcacaggccgccgccgcuaa

SEQ ID NO: 38922 - RNA, 1617 nt, Artificial Sequence
  derived and/or modified sequence opt11 from VP1__Norovirus_and/or_Norovirus-like__JX439833
augaaaauggccuccucagacgccaacccaucugacgggagcaaagccaacuuaguucccgaggucaacaacgaagucauggcccucgaacccgucgucggagcggccaucgccgcaccagucgccggccaacaaaacgucauugaccccuggauccgcaacaacuucguucaagcuccuggcggcgaguuuaccguaagcccccgaaacgcccccggcgagauccucugguccgcgccacucggccccgaccucaaccccuaucucucacaccuugccagaauguacaacggauacgccggcggcuucgagguacaaguaaucuuagcaggcaacgcauucaccgccggcaaaaucauuuuugcagcgguacccccaaacuucccuaccgagggccuaucccccucccagguuaccauguucccucacaucaucgucgacguacgccaacucgaacccguccucauaccacuucccgauguccgcaacaacuuuuaccacuauaaccaauccaacgaccccaccaucaaacuaaucgccaugcuauacaccccucuccgcgcgaacaaugcaggcgacgaugucuucacagugucuugccgcguacuaacacgaccauccccggacuuugacuucaucuuccucguuccacccaccgucgaaucccgaaccaaacccuuuuccguccccguccuaaccgucgaagaaaugaccaacucacgauucccaaucccccuggaaaaacuuuucacaggcccaucaucagccuucgucguccaaccacaaaauggacgcugcaccaccgaugguguacuucucgggaccacccagcucucccccgucaacaucugcaccuuccguggugacguaacccacauccccggcucucgaaacuacacaaugaaccucgccucccaaaacuggaacucauacgacccaaccgaagaaauuccagcgccccucggcaccccugacuucguaggcaaaauccaaggcguacucacacaaaccacacgaaccaacggcuccacacgaggacacaaggccacugucuacaccggaucugccgacuucagcccuaaacucggcagaguacaauucgccaccgacaccgacaacgacuucgaaacuaaccaaaacaccaaauucaccccagucggagucauccaagacggaagcacaacaccccgcaacgaaccacaacaauggguacuacccucuuacucaggcagaaacauacacaacguacaccucgcccccgccgucgcucccaccuuccccggagaacaacuccucuucuuccgcuccaccaugcccggcugcucuggauaccccaauauggaccucgacugccuccucccccaagaauggguccaauacuucuaccaagaagcugcacccgcccaauccgacgucgcccuacuccgcuucguaaaccccgacaccggccgcguccucuucgaauguaaacuacacaaaucaggauacguaaccgucgcccacaccggacaacacgaccuuguuaucccuccaaacggcuacuucagauucgacagcugggucaaucaauucuacacccucgccccaaugggaaacgguaccggcagccgcagguaa

SEQ ID NO: 38923 - RNA, 1617 nt, Artificial Sequence
  derived and/or modified sequence opt11 from VP1__Norovirus_and/or_Norovirus-like__JQ613548
augaaaauggccucauccgacgccaaccccagcgacggauccaccgccaaccucguccccgaagugaacaacgaagucauggcccuagaacccguagucggcgccgcaauagcagcccccgucgccggccaacagaacguaaucgaccccuggauccgcaacaauuucguccaagcccccggcggcgaguucacaguaucaccccguaaugcccccggcgaaauccuauggucugccccgcucggccccgaucucaaccccuaccucucccaccuugcccgcauguacaauggcuacgccggugguuucgaaguucagguaauccuggcaggaaacgcauuuacagccggaaaaauaaucuucgcagcaguuccacccaacuuccccaccgaaggccuaucccccucacaagucaccauguucccacacauaaucguagacguacgacaacucgaaccaguccucaucccacuaccagauguacgcaacaacuucuaccacuacaaccaauccaacgacucuaccauaaaacucaucgccaugcucuacacccccuugcgcgcaaacaacgccggugacgaugucuucaccguauccugccgaguccuuacccggccaucgccugacuucgacuucaucuuccuuguacccccaaccguagaaucucgcaccaaacccuucuccguuccaguccucaccguagaagaaaugaccaacucucgcuucccaaucccacucgaaaaacuuuucacuggacccuccagcgccuucgugguccaaccacaaaacggccgcuguaccaccgacggaguccuacucggaacuacacaacuaucccccgucaacaucugcaccuuccgaggcgacgucacacacaucuccgguucccgcaacuacaccaugaaucucgccucccaaaacuggaacuccuacgacccagcagaagaaauccccgcaccccuaggaacucccgacuuugucggcaaaauccaaggcguccucacccaaacaacucgcacaaauggcuccacccgcggccacaaagccacugucuacaccggguccgcagacuucucccccaaacuuggacgcguccaauucgcuaccgacaccgacaacgacuucgaaaccaaccaaaacaccaaauucacucccgucggcgucauccaagacggauccacaacaccacgcaaugaaccacaacaauggguccuccccucauacucaggccgcaauauccacaacguucaccuagcaccagccguagccccaaccuuccccggagaacaacuccuauucuuccgauccaccaugcccggaugcucuggauacccaaacauggaccucgacugccugcucccccaagaauggguccaauacuucuaccaagaagcagcccccgcccaauccgacguagcccuccuacgauuugucaacccagacacgggccgcguccucuucgaaugcaaacuccacaagucuggcuauguaaccgucgcacacaccggacaacacgaccuuguaaucccacccaacggcuacuuccgcuucgacucuugggucaaccaauucuacacucucgcccccaugggaaacggcacuggucgccgcagauaa

SEQ ID NO: 38924 - RNA, 1617 nt, Artificial Sequence
  derived and/or modified sequence opt11 from VP1__Norovirus_and/or_Norovirus-like__JN595867
augaaaauggccagcuccgacgccaaccccuccgacggcuccacagccaaccucguaccagaaguaaacaacgaagucauggcacuagaacccguaguaggcgccgccauagccgcuccagucgcuggucaacaaaacguaaucgacccauggauacgcaacaacuucguccaagcgcccggcggcgaauuuacagucuccccacgcaacgccccgggcgagauccuauggucagcaccccucggcccagaccucaacccauacuuaucccaccuagcccgcauguacaacgguuacgccggaggauucgaaguacaaguaauacuagccggaaacgcauucaccgccggcaaaaucaucuucgcagcagucccacccaacuucccuaccgaagggcucucgccuucacaaguaaccauguucccacacaucauagucgacguccgccaacucgagcccguccuuauuccccuccccgacgugcguaacaacuucuaccauuacaaccaauccaacgaccccaccaucaagcucauagccaugcuauacacaccccuucgcgcaaacaacgcuggcgacgacguuuuuaccgucuccugccgcguccucacccgccccucccccgacuucgacuucaucuuccucguaccacccaccgucgaaucacgcaccaaaccuuucuccgucccuguccuuaccgucgaagagaugaccaacucccgauuccccaucccccuagaaaaacuuuucaccggccccaguuccgcauucgucguccagccacaaaacggccgauguaccaccgacggaguccuccucggcaccacccaauuauccccagucaacaucugcaccuuccgcggcgacguaacccacaucccaggcucccgaaauuauaccaugaaccuugcaucccaaaacuggaacuccuaugaccccaccgaagaaacacccgcaccccucggcacccccgacuucgucgggaaaauccaaggcguccucacacagacuacccgcacuaacggaucaacacgcggccacaaagccacagucuacacaggcagcgccgacuucucacccaaacuaggccguguccaauucgccaccgacaccgacaacgacuucgagaccaaccaaaacacaaaauucaccccaguagguguuauccaagacggauccacuacaccccgcaaugaaccccaacaauggguccuacccuccuauuccggccgaaacauacacaacguccaccucgcccccgccgucgccccaaccuucccaggcgaacagcuucucuucuuucgaucaaccaugcccggcugcucaggauaccccaacauggaccuagacugccuacucccacaagaauggguccaauacuucuaccaagaggccgccccggcacaauccgacgucgcucuccuccgcuucgucaacccagacaccggacgcguccucuucgaaugcaaacuucacaaaucaggcuacguaaccgucgcacacaccggacaacacgaccugguaaucccacccaauggauacuuccguuucgacucauggguaaaccaauuuuacacccuagcccccaugggcaaugguaccggccgccgacgcuag

SEQ ID NO: 38925 - RNA, 1617 nt, Artificial Sequence
  derived and/or modified sequence opt11 from VP1__Norovirus_and/or_Norovirus-like__AB629944
augaaaauggccucauccgacgcaaaccccuccgacggcuccacagcaaaccuaguccccgaagucaacaacgaaguaauggcccucgaaccugucguaggcgccgccaucgcugccccagucgccggacaacaaaacgucaucgacccuuggauccgcaacaacuucguacaagcaccgggaggcgaguucaccguaucaccucgcaacgcccccggcgaaauccucugguccgccccacucggccccgaccuaaacccauacuuaucucaccuggcacgaauguacaacggcuacgccggcggauucgaaguccaagucauacuagcaggcaaugccuucaccgccggaaaaaucauauucgcagcagucccacccaacuuccccacagaaggccuuucuccuucacaagucaccauguuuccccacauuaucguagacguacgccaacuagaaccuguacuaaucccucuaccugauguacgaaacaacuucuaccacuacaaccaaucuaacgacccaacaaucaaacucauagccaugcuauacacaccccuucgcgccaacaacgccggcgacgacguauuuaccgucagcugccgaguacucacccgccccuccccagacuuugacuucaucuuccucgucccaccaaccgucgaaagccgaaccaaacccuucucuguucccguccuaaccgucgaagaaaugacaaacucccgcuuccccaucccccucgaaaaacuuuucaccggucccaguucagccuucgucguacaaccccaaaacggccgcugcaccacagacggcguacuacucggcaccacccaacucucccccgucaacauuugcaccuuccgaggagacgugacucacauuuccggcuccagaaacuacacuaugaaccucgccucccagaacuggaacucuuaugaccccacggaagaaauccccgcaccacucggaacacccgacuucguaggcaaaauucagggaguccucacccaaaccacccgaaccaacggauccacccgaggccacaaagccacugucuacaccggcagcgcugacuucucccccaaacucggacgcguccaauuugcaaccgacaccgacaacgacuucgaaaccaaccaaaacaccaaauucacaccagucggagucauccaagacggcuccaccacaccccgcaacgaaccacaacaauggguacuacccucauacagcggccguaauacucacaacguccaccucgcucccgccguagccccgaccuuccccggagaacaacuccucuucuuccguuccaccaugcccggcugcuccggcuaccccaauauggaccucgacugccuccucccccaagaauggguacaauacuucuaccaagaagccgccccugcccaaucugacguggcccuccuucgauucgucaacccugacacaggacgcguacuuuucgaauguaaacuucacaaaucguccuacgucaccguagcacacaccggacaacacgaucuugucaucccacccaauggcuacuuccguuucgacaguugggucaaccaauucuauacccucgcccccaugggcaacggaacuggacgccgccacuga

SEQ ID NO: 38926 - RNA, 1617 nt, Artificial Sequence
  derived and/or modified sequence opt11 from VP1__Norovirus_and/or_Norovirus-like__AB541192
augaaaauggcaagcucggacgccaacccacccgacggcucugccgccaaccuaguccccgaagucaacaacgaaguuauggcccucgaacccguaguuggagccgccaucgccgcacccgucgccggccaacaaaauguaaucgaccccuggauccgaaauaacuucguccaagcacccggaggcgaguucaccguaucuccacgaaacgcccccggcgaaauacucugguccgcaccacuuggccccgaccuaaaccccuaccucucccaucuagcccgcauguacaacggauacgccggcggguucgaaguccaaguaauacuagcgggcaacgccuuuaccgccggcaaaauaaucuuugccgccguaccucccaacuuccccaccgaaggccucucacccucccaaguaaccauguucccccacaucauagucgacguacgccaacuugaaccaguacuaaucccacuuccugauguucgcaacaacuucuaccacuacaaccaaucaaacgacuccaccaucaaacugaucgccaugcuauacacaccccuccgugccaacaacgccggcgaagacgucuucaccgucagcugccgaguacuuacccgccccucccccgacuucgacuucaucuuucucguacccccaaccgucgaaucccgcaccaaaccauucaccgucccaauccuuaccgucgaagaaaugaccaacucucgcuucccgaucccacuagaaaaacuauuuacugggcccuccggcgcauucgucguccaaccccaaaacggcagauguaccaccgacggcguccugcuagguaccacccaacuuucgccugucaacaucugcaccuuccgcggcgacgcaacccauaucgcaggaagccgauccuacaccaugaaccuagccucccucaacuggaacaacuaugacccaaccgaagaaaucccagcaccccucggcacccccgacuuuguaggaaaaauacaaggcaugcuaacccaaaccacaaaaggugacggcuccacccgcggacacaaagccacaguauacaccggcuccgccccauuuacacccaaacucggcuccguccaauucucaaccgacaccgaaaaugacuuccaaacccaccaaaacaccaaauuuaccccgguuggcgucauucaagacggcuccacuacccaucgcaacgaaccccaacaguggguacuccccuccuauucaggccgcgacguccacaacguccacuuagccccagccgucgcacccaccuuccccggugaacaacucuuauucuuccgcucuacuaugccaggcugcucaggcuacccaaauauggaccuugacugccugcuaccccaagaauggguacaacacuucuaccaagaagcagcccccgcucaauccgacgucgcccugcuccgcuucguaaacccagacaccggccgcguacucuucgaaugcaaacuccacaaauccggcuacgucaccgucgcccacaccggucaacacgaccucguaauaccgcccaacgguuauuuccgcuucgacagcugggucaaccaauucuacacccuagcccccauggggaacgguacaggccgcagacgauaa

SEQ ID NO: 38927 - RNA, 1617 nt, Artificial Sequence
  derived and/or modified sequence opt11 from VP1__Norovirus_and/or_Norovirus-like__AB504314
augaaaauggccagcaacgacgccucccccucagacggcuccaccgcuaaccucguacccgaagucaauaacgaagucauggcacuagaaccagucgucggcgccgccaucgcugcucccgucgccggccaacaaaacgucaucgacccauggauccgcaacaacuucguccaagcccccggcggcgaauuuacagucucuccccgcaacgcccccggagaaauucuaugguccgcaccccucggaccagaccucaacccuuaccucucccaucuugcccgcauguauaacgguuaugcaggcgguuucgaaguccaagucauccuagccggaaacgccuucaccgccggcaaaaucaucuucgccgccguacccccaaacuucccaaccgaaggacuaucacccucccaggucacaauguucccccacauaaucgucgauguacgacaacucgaacccguccucauaccacuaccagacguccguaacaacuucuaccacuacaaucaauccaacgacuccaccauaaaacucauagccaugcucuacaccccacuccgagccaacaacgcaggcgacgacgucuucaccguuagcugccgcgucuuaaccaggcccucacccgacuuugacuucauauuccucgucccucccacagucgaauccagaaccaaacccuuuacugucccuauccucacugucgaagaaaugaccaacucccgguuccccaucccacucgaaaaacucuucaccggcccauccuccgcauucgucguccagccccaaaacggccgcugcacaacggauggcguccuccuaggaacaacccaacucuccccaguaaacaucugcaccuuucgcggcgacgucacacacauccccggcacccgaaccuaccguaugaaccucgcaagccaaaauuggaacaacuacgacccaaccgaagaaaucccagcaccccucggcacacccgacuuugucggucgaauccaaggaaugcucacacaaacuaccaaaggagacgggucgacucgcggccacaaggccaccguauccaccggcucuguagacuucacccccaaacuaggaucuguacaauucgccacagacaccgacaacgacuucgaaaccggccaaaacacccgauucacacccgucggcgucauacaagauggcuccucugcccuccgaaacgaaccccaacaauggguccuccccgauuacucaggccgaacaguccauaacguacacuuagcccccgccgucgcccuuaccuuccccggcgaacaacuacucuucuuccguucaaccaugccagguugcuccggcuaccccaacauggaccucgacugccuccucccccaagaauggguccaacauuucuaucaagaagccgcccccucccaauccgacguugcccuucuccgcuucgucaaccccgacaccggacgcguccuuuucgaaugcaaacuccaccgcgcuggcuacgucaccgucgcccacaccggacaacacgaccuagucaucccuccuaacggcuacuuccgcuucgacucauggguaaaccaauucuauacccuggcccccaugggcaacggggccggccgccgcagauaa

SEQ ID NO: 38928 - RNA, 1617 nt, Artificial Sequence
  derived and/or modified sequence opt11 from VP1__Norovirus_and/or_Norovirus-like__KX514350
augaaaauggccuccaacgacgccaaccccucagacggcagcgccgccaaccucguccccgaagucaacaacgaaguaauggccuuagagcccguagucggagcagccauagccgcucccgucgccggccaacaaaacguaaucgaccccuggauccgcaacaacuucguccaagcacccggaggcgaguucacagucucaccccgaaacgcccccggagaaauccucuggucagcaccccucggccccgaucugaaccccuaccuaucccaccucgcccgcauguacaacggauacgccggcggauucgaaguccaaguaauccucgccggaaacgccuucacugccggcaaaaucauauucgccgccguacccccuaauuuccccaccgaaggcuuaagccccagccaaguaaccauguuuccccacaucauagucgacgucagacaacucgaacccguccucaucccccuccccgacguccgcaacaacuucuaccacuacaaucaauccaacgacucaaccaucaaacucaucgccaugcucuacaccccacuuagagccaacaacgccggcgaugacguauucacugucuccugucgaguccuaacccgcccaucccccgacuucgacuucauauucuuagugccaccaacggucgaaucucgauccaagcccuucucugucccaguccuaacagucgaagaaaugaccaacucccgcuuccccgccacacuggacaaacuuuucaccgggcccuccucaaccuucgucguucaaccacaaaacggacgauguaugauagacggcguccuacucggaaccacacaacucucuccuguaaacaucugcaccuuccgaggcgacgucacacaauccggcaauaccaaaaucuacaccaugaaccucgcaagccccaacuggaacaacuacgauccaaccgaagaaauacccgcaccacucggcaccccagacuucgucggcaagauacagggcaugcucacacaaacuaccaaaggcgagggauccacacguggacaccgcgccacagucuacgucggaucagcaaacuacgccccaaaacuaggccgcguccaauucgaaaccgacacaaccgacgaccucgaugcacaccaaaacaccaaauucaccccaguaggcguuguacaauccggcgagucccccaaaggauccgaaccucaacaauggguccucccaucauacucaggccgagacacccccaacguucaccuagcccccgcagucgcacccacguuccccggagaacaacugcuuuucuuccgcucaacuauacccggcuguggaggacacccuaacaugaaccuagacugcuuacucccacaagaauggguccaacacuuuuaccaagaagccgcacccgcacaauccgacguagcccuccuucgcuucgucaacccagacaccucucgaguccucuucgaaugcaaacuccacaaaucaggauacguaaccguagcacacaccggacaacacgaccuggucaucccacccaacggcuacuuccgcuucgacuccuggguaaaccaauucuacacccuugcccccaugggcaacggcaccggccgcaaacgcuaa

SEQ ID NO: 38929 - RNA, 1617 nt, Artificial Sequence
  derived and/or modified sequence opt11 from VP1__Norovirus_and/or_Norovirus-like__KX514342
augaaaauggccucaaacgacgccaaccccuccgacgguucggccgcuaaccuugucccagaagucaauaaugaagucauggcacucgaaccaguagucggugcagccauugcagcccccgucgccggacaacaaaacgucaucgacccuuggauacgaaauaacuucguacaggcacccggcggcgaguucaccgucuccccacgcaacgcccccggcgaaauccucugguccgcaccccucggccccgaccuaaaccccuaccuuucccaccucgcacgcauguacaacggcuacgcuggcgguuucgaaguccagguaauacucgccggaaacgcauucacugcuggcaaaaucaucuucgccgccgucccuccuaacuuccccaccgaaggccucucacccucccaaguaacaauguucccccacaucaucgucgacguccgucaacuagaacccguccuaaucccgcugccagacguucgaaacaacuucuaccacuacaaccaaagcaacgacuccacuaucaaacucaucgccaugcucuacacaccccuccgcgccaacaaugccggcgacgacgucuucaccgucuccugccgcguccucacccgacccucacccgacuucgacuucaucuuccuagucccgcccaccguagaaucccgcuccaaacccuuuuccguccccguccuaaccguagaagaaaugaccaacucccgauuucccgccacccuugacaaacucuucacuggucccuccuccacauucgucguacagccucaaaacggccgcugcaugaucgacggcguacuacuaggcaccacccaacucucgcccgucaacaucugcaccuuccgaggcgacguuacccaauccggcaacacaaaaaucuacaccaugaaccuagccucacccaacuggaauaacuacgaccccaccgaagaaauaccugccccucucggcacccccgacuucgucggaaaaauacaaggcaugcuaacccaaacaaccaaaggcgagggauccaccagaggccaccgcgccacggucuauguagguucugcaaacuacgcccccaaacucggacgcguacaauucgaaacagacacuacagacgacuuagacgcccaccagaacaccaaauucacccccgucggcgucguccaauccggagaaagucccaaaggcucagaaccccaacaauggguccuccccucuuacucaggccgcgacacccccaauguccaccucgcucccgcugucgcucccaccuuuccaggcgaacaacuacucuucuuccgauccacaauaccaggaugcggcggccaccccaacauggaccuugacugccuacuaccccaagaauggguucaacacuucuaccaagaagccgcccccgcccaaucagacguagcacuacuacgcuucgucaaucccgauaccucccguguacucuuugaaugcaaacuccacaaaucaggcuacguaacagucgcccacacaggccagcacgaccuaguaauaccacccaacggcuacuuccgcuucgacuccugggucaaccaauucuauacccucgcaccaaugggcaacggcaccggccgcaaacgcuaa

SEQ ID NO: 38930 - RNA, 1617 nt, Artificial Sequence
  derived and/or modified sequence opt11 from VP1__Norovirus_and/or_Norovirus-like__KX514280
augaaaauggccuccaacgacgcuaaccccucagacggaucaaccgcuaaccuaguccccgaaguaaacaacgaaguaauggcccuagaaccagucgucggcgccgccauagccgcccccgucgccggucaacaaaacgugaucgacccauggauccguaacaacuucguacaagcccccggcggcgaauuuacagucucuccccguaacgcaccuggcgaaauacuguggucagcaccccucggccccgaccucaaccccuaccuaucccaccucgccagaauguauaacggauacgccgguggcuucgaaguccaagucauacucgccggcaacgccuucacagccggcaagaucaucuucgccgcaguaccacccaacuucccaacagaaggccuuucaccaucgcaaguaaccauguucccccacauaauagucgacguacgucaacucgaaccaguccuaauaccccuucccgauguccgaaauaacuucuaccauuacaaccaaucaaaagacagcaccaucaaacucauagccaugcuauacacaccacuccgcgccaacaacgccggggacgacguuuucacagucuccugccgaguccuuacccggccaucucccgacuucgacuucauuuuccuagucccacccaccguagaaucacgcucaaaacccuucucaguccccguucucaccguagaagaaaugaccaacagccguuuccccgucacccucgacaaacucuucacaggccccagcuccaccaucguuguccaaccgcaaaacggccguugcacaauagacggcguacuccucggcaccacacaacuaucaccggucaacaucugcaccuuccgcggcgacgucacccacccccgugacagcaccauauacaccaugaaccuugccuccccuaacuggaacacauacgaccccaccgaagaaaucccagcaccccucggcacccccgacuucgucggcaaaauccaaggaaugcucacccaaaccaccaaaggcgcagguuccacucgcggacaccgagccacugucuacgucggcuccgcaaacuacgcccccaagcucggccgcguacaauucgaaacgaacaccucagacgaccucgacgcacaccaaaacacuaaauucaccccagucggugucauccaagguggagaauccgcacaucgauccgaaccccaacaauggguacucccguccuacuccggccgcgacauacccaacguucaccucgcaccagccgucgcccccaccuuccccggcgaacaacuacucuucuucagaagcaccauccccgguugcggcggacacccaaacauggaccucgacugccuccuaccccaagaauggguccaacauuucuaccaagaagccgcccccgcccaauccgacgucgcccuacuacgcuucguaaacccagacaccucacgcguccucuucgaaugcaagcuccacaaguccggcuauguaaccguagcccacacaggccaacacgaccucgucauuccacccaacggcuacuuccguuucgauuccugggugaaccaauucuacacccuagcucccaugggcaacggaaccggcagaaagcgcuaa

SEQ ID NO: 38931 - RNA, 1617 nt, Artificial Sequence
  derived and/or modified sequence opt11 from VP1__Norovirus_and/or_Norovirus-like__LC177654
augaaaauggccucauccgacgcuaacccauccgauggcuccacugcuaaccucguccccgaagucaauaacgaagucauggcccucgaacccguugucggagccgccaucgccgcccccgucgcuggacaacaaaacgucaucgacccuuggauccgcaacaacuucguccaagccccagguggcgaguucaccgucucaccacgcaacgcacccggcgaaauccucugguccgcgccccuuggaccagaccucaacccauaucuuucccaccucgcccgcauguacaaugguuacgccggcggguucgaaguacaggucauccucgccggcaacgcauucacagcaggcaaaauaaucuucgccgccguacccccaaacuuccccaccgaaggacuaucucccucacaagucaccauguucccccacaucaucgucgacguacggcaacuugaaccaguccuuaucccccuccccgacgucagaaacaauuucuaccacuauaaccaaucaaacgacucuaccaucaaacuaaucgccaugcucuacaccccucucagggccaacaacgccggcgacgacgucuucaccgucuccugccgaguccucacccgccccucccccgauuucgacuuuaucuuucuagucccacccaccguagaaucccguaccaaacccuuuuccguacccguccucaccguagaagaaaugaccaacucccgcuucccaauaccacucgaaaaacuuuucacagggcccucauccgccuucgucguccaaccacaaaacggucgcugcaccaccgacggaguccuucuuggcacuacccaacuaagcccaguuaacaucugcaccuuccgcggcgacgucacccacauccccggaucccgcaacuacacuaugaaccucgccucacagaacuggaacuccuaugacccgaccgaagaaauaccagcaccccuaggcacaccagauuucgucggaaaaauacaaggcguacuaacccaaaccacaagaaccaacggcucuacccgaggacauaaagccaccgucuacaccggguccgccgacuucagccccaaacuaggccgcguccaauucgcaaccgacaccgauaacgacuucgaaacaaaccaaaacaccaaauucacacccguuggcgucauacaagacggcucaaccacaccccggaacgaaccccaacaauggguacucccauccuauagcggccgcaacauccacaacguacaccuagcccccgcagucgcccccaccuucccuggcgaacaacuccuuuucuuucguuccacaaugcccggcugcucaggauacccuaacauggaccucgacugccuacugccucaagaauggguccaauacuucuaccaagaagccgcaccagcccaaucagacgucgcccuucuccgcuucguaaaccccgacaccggccgaguccucuucgaaugcaaacuacacaaaagcgguuacgucaccgucgcacacaccggccaacacgaucucgucauaccacccaacggauacuuccgcuucgacucauggguaaaccaguuuuacacucucgcccccaugggaaacggaaccgggcgccgacgcuaa

SEQ ID NO: 38932 - RNA, 1617 nt, Artificial Sequence
  derived and/or modified sequence opt11 from VP1__Norovirus_and/or_Norovirus-like__KX354026
augaaaauggcuuccucggacgcaaaccccuccgacggcuccaccgccaaccucgucccagaaguaaacaacgaagucauggcgcuagaaccagucguuggagccgccauugccgcacccguagccggacagcaaaaugucaucgacccuuggauacgaaacaauuucguccaagcccccggcggcgaguucaccgucucuccccgaaacgcccccggcgaaauccugugguccgcaccccuaggacccgaccucaaucccuaccucucccaccuagcccgcauguacaacggcuacgccggcggauucgaaguccaagucauccucgccggcaacgccuucacagccgguaaaauaaucuucgccgccgucccucccaacuuccccacagagggccuaucccccucccaaguaaccauguucccccacaucaucguagacguccgccaacucgaaccaguccucauuccccuacccgacgucagaaacaacuucuaccacuacaaccaaucuaacgacuccaccaucaaacucaucgccaugcuuuacacacccuuacgugcaaacaaugccggcgacgacgucuucacaguaucuugucgaguccuaacccgacccucccccgacuucgauuucaucuuccuagucccacccacagucgaaucucgcaccaaacccuucuccguccccauacugacagucgaagaaaugaccaacucucgcuucccaaucccccucgaaaaacucuucaccggucccuccagcgccuucgucguacaaccccaaaacggccgcugcaccaccgacggaguacuccuaggcacuacccaacucucccccgucaacaucugcacauuccgcggagacguaacccacaucccgggcucccacaauuacacgaugaaucuagccucccaaaacuggaacuccuacgaccccaccgaagaaauacccgcaccccucggaaccccagacuucgucggcaaaauccaaggcguuuuaacccagacaaccuccacuaacggauccacccgcggccacaaagccacggucuacaccggauccgcagacuucucaccuaaacuaggccggguccaguucgccacagauaccaacaaugacuucgaaacuaaccaaaacaccaaauuuaccccaguaggcgucauucaagacggcucaaccacaccacggaaugaaccccaacaauggguccugcccuccuacuccggccgaaacauccacaacguccaccucgcccccgccguggccccaaccuuucccggagaacaacuccucuucuucagauccacaaugcccggaugcuccggauacccaaacauggaucuagacugccuccucccccaggaauggguccaauacuucuaccaagaggccgccccugcacaaucagacguugcacuccuacgauucgucaacccggacacaggacgcguccuuuucgaaugcaaacuccacaaaucuggcuacguaacagucgcucacaccggccaacacgaccuagucaucccacccaacggcuacuuccguuuugacucaugggucaaccaauucuacacccucgcccccaugggcaacggcaccggcagacgacgauaa

SEQ ID NO: 38933 - RNA, 1617 nt, Artificial Sequence
  derived and/or modified sequence opt11 from VP1__Norovirus_and/or_Norovirus-like__KR904218
augaaaauggcgagcuccgacgcuaaccccucagacggauccaccgcaaaccucgucccugaagucaacaacgaagugauggcccucgaacccgucgucggagccgcaaucgccgcucccgucgcaggccaacaaaacgucaucgaccccuggaucagaaacaacuucguccaagccccaggcggcgaguucaccgucagcccucgcaaugccccuggcgaaauccucuggagcgccccucucggacccgaccucaaucccuaccucucccaccucgcccgcauguacaacggcuacgccggaggcuucgaaguacaagucauacucgcaggcaacgcauucaccgcaggcaaaaucauuuucgccgcaguacccccaaacuucccaacagaaggccucucacccucucaagugaccauguucccccgcaucauaguagacguuagacaacuagagccaguccuuauaccccuaccugacguacgcaacaacuucuaccacuacaaccaguccaacgacccaacaaucaaacucaucgccaugcuauacacaccccugcgagccaauaacgcaggcgacgacguuuucaccgucuccugccgaguccuuacccgccccucacccgacuucgacuucaucuuccucgucccacccaccguagaaucacgcacaaaacccuucagcguacccauccucaccgucgaagaaaugacaaacucccgcuuccccaucccacucgaaaaacucuuuaccggcccauccucagccuucgucguccaaccccaaaacggacguuguucaaccgacggaguccuccucggcacaacucaacuaucaccggucaauauaugcacuuuccggggcgacgucacacacaucgccggcagccacaacuacaccaugaaccucgccucccaaaacuggucauccuacgaucccacagaggaaauccccgcaccccucggaacacccgauuucguaggcaaaauccaagguguccucacccaaaccaccagaaccgacggcucaacaagaggccacaaagccacagucuacaccggcuccgccgacuucagccccaaacucggccgaguacaauucgccaccgacaccaacaacgacuucgaaucaaaccaaaauaccaaauucgcccccgucggcgucauccaagacggcggcaccgcacaccgcaacgaaccccaacaauggguccuccccucuuacuccggucguaacauccacaacguacaccucgccccagcaguagcccccacauucccaggagagcaacuccucuucuucagaucaaccauccccggcugcuccggcuaucccaauauggaccucgacugccuacucccccaagaauggguccaauacuucuaucaagaagccgcccccgcccaaucagacgucgcacuacuacgcuuugucaauccggacacgggcaggguucucuucgagugcaaacuacacaaauccggauacgucacagucgcccacaccggccaacacgaccucgucauacccccaaacggauauuuccgauucgacuccugggucaaccaauucuacacccucgcgcccaugggcaacggcaccggaagacgacgcuaa

SEQ ID NO: 38934 - RNA, 1617 nt, Artificial Sequence
  derived and/or modified sequence opt11 from VP1__Norovirus_and/or_Norovirus-like__KJ678150
augaaaauggccucauccgacgccaacccauccgacggcucagccgccaaccuagucccagaagucaacaacgaagucauggcccucgaacccguugucggcgccgcgaucgccgcccccgucgccggccaacaaaacgucaucgaccccuggauacgaaacaacuucguacaagcaccuggcggcgaguucaccgucucaccccgcaacgcccccggagaaauacugugguccgcaccccuaggacccgaccucaaccccuaccucucccaccuagcucgaauguacaacggcuacgcaggcggauuugaaguacaaguaauauuagccggcaacgccuuuaccgcgggcaaagucauuuucgcggcgguaccacccaacuuccccaccgaaggccuaucccccucccaagucacuauguucccccacaucguugucgacguccgccaacucgaacccguacuaaucccccuccccgacguaaggaauaacuucuaccacuacaaccaaucuaacgacucgaccaucaaacuaaucgcaaugcuuuacacaccccuacgcgcuaacaacgccggugacgacgucuucacagucuccugcagaguacucacccgaccuagcccggacuuugacuuuaucuuccucguaccaccaacagucgaaucacgcacaaaacccuucucaguccccguccuaacaguagaagaaaugacaaacucccgcuucccaaccccacucgaaaaacuauucaccggcccaucuuccgccuucgucguccaaccacaaaacggccgaugcaccaccgacgguguucuccucggcaccacccagcuuagcccagucaacaucugcaccuucagaggcgacgucacccacaucacgggaucgagaaacuacacaaugaaccucgccagccaaaacugguccaacuacgaccccaccgaagaaaucccagccccacuaggaacacccgacuucgucggaaaaauacaaggcguccucacucaaaccacacgaaccgacggcuccacccgcggccacaaagccacggucuacacaggaucggcagacuucgccccgaaacucggacgcguacaauucgaaacagacaccgaccacgacuucgagacaaaccaaaacacgaaauucacccccgucggcgucauacaagacgguuccacaacccacagaaaugaaccccaacaguggguccuacccagcuacucaggccgaaacaccccuaacguccaccucgcaccagccguugcccccacauuccccggcgaacaacuacuauucuuccgaucaaccaugccaggcugcuccggcuacccaaacauggaucucgacugccuccuaccccaagaauggguacaauacuucuaccaagaagccgcacccgcccaaucagacguagcccuucuacgcuucgucaacccagacaccggacguguccuauucgaaugcaaacuucacaagucaggauacgucaccguggcccacacuggccaacaugaccucgucauacccccaaacggcuacuuccgcuucgacucaugggucaaccaauucuacacccuugccccaaugggcaacggaaccgggcgccgacgcuaa

SEQ ID NO: 38935 - RNA, 1617 nt, Artificial Sequence
  derived and/or modified sequence opt11 from VP1__Norovirus_and/or_Norovirus-like__KJ678148
augaaaauggccuccuccgacgcaaaccccagcgacggcucagccgccaaccuagucccagaagucaacaacgaagucauggcccucgaacccgucgucggcgccgcuaucgccgcccccguagcuggccaacagaacgucauagacccuuggauccgcaacaacuucguccaagcccccggcggcgaguucacagucucgccccgcaacgcuccaggagaaauccucugguccgcaccacucggccccgaccucaauccauaccuaagccaccuagcccgcauguauaacggcuacgcaggaggcuucgaaguacaagucaucuuagccggcaaugcauuuaccgcaggcaaagucaucuucgccgccguacccccuaacuuccccaccgaaggccucucccccucgcaagucacaauguucccacauaucguaguagacgucagacaacucgaacccguacucauaccacuccccgacguucgaaacaauuucuaccacuauaaccaauccaaugacuccaccauaaaacucauagcaaugcuauacacaccacucagagccaacaacgccggagacgacgucuucaccguaucaugccgcguccuaacccgccccucacccgacuuugacuucauauuccuagucccucccacagucgaaucacgcacaaaacccuucuccguccccguccuaacagucgaagaaaugacgaacucccgcuucccaacaccccucgaaaaacuauucaccggccccucauccgcuuuuguaguccaaccucaaaacggaagaugcaccacagacggcguccuccuaggaaccacccaacuaucuccuguaaacaucugcacuuuccgcggagacgucacacauauaacagguagccgcaacuacaccaugaaccuagccucucagaauugguccaacuacgaccccaccgaagaaauccccgcgccccucggcaccccagacuucgucggaaaaauccaaggcguacucacccaaaccacaagaaccgacggcucaacccgaggccacaaagcuacgguauacaccggcuccgcggacuucgcccccaaacuaggccgaguacaguucgaaaccgacaccgaccacgacuucgaaaccaaccaaaacaccaaauucacccccgucggcgucauccaagacgguuccaccacacaccguaacgaaccccaacaauggguccucccaucuuacucggggcgaaacaccccaaacguccaccuugcccccgcaguugcaccuaccuuccccggcgaacaacuccuauucuuccgcucaaccaucccugguugcuccggcuaccccaacauggaucucgacugccuccucccacaagaauggguacaauacuucuaccaagaagccgccccagcccaauccgacguagcacuccuccgcuucguaaaucccgauacaggccgcguccuauucgaaugcaaauuacacaaaagcggcuacguuaccguagcacacaccggacaacacgaccucgucaucccucccaauggcuacuuccgauucgacuccugggucaaccaauucuacacacuagcccccaugggcaaugguacaggcaggcgucgcuga

SEQ ID NO: 38936 - RNA, 1617 nt, Artificial Sequence
  derived and/or modified sequence opt11 from VP1__Norovirus_and/or_Norovirus-like__KP244316
augaaaauggcauccagcgacgcaaaccccuccgacggcucaacggccaaccucguaccagaaguaaauaacgaagucauggcccucgaaccagucguaggcgccgcaaucgccgcacccguagcgggucaacaaaacgucauagauccauggauccgcucaaacuucguccaagcccccggaggcgaguucaccguaucuccucgcaacgcaccaggagaaauucuauggucugccccacuaggcccagaccuaaauccauaccucagccaccuugcccguauguacaacggcuacgcaggcggauuugaaguccaagugauccucgccggaaacgccuucacugccggcaaaaucaucuucgccgcaguacccccaaacuuccccacugaaggacuaucccccucccaagucacaauguucccccacaucaucgucgacguacgacaacuagaacccguccuaaucccacuaccagacguccgaaacaacuucuaccacuacaaccaaucaaacgacccaaccauuaaacucaucgccaugcuguacacgccccugcgcgccaacaacgccggcgacgacgucuucaccguaucaugcagaguccuuacccgcccaucuccugacuucgacuucauauuccucguuccacccaccgucgaaagccguaccaaacccuucucaguccccguccuaaccgucgaagaaaugaccaacucccgauucccaauuccccuagaaaagcucuuuaccggacccuccuccgcauuugucguccaaccucaaaacggccgcugcaccaccgacggaguacuacuaggcaccacccaacucucccccgucaacaucugcacauuucgcggcgacguaacccacaucuccggcucccgcaacuacaccaugaaccucgcuucccaaaacuggaacuccuacgaccccacagaagaaaucccagcccccuuagggaccccagacuucgucgguaaaacccaaggcguccuaacucaaaccacaaaaacuaacggauccacccgcggacacaaagccaccguauacacggguucagccgacuuuucacccaaacucggccgcguacaauucgcaaccgacaccgacaacgacuucgaaaccaaccaaaauacaaaauucacacccgucggcguaauccaagacggcuccaccacaccccgagaugaaccucaacaauggguccuuccaucauacucaggacgcaacacccauaacguacaccuggcccccgccgucgcccccaccuuccccggcgaacaacuacucuucuucagauccacaaugccaggcuguucgggcuaccccaacauggaccucgacagacuacuuccacaagaauggguacaauacuucuaccaagaacccgccccugcacaauccgacguagcucuccuccgcuucgucaacccagacacaggccgcguccuauucgaaugcaaacuccacaaauccggauacgucaccguagcccacacaggccaacacgaccucgucaucccacccaacggauauuuccgcuucgacucuugggucaaccaguuuuacacccucgcccccauggguaacggcaccggacgccgccgcuaa

SEQ ID NO: 38937 - RNA, 1617 nt, Artificial Sequence
  derived and/or modified sequence opt11 from VP1__Norovirus_and/or_Norovirus-like__KF060072
augaaaauggccuccucagacgcaaacccauccgacggcuccgccgcaaaucucguccccgaaguuaacaaugaaguaauggcccucgaacccguagucggagcagcaaucgcagcccccgucgccggacaacaaaacguaaucgaccccuggauucgaaacaacuucguacaagcccccggaggcgaguucaccguauccccucgaaacgcaccgggagaaauacucugguccgccccucucggcccagaccucaaucccuaccucucccaccucgcccggauguacaacggcuacgccggcggcuucgaaguccaagucauacuagccggcaacgccuucacagcaggaaaaauaaucuucgcugcaguaccaccaaacuuucccacagaaggacucuccccaucucaaguaaccauguuuccacacaucaucgucgacguccgacaacucgaaccaguacucaucccccuccccgacguccgcaacaacuucuaccauuauaaccaaagcaacgacucaaccaucaaacucaucgccauguuauacacaccccuacgugccaacaacgccggcgacgacguauucaccguaagcugccgcguccucaccagacccucccccgacuucgacuucaucuuccuagucccacccaccguagaaucacgaaccaaacccuucucagucccaguccucaccguagaagaaaugaccaacucccgauucccaaucccccucgaaaaacuauucacaggacccuccagcgcuuucgucguacaaccccaaaacggccgcugcaccaccgacggcguccuccugggcaccacccaacucucaccggucaacauaugcaccuucagaggcgacgucacacacaucuccgguucacgcaacuacaccaugaaccucgccagccaaaacuggaacucauacgacccaaccgaagaaaucccugccccacuuggcacccccgacuucgucggaaaaauccaaggcguacuaacccagaccacccgcaccgacggcagcaccagaggacacaaagccacugucuacaccgguucugcagacuucucucccaaauuaggccgaguccaauucgcaacugacaccgacaacgauuucaucaccaaucaaaacacaaaguucacaccggucggcgugauacaagacggaucaacaacaccccggaacgaaccacaacaauggguccucccaagcuacuccggccgcaacacccacaacguccaccuagcccccgcggucgccccaaccuuccccggcgaacaacuccucuucuuccgcucaacgaugcccggaugcuccggcuacccuaacauggaccuugacugccuucuaccccaagaauggguccaguacuucuaccaagaagcugcgcccgcucaauccgacgucgcucuacuacgauucgucaaccccgauaccggacgaguccucuuugaaugcaagcuacacaagcccggcuacguuacaguagcacacaccggccaacacgaccuaguaauuccacccaacggauacuucagauucgacagcugggucaaccaauuuuacacucucgcccccaugggcaacggcaccggucgccgccgauaa

SEQ ID NO: 38938 - RNA, 1617 nt, Artificial Sequence
  derived and/or modified sequence opt11 from VP1__Norovirus_and/or_Norovirus-like__JX439822
augaaaauggcuuccuccgacgcaaacccaagcgacggauccacagccaaccucguuccagaagucaauaacgaagucauggcccucgaacccgucguaggcgcagccaucgcagcaccagucgcaggccagcaaaauguaaucgacccauggauccgcaacaauuucguacaagccccugguggcgaauuuacaguaucaccccgaaacgcacccggcgaaauccucugguccgcaccccucgggccagaccuaaaccccuaccuuagucaccuagcacgcauguacaacggcuacgccggcggcuucgaaguccaagucauacuagcgggcaacgccuucacagcuggaaaaaucaucuucgcagcagucccacccaacuucccaaccgaaggccucucucccucucaagucaccauguucccccacauuauagucgacguccgucaacucgaacccguccuaaucccccuacccgacguccgcaacaacuucuaccacuacaaccaauccaaugaccccaccaucaaacucaucgccaugcuuuauacaccccuacgagcaaacaacgccggcgacgacgucuucaccgucuccugccgcguacucacccgacccuccccugacuucgacuucauauuucuaguaccucccaccguagaaucacgcaccaaacccuucucaguucccguccuaaccgucgaagaaaugaccaacucacgauuccccauaccccucgaaaaacucuucaccggacccucguccgccuucgucguucaaccccaaaacggacgcugcaccaccgacgguguccuacucggcacuacucaacuaucacccguaaacauaugcaccuuccgcggugauguaacacauauacccggcucuagaaacuacacgaugaaccucgcaucccaaaacuggaacucguaugaccccaccgaagaaauuccagcaccccucggcacccccgacuucgucgguaaaauacagggaguccucacgcaaaccacccgcaccaacggaucuacacgaggccacaaagccaccgucuacacaggcuccgccgacuucuccccaaaguuaggccgcguccaauucgccaccgacacagacaacgacuucgaaaccaaccaaaacaccaaauucacaccaguuggcgucauccaagaugggagcaccacaccccgcaacgaaccccagcaauggguccucccauccuacagcggacguaacauacacaacguccaccuagccccagccguagcccccaccuuccccggcgaacaacuccuauucuuccgcucaacaaugccuggaugcuccggcuaccccaacauggaccucgauugccuccucccccaagaauggguccaauacuucuaccaagaagccgcccccgcacaauccgacguugcccuccucagauuuguaaaccccgacaccggccguguccucuucgaaugcaaacuacacaaaucaggcuacguuaccgucgcccacacaggacaacacgaccucguuauaccucccaacggauauuuccgcuucgauuccugggucaaccaauucuacacauuagcaccaaugggcaacggcacuggcucaagacgcuaa

SEQ ID NO: 38939 - RNA, 1617 nt, Artificial Sequence
  derived and/or modified sequence opt11 from VP1__Norovirus_and/or_Norovirus-like__KC463910
augaaaauggcuucaucagacgccaacccauccgacggaucuacagccaauuugguccccgaaguaaacaacgaagugauggcacuugagcccguaguuggugcagccauugccgcccccguugcaggccaacaaaacguaaucgaccccuggauccgcaauaacuuuguacaggcccccggcggcgaguucaccguguccccacgaaacgccccuggcgaaauacuuugguccgcaccccucggcccagaucucaaccccuaccuuucacaccucgcucgcauguacaauggcuacgccggcggcuucgaaguucagguaauacuagccggcaacgcauucaccgccggcaaaaucaucuuugccgccgucccacccaacuuccccacugaaggccucucccccucccaagucaccauguucccacacaucaucguagauguacggcaacucgaacccgucuuaaucccacucccugacguccgcaacaacuucuaccacuacaaccaaucaaaugacuccaccauaaaacucaucgcaaugcucuauacaccccuucgcgccaacaacgccggcgacgacgucuucaccgucuccugccgaguccucacccgaccaucaccugacuuugacuucaucuuccuaguacccccaaccgucgaaucccgcaccaaaccuuucuccguccccauccucacagucgaagaaaugaccaacucccgcuucccuauaccccucgaaaaacucuucaccggcccauccuccgccuucguaguccaaccccaaaacggccgcugcaccacugacggcguccuucucggcaccacacaacucucccccguaaauauaugcacauuccgaggcgacguaacccacaucccaggcucccacaacuacaccaugaaccuagcaagccaaaauuggaacuccuacgaccccaccgaagaaaucccggcgccacucggaaccccagacuuuguaggcaaaauccaaggcguccuaacacaaaccacauccaccaacggcuccacccgaggacacaaagccacagucuacacaggauccgccgacuucuccccgaaacuuggacgcguccaauucuccacagacaccaacaacgacuucgagacaaaccaaaacaccaaauucacccccgucggcgugauccaagacggaagcacaacaccccgcaacgagccccaacaauggguccuacccucuuacuccggccgcaacauacacaacguccaccuugcuccagccguagcaccaacauuccccggagaacaacuccucuucuuccgcucaacaaugcccggcugcagcggauacccuaacauggaccuagacugccuccucccccaagaauggguacaauauuucuaccaagaagccgcaccagcccaaucugacguagcccuucuccgauucgucaacccagacacaggacgcguacucuucgagugcaaacuacacaaaucaggcuacgucaccguugcccacaccggccaacacgaccucgucauaccacccaacggcuacuuucgcuucgacuccugggucaaccaauucuacacucuagcucccaugggaaacggcacgggacgaagacgcuaa

SEQ ID NO: 38940 - RNA, 1617 nt, Artificial Sequence
  derived and/or modified sequence opt11 from VP1__Norovirus_and/or_Norovirus-like__JX459651
augaaaauggcaucauccgacgccaacccaucagacggcucaaccgccaaccucguccccgaagucaacaacgaaguaauggcccucgaacccgucgucggagccgccauagccgcccccguagccggccaacaaaacgucaucgaccccuggauccgcaacaacuucguccaagcaccaggcggcgaguucaccgucagcccccgcaacgcccccggcgaaauccucugguccgcaccacuaggcccagaccucaacccauaccucucacaucuagccagaauguacaacggcuacgcugguggauucgaaguacaagucauacucgcuggcaacgccuucacagcagggaaaaucaucuucgccgccguaccacccaacuuccccaccgaaggccucuccccaucucaagucacuauguucccccacaucaucgucgacguacgacaacuagaaccaguccuaauaccccuacccgauguccgaaacaacuucuaccacuacaaccaauccaacgacccaacaaucaaacucauagcgaugcucuacacaccccucagagccaacaaugcuggagacgacguauucacugucucuugcagaguucuaacccgcccaucccccgacuucgauuucaucuuccucgucccacccacagucgaaucccgcacaaaacccuucuccgucccaguccuaaccguagaagaaaugaccaacucccgauucucaaucccccucgaaaaacucuucacuggcccgucuagcgcuuucgucguucaaccacaaaacggucgcugcaccaccgacggaguccuacucggcaccacacagcuuucccccgucaacaucugcacuuuccgcggcgacgucacccacauccccggcucccgaaacuacaccaugaaccucgcaucccaaaacuggaacagcuacgaccccacagaagaaauccccgcuccccucggaacccccgacuucgucggcaagauccaaggaguacuaacccaaaccacacgcaccaacgguucaacccgcggccacaaagccacaguuuauacaggaucagccgacuucuccccgaaacuaggccgcgugcaauucgccacagacaccgacaacgacuucgaaacaaaccaaaacacaaaauucacgccaguaggagucauccaagauggcuccaccacaccccgcaacgaaccccagcaauggguccucccauccuauuccggccgaaacauccacaacguccaccucgcccccgccgucgcaccuaccuuccccggcgaacaacuacucuucuucaggucaaccaugcccggaugcucaggcuacccaaacauggaccucgacugccuccucccccaagaauggguacaauauuucuaccaggaagccgcccccgcucaaucagacgucgcccugcuccgguucgucaacccagacaccggacgcguccucuucgaauguaagcuacacaaauccggcuacgugacuguagcacauacaggccaacacgaccucguaauaccacccaacgguuauuuccgcuucgacucaugggucaaccaauuuuacacccucgcccccaugggcaacggcacaggccgccgacgauaa

SEQ ID NO: 38941 - RNA, 1617 nt, Artificial Sequence
  derived and/or modified sequence opt11 from VP1__Norovirus_and/or_Norovirus-like__AB541314
augaaaauggcauccucggacgccaacccauccgacgguucagcagcuaaccucgucccagaagucaacaacgaaguuauggcacucgaacccgucgucggcgccgccaucgccgcccccguagccggccaacaaaacgucaucgacccuuggauccgcaauaacuucguccaggcacccggcggugaguucacagucucaccccguaacgcgccaggugaaauccuaugguccgcuccccuaggaccagaucucaaccccuaccuaucucaucuugcccgcauguacaacggcuacgccggcggcuuugaaguacagguuauccuagccggcaaugccuuuaccgccggaaaaauaaucuucgcugccgugccgcccaacuuccccacagaaggccucucccccucccaagucaccauguucccccacaucaucgucgacguccgacaacucgaacccguccuuaucccccuacccgacguacgaaacaacuucuaccauuacaaccaauccaacgacuccaccaucaaacucauagccaugcucuacacuccccuacgagccaacaaugccggagaagucgucuucaccgucucaugccgcguccucacccgccccagccccgauuucgacuucaucugccucguaccacccaccguagaaagccgcacaaaacccuucacaguccccauucucaccguagaagaaaugaccaacucccgcuuccccaucccccuagaaaaacuauucacaggacccucauccgccuucgucguacaaccacaaaacggccgaugcaccaccgacggcguccuacucggcacaacccaacuauccccagucaacaucugcacuuuccgcggugacguaacccacauagcaggcucccgaaacuauaccaugaacuuagcuucucucaacuggaacaacuacgaccccacagaagaaauccccgccccacugggaacccccgacuucgucggcaaaauccaaggcgucuuaacacaaacuacuaaaggcgacggaucaacccgcggccauaaagccacagucuacaccggcuccgcccccuucaccccaaagcuaggauccguccaauucuccaccgacaccgagaacgacuucgaaacccaccagaacaccaaauucacccccgucggaguaauccaagacggcggcacaacccaccgaaacgaaccccaacaaugggugcucccauccuacucuggacguaacgucccuaacguucaccucgcaccagccgucgcccccaccuuccccggcgagcaacuacuauucuuccgcuccaccaugcccggcugcuccggcuaccccaauauggaccucgacugccuccucccacaagaauggguccaacacuucuaccaagaagcagccccagcucaaucggacguugcccucuuaagauucguaaaccccgacaccggccgaguacucuucgaaugcaaacuacauaaacccggcuacguaacagucgcccacacaggacaacaugaccuugucauccccuccaacggcuacuuccgauucgacagcugggucaaccaauucuacacauuagcccccaugggcaacggaacuggacgccgacgcuaa

SEQ ID NO: 38942 - RNA, 1617 nt, Artificial Sequence
  derived and/or modified sequence opt11 from VP1__Norovirus_and/or_Norovirus-like__AB504323
augaaaauggccuccucagacgccaaccccuccgacggcagcgccgcuaaccucgucccagaaguaaacaacgaaguaauggcacucgaaccugucguaggcgccgccaucgccgccccagucgcgggccaacaaaacguaaucgaccccuggaucagaaacaacuucguccaagccccaggcggcgaguucaccguuagcccccgaaacgcccccggagaaauccucugguccgcuccccucggccccgacuuaaacccauaccuaucccaccucgcccgcauguacaauggcuacgccgguggguucgaaguccaagucauacucgccggaaacgccuucacagccgguaagauaaucuucgcagcaguacccccaaauuucccaaccgaaggccuuuccccuucacaagucaccauguucccccauaucaucaucgacguaagacaacuagaacccguacuaauaccccuuccagacguccgaaacaacuucuaccacuacaaccaauccaacgacucuaccaucaaacucaucgcaaugcucuacacaccccuucgugcaaacaacgcuggcgaagacguauucaccgucuccuguagaguccucacccgaccaucacuagacuuugacuucaucuuccuaguacccccaaccgucgaaucacgcaccaaacccuucaccguccccauccuuacaguagaagaaaugacaaacucccgcuuucccaucccccucgaaaaacucuucacuggccccuccggcgcguucgucguccaaccccagaacggccgcugcaccacagacgggguccucuuaggcaccacacaacucucccccgucaacaucugcacccuacgcggcgacgucacacacauugccggcucccgcaacuacacaaugaaccucgccucacucaacuggaauaacuacgaccccacagaggaaaucccagcaccccucggaaccccagacuucguaggcaaaauccaaggaguccucacacaaaccaccaagggagacggcucuacccgaggccacaaagccacagucuauacaggcuccgcccccuucaccccuaaacucggcuccguccaauucuccacugacaccgaaaacgacuucgaaacccaccaaaacaccaaauucaccccagucggcguaauccaagacggauccaccacccaccgcaacgaaccccaacaauggguccucccaucauacucaggcagaaacguccacaacguccaccuagccccagcaguagcccccaccuuccccggcgaacaacuacucuucuuucgaucaaccaugcccggcugcucaggcuacccaaacauggaccucgacugccugcugccccaagaguggguucaacacuucuaccaagaagccgcccccgcccaauccgacgucgcccuacuacgauucgugaaucccgacacuggccgaguacuauuugaaugcaaacuacacaaaucaggcuacguaacggucgcccacacaggccaacacgaccuugucauacccccaaauggguacuuccgcuucgacucaugggucaaccaauucuacacccucgccccaaugggcaacggcaccggccgccgacgauaa

SEQ ID NO: 38943 - RNA, 1617 nt, Artificial Sequence
  derived and/or modified sequence opt11 from VP1__Norovirus_and/or_Norovirus-like__KX353963
augaagauggcauccucagaugcaaaccccucagacggcuccaccgcaaaucuaguccccgaagucaacaacgaaguaauggcacucgaacccgucguaggagcagccauagcagcacccgucgccggacaacaaaacgucaucgacccauggauccgaaacaacuucguccaagcccccggcggugaguucaccguuuccccuagaaacgccccgggcgaaauccuuugguccgcaccucucgggcccgaccuaaaccccuaccuaucacaccucgcuagaauguacaacggauacgccgguggauucgaaguccaaguuaucuuagcaggaaacgcuuucaccgccggaaaaaucauauuugcggccgucccacccaacuuccccaccgaaggucucuccccuucucaagucaccauguuuccacacaucaucgucgacguccgccaacucgaaccaguacucauaccccucccagacguacgcaacaacuucuaccacuacaaccaaagcaacgacuccaccaucaaacucauagcaaugcucuacacaccgcuccgcgcuaacaacgccggagacgacgucuucaccgucuccugucguguccucacccgacccucaccagacuucgacuucaucuuucucgucccucccaccgucgaaucccgaaccaaacccuucucuguccccgugcucaccgucgaagaaaugacaaacucucgcuucccuaucccacuugaaaaacucuucaccggcccguccucagcuuucguaguccaaccacaaaacggacgauguaccacggacggcgucuuacucggaacaacacaacucucccccgucaacauaugcaccuuccgcggcgacguaacccacaucccaggcucccgcaacuacaccaugaaccuagcaucucaaaacuggaacuccuacgacccaaccgaggaaaucccagcaccacucggcacacccgacuucgucgguaaaauccaagguguacucacccaaaccacccgaaccaauggaucaacccgcggacauaaggccaccgucuauacaggaucagcagacuucuccccaaaacucggccgcguacaauucgccacugacaccgacaacgauuucgaaaccaaccaagacaccaaauucacacccguuggcgucauccaagacggaagcaccacaccccgcaacgaaccucaacaauggguacuccccuccuacuccggccgaaacauacacaacguccaccucgcacccgcggucgccccaaccuuuccaggcgaacaacuccuauucuuccgcucaaccaugcccggcugcuccggauacccaaacauggaccucgacugccuccuuccccaagaauggguccaauacuucuaucaagaagcagcccccgcacaauccgaugucgcccuacuccgauucgucaacccugacaccggccguguacuauucgaaugcaaacuccacaaauccggauacguaaccgucgcucacaccggacaacacgaccucgucaucccacccaacggcuacuuccgauucgauuccugggucaaccaauucuacacccucgcccccauggguaacggcaccggcagacggcguuaa

SEQ ID NO: 38944 - RNA, 1617 nt, Artificial Sequence
  derived and/or modified sequence opt11 from VP1__Norovirus_and/or_Norovirus-like__KR904213
augaagauggcuuccucagacgccaaccccagcgacggcuccaccgccaaccuaguccccgaagucaacaaugaagucauggcacucgaacccgucgucggcgcagccauagcagccccugucgcaggccaacaaaacguaaucgaccccuggauccgcaacaacuuuguccaagcuccuggaggagaauuuaccguaucuccccgcaacgcacccggcgagauccucugguccgccccacucgguccagaccuaaaccccuaccucucccaccucgcccgcauguacaacggcuacgccgguggcuucgaaguccaagucauacuagcaggcaacgcauucaccgccggcaaaauaaucuucgcugccgugccucccaacuuccccaccgaaggacuaucccccucccaaguaaccauguucccccacaucaucgucgauguccgccaacucgaacccguccuaaucccacuccccgacguacgaaacaacuucuaccacuacaaccaaucaaacgacucuaccauaaaacucaucgcaaugcucuacacaccacuucgcgcaaacaacgccggugaugacguuuucacugucucuugcagaguccuaacccgccccucacccgacuucgacuuuaucuuccugguaccaccuacaguagaaucacgaacaaaacccuucucaguacccguccucaccgucgaagagaugacaaauucccgcuucccaauaccacuagaaaaacucuucacaggccccuccuccgccuuugucguccaaccccaaaacggacgcugcaccacugauggcguccuucucgguaccacccaacucucacccgucaacauauguacauuucguggagacguuacucacauccccggcucccgcaauuacaccaugaaccuagccucacaaaacuggaacuccuacgaccccaccgaagaaauacccgcaccccucggcacucccgacuuuguagguaaaauccaaggcguccucacccaaaccacccgaaccaauggcuccacacgcggccacaaagccaccguauacaccggauccgccgacuucucacccaaacuaggccgaguccaauucgccacagacaccgauaaugacuuugaaaccaaccaaaacaccaaauucacacccgucggcguuauccaagacgguuccaccacaccccgaaaugaaccccaacaauggguccugcccuccuauuccggccgcaauauccacaauguccaccucgccccagccgucgcucccaccuuccccggcgaacagcuccuuuucuuccgauccacuaugcccggcugcuccggauacccaaacauggaccucgacugccuccucccacaagaaugggugcaauauuucuaucaagaagccgcccccgcucaauccgacgucgcccuccuacgcuucgucaaccccgacacaggccgaguccuuuuugaaugcaaacuccauaaaucaggcuacguaaccguugcacacacuggccagcacgaccucgucaucccacccaacggauacuuccgauucgacuccugggucaaccaauucuucucccucgcccccaugggaaacggcacaggcagacgccguuga

SEQ ID NO: 38945 - RNA, 1617 nt, Artificial Sequence
  derived and/or modified sequence opt11 from VP1__Norovirus_and/or_Norovirus-like__AB933745
augaaaauggcauccaaucacguaaaccccucggacggauccacagcuaaccuaguccccgagguuaacaacgaagucauggcccucgagccagucguaggcgcugcaaucgccgcacccgucgccggacaacaaaacguaauagacccauggaucaggaacaacuucguccaagcccccgguggcgaguucaccguaagcccacgcaacgcacccggcgaaauccucuggagcgcaccccucggucccgaccucaaccccuaucucucucaccucgcccguauguacaauggcuaugccggcgguuucgaaguccaaguaauccuagccggcaacgccuucaccgccggaaagauaaucuucgccgccgucccacccaacuuccccaccgaaggacucuccccaucccaaguaaccauguucccacauaucaucgucgacguccgacaacuagaacccguacucaucccacuucccgacguacguaacaacuucuaccacuacaaccaauccaacgacccaacaaucaaauuaauagcaaugcucuacaccccacuccgagcuaacaacgcaggagacgacguguucaccgucuccugccgaguccucacccgccccucccccgacuucgacuucaucuuccucguacccccgacagucgaaucccguacaaaaccauucucaguccccguccuaacaguagaagaaaugaccaacucccgcuuccccauaccccuagaaaaacuauucaccggcccuuccuccgcauucgucguacaaccacagaacggacgcuguaccaccgacggaguccuccucggcaccacccaacuuucucccgucaacaucugcaccuuccgcggcgauguuacccacauccccgggucacgcaacuacaccaugaaccucgcuucucaaaacuggaacucauacgacccuacagaagaaauccccgcuccccucggcacccccgacuucgucggcaaaauacaaggaguacuaacccaaaccacccgcaccaauggcucuacccgaggucacaaagccaccgucuacaccggcagcgccgacuucucaccaaaacuaggccgugugcaauucgccaccgacaccgacaacgacuucgaaaccaaccaaaacaccaaguucaccccuguaggcgucauccaagacggauccacgacuccccgcaacgaaccccaacaauggguccuccccucauacuccggucgcaacauccauaacguccaucucgcuccagccguugcccccaccuuccccggcgaacaacuccuuuucuuccgauccaucaugcccggaugcucaggcuaccccaacauggaccuagauugccuacucccacaagaauggguccaauacuucuaccaagaggccgcaccagcccaaucagacguugcccuccuccgauucgucaaccccgacacaggccgcguccuauucgagugcaaacuccacaaauccggcuacguaacagucgcacacaccggccaacacgaccucguaauaccgccuaacggcuacuuccgcuucgacuccuggguaaaccaauucuacacccucgccccuaugggcaacggcaccggccgccgucgauaa

SEQ ID NO: 38946 - RNA, 1617 nt, Artificial Sequence
  derived and/or modified sequence opt11 from VP1__Norovirus_and/or_Norovirus-like__KP096341
augaaaauggccucaucagacgcuaaccccucagauggcucagccgccaacuuaguccccgaagucaacaacgaagucauggcacucgaacccgucgucggcgccgccaucgccgcccccguagccggccagcaaaacgucaucgaccccuggauccguaacaacuucguacaagccccaggaggagaauuuacagucucaccccgcaacgcuccaggcgaaauccucugguccgcaccccucggacccgaccucaaccccuaccuaucgcaccucgccagaauguacaacggcuacgccggcggcuucgaaguacaagucauccuagcuggcaaugccuucaccgccggcaaagucaucuucgccgcagucccaccgaacuuccccaccgaaggucuaucccccucccaaguuaccauguucccacacaucgucgucgacguccgccaacuugaacccguucucaucccccuuccagacguacgcaauaacuucuaccacuacaaccagagcaacgacccgaccauuaaguuaaucgccaugcucuacacaccccuucgugcaaacaacgccggagacgauguuuucaccgucucaugccgaguccucacccgcccaucccccgacuucgacuucaucuuccuagucccacccacagucgaaucccgcacaaaacccuucuccgucccaguccuaaccguagaagaaaugacaaacucccgauuccccaucccccucgaaaaacuauucaccggaccuucauccgcauucgucguacaaccacaaaacggccgaugcaccaccgacggcguccuucuuggaaccacccaacuaucccccgucaacaucuguaccuuccgaggagacgucacccacaucaccggcucgcgaaacuauaccaugaaccuugccucccaaaacugguccaacuacgaucccacagaagaaauaccagcuccccucggcacccccgacuucgucggcaaaauccaaggaaugcuuacccaaaccacccgcacggacggcuccacccggggccacaaagccacagucuacaucggcggcgccgacuucgcccccaaacucggccguguccaauucgaaacagauaccgaucacgacuucgaagccaaccaaaacacaaaauucacccccgucggagucauccaagacggauccacuacccaucgcaacgaaccccaacaauggguccucccgucauacucaggccgaaauacccccaacguucacuuagccccagccgucgcaccaaccuucccaggcgaacaacuccuuuucuuccguuccacaaugcccggaugcucagguuacccaaacauggaccucgacugccuccucccacaagaauggguacaauacuucuaccaagaagccgcacccgcccaauccgauguagcccuccuccgcuucgucaaccccgacaccggccgaguccuauucgaaugcaagcuccacaaaucaggcuacgucaccgucgcccacaccggacagcacgaccucgucaucccacccaacggcuacuuccgcuucgacuccugggucaaccaauucuacacacuagcacccaugggaaacggcaccggcagacgccgauaa

SEQ ID NO: 38947 - RNA, 1617 nt, Artificial Sequence
  derived and/or modified sequence opt11 from VP1__Norovirus_and/or_Norovirus-like__KM114291
augaaaauggcaagcucagacgcaaauccuagcgauggauccgcagccaaccucguucccgaagucaacaacgaaguaauggcccucgaacccgucguuggagccgccaucgccgcacccgucgccggccaacaaaacgucaucgacccuuggauccgcaacaauuucguucccgcaccagggggcgaguucaccguaucuccccgcaacgcccccggagaaauccucugguccgcuccccucggcccagaucuaaaccccuaccucucccaccucgcccgaauguacaacggcuacgccggaggcuucgaaguacaagucauacucgccggcaaugccuucacagcuggaaaagucaucuucgcugcagucccacccaacuuccccacagaaggccuauccccaucccaagucaccauguucccacacauagucgucgacguccgccaacucgaacccgucuuaaucccgcuccccgauguucgcaauaauuuuuaccacuacaaccaauccaacgacccgaccauaaaacucaucgccaugcucuacacaccacucagagccaacaacgcuggggacgacgucuucaccguuuccugccgaguccucacccgcccauccccagacuucgacuucauauuccuagucccaccuacggucgaaucccgcacaaagcccuucucaguccccguacuaaccguagaagaaaugacaaauucacgauuccccaucccacucgaaaaacuguucaccggcccgucaucagcguucguaguccaaccccaaaacggucgcugcaccacagacggcguccuccuuggcgccacacaacuauccccagucaacaucugcaccuuccgaggcgacgucacacacaucaccggcucccgcaacuacaccaugaaccucgcaucccaaaacuggucgaacuacgaccccaccgaagaaaucccagcaccacuaggaacccccgacuucgucggcaaaauacaaggaguccuaacccagacuacacgcaccgacggcagcacacgcggucacaaagccacaguauacaccgguuccgcugauuucgcaccaaaacuaggacgcguccaauucgaaaccgacaccgaucgcgacuucgaagccaaccaaaauacuaaauucacccccgucgguguaauccaagacggcucaaccacacaccgcaacgaaccacaacaauggguacucccauccuacagcggccgcaacacuccaaacguccaccuagccccugccguagcccccaccuuccccggagaacaacuccuauucuuccgaagcaccaugcccggcugcuccggcuacccaaacauggaccuugacugccuccucccccaagaauggguccaauauuucuaccaagaagcagcaccagcccaaucagacgucgcacuauuacgauucguuaaccccgacaccggccgcguccucuucgaaugcaaacuccauaaauccggcuauguaaccguagcccacaccggccaacacgaccucgucaucccacccaacggauacuuccgcuucgacucaugggucaaccaauucuacacccucgcccccaugggcaacggaaccggccgacgucgcuga

SEQ ID NO: 38948 - RNA, 1617 nt, Artificial Sequence
  derived and/or modified sequence opt11 from VP1__Norovirus_and/or_Norovirus-like__KF060105
augaaaauggccucuuccgacgccaacccguccgacggcuccaccgcaaaccuaguacccgaagucaauaacgaagugauggcacucgaacccgucgucggcgccgccaucgcagcacccgucgcgggacaacaaaacgucaucgaccccuggaucagaaacaacuuuguccaagcccccggcggcgaguucaccgucucuccccgcaacgcuccaggcgaaauucuaugguccgcaccccucggacccgaccucaacccauaccucucccaccucgcccgcauguacaacggcuacgccggcgguuucgaaguccaagucauccucgccggaaacgcauucaccgccgguaaaaucauauuugccgccgucccacccaacuuccccaccgaaggucucucaccaucccaagucacuauguuuccccauauaaucgucgacguccgccaacuugaacccguccuuaucccccuccccgacguaagaaacaauuucuaccacuacaaccaauccaacgacucaaccauaaaguuaaucgcaaugcucuacacuccccuucgcgcuaacaacgccggagacgacguuuucaccgucucaugccgcguacuuacccgccccagccccgacuucgacuucauuuuccucguacccccaaccgucgaaucccguaccaagccauucuccgucccaauucuaacagucgaagaaaugaccaacucacgcuuccccaucccccucgagaaacucuucaccggccccuccucugcauucgucguccaaccacaaaacggacgcugcaccaccgacggcguccuucugggcaccacccaacuauccccagucaacgucugcacauuccgcggcgacgucacccacauccccggaucacacaacuacacaaugaaccuagcaucacaaaacuggaacuccuacgaccccacugaagagauacccgcaccacucggcacccccgacuucguugguaaaauccaaggcguucucacccaaacaaccucaacgaacggaucaacccguggccacaaagccaccgucuacaccggcagcgccgauuucucacccaaauuaggaagaguucaauucgccacagauacaaacaacgacuuugaaaccaaccaaaacaccaaauucacccccguaggcgugauacaagauggaucaaccacuccccgcaacgagccccaacaauggguccuccccuccuacuccggccgcaacauccacaacguccaccuugcccccgccgucgcacccaccuucccaggagaacaacuccucuucuuucgcucgaccaugccgggauguuccggcuacccuaacauggaccucgacugccuccuaccccaggaauggguccaauacuucuaucaagaagccgcacccgcacaauccgacguagcccuucucagauucguaaauccugacaccggccguguacucuucgaaugcaaacuccacaaauccggcuacguaaccguagcacacaccggacaacacgaccucgucaucccuccuaacggcuauuuccgauucgacuccugggucaaccaauucuauacccucgcccccaugggcaacggaaccggccgccgucgcuag

SEQ ID NO: 38949 - RNA, 1617 nt, Artificial Sequence
  derived and/or modified sequence opt11 from VP1__Norovirus_and/or_Norovirus-like__KF060081
augaaaauggcauccuccgacgccaacccaagcgacgguucaacagccaaccucguccccgaaguuaauaaugaaguaauggcucuugaaccugucguaggagccgccaucgcugccccagucgcaggccagcagaacgucauugaccccuggauccgaaacaacuucguccaagcuccuggcggcgaguucaccgucagcccccguaacgcccccggcgaaauccucugguccgcaccacucggccccgaccucaacccauaccucucacaucuugcucgcauguacaauggauaugccggcgguuucgaaguccaaguaauccucgccggaaacgccuucacugcuggcaaaaucaucuucgcagcaguaccaccaaacuuccccaccgaaggccuaagccccucucaagucaccauguucccacacauaauaguagacguccgacagcucgaacccguacucauaccccuacccgacguacgcaacaacuucuaucacuacaaccaauccaaugacuccaccaucaaacucaucgcuaugcucuacacgccacuccgcgccaacaacgcaggcgacgacguauucacaguauccugcagaguuuuaacccgccccucaccagacuucgauuuuaucuuccuaguucccccaaccguugaaucgcgaacuaaaccauucuccgucccaguccucacugucgaagaaaugaccaauucaagauuuccgauaccacucgagaaacucuuuaccggaccaucauccgccuucgucguccagccacagaacggcagaugcacaaccgacgggguucuacuaggcacaacccaacucucccccgucaacauaugcacauuccgcggggacgucacucacauccccggaucacacaacuacaccaugaaucucgcaucccaaaauuggaacuccuacgacccgaccgaagaaaucccagcaccccuaggcacccccgacuucgucggaaaaauacaaggcguccuaacccaaaccacuuccacaaacggauccacaagaggccacaaagccacaguauacacaggcucugccgauuucucccccaaacucggccgcguacaauucgccaccgacacaaacaacgacuucgaaaccaaccaaaacacaaaauucacccccguaggcgucauccaagacggcuccaccacaccccgcaacgaaccacaacaauggguccuccccagcuacuccggccgaaacauccacaacguacaucucgcccccgccgucgcccccaccuuccccggcgaacaacuccuauucuuccgauccaccaugccaggauguuccggauaccccaacauggaccucgacugccuacucccacaagaauggguacaauacuucuaccaagaagccgcccccgcacaaucggacgucgcacuauuacgauucgucaacccagacaccggacgcguccuauucgaaugcaaacuacacaaaucaggcuacguaaccgucgcccacaccggacaacacgaccucgucauaccacccaacggcuauuuccguuuugacuccugggucaaccaauucuacacccuagcacccauggggaacggcaccggacgccggcgcuga

SEQ ID NO: 38950 - RNA, 1617 nt, Artificial Sequence
  derived and/or modified sequence opt11 from VP1__Norovirus_and/or_Norovirus-like__KF059999
augaaaauggcgagcuccgacgccaacccuuccgacggcucagcagcaaaccugguacccgaaguaaacaacgaagucauggcucuagaaccaguugucggagcagccaucgcagcccccgucgcaggccaacaaaacgucauagaccccuggauccgaaacaacuucguccaagcacccggaggcgaguucaccgucucccccagaaacgcccccggcgaaauccuaugguccgccccgcuaggucccgaccucaacccauaccuaucccaccucgcccgaauguacaauggauacgccggcggcuucgaaguacaagucauacucgcaggcaacgccuuuacagccggaaaggucauuuucgcagcaguacccccaaacuucccaaccgaaggacucucccccucccaagucaccauguucccacacaucgucgucgacguacgccaacucgaaccaguccucaucccccuaccagacguaagaaacaacuucuaccacuacaaucaaagcaacgaccccacuauaaaacucauugccaugcucuacaccccacuccgagcaaacaacgccggcgacgacgucuucacaguguccugccguguucuuacccgaccgucacccgacuucgacuucaucuuucuaguaccacccacuguagaauccagaacaaaacccuucucaguacccguccucaccguagaagaaaugacaaacucacgcuuucccauaccccucgaaaaacucuuuaccgguccuuccuccgccuucgucguacaaccacaaaacggucgaugcacaaccgacggaguccuccuuggaaccacccaacucucccccgucaacaucugcaccuuccgcggcgacguaacccauaucaccggaucacgcaacuacacaaugaaccucgccucccaaaacuggaacaacuacgacccaaccgaagaaaucccggcaccacucggcacaccagacuucgucgggaaaauacaagggguccuaacccaaacaacccgaaccgacggaucaacgcgcggccacaaagccaccgucuacacaggcuccgccgacuucgcuccaaagcuaggccguguccaguucgagaccgauacagaccacgacuucgaagcaaaucaaaacaccaaauucacccccgucggcgucauccaagacggcggcacaacccacagaaacgaaccccaacaauggguccuacccuccuacagcggaagaaacacccauaacguacaccuggcccccgccguagcccccacauuccccggcgaacaacuacuauucuuccgcucuaccaugccaggaugcucaggauaccccaacauggaccuagacugccuccucccccaagaauggguccaguacuucuaccaagaaacagcgccagcccaaucagacgucgcccuccuccgauucgucaaccccgacaccggucgcguccuauucgaaugcaaacuccacaaauccugcuacguaacugucgcacacacaggccaacacgaccucguaaucccaccaaacggcuacuucagauucgacuccugggucaaccaauuuuacaccuuagcuccaaugggcaacggcaccggccgccgacguuaa

SEQ ID NO: 38951 - RNA, 1617 nt, Artificial Sequence
  derived and/or modified sequence opt11 from VP1__Norovirus_and/or_Norovirus-like__JX644036
augaaaauggccuccagcgacgccaacccgucugacggauccacugcuaaucuagucccagaaguaaacaacgaagucauggcccucgaaccgguagucggcgcugccaucgcugccccugucgccgggcaacaaaacguaaucgaccccuggauacgcaacaacuucguacaagcucccggcggagaguucaccgucucaccccgcaacgcacccggcgaaauccucugguccgcaccccucggcccagaccucaacccauaccuaucacaccucgcacgcauguacaacggcuacgcgggcggcuucgaaguccaagucauacuagccggcaaugcauucaccgcaggcaaaaucaucuucgcagcagucccacccaacuucccaacagaaggacucagccccucccaaguuaccauguucccccacaucaucgucgacguccgccaacucgaacccguccucauaccccuuccugacguccgcaacaacuucuaccacuacaaccaauccaacgacuccacaaucaaacuaaucgccauguuauacacaccccuccgcgccaacaaugccggagacgacgucuucaccguuuccugccgaguacuuacacgaccuucacccgauuucgacuucaucuuccucguacccccaacagucgaaucccgcacaaaaccauucuccguaccuguccuuacaguagaagaaaugaccaauucucguuuccccaucccccuagaaaagcuauucaccggccccucaaacgccuucguuguacagccccaaaacggacgcuguaccacagacggaguacuacuaggaaccacccaacucagcccagucaacaucugcacuuuucgcggagacguaacacauaucccaggcucccgcaacuacaccaugaaccuagccucucaaaacuggaacuccuacgaccccacagaagaaauaccugcaccccucggcaccccggacuucgucggcaaaauucaaggcguccuuacgcaaaccacacgaacuaauggcuccacccgaggacacaaagccacaguauacacaggaucagccgauuucagcccaaaacuaggacgcguccaauucgcaaccgauaccgacaaugacuucgaaacaaaccaaaauaccaaauucacaccagucggggucauccaagacggcuccaccacaccccgcaacgaaccccaacaauggguccuaccaucauacaguggcagaaacauccauaacguccaccucgccccggccgucgcacccaccuucccaggcgaacaacuucucuucuuccguucaaccaugcccggaugcuccggcuacccaaacauggaccuagacugccuacucccccaagaguggguccaauacuuuuaccaagaggccgcaccagcacaauccgacgucgcccuccuacgcuucgucaacccugauaccggacgaguccuauucgaaugcaaacuccauaaauccggauacguuacaguagcgcacaccggacagcacgaccucguaaucccacccaacggcuacuuccgauucgauucauggguaaaccaauucuacacacuagccccaaugggcaacggcaccggccgccgacgcuaa

SEQ ID NO: 38952 - RNA, 1617 nt, Artificial Sequence
  derived and/or modified sequence opt11 from VP1__Norovirus_and/or_Norovirus-like__JX459654
augaaaauggccucuaacgacgcaaacccaagcgacggcuccaccgcaaaucuaguuccagaaguuaacaacgaaguaauggcacucgaacccgucguuggggccgccaucgccgcaccagucgcaggccaacaaaacgucaucgacccauggauacgcaacaacuucguccaagcccccggcggggaguucacaguuucaccccgcaacgcccccggcgaaauacucugguccgcaccccucggccccgaucucaaucccuaccuaucucaccucgcacgcauguacaacggauacgccgguggcuucgaaguacaaguaauccucgccggcaacgcauucaccgcagguaaaauaaucuucgccgcaguacccccaaacuuccccacugaaggucuuucacccucacaagucacaauguucccccacauaaucgucgacguacgccaacuagaaccaguccucaucccacuccccgacguccgcaacaacuucuaccacuacaaccaauccaaugaccccacaaucaaacucaucgcgaugcuuuacaccccacuacgagcaaacaacgcaggcgacgacgucuucaccgucuccugucgcguccucacccgaccaucacucgacuucgauuucaucuuccucguucccccaaccgucgaaucccgcaccaagcccuucucugugcccguacuaaccgucgaagaaaugacaaacucacgcuuccccauuccacuagaaaaacucuucacaggcccauccagugccuucgucguccaaccccaaaacggccguugcacaacugacggcguccuccucggcaccacccaacuaucccccgucaacaucuguacauuccgcggcgacguuauacacauuccaggcucacgaaacuacacaaugaaccucgccucccaaaacuggaacucuuacgaccccacagaagaaaucccagcaccacuaggaacaccggacuucgucggaaaaauccaaggcguacucacucaaaccacccgcacaaauggcucuacccgcggccacaaggcaacugucuacaccggcucagcugacuucucaccaaaacuuggacgcguucaauucgcaaccgacaccgacaacgacuucgaaacuaaccaaaacaccaaauucacccccgugggcgucauccaagauggcuccaccacaccccgcaaugaaccccaacaauggguccuccccagcuacucaggccgcaacauccacaacguacaccucgccccagccguagcccccaccuuccccggagaacaacuauuauucuuuagaucaaccaugccagguugcagcggcuaccccaacauggaucuggacugccugcucccacaagaauggguccaauacuucuaucaagaagccgcccccgcccaguccgacgucgcccugcuccgcuucgugaacccagacaccggccgcguccucuucgaaugcaaacuccacaaaucaggcuacgucaccguugcccacacaggccaacacgaucucguaaucccucccaaugguuacuuucgcuucgacuccuggguuaaccaauucuacacccuagcccccaugggcaacggaaccggacgacgucgcuga

SEQ ID NO: 38953 - RNA, 1617 nt, Artificial Sequence
  derived and/or modified sequence opt11 from VP1__Norovirus_and/or_Norovirus-like__JN400621
augaaaauggccagcuccgacgccaacccgagcgacggcuccaccgccaaccucguuccagaaguaaacaacgaagucauggcacucgaacccgucgucggcgccgcgaucgccgcccccgucgcaggccaacaaaacgucaucgaucccuggaucagaaauaacuuuguacaagcacccggcggagaauuuaccguaagcccacgcaacgcccccggcgagauacuauggucagccccacucggccccgaccucaaccccuaccuaucccaucuagcacguauguacaacgguuacgccggaggauucgaaguccaggucauccucgccggaaacgccuucaccgcagguaaaaucaucuucgccgcagucccaccgaacuucccaaccgaaggccucuccccaucccaagucacaauguucccccacaucaucgucgacguacgacaacuagaaccaguccuaaucccacuccccgacguccgaaacaauuucuaccauuacaaccagucaaacgacucaacaaucaagcucauagccaugcucuacacaccccuccgagccaacaacgcaggcgacgacgucuucacagucucaugccgcguccucacccgccccagccccgacuuugacuucaucuuccucguuccacccaccguagaaucccguaccaaacccuucucaguccccguccuaaccgucgaagagaugacuaacucacguuuucccaucccccuagaaaaacuguucacaggacccuccuccgccuuuguaguccaaccccaaaacggacgcugcacaaccgauggcguccuccuuggcaccacccaacucuccccuguuaacaucugcaccuuccgcggagacgucacucacauacccggcucccgaaacuacaccaugaaccucgcaucacaaaacuggaacuccuacgacccaaccgaagaaauuccagccccacuuggcaccccagacuucgucggaaaaauacaaggcguacucacacagaccacccgcaccaacggauccacucgcggucauaaagccaccgucuacaccggauccgccgacuucucaccgaaacuaggccgcguccaauuugcaaccgacacagacaacgacuucgaaacaaaucaaaacaccaaauucaccccagucggcguaauacaagacggcuccacaacaccaagaaacgaaccccaacaauggguccuccccuccuacucaggccgaaacauccacaacguccaccuggccccugcagucgcccccacauuuccgggugaacaacucuuguuuuuccgcuccaccaugcccggaugcuccggcuaucccaacauggaccuagacugccuccuaccccaagaauggguacaauacuuuuaccaagaagccgcacccgcccaaagcgacgucgcccuucuccgauucgucaaccccgacacuggccgcgucauguucgaaugcaaacugcacaaaucaggcuacgucaccguagcccacaccggacaacacgauuuagugaucccacccaauggcuacuuccgcuucgacuccuggguuaaccaauucuacacccucgccccaaugggaaacggcaccggccgacgccgcuaa

SEQ ID NO: 38954 - RNA, 1617 nt, Artificial Sequence
  derived and/or modified sequence opt11 from VP1__Norovirus_and/or_Norovirus-like__AB541260
augaaaauggccucaaaugacgcuaaccccucagacggaucugccgccaaccucguacccgaagucaacaacgaagucauggcccuagaacccgucgucggcgccgcaauagcugcaccaguugcugcacaacagaacgucauugaccccuggauccgcaacaacuuuguccaagcgccuggcggagaguucacaguaucaccccgcaacgccccuuccgaaauacucuggucagcaccccucggccccgaccucaacccauaccugucacacuucgcccgcauguacaauugcuacgcuggcggcuucgaaguacaagucauccuugccggaaacgccuucaccgcugguaagauaaucuucgccgccguacccccaaauuucccaacagaaggacuuucacccucucaaguaaccauguucccacacauaaucguugacgucagacaacucgaacccguccucaucccccuccccgacguacgcaacaacuucuaccacuacaaccaaucuaacgauuccaccaucaaauuaauagccaugcucuacacaccccucagagccaacaacgccggcgaagacguuuucaccgucagcugccgaguccucacccgccccuccccagauuucgacuuuaucuuucuggucccacccacagucgaaucucgaaccaaacccuucacaguacccauccucaccgucgaagagaugaccaacuccagauucccaaucccccuugaaaaacuauucacaggccccucuuccgccuucguaguacaaccccaaaacggacgcugcacaaccgacggcguccuccucgggaccacucaacucucucccguaaacaucugcaccuuccgaggcgacgucacccacaucgcuggcucacgcaacuacaccaugaaccucgccucccucaacuggaacaacuaugacccaacugaggaaauacccgcaccccucggaacccccgacuucgucggcaaaauccaaggcguccuaacacagacaacaaaaggcgacggcuccacccgcggccacaaagccacaguauacaccggcagcgcccccuucacaccaaaacucgguucagugcaauucucaaccgacacugaaaacgacuucgaaacccaccaaaacaccaaauucacccccgucggcgucauccaagauggcggcacaacccaccgcaacgaaccucaacaauggguccuccccagcuacagcggcagaaacguccccaacguccaccucgcccccgccgucgcacccacauucccaggcgaacaacuccucuucuuucgcuccacaaugcccggcugcucagguuaccccaacauggaccucgacugccuccugccccaagaauggguccaacacuucuaccaagaagcagccccugcccaauccgacgucgcacuccuccgcuucgucaaccccgacacaggucgcguccucuucgaauguaaacuacauaaaagcggauacgucaccguagcccacaccggccaacacgaccuagucaucccacccaacggcuacuuccgcuucgacucguggguaaaccaauucuacacacucgcaccaaugggcaacggcacuggcagaagacgcuaa

SEQ ID NO: 38955 - RNA, 1617 nt, Artificial Sequence
  derived and/or modified sequence opt11 from VP1__Norovirus_and/or_Norovirus-like__KX514341
augaaaauggccuccaacgacgccaaucccucugacggcucagccgcaaaccuaguccccgaaguaaacaacgaagucauggcccucgaacccgucgucggugccgccaucgccgcacccguggccggccaacaaaacguaaucgacccauggauccgcaauaacuucguccaagcccccggaggcgaguucacagucucaccacgaaaugcccccggagaaauccuauggucugcaccccucggacccgaccugaaccccuaucucucccaccuagcccguauguacaacggguacgccggagguuucgaaguucaaguaauccuggccggcaacgccuucaccgccggcaaaaucaucuucgccgccgucccacccacguuucccaccgaaggccucucccccucccaggucaccauguucccacacaucauagucgacgucagacaacuugaacccguccuuauaccacuacccgacguccgcaacaacuucuaccauuacaaccaguccaacgacucuaccauaaagcuaauagccaugcuauacacaccccuacgugccaacaacgcaggagacgaugucuucaccgucagcugccgcguucuuacccgacccucucccgacuucgacuucaucuucuuaguaccacccaccgucgaaucacgaagcaaacccuucagcguaccuguucuaacaguagaagaaaugacaaacucacgcuuccccgccacacucgacaaacuauucacaggccccuccuccacuuucgucguccaaccccaaaacggccgcugcaugaucgacggaguacuccuaggcaccacccaacucucacccgucaacauuugcaccuuccgaggagacguuacucaauccggcaacaccaaaaucuacaccaugaaccucgcaucgcccaacuggaauaacuacgaccccaccgaagaaauacccgcaccccuagguacaccugacuucguaggcaaaauacaaggcaugcucacccaaacaaccaaaggcgaaggcucaaccagaggacacagagcaaccgucuacguaggcuccgcaaacuacgcucccaaacucggccgcguucaauuugaaaccgacaccaccgacgaccuugacgcccaccaaaacaccaaauucacccccgucggaguaguccaaucaggcgaauccccgaaaggcuccgaaccccaacaauggguccuucccucguacagcggccgcgacacacccaacgugcaccucgccccugccgucgcccccaccuucccaggagaacaacuacucuucuucagauccaccauacccggcugcggcggccauccaaacaugaaccuagacugccuccuaccccaagaauggguccaacacuucuaccaggaagcagcuccggcccaauccgacguagcccuguuacguuucgucaacccagacaccucacgcguccuauucgaaugcaaacuccacaaaagcggcuacguaaccguagcccauacagggcaacacgaccucgucaucccacccaacggcuauuuccgcuucgauucauggguaaaccaauucuacacccuagcacccaugggaaacggaaccggacguaaacgauaa

SEQ ID NO: 38956 - RNA, 1617 nt, Artificial Sequence
  derived and/or modified sequence opt11 from VP1__Norovirus_and/or_Norovirus-like__KX514253
augaaaauggcuucaaacgacgcaaacccaucagacggcucaaccgccaaccucguccccgaagucaacaaugaagucauggcacuagaacccgucgucggcgcagcaauagccgccccagucgccggccaacaaaacgucaucgaccccuggauacgaaauaacuucguccaagcaccaggcggagaauuuacaguuuccccaagaaacgcacccggcgagauacuaugguccgcaccucucggccccggccucaacccauaccugucccaccucgcccgaauguacaacggcuacgcaggcggcuucgaaguccagguuauccuagccggaaacgcguucaccgcuggcaaaauaaucuucgcugccguaccacccaauuuccccacagaaggacuaaaccccucacaaguaaccauguucccccacaucaucgucgacguccgccaacucgaacccguccucaucccccucccagacguccgcaacaacuucuaccacuacaaccaauccaacgauuccaccauaaaacucauagccaugcuauacaccccacuccgcgcuaacaacgccggcgacgacgucuucaccgucucaugccguguccucacccgccccuccccagacuucgacuucaucuuccucgucccacccaccgucgaaagucgauccaaacccuucucuguacccguacucaccguccaagaaaugaccaacucaagauuccccgccacccucgacaaacuauucaccggacccagcuccaaccucguuguacaaccccaaaacggccgcugcaugaucgauggcguccuccucggcaccacccaacuauccccagucaauauauguacauuccgcggagacgucacccaccuacgcgacuccaccaucuacaccaugaaccucgccucccccaacuggaacaacuacgacccaacagaagaaauccccgccccacuaggcacucccgacuucguaggaaaaauccaaggaguccucacccaaacaaccaaaggcgaaggcuccacucgcgggcacagagcaacaguuuacguagguagcgccgacuacacaccaaaacucggcaaaguacaauucgaaacaaauaccaccaacgaccuguaugcucaccaaaacaccaaauucacccccgucggcguaguccaaggcggcgaaucagcccaccgcagcgaaccccagcaguggguccugcccggauacucaggccgcgacacaccaaacguccaccuugccccagccguagccccaacauuccccggcgaacaacuccuguucuuccgcuccaccaucccaggcugcggcggccaucccaacauggaucuagacugccuccucccccaagaauggguacaacacuucuaccaagaagccgcccccgcccaauccgacgucgcccuacucagguucguaaaccccgacacaagccggguccuauucgaauguaaacuccacaaauccggcuaugucaccgucgcccacaccggccaacacgaccuaguaaucccuccaaacggcuacuuccgauucgacucauggguaaaccaauucuacacccucgcccccaugggcaacggaacgggacgcaaacgcuaa

SEQ ID NO: 38957 - RNA, 1617 nt, Artificial Sequence
  derived and/or modified sequence opt11 from VP1__Norovirus_and/or_Norovirus-like__KX514195
augaaaauggccagcucagacgccaacccauccgacgguucagccgccaacuuaguccccgaagucaacaacgaagucauggcccucgagcccguagucggcgccgcaaucgcagcacccguagccggccaacaaaacgucauagaccccuggauacgcaauaacuucguccaagcaccuggaggcgaguucaccguuuccccucgcaacgccccaggcgaaauccucuggucagccccacuaggacccgaucuuaacccauaccuaucacaucucgcccgcauguacaacuccuaugcgggcggcuucgagguacaagucauccucgcaggcaacgccuucacugcuggaaaaauaauauucgcugccgucccacccaccuuccccacagagggucuuucacccucacaagucaccauguuuccacacauaaucguagacguacgccaacuagaaccuguccucaucccacuccccgacguacguaacaacuucuaucacuacaaccaauccaacgacucaaccaucaaacucaucgccaugcucuacaccccucuccgcgccaacaaccccggcgacgacgucuucaccguauccugcagaguacuuacacgaccaucacccgacuuugacuucaucuuccucgugccucccacaguggaaucccgcacaaaacccuucucuguccccauacuaaccguaggugaaaugacaaacucccgauuccccaucaaccucgaacgccuauucaccggcccauccucaacccucgucguccaaccacaaaacggccgcugcaugaucgacggcguccuccucggcaccacacaacuaucccccgucaacauaugcaccuuucguggcgacgucacacacucacgcgacucuacaauuuacaccaugaaccucgcaagccccaacuggaauaacuacgacccaaccgaagaaauaccagccccacucggcacccccgacuucguaggcaaaauucaagguguccucacccaaaccacaaaaggugaaggcuccacacggggccaccgagcuacaguuuacgucggaagcgcaaacuacacccccaaacucggcaaaguccaauucgaaacaaacaccaccaacgaccuuuacgcccaccaaaacacccgauucacaccaguaggcgucguacagggaggcgaaagcgcucaccgauccgaaccccaacaguggguccuaccauccuacuccggaagagacacucccaacguacaccuagcccccgccguagccccaacauuccccggcgaacaacuacucuucuuucgcuccaccauccccggcugcgguggccacccaaacauggaccucgacugccucuuaccacaagaguggguccaacacuuuuaccaagaagccgcccccgcccaaucugacguagcccuacuccgauucgucaaccccgauaccucacgcguacuauucgaaugcaaacugcauaaaucuggauacgucaccgucgcccacacaggacaacacgaccucguaaucccucccaacggauacuuccgcuucgauuccugggucaaccaauucuacacacuagccccaaugggcaacggcaccggucgcaaacgauga

SEQ ID NO: 38958 - RNA, 1617 nt, Artificial Sequence
  derived and/or modified sequence opt11 from VP1__Norovirus_and/or_Norovirus-like__KX354016
augaaaauggcaucaucagacgccaacccaucagacggcucaacugccaaccucgucccagaagucaacaacgaaguaauggcccucgaaccugucgucggcgcagccauagccgcccccguagccggucaacaaaacgucauagacccguggauccgaaacaacuucguccaagccccaggcggcgaguucaccgucucaccccguaaugcccccggcgaaauccuaugguccgccccacuagguccagaccuuaaccccuaccuuucccaccuagcccgaauguacaacggauacgcuggagguuucgaaguccaagucauccuugccggcaacgcauucaccgcagggaaaauuaucuucgccgccguacccccaaacuucccuaccgaagggcuguccccaucgcaagucacaauguucccacacauaaucgucgacgugcgucaacucgaaccuguacuuauaccccuccccgacguaagaaacaacuucuaucacuacaaccaaucuaacgacucaaccauaaaacuaaucgcaaugcuauacacaccccuucgcgcaaacaacgccggcgacgacgucuucaccgucucaugccgcguacuaacccgcccaucacccgacuucgacuuuaucuuccuagucccacccaccguagaaagccgcaccaaacccuucuccguccccauccuaaccgucgaagaaaugaccaacucacgcuuccccauaccccucgaaaaacucuucaccgguccauccuccgccuucguaguccaaccccaaaauggccgcugcaccaccgacggcguccugcucggaaccacccaacucagccccgucaauaucugcaccuuucgcgguggcgucacccacaucccagguucccacaacuacacuaugaaccucgccucacaaaacugguccucauacgacccaacugaagaaaucccggccccgcucggcacacccgacuucguaggaaaaauccaaggaguacuaacucaaaccacaucaaccaacggaucuacacgcggucacaaagcaacaguauacaccggguccgccgacuucucccccaaacucggccggguacaguucgccacggauaccaacaacgacuucgaaacaaaccaaaacacuaaauucaccccuguaggcgucauccaagacggcucuaccacaccccgaaacgaaccgcaacaauggguacuaccauccuacuccggccguaacauccacaacguccaccuugccccugccgucgcgcccaccuuccccggcgaacaacuccuauucuuucgaucaaccaugcccggaugcucaggcuaccccaacauggaccuagacugccuccucccacaggaauggguacaauacuucuaccaagaagcagcacccgcacaauccgacguagcccuacuccgcuucguaaacccagacacaggaagaguccuuuucgaaugcaaacuccacaaaucaggauacgucacagucgcgcacacaggacaacacgaccuagugaucccgccaaacgguuacuuccgauucgacuccugggucaaccaguucuacacccucgcccccaugggcaacggcacuggcagacgaagauga

SEQ ID NO: 38959 - RNA, 1617 nt, Artificial Sequence
  derived and/or modified sequence opt11 from VP1__Norovirus_and/or_Norovirus-like__KM245073
augaaaauggccucaucugacgccaaccccucagacggcucaaccgcaaaccuaguacccgaagucaacaacgaagucauggcccucgagcccgucgucggcgccgccauagcagcacccguagcaggacaacaaaacgucauugaccccuggauccgaaauaacuuuguccaagcccccggcggcgaguucaccgucucaccccgcaacgcaccaggcgaaauccucuggucagcaccccucggccccgaccucaacccauaucucucccaccucgcccguauguauaauggcuacgccggcgguuucgaaguacaaguaauccuugccggaaacgccuucacagccggcaaaaucaucuucgccgccguacccccaaacuuccccaccgaaggccucuccccaucucaaguaaccauguucccccaccuaaucguagacguucgccaauuagaacccguucucaucccccucccagacguccgcaacaacuucuaccauuacaaccaauccaacgacuccaccaucaaacucaucgccaugcucuacacuccucuacgagccaacaacgccggcgacgaugucuucaccguauccugccgaguacuaacccgccccucccccgacuucgacuucauauuccuaguacccccaaccgucgaaucacgcacgaaacccuucuccgucccaguccuaaccguugaagaaaugaccaacucccgcuucccaauaccccuagaaaaacucuucacuggacccucauccgccuucgucguccaaccacaaaacggccguugcaccacugacggcguacuccuaggcacaacacaacuaucccccguaaacauaugcacauuuagaggcgacgucacacacauacccggcucccgcaacuacaccaugaaccucgcuagccaaaacuggaacuccuacgacccaaccgaagaaaucccagcaccccucggcacucccgacuucgucggaaagauacaaggaguccucacccaaacaacccgaacaaacggaagcacccgaggccacaaagcgaccgucuacaccggaagcgcagacuucucacccaaacucggccgaguucaauuugccacagacaccgacaacgauuucgaaaccaaccaaaacaccaaauucacaccagucggagucauccaagauggcuccaccacaccccgaaacgaaccacaacaguggguccuucccuccuacucaggccgcaacauccacaacguucaccuagcccccgcagucgcccccaccuuccccggcgaacaacuccuuuucuuccgauccaccaugcccggcugcucuggcuaccccaacauggaccuagacugccuucuaccacaagaauggguccaauacuucuaccaagaagcugccccagcccaaucagauguagcacuacuccgcuuugucaaccccgacaccggccguguccucuucgaaugcaaacuccacaaauccggcuacguaaccgucgcccacacuggucaacacgauuuagucauaccaccaaacggauauuuccgcuucgacuccugggucaaccaauucuacacccucgcccccaugggcaauggaacuggccgacgccgcuaa

SEQ ID NO: 38960 - RNA, 1617 nt, Artificial Sequence
  derived and/or modified sequence opt11 from VP1__Norovirus_and/or_Norovirus-like__LN854567
augaaaauggcauccagcgacgcaaaccccagcgacgguucagcagccaaucuagucccagaagucaacaacgaaguuauggcacuagagccagucgucggagcugccaucgcagcaccgguugccggccaacaaaacgucauagaccccuggauccgcaacaacuucguccaagcaccuggaggagaguucacaguaucuccacgcaacgcucccggcgaaauacucugguccgcaccccuaggacccgaccucaaccccuaccucucccaccucgcucgaauguacaacggcuacgccggcggcuucgaaguccaaguaauacuagcuggcaacgcauucaccgccgguaaaguaauauucgcggccguuccacccaacuucccaacagaaggccucucucccucccaagucaccauguucccacacaucgucguagacguacgacagcucgaacccguacucauaccucuacccgacguccgaaacaacuucuaccacuacaaucaauccaacgauccuacgaucaaacuuaucgccaugcucuauaccccacuccgcgcaaacaacgccggcgacgacgucuucaccgucuccugccgaguccucacucgccccucccccgacuucgacuucaucuuccucgucccaccuaccgucgaaucccgcaccaaaccauucuccguacccguccucacagucgaagaaaugaccaacucgagauucccuaucccccucgaaaaacucuucacaggacccucaucagacuucgucguccaaccccaaaacggacgcugcacuaccgacggcguccuccucggcacaacccaacucucccccguaaacaucugcacuuuccguggcgacgucacccacaccaccggcucacgcaacuacaccaugaaccucgccucccagaacuggaacaacuacgacccaaccgaagaaacccccgcaccacucggcacccccgacuucgugggaaagauaagaggcauguuaacccaaacaacccgcgcagacggcuccacccgcggccacaaagccaccguuuauacaggauccgccgacuucgccccuaaacucggucgcguccaauucgaaaccgacaccgacaacgacuucgacgcgaaccaaaauaccaaauuuacacccgucggcgucauccaagacggcacaaccacacaccgcaacgaaccccgccaauggguccucccuuccuacuccggccgaaacacacacaacguacaccucgcacccgcagucgcuccaaccuuccccggugaacaacuccucuucuuccgcucaacaaugccaggcugcagcggcuacccaaauauggaccuagacugccuccucccacaagaauggguccaauucuucuaccaagaagccgcaccagcucaauccgacgucgcccuacugagauucgucaaccccgacaccggccgcguacucuucgaaugcaaacuacauaaauccggauauguaacagucgcccacaccggaccacacgaccucgucaucccucccaacggauacuuccgauucgacucauggguuaaccaauucuacacacuagccccaauggguaauggaacaggccgccgacgcuaa

SEQ ID NO: 38961 - RNA, 1617 nt, Artificial Sequence
  derived and/or modified sequence opt11 from VP1__Norovirus_and/or_Norovirus-like__JN400619
augaaaauggccucaucugacgccaaccccuccgacggaucaaccgcuaaccuaguaccagaaguaaacaacgagguaauggcccuagaacccguaguaggcgccgccauagcggccccaguagccggacagcaaaacgucaucgacccauggauacgaaacaacuucguccaggcccccuguggcgaguucaccgucucuccccgcaacgcccccggcgaaauccucugguccgccccucuaggccccgaccuaaaccccuaccucucccaccuugccagaauguacaacggcuacgcaggaggcuucgaaguccaaguaauacuagccggcaacgcauucaccgccggcaaaaucauauucgccgcaguacccccuaacuucccaacagaaggccucucucccucccaagucaccauguucccccacaucaucgucgacguccgacaacuagaacccguccucaucccacuacccgacguccguaacaacuucuaucacuacaaccagucaaacgacuccaccaucaaacucauagcaaugcucuacacaccacuccgcgccaacaaugcuggagacgacgucuucaccgucucuugccgcgucuugacccguccaucacccgacuucgacuucaucuuccuaguacccccaacugucgaaucccgaaccaaaccauucuccgucccugucuuaaccgucgaagaaaugacaaacucccgauucccaaucccccucgaaaaacucuucacaggcccauccuccgccuucgucguccaaccccaaaacggucguugcacuaccgacggcguacuccuaggaaccacgcaacucucacccguaaacaucugcacuuuucgaggcgacguaacccacauacccggaucccgcaacuacaccaugaaccucgccucacaaaacuggaacuccuacgaucccacagaagaaauccccgcaccccucggaaccccagacuuugucggaaaaauccaagguguccuaacccaaaccacccgcaccaauggcagcacccgaggccacaaagccacaguuuauaccggcucagcggacuucagccccaaacuaggacgcguccaauucgccaccgacaccgacaacgacuucgaaaccaaccagaauacaaaauucacacccgucgguguaauccaagacggcucaaccaccccucgcaacgaaccccaacaauggguccuccccuccuacuccggccgcaacauacacaacguccaccuagccccggcagucgccccuaccuuccccggugaacaacuccucuucuuccgcucuaccaugcccgguugcucaggauaucccaacauggaccuggacugccuacucccccaagaauggguccaauacuucuaccaagaagcugcacccgcccaauccgacguagcucuccuccgcuucgucaacccugacacaggccgcguacucuucgaaugcaaacuucacaagagcgguuacgucaccguagcucacaccggacaacacgaccucguaaucccucccaacggcuacuuccguuucgacuccuggguaaaccaauucuacacucucgcccccaugggcaacggaacgggccgucgacgcuaa

SEQ ID NO: 38962 - RNA, 1617 nt, Artificial Sequence
  derived and/or modified sequence opt11 from VP1__Norovirus_and/or_Norovirus-like__KF060052
augaaaauggcauccucagacgcaaacccauccgacggcagcacugccaaccucguuccagaaguaaacaacgaagucauggcccuagagccugucguaggcgccgccaucgccgcccccgucgcuggccagcaaaacguaaucgaccccuggaucagaaacaacuucguccaagcccccggcggcgaguucaccguguccccucgaaacgcaccaggcgaaauacucugguccgcuccccucggccccgaccucaaccccuaucucucccaccuagcccgcauguacaacggauacgcaggcggcuucgaaguccaagucauccucgccggcaacgccuucaccgcaggcaaaauuaucuucgccgcugucccacccaacuucccaaccgaaggccucucacccucacaaguaacaauguucccccacaucaucgucgacguacgccaacuagaacccguccucaucccccugccugacguccgaaauaacuucuaccacuacaaccaaucuaacgacuccaccauaaagcuaaucgccaugcucuacaccccacuacgcgccaacaacgccggugacgacguauucaccgucucgugccgcguccucacccgacccucccccgacuucgacuucauauuccucguuccacccaccgucgaaucacgcacgaaacccuucuccguccccauccucaccguagaagaaaugacuaauucacgcuucccuaucccccucgaaaaacuauucaccggccccagcuccgccuucgucguccaaccccaaaacggccgaugcaccaccgacgguguccuacuaggcacuacccagcucuccccagucaacaucugcaccuuccgaggcgacguaacucacaucccuggaucacacaacuacaccaugaaccucgcgucccaaaacuggaacuccuacgaccccacagaggaaauccccgcaccccucggaaccccagacuucgucggcaaaauccaaggcgucuuaacccaaaccacuucaaccaacggcucaacccggggacacaaagccaccguauacaccggauccgccgacuucucaccuaaacuaggacgcguacaguucguaaccgacacuaacaacgauuucgaaacaaaucaaaacaccaaauucacacccgucggcguaauccaagacggcagcaccacaccucgcaacgaaccccaacaauggguccuccccagcuauagcggccgcaacauccacaacguacaccucgcaccagcagucgccccuaccuuccccggugaacaacuacuauucuuccgcucaacaaugccaggcugcucgggcuaccccaacauggaccucgacugccuucuaccacaagaauggguucaauacuucuaucaagaagcagccccagcccaauccgacguugcacuacuccgauucgucaaccccgacacuggcagaguacuauucgaaugcaaacuacacaaaagcggcuaugucacagucgcccacacaggacaacacgaccucguaauaccacccaacggcuauuuccgcuucgacuccugggucaaccaauucuacacccucgcacccaugggcaacggcaccggccgccgccgcuaa

SEQ ID NO: 38963 - RNA, 1617 nt, Artificial Sequence
  derived and/or modified sequence opt11 from VP1__Norovirus_and/or_Norovirus-like__KF060014
augaaaauggcauccucagacgcuaacccauccgacggcuccacagcaaaccucguccccgaaguuucgaacgaaguaauggcacuagaaccuguagucggcgccgcaauagcagcucccguagccggccaacaaaacguaaucgacccauggauacgcaacaacuucguccaagccccuggcggagaguucacaguaucccccagaaacgcaccaggcgaaauacucuggucagcaccccucggucccgaccucaaccccuaccuaucacaccuggcacgcauguacaacggcuacgcuggcggauucgaaguccaagucauacuagcaggcaacgccuucaccgcaggcaaaauuaucuucgccgccguacccccaaacuuccccaccgaaggccucucucccucgcaagucaccauguucccgcacaucaucguggacguacgccaacucgaacccguccugaucccccuccccgacguacgaaacaacuucuaccacuacaaccaauccaacgacuccacaauaaaacucaucgcaaugcuauacacaccccucagagcaaacuccgccggcgacgacgucuucaccguauccugucggguccuuacccgccccucccccgacuucgacuucaucuuccucguacccccuaccgucgaaucccgcacaaaacccuucucggucccuauucucaccgucgaagaaaugacuaacucccgcuucccuaucccccucgaaaaacuauucacaggaccauccuccgccuucgucguccaaccccaaaacggacgcugcaccacugacggcguucuucuuggcaccacccaacucucacccgucaacauauguaccuuccgcggcgacgucacccacauccccggaucccacaacuacacaaugaaccuagccucccaaaacuggaacuccuacgacccaaccgaagagauccccgcaccccucggaacuccagacuucguaggcaaaauccaaggaguucuaacccagacuacaagcaccaacggcucaacccgcggacacaaagccaccgucuacaccggcucugccgauuucuccccaaaacuuggccgcguccaauucgccaccgacacuaacaacgacuuugaaaccaaccaaaacaccaaguucaccccuguaggcguuauccaagacggcuccacaacaccuagaaacgaaccccaacaauggguacucccuucuuauucaggccgcaauauacacaacguacaccucgcccccgccgucgcaccuaccuuccccggcgaacaacuccuguucuuucgaucaacaaugccagguugcuccggcuaccccaacauggaccucgacugccuccuaccccaagaauggguacaauacuucuaccaagaggccgcucccgcccaaucugacgucgcacuacuucguuucgucaaccccgacacuggacgaguccuguucgaaugcaaacugcacaaguccggauacaucacuguagcacacacaggacaacacgaccucgucauaccacccaacggcuacuuccgcuucgacucaugggucaaccaauucuacacccuagcacccaugggcaauggcaccggacgccgccgguaa

SEQ ID NO: 38964 - RNA, 1617 nt, Artificial Sequence
  derived and/or modified sequence opt11 from VP1__Norovirus_and/or_Norovirus-like__KC517375
augaaaauggccucaucagacgccaauccauccgacgggucagccgcaaaccugguaccagaaguaaacaacgaagucauggcccuagaacccgucgccggcgccgcaaucgcugccccugucgccggucaacaaaacguuaucgaccccuggaucagaaacaauuucguccaagcccccggaggcgaauuuacagugucaccccgcaacgccccuggcgaaauccuauggucagcuccacuaggccccgaccucaaccccuaccucagccaccuagcccgcauguacaacggauacgccggcggcuucgaaguccaaguuauacuagcaggaaacgccuucaccgcaggaaagguaauauucgcagccguaccacccaacuucccaaccgaaggccucucucccucccagguuacaauguucccgcacaucguaguagacguccgccaacuagaacccguccucaucccccuacccgacguacgaaauaacuucuaccacuacaaccaguccaacgacccaacaauuaagcucauagcaaugcuauacgcuccucuccgagccaacaacgcuggcgacgacguauucacugucuccugccgcguacucacgcgccccuccccagacuucgacuucaucuuuuuaguacccccuacugucgaaucaagaaccaaacccuucuccguaccaguccucacugucgaagaaaugaccaacucccgauuucccauuccccuagaaaaacuauucacaggacccuccuccgccuucgucguccaaccccagaacggccgaugcaccacggacggcguccuacuaggaacaacccaacuuucacccgucaacauaugcacguuccgcggcgacgucacccacaucacaggcucccgcaacuacacuaugaaccucgccucacaaaacuggaacaacuacgaccccacagaagaaaucccagcaccacucggcacccccgauuucgucggcaaaauccaaggaguucucacccaaaccacccgcaccgacgguuccaccagaggacacaaagccaccgucuacaccggcucagcagacuucgcccccaaacuuggacgcguccaguucgaaaccgacaccgaccaugacuucgaagcgaaccaaaacaccaaauucacaccagucggagucauccaagauggcggaaccacucauaggaacgaaccacaacaauggguucuacccagcuacuccggccgcaacacacacaacguacaccuagcaccagccguagccccaacauuucccggggaacaacuacucuucuuccgauccacaaugcccggcugcuccggguaccccaacauggaccucgacugccuccucccccaagaauggguccaauauuucuaccaagaagccgccccagcccaaucggacguagcacuccuacgcuucguaaacccagacaccggcagaguucuauucgaaugcaaacuacacaagucaggauacguuaccguagcucacacuggacaacacgaccucguaauaccucccaacggauacuuucgcuucgacuccugggucaaccaauucuacacacucgcccccauggguaacggaaccggacgccgccgauaa

SEQ ID NO: 38965 - RNA, 1617 nt, Artificial Sequence
  derived and/or modified sequence opt11 from VP1__Norovirus_and/or_Norovirus-like__JX644039
augaaaauggcaucuagcgacgcuaaccccuccgacggcuccaccgcuaaccucguccccgaagucaacaacgaagugauggcccucgaaccagucgucggcgccgccaucgcagcacccgucgcuggccaacaaaauguaauugaccccuggauccgaaacaacuucguccaggcacccggaggcgaguucaccguuucaccccgcaacgcucccggugaaauccuuugguccgccccacucggcccagaucuaaacccuuaucucucccaccucgcacgcauguacaacggcuacgccggcggauucgaaguccaagucauccucgccggcaaugccuucaccgcaggaaaaaucaucuucgcugcagucccacccaacuuucccacagaaggacucucccccucccagguaacuauguucccccacauaaucgucgauguacgccagcucgaaccuguacucaucccccugcccgacguccgcaacaacuucuaccacuauaaccaaucaaacgacucgaccaucaaacucaucgccaugcucuacacaccccuccgugcaaauaacgccggcgacgacguuuucaccgucucgugccguguacucacccgcccaucccccgacuucgacuucaucuuccucguaccacccaccgucgaaucccgcaccaaacccuucucaguccccauccuaacaguugaagaaaugaccaacucacgcuuccccauaccacucgagaaacuauucacuggccccucauccgccuucguuguccaaccccaaaacggccgcugcaccaccgauggcguccuacucgggaccacgcaacuaucccccguaaauauaugcaccuuccgaggcgacguuacccacauaagcggcucccgcaacuauacaaugaaucuugccucccagaacuggaccucauaugacccaaccgaagaaaucccagcaccccuaggcaccccugacuucguaggcaaaauacaaggcguccucacccaaacaacccgcaccaacggcuccacccgaggacacaaagccacagucuacaccgggagugccgacuucuccccaaaacuaggacgcguacaauucgccaccgacaccgacaacgacuucgaaaccaaccaaaauaccaaguucaccccugugggaguaauccaagauggcuccacuacucccagaaacgaaccacaacaauggguccuaccguccuauuccggccgcaacauucacaacguccaccucgccccugcggucgcccccaccuuccccggcgaacaacuacuauucuuucgcucaacuaugccagguugcuccggcuacccaaacauggaccucgacugccuccucccucaagaauggguccaauacuucuaucaagaagccgcacccgcccaaucagacgucgcccuccuccgcuucguaaaccccgacaccggacgaguccucuucgaauguaaacuacacaaauccggauacgucacagucgcccacacaggccaacacgaccucguaaucccacccaacggauauuucagauucgacuccuggguaaaccaauucuacacccucgcccccauggggaacggcacaggacgacgccgauaa

SEQ ID NO: 38966 - RNA, 1617 nt, Artificial Sequence
  derived and/or modified sequence opt11 from VP1__Norovirus_and/or_Norovirus-like__JX644031
augaaaauggcauccucagacgcgaacccauccgacggaucuaccgccaacuuaguccccgaagucaacaacgaaguaauggcccucgagcccgucgucggagccgccauagccgcccccgucgcaggccaacaaaacgucaucgauccauggauccgaaacaacuucguacaagcccccggaggagaguucacaguaucccccagaaacgccccaggcgaaaucuuaugguccgccccacuaggcccagaccucaacccauaccuaucucacuuagcccgcauguacaauggcuaugcaggaggcuucgaaguccaagucauacuagccggcaaugccuuuaccgccggcaaaaucaucuucgccgccguuccacccaacuuccccacugaaggcuuaucccccucgcaaguaacaauguucccacacauaauaguagacguccgccaauuagaacccguucucaucccccuucccgacguccgaaacaacuucuaccacuauaaccaauccaaugacucaaccaucaaacucaucgcaaugcuguacaccccacuacgcgccaacaacgccggcgacgaugucuucaccguuucaugccgcguccuuaccagaccaucaccagacuucgacuucauauuccucgugccucccaccgucgaaucccggacuaaacccuucucaguucccguccuaacaguagaagaaaugaccaacagccgauuccccauaccccucgaaaaacucuucaccggccccuccuccgcauucguaguccaaccacaaaacggacgcugcaccaccgacggcguccuccuaggaaccacacaacuuucacccgucaacaucugcaccuuccgaggcgacguaacacacauccccggaucccgcaauuacacaaugaaucucgccucccagaacuggagcucuuacgacccaaccgaagaaauccccgcuccccucggaaccccagacuucgucggcaaaauccaaggcguccucacccaaaccacacgaacaaacggcuccacccgagggcauaaagccaccguuuauaccggaucagcugacuucuccccuaaacuaggccgcguccaauucgccaccgacacagacaacgacuucgaaaccaaccaaaacaccaaauucacccccgucggcgucauccaagacggauccacaacaccccgcaacgaaccccaacaauggguacuccccucauacuccggcagaaacauccacaacguccaccuagcccccgccgucgcccccaccuucccaggcgaacaacuccucuucuuccgauccaccaugccuggcugcuccggcuaccccaacauggaccucgacugucuccucccccaagaauggguccaguacuucuaccaagaagccgcaccagcacagucagacgucgccuuacuccgcuucgucaaccccgacaccggcaggguacucuucgaaugcaaacuccauaaaucaggcuacgugaccguugcacacacuggccaacacgaccucguaauaccacccaauggcuacuuucgcuucgacuccuggguuaaccaauucuacacgcucgcccccaugggcaacgguaccggacgccgccgauaa

SEQ ID NO: 38967 - RNA, 1617 nt, Artificial Sequence
  derived and/or modified sequence opt11 from VP1__Norovirus_and/or_Norovirus-like__HM191773
augaaaauggcaucaucugacgcaaaccccagcgacggcuccaccgccaaccucgucccugaagucaacaacgaagucauggcccucgaacccguagucggcgccgccaucgccgccccagucgccggccaacaaaacguaaucgaccccuggauacguaauaacuucguccaagcccccggaggcgaguucacagucuccccacgcaacgcaccuggagaaauccucugguccgccccacuuggccccgaccucaaccccuacuuaucucaccucagccgcauguacaacggcuacgcaggagguuucgaaguccaaguaauacucgccgguaacgccuucaccgccgguaaaauaauuuucgccgcugucccacccaacuuccccaccgaaggccucucccccucccaaguuacaauguuuccacacaucaucgucgacguucgucaacucgaacccguacucauaccgcuccccgacguacgcaacaacuucuaccacuacaaccaaucuaacgaccccaccaucaaacucauagccaugcucuacaccccacuccgcgccaauaacgccggugacgacguuuucaccguuuccugucgaguccucacccgcccuucaccagacuucgacuucaucuuccucguaccacccaccgucgaaucccgaaccaaaccuuucucuguuccaguccucacugucgaagaaaugaccaacucccgcuuccccauacccuuagaaaaacuuuucaccggacccuccuccgccuucgucguccaaccacaaaacggcagauguacaaccgacggcguccuccucggcaccacccaacugagccccgucaacaucugcacuuuccgaggcgacgucacccacauaccaggcagccgcaacuacaccaugaaccucgccucccagaacuggaacucauacgaccccaccgccgaaauccccgcaccucucggcacaccagacuucgucggcaaaauacaaggcguacuuacccaaaccacacgaaccaacgguucaacacgcggccacaaagcaacagucuauaccggauccgcagacuucuccccaaaacuaggccgcguacaauucgcaacggacacagacaacgacuucgaaaccaaccaaaacacuaaauucacucccgucggcgucauccaagacggcuccacuacuccccgcaacgaaccacaacaauggguccuaccauccuacuccggccgaaacauccacaacguucaccucgcacccgccguggcucccaccuuccccggcgaacaacuacuuuucuuccguagcaccaugcccggcugcucaggcuaccccaacauggaccuagacugccuacucccacaggaauggguccaauacuuuuaccaagaagcagcccccgcacaaucagaugucgcacuucuccgauucgucaaccccgacaccggccgcguacucuucgaaugcaaacuccauaaauccggcuauguaaccgucgcacacacuggccaacacgaucuuguaaucccacccaacggauacuuccguuucgacagcugggucaaccaauucuacacccucgccccgauggguaacggaaccggacgccgucgcuaa

SEQ ID NO: 38968 - RNA, 1617 nt, Artificial Sequence
  derived and/or modified sequence opt11 from VP1__Norovirus_and/or_Norovirus-like__AB504309
augaaaauggcuagcaaugacgccucccccuccgauggcuccaccgccaaccucguacccgaagucaacaacgaaguaauggcccucgaacccgucgucggcgcugcaauagccgcccccgucgccggccaacaaaacgucaucgaccccuggaucagaaacaacuucguucaagccccuggcggagaguucaccgucuccccucguaacgcccccggcgaaauccucugguccgcgccacucggccccgaucuuaacccuuaccuaucccaucucgccagaauguacaacggcuacgccggcggcuucgaaguccaagucauccucgcaggaaacgccuucacagcuggcaaaaucaucuucgcggcaguaccuccaaauuuuccaacagaaggccucucccccucccaagucaccauguucccccauaucauaguagacguccgucaacuugaacccguccuaaucccacucccagacguccgaaacaacuucuaccacuacaaccaauccaacgacucaacgaucaagcuaauagccaugcucuacacccccuugcgagcuaauaacgcaggcgacgacguuuucaccgucuccugccgcguccuaacccgccccuccccagacuucgauuucauuuuccucgugccacccaccgucgaaagccgaacaaaaccuuucacaguacccauccucaccgucgaagaaaugacaaacuccagauucccaauuccccuagaaaaacucuucacaggccccuccuccgccuucguaguacaaccccaaaacggucgcugcaccaccgacggcguccuccucggcacaacacaacuuagccccguaaacaucuguacauuccgcggagacguaacccacauccccggcacccgaacauaccgcaugaacuuagccucacaaaacuggaacaauuacgaccccaccgaagaaauccccgccccacuuggcacacccgacuucgucggcaaaauccaaggcguccucacccaaaccacucgcggcgacggcucaacucgaggucacaaagccacagucucuaccggcucagucgacuuuaccccaaaacuaggcagcguccaauucgccaccgacaccgacaacgacuucgaaaccggccaaaacacccguuucacacccgucggcgucauccaagacggcuccucugcccaccgcaacgaaccccaacaaugggucuugcccgacuacucaggacguaccguccacaacguccaccuugccccagcaguagccccuaccuuucccggcgaacaacuccuauucuuccgcuucacaaugccagguugcucaggcuaccccaauauggaccuagacugucuccucccccaagaauggguccaacacuucuaccaagaagccgcuccugcccaaucagacgucgcccuccuccgcuucgucaacccagacaccggccgcguacucuucgaaugcaaacuccacaaaaccggauacgucaccguugcucacacuggccaacacgaccucguaauucccccaaacggcuacuuccgauucgacuccugggucaaccaauucuacacccuagcaccaaugggcaacggcgccggccgacgacgauaa

SEQ ID NO: 38969 - RNA, 1617 nt, Artificial Sequence
  derived and/or modified sequence opt11 from VP1__Norovirus_and/or_Norovirus-like__KX514216
augaaaauggcuagcaaugacgcaaaccccucagacggauccgccgccaaccugguccccgaaguaaacaaugaagucauggcccucgaacccgucguaggcgccgccauugccgcccccguagcuggacagcaaaacguuaucgacccuuggauacgcaacaacuucguacaagcccccggcggagaguucaccguaucuccacgcaacgcacccggcgaaauccucugguccgcuccucuaggucccgaccuaaaccccuaucucagccaccuagcacgcauguacaaugguuacgccggaggauucgaaguccaaguaauccuugcgggcaacgccuucaccgcuggcaaaaucaucuucgccgccgucccacccaacuuccccacagaaggccuaucccccucccaagucaccauguucccccacauaaucgucgacguccgacagcuagaacccguccucaucccccuccccgacguucgcaacaacuucuaccacuacaaccaaucuaacgacuccaccaucaaacuuauagccaugcucuacaccccacuucgagccaacaaugccggugacgacgucuucacagucuccugccgcgucuuaacccgccccucccccgacuucgacuucaucuuccucguaccucccaccguugaaucacgaucuaaaccauuuuccgucccaguccuaacggucgaagaaaugaccaauucccgcuuccccgcaacccucgacaaacucuucaccggaccauccucuaccuuugucguccaaccccaaaacggccgcugcaugaucgacggcguccucuuaggaacaacccaacucucaccagucaacauaugcaccuuccgcggagacgucacacaccuucgcgacucccccaucuacacuaugaaccucgcgucccccaacuggaacaacuacgacucaaccgaagaaauccccgcaccacucgguacccccgacuuuguaggcaaaauccaaggaguucucacacaaaccaccaaaggagaagguucaacacgaggucaccgcgcaaccgucuacgugggcucagcaaacuacacccccaaacucggcaaaguccaauucgaaaccaacaccacaaacgaccuuuaugcccaccaaaacaccaaauuuaccccagucggcgucguccaaggcggcgaauccgcccaccgcucugaaccacaacaauggguacugcccggauacuccggccgcgacacacccaacguccaucucgcccccgcagucgcacccacuuuccccggcgaacaacuccuauucuuccgcuccacaaucccaggaugcggcgggcaccccaacauggaccucgacugccuccucccccaagaauggguccagcauuucuaucaagaagccgcacccgcacaaucagacguugcccuccuccgauucgucaaccccgacacuucccgcguccuauucgaaugcaaacuacacaaauccggcuacguaacaguagcacacacaggccaacacgaccuggucauaccacccaacggcuacuuccgauucgacucuuggguuaaucaauucuacacacucgcccccaugggcaacggcaccggucgcaaacgcuaa

SEQ ID NO: 38970 - RNA, 1617 nt, Artificial Sequence
  derived and/or modified sequence opt11 from VP1__Norovirus_and/or_Norovirus-like__KX514212
augaaaauggcgucaaacgacgccaaccccucagacggcuccgcagccaaccucgucccagaagucaacaacgaagucauggcccucgaaccugucguaggagcagcaauagccgcaccagucgccggacaacagaaugucauagacccuuggauacgcaacaauuucguccaagcccccggcggcgaguucacugucucaccccgcaacgcccccggcgaaauccucuggagcgcgccauuaggacccgaacuaaaccccuaccucucccaccuagcccgaauguacaacggcuacgcaggaggcuucgaaguccaaguaauacuagcaggcaacgcauucacagccggcaaaaucauauucgccgcaguaccacccaacuuccccaccgaaggccuaucucccucacaggucaccauguucccccacauaauagucgacguccgccaacucgaaccaguauuaaucccccucccagacguccgcaacaacuucuaucacuacaaccaauccaacgacucuaccauuaaacucauagccaugcuauacaccccacuccgagcuaacaacgcaggcgaugacguauucaccguauccugcagaguacugacacgccccucacccgacuucgacuucauauuccuugucccacccaccguugaaucccgcuccaaacccuucuccguacccguacucaccguacaagaaaugaccaacuccagauuccccgccacccuagacaaacucuuuaccgggcccagcucuaaccucgucguccaaccgcaaaacggccgcugcaugaucgauggcguccuccucggcaccacccaacucucaccuguaaacauaugcaccuuccgcggcgacguaacccacccucgagauucccccaucuacaccaugaaucuagccucccccaacuggaacaacuaugacccaaccgaagaaaucccagcaccccucggaaccccagacuucgucggcaagauccagggcguccuuacccaaaccacaaagggcgaaggcaguacccgcgggcaccgcgccacaguauacgucggaucggcgaacuacaccccgaaacucgggaaaguccaauucgaaacaaacacaaccaacgaucuauacgcccaccaaaacacuaaauuuacaccaguaggaguaguccaaggcggcgaaucagcucaccgauccgaaccccaacaauggguccuacccggauacucaggacgcgacacucccaacguccaccucgcacccgcugucgcucccacauuccccggcgagcaacuacucuucuuccgcuccaccauccccggaugcggaggucaccccaacauggaccuggacugccuccucccacaagaauggguacaacacuucuaccaggaagccgcacccgcccaaagcgacguagcacuucuucgauucgucaaccccgacacuucgcgcguccucuuugaauguaaacuacacaaaucaggcuacgucaccguagcccacaccggacaacacgaccucguaauacccccaaacggcuacuuccguuucgacuccugggucaaccaauucuacacccuagcccccaugggaaacggcaccggccgaaaacgauaa

SEQ ID NO: 38971 - RNA, 1617 nt, Artificial Sequence
  derived and/or modified sequence opt11 from VP1__Norovirus_and/or_Norovirus-like__KX354138
augaaaauggccucuucagacgccaaccccuccgacggaagcgcagccaaccucgugcccgaggccaacaacgaagucauggcacuagaacccgucgucggagcagcaauagccgccccagucgccggccaacaaaacguaaucgacccauggauccgcaacaacuucguacaagccccaggcggcgaguucaccaucucaccccgaaaugccccuggagaaauucucugguccgcgccccucggaccagaccucaaucccuaccucucccauuuagccagaauguacaacggauacgccggcggcuucgaaguacaaguaauccuagcaggcaacgccuucacagcagguaaagucauuuucgccgcaguaccacccaauuuucccaccgcaggcuuaucccccucccaggucacaauguuccccucaaucgucguagacguccgccaacuugaacccgucuuaaucccacucccugacguccgcaacaacuuuuaccacuacaaccaauccaacgaccccacaaucacccucauagccaugcucuacacaccccucagagccaacaacgcaggcgacgacguauucaccgucucaugccgcguccuaaccagacccucacccgacuucgauuuuaucuuccuuguaccucccaccgucgaaucacgcaccaaacccuucuccguccccguccucaccguagaagaaaugaccaacucccgcuuccccaucccccucgaacgacucuucaccggacccagcucagcauucgucguacaaccacaaaauggacgcugcaccacugacggcgugcuccuaggcaccacccaacuaucaccagucaacaucugcacauuccguggcgacaucacacacauaaccggaucccacaacuacaccaugaaccucgcaucccaaaacuggaacaacuacgacccaaccgaagaaauacccgcuccccuggguacacccgacuuugucggaaagauccaaggcguacucacccaaaccaccagaggcgacggcucuacccgcggccacaaagccaccgucuauaccggcuccgccgacuucuccccaaaacuuggccgaguccaauucgaaacagacaccaaccacgacuucgaagccaaccaaaacacaaaauucacaccaguaggcgucauacaagacggcuccaccacccaccgcaacgaaccccaacaauggguucuccccuccuacagcggaagaaacacacacaacguccaccucgccccugcaguagcucccacauuccccggcgaacaacuccuauucuuccgcuccaccaugcccggcuguagcggauaccccaacauggaccuagacugccuacucccccaagaauggguacaauauuucuaccaagaagccgcacccgcccaauccgacguagcccuccuccgcuucgucaaccccgacaccggccgcguacucuucgaaugcaaacuucacaaauccggcuacauaaccguagcccauaccggccaacacgaccucgucaucccuccgaacggauacuuccgcuucgacuccugggucaaccaauucuacacacuggcccccaugggaaacggaaccggacgccgccgcuaa

SEQ ID NO: 38972 - RNA, 1617 nt, Artificial Sequence
  derived and/or modified sequence opt11 from VP1__Norovirus_and/or_Norovirus-like__AB933747
augaaaauggcaagcagcgaugccaaccccuucgauggcucuacugccaaccucguccccgaaguaaacaacgaaguaauggcucucgaacccguugucggagccgcgaucgcagcccccgucgccggccaacaaaaugucaucgaccccuggauacgcaacaacuucguccaagcacccggaggcgaauuuaccgugucaccccgcaacgccccaggcgaaauccucugguccgcuccccuaggacccgaccuuaacccauaccucucccaccucuccagaauguacaaugguuacgccggcggcuucgaaguccaagucauccucgccggcaacgcauucacagccggcaaaauaaucuucgccgccgucccacccaacuuccccaccgaaggccuaucccccucccaagugaccauguucccccacaucaucgucgacguccgucaauuagaacccguccucauuccccuccccgauguccgcaacaacuucuaccauuauaaccaauccaacgacccaacuauaaaacucaucgcuaugcuuuacacaccccuccgcgccaacaacgcuggcgacgauguuuucaccgucuccugccgugugcuaacccgccccucccccgacuucgacuucauauuccucguuccacccacagucgaaucccguacaaaacccuucuccguccccguccuuacagucgaagaaaugacaaacucccgcuuccccaucccccucgaaaaacucuucacaggucccucauccgccuuugucguccaaccucaaaacggccgaugcaccaccgacggcguccugcucggcaccacccaacuauccccugucaacaucugcaccuuccguggcgacgucacccacauccccggaucccgaaacuacaccaugaaucucgccucucaaaauuggaacucuuacgacccaacagaagaaaucccagcaccgcucggcaccccugacuucgucggcaaaauacaaggcguacucacccaaaccacacgcacaaacggcucaacucgcggacacaaagccacugucuauaccggcucagcagacuucagccccaaacucggccguguccaauuugccaccgauaccgacaacgacuucgaaaccaaccaaaacaccaaauucacccccgucggcgucauccaagacgggagcaccaccccacgcaacgaaccccaacaauggguccuccccuccuacucgggcagaaacauccacaacguacaccuugcccccgcaguagcaccaacauuccccggcgaacagcuccucuucuucagaucaaccaugcccggcugcucaggauaccccaacauggaccucgacugccuccucccccaagaauggguacaauacuucuaccaagaagccgcucccgcccaaucagacgucgcccuccuacgcuucguuaaccccgacaccggacgcguccucuucgaaugcaaacuccacaaaucaggcuacgucaccguagcccacaccggccaacacgaccucguaauaccacccaacggauacuuccgcuucgauucaugggucaaccaauucuacacccucgcgcccaugggaaacggcacuggccgacgccgauaa

SEQ ID NO: 38973 - RNA, 1617 nt, Artificial Sequence
  derived and/or modified sequence opt11 from VP1__Norovirus_and/or_Norovirus-like__KJ955493
augaaaauggccuccucagacgccaaccccucagacggcucagccgcaaaccucguccccgaagucaauaacgaagucauggcccucgaacccuucguuggagcagccauagccgccccuguagcaggccaacaaaacgucaucgaccccuggauccggaacaacuucguccaagccccuggcggcgaguucaccgucuccccacgcaaugccccuggcgaaauucucuggucagcaccccucggccccgaccuuaacccauacuugucccaccucgcccgcauguacaacgguuacgcuggaggauucgaaguccaaguaauccuggccggcaacgccuucaccgcuggaaaagucaucuucgccgccgucccacccaacuuccccacagaaggccuauccccaucacaagucacaauguucccccacaucgucgucgauguccgucaacucgaaccaguccuaaucccacuccccgacguccgaaacaacuucuaccacuacaaccaauccaacgaucccaccaucaaacuuauagccaugcucuacacaccccuccgagccaacaacgccggagacgacgucuucaccguuuccugccgcguucucacccgacccucccccgacuucgauuucauauuucucgucccuccuaccguugaaucaagaacaaaacccuucucaguccccguucuaaccgucgaagaaaugacaaacucccgguuccccaucccuuuagaaaaacucuucaccggcccaucuuccgccuucguaguccaaccccaaaacggacgcugcacaaccgacggcguccuccucggcacaacccaacucucacccgucaacaucugcacauuccguggagacguaacccauaucacaggaucccgcaacuacaccaugaaccucgcuucucaaaacuggaacaacuacgaccuuacagaagaaauaccagcgccacucggaacccccgacuucgucggcaaaauccaaggaguucucacccaaaccacacgcacggacggcuccacccgcggccacaaagccacaguuuacaccggcuccgccgauuucgcaccaaaacucggccgcguccaauucgaaacugacaccgaccacgacuucgaagcaaaucaaaacacaaaguucacccccgucggcgucauccaagacggcggcaccacacaccgcucggaaccccaacaauggguccuccccucuuauucuggccgcaacacccccaacguccaccucgccccagcagucgcccccaccuuccccggugaacaacuccuuuucuuccgcucaaccaugcccggcugcuccggauacccaaacauggaccuugacugccuacucccacaagaauggguccaauacuucuaccaggaagcagccccagcacaauccgacgucgcccuccuccgcuuugucaaccccgauaccggcagaguacucuucgaaugcaaacuacacaaaucgggcuacgucacgguagcccacaccggccagcacgaccuagucauucccccuaacggauacuuccgcuucgacuccugggucaaccaauucuacacacuagccccaaugggaaacggcaccggccgccgacgcuaa

SEQ ID NO: 38974 - RNA, 1617 nt, Artificial Sequence
  derived and/or modified sequence opt11 from VP1__Norovirus_and/or_Norovirus-like__KJ678153
augaaaauggcauccuccgacgccaacccauccgacggcucugccgccaaccuagucccugaagucaacaacgaagucauggcccucgagccagucgucggcgcagccauagcagcccccguagccggucaacaaaacgucaucgauccguggauccgaaacaacuuuguccaagcacccggaggcgaguucacaguauccccucgcaaugcucccggagaaauccuauggucggcaccccucgggcccgaccugaaccccuaccucucacaccuagcccgaauguacaacgguuacgccggcggcuucgaaguacaagucauccucgccggaaacgcuuucaccgccgguaaagucaucuucgccgccguacccccaaacuuuccaaccgaaggucuaucccccucccaagucaccauguucccgcacaucgucgucgauguccgccaacucgaacccguccuaaucccucucccagacguccgcaacaacuucuaccacuacaaucaaucaaacgacuccaccauaaaacuaauagccaugcuauacacaccacucagagccaacaacgccggcgacgacguauucaccgucagcugccgcguacuuacacgccccuccccagacuucgacuucaucuuucucguacccccaacagucgaaucaaggaccaaacccuucucaguaccuguacucaccgucgaagaaaugaccaacucucgauuucccaccccucucgaaaaacucuucaccggccccuccuccgccuucgucguccaaccucaaaacggccgaugcacaacugacggcguucuccucggaacuacccaacucucccccgucaacaucugcaccuuccguggugacgucacccacaucacuggcucccgcaacuacacaaugaaccucgccucacaaaacugguccaacuaugaccccaccgaagaaaucccagcaccccucgguaccccagacuuugucggcaagauccaaggagucuuaacccaaaccacccgcacagauggaucaacccgcggccacaaagcaaccgucuauauaggcuccgccgacuucgcucccaaacucggccgaguacaauucgaaacugacacagaccacgacuucgaaaccaaccaaaacaccaaauucaccccagucggcguaauccaggacggcuccaccacacacagaaacgaaccccaacaguggguccuccccucauacucaggccgcaauaccccuaacguacaccuagccccagccguagcaccaaccuuuccaggcgaacaacuccuauucuucagaucuacccuucccggcugcucaggauaccccaacauggaccuagacugcuuacucccacaagaaugggugcaauacuucuaucaagaggccgcccccgcccaauccgacguagcccuacuacgcuucgucaaucccgauaccggucgcguccuguucgaauguaaacuacacaaaucaggcuacguaaccgucgcccacaccggccaacacgaccucgucaucccacccaacggcuacuuccguuucgauucaugggucaaccaauucuacacccucgcacccaugggcaacggcacaggccgccgccgcuaa

SEQ ID NO: 38975 - RNA, 1617 nt, Artificial Sequence
  derived and/or modified sequence opt11 from VP1__Norovirus_and/or_Norovirus-like__KC456071
augaaaauggcauccucagacgccaacccacccgauggcagcgccgccaaucuagucccaaaagucaacaacgaagucauggcccuagaaccaguggugggcgcagcaaucgccgcccccgucgccggucaacaaaacgucaucgaccccuggaucaaaaacaacuucguccaagcccccggcggcgaguucaccguaucacccaaaaacgcaccaggcgaaauccucugguccgccccucucggccccgaccucaaccccuaccucucccaccucgcccgaauguacaacggcuacgccggcggcuucgaaguccaagucauacucgccgguaacgccuucaccgccggcaaaguaaucuucgccgccgucccucccaacuuccccaccgaaggucuaucccccucucaagucacgauguucccccacaucgucgucgacgugcgccaacucgaacccguacuaaucccccucccagauguccgcaacaacuucuaccauuacaaccaauccaacgaccccaccaucaaacucauagccauguuauacacaccccuccgcgccaacaacgcaggagacgacguauucaccgucucuugccgcguccucacccgccccucaccugacuucgacuucaucuuccuugucccacccaccgucgaaucucgaaccaaacccuucuccguaccaguacuuaccgucgaagaaaugaccaacucacgauucccuaucccccuagaaaaacucuucacuggacccagcucagccuucgucguacaaccccaaaacggaagaugcaccacagacgguguccuacucggcaccacccaacuuucccccguuaacauaugcacauucaggggagacguaacacacauaacaggcagcagaaacuacaccaugaaucucgccucucaaaacuggaacaacuacgaccccaccgaagaaauccccgcaccccucggcacaccagacuucgucgguaagauacaaggcguccucacccaaacuacccgcacugacggaucaacacguggccacaaagccaccgucuacaccgggucggccgacuucgccccaaaacuaggccgcguccaauucgaaacagacacagaccacgacuucgaagcaaaccaaaacaccaaauucacccccgucggcgucauccaagacggaucuaccacccaccguaacgaaccccaacaauggguacucccauccuacuccggccgggacacccacaauguacaccuagccccugcagucgcacccaccuucccaggagaacaacuacucuucuuccgcucaacaaugcccggaugcuccgguuaccccaacauggaccuugacugccuacucccccaagaauggguccaauacuucuaccaagaagcagcccccgcccaauccgacgucgcacugcuacgcuucgucaaccccgacaccggccgcguccuauuugaauguaaacuccacaaauccggcuaugucaccgucgcccacacaggccaacaugaccucgucauuccaccaaauggcuacuuccgcuucgauuccuggguaaaccaauuuuacacccucgcaccgaugggaaacggcacaggccgucgccgcuaa

SEQ ID NO: 38976 - RNA, 1617 nt, Artificial Sequence
  derived and/or modified sequence opt11 from VP1__Norovirus_and/or_Norovirus-like__KC175384
augaaaauggccucauccgacgccaaccccucugauggauccaccgcaaaccucguucccgaagucaacaacgaaguaauggcccucgaacccgucguaggcgccgcuaucgcagcccccgucgccggccaacaaaacguaaucgauccauggauacgaaacaacuucguccaagccccaggcggcgaguucaccguaucaccccgcaacgcccccggcgaaauccuaugguccgccccucucggcccagaccucaacccauaccucucucaccucgcccgcauguacaacggcuacgcaggcggcuucgaaguccaagucauccucgcaggcaaugcauucacagccggaaaaaucauauucgcagccguaccacccaacuuccccacugaaggacuaucaccaagccaagucaccauguucccccauaucaucguggacguucgacaacucgaaccuguacuaaucccccuccccgacguccgcaacaacuucuaccacuacaaccaauccaacgaccccaccaucaaacucaucgccaugcucuacacuccccuucgcgcaaacaacgcaggcgacgacgucuucaccgugucaugccgcguacuaacucgcccaucccccgacuucgacuucaucuuccucguaccacccacaguagaaucgcgcaccaaacccuucuccguccccguccucacagucgaggaaaugacaaacucccgcuucccaaucccccucgaaaaacuauucaccggaccuucauccgcguucgugguccaaccccaaaacggccgcugcacaaccgacggcguccuccuagguaccacccaacuuucaccagucaacauuugcacauuccgcggcgacguaacucacauacccggcucccgcaacuacaccaugaaccuugcaucgcaaaacugggauuccuacgaccccaccgaggaaacccccgccccacuaggaacaccggauuucgucggcaaaauccaagguguacucacccaaacaacccgcaccaaugguuccacccgaggccacaaagccacagucuacaccggaagcgccgacuucagcccgaaacuuggccgaguccaauucgccaccgacaccgacaacgacuucgagacaaaccaaaacacaaaguucaccccugucggggucauccaagacggaucaacaacaccgcgcaacgaaccccaacaauggguccuccccucauacuccggccgaaacauccauaacguacaccuugcccccgccgucgccccaaccuuccccggcgaacaacuacuauucuuccguucgaccaugcccggaugcucuggcuaccccaacauggaccuagacugccuucuuccccaagaauggguccaauacuucuaucaagaagcugcccccgcccaauccgacguagccuuacucagauucgucaaucccgacacaggccgcguacuauuugaaugcaaacuucauaaaucaggauacguaaccgucgcccacaccggacaacacgaccuagucaucccacccaacggauacuuccgauucgacucauggguaaaccaauuuuacacacuagcacccauggguaacggcaccggccgacgccguuaa

SEQ ID NO: 38977 - RNA, 1617 nt, Artificial Sequence
  derived and/or modified sequence opt11 from VP1__Norovirus_and/or_Norovirus-like__JQ613561
augaaaauggcuuccagcgacgcuaaccccuccgacggcuccacagccaaccuuguacccgaaguuaacacggaaguuauggcccuagaacccguaguaggcgccgccaucgccgccccugucgccggccaacaaaacgucaucgacccauggauccgcaauaacuuuguccaagccccaggaggagaauuuaccgugucaccacgcaacgcccccggagaaauacucugguccgcuccccucggccccgaccuaaaccccuaccuuucucaucuugcacgcauguacaacggcuacgccgggggauuugaaguccaaguaauacucgcagguaacgcuuucaccgcaggaaaaaucaucuucgcagccgucccaccaaauuucccaacugaaggccuaucacccucacaaguaaccauguucccccacaucaucgucgacguucgccaacucgaacccguacucauaccacuccccgacguacgcaacaauuucuaccauuacaaccaaucaaacgaccccacuaucaaacuuaucgccaugcuauacacuccacuacgcgccaacaacgcaggagacgacgucuucacagucucuugcagaguccucacccgacccucccccgacuucgauuucauuuuccucguaccacccaccgucgaaucccgaaccaaacccuuuucuguccccguccucacuguugaagaaaugaccaacagcagauuccccaucccccuagaaaaacuauucaccggucccucuucagcuuucgucguccaaccccagaacggacgcugcacaaccgacggcguccuccucggcaccacgcagcucucuccugucaacauaugcacauucagaggcgaugucacucacauaccuggaucccgcaacuacaccaugaaccuugccucccaaaacuggaacucuuacgaccccacugaagaaaucccagcuccccuaggcacccccgacuuugucggcaaaauccaaggaguacucacccaaacaacccgcaccaacggcucaacacgcggccacaaagccaccgucuacacaggauccgcugacuuuagcccaaaacucggccgugugcaauucgcaaccgauaccgacaacgacuucgaaaccaaccaaaacaccaaauucacgccagucggcguuauccaagacggauccaccaccccacgaaacgaaccccaacaguggguccuacccuccuauuccggccguaacauacacaacguccaccucgcacccgcagucgcccccacauuuccuggagagcaacuccucuucuuccgcucaaccaugcccggcugcucuggcuaccccaacauggaccucgauugccuacucccccaagaauggguccaauacuuuuaccaagaagccgcccccgcccaaucugacgcggcccuucuccgcuucguuaacccagacaccggacgcguccucuucgaaugcaaacuccacaaauccggcuacgucacagucgcacacaccggccaacaugaccucgucauacccccaaacggcuacuuccgauucgacagcugggucaaucaauucuacacucucgcccccauggguaacgguaccggccgccgccgcuaa

SEQ ID NO: 38978 - RNA, 1617 nt, Artificial Sequence
  derived and/or modified sequence opt11 from VP1__Norovirus_and/or_Norovirus-like__KJ678145
augaaaauggccagcucggacgccaaccccuccgacggcuccgcagcgaaccucguacccgaagucaacaacgaagucauggcccucgaacccgucguaggcgccgccauagcggcuccugucgcaggccagcaaaacgucaucgaccccuggaucagaaacaacuucguccaagcaccuggaggagaauucacuguaucaccucgaaacgccccaggagaaauccuguggagugccccucuaggacccgaccucaacccauaccucucccaccucgcccgaauguacaacggauacgcuggcgguuucgaaguccaagucauccucgccggcaacgccuucaccgccggcaaaguaauauucgcagcaguuccccccaacuuccccaccgaaggacucucacccucccaaguaaccauguucccccacaucgucgucgacguacgccaacuagaacccguacuaauaccucuucccgacguccgcaacaacuucuaucauuacaaccaaagcaacgacuccacaauaaaacucaucgcgaugcucuacacuccccuacgcgcaaacaacgccggcgacgacguuuucacagucucaugccgcguccucacucgcccaucccccgacuucgacuucaucuuccucguccccccaaccguagaaucucgcaccaaacccuucuccguacccguccuuaccgucgaagaaaugacuaacucucgcuucccaaccccccucgaaaaacucuucacaggccccucauccgcauucguaguccaaccccaaaacggccgauguaccaccgacggcguacuccucggaaccacacaacucagccccgucaacaucuguaccuuccgcggagacgucacacacaucacuggcucacgcaacuacaccaugaaccucgccucucaaaacugguccaacuaugaccccaccgaagaaaucccagccccccuaggaaccccagacuucgugggcaaaauacagggcguccuaacccaaaccacccggacugacggcagcacccgcggccacaaagcaacaguauauaccggcuccgccgauuucgccccgaaacucggaagaguacaguucgaaacugacacagaccacgauuucgaaaccaaccaaaacaccaaauucacccccgucggcgucauccaagacggcuccaccacccaccgcaaugaaccccaacaauggguccucccuucauacagcggacgcaacaccccgaacguccaucuagcacccgcagucgcccccaccuucccaggcgaacaacuccucuucuuccgcuccacaaugcccggcugcucaggcuaccccaacauggaccuugacugccuccucccccaagaauggguucaauacuucuaccaagaagccgcccccgcccaauccgacgucgcccuccugcgauucgucaacccugacaccggccgaguacuguucgaaugcaaauuacacaaaucaggcuacguuaccguagcccacacuggccaacacgaucuagucaucccaccaaacgguuauuuccgguucgaaucauggguaaaccaauucuauacucuagccccaaugggcaacggaaccggacgacgacgcuaa

SEQ ID NO: 38979 - RNA, 1617 nt, Artificial Sequence
  derived and/or modified sequence opt11 from VP1__Norovirus_and/or_Norovirus-like__KF060116
augaaaauggccuccagugacgccaacccaucagacggcucaaccgcaaaccucguccccgaaguuaacaaugaaguuauggcccucgaaccaguggugggcgccgcaaucgcugccccggucgccggacaacaaaacguaaucgaccccuggauccgcaacaacuucguccaagcccccggcggcgaguucacuguaagcccccgaaacgccccuggcgaaauccucugguccgcuccccucggccccgaccuaaaccccuaccucucccaccucgcccgcauguacaacggcuacgccgguggcuucgaaguccaagugauccuagccggaaacgcguucaccgcaggcaaaauaaucuucgccgccguaccuccaaacuuccccacagaaggccuaucaccaucgcaaguaaccauguucccucacauaaucguugauguccgacaacuagaaccaguccucaucccccuccccgauguccgcaauaacuuuuaccacuacaaccaauccaacgacuccacgaucaaacuuaucgccaugcucuacacaccccuacgcgccaauaacgcaggcgacgacgucuucaccgucucaugccgcguccucaccagacccuccccugacuucgacuucauauuccucgugccaccuaccguagaaucacgaacuaaacccuucucaguccccauccuaaccguagaagaaaugacaaauagccgcuuccccaucccccucgaaaagcucuuuaccggccccuccucagccuucgucguccagccccaaaacggccgcugcaccaccgacggcguacuccucggcaccacccaacuuagcccaguaaacaucuguaccuuccgcggagacgucacccacauucccggcagccacaacuacacuaugaaccucgccucccaaaacuggaacucauacgacccaacagaagaaaccccagcaccccuaggcacccccgacuucgucggcaaaauacaagggguccucacacagaccaccuccaccaacggauccacccgaggacacaaggccaccguauacacuggaucagccgacuucucccccaaacucggccgaguacaauucgccacagacacaaacaacgacuucgaaacaaaccaaaacaccaaauucacucccgucggagucauccaagacggcagcacaacuccacgaaaugaaccccaacaauggguccuccccuccuacucaggacgaaacauccacaacguccaccucgcccccgccgucgcccccaccuuccccggagaacaacuacuuuucuuccgaucaaccaugccaggaugcuccggcuaccccaauauggaccuagacugccuacucccccaagaauggguccaauacuucuaccaagaagccgcacccgcccaaucagacgucgcccuacuacgauucgucaaccccgacacugggcgaguccucuucgaaugcaaacuccacaaaucaggcuacgucacaguagcacacaccggccaacacgaccuagucauacccccaaauggauacuuccgcuucgacuccuggguaaaucaauucuacacccuagcacccaugggcaacggaacaggccgcagacgauaa

SEQ ID NO: 38980 - RNA, 1617 nt, Artificial Sequence
  derived and/or modified sequence opt11 from VP1__Norovirus_and/or_Norovirus-like__KC517362
augaaaauggccuccuccgacgccaaccccucagauggcuccgcugcaaaccuagugcccgaagucaacaacgaaguuaucgcacucgaacccgucgucggagccgccaucgccgcacccgucgccggccagcagaacgucaucgacccauggauccgaaauaauuucguacaagcccccggcggagaauuuaccgucucaccacgcaacgcccccggcgaaauccucugguccgcaccccuuggcccagaucucaacccauaccucagccaccucgcccgaauguacaacggcuacgccgguggauucgaaguacaaguaauccuagccggcaacgccuucaccgccgguaaagucaucuuugccgccgucccacccaauuuccccaccgaaggccuaagucccucacaagucaccauguuuccccacauuguugucgacguaagacaacuugaaccugugcuaauaccccuaccagacguccgaaacaacuuuuaucacuauaaccaauccaacgacccuaccaucaagcucaucgcaaugcuauacaccccucuccgagccaacaacgcgggagacgacguuuucaccguaucaugccgcguccucacccguccauccccagacuucgacuucaucuuccuggucccacccacugucgaaucccgcaccaaacccuucuccguccccguccucacaguggaagaaaugacaaacucacgauuuccuaucccccuugaaaaacuauucaccggacccagcucugccuucgucguacaaccacaaaacggacguugcacaacagacggcguacuccuuggcaccacucagcucucaccaguaaacauaugcacuuuccguggcgacaucgcacacaucacaggcucccgaaacuauaccaugaaccucgcaucucaaaacuggaacaacuacgaccccaccgaagaaauccccgccccacucggcacccccgacuucguuggaaaaauccaaggcguccucacacaaaccacccgaacagacggaucuacccgcggccacaaagccaccguauacacaggcuccgcagacuuugcaccuaaacucggccgcguacaauucgaaaccgacaccgaccacgauuucgaagccaaccaaaauaccaaauucacacccgucggcgucauacaagacggcggcaccacccaccgaaacgaaccacaacaauggguccuaccaucauacucaggccgcaacacucacaacguccaccucgcccccgccgucgcccccacauuccccggcgaacaacuccuuuucuuccgcuccaccaugcccggcugcucuggcuaccccaacauggaccuagacugccuccucccccaagaauggguacaguacuucuaccaagaagccgccccugcucaauccgacgucgcacucuugcgauucgucaaccccgacaccggccgcguccucuucgaaugcaaccuccacaaaucuggauacguaaccgucgcccacaccggccaacacgaccucgucaucccacccaacggauacuuccgcuucgacuccugggucaaccaauucuacacccuagcacccauggguaacggcacaggccgccgccgcuag

SEQ ID NO: 38981 - RNA, 1617 nt, Artificial Sequence
  derived and/or modified sequence opt11 from VP1__Norovirus_and/or_Norovirus-like__JX644038
augaaaauggcauccuccgacgccaaccccuccgacggcucaaccgccaaucuuguccccgaagucaacaaugaaguuauggcacuggaaccugucgucggcgccgccaucgccgcccccgucgcaggccaacaaaacgucauagaccccuggauacgaaauaacuucguccaggcccccggcggagaguucacaguuucacccagaaacgccccaggagaaauucuaugguccgcaccucucggacccgaccuaaacccuuaucucucccaccucgcucgcauguacaacggguacgccgguggauucgaaguccaagucauucucgcaggcaacgcauuuacagcaggcaaaaucauauucgccgccguaccgccaaacuuccccaccgaaggucucagcccaucacaagucaccauguucccccacaucauaguugauguacgacaacuagaacccguacucaucccccuucccgauguccgaaacaauuucuaccacuacaaccaaucaaacgacucuacaauuaaacucauagcaaugcucuacacccccuugcgcgccaauaacgccggagacgaugucuucaccgucagcugccgcguccucacccgcccauccccagacuuugacuucaucuuccucguucccccaacuguagaaucacgaacuaaaccauucuccguccccauccucacaguugaagaaaugaccaacucccgcuuccccauaccacucgaaaaacucuucaccgguccuuccuccgccuucguaguccaaccccagaauggcagaugcacaaccgacggaguccuucucggaaccacucaacuauccccaguuaacgucugcaccuuccgaggagacgucacccauauaucuggcuccagaaacuauaccaugaaccuagccagccaaaacuggaccucauaugaccccacagaagaaauccccgcaccgcucgggaccccggacuucgucggaaaaauacaaggcguacuuacccagaccacacgcacuaacggauccacacgaggucauaaagccacggucuacaccggcucagccgacuucucccccaaacuuggccgcguacaauucgccaccgacacagacaacgacuuugaaacaaaccaaaacacuaaauucaccccuguaggcguaauccaagauggaagcaccacccccagaaacgaaccacaacaauggguucuccccucauacuccggccgaaacauacacaacguccaccuagcccccgccguugcccccaccuucccaggugaacagcuacuuuucuuccgcuccaccaugcccggcugcucaggcuaccccaacauggaccucgacugccuccuaccacaagaauggguccaauacuuuuaccaagaagcagcccccgcccaauccgacguagcuuuacuccgauucguaaaccccgacaccggccgcguacucuuugagugcaaacuacacaaauccggcuacguaaccguagcacacaccggccaacacgaccucgucaucccucccaacggcuacuuccgcuucgacuccuggguaaaccaauucuacacacucgcccccaugggcaauggcaccggccgccgccgcuaa

SEQ ID NO: 38982 - RNA, 1617 nt, Artificial Sequence
  derived and/or modified sequence opt11 from VP1__Norovirus_and/or_Norovirus-like__AB504313
augaagauggccucuaacgacgcuuccccauccgauggcuccacagccaaccucguaccugaaguaaacaacgaagucauggcccucgaacccguagucggagccgcaaucgccgcaccugucgcgggccaacaaaacguaauagacccauggauacgcaauaacuucguucaggcucccggcggagaguucaccguuucaccccgcaacgccccgggcgaaauccuaugguccgccccucucggccccgaccucaauccguaccuaucccaccucgcucgcauguacaacggauacgccgguggcuucgaaguccagguaauccuugccggaaacgccuucacagcaggcaaaaucauauucgccgcaguaccuccaaacuuccccaccgaaggccuuuccccaucccaagucaccauguucccccauaucaucguagacguacgacaacuagagccaguccuaaucccgcuuccagacguccgaaacaacuucuaccacuacaaccaauccaacgacucaaccaucaaacuaaucgccaugcucuacacaccccuacgagcuaacaacgccggugacgacgucuucaccguaagcugccgcguccuaacccguccaucccccgacuucgacuucauauuccucgucccaccaaccguagaaucccgcaccaaacccuuuaccguacccauccuuaccguugaagaaaugaccaacucccgcuuuccaauaccacuagaaaaacucuucaccgguccauccuccgcauucguaguacagccacaaaacgggcguugcaccacggacggugucuuacuuggcaccacacaacuaucccccgucaacauuugcaccuuccgcggcgacgugacccacauccccggcacccgcaccuaccgaaugaaccucgcaucccaaaauuggaacaacuacgacccaaccgaagaaauucccgcaccccucggcaccccagacuucgucggcaagauccaaggcaugcuaacccaaacaacucgcggggacggccucacccgcggccacaaagccacaguauccaccggauccguugacuucacacccaaacucggcuccguccaguucgcaaccgacacagacaacgacuucgaaaccggccaaaacacccgauucacacccguaggugucauccaagacgguuccuccgcacaccgcaacgaaccccaacaauggguacuccccgacuacuccggacgcacaguccacaacguccaccucgcccccgccgucgccccaacauucccaggcgaacaacuccuauucuuucgauccaccaugcccggaugcucaggauaccccaacauggaucucgacugccuacuaccacaagaguggguccaacacuucuaccaagaagccgcacccgcucaauccgauguagcccuccucagauucguugaccccgauaccggacggguccucuucgaaugcaaacuccacaaaaccggcuacgucacagucgcacacaccggccaacacgaccuagucaucccgcccaacggcuacuuccgauuugacuccuggguaaaccaauucuacacccuagcccccauggguaacggcgccggccgccgccgcuaa

SEQ ID NO: 38983 - RNA, 1617 nt, Artificial Sequence
  derived and/or modified sequence opt11 from VP1__Norovirus_and/or_Norovirus-like__KX514361
augaaaauggcaucaaacgacgccaaccccucggauggauccgccgccaaccucguacccgaagucaacaacgaaguaauggcccucgagcccgucguaggcgcggccaucgcagcacccguggccggccaacaaaacgucaucgaccccuggauccgaaacaacuuuguccaagcccccggaggcgaguucacaguaagcccccgaaacgcccccggcgaaauccuauggucagcaccucuuggccccgaccuaaacccuuaccuaucccaccuagcccgcauguacaacggcuacgcuggaggcuucgaaguccaaguaauucucgccggcaacgcauucaccgccggcaaaaucauauucgccgccgucccacccaacuucccuaccgaaggccucucacccucucaagucacaauguucccucacaucaucgucgauguccgccaacucgaaccaguccucaucccccuccccgacguaagaaacaacuucuaucacuacaaccaauccaacgacuccaccauaaaacucaucgccaugcuauacacaccccuacgcgccaacaaugcaggcgacgacguuuucaccgucuccugccgcguccucacaagacccucccccgacuucgacuucaucuuccuaguaccacccacugucgaaucacgaagcaaacccuucucaguacccgucuuaacugucgaagaaaugaccaacagccgauuccccgccacccucgacaaacuauucaccggaccaucuuccacauucgucguucagccacaaaacggccgaugcaugaucgacggcguacuucucggaaccacacaacugucuccugucaacaucugcaccuuccgaggugacgucacccacccccgcgacuccaaaaucuacaccaugaaccucgccucuccaaacuggaacaacuacgacccaaccgaagaaauccccgcaccccucggcacuccagacuucgucgguaaaauacaagggaugcucacccaaaccacaaaaggagaagggucgacccgcggccaccgagccaccguuuacgucggauccgccaacuacgcaccuaaacucggacgcguccaauucgaaaccgacaccaccgacgaccucgacgcccaccaaaacacaaaauucacaccaguuggagucguccagggcggcgaaucccccaaaggcagcgaaccccaacaauggguacuccccuccuacucuggaaaagacacucccaacguucaccuugcccccgccgucgcaccuaccuuucccggcgaacaacuacucuucuuccgcucaacuauacccggaugcggcggccaccccaacaugaaccucgacugccuccucccccaagaauggguccaacacuucuaccaagaagccgcucccgcccaauccgacgucgcccuucuccgcuucgucaacccagacaccagccgaguacucuucgaaugcaaacuccacaaaucaggauacguaaccgucgcccauaccggccaacacgaccucgucauacccccaaacggcuacuuccgauucgacucauggguaaaucaauuuuacacacuagcccccaugggcaacggcacaggccgcaaacgcuag

SEQ ID NO: 38984 - RNA, 1617 nt, Artificial Sequence
  derived and/or modified sequence opt11 from VP1__Norovirus_and/or_Norovirus-like__KX514336
augaaaauggccuccaacgacgccaacccaucagacgguuccgccgccaaccucguccccgagguaaacaacgaaguaauggcccuagaacccguagucggcgccgcuauagccgcaccaguagccggucaacaaaacguaaucgacccauggauacguaacaacuucguccaagcacccggcggggaguucacaguauccccucgaaacgcccccggugaaauccuauggucagcaccccucggccccgacuugaaccccuaccuaucccaccuagcccgaauguacaacggcuacgccggaggcuucgaaguccaagucauccuagccggaaacgccuucacugccggaaaaaucaucuucgccgccgucccacccaacuuccccaccgagggccucucccccucccaagucacaauguucccccauaucaucguagauguccgacaacuagaacccguccuaauacccuuaccugacgucagaaauaacuuuuaccacuacaaccaauccaacgacucuacaaucaaacucaucgcaaugcuguacacuccucuucgcgccaacaaugcaggcgacgacguguucacugucucaugccgcguccuaaccagacccucaccagacuucgacuucauauuccucguacccccaaccgucgaaucccgcuccaaacccuucuccgucccaguccuaacaguggaggaaaugaccaacucccguuuccccgcuacucuagacaagcuauucacuggccccuccagcaccuucguaguccagccccaaaauggccgaugcaugauagauggcguacuccugggcacaacccaacuauccccuguuaauaucugcaccuuccguggcgauguaacccacuccggcaacuccaaaauauacaccaugaaccucgccagccccaacuggaacaacuacgaccccacugaagaaaucccugcaccccucggcacucccgacuucgucggcaaaauccaagguauguuaacacaaaccaccaaaggagaaggcuccacccgcggacaccgcgccaccgucuacgucggcucagccaacuacgcacccaaacuuggcagaguucaauucgaaaccgacaccacugacgaucucgacgcccaccaaaacaccaaauuuaccccagucggcgucguacaaggaggugaaucaccaaaaggcuccgaaccccagcaauggguauuacccuccuacucuggccgcgauacccccaacguacacuuagccccugccguagcccccaccuuccccggagaacaacuccuauucuuccgcucuaccaucccaggcugcgggggacaccccaacaugaaccucgacugccuccuaccccaagaauggguucaacacuuuuaccaagaagccgcacccgcccaaucggacguagcacuccuccgauucguuaaccccgacaccucccgcguacuauucgaaugcaaacuacacaaauccggcuacgugacagucgcacacacgggccaacacgaccucgucaucccuccaaacggcuacuuccgauucgacucaugggucaaccaauucuacacccucgcacccaugggcaacggcaccggccgaaaacguuaa

SEQ ID NO: 38985 - RNA, 1617 nt, Artificial Sequence
  derived and/or modified sequence opt11 from VP1__Norovirus_and/or_Norovirus-like__KX514203
augaaaauggcauccucagacgccaacccauccgacggcucugccgccaaccucgucccagaaguuaacaacgaggucauggcacucgaacccgucgucggcgccgccaucgccgccccagucgccggccaacaaaacgucauagaccccuggaucagaaacaacuucguucaagccccuggcggagaguucacugucucuccgcgaaacgcucccggcgaaauccuauggucagcgccacuaggaccagaccuaaacccauacuuaucccaccucgcacgcauguacaaugguuacgcaggcggcuucgaaguccaagucauacucgccggcaacgccuucaccgccggcaagauuauauucgcagccguaccacccacauucccaacggaaggucuauccccaucacaagucaccauguucccacacauaaucgucgauguccgccaacucgaacccguacuaauuccacuacccgacguacgcaacaauuucuaccacuacaaccaauccaacgacagcacaaucaaacuuaucgccaugcucuacaccccacuccgcgccaacaaccccggcgacgacguuuucacaguauccugccgcguccucacccgacccagcccagauuucgacuucaucuuccuugucccacccacugucgaaucacggucaaagcccuucucaguccccgugcucaccguucaagagaugaccaacuccagauuccccgccacacucgacaaacucuucaccggccccucaucaacccucguaguccaaccacaaaacgggcgaugcaugauagacggaguacucuuaggcaccacccaauuaucccccguaaacaucugcaccuuccgcggcgacguuacccacucccgcgacaguaccaucuacaccaugaaccuagcaucgccaaacuggaacaacuacgaccccacagaagaaaucccugcaccccucgguacccccgacuucgugggaaaaauccaaggcguccucacccaaaccacgaagggcgaaggcuccacacgcggacaccgcgccacagucuacguaggcucagccaacuacaccccaaaacucggcaaaguccaauucgaaacaaacaccaccaacgaccuguacgcccaucaaaauacccgcuucacccccgucggagucguccaaggcggcgaaucagcccacagauccgaaccccaacaauggguacuacccucauacucaggccgcgacacccccaacguacaccuagcccccgccgucgcacccacuuuccccggugaacaacuacucuucuuccgaucaaccauacccggaugcggcggccaucccaacauggaccuggacugccuucuaccacaagaauggguccaacacuucuaccaagaagccgccccagcccaauccgacgucgcucuccuacguuuugucaaccccgauaccucccgcguacuauucgaaugcaaacuucacaaaucaggcuacgucacaguagcacacacuggucaacacgaccuggucauacccccaaacggcuacuuccgcuucgacagcugggucaaccaauucuacacccuagccccaaugggcaacggaaccggccgaaaacguuga

SEQ ID NO: 38986 - RNA, 1617 nt, Artificial Sequence
  derived and/or modified sequence opt11 from VP1__Norovirus_and/or_Norovirus-like__KP784693
augaaaauggccucaucagacgcgaaccccagcgacggaucuaccgccaaccuagucccagaagucaacaacgagguuauggcacucgaaccgguagucggcgccgcgauagcugcccccgucgccggccaacaaaacgucauagacccauggaucaggaacaacuucguccaagcacccggaggcgaguucaccgucuccccacgcaacgcccccggcgaaauacuuuggucagcaccuuuaggccccgaccucaaccccuaccucucccaccuugcccguauguacaacggcuacgccggcggcuucgaaguccaagucauccuagcuggcaacgcauucaccgcgggcaaaaucauuuucgccgcagucccacccaacuuccccaccgaaggucucucucccucccaaguaaccauguucccccacaucaucgucgacguacgccaacuagaacccguccucauaccccuccccgacguccgcaauaauuucuaucacuacaaccaaagcaacgacuccaccauaaaacuaaucgccaugcuuuacacuccccucagagcuaacaacgccggagacgacguauucaccguauccugccgaguccuaacccgucccucaccagacuucgacuucaucuuccucgucccaccaaccguugaaucccguaccaaacccuucuccguccccguacucaccgucgaagaaaugacuaacucaagauucccuauaccacuagaaaaacucuucaccggucccuccuccgccuucgugguccaaccccaaaacggacgcugcaccaccgaaggcguccuacuagggaccacccaacuaucacccguuaacaucugcaccuucagaggcgacguaacacacauauccggcucccgaaacuacaccaugaaccuagccagccaaaacuggaacuccuacgaccccaccgaagaaauccccgcaccccucgguacacccgacuucgucggcaagauccaaggcguccucacccaaaccacacgcaccgacggauccaccagaggccacaaggccacaguauauaccggcagcgcagacuucagccccaaacucggccgaguccaauucgccaccgacaccgauaacgacuucgucaccaaccaaaacaccaaauucacaccaguuggcgucauccaagacggcagcacaacuccccgcaacgaaccacaacaauggguccucccauccuacucaggccgcaauacccacaacguucaccucgcccccgcagucgcccccaccuuucccggagaacaacuccucuucuuccgcagcaccaugcccggcugcuccggcuaccccaacauggaccucgacugccuacuaccccaagaauggguacaauacuucuaccaggaagccgcacccgcacaaucugaugucgcccucuuacgcuucgucaaccccgauacaggccgcguccuauucgaaugcaaacuccacaaaagcggauaugucaccgucgcccacaccggccaacacgaccuagucaucccgcccaacggauacuuccgauuugauuccugggucaaccaauucuacacccucgcaccuaugggcaacggagccggcagacgccgguaa

SEQ ID NO: 38987 - RNA, 1617 nt, Artificial Sequence
  derived and/or modified sequence opt11 from VP1__Norovirus_and/or_Norovirus-like__AB933734
augaaaauggccagcuccgacgcuaacccaagcgacggcucgaccgcuaaccucgugcccgaagucaacaaugaagucauggcacucgaacccgucguuggagcagcaaucgccgccccaguagccggccagcaaaaugucaucgaucccuggauccgcaacaacuuuguccaagcccccggcggcgaguucaccguuucuccacgcaacgcccccggcgaaauccuaugguccgcuccccucgggcccgaucucaauccuuaccucucacaccucgcccggauguacaacggauacgccggagguuucgaaguccaagucauccucgcaggcaacgccuucacagcaggcaaaaucauauucgccgccgucccucccaacuuccccacagaaggccucucccccucccaagucaccauguucccccacaucaucguugacguccgccaauuagaacccguucuuaucccacucccagacguccgaaacaacuucuaccauuauaaccaauccaacgacuccaccaucaaacucauagcaaugcucuacacaccccuccgugccaacaacgccggagacgacgucuuuaccgucagcugccgcguccucacccgcccgagcccagacuucgacuucaucuuucuaguaccucccaccgucgaauccgaaaccaagccauucuucuucccaguacuaaccgucgaagaaaugaccaauucacgcuuucccaucccccuugaaaaacucuucacagggcccucauccgcauucgucguccaaccccaaaacggucgaugcaccacagacggcguccuacuuggcaccacacaacucuccccggucaacaucuguaccuuccgcggagacguaacacacauccccggcucacgaaacuauacaaugaaccucgcuucccaaaacuggaacuccuacgacccaacagaagaaauaccagccccacuaggcacucccgacuucguaggcaaaauacaaggcguacucacccaaaccacccgcaccaacgguucuacccgcggacacaaggccaccgucuauaccggcucugccgacuucuccccaaaacucggaagaguccaauucgccacagacaccgacaacgacuucgaaaccaaccaaaauaccaaauucacgcccgucggcguaauccaagacggcuccaccaccccaagaaacgaaccccaacaauggguccuaccauccuauuccggacgaaacauccacaacguccaccuugcacccgccguagccccaacauuccccggagaacaacuccucuucuuccgaucuacaaugcccgguugcagcggcuaccccaauauggaccucgacugccuccucccccaagaauggguacaguauuuuuaccaagaagccgccccagcccaguccgacgucgcacugcuacgcuucgugaacccagacacaggcagaguccucuucgaaugcaagcuccacaaaucaggauacgucaccguagcacauacaggacagcaugaccuaguaauacccccgaacggauacuuccgcuuugacucaugggucaaccaauucuacacccuugccccuaugggcaacggcaccggacgccgacgcuaa

SEQ ID NO: 38988 - RNA, 1617 nt, Artificial Sequence
  derived and/or modified sequence opt11 from VP1__Norovirus_and/or_Norovirus-like__KF060041
augaaaauggccucauccgaugcaaaccccucagacggcucggccgcaaaccuagucccagaagucaacaaugaagucauggcacuagaaccugucgucggcgccgcaaucgcugcacccguagccggccaacaaaacgucaucgaccccuggauccgcaacaacuucguacaagcccccggcggcgaguucaccgucucaccccgaaacgcucccggcgagauccucugguccgcaccccuaggccccgaccucaacccauaucucucgcaccucgcacgcauguacaacggauacgccggcggcuucgguguccaggucauccuagccggcaacgccuucaccgcgggcaaaguaauauucgccgccgucccacccaacuucccaaccgaaggccucucuccaucucaaguuaccauguucccgcacaucgucgucaacguucgccaacucgaacccguacuuauaccacuccccgauguacgcaacaacuucuaccacuacaaccaaucuaacgacccaacaauaaaauuaaucgcaaugcuauacacaccgcuacgugccaauaacgccggcgacgacgucuucaccgucuccugccgaguccuuacacgccccagucccgacuucgacuucaucuuccucgucccaccaaccgucgaaucccggaccaagccguucuccguucccguccucacugucgaagaaaugacaaacucccgcuuucccauaccccucgaaaaacuauucaccggacccucaucugccuucgucguccaaccacaaaacggccgcugcaccaccgacggcguccuccugggcaccacccaacuuucccccguaaacauauguacauuccgaggagacgucacccacauaaccggcucccgcaacuacaccaugaaccucgccucccaaaacuggaacaacuacgaccccaccgaagaaaccccagcuccccucggcacccccgacuuuguaggcaaaauccaagguguacucacccagaccacucgcaccgacggcuccacccgcggccauaaagcaaccgucuacacuggcucagccgacuucgccccuaaacucggccgcguacaauucgaaaccgacacagaccacgacuucgaagcaaaccaaaacaccaaauucaccccugucggagucauccaagacggauccaccacccaccgcaacgaaccccaacaauggguccuccccucauacuccggcagaaacacccacaacguacaccuggcccccgccgucgcaccaaccuuccccggagaacaacuccuauucuuccgcuccaccaugcccggaugcuccggguaccccaacauggaccucgacugccuccucccccaagaauggguccaauacuucuaccaagaagccgcccccgcucaaucagacgucgcccuacuccgcuuugucaaccccgauaccggccgaguacucuuugaaugcaaacuacacaaauccggauacgucaccgucgcacuaaccggacaacacgaccuaguaauacccccgaacggcuacuuccgcuucgacuccugggucaaccaauucuacacccucgcuccaauggguaacggcaccggccggcgccgcuga

SEQ ID NO: 38989 - RNA, 1617 nt, Artificial Sequence
  derived and/or modified sequence opt11 from VP1__Norovirus_and/or_Norovirus-like__JX989074
augaaaauggcauccagcgacgcuaaccccuccgacggaucuaccgccaaccuaguuccagaaguaaacaaugaagucauggcacucgaacccgucguuggcgccgccaucgcugccccagucgccggccaacaaaacgucaucgaccccuggauccgcaacaacuuuguacaagcccccggcggcgaguucaccguaucaccccgcaacgcccccggcgaaauccucugguccgcaccacucggacccgacuuaaacccauaccuuucacaccuagcucgaauguacaacggguacgccggcgguuucgaaguccaaguaauccucgccgggaacgccuucaccgccggcaaaauuauauucgcagccgucccuccaaacuuccccaccgaaggccuauccccaucucaaguaacaauguucccucacaucaucgucgacguccgacaacucgaacccguccucaucccacuaccagacguccgcaacaacuucuaucacuacaaucaauccaaugacuccaccaucaaacucaucgcuaugcuuuauacaccccuccgcgccaacaacgccggugacgacguauucacagucuccugucgaguccucacccggccaucaccugacuucgacuucauauuccuaguucccccaacugucgaaucacggacaaaacccuucuccguccccguccuaaccgucgaagaaaugacaaacucacgcuucccaaucccacuagaaaaauuauucacaggacccucauccgccuuuguaguccaaccccaaaauggccgcugcaccaccgacggaguccuacucggaacaacccaacucucccccgucaacaucugcaccuuccguggcgacguaacccacauacccggcucccgcaacuacaccaugaaccuggccucacaaaacuggaacuccuacgaccccaccgaagaaacacccgcaccccucggcaccccggacuuugucggaaaaauacaaggcguccuaacacaaaccacucgaacuaauggaucaacccgaggccacaaagccacagucuacaccggauccgccgacuucuccccaaaacucggccgcguacaauucgccaccgauacugacaacgacuucgaaaccaaccaaaacaccaaauucacccccgucggaguaauccaggacggauccaccaccccucgcaacgaaccccaacaauggguccuccccuccuacuccggcagaaacauucacaacguucaccuagcccccgcaguagcacccaccuucccaggcgaacaauuacucuucuuccguuccacaaugccuggcugcucaggauacccuaacauggaucucgacugccuacucccccaagaauggguccaauacuucuaccaagaagccgcacccgcacaaagugacgucgcccuccuccgcuucguaaacccagacaccggucgcguacuauucgaaugcaaacuccacaaauccggcuacguaacagucgcccacacaggacaacacgaccucgucaucccucccaacggauacuuccgcuucgacuccuggguaaaucaauucuacacccuagccccaaugggaaauggaacuggccgacgaagauag

SEQ ID NO: 38990 - RNA, 1617 nt, Artificial Sequence
  derived and/or modified sequence opt11 from VP1__Norovirus_and/or_Norovirus-like__JN400624
augaaaauggccucaagcgacgccaaccccucugacggcucaacugccaauuuaguacccgagguaaacaacgaaguaauggcccucgagcccguagucggcgccgccauagccgcaccaguugcaggccaacaaaacguaauagaccccuggauccgcaacaacuucguccaagcccccggcggggaguucacagucagcccccgcaacgcacccggugaaauccuguggucugcaccccuaggcccagaccucaaccccuaccucagccaccuugcccgcauguacaacggauacgccggcggcuucgaaguccaagucauccuagccggaaacgccuucacggcgggcaagaucauauucgccgccgucccgcccaacuuccccacagaaggccuaucuccaucccaaguaacaauguucccccacaucaucguagacguccgccaacucgaacccguacuaaucccccucccagacguacgcaacaacuucuaccacuacaaccaauccaacgacccuaccaucaaacucaucgcaaugcucuacacuccccuuagagccaacaacgcuggcgacgaugucuucaccgucuccugccgcguacuaacaagacccucccccgacuucgacuucaucuuccuagugcccccaaccgucgaaucucgcaccaaaccauucuccguucccguacuaaccgucgaagaaaugaccaacucacguuucccaaucccacuugaaaaacucuucacagguccauccuccgccuucgugguacaaccccaaaacgaccgcugcacaaccgacggcguccuacucggcaccacucaacucucccccgucaacaucugcaccuuccgcggcgacguaacccacauacccggcucacggaacuauacaaugaaccuggcaucccaaaacuggaacuccuacgaucccaccgaagaaauccccgccccacuaggcacccccgacuucgucggaaaaauacaaggaguccucacccaaaccacccgcaccaacggcagcacacgcggccacaaagccaccgucuacaccggcuccgcagacuucuccccaaaacucggccgcguucaauucgccaccgacacugacaacgacuucgaaaccaaccaaaacaccaaauucaccccugucggcguaauacaagacggcucaaccacaccccggaacgagccccaacaauggguccuacccucuuacuccggacgcaauauccacuccguccaccucgccccagccguagcccccaccuuccccggagaacaacuacucuucuuccgcuccaccaugcccggcugcuccggauaccccaacauggaccucgacugcuuacuaccacaagaauggguacaauacuuuuaccaagaagccgccccagcccaaucagacgucgcucuacuccgguucguaaacccggacaccggacgaguacucuucgaaugcaaacuacauaaauccggauacguaaccguagcccacaccgggcaacacgaccucgucaucccacccaacggcuacuuccgcuucgauuccugggucaaccaauucuacacacuagcacccaugggaaauggcacaggccguagaagguag

SEQ ID NO: 38991 - RNA, 1617 nt, Artificial Sequence
  derived and/or modified sequence opt11 from VP1__Norovirus_and/or_Norovirus-like__EU876894
augaagauggccuccuccgacgcaaaucccuccgacggcuccacugcaaaccucguacccgaagugaacaacgaaguaauggcacucgaaccagucgucggugcagccaucgcugcuccgguugccggacaacaaaacgucauugacccucgcauacgcaacaacuucguccaggcaccaggcggagaauuuaccguuagcccccgaaacgcccccggagaaauccuaugguccgccccacuaggacccgaccucaacccauaccucucccaccuagcccguauguauaacuccuacgccggcggauucgaaguccaagucauccucgcgggcaacgccuucacagccggcaaaaucaucuucgcugcagucccacccaacuuccccaccgaaggacuuucucccucacaagucaccauguucccccacaucauagucgacguacgccaacucgaacccguccucaucccccuacccgacguucgcaacaacuucuaucauuacaaccaaagcaacgaccccaccaucaaacuaaucgccaugcuguacacgccucuccgcgccaacaaugcuggagacgacgucuucacuguauccugcuggguccuaacacgucccucccccgacuucgacuucaucuuccucguacccccaaccgucgaaucccgcaccaaacccuucucagucccaauacucaccgucgaagaaaugacaaacucacgauuccccauaccccuagaaaaacucuucaccggacccucauccgcauuugucguacaaccacaaaauggacgcuguacaaccgacggaguucuccucggcaccacccaacuuagccccgucaauaucugcaccuuccgaggagacguaacccacaucgccggcacacaggaauauaccaugaaccuugccucccagaacuggaacaacuacgaccccacugaagaaaucccagcaccccucggcaccccggauuucgucggcaagauccaagguguucuaacucaaacaacccgcucagacgggagcacccguggacacaaagcaaccguuagcaccggcuccguucacuucacccccaaacuaggccguauccaauucuccaccgauaccucuaacgacuucgaaacaggacaaaacaccagauucacuccagucggcgucguccaagacggcuccaccacccaccaaaaugaaccccaacaauggguacuccccaacuacuccggccgcgacucacacaacguacaccucgcaccggccgucgcccccucauuccccggcgaacaacuccuuuucuuccguuccacaaugcccggcugcuccggcuaucccaacaugaaucucgacugccuacuuccccaagaauggguacaacauuucuaccaagaagccgccccugcccagucugacguagcccuccuccgcuucguuaacccagacacuggccgcguccucuucgaaugcaaacuccacaaaucaggcuaugucacagucgcccauaccggccaacacgaccucguaauaccacccaacggcuacuuccgcuucgacuccugggucaaucaguucuacacucucgcccccaugggcaacggcaccggccgccgccgcuag

SEQ ID NO: 38992 - RNA, 1617 nt, Artificial Sequence
  derived and/or modified sequence opt11 from VP1__Norovirus_and/or_Norovirus-like__KX514173
augaaaauggccucuucugacgcaaacccauccgacggcuccaccgccaaccuagucccagaaguaaauaacgaaguuauggcacuggaacccgucgucggagccgccaucgccgcacccguagccggacaacaaaaugucaucgaccccuggauccgcaacaacuucguucaagcaccaggaggcgaauuuaccgucucaccccgcaacgcucccggagaaauccuauggucugcaccccuaggucccgaccucaaccccuaccuaucccaccucgccagaauguauaacggcuacgccgguggcuucgaaguacaaguaauccuagccggcaacgccuucaccgccggaaaaauaaucuucgcugcagucccacccacauuccccacggaagggcuaucacccucacaaguaaccauguucccccacaucauaguagacguacgccaacuggaacccguccuuauaccccuccccgacguccgaaacaacuucuaccacuacaaucaaucaaacgacuccacaaucaaacucaucgccaugcuauacacaccacuccgugccaauaacccaggagacgacgucuucacaguauccugccgaguccucacacgacccucccccgacuuugacuucaucuuccucgucccacccacagucgaaucacgaacaaagcccuucuccgugccaauacucaccgugggcgaaaugaccaacucacgguuccccgucaaccucgaacgccucuucacagggcccuccuccgccaacguaguucaaccccaaaacggccgcugcaccaucgacggcgaacuccucggcacaacacaacucuccagcgucaauaucugcaccuuccgcggcgacguaacccacaucggcaccacccgccacuggaccaugaaccucgccagccccaacuggaacaauuaugaccccacagaagaaaccccugcaccccuaggcacccccgacuucgucggcaaaauccaaggaaugcucacacaaacaaccaaaggcgaaggaucaacccgcggacaccgcgcuaccguauacgucggcucagcaaacuacgcccccaaacuaggcagaguccaauuugaaaccgacaccaccaacgaccucgacgcccaucaaaacaccaaauucacaccagucggcgucguacaaggcggcgaaucacccaaaggcucagaaccccaacaauggguacuccccuccuacuccggucgagacacccccaacguccaccucgcacccgcaguagcaccuaccuuccccggcgaacagcuacucuucuuccgcucaaccaucccuggcugcgguggacaccccaauaugaaucuugacugccuccuuccccaagaauggguacaacauuucuaucaagaagccgccccagcccagucggacgucgcccuacuccgauucguaaaccccgacaccucacgcguccucuucgaaugcaaacuccacaaauccggauacgucacugucgcucacaccggccaauacgaccucguacuccccuccaacggauacuuccguuucgauucaugggucaaccaauucuacacccuagcccccaugggaaacggaacaggccgccgccgcuga

SEQ ID NO: 38993 - RNA, 1617 nt, Artificial Sequence
  derived and/or modified sequence opt11 from VP1__Norovirus_and/or_Norovirus-like__KX353989
augaaaauggcaucauccgacgcaaaccccuccgacggcuccacagccaaccuaguccccgaagucaacaacgaaguuauggcccucgaacccgucguaggcgccgccaucgcagcgccagucgccggacagcaaaacguaauagacccauggauacgaaacaacuucguccaagcccccggcggcgaguucaccguaucgccccgaaacgccccaggcgaaauucuaugguccgccccacuaggacccgaccucaaccccuaccuaucccaccuugcucgcauguacaacggcuacgccggaggcuucgagguccaagucauacuugcaggaaacgccuucaccgccggaaaaaucauauucgcagccgucccacccaacuuccccacugaaggucuaucacccucacaagucaccauggucccccacauaaucgucgacguccgacaacucgaacccguccucauacccuuacccgacguccgaaacaacuucuaccacuauaaccaauccaacgacucaacaaucaaacucaucgccaugcucuacacaccccuacgcgcaaacaacgccggcgacgacgucuuuaccgucucaugccggguccucacccgccccuccccugauuucgauuucaucuuccucguucccccaaccgucgaaucacgcaccaaaccguucagcguccccauccucaccgucgaagaaaugaccaacucccgcuuccccauaccacuggaaaaacucuucaccgggcccucauccgccuucguaguacaaccccaaaacggccgcugcaccacggacggcguccuccucggcaccacccaacuaucccccgucaacaucugcacuuuccgaggugacguaacccacauaccuggcucacacaauuacaccaugaaccucgcaucccaaaacuggaacucguacgaccccacagaagaaauccccgccccucuaggcaccccugacuuugucggcaaaauacaaggcguccuaacacaaacaaccuccacuaacggcucaacgagaggacacaaagcuacagucuacacaggcuccgccgacuucucgccaaaacuuggccgcguucaauuugcaaccgacacaaacaacgacuucgaaaccaaccaaaacacaaaguucacccccguuggcgucauacaagacggaucuacaaccccacgaaacgaaccccaacaaugggugcuccccucauacucgggccgcaacauacauaacguccaccuugcccccgccguagcccccaccuuccccggcgaacaacuccucuucuuccgcucaaccaugccaggcugcuccggcuaccccaacauggaccuagacugccuccucccccaagaauggguccaauacuucuaccaagaggccgcccccgcccaaucagacgucgcacuacuccgcuuugucaauccagauaccggccgcguccucuucgaaugcaaacuccacaaaucaggcuacgucaccguagcacacaccggacaacacgaccuagucaucccacccaacggcuacuucagauucgacagcuggguaaaccaauucuacacccuagcacccaugggaaacggcaccggacgccgccgcuaa

SEQ ID NO: 38994 - RNA, 1617 nt, Artificial Sequence
  derived and/or modified sequence opt11 from VP1__Norovirus_and/or_Norovirus-like__KX353962
augaaaauggccuccucagaugccaacccauccgauggauccacagcaaaccuaguacccgaagucaacaacgaaguaauggcccucgaacccgucgucggagccgccaucgccgccccagucgcaggacagcaaaacguaaucgacccguggauucgcaacaacuucguacaagccccaggaggcgaguucaccgucaguccccguaacgccccaggcgaaauccucuggucugcaccccucggcccagaccucaacccauaccuaucacaccucgcccgcauguacaacggauaugcuggcggauucgaaguccaaguuauacuagcaggcaacgccuucaccgccggcaaaaucauauuugcagccgucccuccgaacuucccaacagaaggccuauccccuucucagguaacuauguucccccacaucaucgucgacguacgccagcuugaacccguacucaucccccuccccgacguccgaaacaacuucuaccacuacaaccaaucaaaugacuccacaaucaaacuuaucgccaugcuauacaccccacuccgcgcaaauaacgccggcgacgauguauucaccguaucauguagaguccuuacccgaccaaguccagacuucgacuucaucuuccucgucccacccaccgucgaaagccgcaccaaacccuucucagugcccguccucacagucgaagaaaugaccaacccccgcuuuccaauuccccucgaaaaauuauucaccggaccaucauccgcauucgucguacaaccccaaaacggccgcugcacaaccgacggcguccuacuagguaccacacaacuaucccccguaaacauaugcaccuuccgcggcgacguaacccacauccccggcucgcgcaauuacacaaugaaccuagcaucacaaaauuggaacuccuacgaucccacagaagaaauccccgcaccccucggcacccccgacuucguaggcaaaauccaaggaguccuuacccaaaccacacgcaccaacggcagcacccgcggccacaaagccaccguauacaccggcucggcagacuucuccccaaaacucggccguguccaauucgccaccgacaccgacaacgacuucgaaaccaaccaagauaccaaauucacccccguaggugucauccaagacgguucaacuacaccccgaaaugaaccccaacaauggguacuacccucauauagcggccgaaacauccauaacguucaccucgcccccgccgucgcccccaccuuccccggagaacaacuccuauucuuccgcuccaccaugcccggaugcucagguuaccccaacauggaccucgacugucuccucccccaagaauggguccaauacuucuaccaagaagcagcacccgcacaauccgacgucgcccuucuccgauucgucaaccccgacacaggccgcguccucuucgaaugcaaacuccacaaaucaggauacgucaccguagcccacaccggccaacacgaccucguaauaccgccaaauggcuacuucagauucgacucauggguaaaccaauucuauacccucgcaccaaugggcaacggaaccggacgccgccgcuaa

SEQ ID NO: 38995 - RNA, 1617 nt, Artificial Sequence
  derived and/or modified sequence opt11 from VP1__Norovirus_and/or_Norovirus-like__AB972515
augaaaauggccucgucugacgcuaacccuagcgacggcuccaccgcuaaccuaguacccgaagucaacaacgaagucauggcccucgaaccagucauaggcgccgcaaucgcggcaccugucgccgggcaacaaaacgucaucgacccauggauccgcaauaacuucguacaagcccccggaggcgaauuuacugucucaccacgcaacgcacccggcgaaauccucugguccgcuccccucggccccgaccucaaccccuaccucucucaccucucccgcauguacaacggcuacgccggcggcuucgaaguccaaguuauccuugcaggaaacgccuucacagccggcaaaaucauauucgccgccguacccccaaauuuccccaccgaaggucucucucccucccaagucaccauguucccccacaugauugucgauguccgccaacuagaaccuguccuaauuccccuccccgacgucagaaacaacuucuaccauuacaaccaauccaacgacucaacuaucaaacucauagccaugcuuuacacaccccuccgagccaacaacgccggcgacgacguauucaccgugucaugccgaguacucacccgcccauccccagacuuugacuucaucuuccucgucccaccaaccguagaaucccgaaccaaaccauucucgguccccgucuugaccgucgaagaaaugaccaacucacgguuccccaucccccucgaaaagcuguucaccggccccuccuccgcuuucguaguccagccccaaaauggccguugcaccaccgacggcguacuccuuggcacaacacaacucucuccagucaacaucugcaccuuucgcggcgacgucacccacauccccggcucacguaacuacaccaugaaucuagccucccaaaacuggaacuccuacgacccaacugaagaaauacccgccccucucggcaccccagacuucguaggcaaaauccaaggcguccucacccagacuacccgcaccaacggaagcacccguggucauaaagccacagucuacacuggcucugcagacuucuccccuaaacucggccgaguccaauuugcuacugacaccgacaacgacuucgaaaccaaccaaaacacuaaauucacgcccgucggagucauccaagacggauccaccaccccacgaaacgaaccccaacaguggguacucccauccuacuccggccguaacauacacaacguccaucucgccccggcaguagccccuacauuccccggcgaacaacuccucuucuuccgcuccaccaugcccggcugcuccggcuauccaaacauggaucucgacugccuuuuaccucaagaauggguucaauacuucuaccaagaagccgccccugcucaauccgauguagcacuacuccgcuucguaaaccccgauaccggacgcguccucuuugaaugcaaacuccacaaaucaggcuacgucaccgucgcccacaccggccaacaugaccugguuaucccacccaacggcuacuuccgcuucgacucaugggucaaucaauucuacacacucgcccccaugggaaacggcaccggacgacgacgauaa

SEQ ID NO: 38996 - RNA, 1617 nt, Artificial Sequence
  derived and/or modified sequence opt11 from VP1__Norovirus_and/or_Norovirus-like__KT033904
augaaaauggccucuaaugacgccaaccccuccgacggaucagcagccaaccucguacccaaagucaauaacgaagucauggcacuagaaccagucgucggcgccgccaucgccgcccccgucgccggccaacaaaaugucaucgaccccuggauuaagaacaacuucgugcaagcccccggugguaaauucaccgucucgcccaaaaacgcccccggugaaauacuauggagcgcaccucucggccccgaccuuaacccauaucucucucaccucgcccgcauguacaaaggacacgccggcgguuucgaaguacaagucauccuagccggcaacgcauucacagccgggaaaauaauauucgccgcaguaccucccaacuuccccacagaaggccuuucccccucccaagucacuauguucccccacaucaucgucgacguucgacaauuagaaccuguacuaaucccccuacccgacguacgaaacaacuucuaccacuacaaccaaucaaacgacucaaccaucaaacucaucgccaugcucuacaccccacuccgcgccaacaacgccggugaagacguuuucacugucucaugccgcguacucacccgacccuccccugacuuugacuucaucuuccuagucccacccaccguagaaucucguaccaaacccuucaccgucccuauccugacugucgaagaaaugacaaacucccgauuccccauuccucucgaaaaacuauucacaggacccuccucagccuucgucguccaaccccaaaacggccgauguaccaccgacggaguccuccuaggcaccacccaacucucccccgucaacaucugcacauuccgcggcgacgucacucacaucgcgggaucccguaacuacaccaugaaccuagccagccuaaacuggaacaacuacgaccccaccgaagaaauccccgccccacucggcaccccagacuucguuggaaaaauccaaggaguccucacccaaaccacaaaaggugauggcuccacccgcggccacaaagcaaccguauacaccggcucagcacccuucacacccaaacuuggauccguccaauucuccaccgacaccgaaaacgacuucgaaacacaccaaaacaccaaauuuacccccgucggugucauucaagacggaggcacuacccaccgcaacgaaccccaacaauggguacuccccucguacagcggucgaaacguaccuaacguccaccucgcuccagccgucgcucccaccuuccccggagaacaacuccuauuuuuccgcucaaccaugcccggcugcuccggcuacccuaacauggaucucgacugccuccuaccacaagaauggguacaacacuucuaccaagaagccgcacccgcccaaucagacgucgcucuacuacgguucgucaaccccgauaccggccgcguccucuucgaaugcaaacuacacaaaucaggauacguaaccgucgcccauaccggccaacacgaccuagucaucccacccaacgguuacuuccgauucgacuccuggguaaaccaguucuacacccucgcucccaugggcaacggcaccggacgccgacgauag

SEQ ID NO: 38997 - RNA, 1617 nt, Artificial Sequence
  derived and/or modified sequence opt11 from VP1__Norovirus_and/or_Norovirus-like__KM982942
augaaaauggccuccuccgacgccaaccccucugacggauccgccgccaaccuuguccccgaagucaacaacgaagucauggcccuggaaccaguugucggagccgccaucgccgccccaguugccggccaacaaaacgucaucgacccguggauccgaaacaacuuuguccaagcccccggcggagaguucacagucucgccucgaaacgccccgggcgaaauccuaugguccgcaccccucggccccgaccucaacccauaucucucacaccucgcacgaauguacaacggcuacgcgggcgguuucgaaguacaagucauacucgcaggcaacgccuucaccgccggcaaagucauauucgccgccgucccucccaacuuccccaccgaaggccucuccccaucacaagucaccauguucccccacaucguuguagacguccgacaacucgaaccaguccucaucccgcucccagacguacguaacaacuucuaccacuacaaccaaagcaacgacccaaccaucaaacugauagcuaugcucuacacaccacuuagagccaauaacgccggcgacgaugucuucaccgucucgugccgcguccuaacccgaccuucacccgacuucgacuuuauauuccucguaccacccaccguugaaagccgaacaaaacccuucuccguucccguacucacugucgaagaaaugaccaacucccgauuccccauccccuuagaaaaacucuucaccggucccuccucagcguucgucguccagccccaaaacggccgcuguaccaccgacggaguacuccucgguaccacacaacucucacccguaaacaucugcaccuuccguggcgaugucacccacaucacgggcucacacaacuacaccaugaaccuugcaucacagaacugguccaacuaugaccccacugaagaaauucccgcaccccucggcacacccgacuucgucggcaaaauccaaggaguacuaacccaaaccacccgcacggacggcucaacccgcggccacaaagccacagucuacaucggauccgcagacuucgcccccaaacuaggacgcguccaguucgaaacagacaccaaccacgauuucgaagcaaaucaaaauaccaaauucaccccaguuggaguaauacaagacggcggaaccacccaucgaaacgaaccccaacaauggguccuacccuccuacucaggacgcaacaccccaaacguccaccuagcccccgccgucgcccccaccuuccccggcgaacaauuacucuucuuccgaucuaccaugccaggcugcuccgguuaccccaacauggaccucgauugccuacuaccacaagaauggguccaauacuucuaccaagaagcagccccugcgcaaucagacgucgcccuccuccguuuugucaacccagacacaggccgaguccucuuugaaugcaaacuccauaaauccggcuacgucaccgucgcccacacaggacaacacgaccuagucaucccgcccaacgguuauuucagauucgacucacgagucaaccaguucuacacgcuagcccccaugggcaacggcacgggccgccgacgauaa

SEQ ID NO: 38998 - RNA, 1617 nt, Artificial Sequence
  derived and/or modified sequence opt11 from VP1__Norovirus_and/or_Norovirus-like__KJ685417
augaaaauggccuccuccgacgccaaccccucagacggcuccacagccaaccuuguaccagaaguaaacaaugaagucauggcccucgaacccgucgucggcgccgcaaucgccgcccccgucgccggccaacaaaacgucaucgacccauggauccgcaauaacuucguccaagccccgggcggagaguucacugucuccccacgcaacgcccccggcgaaauccuauggucagcuccccuaggcccagacuuaaacccauaccuaucacaccucgcccggauguauaacggauacgcgggcggguucgaaguccaagucauccucgccggcaacgccuucaccgccggcaagaucaucuucgccgccgucccucccaacuuccccaccgaaggccuuagccccucccaagucaccauguucccacacauaaucguagacguacgucaauuagaacccguccucaucccucuacccgacguccgcaacaacuucuaccacuacaaccaaagcaacgauuccacgaucaaacuaauagccaugcuguauacaccccuccgcgcaaacaacgccggagacgacgucuuuaccguaucuugccguguccucacccgccccagccccgacuucgacuucauauuccucguaccucccaccgucgaaagccgcaccaaacccuucucgguccccguccucaccgucgaagaaaugacaaacucucgcuuccccaucccccuagaaaaacucuucaccggacccagcuccgccuuuguaguacaaccccaaaacggccgcugcacaaccgacggcguccuucucggaaccacccagcucuccccagucaacaucugcacauuccgcggagacgucauucacaucucaggcucacgcaacuacacaaugaaccucgcaucccaaaacuggaacucauacgacccaaccgaagagauccccgcaccccucggcacaccugacuucgucggcaaaauccaaggaguccucacccaaaccacccgcacagacgguuccacccgaggacacaaagcaaccgucuacaccggcuccgccgacuucagccccaaacuaggucguguacaauuugcaacugacacagacaacgacuucguaaccaaccaaaacacaaaauucaccccagucggcgucauacaagacggaucaacuacaccccgaaacgaaccacaacaauggguacucccguccuacucuggccgcaacacccauaacguccaccucgcacccgccguagccccaaccuuccccggcgaacagcuacuauucuuccguuccacaaugccaggcugcuccggcuaucccaacauggaccucgauugccuacucccccaagaauggguccaguacuucuaccaagaagcugcacccgcccaauccgacguagcccuccuccgguucguaaacccugacacaggucguguccuauucgaaugcaaacuccacaaauccggcuacgucaccgucgcccacaccggccaacacgaccucguaauacccccaaaugguuacuuccgcuucgacuccugggucaaccaguucuacacacucgcaccaaugggcaacggcaccggucgccgcagauga

SEQ ID NO: 38999 - RNA, 1617 nt, Artificial Sequence
  derived and/or modified sequence opt11 from VP1__Norovirus_and/or_Norovirus-like__KC907392
augaaaauggccuccaacgacgccacacccucagacggcagcaccgccaaccucguacccgaagucaacaaugaaguaauggccuuagaaccugucgucggcgccgccauagccgcccccgucgccggccaacaaaaugucaucgacccauggauccgcaacaacuucguacaagcacccggaggcgaguucaccgucuccccacgcaacgcccccggagaaauccucuggucagccccuuuaggaccugaccucaaccccuaccucucacaccuagcccgcauguacaauggauacgcaggcggcuucgaaguccaagucauccuggccggcaacgcuuucacugccggaaaaaucaucuucgccgccguaccucccaacuuccccaccgaaggccucucccccucccaaguuaccauguucccacacauaaucgucgacguccgccaacuugaacccguacucauaccccuacccgauguccgaaacaacuucuaucacuacaaccaauccaacgaccccacuauuaaacuuaucgcaaugcucuacacaccccuccgagcaaacaacgcaggcgacgacgucuucaccgucuccugucgcguacuuacucgcccaucccccgacuuugacuucaucuuccuagucccacccaccgucgaaucucgcaccaaaccauucuccguccccauacugacaguugaagaaaugaccaauucgcgauccccaaucccacucgaaaaauuauucaccggacccucauccgccuucguaguccaaccccaaaacggucgcugcacaaccgacggcguacuacucgguacgacucaacucagcccagucaacauuugcaccuucagaggcgacguugcccacauagcaggcacccaaaacuacacgaugaaccuggccucccaaaacuggaacaacuacgaccccacagaagaaauccccgcaccccucggaacaccaaacuucgucggcaagauucaaggaguccucacccaaaccaccaaacgcgacggcucaacccgcggccgcaaagccaccgucucaaccggcucaguccacuucacccccaaacucggauccguccaauucuccacagacaccuccaacgacuucgaaaccggccaaaacaccagauucacaccugucggcguuguccaagacggaucaaccacccaccgcaaugaaccacaacaauggguucuacccgacuacuccggccgcgacagccacaacguacaccucgcacccgcagucgccccgaccuuccccggugaacaacuacucuucuuccgcuccuccaugcccggaugcuccggauaccccaacauggaccuagacugccuucucccacaagaauggguccaacacuucuaccaagaauccgcacccgcacaauccgacguugcccuucuccgauucguuaaccccgacaccggacgaguauuauucgaaugcaaacuccacaaauccggcuacguaacuguagcacacaccggccaacacgaccucgucaucccucccaacggcuauucccgauucgacuccugggucaaccaguucuacacacucgcccccaugggcaacggcgccggccgccgccgcuaa

SEQ ID NO: 39000 - RNA, 1617 nt, Artificial Sequence
  derived and/or modified sequence opt11 from VP1__Norovirus_and/or_Norovirus-like__KC517377
augaaaauggcuagcucagacgccaacccguccgacggcucggccgcaaaccuagucccugaagucaacaacgaagucauggcccuagaaccuguaguaggagccgcaaucgcagcccccgucgcaggccaacaaaacgucauugacccuuggauccgcaacaacuucguccaggcccccggcggcgaguucacagucuccccacgcaaugccccuggcgaaauccucugguccgccccgcuaggaccagaccucaacccuuaccucucccacuuagcccgaauguacaacggcuacgccggcggcuucgaaguccaagucauccucgcaggcaacgccuucacagcgggaaaaguaauauucgcagccgucccacccaacuuccccaccgaaggacucucccccucccaagucacgauguuuccccacaucguugucgacguacgucaacuagaacccguccuaauaccacuccccgacguuagaaacaacuucuaccacuacaaccaauccaacgaccccaccaucaaacuaauagcaaugcuauacgcuccccugcgagccaacaacgccggcgacgacgucuucacagucucaugccgaguacucacccgacccucccccgacuucgacuucauuuuucuugucccacccacugucgaaucaagaacaaaacccuucucuguacccguacugacuguagaagaaaugaccaacagccgauuccccaucccacucgaaaaacucuucaccggucccuccagcgccuucgucguacaaccccagaacggcagaugcaccacagacggcguccuacucggcaccacccaacucucaccagucaauaucugcacauuccgcggcgacgucacacacaucaccggaucccgcaacuacacaaugaaccucgcuucccaaaacuggaacaacuaugacccaacagaggaaauccccgcuccccugggcaccccagacuuugucggcaaaauacaaggcguccuaacccaaaccacccgcacugacggcuccacccgcggccacaaagccaccgucuacacaggcuccgccgacuucgcccccaaacuugguagaguacaauucgaaacagacacagaucacgauuucgaagccaaccaaaauaccaaauucacccccgucggagucauccaagacggagguaccacacaccgcaacgagccccaacaguggguauuaccaucauauuccggucgaaacacccauaacguacaccucgccccggccguagcccccaccuuccccggcgaacaacuacuauucuuccgcuccaccaugccuggaugcucuggcuacccgaacauggaccucgacugccuccucccccaagaauggguucaguacuucuaccaagaagccgcccccgcccaaucagacgucgcccuccuccgcuucgucaaccccaacacaggccgcguacucuuugagugcaaacuccacaaauccggauacgucaccguagcccacaccggccaacacgaccuagucaucccacccaacgacuacuuccgcuucgacagcuggguuaaccaauucuacacccucgccccuaugggcaacggcaccggccgacgacgcuaa

SEQ ID NO: 39001 - RNA, 1617 nt, Artificial Sequence
  derived and/or modified sequence opt11 from VP1__Norovirus_and/or_Norovirus-like__KC517368
augaaaauggccucaaacgacgccaaccccuccgacgguucagccgccaauuuaguccccgaaguaaacaacgaagucauggcccucgaacccguggugggagccgccaucgcagcacccgucgccggacaacaaaacgucaucgacccauggauccgcaacaacuucgcccaagcccccggaggagaauuuacagucucaccccgcaacgcccccggagaaauccucugguccgcaccccucggcccagaccucaacccauaccuaucccaccuagccagaauguacaacggcuacgccggaggcuuugaaguccaagucauccuagcagaaaaugcauucacagccggcaagaucauauuugccgccguaccucccaacuuccccaccgaaggccucucccccucacgcguaaccauguucccucacauaauagucgacguccgccaacucgaacccguccuaaucccacucccagacguccgaaacaacuucuaccacuacaaccaauccaaugacuccacaauaaaacucaucgccaugcucuacacgccccuucgcgcaaacaacgcaggagaagacgucuucaccgucucaugccgcguccucaccagacccuccccagacuucgacuucauuuuccuaguacccccgaccgucgaaucacgcacaaaacccuuuacagucccaauauuaaccgucgaagaaacuaccaacucccgcuuccccaucccccucgaaaaacucuucaccggccccucauccgccuucguaguccaaccacaaaacggacgcugcaccaccgacggcguccuacucggcacaacacaacuaagccccguuaacaucugcacguuccgaggagauguuacccacauugccggcucccgcaacuacaccaugaaccucgcaagccucaacuggaauaacuacguacccacggaagaaauccccgcaccccuaggcacacccgacuuugucggcaagguacaaggcaugcucacccaaacaaccaaaggcgacggcagcaccagaggacacaaggccaccgucuacaccggcucagcccccuucacgccgaaacucggaucaguccaauucgaaacagacaccgagaacgacuucgaaacacaccaaaacaccaaauucacccccguaggcgugauccaggacggcggcacaacacaccgcaacgaaccacaacaauggguccuacccuccuacucaggccgcaacgugccaaacguccaucucgcccccgcaguagcccccaccuuccccggcgaacaacuccuuuucuuccgcuccaccaugcccggcugcuccggcuaccccaacauggaccucgacugccuucucccccaagaauggguacaacacuucuaccaggaagccgccccugcccaaucagacgucgccuuauuacgauuugucaaccccgauaccggccgcguccuuuucgaaugcaaacuucacaaaucaggauacgucacagucgcacacaccggccaacaugaccucgucauaccacccaauggcuacuuccgauucgacucaugggucaaccaauucuacacccucgcacccaugggcaacggaacaggccgccgccgauaa

SEQ ID NO: 39002 - RNA, 1617 nt, Artificial Sequence
  derived and/or modified sequence opt11 from VP1__Norovirus_and/or_Norovirus-like__AB541310
augaaaaugcgauccuccgacgcaaaccccuccgacggcuccaccgccaaccucgucccagaaguaaacaacgaagucauggcccucgaaccuguagucggcgccgccaucgcagcaccuguagcuggccaacaaaacgucaucgaccccuggauccgcaacaacuucguccaagcacccggcggagaauuuaccguauccccacguaacgccccuggagaaauccucuggucagccccucucggccccgaccuuaacccauaccuaucccaccuagcacgcauguacaacggguacgcaggagguuucgaaguccaaguaauccuggcaggaaacgcauucacagccggcaagaucauauucgcagccgucccacccaacuucccaacagaaggccuaucaccuucacaagucacuauguucccgcacaucaucgucgacgucagacaacuugagccggucuuaaucccccuucccgacguacgaaacaacuucuaccacuacaaccaaagcaaugacccaaccaucaaacucaucgccaugcucuacacgccacuccgcgcgaacaacgccggcgacgacguauucacaggcuccugccgcguccugacccgucccucucccgacuucgacuucaucuuccucguacccccaacugucgagucacgcaccaaaccauucucagucuccuuuuucaccggcgaggaaaugaccaacucucgauuccccaucccccucgaaaaacuauuuacaggccccaguucagcauucgucguccagccacaaaacggccgcugcaccacagacggcguccuacuuggcacaacccaacuaagcccagucaauaucugcacauuccgaggcgaugucacccacauaaccggcucccgcaauuacaccaugaaccucgcaacacaaaacuggaacuccuacgaccccaccgaagagauucccgcaccccucggaaccccagacuucguaggcaaaauccaaggcguccucacccaaaccacacgcgccgacggcucaacacgaggacacaaagcaaccgucuacaccggcagcgccgacuucgcccccaaacucggccgcguacaauucgcaaccgacaccgauaacgacuucgacgcgaaccaaaacaccaaauucacccccguaggcgucauccaagacggcgacacugcccaccgcaacgaaccccaacaauggguccuacccucuuacuccggacguaacucacacaacguccaccucgcccccgccguugcccccacauucccaggagaacaacuccucuucuuccgauccaccaugccuggcugcuccggcuaccccaacauggaccuagacugccuccucccccaagaauggguacaauacuucuaccaagaagcagcccccgcccaauccgacgucgcacuccuccgcuucgucaacccugacacaggccgcguucucuucgaauguaaacuacacaaauccggcuacguaacagucgcacacaccggccaacacgaucuaguaauaccacccaauggcuacuuccgauucgacucauggguaaaccaauucuacacccucgcccccaugggcaacggaaccggccgcaggcgcuaa

SEQ ID NO: 39003 - RNA, 1617 nt, Artificial Sequence
  derived and/or modified sequence opt11 from VP1__Norovirus_and/or_Norovirus-like__EF535854
augaaaauggcuaccaacgacgccuccccaucagacggcagcacagcuaaccucguaccagaagucaacaacgaagucauggcauuagaacccgucgucggcgccgccaucgccgcccccgucgcuggccaacaaaacgucauugacccauggauccggaacaacuucguccaagcaccgggcggagaguucacugucagccccagaaacgcacccggcgaaauccucuggucagccccucuaggcccagaucucaaccccuacuuaucccaccuugcccguauguauaacgguuacgccggcggcuucgaaguugaagucauccucgccggcaacgccuucaccgcaggcaaaauuaucuucgccgccgucccgcccaacuuccccaccgaaggccucucccccucacaaguaacaauguucccacacauaaucgucgacgugcgccaacuugaacccguacucauccccuuacccgacguacgcaacaacuuuuaucacuacaaccaauccaacgauucuacaaucaaacugaucgccaugcucuacacuccccuccgcgcaaauaacgccggagacgacgucuucaccgucuccugccgcguucucacccgccccucgccagacuuugacuucaucuuccucguacccccaaccgucgaaucacgcaccaaaccuuuuaccgucccaauccucaccgucgaagaaaugacuaacucccgcuuucccaucccucuggaaaaacucuucaccggccccuccagcgcucucgucguacaaccccaaaacggccgcugcacgacagacggcguccuccucggcaccacccaacuaucccccgucaacauauguaccuuccguggagacgucacacacaucucuggcacacgcacauaccguaugaaccucgccucccaaaacuggaacaacuacgaucccacagaagaaauacccgcaccacuaggcacucccgacuucgucggcaaaauacaaggcaugcucacacagaccacaaaaggcgacggauccacacgagggcacaaagccaccgucuccaccggcuccgucgacuucacccccaaacucggaucuguccaauucgcaaccgacacagacaacgacuucgaaacgggccaaaacacacgcuucacccccgucggaguaauccaagacggaucaucugcccaccgaaacgaaccccaacaauggguacucccagacuacucaggccgaaccguccacaacguccacuuagcccccgccguagcccccaccuuccccggcgaacaacuccccuucuuccgauccaccaugcccggaugcuccggauaccccaacauggaucucgacugccuccuaccccaagaauggguccaacacuucuaccaagaagcagccccaagccaaucugaugucgcccuccuccgcuucguuaaccccgacaccggucgcguccucuucgaaugcaaacuucacaaagccggcuacgucacagucgcacacacaggccaacacgaccuggucauacccccaaacggcuauuuccgauucgacucauggguaaaccaaucuuacacccuagcacccaugggaaauggagcaggucggcgccgauaa

SEQ ID NO: 39004 - RNA, 1617 nt, Artificial Sequence
  derived and/or modified sequence opt11 from VP1__Norovirus_and/or_Norovirus-like__KX514368
augaaaauggccuccaacgacgccaaccccucugauggcagcgccgccaacuuaguccccgaaguuaacaacgaaguaauggcccucgaaccuguagucggugccgcuauugccgcaccagucgcaggccaacaaaacguaauagaccccuggauccgcaacaacuucguccaagccccaggcggagaguucacagucuccccucgcaacgccccaggcgaaauacuauggucagcaccacuaggacccgaccucaaccccuaccuaucccaccucgcacgcauguacaacggauacgccggcggcuucgaaguacagguaauccucgccggaaacgcauucaccgcaggaaaaaucauauuugccgccgucccaccaaacuuccccacagaaggacucuccccgagccaagucaccauguucccccacaucaucgucgacguccgccaacucgaaccaguccuaaucccacuaccagacguucgcaacaacuucuaccacuacaaccaaucaaacgacagcacaaucaaacucaucgccaugcucuacaccccacuacgcgccaacaacgcaggagacgacgucuucacaguaucaugccgcguccuaacacgccccagccccgacuucgacuucaucuuccucgucccacccaccgucgaaucacgaucaaaaccauucucaguucccgugcucacaguagaagaaaugaccaacagcagauuccccgccacccucgacaaacuauuuaccggcccaucuuccacauucgucguccaaccccaaaacggucgcugcaugauagacggaguacuccucggcaccacccaacucuccccugucaacaucugcaccuuucguggcgacgucacucaccccggcaacagcaaaaucuacacaaugaaccucgcguccccaaauuggaauaacuacgacccaacggaagaaauccccgcaccccugggcacacccgacuucgucggcaaaauccaaggaaugcuaacacaaacaaccaaaggcgaaggcagcacccguggucaccgagcuaccgucuaugucggcuccgccaacuacgccccaaaacucggccgcgugcaauucgaaaccgacaccacagacgaccuagacgcacaccaaaacaccaaauuuacccccguaggcguaguccaaggaggcgaaucccccaaagguuccgaaccacaacaauggguccuccccuccuacuccgggagagacaccccaaacguccaccuggccccagccgucgcuccaacauucccaggcgaacaacuucuauucuuccgcagcacaaucccaggaugcgguggacaccccaacaugaaccucgacugccuccucccccaagaauggguacaacacuucuaccaagaagccgcccccgcccaaucagacguugcccuacuccgcuucguaaaccccgacaccucaagaguccucuucgaaugcaagcuccacaaaucuggcuacgucaccgucgcccacacaggccaacacgaccucgucauaccaccuaacgguuacuuccgcuucgauuccugggucaaccaauucuacacccucgcccccaugggcaacggcaccggacgcaaacgcuaa

SEQ ID NO: 39005 - RNA, 1617 nt, Artificial Sequence
  derived and/or modified sequence opt11 from VP1__Norovirus_and/or_Norovirus-like__KX514351
augaaaauggcauccaacgaugccaaccccuccgacggcuccaccgccaacuuaguucccgaaguuaacaaugaagucauggccuuagaaccaguggucggcgcagccaucgccgcccccguagcaggacaacaaaaugucaucgaccccuggauccgcaacaauuucguccaagccccgggaggcgaguucaccgucuccccacgcaacgccccaggcgaaauccugugguccgcaccccucggccccggacucaaccccuaucucagccaccucgcccgcauguauaacggcuacgcaggcggcuucgaaguucaggucauacucgccggaaacgccuucaccgcaggcaagaucaucuucgccgccguacccccaaacuucccaacagaaggacucaaccccucucaagucaccauguucccccacauaauuguagacguccgccaacuagaaccuguucucauaccacuccccgauguccgcaacaacuucuaccacuacaaccaaucuaacgacuccacuaucaaacucaucgccaugcucuacacaccccuccgcgccaacaacgccggcgaugacgucuucaccgucuccugccgcguccucacccgccccucucccgacuucgacuucaucuuccucguacccccuaccgucgaaucccgguccaaaccuuuuucaguccccguacucaccguccaagaaaugacaaacucccgcuuccccgccacacuagacaaacucuucaccggcccaagcuccaaucucguaguccaaccccaaaacggccgaugcaugaucgacggcguccuucuaggcaccacccaacucucccccgucaacaucugcaccuuccgcggcgacguaacccaccuccgagacagcaccaucuacaccaugaaccucgcaagucccaacuggaacaacuacgaccccaccgaagaaauacccgccccacucggcacccccgauuucguaggcaaaauccaaggcguacuaacacaaacaaccaaaggcgaaggcuccacucgcggccaccgagcaaccgucuacgucggcuccgccaauuacaccccaaaacucggcaagguccaauuugaaaccaacacaacaaacgaccuauaugcccaccaaaauaccaaauucacaccggucggagucguccaaggcggagaauccgcccaccgcucagagccccaacaauggguccuccccggcuucucaggcagagacaccccaaacguccaccuagccccugccguagcccccaccuuccccggagaacaacuacucuucuuccgaagcaccauucccgguugcggagggcaccccaacauggaccuagacugccuccucccccaagaauggguccaacacuucuaccaagaagccgcaccagcccaauccgaugucgcacuacucagauucguaaacccagacaccucucggguucuuuucgaaugcaagcuccacaaaucaggcuacguaaccguugcccauaccggacaacacgaucuaguaauacccccaaacggauacuuucgcuucgacucaugggucaaccaauuuuacacccucgccccaaugggaaauggaacaggacgcaaacgauaa

SEQ ID NO: 39006 - RNA, 1617 nt, Artificial Sequence
  derived and/or modified sequence opt11 from VP1__Norovirus_and/or_Norovirus-like__KC517372
augaaaauggccucaaaugacgccaauccuuccgacggcuccgccgucaaccucguucccgaagucaacaacgaaguuauggcccucgaacccguugucggcgccgccaucgccgcucccgucgcaggccaacaaaacguaauagaccccuggauucgcaacaacuuuguccaagccccaggcggagaguucacaguuuccccacgaaacgcacccggcgaaauccucuggucagccccucucggccccgaccuaaacccuuaccuaucacaccucgcucgcauguacaacggcuacgccggcgguuucgaaguccaaguaauccuagccggaaacgcauucaccgcgggaaagauaauauucgccgcuguacccccuaacuuccccaccgaaggccucucucccucccaagucaccauguucccgcacauuauaguagacgcaagacaacuagaacccguccuuauaccgcuacccgacguccgcaacaacuuuuaccacuacaaccaaagcaacgacucgacuaucaaacucaucgccaugcucuacacaccacuacgcgccaauaacgccggagaagacgucuucaccgucuccugccgaguacucacucgcccaucucccgacuucgacuucauuuuccucguacccccaaccgucgaaucucgcacaaaacccuucacaguccccauccuaacugucgaagaaaugaccaacuccagauucccaauaccccucgaaaaacucuucaccggaccuuccuccgcauucgucguccagccccaaaacggucguugcaccaccgacggcguccuccuaggcacaacccaacucagcccagucaacaucugcacauuccgcggagacgucgcccacaucgcaggcucacgaaacuacaccaugaaccuugcaucccucaacuggaacaauuacgaccccaccgaagaaauccccgcaccccuaggcacccccgacuucgucggcaaaauccaaggcaugcucacccaaacaacaaaaggagacgguucaacucggggccacaaagccaccgucuacaccggcagcgcccccuucacccccaaacuaggcuccguccaauucgaaaccgacaccgagaacgacuucgagacccaccaaaacaccaaauucacccccgucggcguaauucaggacggcgguacaacacaccgaaaugaaccacagcaauggguccuccccucauacuccggacgcaacgucccuaacguucaccuagcccccgccguagcccccaccuucccaggcgaacaacuccuccuauuccguucaaccaugcccggcugcuccggguauccuaacauggaccuagacugccuccucccccaagaauggguccaacacuucuaccaagaagccgcaccagcacaaagcgacgucgcccuucuccgauucgucaacccagacacaggccgcguacucuucgaauguaagcuacacaaauccggcuaugucaccguagcccacaccggccaacacgaucuggucaucccacccuccggcuacuuccgcuucgacucuugggucaaccaauucuacacccuagcccccaugggcaaugguaccggccgccgacgcuaa

SEQ ID NO: 39007 - RNA, 1617 nt, Artificial Sequence
  derived and/or modified sequence opt11 from VP1__Norovirus_and/or_Norovirus-like__JN400613
augaaaauggcaaguaacgacgccaacccauccgacggcucugccgccaaccucguccccgaagucaacaacgaaguaauggcccuagaacccgucguuggcgcugccaucgccgccccugucgcuggacaacaaaacguuaucgauccuuggauccguaacaacuucguccaagcacccggcggcgaguucaccguuucaccccgcaaugcacccggugaaauacucugguccgcuccgcucgggccagaccuuaacccauaccucucucaccucgcgcgcauguauaacggauacgcuggcggcuucgaaguccaggugauacucgcgggcaacgccuucacagccggcaaaaucauuuucgccgcgguuccacccaacuuccccaccgaaggacucucacccucccaaguuacaauguucccccacaucaucguagacguccgccaacucgaacccguacucaucccccuacccgacguacgcaacaacuucuaccacuauaaccaauccaacgacuccaccaucaagcucaucgcaaugcucuauacgccucuccgagcaaacaacgccggugaagacgucuucacagugagcugccgcguccucacacgacccuccccagacuucgacuucaucuuccuuguaccacccaccgucgaaucacgcacuaaaccauucacaguaccaauacucaccgucgaagaaaugaccaacucccgcuucccaaucccacucgaaaaacucuucagaggccgaucaucagcccuagucguacauccccaaaacggccgcuguaccaccgacggcguccuccuuggcacaacccaacucaguccagucaacaucugcaccuucagaggcgacgugacucacaucgcuggcucucacaacuacaccaugaaccucgcaucacugaacuggaacaacuacgaccccaccgaagaaauaccugcaccccucggcacacccgacuucgucggcaaaauccaaggaguccucacucaaaccacuaaaggcgacggcucaacacgcggccacaaagccacagucuacacaggcuccgcccccuucacucccaaacucggaucaguccaauucucaaccgacaccgaaaacgacuucgaaacacaccaaaauaccaaauucacaccagucggcgucauccaagacggaagcacaacacaccguaacgaaccccaacaauggguucuccccucauacucaggcggcaauguacacaacguacaccucgccccagccgucgcccccacauuccccggagaacaacuccuuuucuuucguucaaccaugcccgggugcucaggcuaccccaacauggaccuugacugccuacucccccaagaauggguccaacauuucuaccaggaagccgccccugcgcaaucagacgucgcccuacuccgcuucgucaacccugacacugguagaguccuauucgaguacaaacuccacaaaucagacuacgucaccguagcucacacaggccaacacgacuuagucaucccacccaacggcuauuuccgauucgauuccugggucaaccaauucuacacccucgcagcaaugggaaacggcaccggccgacgccgcuaa

SEQ ID NO: 39008 - RNA, 1617 nt, Artificial Sequence
  derived and/or modified sequence opt11 from VP1__Norovirus_and/or_Norovirus-like__KX514291
augaaaauggccuccaaugacgccaaccccucagacggcagcgccgccaaucucguacccgagguaaacaacgaagucauggcccuggagcccgucgucggugcagccaucgccgccccagucgcaggucaacaaaacguaauagacccuuggauacgcaacaacuucguccaagccccaggaggcgaguucaccguaucuccccgaaacgcgcccggcgaaauccucuggucagcuccccuaggcccagaccucaacccauaccucucccaucuugcccgaauguacaacggcuacgcaggaggcuucgaaguccaaguaauacuggccggcaacgccuuuaccgccggcaaaaucaucuucgccgccgucccacccaacuucccaaccgaaggccucuccccaucucaaguaaccauguucccccacauaauuguagacguccgccaacucgaacccguccucaucccccuccccgacguccgcaacaacuuuuaucacuacaaccaaucaaacgacuccaccauaaaacucauagcaaugcucuacaccccucuccgagccaacaacgccggcgacgacgucuucaccguauccugccguguccuaacccgccccuccccagacuucgauuucauauuccuaguacccccgaccgucgaaagccgcuccaaaccauucucggucccuguacuaacagucgaagaaaugaccaauuccagauucccagcaacacucgauaaacucuucaccggccccuccuccacauucgucguccaaccucaaaacggacgcugcaugaucgacggaguacuccucggaaccacccaacuaucccccgucaacaucuguaccuuccgcggcgacgucacucaccccagagacucacccauauacacuaugaaccucgcaucucccaacuggaacaacuacgacccaacagaggaaauacccgcccccuuaggaacucccgacuucacaggcaaaauccaaggcaugcugacccaaaccaccaaaggagaaggcagcacacgcggccaccgcgcaacaguauacgucggcuccgcaaacuaugccccaaagcucggccgaguccaauucgaaacagacaccacaaacgaccucgacgcccaucaaaauaccaaauuuacccccguaggcgucauccaaggcggagaguccgcccacagaucagaaccucaacaauggguccuccccuccuacucuggccgugacacucccaauguacaccuagcgcccgcugucgcccccacauucccaggcgaacaacuacucuuuuuccgcucgaccauccccggcugcggcggacacccaaacaugaaccuagacugccuauuaccccaagaauggguucagcacuucuaccaagaagcagcccccgcacaaucagacgucgcacuacugcgcuuugucaaccccgacacaucacgaguacucuuugaaugcaaacuccacaaauccggcuaugucaccgucgcccauaccggccaacacgaucucguaaucccacccaacggauacuuccgcuucgacucaugggucaaucaauucuacacccucgcccccaugggcaacggaaccggccgcaaacgauaa

SEQ ID NO: 39009 - RNA, 1617 nt, Artificial Sequence
  derived and/or modified sequence opt11 from VP1__Norovirus_and/or_Norovirus-like__KX514219
augaaaauggccucaaacgacgccaacccaucugacggcucagccgccaaccucgucccugaagucaacaacgaagucauggcccuugaacccguaguaggcgccgccauagccgcgcccguggccggccaacaaaacguuaucgacccuuggauccgaaacaacuucguccaagcccccggaggcgaauuuaccgucucaccccgcaacgcacccggcgaaauacuuuggucggcaccccuuggacccgaucuaaaccccuaucucucccaccucgcccgaauguacaacggcuacgccggcggcuucgaaguccaagugauacuagccgguaacgccuucaccgccggcaagaucaucuucgccgccguacccccuaacuucccuaccgaaggauuauccccaucccaagucaccauguucccccauaucaucgucgacguccgccaacuggaaccaguccuaaucccacuaccagacguacgaaacaacuucuaccacuacaaccaauccaaugauucuacaauuaagcucauugccaugcucuacacaccccuccgcgccaacaacgccggcgacgacgucuucaccgucagcuguagaguucucacccgccccuccccugacuucgacuucauuuuccucgucccacccaccguugaaucacgcuccaaacccuucucaguccccguccuaaccgucgaagaaaugacaaauucccgguuccccgccacucucgacaaacucuucaccggccccagcucaaccuucguuguucaaccccagaacggacgcugcaugaucgacggcguccuacuaggcacaacucaacucuccccagucaauaucuguaccuuccgaggcgacguaacccacccgcgcgacuccccaaucuacaccaugaaccucgccucuccaaacuggaacaacuacgaccccacagaagaaauccccgcaccccucggaacacccgacuucgucggcaaaauccaaggcaugcuaacccaaacaacuaaaggcgaaggcucaacacgaggccaccgcgcaaccgucuauguaggauccgccaacuacgcucccaaacucggccgcguccaauucgaaaccgacacaaccaacgaucucgacgcccaucaaaacaccaaauucaccccagucggugucguacaaggcggcgaaucaccccaacgcuccgaaccccaacaauggguacuccccuccuacuccggcagggauacccccaacguacaccuugccccagccguagccccaaccuuccccggcgaacagcucuuauuuuuccgauccacccuccccggcugcggcggccaccccaacauggaccuagauugucuacuaccccaagaauggguccaacacuucuaccaagaagccgccccagcacaauccgacgucgcccuccuacgauucgucaaccccgacaccucccgcguacucuucgaaugcaaacuccacaaaagcggcuacgucaccgucgcccacacuggacaauacgaucuaguccuacccucaaacggguacuuucgcuucgacucaugggucaaccaauucuacacccucgcacccauggguaacggcacaggcagacgccguuga

SEQ ID NO: 39010 - RNA, 1617 nt, Artificial Sequence
  derived and/or modified sequence opt11 from VP1__Norovirus_and/or_Norovirus-like__AB933668
augaaaauggccucaaacgacgcuaacccaucugauggcuccgccgccaaccucgucccagaagucaacaacgaagucauggcccucgaaccagucgucggcgccgcaauagccgcacccgucgcgggacaacaaaacguaauagaccccuggauucguaacaacuucguucaagcaccgggaggagaauuuaccguuuccccacgaaacgccccaggugagauccucugguccgcaccccucggcccagaucucaacccuuaccucucccaccucgccagaauguacaacggauacgccggcggcuucgaaguucaagucauccuagcaggcaacgcauucaccgucgucaaaacaacccuauccgcuguacccccgaacuuccccaccgaaggccuaucccccucccaagucaccauguucccccacauuaucgucgacguaagacaacucgaacccguacuaaucccacuccccgacguccguaacaacuucuaccacuacaaucaguccaacgacuccacaaucaaacucaucgccauguuauacacuccacuacgcgccaacaacgccggcgaggacguauucacagucuccugccgcguucucacccgccccagccccgauuucgacuucauauuccuggucccacccaccgucgaaucucguaccaaacccuucaccgucccaauccucacaguagaagaaaugacaaacucacgcuuccccaucccacucgagaaacucuucaccggccccucaagcgcauucguuguccaaccacaaaacggacgaugcacaaccgacggagucuuacucggcacaacacaacucucccccgucaacaucugcacauuccgaggagacgucacccauaucgcaggaucacgaaacuauacaaugaaccucgccucacuaaacuggaacaacuacgaccccaccgaagaaaucccugcaccccuaggcacaccagacuucgucggcaaaauacaaggcguacucacccaaaccaccaaaggagacggcuccacacgcggccacaaagccaccguauacacaggaucagccccauucaccccaaaacuaggcucaguacaguucuccacagacacagaaaacgacuucgaaacccaccaaaauaccaaauucacccccgucggagucauccaagacggaggcacaacccaccggaacgaaccccaacaauggguccuccccuccuacagcggacgaaacgucccaaacguacaccucgcccccgccgucgcacccacuuuccccggcgaacaacuucucuucuuccgcucaaccaugccaggcugcuccgguuacccaaauauggaucucgacugccuucucccacaagaauggguccaacacuucuaccaagaagccgcuccagcccaauccgacgucgcccuccuccgcuucguuaacccagacaccggaagaguacucuucgaaugcaaacuccacaaaucuggcuacgucacagucgcccacacaggccaacacgaccucgucaucccacccaacggcuacuuccgcuuugacuccugggucaaccaauucuacacccuugcacccauggguaauggcaccggccgccggcguuaa

SEQ ID NO: 39011 - RNA, 1617 nt, Artificial Sequence
  derived and/or modified sequence opt11 from VP1__Norovirus_and/or_Norovirus-like__KJ678149
augaaaauggccuccuccgacgcuaaccccuccgacggcuccgccgcaaaccuaguccccgaagucaacaacgaaguaauggcacuugaacccguaguaggugccgccaucgcugccccagucgccggccaacaaaaugucaucgaccccuggauccgcaacaauuucguccaagcccccggcggcgaguucacuaucucaccccgcaacgcucccggcgaaauccucugguccgcuccguuaggacccgaccucaaccccuaccuaucccaccuagcacgcauguacaacggauacgccggcggcuucgaaguccaagucauucuggccggcaacgccuucacugccgggaaagucauauucgccgccguucccccgaauuuccccaccgaaggccuaucacccucccaagucaccauguuuccccacauagucguagacguacgccaacucgaaccaguucucauuccccucccagacguccgcaauaacuucuaccacuauaaucaaaguaacgacucaacaauaaaacuaaucgccaugcuauacacuccccuucgugccaacaaugccggcgacgauguauucaccgucagcugccgaguccuaacacgcccaucccccgacuucgaccucauauuccucguaccuccaaccguagaaucccgaaccaaaccauucucaguacccguacucacagucgaggaaaugaccaacagucgcuuccccacaccccucgaaaaacuauucaccggcccaucauccgcauucgucguucaaccccaaaacggccgauguacuacagacggcguccuccucggaaccacacaacucuccccagucaacaucugcaccuuucgcggcgacgucacucacauaacaggcucacgcaacuacaccaugaaccucgccucccagaacugguccaacuacgaccccacagaagaaaucccagcaccccucggaaccccagacuucgugggaaaaauccaaggcguccucacccaaaccacccgcacagauggcucaacuagaggccacaaagccaccguauauaccggauccgccgacuucgccccaaaacucggccgcguacaauuugaaaccgacacugaccacgacuucgagaccaaucaaaacacuaaauucacccccgucggcguaauccaggacggaucaacaacccaccgcaacgaaccccaacaguggguccucccauccuacucaggccgcaacaccccuaacguccaccucgcacccgccgucgcaccaacauuccccggcgaacaacugcuauucuuucgcucaacaauccccggcugcuccggcuacccaaacauggaucucgacugccuccugccucaagaauggguccaauacuucuaucaagaagccgcccccgcccaaucagacguagcccuacuccgauucguaaaucccgacaccggccgcguccuuuucgaauguaaacuccacaaaucaggauacgucacagucgcccacaccggccaacacgaccuagucauacccccuaacggauacuuccgcuucgacuccuggguaaaccaauucuacacccuagccccaauggguaauggcacuggucgccgccgcuaa

SEQ ID NO: 39012 - RNA, 1617 nt, Artificial Sequence
  derived and/or modified sequence opt11 from VP1__Norovirus_and/or_Norovirus-like__KP244318
augaaaauggcaagcuccgacgcaaaccccuccgacggcuccaccgcuaaccucgucccagaaguaaacaacgaagucauggcacuagaaccaguagucggcgccgcaaucgcagcccccgucgcaggccaacaaaacgucaucgaccccuggauccgcaacaacuucguacaagccccaggcggagaguucacagugucuccccgcaacgccccaggagaaauccuaugguccgcaccccucggcccagaccugaaucccuaccucucccaccuugcccgcauguacaacggauacgccggaggguucgaaguccaagucauacuagccgguaacgccuuuacagccggcaagaucaucuucgccgccgucccacccaacuuccccacggaaggacucucccccucccaagucaccauguucccccacauaauagucgacguacgacaacuagaacccguacucauaccccuccccgacguccgcaacaacuucuaccacuacaaccaguccaacgaccccaccaucaaacucaucgccaugcucuacacaccccuccgcgccaacaacgccggcgacgacgucuucaccgucuccugccgaguacucacccgcccauccccagacuucgacuucauuuuccucguacccccaaccgucgaauccagaacgaaacccuucucuguuccaguacuaacaguagaagaaaugaccaacuccagguuccccaucccccucgaaaaacuuuucaccggacccucaagcgcuuucguuguucaaccccaaaacggacguugcacaaccgacggcguucuccuaggaacaacccaacuuucccccgucaacauccgaaccuuccguggagacguaacccacauacccggcagccgaaacuacacaaugaacuccgcaucucaaaacuggaacucguacgauccaaccgaagaaauaccagccccacuaggcacccccgacuucguagguaaaauucaaggaguacucacacaaaccacacgcgccaauggaucuacccgcggccacaaagccacaguauacacaggauccgccgacuucucuccuaaacucggccgaguacaauucgccaccgauacagacaaugacuuugaaaccaaucaaaacaccaaauucaccccugucggcguaauucaagacggcuccaccacaccccgcaaugaaccucaacaaugggucuuacccucguacuccggccgcaacauccacaauguacaccucgcacccgcugucgcucccaccuuccccggcgaacaacuccucuucuucagaagcaccaugcccggcugcuccggcuaccccaacauggaccucgacugccuccucccgcaagaauggguccaauacuucuaccaagaagccgccccagcccaaucagacgucgcccuccuccgauucguaaaccccgacaccggaaggguccucuucgaaugcaaacuccacaaauccggcuacguaaccgucgcccacaccggccaacacgaccucgucaucccacccaacggcuacuuccgauucgacuccuggguaaaucaauucuacacucucgcacccaugggcaacggcaccggacgucgccgauaa

SEQ ID NO: 39013 - RNA, 1617 nt, Artificial Sequence
  derived and/or modified sequence opt11 from VP1__Norovirus_and/or_Norovirus-like__KX514362
augaaaauggcuuccaacgacgccaacccauccgacggcuccgcagccaaccucguacccgaaguaaauaacgaggucauggcccucgaacccgucgucggcgcagccaucgccgccccugucgccggccaacaaaacguaaucgaccccuggauccgcaacaacuucguccaagcacccggcggagaguucaccgucucuccccggaacgccccuggggaaauccuaugguccgccccacucgguccagaccuaaaccccuacuuaucccaccucgcccguauguacaacggcuacgcuggcgguuucgaaguacaaguaauacuugcaggcaacgccuucaccgcaggaaaaauaaucuuugccgcaguaccacccaacuucccaacugaaggacuauccccaucacaaguaacgauguucccacacauaaucgucgacguccgccaauuagaaccaguccuaaucccccuccccgacguacgaaauaacuucuaucacuacaaccaauccaacgacuccaccauaaaauuaaucgccaugcucuacaccccucuccgcgccaacaacgccggcgacgacguauucaccgucuccugucgaguccugacccgcccaucacccgacuucgacuucauauucuuaguaccacccacaguagaaucccgcuccaaacccuuuuccgucccuguccuaaccgucgaagaaaugaccaacucccgguuccccgcaacacucgacaaacucuucaccggcccaucuucgaccuucgucguccaaccccaaaacggccgcugcaugaucgacggcguccuccucggcacaacccaacucucccccguuaacaucuguaccuuccgcggagacguaacccacccaggcggcuccaaaaucuacaccaugaaccuggcauccccaaauuggaacaacuacgacccuacagaagaaauaccagcaccccuaggcaccccggacuucguaggcaaaauccaaggcaugcuaacccaaaccacaaaaggcgaaggauccaccagaggccaccgcgcaaccgucuacguaggcuccgcaaacuacgcccccaaacuaggacgcguccaauucgaaaccgacaccaccgacgaccuugacgcacaccaaaacacaaaauucaccccagucggcgucguccaaggcggcgaaucccccaaaggcucagaaccccaacaauggguccuccccuccuacucaggccgcgacacccccaacguucaucucgcccccgccgucgcccccaccuuccccggcgaacaacuccucuucuuccgcuccaccauuccaggcugcgggggccaccccaacaugaaccucgacugucuccucccucaggaauggguacaacacuucuaccaagaagccgcaccagcacaaagugacguagcccuccuccgauucgucaaccccgacaccucacgaguccucuucgaaugcaaacuccacaaaucaggauacguaacaguagcacacaccggccaacacgacuugguaauaccacccaacggauacuucagauucgacucaugggucaaccaauucuacacccuagcacccauggguaacggcaccggccgaaaacgcuaa

SEQ ID NO: 39014 - RNA, 1617 nt, Artificial Sequence
  derived and/or modified sequence opt11 from VP1__Norovirus_and/or_Norovirus-like__KX514329
augaaaauggccuccagugaugcaaaccccuccgacgggagcgccgccaaucucguaccagaggucaacaacgagguaauggcccuagaacccgucgucggagccgccauagccgcacccguagcaggucaacaaaacguaaucgaccccuggauccgcaacaacuucguacaagcccccgguggcgaauuuacaguaucaccccgcaacgccccuggcgaaauacucugguccgcaccccucggccccgaucuaaaccccuaccucucccaccucgcccgaauguacaacggcuacgccggcggcuucgaaguucaagucauccucgcuggcaaugccuucacagccggaaaaauuauuuuugccgccguuccacccaacuuccccacagaaggcuuaucccccucucaagucaccauguucccccacaucauugucgacguccgucaacucgaacccgugcugaucccucuccccgauguccgaaacaacuucuaccacuacaaccaaucaaacgauuccacaaucaaauugaucgcaaugcucuacacaccccuccgagcuaacaacgccggugacgacgucuucaccguauccugcagaguccuuacccgcccuucccccgacuucgacuucaucuuccuuguacccccuacugucgaaucacgcucgaaaccauucagcguccccguccucacugucgaagaaaugaccaacucccgcuucccagcuacccuagauaaacuauucaccggacccuccucuacauucguaguacaaccacaaaacggacgaugcaugaucgacggcguccuccuaggcacuacacaacucucacccgucaacaucugcaccuuccguggcgacguuacccacucaggaaacuccaaaauauacaccaugaaccucgccucaccuaacuggaacaauuacgaucccaccgaggaaauacccgcaccccuaggcacacccgacuucgucggcaaaauccaaggcaugcucacccaaaccaccaaaggcgaaggaucuacccgcggacaccgagcaaccgucuauguaggcuccgcaaauuacgcccccaaacucgggcgcguccaauucgaaacagacaccaccgacgaccuagaugcccaccagaacaccaaauucaccccuguaggcguaguccaaggcggcgagucccccaaaggaucagaaccccaacaauggguccuucccucauacuccggccgcgacaccccaaacguacaucuugcccccgcgguagccccuacauucccaggcgaacaacuccuuuucuuccguucuaccaucccaggcugcggaggccaccccaacaugaaccuagacugccuccucccccaagaauggguccaacacuuuuaccaagaagccgcaccagcacaauccgaugucgcccuccuccgauucguaaaccccgacaccucccgcguccucuucgaaugcaaacuccacaaaagcggauacguaaccgucgcccacaccggacaacacgaccuggucauacccccgaauggauacuuccgcuucgacucauggguuaaccaauucuacacccucgccccuaugggcaacggcacuggccgcaaacguuaa

SEQ ID NO: 39015 - RNA, 1617 nt, Artificial Sequence
  derived and/or modified sequence opt11 from VP1__Norovirus_and/or_Norovirus-like__KJ678152
augaaaauggcuuccuccgacgcaaaccccugcgaugguagcgcagcuaacuuaguccccgaaguaaacaacgaaguaauggcacuugaacccgucgucggggccgcuaucgccgcaccaguagggggacaacaaaacgucaucgaccccuggauccgcaauaacuuuguacaagcccccggcggcgaguucaccguaagcccccgcaacgcccccggcgaaauccuuugguccgccccacucggccccgaccuaaacccauaccuaucccaccuagcccguauguacaacggauacgcaggcggcuucgaaguccaaguaauacuugccggcaacgccuucacagcaggaaaagucaucuucgcagcugucccaccaaacuuucccaccgaaggacucucccccucccaagucaccauguucccacacaucgucguagacguccgccaacucgaaccaguccucaucccacuacccgacguccgcaacaauuucuaccacuacaaucaaucaaaugacuccaccaucaaacuuaucgccaugcuauacacgccccuccgcgccaacaacgccggcgacgacgucuucaccguauccugcagaguccucacccgcccaaguccugacuucgacuucaucuuccucguaccacccaccgucgaaucccgcaccaaacccuucucaguucccguccuaaccgucgaagaaaugaccaacucucgguucccuacuccccucgaaaaacucuucacaggcccauccuccgccuucgucguccaaccccaaaacggccgaugcaccaccgacggcguccuucucggcacaacccaacucucacccgucaacaucugcaccuuccgaggugacgucacccacaucacaggcucgcgaaacuacacgaugaaccucgccucccaaaacuggagcaacuacgacccaacagaagagauacccgccccacuugggacccccgacuucgucggaaaaauacaaggcguccuaacccaaacaacccgaacagacggcagcaccagaggccacaaagccacagucuacauaggcuccgccgacuucgcccccaaacuuggccgcguccaauuugaaaccgacacagaccacgacuucgaaaccaaccaaaacaccaaauucaccccagucggcgucauccaagacggcucaacaacccaccgcaacgaaccucaacaauggguccucccauccuacuccggccgaaacaccccuaacguacaccucgcacccgccgucgcccccaccuucccuggcgaacaacuccucuucuuccgcuccacccuacccgguugcuccggauaucccaacauggaccuagacugccuccucccucaggaaugggugcaauacuucuaccaagaggccgcccccgcccaaucugacguagcccuucuccguuuugucaauccagacaccggccgcguacuuuucgaaugcaaacuccacaaaucuggcuaugucaccgucgcccacaccggccaacacgaccucgucauaccacccaacggcuacuuccgcuucgacuccugggucaaccaauucuacacacuagcccccaugggcaauggcacaggacgacgacguuaa

SEQ ID NO: 39016 - RNA, 1617 nt, Artificial Sequence
  derived and/or modified sequence opt11 from VP1__Norovirus_and/or_Norovirus-like__KX514352
augaaaauggcauccaacgacgcuaaccccucugacggcucagccgcuaaccucguccccgaagucaacaacgaagucauggcccuagaaccugucguuggagcagccauagccgcccccguagcaggacaacaaaacgucaucgauccauggauucgcaacaacuuuguccaggcccccggcggcgaguucacaguaucaccccgcaacgcccccggcgaaauccuaugguccgcuccccuuggccccgaccucaaccccuaccuaucccaccuggcccgcauguacaacgguuacgcaggcggcuucgaaguccaaguaauccuagccggcaacgccuucacagccggcaaaauaauauuugcugccgucccucccaacuuccccacagaaggccucuccccaucccaagucaccauguucccccacaucaucgucgacguccgucaacucgaaccaguacucaucccacuccccgacguccgcaacaacuucuaccacuacaaccaauccaacgacagcaccauaaaacucaucgccaugcucuacacuccccuacgcgccaacaacgcaggcgacgacguauuuaccguaagcugcagaguccuaacacgccccucccccgacuuugauuucaucuuccucgucccaccaacaguagaauccagguccaaaccauucuccguccccguccuuacagucgaagaaaugaccaacucucgcuuuccugccacccucgacaaacuauucaccggucccagcucgaccuucguaguacaaccacaaaacggccguugcaugaucgacggcguacuccuuggaacaacucaacucucacccguaaacaucugcacauuccgcggcgacguaacccacccccgugauucacccaucuacacaaugaaucucgcaucccccaacuggaacaacuaugauccaaccgaagaaaucccagcuccccucggcaccccugacuuugucgguaaaauacaaggaaugcuaacacaaaccacaaagggagaaggaucaacacgaggccaccgcgccaccguauacguaggcucagccaacuacgccccaaaacucggcagaguccaauucgaaaccgacacuaccaacgaccuauacgcccaccaaaacaccaaauucacacccgucggagucguccaaggaggugaaucagcacacagaucagagccccagcaauggguacuccccggcuacucaggucgcgacacacccaacguccaccucgcccccgccguagccccuaccuuccccggcgaacaacuccucuucuuccgaucaacaauccccggcugcggcggucaccccaacauggaccucgacugccuccucccacaagaauggguccaacacuucuaccaagaagccgcacccgcucaaucagacguagcccuucuucgguucguuaauccugacaccucacgaguucucuucgagugcaaacuccacaaauccggcuacgucaccgucgcccacaccggccaacacgaucuagucauaccacccaacggcuacuuccguuucgacuccuggguaaaccaauucuacacacucgcccccaugggcaacggaacaggccgcaaaagauga

SEQ ID NO: 39017 - RNA, 1617 nt, Artificial Sequence
  derived and/or modified sequence opt11 from VP1__Norovirus_and/or_Norovirus-like__KX514339
augaaaauggccuccucggacgccaaccccagcgacggauccaccgcaaaucuuguccccgaagucaacaaugaaguaauggcacuugaacccgucguaggcgccgccaucgccgcaccugucgccggccaacaaaacgucaucgacccauggauccgaaacaacuucguacaagcccccggcggcgaauuuaccgucucacccagaaaugccccaggagaaauccuuuggagcgcuccccucggcccggaccuaaaucccuaccucucccaccuagcccgaauguacaauggauacgccggaggauucgaaguacaaguaauacuagccggcaacgcguucacagccggcaaaaucaucuucgccgcugucccacccaauuuccccacagaaggccuaucacccucccaagucaccauguucccccacaucauaguagacguccgccaacuugaaccuguacucauaccacuucccgacguacgcaacaauuucuaccacuacaaccaauccaacgacucgaccaucaaacucaucgccaugcuauacacuccccuccgcgccaacaacgccggcgacgacgucuucacaguuaguugccgcguacucacacgccccucccccgacuucgacuucauauuccucgucccacccaccgucgaaagccgguccaaacccuucucaguccccguccucaccgucgaagaaaugaccaauucuagauuccccgcaacccucgacaaacuauucacuggaccaucuagcaccuucguuguacaaccccaaaauggccgcugcaugaucgacggcguccuccuaggcaccacccaacuuucccccguaaacaucugcaccuuccgcggcgacguuacccaauccggaaacacaaaaauuuauaccaugaaccuagcuuccccaaacuggaauaacuacgaccccaccgaagaaaucccagcaccucucggaacccccgacuucguaggaaagauccaaggcaugcucacccaaaccacaaagggcgaagguuccacacgcggacaccgcgcaaccgucuacgucggcagcgcaaacuacgcacccaaacucggccgcguccaauucgaaacagacaccaccgacgaccucgacgcacaccaaaacaccaaauucacccccgucggcgucguacaaggaggagaaucccccaaaggcuccgaaccucaacaauggguucuccccagcuacagcggccgcgacacacccaacguacaccuugccccagccguagcccccaccuuccccggcgaacaacuccucuucuuccgcuccaccauaccaggcugcggcggccaccccaauaugaaccucgacugccuacugccucaggaauggguccaacacuucuaucaagaagccgcacccgcccaauccgacgucgcacuacuccgcuucgucaacccugacacaucccgaguccucuucgaauguaaacuacacaaauccggauacgucaccgucgcacacaccggucaacacgaccuagucaucccuccaaacggauacuuucgauucgacucuuggguaaaccaauucuacacccucgcccccauggguaacggcaccggccgccgccgauaa

SEQ ID NO: 39018 - RNA, 1617 nt, Artificial Sequence
  derived and/or modified sequence opt11 from VP1__Norovirus_and/or_Norovirus-like__KR904238
augaaaauggccucaucagacgcaaaucccucagacggcuccgcugccaaccucguacccgaaguaaacaacgaagucauggcccucgaacccgucguaggcgccgcaauagccgcacccgucgccggacaacaaaacgugaucgacccauggauacgcaacaacuucguccaagcccccgguggagaguucaccgucucaccccguaaugcuccaggagaaauccucugguccgcaccccuaggccccgaccucaacccauaccucucccaccuagcccguauguacaacggcuacgccggcggcuucgaaguacaagucauccucgccgguaacgcauucaccgcaggaaaaaucaucuucgccgccguaccacccaacuuccccaccgaaggacucucccccucccaagugacaauguucccacacaucauagucgacguacgccaacucgaaccaguccuaaucccacuccccgacguccgcaacaacuucuaccacuacaaccaauccaaugacuccaccaucaaacuaaucgccaugcuuuauacaccccuccgcgcaaacaacgccggcgacgacguauucaccguaucaugccgcguccucacccgcccaucacccgacuucgacuucaucuuccucgucccaccuaccgucgaauccagaacaaaacccuuuucagugcccguacucacagucgaagaaaugacaaacucacgcuuccccauaccccucgaaaaacucuucaccggccccagcuccgccuucgucguccaaccccaaaacggacgcugcaccaccgacgguguccuucucggaaccacucaacucucccccgugaacauaugcaccuucagaggcgauguaacccacauaaccggaucacguaacuauaccaugaaucucgcaucucaaaacuggaacaacuacgaccccaccgaagaaauccccgccccacucggaacuccugacuuuguaggcaaaauccaaggcaugcucacucaaaccacacgaacagacggcuccacccgaggccacaaagcaaccguauacacuggcuccgccgacuucgcacccaagcucggcagaguccaauucgaaacagacaccgaccacgacuucgaagccaaccaaaacaccaaauucacgcccguaggcguaauccaagacgggagcaccacccaccgcaaugaaccacaacaauggguccucccuucauacuccggucgcaacacacacaacguccaccuugcacccgccgucgcccccacauuccccggagaacaacuccccuucuuccgcagcacgaugcccggcugcagcggcuacccuaacauggaccucgauugccuccucccccaagaauggguccaguacuucuaccaagaagccgcccccgcccaauccgacgucgcacuccuccgcuucgucaaccccgacacgggacgaguacucuucgaaugcaaacuccacaaauccggcuacguaaccguagcccacacgggacaacacgaccucguaaucccucccuacggcuacuuccgauucgacucauggguaaaccaauucuacacccucgcccccauggguaauggcaccggccgccgccgcuga

SEQ ID NO: 39019 - RNA, 1617 nt, Artificial Sequence
  derived and/or modified sequence opt11 from VP1__Norovirus_and/or_Norovirus-like__KJ710245
augaaaauggccucauccgacgccaaccccucugacggcucaacagcaaaccuaguuccagaaguaaacgacgaaguaauggcccucgaacccguugucggugcagcacucgcugcccccgucgccggccaacaaaacgucaucgacccauggauacgaaacaacuucguacaagccccagguggcgaauuuacaguaagcccccgcaacgcccccggcgaaauccuaugguccgcaccccuaggucccgaccucaacccuuaucucucccaccucgcccgcauguacaauggcuacgccggcggcuucgaaguccaagucaucuuagccggaaacgccuucaccgccggcaaagucauauucgcagcuguaccaccaaacuuccccacagaaggccucucccccucccaagucacaauguucccccacauaaucguagacguccgacaacuugaaccaguacucaucccacuuccagaugccagaaauaacuucuaccacuacaaccaguccaacgaauccacuauaaaacucauugcaaugcucuacacuccccuccgcgccaacaacgccggcgacgacguauucaccgucuccugccgcguacucacccgccccucccuagacuucgacuucaucuuccucgucccacccacagucgaaucacgcaccaaacccuuuucaguccccauccucacuguagaagaaaugacuaacucccgauuucccauaccccuugaacgccucuucaccggccccuccagcgccuuugccguccaaccacaaaauggccgcuguacaacagacggcguccuacuaggaaccacacaacucagccccgucaacaucuguacauuccgaggugacguaacacacaccaccggcucccacaauuacaccaugaaccuggcgucccaaaaccgaucaaacuacgauccaaccgaagaaaucccggcaccacucggcacccccgacuucgucggcaaaauccaaggugcccuaacacaaaccacacgugccgacggaucaacaagaggacauaaagccacagucuacacuggcucagccgacuucacccccaaacugggacgcguucaauucgccaccgauacagaccacgacuucgacaccaaccaaaacaccaaauucaccccagucggaguaauccaagauggcuccaccacacaccgaaacgaaccccaacaauggguccuacccuccuacagcggacgcaacacccacaacguucacuuagcccccgccgucgcacccacuuuccccggcgaacaacuccucuucuuccgcagcaccaugcccggaugcuccggguacccuaacauggaccuagacugccuccucccccaagaauggguagcacacuucuaccaagaagccgcuccagcacaaagcgacgucgcccuacuacgcuucgucaaccccgacacaggcagaguccuauucgaauguaaacuccacaaaagcggcuacguaacagucgcacacaccggacaacacgaccucgucaucccacccaauggcuacuucagauucgacuccugggucaaccaauucuacacccucgcgcccaugggaaacgguaccggccgccgacgcuaa

SEQ ID NO: 39020 - RNA, 1617 nt, Artificial Sequence
  derived and/or modified sequence opt11 from VP1__Norovirus_and/or_Norovirus-like__KX514298
augaaaauggccuccaacgaugccaaccccucagacggcuccgccgcaaaccucguacccgagguaaacaacgaaguaauggcccuagaaccaguaguaggugcagccaucgcagcccccguagccggccaacaaaacguuauagacccauggauccguaacaacuucguccaagcccccggcggcgaguucaccgucucuccccgaaacgcccccggagaaauccuauggucagcaccccuuggcccagaccuaaaccccuaccuuagccaucuggcccgcauguacaacggcuacgccggcggcuucgaaguccaagucauucucgccggcaacgccuucacagccggcaaaaucauuuucgccgccgugccacccaacuucccaaccgaaggacucucccccucccaagucacaauguucccccacaucaucguagacgucagacaacuagaacccguccuaauaccccuccccgacguacgcaacaacuucuaucacuacaaccaauccaacgauuccaccaucaaacucaucgcaaugcuuuacacaccccuacgagccaacaacgccggcgacgacgucuuuaccgucagcugccgaguccucacucgacccucuccagacuucgacuucaucuuccucgucccacccacagucgaaagccgauccaaacccuucucaguacccguccucaccgucgaagaaaugacaaauucucgcuucccagccacucuugacaaacuauucaccggaccauccuccacauucguugugcaaccacaaaacggacgcugcaugaucgacggcguccuucucggcaccacccaacuaucucccgucaacauaugcaccuuccguggcgacgucacacacccacgcgacagccccauauauacaaugaaccuagcaagccccaacuggaacaacuacgaccccacagaagaaauccccgcaccccuaggcacaccugacuucgugggcaagauucaaggcaugcugacccaaacaaccaaaggcgaaggauccacccgcggccaccgcgccaccgucuacgucggcuccgccaacuacgcccccaaacuaggcagaguccaauucgaaacagacacaaccaacgaccucgacgcucaccaaaacaccaaauucaccccagucggagucauccaaggcggagaauccgcacaucgaucagaaccacagcaauggguucuucccuccuacuccggucgagacauccccaacguccaccucgcccccgcuguggccccuacauucccaggcgagcaacuucucuucuuccguagcaccauccccggcugcggcggucaccccaacaugaaccucgacugccuacugccgcaggaauggguccaacacuuuuaccaagaagccgcccccgcccaauccgacgucgcccuuuuacgguucguaaaucccgacaccucacguguacucuucgaaugcaaacuacacaaauccggauaugucaccguagcccacacuggccaacaugaccucgucauaccucccaacggcuacuuccgcuucgacuccuggguaaaccaauucuacacccucgccccuaugggcaacggcacaggccgcaaacgcuaa

SEQ ID NO: 39021 - RNA, 1617 nt, Artificial Sequence
  derived and/or modified sequence opt11 from VP1__Norovirus_and/or_Norovirus-like__KX514269
augaaaauggccucaaaugacgcuaaccccucagacggcagcgcagcgaaccucguccccgaagucaacaacgaaguaauggcacucgaaccuguagucggcgccgcuaucgccgccccagucgccggccaacaaaacgucaucgaccccuggauccgaaacaacuucguccaagccccaggcggagaauuuacaguaucaccccgcaacgccccaggcgaaauccuauggucggccccucucggccccgaccucaaccccuaccuaucucaccucgccagaauguacaacggcuacgccggcggcuucgaaguccaaguaauccucgccggaaacgccuucacagcaggcaaaaucaucuucgcagccgucccacccaacuuccccacugaaggccugagcccaucccaggucaccauguucccccacauaaucgucgacguacgccaacucgaaccuguacucauuccacuccccgacguccguaacaauuucuaccacuauaaccaaagcaaugacuccacuaucaaacucauagccaugcucuacacaccccuccgcgcuaacaaugccggcgacgacgucuucaccgucagcugucguguacuaacucgcccuucuccugacuucgacuucaucuuccuaguacccccaacagucgaaucccgaucaaaaccuuuuuccguccccguccucaccguagaagaaaugaccaacucccgauuccccgccacccucgacaaacuuuucaccggcccaucuuccacauucguaguccagccacaaaacggccgcugcaugaucgacggaguacuacuaggcacaacccagcucuccccaguuaacauaugcacauucagaggagacgucacucacccccgcgacagccccaucuacacgaugaaccucgcaucacccaacuggaacaacuacgaccccaccgaagaaauccccgccccacucggcacccccgacuucacaggcaaaauccaaggcaugcucacccaaacaaccaaaggcgaaggcucuaccaggggccaccgcgcaaccgucuacguaggauccgccaacuacgcacccaaacucggucgaguccaguuugaaacagacaccaccaacgacuuagacgcacaccaaaacacaaaauucacucccgucggcgucguccaaucaggcgaauccccaaaaggauccgaaccccaacaauggguacuccccuccuacuccggccgcgacacuccaaacguccaccucgcccccgcagucgccccgaccuucccaggcgaacaacuacucuucuuccgauccaccauccccggaugcggcggccaccccaacaugaaccucgacugccuccucccccaagaauggguccaacauuucuaccaagaagccgccccggcccaaucugacgucgcccuacuccgcuucgucaaccccgacaccucccgaguacuauucgaauguaaacuacacaagucuggcuacgucaccguagcacacacaggccaacacgaccucguuauaccucccaacggauacuuucgauuugacagcugggucaaccaauuuuacacccucgcccccaugggaaacggcaccggccgcaaaagauag

SEQ ID NO: 39022 - RNA, 1617 nt, Artificial Sequence
  derived and/or modified sequence opt11 from VP1__Norovirus_and/or_Norovirus-like__KX514179
augaaaauggccuccaacgacgccaaccccucggacggcuccgccgccaaccucguccccgaaguuaacaacgaagucauggcacucgaacccgucgucggcgcagcaauugccgcaccagucgcaggccaacaaaacgugaucgaccccuggauaagaaacaacuucguacaagcccccggaggcgaguucacuguuucaccccgaaacgcacccggagaaauccucugguccgccccacuaggcccggaccugaaccccuaccucucccaucucgcaagaauguacaaugguuacgccggcggauucgaaguucaagucauccuagcaggaaacgccuucacagcuggcaaaaucaucuucgccgccgucccaccaaacuuccccacagaaggucuaucucccucccaagucaccauguucccccacaucaucgucgacguccgacaauuagaacccguccucaucccacuccccgacguucgcaacaacuucuaccauuacaaccaguccaacgacucaacaaucaaacucauagcuaugcucuacacgccccuccgagccaacaacgcaggcgacgacgucuucaccguaucuugucgcguacuaacccgaccauccccagacuucgacuucaucuuccucguaccucccaccguagaaagccgcucuaagcccuucagcguccccguccucaccguugaagaaaugaccaacucccgcuuccccgcuacccucgacaagcuauucaccggacccucaucgacauucguaguacaaccacaaaacggacgcugcaugaucgacggcguacuccuagguaccacccaacucuccccugucaacaucugcacguuucgcggcgacgucacccauccccgcgacucccaaaucuacacuaugaaccuagcaucccccaacuggaacaacuacgacccaaccgaagaaauacccgcaccccucggcacccccgacuucgucggcaaaauccaggguaugcucacacaaaccaccaaaggcgagggcucuacaagaggacaccgugccacaguuuacguuggcucagccaacuacgcccccaaacucggacgaguccaauucgaaacagacacaaccaacgaccuagacgcacaccaaaacacaaaauucacuccugucggaguuguccaaggcggagaaucccccaaaggcuccgaaccccaacaauggguucucccuucuuacucgggacgagacacacccaacguccaccuugccccugccgucgcccccacauucccaggcgaacaacuacuauucuuccgcucaaccaucccaggaugcggcggacacccgaacaugaaccuagacugccuacucccucaagaauggguccaacacuucuaccaagaagcagccccagcacaauccgacguagcccuccuccgauucgucaacccagauaccucacgcguccuauucgaaugcaaacuccacaaaagcggcuacgucacagucgcccacaccggccaacacgaccucgucaucccacccaacggauauuuucgcuucgacucaugggucaaccaauucuauacccucgcccccaugggcaacggcaccggcagaaaacgcuaa

SEQ ID NO: 39023 - RNA, 1617 nt, Artificial Sequence
  derived and/or modified sequence opt11 from VP1__Norovirus_and/or_Norovirus-like__KX514289
augaagauggccagcaacgaugcaaaucccagcgacggcagcgccgccaaccucguaccagaaguaaauaacgaagucauggcccucgaacccguaguaggcgccgccauagccgcgcccguggccggccaacaaaacguaaucgaccccuggauacgaaauaacuucguccaagcccccgguggcgaguucacaguaagccccagaaacgcacccggcgaaaucuuaugguccgcaccccuaggaccagaccucaaucccuaucugucccaccuagcccgaauguacaacggcuacgcuggcggauucgaaguccaagucauucucgccggcaacgccuucaccgcuggcaaaaucaucuucgccgccgucccacccaacuucccaaccgaaggacuuucacccucccaagucaccauguucccccacauaauuguagacguacgacaacucgaacccguacucauuccccuaccugauguccgaaacaacuucuaccacuacaaccaauccaacgacagcaccauaaaacucaucgcaaugcucuacacaccccuacgcgccaacaacgcaggcgacgacgucuucaccgucuccugccguguccuaacaagacccucgcccgacuucgacuucaucuuccuagucccucccaccguagaaucuagauccaaacccuucucuguccccguccucaccgucgaagaaaugaccaacucaagauucccagcaacccucgacaaacucuucaccggacccaguucaaccuucgucguacaaccacaaaacggccggugcaugaucgacggcguccuccuaggcacuacacaacucagccccguaaacauaugcaccuucaggggcgacgucacacacccacgcgacucacccauuuauaccaugaaccucgccuccccaaauuggaacaacuacgaccccaccgaagaaauccccgccccacucggcacacccgacuucguaggcaaaauacaaggaauguuaacacaaaccacgaaaggcgaaggauccacccgcggccaccgcgccaccgucuauguuggcuccgccaacuacgccccaaaacuuggaagaguacaauucgaaaccgacaccacaaacgaucucgacgcccaccaaaauaccaaguucaccccagucggcguuguccaaucuggcgaauccccuaaggguuccgaaccccaacaauggguccuccccucuuacuccggccgcgacaccccaaacguccaccucgcccccgcaguagcaccaacuuucccaggugaacaacuccucuucuuccgcuccaccauacccggcugcggaggacaccccaacaugaaucucgacugccuacuaccccaagaauggguacaacacuucuaccaagaagccgcucccgcccaauccgauguagcgcuacuccgcuucgucaauccagacaccucccgcguacucuucgaauguaaacuacacaaaagcggcuacguaacagucgcccacaccggacaacacgaccuagucaucccacccaacggauacuuccgauucgacuccuggguuaaccaguucuauacccucgcacccaugggcaacggcaccggacgcaaacgauag

SEQ ID NO: 39024 - RNA, 1617 nt, Artificial Sequence
  derived and/or modified sequence opt11 from VP1__Norovirus_and/or_Norovirus-like__KX514288
augaaaauggccucaaacgaugccaaccccucagacgguucagccgccaaccugguaccagaaguaaacaacgaaguuauggcccucgaacccguagucggcgccgccauagccgccccagucgcaggacaacaaaaugucaucgacccauggauacgcaacaacuucguccaagcccccggcggcgaguucacagucucaccacgcaacgcaccuggcgaaauccucuggucugcaccccuaggcccugaccuuaaucccuaccucucccaucucgcccgaauguauaacggcuaugccggaggcuucgaaguccaagucauccucgcaggcaacgcauucaccgcaggaaaaaucaucuucgccgccguacccccaaacuuccccaccgaaggccucucccccagccaagucaccauguucccccacauaaucgucgacguccggcaacuagaacccguucucaucccccuccccgacguacgaaauaacuucuaccacuacaaccaaucaaacgacuccacuauuaagcucauagccaugcucuacacuccccuccgcgccaauaacgcuggcgaugacgucuuuaccgucucaugccguguauuaacccgccccucucccgacuuugauuucaucuuccucgucccucccacagucgaauccagaucuaaacccuucuccguacccguccucaccguugaagaaaugaccaacucccgauuccccgccacccucgacaaacuauucaccggccccucauccaccuucgucguccaaccccaaaacggccgaugcaugaucgacggcguacuccucggcaccacccaacuuagcccugucaauauaugcaccuuccgcggugacgucacacacccccgagacucgcccaucuacaccaugaaccucgcauccccaaauuggaacaacuacgaccccaccgaagaaauccccgccccacucgguacucccgacuucguagguaaaauccaaggaaugcucacccaaaccaccaaaggcgaaggcuccacacgcggccaccgcgcaacggucuaugucggaucagccaacuacgcacccaaacucggucgcguccaauucgaaaccgacaccaccaacgaucuugacgcccaccaaaacacuaaauucaccccuguaggagucguccaaucaggcgaauccccaaaaggcuccgaaccacaacaauggguccuccccucuuacuccggccgcgacacaccuaacguccaccucgcacccgccgucgcccccaccuuccccggcgaacaacuccucuucuuccguucaaccauccccggcugcggcggccaccccaacauggaucuugacugccuucucccacaagaauggguucaacacuucuaccaagaagccgcccccgcacaaagcgacguagcccuccuccgauucgucaacccagacaccucccgaguccuauucgagugcaaacuacauaaauccggcuaugucaccguugcccacaccggucaacacgaucuagucaucccacccaacggcuacuuccgcuucgacucaugggucaaccaauucuacacccuggcccccaugggcaacggcaccggccguaaaagauaa

SEQ ID NO: 39025 - RNA, 1617 nt, Artificial Sequence
  derived and/or modified sequence opt11 from VP1__Norovirus_and/or_Norovirus-like__KX514268
augaaaauggccucaaacgacgccaacccaucugauggcucugcagccaaccuagucccagaagucaacaacgaagucauggcccucgaaccaguagucggagccgcaaucgcugccccagucgcaggacagcaaaacgucauagaccccuggauacguaauaacuucguacaagcacccggaggagaguucaccgucucuccacgcaaugcccccggcgaaauacuuuggucagcaccccucgguccagaucucaacccauaccucucccaccucgcccguauguacaacggcuacgcaggcggauucgaaguacaggucauccucgccggaaacgccuucaccgcaggcaaaaucaucuucgccgccguacccccaaacuuccccaccgaaggccuaucacccagccaagucacaauguucccacacaucauugucgacguccgccaacuagaacccguucugauaccacuacccgacguacgcaacaacuucuaccacuauaaucaauccaacgacuccacaaucaaacucaucgccaugcuauacacaccccucagagccaacaacgcaggagacgauguauucaccgucucaugccgcguccuaacccgcccaagcccagacuucgacuucauauuccucgucccacccaccgucgaaucccgcuccaaacccuucagcguacccgugcucaccgucgaagaaaugacaaacucccgauuccccgcaacucucgacaaacucuuuaccggccccuccucaaccuucguaguccagccccaaaacggccgaugcaugaucgacggcguccuacucggcacaacccaacucucccccguuaacauaugcaccuuccgcggcgacgucacccacccucgagacucacccaucuacacaaugaaccuagccucaccgaacuggaauaauuacgacccaaccgaagaaauacccgccccacucggcacccccgacuucgucggaaaaauacacggcaugcuuacccaaacgaccaaaggugaaggguccacucgcggccaccgcgccaccgucuacgucggcuccgccaacuacgcccccaaacucggucgaguccaauuugaaacagacaccaccaacgaccuagacgcacaccaaaacaccaaauucacuccggucggagucguccaagggggugaaucccccaaaggcuccgaaccacaacaauggguccuaccuucuuacuccggacgcgacacaccaaacguccaccucgcccccgccguagcccccacuuuccccggcgaacaacuccuguucuuccgaucuaccauacccggaugcggcggccacccaaacaugaaccucgauugccuccucccacaagaauggguccaacacuuuuaucaagaagccgcccccgcccaaucagacgucgcccuccuccgcuucgucaaucccgacacuucucgcguccuauucgaaugcaaacuccacaaauccggcuaugucaccguagcccauaccggccaacacgaccucgucauuccuccaaauggauacuuccgcuucgacucaugggucaaccaauucuacacccucgcacccaugggcaacggaaccggaaggaaacgauaa

SEQ ID NO: 39026 - RNA, 1617 nt, Artificial Sequence
  derived and/or modified sequence opt11 from VP1__Norovirus_and/or_Norovirus-like__JX459653
augaaaauggccagcucugaccccaacccuucagacggaagcacagccaaccuaguuccagaagucaacaaugaagucauggcccuugaacccgucgucggcgcagccaucgccgcccccgucgccggccaacaaaacguaaucgaccccuggauaagaaacaacuucguucaagccccaggcggcgaauuuacaguaucaccccgcaacgcccccggcgaaauacucugguccgcaccccuaggcccagaccuuaacccauaccucucacaccuagcccgaauguacaacggauacgcggguggcuucgagguacaagucauccuagccggcaaugcuuucacugcaggcaagaucaucuucgcagcagucccucccaacuuccccacagaaggucucucacccucccaagucaccauguucccucacauaaucguugacguccgucaacuugaacccguccucaucccccuccccgauguacgcaacaacuucuaccacuacaaccaauccaacgacucaaaacucaagcuccgcccaaugcuuuacacgccucuccgagcaaacaacgcaggcgacgacgucuucaccguauccugcagaguccucacucgcccaucccccgacuucgacuucauauuccucgucccacccaccgucgaaucccgcacaaaacccuucuccguacccguucucaccgucgaagaaaugacaaacuccagauuccccaucccccuugaaaaacuauuuaccggcccaucaucggcuuuugucguccaaccccaaaacggacgcugcacaaccgacggcgucuuacucggcaccacccaacuguccccagucaacaucugcacuuuccgaggcgacguaacacacauccccggaagcagaaauuacacaaugaaccuagcuucucaaaacuggaacucuuacgacccuaccgaagagauucccgcuccccucggaaccccugacuuugucggcaaaauccaaggcguacucacccaaaccacaagaaccaaugguuccacucgaggccacaaggccaccguuuacaccggcagcgccgacuucucccccaaacucggccgcguccaauucgcuacagauaccgacaacgacuucgaaacaaaccaaaacaccaaauucaccccugucggcgucauccaagacgguuccaccaccccaagaaacgaaccccaacaauggguccuacccuccuacuccggccgcaacauucacaacguacaccuagcucccgccguugccccaaccuuccccggcgaacagcuuuuauucuuccgcuccaccaugcccggcugcucaggcuaccccaacauggaucuagauugccuucucccccaagaguggguccaauacuuuuaccaagaagccgcccccgcccaguccgacguugcccuccuccgauucguuaacccagacaccggacgaguccucuucgaaugcaaacuccacaaauccggcuacguuaccgucgcacauaccggacaacacgaccucgucauacccccuaacggcuacuuccgcuucgacucaugggucaaccaauucuacacucucgcccccaugggcaacggcacaggacgccgccgcuaa

SEQ ID NO: 39027 - RNA, 1617 nt, Artificial Sequence
  derived and/or modified sequence opt11 from VP1__Norovirus_and/or_Norovirus-like__KX514359
augaaaauggccagcaacgacgcaaaccccucagacggcucugcagcuaaucuggucccagagguuaacaacgaagucauggccuuagaacccgucgucggcgcagcaauagccgccccugucgccggacaacaaaacgucaucgaccccuggauacgcaacaacuucguccaagcccccggcggagaguucacagucucaccccgcaaugcccccggcgaaauacucuggucagccccucucgguccagaccucaauccauaccuuucccaccuagcacgaauguacaacgguuacgcaggaggauucgaaguccaaguaauacucgcugguaacgccuucaccgccgguaaaauaauauucgcagccguaccacccaacuuccccaccgaaggucuaucccccucacaagucaccauguucccccacaucaucguagacguucgacaacucgaacccguccuaaucccccuucccgacguccgcaacaacuucuaccacuacaaccaaucaaacgacuccaccaucaaacucaucgccaugcuguacacaccccucagagcaaacaacgcaggcgacgacgucuuuaccgucuccugccgcguccuaacccgcccuucaccugacuucgacuucaucuuccuaguacccccaaccgucgaaagccgcuccaaaccauucucaguucccguccucaccgucgaagaaaugaccaacucccguuuccccgccacucucgacaaacuauuuaccggacccuccagcacauucgucguccagccacaaaacggcagaugcaugaucgacgguguccuccucggcacaacccaacucucccccgucaacauaugcacauuccgcggcgacguaacccauccccgcgacucaccaaucuacacaaugaaccucgcaucccccaacuggaacaauuacgaccccaccgaagaaauaccagcuccccucggcacccccgacuucgugggcaaaauccaaggcaugcucacccaaaccaccaaaggcgaaggcagcacccgcggccaccgcgccacugucuacgucggcuccgccaacuacgccccaaaacuuggccgcguacaauucgaaacagacaccacaaacgaccucgacgcccaccaaaacacaaaauucacccccguaggagucguccaaggcggagaaucaccccaacguuccgaaccccaacaguggguacucccauccuacuccggucgcgacacccccaacguccaccuugcccccgcagucgcacccaccuuccccggcgaacaacuacuuuucuuccgcuccaccauacccgguugcggcggucacccuaacaugaaucucgacugcuuacuuccccaagaauggguucaacauuucuaucaagaagccgcccccgcccaauccgacgucgcacuacuccgguucgucaacccugauaccucucgcguacuauucgagugcaaacuccauaaauccggcuacguaaccguugcacacacaggccaacacgaccuaguaaucccaccgaauggauacuuccgcuucgacucaugggucaaccaauucuacacccucgccccaaugggaaacgggaccggccgcaaacgcuaa

SEQ ID NO: 39028 - RNA, 1617 nt, Artificial Sequence
  derived and/or modified sequence opt11 from VP1__Norovirus_and/or_Norovirus-like__KX514296
augaaaauggccucgaacgacgcuaaccccucagacggcagcgccgccaaccucguccccgaaguuaauaacgaagucauggcacuagaacccguaguaggugcagccauagcagcccccguagcaggacaacagaacguaaucgaccccuggauccgaaauaacuucguacaagcucccggaggcgaguucacagucagcccccgcaacgcacccggcgaaauccucugguccgcuccacuuggccccgacuuaaacccauaccucucccaccuagcccgaauguacaacggauacgccggaggauucgaaguccaagucauucucgccggaaacgcauucacagcaggcaaaaucauauuugccgccgucccacccaauuuccccaccgaaggacucucccccucccaagucacgauguucccccauaucauuguagacguccgucaacuugaaccuguccuaauaccccuuccugacguacgaaacaacuucuaucacuacaaccaaucaaacgacuccaccaucaagcuaauagccaugcucuacacaccccuucgcgcaaacaacgccggugacgacgucuuuaccgucuccugccgcguccucacccgucccucccccgacuuugacuucaucuuccucguucccccaaccgucgaaucccgaucuaaacccuucuccgucccuguccucacagucgaagaaaugaccaacucacgauuccccgccacacucgacaaacuauucaccggcccuucauccaccuucguaguccaaccacaaaacggccgaugcaugauagacggcguccuccuaggcaccacccaacucucacccgucaacauuugcaccuuccgcggugacguaacacacccccgagacucccccauauauaccaugaacuuagcaucccccaacuggaauaacuacgacccaaccgaagaaauccccgccccucucggaacccccgacuucgucggcaaaauccaagguaugcucacccaaaccaccaaaggcgaaggcucgacccgcggucaccgcgcaaccguauacguaggcuccgcuaacuacgcccccaaacucggccgcguacaauuugaaaccggcacaaccaacgaccucgacgcacaccaaaacacaaaauucacccccguuggcgucguccaaggcggcgaaucaccccaaggcucagaaccacaacaauggguccuccccuccuacuccggacgcgacacccccaacguccaccuagccccagcagucgcacccacauuccccggagaacaacuccucuucuuccgcuccaccauacccggcugcggcggccacccaaacaugaaccuagacugccuccucccacaagaauggguucaacacuucuaccaagaagcagcaccagcccaauccgacgucgcccuucuccgcuucguaaaccccgacaccucacgcguccucuucgaaugcaaacuccauaaaucuggcuacgucaccguagcccacaccggccaacaugaccuagucauuccacccaacggcuacuuccgguucgacuccuggguaaaucaauucuacacacucgcacccaugggcaacggcaccggccgcaaacgauaa

SEQ ID NO: 39029 - RNA, 1617 nt, Artificial Sequence
  derived and/or modified sequence opt11 from VP1__Norovirus_and/or_Norovirus-like__KX514284
augaaaauggccucaaacgacgcaaaucccagcgacggcagcgcagccaaccuaguucccgaaguaaacaacgaaguaauggcccucgaaccaguaguaggcgcagccaucgcagcccccguugcaggccaacaaaaugucaucgaccccuggauacguaacaacuucguccaagcacccgguggagaguucaccgucucuccccguaacgcccccggagaaauacucugguccgcaccacucggcccagaccucaacccuuacuuaagccaccucgcccgcauguauaacggcuaugccggcggguucgaaguccaaguaauucucgccggcaaugccuucaccgcaggcaaaauaaucuucgcagccgucccaccuaacuuccccaccgaaggacucucucccucucaaguaacuauguucccucacaucaucgucgacguccgacaacuagaaccaguccucaucccccuacccgacguacgcaacaacuucuaccacuacaaccaauccaacgacuccaccaucaagcucauagccaugcuguacaccccacuacgcgccaacaacgccggcgacgacguauucaccgucuccugcaggguucucacacgaccaucucccgacuucgacuuuaucuuccucguaccacccaccguagaaucacgcagcaaacccuucucaguacccguacuaaccguagaggagaugacuaacucccgcuuccccgccacacuugacaaacuauucacaggaccauccuccaccuucgucguccaaccccaaaacggccgcugcaugaucgacggcguccuacuuggcaccacccaacucucccccgucaacauuugcaccuuccgcggcgacguuacucaccccagagacucccccauauacaccaugaaucucgccuccccaaacuggaacaacuacgaccccaccgaagaaauccccgccccucucggaacaccagacuucgucggcaagauccaaggcaugcucacccaaaccaccaaaggcgaaggcuccacccguggccaucgggcaacagucuacguuggcagcgccaacuacgcacccaaacuaggcagaguacaauucgaaaccgacacaacaaacgaccucgaugcacaccagaacaccaaauucacccccgucggcguaguucaaggcggagagucaccccaacgcuccgaaccccaacaauggguccuuccauccuacuccggccgcgacacccccaauguccaccucgcacccgccgucgcccccaccuuucccggagaacaacuccucuucuuccgcuccaccaucccaggcugcggcggccaccccaacauggaccuagacugccuacucccucaagaauggguccaacacuucuaccaagaggcugccccagcccaauccgacguagcccuccuacgcuucgucaaccccgacaccucccgaguccucuucgaaugcaaacuccacaaauccggcuacgucacagucgcucacaccggccaacacgaccucguaauaccacccaauggcuacuuccgauucgauucuugggucaaccaauucuacacacuagcccccaugggcaacggcaccggacgcaaacgcuaa

SEQ ID NO: 39030 - RNA, 1617 nt, Artificial Sequence
  derived and/or modified sequence opt11 from VP1__Norovirus_and/or_Norovirus-like__KX514245
augaaaauggccuccaacgacgcuaaccccuccgacggcucagcagccaaccucguacccgaaguuaacaacgaagucauggcauuagaaccagucguuggcgccgccauagcagcaccaguugcaggccaacaaaacgucauagacccauggauacgcaacaauuucguccaagcuccaggcggagaguucaccguuucaccccgaaacgcccccggcgaaauccucugguccgcaccccuaggccccgaccucaaccccuaucucucgcaucucgcacgcauguacaacggcuacgccgguggcuucgaaguacaagucauacuggccgguaacgccuucacagccggcaaaaucaucuucgccgccgucccacccaacuuccccacagaaggccucucccccagccaagucaccauguucccccacaucaucgucgacguccgccaacucgaaccuguccuuaucccccucccagacgucagaaacaacuuuuaccacuacaaccaaucaaacgacuccaccaucaaacuaaucgcaaugcucuacacuccccuccgagccaacaacgcuggagaugacgucuucaccguauccugccgcguccucacccgccccucacccgacuucgacuucauauuccucguaccgccaaccgucgaaucccgcagcaagcccuucuccguaccaguacuaaccgucgaagaaaugacuaauucccgcuuucccgccacccucgacaaacuauucacaggccccuccucaaccuucgucguccagccacaaaacggucguugcaugaucgacggcguacuccucggcacgacccaacucucccccguaaacaucugcaccuuucgcggagacgucacccacccccgcgacucuccaaucuacaccaugaaccuagcuucucccaacuggaacaacuacgacccaacagaagagauccccgcaccccucgguacacccgacuucgucggcaaaauacaaggcaugcucacccaaaccacuaaaggcgaagguuccacacgaggacauagagccacgguauacgucggcuccgccaauuacgcccccaaacucggccgcgugcaauucgaaaccgacaccacuaacgaccuggacgcacaccaaaacacaaaauucacccccgucggcguaguacaaggcggugaaucaccccaacguucugaaccucaacaauggguccuacccucguacucaggccgcgacacccccaacguccaccuagcacccgccguagcccccaccuuccccggagaacaacuccucuucuuccgcuccacuauaccaggcugcggcggccaccccaacaugaaccucgacugccucuugccacaagaguggguccaacacuucuaccaagaagcugcucccgcacaauccgacgucgcccuacuccgauucguaaacccagacaccucccgcguccuguucgaaugcaaacuacacaaauccggcuacgucaccgucacacacacaggacaacaugaccucgucauaccacccaacggcuacuuucgcuucgacuccugggucaaccaauucuacacccuagcacccaugggcaacggcaccggccguaaacgcuga

SEQ ID NO: 39031 - RNA, 1617 nt, Artificial Sequence
  derived and/or modified sequence opt11 from VP1__Norovirus_and/or_Norovirus-like__KX514327
augaaaauggcaagcuccgacgcaaacccaagcgacgggucuacagccaaccucguacccgaaguuaacaacgaagucauggcccucgaacccgucgugggcgcggccaucgccgccccaguagcuggacaacaaaacguuaucgaccccuggauccgcaacaacuucguccaagcccccggaggagaauucaccgugucaccacgcaacgcccccggcgaaauacuuuggucagcaccccuaggccccgaccucaacccauaccuuucccaccuagcccgaauguacaacggcuacgcaggcggauucgaaguccaagugauccucgcaggcaacgccuucacagcuggaaagaucaucuucgccgccgucccccccacauuccccaccgaaggccuauccccuucucaagucaccauguucccccacauuauagucgacguuagacaacucgaacccguccuaauaccacuacccgacguacgaaacaauuucuaccacuacaaccaaucaaacgauagcaccaucaaacuuaucgccaugcucuacacacccuuacgagccaacaacgccggcgacgacguauucacagucuccugccgaguucucacacgaccuucccccgacuucgacuucaucuuccuaguaccccccaccguagaaucccgcuccaaacccuucucagucccaguacucaccgucgaagaaaugacuaacagccgcuucccagccacccucgacaaacucuucaccggccccuccuccaccuucgucguacaaccacaaaacggccgaugcaugaucgacggaguccuccuagggaccacccaacucucccccgucaacauaugcaccuucagaggcgacguaacccacucuggcaacucaaaaaucuacacgaugaaccuagcaucccccaacuggaacaacuacgaucccacagaagaaauccccgccccacugggaacccccgauuucgucggcaaaauccaaggaaugcucacccaaacaacaaaaggcgaaggcuccacccgcggccaccgugcuacggucuacgucggcuccgcaaacuacgcccccaaacucggacgaguccaauucgaaaccgacaccacagacgaccucgacgcacaccaaaacacaaaauucaccccagucggggucguccaagguggagaaucaccaaaaggauccgaaccacaacaauggguacuucccuccuacucaggucgcgacacccccaacguccaccucgccccugccguagccccaacauuccccggggaacagcuacuguucuuccgcuccaccauccccggcugcggcggccacccaaacaugaaccuagacugucuacuaccucaagaauggguacaacauuucuaccaagaagccgcucccgcccaauccgacgucgcccuccuccgcuucgucaaccccgacacaucccgcguccucuucgaaugcaaacuccacaaauccggcuacguaacuguagcccacaccggacaacacgaccuagucauccccccaaacggauacuuccgauucgacagcugggucaaccaguucuacacccuagccccuaugggaaacgguacaggccgaaaacgcuga

SEQ ID NO: 39032 - RNA, 1617 nt, Artificial Sequence
  derived and/or modified sequence opt11 from VP1__Norovirus_and/or_Norovirus-like__KX514301
augaaaauggcaucuaacgacgccaaucccucugacggauccgccgcaaaccucguccccgaagucaacaacgaagucauggcccucgaacccguagucggugccgccaucgccgcccccgucgcaggacaacaaaacgugauagaccccuggauaagaaacaacuucguccaagcacccggaggcgaguucaccgucucaccccgaaacgcccccggugaaauacucugguccgcaccccuagguccagaccucaauccguaccucucucaccuagcccgcauguacaacggcuacgccggcggcuucgaaguucaagucauccuagccggaaaugcauucaccgcggggaaaaucauauucgcugcagucccaccaaacuucccuaccgaaggccuuucccccucccaagucaccauguuuccccacaucaucguagauguacgacaacucgaaccaguacucauaccccuccccgacgucagaaacaacuucuaccacuacaaccagucaaacgacagcacaaucaaacucaucgccaugcucuacaccccacuccgagccaacaacgccggagacgacguauucaccgucuccugucguguccucacccgacccucacccgacuucgauuucaucuuccucguucccccgacagucgaaucacgauccaaaccauucuccgucccaguccuaacaguagaagaaaugaccaacucacgauuuccagcaacccucgacaaacuuuucaccggccccagcuccaccuucgugguccaaccccaaaacggccgcugcaugaucgacgguguacuccuaggcaccacgcaacucucacccguuaacaucugcacauuucgaggcgacgucacacacccacgcgauucaccaauauacacaaugaaccucgccuccccuaacuggaacaacuacgacccaacagaagaaaucccagcaccccuaggaaccccugacuucgucggaaagauccaaggcaugcucacacaaaccaccaagggagaaggcagcacaagagggcacagggccacaguauacguuggcuccgccaacuacgcccccaagcucggccgcguucaauucgaaacggacacaacuaacgaccuagacgcccaccaaaacaccaaauucacccccgucggcgucguacaaggcggcgaaucccccaaagguuccgaaccucaacaauggguccuacccuccuacagcggcagagacacccccaacguccaccucgcacccgccgucgcacccaccuuccccggagaacaacuacuauucuuccgcucaacaauacccggcugcggcggccacccaaacaugaaccucgacugccuacucccccaagaauggguacaacacuucuaccaagaagccgcccccgcccaaucugacgucgcccuccuccgauucguaaacccagacaccagccgcguccuauuugaaugcaaacuccacaaauccggcuacgucaccgucgcccacacaggccaacacgaccuugucauaccacccaauggcuacuuccgcuucgacucauggguuaaccaauucuacacccucgcccccaugggaaauggaaccggccgaaagcgcuaa

SEQ ID NO: 39033 - RNA, 1617 nt, Artificial Sequence
  derived and/or modified sequence opt11 from VP1__Norovirus_and/or_Norovirus-like__KX514299
augaaaauggccuccaacgacgcaaaccccucagacggcucagccgcaaaucucguccccgaagucaacaacgaagucauggcccucgaaccagugguaggcgccgcaaucgccgccccggucgccggccaacaaaacguuaucgacccauggauccgcaacaacuucguccaagcccccggcggcgaguucaccguuucaccacgaaacgcccccggugaaauccucugguccgcaccccucggacccgaccuaaaccccuaccucucccaccuagcccgaauguauaacggauacgcaggaggcuucgaaguacaagucauccucgccggaaacgcauucacagcaggcaaaaucaucuucgccgccgucccucccaacuuccccaccgaaggacucuccccaagccaaguaaccauguucccccacaucauugucgacguaagacaacuagaacccguacuaaucccccuccccgacguccgaaacaacuucuaccauuacaaccaauccaacgacuccaccaucaaacugaucgccaugcuauacaccccacuccgcgcuaauaacgccggugacgacguauucacagucucaugccgcguccucacccgacccuccccugacuucgauuucaucuuccuaguaccaccuaccgucgaaucacgcuccaaacccuucagcguccccguccuaaccguugaagaaaugaccaacucccgcuuccccgccacacucgacaaacucuucaccggccccuccuccaccuucgugguacaaccacaaaacgggaggugcaugauagacggcguccuccucggcaccacacaacuaagcccaguuaacauaugcaccuuccguggagacguaacccacccccgagacucgccaaucuacacaaugaaccucgcgagccccaacuggaacaacuacgaucccaccgaggaaauccccgcaccccucggcaccccugacuucgucgguaaaauccaaggcaugcucacacaaacaaccaaaggcgaaggauccacccgcggccaccgagccacuguuuacguaggauccgcaaacuacgcccccaaacucgggcgcguccaauuugaaaccgauaccaccaacgaccucgacgcccaccaaaacaccaaauucacucccgucggaguaguacaaggcggagaauccccacaaggaucagaaccccaacaauggguccuacccucauacucgggucgcgacacgcccaacguccaccucgcacccgccgucgcacccaccuuucccggcgagcaacuccucuucuuccgcaguaccauccccggcugcggaggccaccccaacaugaaccucgacugucuucuaccacaagaauggguacaacacuucuaccaagaagcagcucccgcccaauccgacgucgcccuccuccgcuucguaaaccccgacacuucacgcguacuauucgaauguaaacuccacaagucuggcuacguaaccguagcacacaccggccaacacgaccucgucaucccacccaacggcuacuuccgcuucgacagcugggucaaccaauucuacacacuagcacccaugggcaaugggacaggcagaaaacgcuag

SEQ ID NO: 39034 - RNA, 1617 nt, Artificial Sequence
  derived and/or modified sequence opt11 from VP1__Norovirus_and/or_Norovirus-like__KX514277
augaaaauggccucaaacgacgccaaccccuccgacggauccgccgccaaccugguccccgaaguaaacaacgaagucauggcacucgaacccguugucggagccgccaucgccgccccugucgccggccaacaaaacgucauagacccuuggauccguaacaacuucguccaagccccgggcggcgaguucaccgucucaccccgcaacgccccuggagaaauccuaugguccgcaccacucggccccgaacucaaccccuaccuaucccaccuugccagaauguacaacggcuacgccggcgguuucgaaguccaagucauccucgccggaaacgccuucaccgccgguaaaaucaucuuugccgcagucccgccaaacuuccccaccgaaggacuaucccccucccaaguaaccauguucccccacauaaucgucgacguccgacaauuagaaccaguccuaauaccucuccccgacguccgcaacaacuuuuaccacuacaaccaauccaaugacuccacaaucaaacucaucgccaugcuauacaccccucuccgcgcuaacaacgccggcgaugacgucuucaccgucucuugcagaguccuaacccgacccucccccgacuucgacuuuaucuuccucguacccccaacugucgaaucccgcuccaaacccuucuccgucccuguucucacugucgaagaaaugaccaacucccgauuccccgccacccucgacaaacuauucacuggacccuccucaaccuucguuguacaaccccaaaacggacgcugcaugaucgacggaguccuccuuggcaccacccaacucucacccgucaacauuugcaccuuccgaggugaugucacacacccucgcgacuccccaaucuacaccaugaaccucgcaagccccaacuggaacaacuacgaccccacugaagaaauuccagcaccgcucggcacaccugacuucgucgguaaaauccaaggcaugcucacacaaaccaccaaaggcgaaggcucaacccgaggccaccgcgcaaccguauacgucggcucagccaacuacgccccaaaacucggccgcguacaauucgaaaccgacaccaccaacgaccuugacgcccaccaaaacaccaaauucaccccuguaggcgucguacaaggaggcgaaucccccaaaggcuccgaaccccaacaauggguccuccccucauauucaggccgagacacccccaacguacaccucgcccccgcagucgcacccacuuucccaggcgaacaacuucucuucuuccgcuccacuauccccggcugcggcggccaccccaacaugaaccuagacugucuccuaccccaagaauggguucaacauuucuaccaagaagcagccccagcccaaucugacgucgcccuccuacgauuugucaaccccgacacuucacgcguacuauucgaaugcaaacuucacaaauccggcuacgucacaguagcacacaccggccaacacgaccuugucauacccccaaacggcuacuuccgauuugacucaugggucaaccaguucuacacucuagcacccaugggcaacggaacaggacgaaaacgcuaa

SEQ ID NO: 39035 - RNA, 1617 nt, Artificial Sequence
  derived and/or modified sequence opt11 from VP1__Norovirus_and/or_Norovirus-like__KX514213
augaaaauggccuccaacgacgccaaccccucugacggauccgccgcaaaccucguaccagaagucaacaacgaggugauggcccuugaacccguuguaggcgcagccaucgccgccccugucgcuggccagcaaaacgucauugaccccuggauccgaaauaacuucguacaagcacccggcggcgaguucaccguuuccccucgcaacgcaccaggcgaaauccucugguccgccccacucgggcccgaccucaaccccuaccuaucccaucucgcccgcauguacaauggcuacgccgggggcuucgaaguucaagucauacuagccggcaacgccuucaccgccggcaaaauaaucuucgccgccguacccccaaacuucccgacugaaggccuaucccccucucaggucaccauguucccucacaucaucguggacguacgccaacucgaacccguacuuauaccccuaccagacguacguaauaauuuuuaccacuacaaccaauccaacgacagcacaaucaaacuaauagccaugcucuacacuccccuccgcgcuaacaacgccggugacgacguauucaccguuuccugccgcguacucacccguccaagccccgacuucgacuucaucuuccuaguaccacccaccgucgaaucucgauccaaacccuuuuccguccccguccucaccguccaagaaaugaccaacuccagauuccccgcaacacuagacaaacuauucacaggcccuuccagcaaccuaguuguccaaccccaaaacggccgaugcaugaucgacggaguacuacucggaaccacacagcucucccccgucaacaucugcaccuuccgaggugacguaacccacccacgcgacucaccuaucuacaccaugaaucucgccucccccaacuggaacaacuaugacccaacagaagaaauccccgcgccccuaggaacccccgacuuugucggcaaaauccaagguaugcuuacgcaaacaacuaaaggcgaaggcuccacccgcggccaccgcgcaaccguauacgucggcuccgccaauuacgcccccaaacucggccgcguccaauucgaaaccgacaccaccaacgaccuugaugcacaccagaacacaaaauucacccccgucggcgucguccagggcggagaaaguccccaacgauccgaaccccaacaauggguccuacccuccuacucaggccgugacacccccaacguccacuuagcccccgcagucgcccccacauuccccggugaacaacuccuauucuucagauccacaauccccggcugcggcggccauccaaacaugaaccucgacugccuacucccccaagaauggguccaacacuucuaccaagaagccgcccccgcacaaucugacguagcacuccuucgcuucguaaaccccgacacuucacguguccucuuugaaugcaaacuacacaaauccggcuacgucacagucgcccacaccggacaacacgaccucgucauaccacccaacggcuacuuccgcuucgacucaugggucaaccaauucuacacccucgcccccauggguaacggcaccggacggaaacgcuaa

SEQ ID NO: 39036 - RNA, 1617 nt, Artificial Sequence
  derived and/or modified sequence opt11 from VP1__Norovirus_and/or_Norovirus-like__KT033903
augaagauggcguccucagaugccaacccaucugacggauccaccgcaaaccucgucccagaagucaacaacgaagucauggcacucgagcccguaguuggcgccgccauagccgcccccgucgcaggccaacaaaacgucaucgacccauggauacgaaacaacuucguccaagcccccggcggcgaguucacagucagcccccgcaacgcccccggagaaauauuaugguccgcaccccuaggccccgaccucaacccuuaucuaucacaccuagcacggauguacaacggauacgcaggcggauucgaaguccaaguaauacuugccgguaacgccuuuacagccggaaaaaucaucuucgccgcagucccucccaacuucccaacagaaggacuaucucccucacaagucacaauguucccacacaucaucgucgacguccgccaacuugaacccguacuaaucccccuccccgacguccgcaacaacuuuuaccacuacaaccaaucaaacgacucaaccauaaaacuaauagcaaugcuuuacaccccacuucgcgccaacaacgcuggcggcgacguauucaccgucucaugccgcguccucacccgccccuccccugacuucgacuucauuuuccucgucccucccacaguagaaucccgaacgaaacccuuuucgguccccguccucaccguagaagaaaugacaaauucccgcuuccccaucccacucgaaaaacucuucacuggccccucguccgccuucgucguccagccacaaaacggacgcugcaccaccgacggcgucuuacuaggcaccacccaacuaucccccguuaacaucugcacauuccgcggagacgucacccacaucccaggcucacgcaacuacacaaugaaccucgccagccaaaacuggaacuccuacgaccccaccgaagaaaucccggccccucuaggcacaccagacuucgucggaaagguacaaggcguccucacacaaaccacccgcacuaacggauccacccgcggccacaaagccacaguauacaccggauccgcagauuucuccccaaaacuaggccgaguccaauucgcaaccgacacagacaacgacuucgaaaccaaccaaaacaccaaauucacccccgucggcguaauacaagacggcuccaccacaccccguaacgaaccacaacaauggguacucccauccuacucgggccgaaacauccacaacguacacuuagcucccgccguugcaccaaccuuccccggggaacaacuccucuucuuccguucaaccaugcccggcuguuccggcuaccccaacauggaccucgacugccuccuaccacaggaauggguccaauacuucuaccaagaggcagcccccgcccaaucagacguagcacucuuacguuucguaaacccagacacaguccguguccucuucgaaugcaaacuccacaaaucgggcuacguaaccgucgcacacacaggccaacacgaccucgucaucccaccaaacggcuacuuccgauuugacagcugggucaaccaauucuacacccucgcaccaaugggcaacggcaccggccgacgccguuaa

SEQ ID NO: 39037 - RNA, 1617 nt, Artificial Sequence
  derived and/or modified sequence opt11 from VP1__Norovirus_and/or_Norovirus-like__HM625866
augaaaauggccuccuccgacgcaaaccccagcgacggaucgaccgccaaccuuguccccgaagucaacaacgaagucauggcacuugagcccguagucggcgccgccuccgccgcgcccgucgcaggccaacaaaacguaaucgacccguggauacgaaacaacuucguacaagcccccggcggcgaauuuaccgaaucccccaccaacgccccaggagaaauccucuggucagccccucuaggccccgaccuaaaccccuaccuaucccaccuagcacgaauguauaacggcuacgcuggaggcuucgaaguccaaguaauacucgccggaaacgccuuuaccgccggcaaaauuauauucgcagccguaccacccaacuucccaacagaaggccuaucaccaucccaaguaaccauguucccccacaucaucguugauguacgccaacuagaacccguccucauaccccuacccgacguccguaauaacuucuaccacuacaaccagagcaacgacccuaccauaaaacucaucgccaugcuauauacaccccuacgcgccaacaacgccggagaugacguguucaccgucagcugccgcguccucacccgacccucacccgacuucgacuucaucuuccuuguacccgccaccguagaaagcagaacaaaaccauucuccguccccguccucacaguagaggaaaugaccaacucccgauuucccaucccccucgaaaaacuguucaccggaccuucaucagccuucgucguucaaccacaaaacggaaggugcaccacagacggcguccuucucggcaccacacagcucuccccaguaaacaucuguacauuucgcggcgacguaacccacauccccggcucacgaaacuacaccaugaaccucgccucccaaaacuggaacucauacgacccaacagaagaaauccccgccccugucggcacccccgacuucgucggcaaaauccaaggcguacucacccaaaccacacgaacgaaugguucaacccgaggacacaaagccacagucuacaccggcucugcagacuucucacccaaacuuggacguguccaauucgccacagacaccgacaacgacuucgaaaccaaccaaaacacaaaauucacccccgucggcgucauccaggauggaagcacaacccccagaaacgaaccacagcaauggguacuacccuccuacuccggacguaacauacacaacguccaccuggccccagccgucgcccccacauucccaggcgaacagcuccuuuucuuccgauccaccaugcccgguugcucaggcuaccccaacauggaccuugauugccuacucccacaagaauggguccaauacuucuaccaagaagcugcaccagcccaaucagacgucgccuuacuucguuucgucaaccccgacacaggccgaguacuauucgaaugcaaacuccacaaaucaggcuacgucaccgucgcccacaccggucaacacgaccucgucaucccacccaauggauacuuccgguucgacagcuggguuaaccaauuuuacacccucgcacccauggguaacggcacaggccgucgucgcuga

SEQ ID NO: 39038 - RNA, 1617 nt, Artificial Sequence
  derived and/or modified sequence opt11 from VP1__Norovirus_and/or_Norovirus-like__KX514319
augaaaauggccuccucagacgcaaaucccuccgacggauccacagcaaaccuagucccugaagucaacaacgaagugauggcacucgaaccuguagucggcgcagcaaucgccgcccccguugccggucaacaaaacguaaucgaccccuggauccgcaauaacuucguacaagcaccaggcggcgaguucacagucagcccccgcaacgcccccggcgaaauccuuuggagcgcuccccucggcccagaccuuaaccccuaccuuucacaccucgcccgcauguacaacggauacgccggcggauucgaaguccaagucauccuagcaggcaacgccuucacagccgguaaaaucaucuucgcagcagucccucccacauucccgaccgaaggccucucaccuagccaggucacaauguucccccacauaauugucgacguacgacaacucgaacccguccuuauaccccucccagauguccgcaauaacuucuaccacuacaaccaaagcaacgacucuacaauaaaacuaaucgccauguuauacacaccccuccgcgccaacaacgccggcgacgacgucuucaccguuucuugcagaguccugacucgacccucacccgacuucgacuucaucuuccuaguacccccaaccgucgaauccagauccaaaccauuuucuguccccguccuaacagucgaagaaaugacaaacucacgcuucccagccacccuagacaaacuauucaccggcccauccagcacauucgucguccaaccccaaaacggccgcugcaugaucgacggcguccuccucggaaccacacaacuaucaccagucaacaucugcaccuucagaggcgacguaacccaccccggaggcuccaaaauauacaccaugaaccucgcaucaccaaauuggaacaacuacgacccaaccgaagaaauaccugcgccccuaggcacccccgacuucgucggcaaaauccaaggcaugcucacacaaaccacgaaaggagaaggauccacccgaggucaccgugccaccgucuacguaggauccgccaauuacgccccaaaacuaggccgcguucaauucgaaaccgacaccaccgacgaccucgacgcccaccaaaauacaaaauucaccccagucggcguaguccaaggcggagaauccccaaaaggcucagaaccccaacaauggguccuacccagcuacuccggccgcgacacacccaacguacacuuagcccccgcaguagcccccacauuucccggagaacaacuauuauuuuuccgcuccaccaucccaggcugcggaggacauccgaacauggaccuagacugccuccucccccaagaauggguccaacacuucuaccaagaggccgccccagcccaauccgacgucgcucuccuccgcuucgucaaccccgacaccucccgcguccucuucgaaugcaaacuucacaaauccggcuacguaaccgucgcacacacugggcaacacgaccucguuaucccacccaacggauacuucagguucgacuccugggucaaccaauucuacacucucgcccccaugggcaacggaacaggacgccgccgauaa

SEQ ID NO: 39039 - RNA, 1617 nt, Artificial Sequence
  derived and/or modified sequence opt11 from VP1__Norovirus_and/or_Norovirus-like__KX514311
augaagauggccucauccgacgccaaucccuccgauggcucaaccgccaaccucguacccgaaguaaacaacgaaguaauggcccuagaacccguagucggugccgccauagccgcaccuguagcaggccaacaaaaugucauagaccccuggaucagaaacaacuucguccaagcccccggcggagaguucaccgucucuccucgcaacgccccaggugaaauccucugguccgcaccccucggccccgaucuaaacccauaccucagccaccucgcccgaauguacaacggcuacgccggcggcuuugaaguacaagucauccucgccggcaacgccuucaccgccggaaaaauaaucuucgcugccguaccacccaacuuccccacagaaggccuuucccccucacaaguaaccauguucccccacaucauagucgacguccgccaacuagaacccguccucaucccccucccugacguccgcaacaauuucuaccacuacaaccaaagcaacgacucaaccauaaaacuaauagcgaugcucuacacaccccuccgcgcaaacaaccccggagacgacgucuucacagucuccugccgcguacucacaagacccucacccgauuucgacuucauauuccucgucccucccaccguagaaucccgcaccaaacccuucuccguccccauacucacagucggcgaaaugacaaacucccgcuucccaaucaaccuugaacgccuuuucaccggccccucauccgccaacgucguacaaccucaaaacgggcgcugcaugaucgacggcguacuucuaggcacuacccaacuaucccccguuaacauaugcaccuuccgcggcgauguaacacacccaggugguucaaaaaucuacaccaugaaccucgcaucucccaacuggaacaacuacgacccaacagaggaaauccccgcuccacucggcacgcccgauuucgucggcaaaauccaaggcaugcuaacccagaccaccaaaggugaaggcucaaccagaggccaccgcgccaccguauacguaggcucugccaacuacgcccccaaacuaggccgcguacaauucgaaaccgacaccaccgacgaucucgacgcacaccagaacacaaaauuuacacccgucggcgucguccaaggaggcgaaagccccaaaggcuccgaaccccaacaauggguccuuccuucauacuccggacgcgacacaccaaacguacaccuugcaccagccguugcacccaccuucccaggcgaacagcuccucuucuuucggucuacaauaccuggcugcggcgggcaccccaacaugaaccucgauugccuacuaccccaagaguggguccaacacuuuuaccaagaagccgcccccgcccaguccgacgucgcccuacuccgcuucguaaaucccgacacaucccgcguccuauucgaaugcaaacuccacaaauccggcuacgucaccgucgcccacaccggccaacacgaccucguaauaccacccaacggcuauuucagauucgacucaugggucaaucaauucuacacccucgcacccaugggaaacggcaccggacgcaaacgcuaa

SEQ ID NO: 39040 - RNA, 1617 nt, Artificial Sequence
  derived and/or modified sequence opt11 from VP1__Norovirus_and/or_Norovirus-like__KX514266
augaaaauggccuccaacgacgccaaccccagugacggcucagccgccaaccucguacccgaagucaacaacgaaguaauggcacuagaaccagucgucggcgccgccauagccgcccccguagccggacaacaaaacguaauugaccccuggauccgaaacaacuucguccaagcucccgguggagaguucaccguauccccacggaacgcccccggcgaaauccugugguccgcaccccuuggacccgaccuaaaccccuaccucagucaucucgcccgcauguacaacggauacgcagggggcuucgaaguccaagucauacucgccggcaaugccuucaccgcaggcaaaaucauauucgccgcugucccacccaacuucccaacugaaggccuauccccgucccaaguaaccauguucccccacaucaucgucgacgucagacaacucgaacccguacucauaccgcucccagacguacgcaacaacuuuuaccacuacaaccaaucaaacgacuccacaauaaaacuuaucgcaaugcucuacacgccccuccgagcuaacaacgccggcgacgacgucuucaccgucuccugccgcguccucacgcgccccucccccgacuuugacuucaucuuccucguaccuccaaccguagaaucccgcuccaagccuuucuccguccccguccucaccgucgaagaaaugacaaacucacgcuucccagcaacccuugacaaauuauucaccggcccaucaucuaccuucgucguacaaccccaaaacggacguugcaugaucgacggcguccuccucggaacuacacaacugucacccgucaauaucugcaccuuccguggcgacgucacccacccuggcgacucuccaaucuacaccaugaaccuggccucacccaauuggaacaacuacgacccuaccgaagaaauacccgcaccccuaggcacacccgacuucgucggcaaaauccaaggcaugcuaacccagacuaccaaaggcgaaggcucaacacgcggccaccgcgccaccgucuacgucggcagugcaaacuacgcgcccaaacucggccgaguacaauucgaaacggacaccacuaacgaccucgacgcccaccaaaacacaaaauucacaccagucggcgucguacaagguggcgaauccccaaaaggcuccgaaccccaacaauggguccucccaucauacucaggucgagacacccccaacguucaucuagccccugccguagcaccuaccuuccccggagaacaacuacucuucuuccgcuccaccauacccggcugcggcggccaucccaacaugaaccuagacugccuacuuccucaagaauggguccaacacuucuaccaagaagccgccccagcccaauccgacgucgcccuccucagauuugucaaccccgacaccucccguguccucuucgaaugcaaacuacacaaaagcggauacguaaccguagcacacacuggccaacacgaccucgucauaccaccaaacggcuacuuucgcuucgacuccugggucaaccaauucuacacccucgcccccaugggcaacggcaccggccguaaacgauaa

SEQ ID NO: 39041 - RNA, 1617 nt, Artificial Sequence
  derived and/or modified sequence opt11 from VP1__Norovirus_and/or_Norovirus-like__KX514235
augaaaauggccuccaacgacgccaaccccuccgacggcagcgcagccaaccucguccccgaaguaaacaacgaaguaauggcccuagaacccgucgucggcgccgcuaucgccgccccaguagccggacaacaaaacgucauagaccccuggauccgcaacaacuucguacaagcccccggaggcgaguucacaguauccccacgcaacgcccccggcgaaauccuuugguccgcuccccugggccccgaccuaaacccauaccuaucccaccuagcccgaauguacaacggcuacgccggaggauucgaaguacaaguaauccuagccggaaacgccuucaccgccggcaagauuaucuucgccgcagucccacccaacuucccaaccgaaggacuaucccccucccaagucacuauguucccccacaucaucgucgacguacgacaacuagaacccguccuuauucccuuaccagacguccgcaacaacuucuaucacuacaaccaauccuccgacucaaccaucaagcucaucgccaugcuguacacgccccuucgcgcaaacaacgccggcgaugacgucuucaccguguccugccgaguacuaacccgccccuccccagacuucgacuucaucuuccuagucccacccacaguggaaucacgcuccaaacccuucucaguaccgguacucacaguagaagaaaugaccaacucacgauuccccgccacucucgauaaacucuuuaccggccccuccuccacuuuugucguccaaccccaaaacggacgcugcaugaucgacggaguuuuacuagguaccacucagcuauccccagucaacaucugcacauuccggggcgacgucacacacccccgugacucccccaucuacaccaugaaccucgccucccccaacuggaacaacuacgaccccacagaagagaucccagcgccccuaggcacgcccgacuucguaggcaaaauccaaggaaugcuuacccaaaccaccaaaggagaaggcucaacccgcggucacagagccaccgucuacgucggcucagccaauuacgcccccaaacucggccgcguucaauucgaaacagacaccaccaacgaccuagacgcccaccaaaacaccaaauucacucccgucggaguaguucaaggcggcgaaucaccccaaagauccgaaccccaacaauggguccuccccuccuacucaggccgagacaccccaaauguccaccuagcccccgccguagccccaacauucccuggcgaacagcuacucuucuuccgcuccacaauaccugguugcggcggccaccccaacaugaaccuagacugccuacucccccaagaauggguccaacauuucuaccaagaagcagccccagcccaauccgacgucgcccuacuccgguuugucaacccggacaccucccgcguacuauucgaaugcaaacuucacaaauccggauacguaaccgucgcacacacaggccaacacgaccuuguaaucccgcccaacggauacuuucguuucgacuccugggucaaccaauucuacacccuggcacccaugggcaacggcaccggccgaaaacgcuaa

SEQ ID NO: 39042 - RNA, 1617 nt, Artificial Sequence
  derived and/or modified sequence opt11 from VP1__Norovirus_and/or_Norovirus-like__KX354115
augaagauggcauccucagacgcaaaccccuccgacggcucagcagccaaccuaguccccgaagcaaacaacgaaguuauggcccucgaacccgucgcuggcgccgcccucgccgccccagucgcaggccaacaaaacgucaucgaccccuggauccgcaacaacuucguccaagccccaggaggugaguucaccauaaguccccgcaacgcccccggcgaaauccucugguccgcaccccuaggucccgaccucaaucccuaccucucccacuuagccagaauguacaacgguuacgcaggcggcuucgaaguucaagucauccucgcaggcaacgccuucacagccggcaaaguuaucuucgccgcagugccgcccaacuucccaacauccggccucucacccucucagguaacuauguucccaucugucgucgucgacguccgccaauuagaacccguccuaaucccccuccccgacguccgcaacaauuucuaccacuacaaccaauccaaugaccccaccaucacccuaaucgccaugcucuauacuccacuccgcgccaacaacgccggugacgacgucuucaccgucuccugccgcguccucacccgucccagccccgacuucgauuuuaucuuccuugucccucccaccguagaaucccgaaccaaacccuucuccguccccguacucaccguagaagaaaugacaaacucccgcuuccccaucccccuugaacgccucuucaccggucccucauccgccuucgucguccagccacaaaauggacgaugcacaacugacggaguccuccuuggcaccacacaacuuucaccagucaacaucuguaccuuucgcggagacaucauccacaucacaggcucccacaauuacacuaugaaccuggccagccaaaacuggaacaacuacgaccccacugaagaaauccccgcaccauuagguacucccgacuucgucggcaaaauccaaggcguucucacgcaaacaacacgcggcgacgguuccaccagaggucacaaagccacagucuacacaggcuccgcagacuucauccccaaacuuggccgcguccaauucgaaacagacaccaaccacgacuucgaagccaaccaaaacacuaaauucaccccagucggcguaauccaagacggcucaaccacacaccgcaacgaaccccaacaauggguccuccccuccuacuccggcagaaacacccauaacguccauuuagccccugccgucgcaccaacauuccccggcgaacaacuucucuucuuccgauccaccaugcccggcuguucaggcuaccccaacauggaccuagacugccuccucccacaagaauggguccaauauuucuaccaagaggccgcacccgcccaauccgacguagcccuccuacgguucguuaaccccgacacaggacgaguccucuucgaaugcaaacuccacaaauccggcuacaucacugucgcgcacaccggccaacacgaccucgucaucccacccaacggcuacuuccguuucgauuccugggucaaccaauucuacacacuugcccccaugggcaacggcacaggccgcaggcgcuga

SEQ ID NO: 39043 - RNA, 1617 nt, Artificial Sequence
  derived and/or modified sequence opt11 from VP1__Norovirus_and/or_Norovirus-like__KM272334
augaagauggccuccucagacgccaaccccuccgacggcucagcugcaaaccucgucccagaggucaacaacgaaguaauggcccuagaacccgucgucggcgcugccaucgcggcaccagucgccggccaacaaaauguuaucgaccccuggauacgcaauaacuucguccaagccccaggaggcgaguucaccgucagcccucggaacgccccaggcgaaauacucugguccgcgccccucggccccgaccucaaccccuaccucucccaccucgcccggaccuacaacggauacgccggcggauucgaaguccaagucauccucgccgguaacgcuuucaccgccggaaaaguuauauucgcagcaguacccccuaacuuccccacagaaggacucuccccaucccaaguuacaauguucccacacaucgucgucgacgcccgacaacucgaaccaguccugaucccccucccagacguccgaaacaacuucuaccacuauaaccaaucgaaugaccccacaauuaaacucaucgcuaugcucuacaccccacucagagcaaacaacgccggcgacgacgucuuuacuguauccugucgcguccuuaccagaccaucccccgacuuugauuucaucuuucuugucccaccaaccgucgaaucccgcacaaaaccauucuccguccccguccucaccgucgaggaaaugaccaacagccgauuccccaucccccucgaaaaacucuuuaccggcccaucauccgccuucgucguccaaccacaaaacucacgcugcaccacugacggaguccuccucggcaccacucaacuuucccccguuaacauaugcacauuccgaggcgaugucacccacauaacagguucccgcaacuacaccaugaaccucgccucccaaaacuggaacaacuacgaccccaccgaagaaauaccaguaccccucggcacaccugauuucgucggaaaaauucaaggcguacucacacaaacaaccagaacagacggaucaacccgcgggcacaaagccaccguauauacaggcagcgcagacuucgcucccaaacuaggccgcguccaauucgaaacagacaccgaucacgauuucgaggccaaccaaaauaccaaauucaccccaguaggcguaauccaagacggcggcaccacccaccgaaacgagccccaacaauggguccuccccuccuacuccggucgcaacacacacaacguccaccucgcccccgccgucgccccaaccuuccccggcgaacaacuacucuucuucagaucuacaaugcccggauguuccggauacccgaacauggaccucgacugccuccuuccacaagaauggguccaauacuucuaccaaggagccgcacccgcucaaucugacgucgcccuccuccgcuucgucaaccccgacacaggacguguacucuuugaaugcaagcugcacaaauccggcuacgucacagucgcccacaccgggcaacacgaccuaguaaucccacccaacggcuacuuccgcuucgacuccugggucaaccaauucuacacucucgcccccaugggcaacggcacaggccgccgccguuaa

SEQ ID NO: 39044 - RNA, 1617 nt, Artificial Sequence
  derived and/or modified sequence opt11 from VP1__Norovirus_and/or_Norovirus-like__KX354116
augaaaauggccucauccgacgccaaucccucagacggcagcgccgcaaaccucguacccgaagcaaacaacgaaguaauggcacucgagcccgucgccggagccgcccuagccgccccugucgccggccaacaaaacgucaucgauccauggauccgcaacaacuucguccaagcccccggcggcgaguucaccauaucuccccgaaacgcacccggcgaaauccucugguccgcaccccucggacccgaccuaaauccauaccuaucccaccuagccagaauguauaacggcuacgccggcggguuugaaguccaagucauacucgcaggaaacgccuuuacagccggcaaagucauauucgccgccguacccccaaacuuucccaccgcaggacuaucccccucccaagucaccauguuccccuccguaguugucgacguccgccaacucgaacccguccucaucccucuccccgacguccgcaacaacuucuaccacuauaaccaauccaaugacccaacuauaacccucaucgccaugcucuacaccccacuacgcgccaauaacgcaggagacgacgucuucaccguaucuugccgcgucuuaacaagacccucuccagacuucgacuucauauuccuagucccucccaccguagaaucccgcaccaaacccuucuccguuccuguucucacugucgaagaaaugaccaacucccgcuuccccauaccccuugaacgacucuuuacaggcccauccuccgccuucguaguccaaccucaaaacggccguugcaccaccgacggcguccuccuaggcaccacccaacucucacccgugaacaucugcacguuucgcggagacaucauccacaucacuggcucccacaacuacaccaugaaccuugcaucccaaaacuggaacaacuacgaccccacugaagaaauaccagcaccccuaggaaccccagacuucgucggcaaaauccaaggcgucuuaacacaaaccacccgcggagaugguuccacccguggacacaaagccacagucuacacaggcagcgcagacuucaucccaaaacucggucgaguacaauucgaaaccgacaccaaccacgacuucgaagccaaccaaaacaccaaauucacccccguaggaguuauccaagacgguucuaccacacacagaaacgaaccccaacaauggguacuucccuccuacagcggccgcaauacccacaacguccaccuagcacccgccgucgcacccaccuuccccggagaacaacuacuauucuuccgcuccaccaugccuggcugcuccggauaccccaacauggaccuugacugccugcuuccucaagaauggguccaguacuuuuaccaagaagccgcccccgcccaaucagacgucgcacuacugcgcuucgucaauccugacaccggccgcguccucuucgaaugcaaacuccacaaaucgggauacaucacugucgcccacacaggccaacacgacuuaguaaucccaccaaacggcuacuuccgcuucgacuccuggguaaaccaauucuacacccucgccccuaugggaaacgguaccggccgccgccgcuag

SEQ ID NO: 39045 - RNA, 1617 nt, Artificial Sequence
  derived and/or modified sequence opt11 from VP1__Norovirus_and/or_Norovirus-like__KX514172
augaaaauggcaagcucagacgcaaacccuucagacggcucugcagccaaccuagugcccgaagucaacaacgaaguaauggcccucgaaccaguaguaggugccgcaaucgcagcucccgucgccggccaacagaacguuaucgacccauggauacgcaacaacuuuguccaggcucccggcggcgaguucacaguauccccacgaaacgcaccaggcgaaauccucugguccgcuccccuagggcccgaccucaaccccuaccucucacaccucgccagaauguacaacggauacgcaggcggauucgaaguucaggucauccucgcaggaaacgccuucaccgccggcaaaaucaucuuugccgccguacccccaaccuuccccaccgaaggacuuucaccaucacaagucaccauguucccccacauaaucgucgacguccgccaacucgaacccguccuaauaccccuaccggacguccgcaacaacuucuaccacuacaaccaaucaaacgacuccaccaucaaacuaaucgccaugcucuacaccccacuccgcgccaacaaugccggcgacgacgucuucaccgucucaugccgaguccucacccgcccgagccccgacuucgacuucaucuuccuaguacccccaacaguagaaucaagauccaaacccuucuccguacccguacucaccgucgaagaaaugacaaacuccagauuccccgccacccuagacaaacucuuuaccggccccagcagcacauucgucguccaaccucaaaacgggcgaugcaugauagacggcguacuacucggaacaacacaacucucacccgucaacaucugcaccuuccgcggcgacguaacccacccccgcgacagccaaaucuacaccaugaaccuagccucaccaaacuggaacaacuacgaccccacagaagagaucccagccccacucggcacucccgacuucgucggcaaaauccaaggaaugcucacacagacaaccaaaggcgaaggcuccacccgcggccaccgagcgaccguguaugucggcuccgccaacuacgcacccaaacuaggacgaguucaauucgagaccgacacuaccaacgaccucgacgcccaccaaaacacaaaauucacgccagucggcgucguccaagguggagaauccccuaaaggauccgaaccacaacaauggguccucccguccuacuccggccgcgauaccccaaacguccaccuagcccccgccgucgcacccaccuucccaggagaacagcuccuauucuuccgcuccaccauaccaggcugcggcggacaucccaauaugaaccucgauugccuccucccccaagaauggguccaacacuucuaccaagaagcugcccccgcucaauccgacguagcccuccucagauucgugaacccugacaccagccguguccuuuucgaauguaaacuccacaaaucaggguacguuaccgucgcacauaccggccagcacgaccuagucauaccacccaacggcuacuuccgcuuugacucuugggucaaccaauucuacacccuagcacccaugggcaauggcaccggcagaaagagauaa

SEQ ID NO: 39046 - RNA, 1617 nt, Artificial Sequence
  derived and/or modified sequence opt11 from VP1__Norovirus_and/or_Norovirus-like__KX354114
augaaaauggccucgucugacgccaaccccucugacggcuccgcugcaaaccugguccccgaagccaacaacgaaguaauggcccucgaacccguagccggugccgcucuagccgcccccguagccggccaacaaaaugucaucgacccauggauaagaaacaacuucguccaggcccccggaggcgaguucaccaucucuccccgcaacgcucccggugaaauacuaugguccgccccucuaggccccgaccuaaaccccuaccucucccaccucgcacgcauguacaacggauacgccggcggcuuugaaguacaggucauccuagcaggcaacgccuucaccgccggcaaaguaaucuucgccgccguaccucccaacuuccccaccuccggacucucgcccucucaagucacaauguuccccuccguagucgucgacguccgccaacuagaacccguccucaucccccuccccgacguacgcaacaacuucuaccacuacaaccaaucaaacgaccccaccaucacgcucaucgcuaugcucuacacgcccuuaagagccaacaacgccggagacgacgucuucaccgucagcugccgcguccucacacgacccucuccagacuucgacuucauauuccuaguacccccuaccgucgaaucgcgcacaaaacccuuuuccgucccgguucuaaccguugaagaaaugaccaacucucgcuuccccaucccacuagaacgucucuucaccggacccagcucggccuucgucguccaaccucaaaacggccgcuguacaaccgacggcgucuuacucggaaccacccaacuuucacccgucaauauaugcaccuuccgaggcgacaucauccacaucacggguucccacaacuacacaaugaaccucgcaucccaaaacuggaacaacuacgaccccaccgaagaaauccccgccccgcucggaacacccgacuucgucggcaaaauccaaggcguccuaacucaaacaacccgcggagacggauccacccgcggucacaaagccaccguauacaccggauccgccgacuucauccccaagcucggccgcguccaauuugaaaccgacacuaaccacgacuucgaagccaaccaaaauaccaaauucacacccgucggcgucauccaagacggguccaccacacaucgcaacgaaccccaacaauggguccuccccucguacuccggccgcaacacacacaacguacaccucgcacccgccgucgcccccaccuuucccggagagcaacuacucuucuucagaucuacuaugcccgguugcuccggauauccaaacauggaccucgacugccuccucccccaagaauggguccaauacuucuaccaagaggccgcacccgcacaaucagacguagcccuacuaagauucguaaaucccgacacaggccgcguccucuucgaaugcaaacuacacaaauccggauauauaaccgucgcccacacaggccaacacgaucuaguaaucccacccaacgguuacuuccgauucgacuccuggguaaaccaauucuacacccucgcacccaugggcaacggcaccggccgcaaacgcuga

SEQ ID NO: 39047 - RNA, 1617 nt, Artificial Sequence
  derived and/or modified sequence opt11 from VP1__Norovirus_and/or_Norovirus-like__KX514295
augaaaauggcauccaacgacgccaaccccuccgacgguuccgccgcaaaccuaguccccgaagucaacaacgaaguaauggcccuagaaccagucgucggcgccgcuauagccgcucccgucgccggccaacaaaacgucauagaccccuggaucaggaacaauuucgugcaagccccuggaggagaguucaccgucucaccccgcaacgcaccaggcgaaauccuaugguccgccccgcucggccccgaccuaaaccccuaccucucccaccucgcccgcauguacaacggcuacgccggcggcuucgaaguacaagucauccuagcuggaaacgcauuuacagcaggaaaaaucaucuucgccgcaguacccccaaccuuccccaccgaaggccuuaacccaucacaagucaccauguucccccauaucaucgucgacguccgccaacucgaacccgucuuaaucccacuacccgacguacgcaacaacuucuaccacuacaaccaauccaaugacagcaccaucaaacucauugccaugcuuuacaccccacugcgagccaacaaugcaggcgacgacguuuucaccguaucaugccguguccucacccgcccaucacccgacuucgacuucauauuccuggugcccccaaccgucgaaucccgcuccaaacccuucuccgucccuguacuaaccgucgaagaaaugaccaacucacgauuccccgcuacacuagacaaacucuucaccggucccagcuccacauucgucguacaaccacaaaacggacgaugcaugaucgacggcguccuacuaggcacaacccaacucucaccgguaaacaucugcaccuuccgaggcgacgucacccacccccgcgacuccccaauauauacaaugaaccucgccuccccaaacuggaacaacuacgaccccaccgaagaaauacccgcaccgcuaggcacuccugacuucgucggcaaaauccaaggaaugcuuacccaaaccaccaaaggcgaaggcucuacccgaggccaccgcgcuacaguauacgucggcuccgccaacuacgcacccaaacucggacgcguacaauucgaaacagacaccaccaacgaccuagacgcacaccaaaacaccaaauucacacccguagguguaguccaaggcggcgaaucucccaaaggauccgaaccccaacaauggguccuccccucauacucaggacgagacacccccaacguccaccucgcacccgccgucgcuccaacauuccccggagaacaacuccucuucuucagauccaccaucccgggcugcggcggccaccccaacaugaaucucgacugccuacucccccaagaauggguccaacacuucuaccaggaggcugcccccgcccaaagcgaugucgcccuacuccgauucgucaaucccgauaccucacgcguccucuucgaaugcaaacuccacaaauccggcuacguaaccgucgcccacaccggccaacacgaccucguaauaccacccaacggcuacuuccgcuucgacuccugggucaaccaauucuacacccuagcccccaugggaaacgguaccggccgaaaacgcuaa

SEQ ID NO: 39048 - RNA, 1617 nt, Artificial Sequence
  derived and/or modified sequence opt11 from VP1__Norovirus_and/or_Norovirus-like__KX514242
augaaaauggccuccuccgacgccaacccauccgacggaagcgcagcaaaccuaguccccgaggucaacaaugagguaauggcccucgaacccguaguaggcgccgccauagccgccccaguugccggccagcaaaacgucauagaccccuggauccgaaauaacuucguccaagccccaggaggugaguucaccgucucucccagaaacgcucccggagaaauccuaugguccgcacccuugggcccagaccuaaacccauaccucagccaccucgcccgcauguacaacggauacgccggcggauucgaaguccaagucauacuagcaggcaacgcauucacugccggcaaaaucaucuucgccgcugucccucccaacuuccccacagaaggccucucacccucccaaguaacaauguucccccacauaauagucgacguccgccaacucgagcccguccucaucccccuccccgacguaagaaacaacuucuaucacuacaaccaaaguaaugauuccacaauaaaacucauagcaaugcuuuacacuccucuccgcgccaacaacgcuggcgacgacgucuucaccguuuccugccgcguccucacccgcccaucaccagacuucgacuucaucuuccucguacccccuacugucgaaucacguuccaaacccuucuccguccccguccucaccguagaagaaaugacaaacucacguuuccccgccacccuugacaaacucuucaccggcccaucguccacuuucguaguacaaccacaaaacggccguugcaugaucgacggcguucuccucgguaccacccaacucucccccguaaacauaugcacauucagaggcgacguaacacaucccagagacucccccaucuacaccaugaaucuugccucccccaacuggaacaacuacgacccaaccgaagaaauacccgcaccccugggaacccccgacuucgucggcaaaauccaaggaaugcucacccaaaccaccaaaggcgaaggcuccacccgaggacaccgugcuaccguauacgucggcagcgccaauuacgccccaaaacuuggccgugugcaauucgaaacagacaccaccaacgaccucgacgcacaccaaaacacaaaguucacccccgugggagucguccaaggaggcgaaucaccacaacgcucagaaccccaacaguggguacuucccuccuacucuggccgcgauaccccuaacguccaccucgcccccgccguugcccccacauuccccggagaacaacuucucuucuucagauccacaauuccaggaugcgggggacacccuaauauggaccucgacugccuccucccccaagaauggguccaacacuucuaccaagaagccgcccccgcccaguccgacgucgcccuacucagauucgucaaccccgacacaucccgcguacucuucgaaugcaaacuccacaaauccggcuacgucaccgucgcgcauaccggccaacacgaccucguaaucccgccaaacggcuacuuccgcuucgacuccuggguuaaccaauuuuacacccuagcacccaugggcaacggaaccggccgaaaacgcuaa

SEQ ID NO: 39049 - RNA, 1617 nt, Artificial Sequence
  derived and/or modified sequence opt11 from VP1__Norovirus_and/or_Norovirus-like__KX514224
augaaaauggccucaaacgacgccaaccccucagacggcagcgcagccaaccucguccccgaaguuaacaacgaaguaauggcccucgaacccguagucggcgcagcaaucgccgcccccgucgccggccagcaaaacguaaucgaccccuggauucgaaacaacuucguccaagcccccggcggugaguucacagucagcccccgcaacgcccccggagaaauacuauggucagcaccacugggccccgaccucaacccauaccuaucacaccucgcacgaauguacaacggauacgccggcggcuucgaaguccaagucauccucgccggaaauguauucacugcaggcaaaaucaucuucgccgccguacccccgaacuucccaaccgaaggacucuccccaucacaaguaaccauguucccucacaucauaguagacguccgacaacuagaaccaguccucauuccacuccccgacguacgcaacaacuucuaccacuauaaccaauccaacgacuccaccaucaaacuaaucgccaugcucuacacaccccuccgagccaacaacgccggcgacgacgucuucaccgugagcugccggguccuaacacgccccucacccgacuucgacuucaucuuccuagucccaccaaccguagaaucucgaucaaaacccuucuccgucccaguccucaccguagaagaaaugaccaacucacgauucccagccacccucgacaaacucuucaccggucccagcuccaccuucgucgugcaaccucaaaacggcagaugcaugauugacggcguccuccuaggcaccacacaacucucaccugucaacaucugcaccuuccgcggcgacgucacacaccccagagacucccccauauacacaaugaaccuggcaucccccaacuggaacaacuacgacccaacagaagaaauaccagcaccccucggcacuccugacuucguaggcaaaauacaaggcaugcugacacaaacaacaaagggagaaggguccacccgaggccaccgcgccaccguauacgucggcucagccaauuacgcccccaaacuuggcagaguccaauucgaaaccgacaccacuaacgaccucgacgcacaccaaaacaccaaauucacccccguuggaguaguccaaggaggcgaaagcccccagcgauccgaaccccaacaauggguccucccaucuuacucuggacgagauaccccuaacguccaccucgccccagcagucgcacccaccuucccaggcgaacaacuccuauucuuccgcuccaccauaccuggcugcggcggccaucccaacaugaaccucgacugccuacuaccccaagaauggguccaacauuuuuaccaagaagcugccccagcccaaucagacguagcccuacuucgauucgucaaccccgacacauccagaguccuauucgaaugcaaacuccacaaguccggauacguaaccguagcccacaccggccaacacgaccuagucaucccacccaacggauacuuccgauucgacuccugggucaaccaauucuacacccuagcccccaugggaaacggaacaggucgaaaacgcuaa

SEQ ID NO: 39050 - RNA, 1617 nt, Artificial Sequence
  derived and/or modified sequence opt11 from VP1__Norovirus_and/or_Norovirus-like__KX514262
augaaaauggccagcucggacgccaaccccagcgauggcuccgccgccaaccuaguccccgaagucaacaacgaaguaauggcccucgaaccaguagucggagccgccauagccgccccuguggccggacaacaaaacgucaucgaccccuggauccggaauaacuucguccaagcccccggcggugaguucacagucucaccucgcaacgcacccggagaaauccuaugguccgcgccccucggcccagaccucaacccauaccuaagccaccucgcccgcauguacaacggauacgccggcggcuucgaaguccaaguaauacucgcuggcaaugccuuuacagcaggcaaaaucaucuucgcagccguuccacccacauuccccaccgaaggccuaucccccagccaagucaccauguucccccacauaauugucgacguaagacaacucgaaccaguauuaaucccacucccagacguccgcaauaacuucuaccauuacaaccaguccaacgacuccacaauaaaacuuauagcgaugcucuacacaccccuccgagcaaauaaugccggcgacgacgucuucaccguaagcugccgcguacuaaccagacccucccccgacuucgacuucauuuuccuagucccacccaccguagaaucccgaucaaaacccuucuccguccccguccucaccgucgaagaaaugaccaacucacgcuucccagccacccucgacaaacucuuuaccggcccauccuccgcauucgucguacaaccacaaaacggccguugcaugaucgacggaguucugcucggaaccacccaacuaagccccgucaacaucugcaccuuccgcggagacgucacucacccacgagacucacccauauacacaaugaaccuagccucacccaacuggaacaacuacgaccccaccgaagaaaucccagcaccacuuggcacaccagacuucguuggcaaaauccaaggcaugcuaacccaaaccaccaaaggagaaggcucuacccgaggacaccgcgccaccgucuacgucggaucagccaacuacgcccccaaacuaggccguguccaguuugaaaccgacaccacaaacgaucucgaugcacaccaaaacaccaaguucacccccgucggcgucguccaaggcggcgaauccccaaaaggcuccgaaccccaacaauggguccucccgucauacuccgggcgagacacaccaaacguacaccucgcccccgcaguagccccaaccuuuccuggugaacaacuccucuuuuuccguuccacaauccccggaugcggcggccacccuaacaugaaccuagacugccuacucccacaagaauggguccaacacuucuaccaagaagcagcccccgcacaaucggaugucgcacuccuaagauucgucaacccagacacaucccgcguucuauucgaauguaaacuacacaaaucugguuacgucaccgucgcccacacuggccaacacgaccuagucauaccacccaauggauacuuccgauucgacucuugggucaaccaauucuacacccuugcuccaaugggaaacggaaccggccgcaaacgauaa

SEQ ID NO: 39051 - RNA, 1617 nt, Artificial Sequence
  derived and/or modified sequence opt11 from VP1__Norovirus_and/or_Norovirus-like__KX354139
augaaaauggccucauccgacgcuaaccccuccgacggcuccgccgccaaccuuguacccgaagcaaacaacgaaguuauggcccucgaacccguagccggcgccgcccucgcagcccccgucgcaggccaacaaaacgucaucgacccauggauccgcaauaacuuuguacaagccccuggcggagaauuuaccaucuccccgcgcaacgcccccggcgaaauccuauggucagcaccacucggcccagaccucaaucccuaccucucgcaccuagcacgaauguacaacggcuacgccggcggauucgaaguucaagucauccuagcuggcaacgcuuucaccgccggaaaagucauauucgcagcaguaccacccaacuuccccacuaccggccuaucacccucacaagucaccauguuccccucggucgucgucgacguaagacaacucgaacccgucaugaucccccuccccgacgucagaaacaauuucuaccacuacaaccaaucaaacgacccaaccaucacccugaucgccaugcuguauacaccucuacgcgccaacaacgccggcgacgacgucuucaccguaucaugccgcguccucacucgacccagcccagauuuugacuucauauuccucguacccccaacagucgaaucacgaaccaaacccuucagcguccccguccuuacagucgaagaaaugacuaacucccgcuucccaaucccccucgaacgacucuucaccggcccaucgagcgcauucgucguccagccacaaaacggccgcuguacaacugacggaguccuacuaggaacaacccaacuuuccccugucaacaucugcacauuccgaggagacgugacacacauaacaggcucccgaaacuacacaaugaaccucgccucacaaaacuggaacaacuacgacccaacagaagaaaucccagcaccgcucggcaccccagacuucgucggaaaaauccaaggaaugcuaacacaaacaacccgcaccgacggcuccacacgcggacacaaagccacgguauacaccggcuccgccgacuucgcccccaaacucggcagaguccaauucgaaaccgacaccgaucacgacuucgaagcaaaccagaacacaaaauucacaccggucggcguaauccaagacggauccacaacccaccguaaugaaccccaacaauggguccuacccuccuacuccggacgcaacacccacaacguccaccucgccccggccguagcccccaccuuccccggagaacaaguuaucuucauacgauccacuaugcccggcuccucaggauaccccaacauggaccuagacugccuucucccccaggaauggguccaauacuucuaccaagaagccgcccccgcccaaucagacgucgcuaugauccgauucguuaaccccgacacaggucguguccuuuucgaaugcaaacuccacaaauccgguuacaucacagucgcccacacgggccagcacgacuuaguuaucccacccaacggcuacuuccgcuucgauucaugggucaaccaauuuuacaccuuagcacccauggggaacggaaccggccgccgacgauaa

SEQ ID NO: 39052 - RNA, 1617 nt, Artificial Sequence
  derived and/or modified sequence opt11 from VP1__Norovirus_and/or_Norovirus-like__KX514215
augaaaauggccucuaacgacguaaaccccuccgacggauccaccgcgaaccucgucccagagguuaacaacgaggucauggcccucgaacccgucgucggggccgccaucgcagcaccaguagccggacaacaaaacguuauagaccccuggauccgcaacaacuucguccaagcccccgggggagaguucacagucucacccagaaacgccccuggcgaaauccucuggagcgccccacuaggacccggacucaaccccuaccuuucucaucucgcccgcauguacaacggcuacgccggaggcuucgaaguccaaguuauucucgcaggcaacgccuucaccgcaggcaaaauaaucuucgccgccguaccacccaacuuucccaccgaaggccuaaaccccagccaaguaaccauguucccccacaucauaguagacguacgccaacucgaacccguccuuaucccucuccccgacguccgcaacaacuucuaccacuacaaccaaagcaaugacuccacaauaaaacucauagcaaugcuauacacaccccuacgagccaacaacgcaggcgacgacgucuucaccguaucgugccgcguccucacccgccccucccccgacuucgacuuuaucuuccuuguaccacccaccgucgaaucccgcuccaaacccuucagcguucccguucuaaccguccaggaaaugaccaacucccgcuuccccgccacccuagacaaacuguucaccggcccuuccuccaccuucgucguacaaccccaaaacggacgaugcaugaucgacggcguacuucucggaaccacccaacucucaccuguaaauauaugcacauuccgcggcgacgucacacacccccgcgacuccccaaucuacaccaugaaccucgcauccccaaacuggaauaacuacgaccccacagaggaaauacccgcaccccucggcacccccgacuucguagggaaaauccagggcaugcucacccaaaccaccaagggcgaaggcucaacucgaggccaccgugccacugucuacgucggcuccgccaacuaugcaccaaaacucggccgcguacaauucgaaaccgacacaaccaacgaccuugacgcacaccaaaacacaaaauucacuccagucggaguuguucaaggcggcgaaucuccccaacgcuccgaaccccaacaauggguccuaccauccuacuccggccgagacacacccaacguccaccuugccccugcaguagcccccacauuccccggggaacaacuacucuuuuuccgcuccaccauucccggaugcggcggccacccaaacaugaaccuagacugccuacucccacaagaauggguccaacacuucuaccaagaagcggccccagcgcaauccgacgucgcacuccuacgcuucguuaacccugacacaucccgaguacucuucgagugcaaacuucacaaauccggauacguaacaguagcccacaccggacaacacgaccuaguuauacccccuaacggcuacuuccgauucgacuccugggucaaccaauucuacacccuagcccccaugggcaacggaaccggucgcaaacgcuag

SEQ ID NO: 39053 - RNA, 1617 nt, Artificial Sequence
  derived and/or modified sequence opt11 from VP1__Norovirus_and/or_Norovirus-like__KX514367
augaaaauggccucaucugaugccaacccgucagacgguuccacggccaaccucguccccgaggucaacaacgaagucauggcacuagaacccgucgucggcgcagcaaucgcagcccccgucgccggccaacagaacgucaucgaucccuggauccgcaacaacuucguacaagccccuggcggcgaguucacaguaucuccacgcaacgcacccggcgaaauccucugguccgcaccccucggaccggaccucaaucccuaccugucccaucucgcccgaauguacaacggcuacgccggcggcuuugaaguccaagucauccuugcaggaaacgcauucaccgcuggaaaaauaaucuucgcagcugucccacccaccuuccccaccgaaggacucaguccuucgcaagucacgauguucccccacaucauaguagacguccgacaacuagaaccuguccucaucccccuccccgacguccgaaacaacuucuaccauuacaaccaaucaaaugacucaaccaucaaacucauagcaaugcucuacacaccacuccgagccaacaaugccggcgaugacgucuucacagucuccugccgcguccucacccgccccucccccgacuucgauuucaucuuccuggucccacccaccgucgaaucccgcuccaaacccuucuccguccccguacucacaguagaagaaaugacaaacucucgcuuccccgcaacacucgacaaacucuucacaggccccagcucaaccuucgucguacaaccccagaacggccgcugcaugaucgacggcguccuccuaggaacaacccaacucucaccagucaacaucuguaccuucagaggcgauguaacccacccccgagacucacccaucuacaccaugaaccuugcauccccuaacuggaacaacuacgacccaacggaagaaaucccagcaccccuaggcacaccagauuucguaggcaagauucaaggaaugcucacacaaaccaccaaaggagaaggcuccacucgcggccaccgcgccacagucuacgucgguuccgcagacuacgcucccaaacuaggccgcguccaguuugaaacagacacaaccaacgaccuugacgcccaccaaaacacaaaauuuacacccgucggugucguccaagguggugaaucuccaaaaggcagcgaaccccaacaguggguccuccccucccauuccggucgagacacaccgaauguacaccuagcacccgccguggcccccacauuccccggcgaacaacuccucuucuuccgcuccaccauuccaggaugcggcggccacccaaacaugaaccucgauugccuccucccccaagaauggguccaacacuucuaccaggaagccgcaccagcucagagcgacgucgcacuccucagauucguaaaccccgacacaucccgcguccucuucgaaugcaaacuccacaaaucuggauacgucacugucgcccacaccggucaacacgaccucgucaucccacccaacggcuauuuccgcuucgacuccugggucaaccaauucuacacacuagcccccaugggcaacggcaccggacgaaaacgcuaa

SEQ ID NO: 39054 - RNA, 1617 nt, Artificial Sequence
  derived and/or modified sequence opt11 from VP1__Norovirus_and/or_Norovirus-like__KX514243
augaagauggccuccaacgacgccaaccccuccgacggaucagccgccaaccucguaccugaaguaaacaacgaagucauggcccuagaaccaguagucggcgcagcuauagccgcccccguugccggccaacaaaacgucaucgacccauggauucgcaauaacuucguccaagccccaggaggcgaauuuacagucucuccccgcaaugcacccggugaaauacucuggucugcaccacucggccccgaccucaaccccuaccucucccaccucgcccgcauguacaacggauacgccggcggcuucgaaguccaaguaauacucgcaggcaacgccuucacagccggaaaaaucauauucgccgccgucccucccaccuuccccaccgaaggccucucacccucccaaguaaccauguucccacacaucaucgucgacguucgccaacuagaacccguccuuaucccucucccagacguccgcaauaacuucuaccauuacaaucaaucaaacgacucuacaaucaaacugauagccaugcucuacacaccccuacgggcaaacaacgcaggagacgacgucuucaccgucucaugucgcguccuaacccgccccagccccgacuucgacuucaucuuccuaguaccacccacagucgaaucccgaucuaaacccuucucugucccaguccuaaccguugaagaaaugaccaacucccgauuccccgccacccuagacaaacucuucacaggacccucauccaaccucgucguccaaccccaaaacggucgaugcaugaucgacggcguccuacuaggcacaacccaacucuccccagucaacaucugcacauucagaggggacgucacccacccccgcgacucccccauauacaccaugaaucucgccucacccaauuggaacuccuacgaccccaccgaagaaacacccgcuccccucggcaccccagacuucguaggcaaaauccacggcaugcuaacccaaaccacccagggcuccggcuccaccagagcccaccgagccaccgucuacguuggcggagccgaguucacaccuaaacucggcaagguacaauucaaaacagaaacagaucacgaccuauccauccgccaaaacacaaaauucaccccuguaggcgucguccaaggcggcgaaucuccccaacgaucagaaccacaacagugggucuuacccuccuacuccggccgcgacacccccaacguccaccucgccccugccgucgccccaacauucccuggcgaacagcuccucuucuuuagaagcaccaucccaggaugcggaggccacccuaacaugaaccucgacugccuccucccccaagaauggguacaacacuucuaccaagaagccgcccccgcacaauccgacgucgcacuccuccgcuucguaaaucccgacaccucccgcguucuauuugaaugcaaacuccauaaauccggcuaugucaccguagcccacacaggacaacacgaccuugucauacccccaaacggcuacuuccgcuucgacuccugggucaaucaauuuuacacccucgccccaaugggcaaugguaccggccgcaagcguuaa

SEQ ID NO: 39055 - RNA, 1617 nt, Artificial Sequence
  derived and/or modified sequence opt11 from VP1__Norovirus_and/or_Norovirus-like__KX353996
augaaaauggcuagcuccgacgcgaaccccucugacggauccaccgccaaccucguaccagaagucaacaacgaaguaauggcccucgaacccgucguuggugccgccaucgcagcccccguagcaggccaacaaaacgucaucgacccauggauacgaaacaacuucguacaggcccccggaggcgaguucaccguaucaccccgcaacgcaccaggugaaauccucugguccgccccgcuaggccccgacuuaaacccuuaccuaagccaccucgcacgaauguacaaugguuacgccggaggcuucgaaguacaagucauacucgccggaaacgcauucaccgccggcaaaaucaucuucgcugcaguacccccaaacuuccccacagaaggacucucacccucccaaguaacuauguucccccacauaaucguagauguccgccaacucgaaccaguccuaaucccucuucccgacgucagaaacaacuucuaccacuauaaccaauccaacgacuccaccauaaaacuaaucgccaugcuauacacaccucuccgcgcaaacaacgccggcgacgacguuuucaccguuucaugccgcguccuaacccgccccuccccagacuuugacuucaucuuccucgucccacccaccguugaaucgcgcaccaaaccauucuccguccccguccuuacugucgaagaaaugacaaacucacgcuucccaaucccccucgaaaaacucuucaccggcccauccuccgccuucgucguccaaccccagaacggccgcugcaccacagacggcguccuucucggaaccacacaacucuccccagucaacaucugcacuuuccgcggcgaugucacccacauccccggcucucgcaacuacaccaugaaucuagccucccaaaacuggaacuccuacgacccgaccgaagaaaucccagcuccacuuggcacacccgacuucguaggaaaaauacagggcguccucacccaaacaacccgaacaaauggcuccacccguggccauaaagcaaccgucuacaccggaagcgcugacuucuccccaaaauuaggcagaguccaauucgccaccgacaccgacaacgacuucgaaaccaaccaaaacaccaaauucacccccgucggaguaauccaggacggcagcacaacaccccgcaaugaaccccaacaauggguacuccccucauacuccggacgcaacacccacaacguccaccuagccccagcagucgcaccaaccuucccaggcgaacaacuacuauucuuccgcagcaccaugcccggcugcucaggauaccccaacauggaccucgaccgccuaccaccccaagaaagaguccaauacuucuaccaagaagccgcccccgcccaaucugacgucgcccuccuucgcuucgucaaccccgauaccggccgcguccucuucgaaugcaagcuccacaaauccggcuacgucaccgucgcccacaccggccaacacgaccuagucauacccccaaacggcuacuuccgcuucgacuccugggucaaccaauucuacacacuagcucccaugggcaacggcacaggccgccgaagauaa

SEQ ID NO: 39056 - RNA, 1617 nt, Artificial Sequence
  derived and/or modified sequence opt11 from VP1__Norovirus_and/or_Norovirus-like__DQ078820
augaaaauggcuucaaaugacgccucccccucagacgguucaacugcaaaccuaguacccgaagucaacaacgaaguaauggcccucgaaccagucgucggcgcugccaucgcggcccccgucgccggucaacaaaacguuaucgaccccuggauccgaaacaacuuuguccaagcuccaggcggagaguucaccgucuccccucgcaacgccccaggagaaauccucugguccgccccucucggccccgaccuaaacccauaccucagccaccucgcccgcauguacaauggcuacgccggaggcuucgaaguccaagucaucuuagccggcaacgcuuuuaccgccggaaaaauaaucuucgcagccgucccucccaauuuccccaccgaaggccucggucccucacaagugaccauguucccccacaucaucgucgacguuagacagcucgaaccaguccucaucccccuccuugacguccgcaacaaccucuaccacuacaaccagucaaacgaccccaccauuaagcucaucgccaugcucuacacaccccuccgagccaacaacgcaggcgaaguagucuuuaccgucuccugccgcguacucacccgacccucacccgacuucgacuucaucuuccucgucccacccaccgucgaaucccgaaccaagcccuucaccguacccauacucaccgcagaagaaaugaccaauucccgcuuccccacaccccucggaaaacuauucaccggaccaagcucugccuucguaguccaaccucaaaacggccggugcgccaccgacggagugcuccucggcaccacccaacucucccccgucaacaucugcacauuccguggcgacgucacacacaucgccggcacccacgacuacaccaugaaccucgccucacaaaacuggaacaacuacgacccuaccgaagaaauucccgcacccuuaggaacccccgacuucgucggcaaaauacaaggaguccucacccaaacaacacgcggcgacggauccacccgaggccacaaagcaacagugucgacaggcuccguccacuucacccccaaacucggcggcguccaauucacaaccgacaccaauaacgacuucgaaaccggccaaaacacaaaauucaccccugucggcguuauccaagacggcaacuccacccaccaaaacgaaccccaacaguggguccuccccaacuacucaggacgcaccggccacaacguccaccucgcaccagccgucgcgcccacuuucccuggugaacaacuccucuucuuccgcucaaccaugcccggaugcuccggcuacccuaacaugaaucuagacuguuuacuaccucaagaauggguccaacacuucuaccaagaagcagcuccggcccaauccgacguugcccuucuacgauucgucaaucccgacgccggaagaguccucuucgaaugcaaaccccacaaaagcggauacgucacugucgcccacaccggccaacacgaucucgucauacccccaaacggcuacuuccgcuucgacuccugggucaaccaauucugcacacucgcccccaugggcaauggaaccggacguagacguuaa

SEQ ID NO: 39057 - RNA, 1617 nt, Artificial Sequence
  derived and/or modified sequence opt11 from VP1__Norovirus_and/or_Norovirus-like__AB933738
augaaaauggcauccaacgacgcaaacccauccgacggcucaacagcaaaccuagucccagaagucaacaacgaagucauggcccuagaaccaguugucggcgccgccaucgccgcacccguagccggacaacaaaacguaaucgacccuuggauccgaaacaacuucguccaagcacccggaggcgaguucaccgucucaccccgcaacgcccccggcgaaauacucugguccgccccacucggacccgaccucaaccccuaccucuucccacuagcucgcaaagucaaaggcuacgcuggcggcuucgaaguucaaguuauccucgccggaaaagcauuccccgccggcaaaaucaucuucgccgccuccccacccaacuucccuacagaaggccuaucaccgucacaagucaccauguucccacacauaaucgucgacgucagacaacucgaaccaguacucaucccacuccccgacguccggaacaacuucuaccacuacaaccagucaaacgauucuaccauaaaacucaucgcaaugcucuacacacccuuaagagccaacaacgcaggcgaagacguauucacagucagcugccgaguccuaacccgacccagcccugacuucgacuucaucuuccucgucccgcccaccgucgaaucccgcaccaaaccauucucuguccccauacuuaccgucgaagaaaugaccaacucucgcuuucccauuccucuagaaaaacucuucaccggcccuuccuccacauucguuguccaaccccagaacggccgcugcacuaccgacgguguccuccucggaaccacccaacucuccccaguuaacaucugcacguuucgcggcgacguaacucacauagccggaucccgaaacuacaccaugaaccuagccagccaaaacuggaacuccuacgaucccacagaagaaauccccgcaccccuagguacacccgacuucgucggcaagauacaaggaguccucacccaaaccacucgccgcgacgguuccacucgcggccacaaagcuaccgucuauacaggcuccgcagacuuuagcccaaaacucggucguguacaauucgccaccgacaccgacaacgacuucgacacccaccaaaacaccaaauucacccccgucggcgucauccaagacggcggaacagcccaccgcaacgaaccucaacaauggguucuuccgucauacucuggccgaaacacccacaacguacaccucgcaccggccguagccccaaccuuccccggcgaacaacuccuuuucuuccgcucaaccaugcccggcugcuccggauaccccaauauggaccucgacugccuacucccccaggaauggguacaauacuucuaccaagaagccgcccccgcccaaucagacgucgcccuccuacgcuucgucaaccccgacacaggccgcguccuauucgagugcaaacuccacaaaucaggcuacgucacagucgcccacacaggacaacacgaccucgucaucccacccaacggauacuuccgguucgacucaugggucaaccaauucuacacccucgcacccaugggcaacggcaccggccgccgacgcuaa

SEQ ID NO: 39058 - RNA, 1617 nt, Artificial Sequence
  derived and/or modified sequence opt11 from VP1__Norovirus_and/or_Norovirus-like__EU780734
augaaaauggccuccaacgacgccacacccuccgacggaucuaccgccaaccucguccccgaagucaacaacgaaguaauggcacucgaacccgucgucggagccgcgaucgccgccccugucgccggccaacaaaacgucaucgaucccuggauccgaaacaacuuuguacaagcccccggcggugaauuuaccgucucgccccgaaacgcccccggcgaaaucuuaugguccgccccucucggccccgaccucaaccccuaccucucccaucuagcccgaauguacaacggcuaugcaggcggguucgaaguccaaguuauacuagcaggcaacgcauucaccgcaggcaagaucaucuucgccgccgucccacccaacuuccccaccgaagggcucucccccucccaagucacaauguucccacacaucaucgucgacguccgccaacucgaaccaguccucauaccacuccccgacguccgcaauaacuucuaccacuacaaccaauccaaugacccaaccaucaaacucaucgcaaugcucuacacaccucuacgcgcaaacaacgcuggagacgacgucuucacuguaucaugccgcguccucacacgccccucccccgacuuugauuucaucuuccuagucccucccacaguagaaucccgcaccaaacccuucagcguccccauacucaccgucgaagaaaugaccaacucacguuuccccaucccccucgaaaaacucuucaccggacccucauccgcauuugucguccaaccacaaaacgguagaugcaccaccgacggcguacuauuagggaccacccaauuaagcccagucaacauaugcaccuuccgaggcgacguaacccacaucgcaggcacccaaaacuacacaaugaaccuagccucccaaaacuggaauaacuacgacccaaccgaagaaauccccgcaccccuaggcacccccgacuuuguaggcaagauucaaggaguccuaacccaaaccacgcgacgcgacggcuccacccgcggccacaaagcaaccgucagcacaggauccauacacuucacccaauccugggccguauucaauuccccacucauccaagccaugacccucaaacucgccaaaacccgcgacucaccccaguccgucgucguacaggacggaucuaccacccaccaaaacgaaccccaacaauggguccucccagacuacucaggccgagacucauacaaugugcaccuagcccccgcagucgcucccaccuuccccggagaacaacuacucuucuuccgcuccaccaugcccggaugcuccggcuaccccaacaugaaccucgacugucuccuuccccaagaauggguccaacacuuuuaccaggaaucugcucccgcccaaucggaugucgcccugcuccgcuucgucaaccccgacaccggccgcguacucuucgaaugcaaacuccacaaauccggcuacguaaccgucgcccacaccggacagcacgaccuaguaaucccacccaacgguuauuuccgcuucgacucuuggguaaaccaauucuauacacuagccccuaugggcaacggugccgguagacgccgauaa

SEQ ID NO: 39059 - RNA, 1617 nt, Artificial Sequence
  derived and/or modified sequence opt11 from VP1__Norovirus_and/or_Norovirus-like__KP064096
auggccucaaaagacgcaccaaccaauauggacggcaccuccggagccggucagcuaguccccgaagccaacacugccgaacccaucucaauggaaccaguugcaggagccguuacagccgccgccaccgcaggacaagucaacaugaucgaccccuggaucaugaacaacuacguccaagccccacagggugaauuuaccauaucuccuaacaacacuccaggagacauccuauucgauuuacaacuaggcccacaccuaaaccccuuccucucucaccuagcccaaauguacaacggaugggucggaaacaugaaaguacguguucuccucgccggaaacgcauucaccgcaggcaaaauaaucaucagcugcauaccacccggauucgucgcccaaaacaucuccaucgcccaagccacaauguucccccacgucaucgccgauguccgaguccuagaaccaaucgaagucccccucgaagacguccgcaacguccucuuccacaacaacgacaacaccccaaccaugaggcucgucugcauacucuacacgccccuccgagcauccggcucauccuccggcacagauccauucguaaucgccggccgcguccucacaugcccaucucccgacuucuccuuccucuuccucguacccccaaacguugaacagaaaacuaaacccuucuccguccccaaccugccccucaacacacuauccaacucgcgagugccaucccuuaucaaaucaaugauggucucccgcgaccacggucaaaugguccaauuccaaaacggacguguaacccucgacggccaacuccaaggaaccacucccacauccgcgucccagcuaugcaaaauccgcggcuccgucuuccacgcaaacggaggcaacggcuacaaccuaaccgaacuagauggcuccccuuaccacgccuucgaaucacccgcacccaucggcuuccccgaccugggcgaaugugacuggcacauggaagccucaccaaccacccaauucaacacuggcgacgucauaaaacaaauaaacgucaaacaagaaucagcguucgccccacaccuagguacaauccaggcggacggucucucagacgucuccguaaacaccaacaugaucgccaaacuaggaugggucuccccagucucagacggccacaaacgggacgucgauccaugggucauaccccgcuacggcucaacccucaccgaagccgcccaacucgccccacccaucuacccacccggcuucggcgaagcaaucguauucuucaugucugacuucccuaucgcacacggcaccaacggacucuccgucccaugcacaauaccccaagaguucguaacccacuucguaaacgaacaagccccuacccgcggagaagccgcccuacuccacuacuuagaccccgacacacaccgcaaccuaggagaguucaaauuauaccccgacggcuucaugaccugcguacccaacaccucuggcaccggcccacaaacccuccccaucaacggcgucuucguuuucgucagcugggucucacgcuucuaccaacucaaacccgucgguaccgcaggccccgcacgccgucuauaa

SEQ ID NO: 39060 - RNA, 1617 nt, Artificial Sequence
  derived and/or modified sequence opt11 from VP1__Norovirus_and/or_Norovirus-like__KC473548
augaugauggcuuccaaagacgcccccaccaacauggacggcaccucgggcgccggccaacucguaccagaagccaacaccgccgaaccucuccccaucaaaccagucgccggagcagcaacagccgucgccaccgcuggacaagugaacaugauagaccccuggaucaugaacaacuucguccaggccccacaaggugaauucaccauaucccccaacaauaccccaggagacauccuauucgaccuacaacuaggcccacaucugaaccccuuccucgcccaccugucacgcauguacaacggcugggucggaaauaugcagguccgcaucaugcucgccggcaacgccuucuccgcaggcaaaaucauagucugcugcauacccccaggcuucagcucccaauccauaucuaucgcccaagccacuauguucccacacgucaucgccgacguacguguucuagaacccaucgauguuccucucgacgacguuagaaacguccucuuccacaacaacgacaacccccaaacaaugcgccuacucugcaugcucuacaccccccuacgcucuggcggcacaagcucaggcacagaccccuucguuaucgccggccgcguccucaccugcccaacccccgauuucagcuuccucuuccucgucccacccgacauagaacaacgcacaaaaccauuuuccgucccuaacauacccaugaaccucaugucaaacucacgagucucaaugcucaucgacggcaugauggucucaaacgaccaaaaccaaguaccacaauuccaaaacgggcgcgucacacucgacggucaacuccaaggaacaaccaccgucucugcagccugcgucgcccgaaugcgcggccgcaucuucaacaacaacggcaacuacggagucaaccuuaccgaacucgacggcaacccauaccacgccuucgauuccccugcaccucucgguuucccagacuucggcaacugcgaccuucacaugacauucguuaagauaaaccccaacgaacucuccucaggagacccaucaggcaaaguggucauacgcucauacgacgcaacauucgccccacaccuaggcacaguuaaacuagaaaacgacgacgaacucgcccgauucgucggcaaagaaguuguacucgaacugacaugggucuccaacagagaaggagccacccucaaccuaugggcaguacccaacuacggcuccucccuaacccaagcaucacaacuagcaccccccaucuacccacccgguuucggcgaagcaaucgucuacuucaccucaaccuucccaacugucucaaaccccaaaguccccugcacccucccccaggaauucguaucacacuucgucaacgaacaagcuccuacucgaggcgacgccgcacuacuccacuacguagaccccgacacccaccgcaaccucggagaauucaaaauguaccccgaaggcuacaugaccugcguaccaaacgccggaggcggcccccaaacccuucccaucaacggugucuucgucuuuaucucuuggguaucccguuauuaccaacucaaaccggucggcaccgccggcgccgcccgccgccucuaa

SEQ ID NO: 39061 - RNA, 1617 nt, Artificial Sequence
  derived and/or modified sequence opt11 from VP1__Norovirus_and/or_Norovirus-like__AB684698
auggccuccaaagacgcucccuccaacauggacggcaccucgggcgcaggacaacucgucccugaagccaacacugccgaacccauuaacauggaauccgucgucggagccgccacagcgacagcaaccgccggacaaguaaaccuaaucgaccccuggauaaugaacaauuacguacaagcuccccaaggcgaauuuaccauaagcccgaacaacacccccggcgacguccucuucgaccuccaacugggcccccaccuaaacccauuccucucacaccucucccgcauguacaacgguugggucggcaacaugaaaguccgugucauguuagccggaaacgccuucuccgcagguaaaaucaucaucuguugcauucccccaggcuucaccucacaguccaucagcaucgcacaagcaaccauguucccccacgucaucgccgauguccgcguccucgaacccaucgacgucccacuugacgacguccgcaauguucucuuccacaacaacgacaaugcacaaaccaugcgucuccucuguaugcucuacacuccccuacgcaccggcgcaagcuccuccggauccgacccuuucgucaucgcaggaagaguccuuaccugccccacccaagacuucaacuuccucuuccucgucccucccgacguagaacagaaaaccaaaccauucuccguccccaauaucccccuaaaucuaauguccaacucccgcgucccagcccuaaucgacggcaugaccgucuccucugaucaaaaccaagucguccaauuccaaaacggccgcguaacccucgacggccagcuccaaggcaccacagccguauccgccucuugcgucgccaaaauccguggacgcaucuucuccaacgcaucacacuacggcaucaaccucaccgaagucgacggcacccaauaccaugcauucgauucuccugcaccccuaggcuucccggacuucggaaacugcgacuggcacgucaccggcaccaaggccagccaaggugaccuucaaaccgacaaccccaccaucuccgguaccaucaaaagcuacgaaagcucauucgccccucaccuuggcacaguccgcaucgaaggcgacgacaacgaacuagcccgauucaacgguaaagacguucuccuaaaccucaccugguucucacaacgcaacggaucccaacucaaccuuuggaccauccccucuuacggcucuaaccucacagaagccucccaacucgccccacccauuuacccacccggcuucggcgaagcaaucguguacuuuaccucaaccuuccccgccaucucccgacccuccguucccugcaccaugccccaagaauuugucucccacuucgucaaugaacaagcaccaacacgaggugaagccgcacuacuacacuaccucgaccccgacacccaccgcaaccuuggcgaauuuaaaauguacccagaaggauucuuuaccugcguccccaacgcaggaggaucaggcccccaaacccucccaaucaacggcgucuucgucuucgucucaugggucucccgcuacuaccaacuaaagcccgucggcaccgucgguaugacccgccgccuauaa

SEQ ID NO: 39062 - RNA, 1617 nt, Artificial Sequence
  derived and/or modified sequence opt11 from VP1__Norovirus_and/or_Norovirus-like__AF538679
augaaaauggcuucaaaagacgcaccaacaaacauggacggcacauccggggcagggcaacuuguacccggcgcaaacacagccgaaccccuacccaucaaacccgucgccggcgcagcaaccgccguagccacagccggccaaguuaacaugaucgaccccuggaucaugaacaauuucguucaggcuccccaaggcgaauuuaccaucucccccaacaauaccccaggcgacauccucuucgaccuccaacucggcccacaucucaacccauuccuugcccaccuaagccgcauguacaacggaugggucggcaacaugcaaguccguaucaugcucgccggcaaugccuucucagccggcaaaaucauagugugcugcauaccacccggauucuccucccaauccauuucaaucgcccaggccacuauguucccccacguaauagcagacguccguguccucgaacccauagacguaccccucgacgacguccgaaacguccucuuucacaacaaugacaacccccaaaccaugagauuacuaugcaugcucuacacuccccuucgauccggaggcgcguccuccggcaccgaccccuucgucaucgcuggccgcguacucacaugccccacuccagacuucucuuuccucuuccucguucccccagacaucgaacaacgcaccaaacccuucuccgucccaaacauccccaugaaccucauguccaacucacgcgucccaaugcucauagacggcaugauggucuccaacgaccaaaaccaagucccccaauuucaaaacggccgugucacccucgacggccaacuccaaggcacaaccaccguauccgcugcgugcaucgcccgcaugcgcggccguaucuucaauaacaacggcaacuacggaguuaaccuagccgaauuagacggcaaccccuaccacgccuucgacuccccugcaccccuaggauuucccgacuucggcaacugcgaucuccacaugaccuucguaaaaaucaacccaaccgaacucuccaccggagaccccucgggcaaagucgucauccacucauacgacgccacauucgcaccccaccucggcaccguaaaacucgaagacaacaaugaacucgaccaauucgucggcaaagaagucguacucgaacuaaccuggguaucgaaccgaacaggagccacccucaacuuaugggccguucccaauuacggauccaacuuaacgcaagccucccaacucgccccacccaucuacccacccggcuucggcgaagccaucguauacuucacauccaccuuccccaccgucucuaauccuaaaguuccuugcacucucccccaagaauuuguuucacacuucgucaacgaacaggcccccacccgcggcgacgccgcccuccuccacuacgucgaccccgacacacacagaaacuuaggcgaguucaaaauguaccccgaaggauacaugacaugcguccccaacgccggaggaggcccccaaacacuacccauaaacggcgucuucguauucaucuccugggucucccgauacuaccaacucaaacccguaggcacagccggcgccgcacgccgccucuga

SEQ ID NO: 39063 - RNA, 1617 nt, Artificial Sequence
  derived and/or modified sequence opt11 from VP1__Norovirus_and/or_Norovirus-like__JQ743332
augaugauggccagcaaggacgccucacaauccgcugacggcgccuccggcgcaggacaacucguacccgaaguuaacaccgcagacccacuccccauggaacccgucgccggccccaccacagccguagccaccgccggccaagucaacaugaucgaucccuggaucguuaacaacuucguccaaaguccccagggagaauuuaccauauccccaaacaacacacccggcgacauccuauucgaccuccaauuaggcccucaccugaaccccuuccucucccaucuaucucaaauguacaacggcugggucggaaacaugcgaguacgcauccuccucgccggcaacgcauucuccgccgguaaaauaaucgucugcugugucccgcccggcuucaccucgucaucacucacaaucgcccaagccacccuauucccccacgucaucgcagacguccgcacccucgaaccaaucgaaaugccccucgaagacguccguaacguucuauaccacacaaacgacaaccagccgacaaugcgacucguuugcaugcuuuacacaccccuacguaccggaggaggcucaggcaacuccgacucauucgucguugccggccgaguacuuaccgccccaagcuccgacuucuccuuccuauuucucguacccccaaccauagaacaaaagacccgagccuucaccguaccaaacauuccccuacaaacucucuccaacucccguuucccaucccucauccaaggaaugauucucagccccgacgccucccaaguuguccaauuccaaaacggccgaugccucaucgacggccaacugcucggcacaaccccugcuaccucaggacaacuauuccguguccgcggaaaaaucaaccaaggagcccgcacccucaaccucaccgaaguagacggaaaaccauucauggccuucgauucacccgcccccgucgguuuccccgauuucggcaaaugcgacuggcacaugcgaauauccaaaacccccaacaacaccucaagcggagacccaaugcgcuccgucucgguacaaaccaacguccagggcuucguaccccaccuaggcucaauccaauucgacgaagucuucaaccacccgacaggcgacuacaucgguacaaucgaauggauaucccaacccucgaccccacccggcaccgacaucaaccucugggaaaucccagacuacggcagcucguuaucacaagccgccaaccuugcaccuccagucuucccucccggauucggagaagcucucguauacuucgucucagccuuccccggacccaacaaccguuccgcacccaacgacguccccugccuccuuccccaagaauacauaacacauuucgucuccgaacaagcccccaccaugggcgacgccgcccuucuccauuacgucgacccggacacaaaccgcaaccucggcgaguucaaacucuaccccggaggcuaccuaaccugcgugcccaacggcgucggagccggcccccaacaacucccacuaaauggcgucuucuuauucgucuccuggguaucccgcuucuaccaauuaaagcccguaggcacagccucuaccgcccgauaa

SEQ ID NO: 39064 - RNA, 1617 nt, Artificial Sequence
  derived and/or modified sequence opt11 from VP1__Norovirus_and/or_Norovirus-like__GQ856470
augaugauggccagcaaagacgcccccacaaacauggacgggacuuccggcgcaggccaacucguccccgaagucagcacagccgaacccaucucaauggaacccgucgccggcgccgccacagccgcagccacagccggacaagucaacaugaucgaccccuggauaauguccaacuacguccaagccccacaaggcgaauuuaccaucucccccaacaauacaccaggagacauccuauucgaccuacaacugggcccccaccuuaaucccuuccucucccaccucgcacaaauguacaacgguugggucggcaacaugaaaguacgcguccuccucgccggcaacgcauucaccgcaggcaaaaucaucaucucgugcgucccucccggauucgccgcccaaaaugucucaauugcucaagccacaauguucccccacgucaucgccgacguacgcguccuggaaccaauagaagucccccuagaagauguuagaaauguccucuuccacaacaacgacuccacgcccaccaugagacuaauauguaugcucuauacuccccuucgagcguccgggucuuccuccggcaccgaucccuucgucaucgccggccgcguacuaaccugccccucaccagacuucaacuuccucuuccugguacccccaaacgucgaacaaaagaccaaaccuuucucugucccugaccucccacucaacguacuaucaaacucccgcguccccucccucaucaaaucaaugauggucucacaagaccacggccaaaugguccaauuccaaaacggacgcgucacccucgacggccaacuccaaggcacaacccccaccuccgcaucccaacuaugcaaaauccgcggcaccgucuaccacgccaccggcggacaaggccucaaccucacugaaauagacgggacccccuaccacgccuucgaauccccagcccccaucggcuuccccgaccuuggugaaugcgacuggcacaucaacgcaaguccagccaacgccuuuaccgacggaucuauuauacaccgcaucgacgucguacaagaccccaccuucgcaccccaccuaggcaccauacacuauaccaacgcaaacuaugaugccaacguaucgcucaucugcucacucgaauggcucucacccccauccggcggagcacucaaagcuaaccccugggccaucccccgcuacggcuccacacuaaccgaagccgcccaacucgcaccaccaaucuacccacccggcuucggcgaagcaauagucuucuucaugagcgacuuccccaucgcaaacggauccgacggccucuccguaccaugcaccaucccgcaagaauuuguuacucacuucgucaacgaacaagccccaacccgcggcgaagccgcacuccuacacuacguagaccccgacacucaccgaaaccucggcgaguucaaacuauaccccgaaggauucaugaccuguguccccaauagcagcggcucuggaccacaaacccuaccaauuaacggcgucuucaccuucauaucuugggucucacgcuucuaccaacucaaacccgucggcacaacaggaccaguccgacgucuuuaa

SEQ ID NO: 39065 - RNA, 1617 nt, Artificial Sequence
  derived and/or modified sequence opt11 from VP1__Norovirus_and/or_Norovirus-like__JN603244
augaugauggccuccaaagacgcccccacaaacauggacggcacuuccggcgccggccaacucguccccgaaguauccacagcagaacccauauccauggaaccugucgccggagccgccacagcagccgcaaccgccggccaagucaacaugaucgacccguggauaaugucuaacuacguccaagccccacaaggugaguucacaaucucccccaacaacacccccggcgacauccuauucgaccuccaacugggcccccaccucaaccccuuccucagccaccucgcccaaauguacaacggcugggucggcaacaugaaaguaagaguccuccucgcuggaaacgccuucaccgccgguaaaaucauaauuucaugcgucccacccggauucgccgcccaaaacgucuccauagcacaggcaacaauguucccccacgucaucgcagacguccgcgugcuagaacccaucgaaguaccccucgaagacguccgaaacguccucuuucauaacaacgacuccacccccaccaugcgccucauaugcaugcuauacacaccccuccgcgcaagcggcuccucaucaggcaccgaccccuuuguuauugccggccgcguccuaaccugccccucacccgacuucaacuuccucuuucucguacccccuaacgucgaacagaaaacaaaaccauucuccguacccaaccucccccuuaacguacuuucaaacagccgcguccccucccucaucaaaucaaugaugguaucucaagaccacggccaaaugguccaauuccaaaacggacgagucacccuagacggccaacuacaaggcaccacccccacaucagcgucucaacucugcaaaauccguggcaccgucuaccacgcaaccggaggccaaggccucaaccucaccgaaaucgacgguacaccauaccacgcauuugaauccccggcccccaucggauucccagaccucggugaaugcgacuggcauaucaacgccuccccugcaaacgccuucaccgacggcucaauaauccacaggaucgacgucgcacaagacuccacauucgcaccccaccucggaacaauccacuacaccaacgccgacuauaacgccaacguaggccucaucuguucccuagaauggcuauccccacccuccgguggcgccccuaaagucaaccccugggccauaccacgcuacggaucaacacucaccgaagccgcccaacucgccccaccaaucuacccacccggauucggugaagccauagucuucuucauguccgacuuccccaucgccaacggcucagacggccuuucaguccccugcaccaucccccaagaguucguaacccacuucguaaacgaacaagcgcccacccgaggagaagcagcccuccugcacuacguagaccccgacacacaccggaaucucggagaguucaaacuauacccagaaggcuucaugacauguguacccaacuccuccggcuccggaccccaaacacuucccaucaacggcgucuucacauuuaucuccugggucucccguuucuaccaacucaaacccgucggcaccacaggccccguacgccgacucuag

SEQ ID NO: 39066 - RNA, 1617 nt, Artificial Sequence
  derived and/or modified sequence opt11 from VP1__Norovirus_and/or_Norovirus-like__AB078335
augaugauggccuccaaagacgccccccaauccgccgacggagcaucaggagcuggccaacucgucccagaagucaacaccgcagacccccucccaauggaaccagucgcaggacccacaaccgccguagccaccgcuggccaaguaaacaugauagacccauggaucgucaacaacuucguacaauccccacagggcgaauucacgauauccccaaacaacaccccaggcgacauccucuucgaccuucaauuaggcccccaccucaacccuuuccuaucacaccuuucccaaauguacaacggcugggucggcaacaugcgaguacgcauacuacuagccggcaacgcauucuccgccggcaaaaucauaguaugcugcguaccaccuggauucaccuccuccucccucaccaucgcccaagccacccucuucccccacguaaucgccgacguucgaacccucgaacccauagaaaugccucucgaagacguccgcaacguacuauaccauaccaacgacaaccagcccaccaugcgacuagucugcaugcuauacacaccccuccgaaccggcggcgguuccggcaacagcgacagcuucguaguagcaggcagaguccucaccgcaccauccagcgauuucuccuuccuauuccucgucccccccacaauagaacagaaaacccgagcuuucacagucccaaauaucccccuacaaacacucucaaacucucguuuccccucccuaauccaaggcaugauccucucacccgaugccucccaagucguccaauuccaaaacggacgcugccucaucgacggccaacuacuaggcaccacaccagcaaccuccggccaacuuuuccggguccgcggcaaaaucaaccaaggagccagaacccucaaccucaccgaaguugacggcaaacccuucauggccuucgauucccccgcccccguuggcuucccagacuucggcaaaugcgacuggcacaugcgcaucucaaaaacccccaacaacacaucauccggcgacccaaugcgcucagucuccguccaaaccaacguccaaggcuucguuccccaccucggcuccauccaauucgacgaagucuucaaccacccaacaggcgacuacauuggcacaaucgaauggaucucccaaccaagcaccccccccggcaccgacaucaaucucugggaaauccccgacuacggcuccucacugucccaggccgcuaaccucgccccccccguauuccccccuggcuucggcgaggcccuagucuacuucgucagcgccuuccccggacccaauaaucgcucugcccccaacgauguccccugccuccucccucaagaauacauaacccacuucguuuccgaacaagccccaaccaugggugacgccgcacuccuacacuacgucgacccagacaccaaucgcaaccucggugaauucaaacuauacccuggcggauaccucaccugcgucccaaacggcguaggcgccggcccucaacaauuaccucucaauggcgucuuccuauucgucucaugggugucccgcuucuaccagcucaagcccgucggcacagccuccaccgcccgcuaa

SEQ ID NO: 39067 - RNA, 1617 nt, Artificial Sequence
  derived and/or modified sequence opt11 from VP1__Norovirus_and/or_Norovirus-like__GU299761
augaugauggcauccaaagacgcacccaccaauauggacgggacauccggcgccggccaacucgucccggaagcuaacaccgccgaaccccuccccaucaaaccuguagcaggcgccgccaccgccguugcaacagccggacaagucaacaugauagaccccuggaucaugaacaacuucguccaagcaccccaaggagaauuuaccaucucccccaacaacaccccaggagacauucuauucgaccuacaacucggaccccaccucaaccccuuccuagcccaccucucccgcauguacaacggcugggucggcaacaugcagguccgcaucaugcucgcaggcaacgccuucagcgccggaaaaaucaucguuuguugcaucccacccggcuucagcucacaaucaaucagcaucgcacaagccaccauguucccccacguaaucgccgauguccgcguacucgaacccauagacgucccccuagaugacguccguaacguccucuuccacaacaacgacaacccccagaccaugcgccuccucugcauguuauacacaccccucagauccggaggcaccucaucaggcacugaccccuucgugauagccggucgaguacuaaccugccccacaccagacuucucuuuccuguucuuaguaccacccgacaucgaacaacgaaccaaacccuucuccguuccaaacauacccaugaaccuaaugaguaauagccgcguuucaaugcuaaucgacggcaugaugguauccaacgaucaaaaccaagucccacaauuccaaaacggccgcgucacucucgacggccaacuccaaggaaccacuaccgucagcgcagccugcguugcacgcaugcgcggucgcauauucaacaacaacggaaacuacggcgucaaccucaccgaacuagacggaaacccauaccacgcuuucgacuccccugcuccccucgguuuccccgacuucggcaacugcgaccuacacaugaccuucgucaaaaucaacccuaacgaacucuccuccggcgacccuuccggaaaagucgucauccacuccuacgacgccacauucgcaccccaccucggaaccgucaaacuugaaaacgacgacgaacuagcccgcuucgucggcaaagaagucguccuagaacuuacaugggucucaaaccgagaaggcgcaacccuaaaccucugggccguccccaacuacggcuccucccucacgcaagcaucccaacucgcgcccccaaucuacccacccggcuucggcgaagccauagucuacuucacguccaccuuccccaccgucagcaaccccaaaguccccugcacccuuccccaagaguucguaucccacuucgucaacgaacaagcucccacccgcggcgaugcagcacuucuccacuacguagaucccgacacacacagaaaucuaggggaguucaaaauguaccccgaagguuacaugaccugcguacccaaugcaggcggaggcccccaaacccuccccauaaacggugucuucguauucaucucaugggucuccagauacuaccaauuaaaacccgucgguaccgcaggcgccgcccgccgccuauaa

SEQ ID NO: 39068 - RNA, 1617 nt, Artificial Sequence
  derived and/or modified sequence opt11 from VP1__Norovirus_and/or_Norovirus-like__AJ277610
augaugauggccucaaaaggugcaccacaaucagcagacggcuccucaggagccggccagcuaguacccgaggucaacaccgccgacccucuuccaauggaacccguagccggcccuaccaccgccgucgcaaccgccggccaagucaacaugaucgaccccuggaucgucaauaacuucguccaaagcccccaaggcgaguucacgaucuccccaaacaacacacccggagacauucucuucgacuuacaacucggcccacaccuaaacccauuccuuucccaccucucccaaauguacaauggcuggguaggaaacaugcgcguucgaauccuacuagccggcaacgccuucucagccggcaaaauuauaguuugcugcguaccgcccgguuucacuuccucgucacucacaaucgcccaagccacccucuuuccccacguaaucgccgacguccgcacccucgaacccaucgaaaugccccuagaagacguacgcaacguccucuaccauaccaacgacucacaacccacaaugcgccuuguauguaugcucuacaccccacuacgaaccggcggcggauccggcaauagcgacuccuucgucguggccgggcguguccuaacagcacccagcuccgacuucuccuuccuuuuccuaguaccacccacuaucgaacagaaaacccgagcuuucacuguccccaacaucccccuccaaacccucucuaauucucgauucccaucccucauccaaggcaugauccuauccccagacgccucccaaguaguacaauuccaaaacggccgaugccuaaucgacggccaacuacuagggaccacaccagccaccuccggccaacucuuccgaguacgaggcaaaaucaaccaaggcgcccgcacccucaaccucaccgaaguagacggaaaaccauuuauggccuucgacucgccagcaccaguaggcuucccagacuucggcaaaugcgacuggcacaugcgcguaagcaaaacucccaauaacacaagcuccggcgaccccaugcgauccgucucaguccaaacaaacguccaagguuucgucccccaccucggcuccauccaauucgacgaagucuucaaccaccccaccggcgacuacauaggcaccaucgaguggaucucccaaccaucaacuccccuaggcaccgacaucaaccucugggaaauacccgacuacgguuccucccucucacaagcagccaaucucgccccacccguauucccacccggcuuuggcgaagcucuagucuacuucgucuccgcuuuccccggcccaaacaaccgcuccgcccccaacgacguccccugccuccucccacaagaauacaucacccacuucgucucagaacaagccccaaccaugggcgacgccgcccuccuccacuacguugaccccgacaccaacagaaaccucggagaguuuaagcucuaccccggcggauaccuaaccugcguccccaacggcguaggcgccggcccccaacaacucccccuaaacggagucuuccucuucgucucuuggguuucucgcuucuaccaacuaaaaccagucggcaccgcuucaacugcacgcuaa

SEQ ID NO: 39069 - RNA, 1617 nt, Artificial Sequence
  derived and/or modified sequence opt11 from VP1__Norovirus_and/or_Norovirus-like__GQ856462
augaugauggccucaaaagacgcacccacuaacauggacggaaccagcggagccggacagcuaguacccgaagcaaauaccgcagaaccccugcccauaaaacccguagcaggcgccgcuaccgccgucgccacagcaggccaagucaacaugaucgaccccuggaucaugaacaacuucguccaagcaccccaaggcgaguucaccauuuccccaaacaacacccccggcgacauccuauucgaccuccaacuaggcccccaccuuaauccauuccucgcccaccucucaagaauguacaacggaugggucggcaacaugcaaguccgaaucaugcuagccggcaacgccuucagcgccggcaaaauaauagucugcuguaucccucccggcuucucaucgcaaucaauaucaaucgcccaagccacaauguucccccacguaauagccgacguacgcguacuggaaccaauagacgucccccucgacgacguccgaaacguucuauuccacaacaacgacaacccccaaacaaugcgacuacucuguaugcucuacacaccccuucgcuccggcgguaccuccuccggcaccgauccauucgugaucgccggcagaguucucacaugccccaccccugacuucucauuccucuuccucgucccaccagacauagaacaacgcacaaagcccuucuccgucccaaacaucccaaugaaccuaauguccaacucaagagucucaaugcuaauagacggcaugaugguauccaacgaccaaaaccaagucccccaauuccaaaacggccgcgucacccuagacggccaacuccaggacaccacaaccguaucugcagcuugcguagcccgaaugcgcggccguauauucaacaacaacggcaacuacggcguuaauuuaaccgaacucgacggcaacccauaccacgccuucgacucacccgcgccccuaggauuucccgacuucggaaacugcgaccuacacaugaccuucgucaaaaucaaucccaacgaacucucauccggcgaccccagcggcaaaguaguaauccacucauacgacgcaacauucgcaccccaucucggaacaguaaaacucgagaacgacgacgaacucgcccgauucgucggcaaagaagucguacuagaacuaaccugggucucaaaccgagaaggcgcaacucuaaaccuuugggcaguaccaaacuacggcuccucccugacccaagcaucccaacucgcaccucccaucuacccucccggcuucggcgaagcaaucgucuacuuuaccucuaccuuucccacagucucaaacccuaaagucccauguacccucccccaagaauuugucucucacuucguaaacgaacaagccccaacccgcggcgacgccgcccuccuccacuacgucgaccccgacacccaccgcaaccuaggcgaauuuaaaauguaccccgaaggcuacaugacuugcguccccaacgccggaggcggcccacaaacacuuccuauaaacggaguauucgucuuuaucuccugggucucucgguacuaccaacucaaaccagucggcaccgcaggcgccgcccgccgccuauaa

SEQ ID NO: 39070 - RNA, 1617 nt, Artificial Sequence
  derived and/or modified sequence opt11 from VP1__Norovirus_and/or_Norovirus-like__AF435807
augaaaauggccuccaaagacgcaccccaguccgccgacggcgccuccggagccggccaacucgucccagaagucaacacugccgacccccugcccauggaaccagucgccgggcccaccaccgcagucgccaccgcgggacaaguuaacaugacagaccccuggaucgucaacaacuucguccaaucuccacaaggagaguucacaaucucgcccaauaacacccccggcgacauacucuucgaccuccaacuagguccccaccuuaaccccuuccucucccaccucucacaaauguacaauggauggguaggcaauaugcgaguacgcauucuccucgccggcaaugccuucucugcaggaaaaauaauagucugcugcgucccgccaggcuucaccucaucgucccugacaauagcccaagccacccucuucccacacgucauugccgacguaagaacccuagaaccaaucgaaaugccccuagaagacguccgcaacguccucuaccacaccaacgacaaccaaccaacaaugcgacucgucugcaugcuuuacaccccacuccgcacaggcggcggcucaggcgacuccgacagcuucguagucgccggaaaaguucuuaccgccccaucaucugacuucuccuuccucuuucucgucccacccacaaucgaacagaaaacccgcgcauucacaguccccaacaucccccuccaaacccuaucaaacucgcguuucccaucucucauccaaggaaugauccucucgcccgacgccucccaagucguccaauuccaaaacggacgcugccucauagacggccaacuccuagguacaacucccgccaccucgggccaacuauuccgcguccgcggcaaaaucaaccaaggcgcacgcacacuuaaccuuaccgaaguagacggcaaaccuuucauggccuucgauucacccgcacccgucggcuuccccgacuucggaaaaugcgacuggcacaugcgcauaagcaaaaccccaaacaacaccuccagcggcgaucccaugcgaucuguaaguguacaaacaaacguccaagguuucgugccccaucucggcagcauacaauuugacgaggucuucaaccaccccaccggagacuacaucggaaccauagaauggauuucacaacccucaaccccucccggcaccgacaucaaccucugggaaauacccgauuacggcagcagccuuucccaagcugccaaccucgcaccacccgucuucccacccggcuucggcgaagccuuagucuacuucgucuccgcuuuccccggcccaaacaaccgaucagcccccaacgacguccccugccuccuaccccaagaauacaucacucacuucguaucagaacaggccccuaccaugggcgacgcugcacuacuccacuacgucgaccccgacacaaaccgaaaccuaggcgaguucaaacucuauccaggcggcuacuuaaccugcguccccaacggagucggcgcuggcccacaacaacucccacucaacggcgucuuccuauucgucagcugggucuccagauucuaccaacucaaacccguaggcaccgccuccaccgcccgauaa

SEQ ID NO: 39071 - RNA, 1617 nt, Artificial Sequence
  derived and/or modified sequence opt11 from VP1__Norovirus_and/or_Norovirus-like__KX396056
augaugauggccuccaaagacgcacccaccaacauggacggcaccucaggugcuggacaacucguccccgaagccucaaccgccgaaccaauauccauggaacccgucgcaggggccgccacagccgccgccacagcaggccaaguaaacaugaucgaccccuggaucauguccaacuacgugcaagcuccccaaggcgaauuuacaauaucacccaacaacacacccggcgacauucucuucgaccuccaacucggaccacaccucaaccccuuccucucucaccucgcccaaauguacaacggaugggucggcaacaugaaaguccgcguacuccucgccggaaacgcauucacugccggcaaaauaaucauuuccugcgugcccccaggcuucgcagcccaaaacgucuccauagcucaagccaccauguucccacacgucaucgccgacguccgaguccuagaacccaucgaaguuccucucgaagacguucgaaacguacucuuccacaacaacgacucaaccccuacaaugcgccucaucugcaugcuauacaccccacuaagagccuccggcuccuccuccgguacagaccccuucgucaucgcaggaagaguccuaacaugcccaucacccgacuucaauuuccuauuccucguucccccaaacgucgaacagaaaacaaaacccuucuccguccccaaccucccccuaaacguccuauccaacuccagaguccccucccuuaucagaucaaugauggucucacaagaccacggccaaaugguccaauuccaaaauggcagagucacccucgacggacaacuccaaggcaccaccccaaccucagcaucccaacucugcaaaauacgaggaacuguguaccaugccacaggcggacaaggccucaaccucacagaaaucgacggcacgcccuaccacgcacucgaaucccccgcccccauaggcuuccccgaccucggcgaaugcgacuggcacauuaaugccagccccgccaacgcauuuaccgacggauccaucauccaccguaucgacgucgcacaagacuccacauucgcaccccaccucggcacaauccacuacacaaacgccaacuacgacgccaauaucucccugauuugcucccucgaauggcucagcccucccuccggcggcgcccccaaagucaaccccugggccaucccccgcuacggcucaacacucaccgaagccgcacaacuagcacccccaauauauccucccggcuucggcgaagccauaguauucuuuauguccgacuuccccaucgccaauggcucagauggacucuccguccccuguaccaucccccaagaauuuguaacccacuucgucaacgaacaagcacccacacgcggcgaagccgcacugcuccacuacguugaccccgacacacaccgcaaucucggcgaguucaaacucuaccccgaaggcuucaugacaugcguccccaacuccucagguuccggcccacaaacccuucccaucaacggcgucuucaccuucaucucaugggucucacgauucuaccaacucaaaccugucggcacuaccggcccuguccgccgccucuag

SEQ ID NO: 39072 - RNA, 1617 nt, Artificial Sequence
  derived and/or modified sequence opt11 from VP1__Norovirus_and/or_Norovirus-like__AB187514
augaugauggccucaaaagacgcccccacaaacauggacggaaccucaggcgccggccaacuuguuccagaagccuccaccgccgaacccaucucaauggaacccgucgcaggcgccgcuacugccgccgcaaccgccggccaagucaacaugaucgaccccuggaucauguccaacuacguccaagcuccucaaggcgaguucaccauaucacccaacaacacaccuggugacauccucuucgaccuccaacuaggcccccaccucaaccccuuccuaucucaccucgcacaaauguacaacggcuggguaggcaacaugaagguccgcguccuccuagccgguaacgcauucacugccggcaaaaucaucaucucaugcguacccccaggauucgccgcccaaaacgucagcaucgcccaagccaccauguucccccacguuauugccgacguaagaguccucgaaccaaucgaaguaccacuugaagacguccgcaacguccucuuccacaacaacgacucaacucccacuaugcgacucaucugcaugcuauacacccccuuacgcgcaagcggaucuuccuccggcaccgaucccuucgucaucgccggccgaguccucaccuguccaucaccggacuucaacuuccucuuccuagucccacccaacgucgaacaaaagacaaaacccuucucgguccccaaccucccccuuaacguccucuccaacucccgcguuccaucccucaucaagucgaugauggucucacaagaccacggccaaauggugcacuuccaaaucggacgggucacucucgacggacaauuacaaggcaccacacccacauccgcaucccaacucugcaaaauccgaggaacugucuaccacgcuaccggcggucaaggucuaaaccucaccgaaauagacgggacccccuaccacgcuuucgaaucccccgcccccaucggauucccagaccucggcgaaugcgacuggcacaucaacgccucccccgccaacgccuucacagacggcuccaucauccaccgcaucgacgucgcccaagacuccacauucgcuccccaccucggaacaauccauuacaccaacgccaauuacgacgccaacgucucacuaauuugcucccucgaauggcuaucgccacccucaggaggcgcccccaaaguaaaccccugggccaucccccgcuacggcucaacccucaccgaagccgcacaacuagcacccccaauauaucccccaggauucggcgaagcaaucgucuucuucauguccgacuucccaauagccaacggaucagacggccuauccguccccuguaccaucccccaagaauuugucacccacuucgucaacgaacaagcccccacccguggagaagccgcccuucuucacuacgucgaccccgacacucaucgaaaccucggcgaguucaaacucuacccagaaggauucaugacaugcgucccaaauucuucagguuccgguccacaaacccuacccaucaacggugucuuuaccuucaucucuugggucucccgauucuaccaacuaaaacccguagguaccaccggaccaguccgacgccucuaa

SEQ ID NO: 39073 - RNA, 1617 nt, Artificial Sequence
  derived and/or modified sequence opt11 from VP1__Norovirus_and/or_Norovirus-like__L07418
augaugauggccucuaaagacgccccccaauccgccgacggcgccuccggcgccggccaacucguaccagaaguaaacaccgcagacccccuccccauggaaccagucgccggcccaaccaccgccgucgccaccgcgggacaagucaacaugaucgaccccuggaucgucaacaacuucguccaauccccccaaggcgaauucacaaucucacccaacaacacacccggcgauauccucuucgaccuacaacucggaccgcaccucaaccccuuccucucccaucucucccaaauguacaacgguugggucggaaacaugagaguccgcauccuacucgccggcaacgccuucucagccggaaaaauaaucguaugcuguguccccccuggcuucaccucauccucccuaaccaucgcccaagcaacacucuuuccccacgucaucgcugacguccggacccucgaaccuaucgaaaugccgcuagaggacguccgaaacguccucuaccacaccaacgacaaccaacccaccaugcgccucgucuguaugcucuauacaccucucagaaccggcggcggcuccggcaacucugacucauucgucgucgcaggucgcguacuuaccgcacccuccagcgacuucagcuuccuauuccugguaccacccaccaucgaacaaaaaacacgagccuuuaccguaccaaauaucccacuccaaacccuauccaacucccgauucccuucccuaauacaaggcaugauccucuccccugacgccucccaagucguccaauuccaaaacggccgcugccucaucgacggccaacuacucggaaccacacccgccaccucaggccaacucuucagaguccgagguaaaaucaaccaaggcgcccgcacacuuaaccuuaccgaaguagacggcaaacccuucauggccuucgacucacccgcccccgucggguucccagacuucggcaaaugcgacuggcacaugcgaauuucuaaaacucccaacaacaccggaagcggcgaccccaugcgcucuguauccguacaaacaaacguacaaggcuucgucccccaccucgguagcauccaauucgacgaagucuucaaccaccccacaggagauuacauagguacaaucgaauggaucucccaaccauccacaccccccggaacagacaucaaccuuugggagauccccgacuacggaaguucacucucgcaagcagccaaccucgcccccccugucuucccacccggauuuggcgaagcccuggucuacuuugucucagcauuccccggccccaacaacagaucagccccaaacgauguaccaugucuacuaccucaagaguacauaacccacuuugucucagaacaagccccaaccaugggcgacgcugcacuccuucacuacguagauccugacaccaaccgcaaucucggcgaauucaaacucuaccccggaggcuaccucaccugcguacccaacggcgucggcgcaggaccacaacaacuuccccucaacgguguauuccuauucgucuccugggucucccgauucuaccaacuuaaaccagucggcacggccuccaccgcccgcuaa

SEQ ID NO: 39074 - RNA, 1617 nt, Artificial Sequence
  derived and/or modified sequence opt11 from VP1__Norovirus_and/or_Norovirus-like__FJ515294
augaugauggccucaaaagacgcaccccaauccgccgacggcgccucuggcgcgggccagcuaguccccgaagucaauacugccgacccccuucccauggaaccggucgcaggcccaacaaccgccgucgccacugcgggccaaguuaacaugaucgaccccuggaucgucaacaacuucguccaaucaccacaaggcgaauuuacuaucucaccaaacaacacacccggcgacauccuauucgaccuccaacuaggcccccaccucaaccccuucuuaagucaccucucacaaauguauaacggcuggguaggcaacaugcgcguaaggauacuccucgcaggcaacgcauucagcgccggaaaaaucaucgucugcugcgucccucccggcuucacaucuucaucccuuaccauagcucaagccacccucuucccccaugucaucgcagacguccgaacccucgaaccaaucgaaaugccccuagaagacguacgcaacguccuauaucacaccaacgauaaccagcccacaaugcgccuagucugcaugcuauacacacccuuaagaaccggaggcgguucaggcaacuccgacagcuucguaguagccggccgcguacuuaccgcaccauccucagacuucuccuuccuuuuccuagucccacccaccauugaacagaaaacacgcgcauuuaccguccccaacauaccccuccaaacgcuauccaacucccgauuccccucccuaauacaaggaaugauccuuucccccgacgccucucaagucguccaauuccagaacggccgaugucuaaucgacggccaacuucuaggcaccacgcccgcaaccuccggccagcuauuucgcguccgaggaaaaauaaaccaaggugcacgcacacucaaccucaccgaagucgacggcaaaccauucauggccuuugacucacccgcccccgucgguuucccagacuucggaaaaugcgacuggcacaugcgaaucuccaaaaccccuaacaacaccuccuccggugacccaaugcgcucaguagacguacaaacagacguacaaggcuucgucccccaccucgguuccauacaauucgacgaaguauucaaccaccccaccggcgacuacauaggcaccaucgaauggaucucccaacccucaacaccacccggcaccgacaucaaccucugggaaauccccgauuacggauccucccuuucacaggcugcaaaccucgccccacccgucuucccacccggcuucggcgaagcccuagucuacuucguuuccgccuuccccggccccaacaaccgcuccgcccccaaugacguccccugccuccucccccaggaauacgugacccacuucguauccgaacaagcucccacuaugggcgacgccgcccuacuccacuacgucgaccccgacacgaaccgaaaccucggcgaauuuaaacuuuaccccggcggcuaccuaacaugcguacccaacggaguuggcgccggaccucaacaacucccccucaacggagucuuccucuucgucucuugggucucgcguuucuaccaacucaaaccagucggcaccgccuccaccgcccgcuag

SEQ ID NO: 39075 - RNA, 1617 nt, Artificial Sequence
  derived and/or modified sequence opt11 from VP1__Norovirus_and/or_Norovirus-like__KJ790198
augcgcauggccuccgacgacgccaagucagcccccuccgaccucgaaggagcaggacucgucccagccaccgccgccccucuaccaguugcaccugucgccggugcacaagccgcugaaccuuucgcaggccaaaucaacguaauagaccccuggaucuacaccaacuuuguccaagcccccacuggagaauuuaccgucucuccucgaaacacccccggcgaaguucucguaaaccucgaaauaggcccaaaucucaaccccuaucuccaacaccuagcccaaauguauaacggcuacgccggaggagucgaaguacaagucauccucgccggaaacgcauucaccgccggcaaacuguuaugcgcccuugucccacccggcuuccccaccucuucuauaacacccgcccaacuaaccaugcucccccacaccaucaucgacguccguaccaccgaccccguaguugucccaaugcccgacguaagacguacauuauggcacgaaguccgaucuaccacagaaccccucaugcgacucguaaucaugcucuacacccccaugcgcgcaaacuccggcucugacgaagccuucgucguuucaggaagaguccucagccgacccgccccagauuucaacuucuucuaucucguaccaccccgcguagaagacaccguagaacccuucucccuacccgaccuacgaguugacgaaaugagcucauccagauggcaaaaucccgucgucaugcuacaagccgaccccaaccaaaauaucgcugcccacuggcaaaacggccgaugcacaaucaacggugaacuccuaggcacaaccccacgaaaucagucguggcuccucagaaugcguggauccguccucgcagcccccggaggccaaaaagcaguaaccgucaacgucgaccucacagaacccgacggccaagccuucucaguacuaucgggcaaucccggccccgaaggcguccccgacuuccaagccaucuacaacgucagaaugucaaccgccuccaccaccgccggccacacagucgccaccaacggauacaucgaacaauccggcuacacccccgcccucggcacucuaguaauccaaggugucgaccuaucacagguucccgcccuaggcucagaagucacaaugcaggucgucagcauugacuuaaaccacaacauggaccccacccgccuacccgacuacaacggagcaggcuucgacgguagcgucgcccucgccccaccccucguaccaccccuacccggcgaaguccuccuccgcuucacaacccuucccaucaccaccucucgcggaagcagcgucagcgcaacccucgacugcgcccuccccgcagaauggauuaccugguuccucguucacaacuucguaccccaaggagacgcugcccuccuacgcuaccgcaaccgaggcaccggccaaauacucuucgaaugcaaacuauacaaagaaggcuucuuagccguagcaggagucuccacccguacaguauuccccaccuccggagucuucgaauuuguauccuggguccccgucuucuaccaacucaccccugucggcuccuccggcgcacgcaaacgcuaa

SEQ ID NO: 39076 - RNA, 1617 nt, Artificial Sequence
  derived and/or modified sequence opt11 from VP1__Norovirus_and/or_Norovirus-like__KF306212
augaugauggcauccaaagacgcuccccaauccgcagacggagcaucuggagcgggucaacucgucccagaaguuaacaccgccgacccccuucccauggaaccagucgcaggccccacuaccgccguugccacagccggccaagucaauaugaucgaccccuggaucguaaacaacuuuguccaaucaccgcaaggcgaguucaccaucucccccaacaacacacccggugacauacuguucgaccuccaacucggaccacaucucaaccccuuucucucccaccucucccaaauguacaacggcugggucggcaacaugcgaguccgcauccuccucgccggcaacgccuucuccgccggcaaaaucaucgucugcuucguaccuccaggcuucacaucgucuagucuuaccauugcacaagcaacacucuucccccacguuaucgcagacguccgcacacucgaacccaucgaaaugccccucgaagacgugcgcaacguccuauaccacaccaacgacaaccaaccaaccaugcgccuugucugcaugcucuauacaccccuccgcaccggcggaggauccggcuccucagacuccuucguagucgccggucgcguccucaccgcccccucauccgacuucuccuuccucuuccucgucccaccaacaauagaacagaaaacccgcgccuucacgguaccuaacaucccucugcaaacgcucuccaacucccgcuuccccucccucauccaaggcaugauucucucacccgacgccucacaagucguccaguuccagaacggccgaugccuaauagacggucaacugcucgggaccaccccagcaacaucaggccagcucuuucgcguccguggcaaaauaaaccaaggcgcacgcaccuuaaaccucaccgaagucgacggcaaaccauucauggccuucgacucuccagcacccgucggcuuuccugacuucggcaaaugcgacuggcacaugcgcauuuccaaaaccccaaacaacacaucaucaggcgacccuaugagaagcguuuccguccaaaccaacguucaaggauucgucccacaccuagguucuauacaauucgacgaagucuucaaccaccccacaggcgacuacaucggcaccaucgaauggaucucccaacccuccaccccacccggaaccgacaucaaccucugggaaauacccgacuacggcuccucccucucacaagccgccaaccucgccccacccgucuucccucccggauucggcgaagcccuagucuacuucgucuccgccuuucccggccccaacaaccgcucagccccgaaugauguccccugccuccucccccaagaauacaucacacacuucgucuccgaacaggccccaacaaugggugacgcagcccuccuccacuaugucgaccccgacacuaaccgcaaccuuggcgaauuuaaacucuaccccggcggauaccuaaccugcguaccgaauggcgucggagcaggcccccaacaacucccucucaacggcguuuuccucuucguguccuggguaucccgcuucuaccagcucaaacccgucggcaccgccucaacagcccgcuag

SEQ ID NO: 39077 - RNA, 1617 nt, Artificial Sequence
  derived and/or modified sequence opt11 from VP1__Norovirus_and/or_Norovirus-like__KM461694
augaaaauggcauccaacgacgccgcucccuccaacgacggagcagccaaccuaguccccgaagcaaacaacgaagucauggcguuagaaccagugguuggcgccucaauagcagccccggucguaggacaacagaacaucauagacccauggauccgcgaaaacuucguccaagccccacaaggagaguucacagucuccccgcgcaacucaccuggcgaaaugcuccucaaccucgaacucggucccgaacuaaaucccuaccucucccaccucucccgcauguauaacggauacgcaggcggcaugcaaguccaagucguacucgcaggcaacgccuucacagcaggaaaaaucauuuucgccgccgugccaccacacuuccccguagacaacaucucagccgcacaaaucacuaugugcccccacgugauagucgacguccgccaacucgaacccguccuccucccccuacccgacauccgcaaccgcuucuuccacuacaaccaagaagacacaccccggaugcgccucguagcaaugcuauacacaccccuucgagccaacucuggcgaagauguauucaccgucucaugccgaguacuaacccgacccgcccccgacuucgaguucaccuucuuaguaccacccacaguugaauccaaaacaaaacccuucacccucccaauccuaacacuuggggaacucuccaacucccgauucccagcugcaauagacaugcuauacaccgacccuaacgaauccaucgucguacaaccccaaaacggcagaugcacccuugacggaacacuccaaggcaccacccaacucguccccacgcaaaucugcgccuucagaggaaccuuaaucucccaaaacgcccgagccgcagaccucaccgacagcccccaaagagcucgcaaccacccacuccacguccaaguuaaaaaccucgacggcacccaguacgacccuaccgacgacauaccagccguccucggcgcaaucgacuucaaagguaccguauuuggcgucgcaucccaaagagacgucuccggcacccaagaacaaggucacuacgccacccgagcccacgaagcccacauugacaccacagaccccaaauacgcaccaaagcucggcaccauccuuauaaaauccgaauccaccgacuucaccacaaaccaacccauccgcuucacacccguaggcaugggugacaacaacuggagacaaugggaacuacccgacuacuccggcucccucacccucaacaugaaccuggcucccgccgucucccccuccuuccccggagaacgcauccucuucuuccguagcaucguccccucugccggcggcuauggcucaggcuauauugacugucuaauaccccaagaauggguacaacacuucuaccaagaagccgcccccucucaauccgcaguagcccucguccgauacgucaacccagacacuggccgcaacaucuucgaagccaaguuacaccgugagggcuuccuaacuguagccaauuccggaaacaaccccauugucgucccacccaacggcuacuucagauucgaagccugggucaaccaauucuacacccucgccuaa

SEQ ID NO: 39078 - RNA, 1614 nt, Artificial Sequence
  derived and/or modified sequence opt11 from VP1__Norovirus_and/or_Norovirus-like__AB039780
augaagauggccuccaacgacgcagccccaucaaacgacggcgccgccggccucguccccgaaaucaaccacgaaguaauggccaucgaaccagucgcuggcgcaucccucgcugcaccagucgucggucaacucaacaucauugacccuuggauccgcaauaacuucguccaagcucccgcaggagaauuuaccgucagcccccgaaacgcacccggagaauuucuccucgaccuugaacucggacccgaacucaacccauacuuagcacaccuagcccgaauguacaacggacacgccggcggaauggaaguccaaaucguucucgccggcaacgccuucaccgcaggcaaaauccucuucgccgucauuccacccggauuccccuacgaaaaucuaucccccgcccaacuaaccauguguccacacgucguagucgacguccgccaacuagaacccauccuacuacccaugcccgacauaagaaacacauucuuccacuauaaucaauccaacgggcccaaacuccgccuaguagccaugcucuacacaccacuccgcgcaaacaacgcaggagaagacguauucacagucuccugucgugucuuaacacgucccuccccagacuucgaguucaacuuccuagucccacccucugucgaauccaaaacaaaagccuucacccuccccauccuuaaaaucucagaaaugaccaacagccgcuuccccauccccguagaccaaauguacaccucccgcaacgaaaacaucgucguacaaccccaaaacggccgcguuacccucgacggcgaacuacaaggcaccacaacacuacaacccguaucuauuugcggauuccgcggcacacuccaaacacgccucgccgaccaacccaauuacacauaccaaguccaucucgaaaaccucgacggaagcccagucgacccaacagacgaagucccagcaccccucggcacccccgacuuccaagcacaacucuucggcgucauaucacaacgcagcuccgacaaugccacgcgagcgcacgaagcacgagucaacaccaacgaccccaccuuugcaccccaaaucgcccaaguccgcuucaaaagccccucaaacgacuucuucgacaacgaacccaucaaauucacacccgucggaaucucgguagacagccaaaacuccuacaaccaguggcuccucccccgcuacggcgggcaccucacuaauaacacccaccuagccccuagcgucaguccaauguuccccggcgaacaaauccuuuucuuccgcuccuucaugccaggagccagcggccacaccgacggcgccauagacugccuccuuccacaagaaugggucgcccacuucuaucaagaagccgccacagcccaaacagacgucgcccucauccgauucguaaaccccgacaccggcagaguccucuuugaaggaaaacuccacaaacaaggauucaucaccaucuccaacuccggagaccacccaaucguaaugccagcaaacggcuacuuccgcuucgaagccuggguuaaccaauucuacucccuagccccaguaggcacaggcagcggccgccgccgcauacaauaa

SEQ ID NO: 39079 - RNA, 1614 nt, Artificial Sequence
  derived and/or modified sequence opt11 from VP1__Norovirus_and/or_Norovirus-like__AY038599
augaaaauggcuuccaacgaugccgcccccuccucagacggcgccgccggcguaguccccgaaaucaaccacgaaguaauggccaucgaacccguagccggcgccuccaucgcagcccccgucgucggccaacaaaauaucaucgaccccuggauccgaaacaacuucguacaagcgcccgccggcgaauuuaccgucucacccagaaacgcacccggagaguuccuccuagaccuagaacucggccccgaccuaaacccuuaccuagcccaccuagccagaauguacaacggccacgccggcggaauggaaguccaaaucguacucgcgggaaacgccuucaccgcuggcaaaauacuguucgccgucauaccaccaggauucccauacgaaaaccucuguccagcccaacuaacaaugugcccacacgucgucgucgacguucgccaacuugaacccgucaugcucccaaugcccgauauccgcaacacauucuuccacuacaaccaagacggaggccccaagcuccgucugaucgcaaugcucuacacuccccuacgagcaaauaacuccggcgacgacgucuucaccguauccugccgaguccuaaccagacccgccccagacuucgaguucaccuucuuaguacccccaucaaucgaaucuaaaacuaaagccuucacaauccccguccuuaaaaucuccgaaaugaccaacuccagauucccugucccagucgaccaaauguacacuucccgcuccgaaggcauagucguccagccccaaaacggccgcgccacuaucgacggagaacuacucggcaccaccuuaguaucccccguauccguuugcaacuucaaaggaaaccuccaagcagaaguucccggucagcaccaacucuaucaacuccaacuaaccaaccuggacggaucccccauugacccaaccgacgacacgcccgguccccucggcugcccagacuucacaggacuucuauacggcgucgccucccaacgcggccccggagacgccacccgagcccacgaagcccgcaucgacaccggcucagauaccuucgcaccaaaaaucggccaaguacgcuucuacuccaccucaagcgacuucgaaacaaaccaacccacccacuucacacccaucggcauuuacauugaaggcaacucuuccgacuucaaccaauggcagcuaccucguuacggcggacaccuagcaaacaacaaccacuuagccccagccguaucaccccuauucccaggcgaacaaauccucuucuuucgaucauucaucccaggcgccuccggacacaccaacggcgaaauggacugccuccucccccaagaguucguccaacacuucuaccaagaagccgccacagcccgcagcgaaguugcccuccuaagauucguaaaccccgacaccggccgcgcccucuucgaaucaaaacuccacaaacaaggcuucaugaccauugcaucaucaggagaccaccccauaaucaugcccacgaacggcuauuuccgcuucgaagccugggucaaccaauucuacagcuuagcaccaguuggcacuggaagcggccggcgucgcauccaauaa

SEQ ID NO: 39080 - RNA, 1614 nt, Artificial Sequence
  derived and/or modified sequence opt11 from VP1__Norovirus_and/or_Norovirus-like__AY054299
augaaaauggccucuaacgacgcggcccccucuuccgacggcgcugccggccuuguuccagaaauaaaccacgaagucauggccaucgaacccguugcaggugcaucaaucgccgcacccgucgucggacaacaaaacaucaucgacccauggaucagaaacaacuucguccaagcccccgcaggcgaauucaccguaucacccagaaacgcccccggugaauuucuacucgaccucgaacucggcccagaccucaaccccuaccucgcacaccucgcccguauguacaacgggcacgccgguggcauggagguccaaaucguccucgccggaaacgccuuuacagcaggaaaaauccuauucgccgucaucccccccggcuuccccuacgaaaaccucagcccagcacaacuaaccaugugcccacacguaguugucgacgucagacaacuagaacccgucaugcuccccaugccagacauccgcaauacauucuuccacuacaaccaagacggcggcccccgccuacgccuuauagccaugcucuacacaccccuccgcgccaacaacucuggcgacgacgucuucacagucuccugccgcguccuaaccagacccgccccagacuucgaauucaccuuccuugucccccccuccaucgaaagcaaaacaaaagccuucacaauccccguacucaaaauauccgaaaugaccaacucccgauucccaguccccgucgaccaaauguacacaagccgaagcgaaggcaucguuguacaaccacaaaacggccgcgccaccaucgacggagaacuccucgguacaacccucgucucacccguguccguauguaacuucaaaggcaaccuucaagcagaagucccaggcgaacaccaacucuaccaacuucaacucacaaaccuagacggcagccccaucgaccccacagacgacacaccaggcccacuaggcugcccagacuucacaggucugcucuacggagucgccucacaacgaggaccgggagacgccacccgggcccacgaagcccgaaucgauaccggaucagacacauacgcuccuaaaaucggccaaguccgauucuacuccaccucauccaacuucgaacgcaaccagccaacucacuucacacccaucggaauauacaucgaaggaaacuccuccgacuucaaccaauggcaacuaccacgcuacggaggacaccucgccaacaacaaccaccucgcacccgccgucuccccccucuucccaggagaacaaauacuauucuuccgaucuuucauccccggagcaucaggccacaccaacggagaaauggacugccuacuaccccaagaauucguacaacauuucuaccaagaagccgccaccgcacaauccgaaguugcccuucucagauucgucaauccagacacaggccgcguccucuucgaaagcaaacuccauaaacaagguuucaugacuauugccuccucaggggaccacccaauaauuaugcccacaaacggcuacuuccgcuucgaagccuggguaaaccaauucuacucccucgcacccgucggcacaggcuccggccgccgucgcauccaauaa

SEQ ID NO: 39081 - RNA, 1614 nt, Artificial Sequence
  derived and/or modified sequence opt11 from VP1__Norovirus_and/or_Norovirus-like__AF195848
augaaaauggcaucuaacgacgccgcacccuccaacgauggcgccgcaggucuuguccccgagauuaaucacgaagucauggccauagaaccggucgccggcgcaucucucgcugcaccagucguaggccaacuaaacaucaucgauccauggauccgcaacaacuucguucaagcuccagccggagaguucaccguaucuccacgcaaugcccccggugaguuccuacuagaccucgaacucgguccugaacuaaaccccuaucucgcucaccucgcccgaauguacaacggacacgcaggcggcauggaaguccaaaucguccuagccggaaacgccuuuacagccggcaaaauccucuucgccguuaucccacccggcuuucccuacgaaaaccuaucccccgcccaacucacaaugugcccacacguaguuguagacguccgacaacucgaacccauacuccuccccaugcccgacauccguaacaccuucuuccacuacaaccaaucuaacggacccaaacgccgccuagucgccaugcucuacacuccccugcgugccaacaaugcgggcgacgacgucuucaccgucuccugcagaguccucaccagacccucuccugacuucgaauuuaauuuccuagucccacccucugucgaaucgaaaaccaaagccuucacccuccccguccuuaaaauauccgaaaugaccaacucacgcuuccccauccccgucgaccaaauguacaccucacgcaacgaaaacauagucguucaaccccaaaacggccgagucacacucgacggcgaacuccagggaaccacaacacuccaacccguauccaucuguggcuuccgcggcacacuacaaaccaggcucgccgaccaacccaauuacacuuaccaaguccaccuagaaaaccuagacggauccccagucgaccccacagacgaaguacccgcuccccuaggcacccccgauuuccaagcucaacuguuuggagucaucucacaacgaucuucagacaacgcuacccgcgcucacgaggcccgcguaaacaccaacgaccccacauucgcuccccaaauugcccaaguacgcuucaaauccccaucuacagacuuuuccgacaacgaaccuauaaaguucacacccgucggcauaagcgucgacucccaaaacuccuauaaccaauggcuccucccacgcuauggaggccaccucacaaacaacacccaccuagcccccuccgucuccccaauguuucccggagaacagauacucuucuuccguucauucaugcccggcgccggcggcuucacagacggcgccaucgacugccuucuaccacaagaauggguagcacacuucuaccaagaagcugccaccgcccaaaccgaugucgcccuaauacgcuucguuaaccccgacaccggacguguacuauucgaaggcaaacuccacaaacaaggcuucauaacuaucuccaacucaggcgaccaccccaucgucaugccagccaacggauacuucagauucgaagccugggucaaacaauucuacucccucgcccccguaggaacaggcuccggacgccgccgcguccaguaa

SEQ ID NO: 39082 - RNA, 1614 nt, Artificial Sequence
  derived and/or modified sequence opt11 from VP1__Norovirus_and/or_Norovirus-like__AB303927
augaaaauggcauccaacgacgccaacccauccgacgguucaaccgccaaccuaguccccgaaguaaacaacgaaguaauggcucucgaacccguaguaggcgccgccaucgccgcgccggucgccggccaacaaaacgucaucgaccccuggauccgcuccaacuucguacaagcacccggcggagaauuuaccguaucccccagaaacgcucccggcgaaauacucugguccgccccacuaggccccgaccucaaccccuaccucucacaccuugcccgcauguacaacgguuaugcaggaggcuucgaaguccaaguaauccucgccggcaacgccuucaccgccggcaaaaucaucuucgccgcgguucccccaaacuuccccacagaaggccucucccccucccaagucacaauguucccccacaucauugucgacguccgacaacucgaacccguacuaaucccccuccccgacguacguaacaacuucuaccacuacaaccaauccaacgacuccaccaucaaacucaucgcgaugcuuuacacaccucuccgagcaaacaacgccggcgacgacguauucaccgucuccugucgcguacucacccggcccuccccugacuuugacuuuaucuuccuagugccgcccaccgucgaaucccgcaccaagccauucaccguacccauccucaccguagaagaaaugucaaacucccgcuuuccagucccccuagaaaaacucuacaccggucccuccucagcauucgugguacaaccccaaaacggccgaugcacaacagauggcguccuccucggcaccacacaacucagcgccgucaacauaugcaccuuccgaggcgacgucacccacaucgcuggcucccacgacuacaccaugaaccucgccucacaaaacuggaauaacuacgaucccaccgaagaaaucccagcaccccuaggaacaccugacuucguaggcaaaauccagggcguucucacccaaacaacccgugaagacggcuccaccagagcccacaaagccaccguuuccaccggcucaguccacuuuacccccaaacucggcucuguacaauacaccacugacaccaauaacgacuuccaaacaggacaaaacacaaaauucacuccugucggaguuauacaagacggcagcaaucaccaaaacgaaccccaacaauggguccucccaaacuacucaggccguaccggucacaacguccaccucgccccagccguugcucccacuuuuccaggagaacaacuccucuucuucagaagcaccaugcccggaugcuccggcuaccccaacaugaaucucgacugccuacucccccaagaauggguucaacacuucuaccaagaagccgcccccgcucaauccgacgucgcccuacuccgauucgucaaccccgacacuggcagaguccucuuugaaugcaaacuccacaaauccggcuacgucacugucgcccacaccgguccccacgaucuaguuaucccacccaacggcuacuuccgcuucgacuccugggucaaccaauucuacacccucgcccccaugggcaauggcgccggccgccgccgauaa

SEQ ID NO: 39083 - RNA, 1614 nt, Artificial Sequence
  derived and/or modified sequence opt11 from VP1__Norovirus_and/or_Norovirus-like__AY038600
augaaaauggccucaaacgacgccucccccucagacggcucaacagccaacuuagucccagaagucaacaacgaaguaauggcacucgaaccuguagucggagcagccaucgccgcacccgucgccggccaacaaaacgucaucgaccccuggauccgcaauaacuucguccaagcccccggaggagaguucacagucucuccccgcaacgcccccggcgaaauccuuugguccgccccacuaggcccagaucucaacccauaccuaagccaccucgcgcgaauguacaacggcuacgccggcggcuucgaaguucaagucauccuugccggaaacgccuucacagccggcaaagucaucuucgcagcaguacccccaaacuuccccaccgaaggccuaucccccucccaagucaccauguucccccacaucauagucgacguccgacaacuagaaccaguacucaucccccuccccgacguccgaaacaacuucuaccacuacaaucaaucgaacgacuccaccaucaaacuaaucgcaaugcucuacacccccuuacgagccaacaacgccggcgacgacguauucaccguuucgugccgcguccuaaccagacccucaccagacuucgacuucaucuuccucguacccccuaccgucgaaucacgaaccaagcccuucaccguccccauccuaaccgucgaagaaaugucaaauucacguuuccccaucccacucgaaaagcucuacacaggccccuccucugcauucgucguccaaccccaaaacggccguugcacaacggacggaguacucuuaggcacaacccaacuauccgccgucaauaucugcaccuuccgcggagacgucacccacaucgccggcucccacgacuacaucaugaaccuagcaucccaaaacuggaacaacuacgacccaacagaagaaauacccgcaccccuagggacaccagacuucgucggaaaaauccaaggcaugcuuacccaaacaaccagagaagacgguucaacacgcgcccauaaagccaccgucucaaccggcucaguccacuucaccccuaaacucggcuccguacaauacacaaccgacaccaacaaugaccuccaaacgggccaaaacacgaaauucacccccguuggcgucauccaagauggcaacaaucaccaaaacgaaccacaacaauggguacuacccaacuacuccggacgcaccggacacaacguacaccuagcccccgcagucgccccuacauuccccggugaacaacugcuauucuuccgcucaaccaugcccggcugcucaggauaccccaacaugaaccuagacugucuuuuaccucaagaauggguccaacauuucuaucaagaagccgcccccgcgcaaucagacgucgcacuacuccgcuucguaaaccccgauaccggccgcguccucuuugaauguaaacuccacaaaucuggcuacgucacaguggcucacacaggcccccaugaccucguaaucccacccaacggcuacuuccgauucgacuccuggguuaaccaauucuacacacucgcacccaugggcaauggcgccggacgccgccgcuaa

SEQ ID NO: 39084 - RNA, 1614 nt, Artificial Sequence
  derived and/or modified sequence opt11 from VP1__Norovirus_and/or_Norovirus-like__AF080554
augaaaauggccuccaacgacgcuaaccccuccgacggcuccaccgccaaccucguccccgaaguaaacaacgaagucauggcacuugaacccgucgucggugcagccaucgccgcaccaguagccggucaacaaaacgucaucgaccccuggauaagaaacaacuucguacaagcccccgguggugaauuuaccgucuccccacgcaacgcuccaggcgaaauccucugguccgcgccccucggcccugaccuaaauccauaccucucccaccucgcacgaauguacaauggcuacgcaggcggauucgaaguccaaguuauccuggcaggcaacgcguucacugccggaaaaauuaucuucgccgccguacccccaaauuucccuacugaaggccuuuccccaagccaagucaccauguucccccauauaaucguagacguacgucaacucgaaccaguacuaaucccacucccagacgugcgaaacaacuuuuaccacuacaaucaguccaacgauuccacuaucaaacuaauagcaaugcuauacacaccccuacgcgccaacaacgccggagaugacguuuucaccgucaguugucgaguccuuacccgcccuucaccagacuucgacuucaucuuucucgucccaccaaccgucgaaucccgcaccaaaccauucacaguccccauccuaacaguagaagaaauguccaacucacgcuuccccaucccacuagaaaagcucuacaccggccccuccuccgccuuuguaguucaaccccaaaacggccgcugcaccaccgacggcguccuacugggcaccacccagcuuuccgcaguuaacauaugcacauuccgcggagacguuacccacauugccggcucccacgacuauacaaugaaccuagcuucccaaaacuggaacaacuacgauccaaccgaagaaauacccgcuccccuuggcacccccgacuucgucggcaaaauucaaggcguacucacccagaccaccaaagaagauggcuccacccgcgcccacaaagccaccgucagcaccggcucaguccacuucacacccaaacuuggcuccguccaauacaccacagacaccaacaaugacuuccaaaccggccaaaacaccaaauuuacccccgucggggucauccaagacggaaacaaccaucaaaacgaaccacaacaauggguccuccccaacuacuccggccgaacaggccacaacguacaccuugccccagccguagcacccacuuuccccggcgaacaacuccuauucuuccgaagcacaaugccaggaugcuccggcuacccaaacaugaaccuagacugccuccuaccccaagaauggguccaacacuucuaccaagaagcagcccccgcccaauccgacgucgcccuccuccgcuuugucaacccagacacaggccgaguacucuuugaaugcaaacuccacaaguccggauacguaaccgucgcgcacaccgguccacacgaccucguaauacccccaaacggcuacuuucgcuucgacuccuggguaaaccaauucuacacccucgccccaaugggaaacggcgccggccgcagacgcuga

SEQ ID NO: 39085 - RNA, 1614 nt, Artificial Sequence
  derived and/or modified sequence opt11 from VP1__Norovirus_and/or_Norovirus-like__AB294778
augaaaauggccaguaacgacgccaacccuuccgauggauccacagccaaccucguccccgaagucaacaacgaagucauggcccucgaacccgucgucggagccgccaucgccgcucccguugcuggccaacaaaacguaaucgaucccuggauccgcaacaacuucguccaggcccccggcggugaguucacagucagcccucgcaaugcccccggcgaaauacucuggucagcaccacucggcccagacuuaaaccccuaccucucacaccuagcccgcauguacaauggcuacgcuggaggcuucgaaguacaagucauccuagccggcaacgcuuucaccgcaggcaaaaucauauucgcagcaguucccccuaauuuccccacugaaggccucucucccucccaagucaccauguucccccacauuaucgucgacguccgacaacucgaacccguccucaucccacuccccgacguucgaaacaacuucuaccacuacaaccaauccaacgacuccacuauaaagcuaaucgccaugcuauacacuccccuacgagccaacaacgccggagacgacgucuucaccguuucaugccguguccucacccguccaucccccgacuucgacuucauauuccucgucccacccaccgucgaaucccguaccaaacccuucaccgucccaauccucacagucgaagaaauguccaacucacgcuuccccguaccccucgaaaaacuauacacaggccccuccuccgccuucguaguacaaccccaaaauggccgcugcacaaccgacggcguccuacuaggcaccacacaacucuccgcgguaaacaucugcaccuuccgcggcgacguuacccacaucgccggcucacacgacuacaccaugaaccucgccucccaaaacuggaacaacuacgacccaacagaagaaauaccggcgccccuaggcacccccgacuucguuggcaagauccaaggcguccuuacccaaaccacccgcgaagacggcucaacccgugcccauaaagccacugucagcaccggcuccguacacuucacuccaaaacuaggaucuguccaguacaccaccgacaccaacaacgacuuucaaaccggacaaaacaccaaauucacccccgucggugucauccaagacgguuccaaccaccaaaacgaaccacaacaauggguacuccccaauuacuccggucgcaccggccacaacguacaucuggcccccgccgucgccccaacauuccccggagaacaacuccucuucuuccgcuccacgaugcccggaugcucaggcuaccccaacaugaaccucgacugucuccucccccaagaauggguacaacacuucuaccaagaagccgccccagcgcaaucagacguagcccuacuccgcuucgucaaccccgacacaggccguguccucuucgaaugcaaacuccacaaaucugguuacguaacaguagcccauacgggcccccaugaccucgucauacccccaaacggauacuuccgcuuugacucuuggguuaaucaauucuauaccuuagcaccaaugggcaacggcgccggccgcagacgauaa

SEQ ID NO: 39086 - RNA, 1614 nt, Artificial Sequence
  derived and/or modified sequence opt11 from VP1__Norovirus_and/or_Norovirus-like__AB303922
augaaaauggcguccaacgacgccacacccuccgacggcuccaccgccaaccuaguacccgaagucaacaacgaagucauggcccuagagcccgucguuggcgcagccaucgccgcucccguagccggccaacaaaacgucaucgaccccuggauccgaucuaacuucguccaagcucccgggggugaauuuaccgucuccccucgcaacgcccccggcgagauccucugguccgccccucucggcccagaccuaaaccccuaccuaucccaccuggcccgcauguacaauggcuacgccgguggcuucgaaguucaaguuauccucgcaggcaacgcuuucacagcaggcaaaaucaucuucgcagccgucccucccaacuucccuaccgaaggacuaucacccucucaaguaaccauguucccccacaucaucgucgacgucagacaacuagagcccguccuuauccccuuaccugacguccgcaacaacuucuaccacuauaaccaauccaacgacuccaccaucaagcuaauagccaugcuauauaccccacuacgagcaaauaacgccggcgacgacguauucacuguaucaugucgcguccuaacucgccccucacccgacuucgacuucaucuuccucgucccacccaccguugaauccagaaccaaacccuucacaguccccauccucacggucgaagaaauguccaacagccgcuuccccaucccacucgaaaaacuauacaccggucccuccucugcuuucgugguccaaccacaaaacgguagaugcacaacugacggcguacuccucggaacaacccaacucagcgcugucaacaucugcacauuccgcggcgacguaacacauaucgccgguagccacgacuacaccaugaaccucgccucacaaaacuggaacaacuacgaccccaccgaagagauccccgccccacuaggcacccccgauuucgucggaaaaauacaaggcguacucacacaaaccacccgcggagacggauccacccgcgcacacaaagcuaccgugucaaccggauccguucacuucacccccaaacucggcuccguacaauacaccaccgacaccaauaacgacuuucaaaccggccaaaacacaaaauucacccccgucggcgucauacaagacggcgacaaccaucaaaacgagccucaacaauggguacucccaaauuacuccggacgcacaggacacaacguacaccucgcccccgcagucgcucccaccuuccccggcgaacaauuacuauucuuccgcucaacaaugcccggaugcuccggcuacccuaauaugaaucucgauugccuccucccacaagaauggguccaacacuucuaucaagaagccgcacccgcccaaucugacgucgcacuccucagauucgucaaccccgacaccggccguguccuuuuugaaugcaaacuacacaaaucaggauacguaacugucgcccacaccggaccccacgaccuugucauucccccaaacggcuacuuccgauucgacuccugggucaaccaauucuacaccuuagccccaauggguaacggcgcaggacgccgccgauaa

SEQ ID NO: 39087 - RNA, 1614 nt, Artificial Sequence
  derived and/or modified sequence opt11 from VP1__Norovirus_and/or_Norovirus-like__AY532128
augaaaauggccagcaacgacgcuaaccccucagauggcucuacagcuaaccucguccccgaagucaacaacgaagucauggcccucgaacccguagucggagcagccaucgccgccccugucgccggccagcaaaacaucaucgacccuuggauccgcaacaacuuuguucaagcaccaggcggcgaguucaccguaucccccagaaacgccccuggcgaaauccugugguccgcaccccuuggccccgacuuaaaccccuaucucagccaccuggcccgaauguacaacggcuacgccggaggauucgagguacaagucauccuagccggcaacgccuucaccgccggcaaaauaaucuucgccgccgucccacccaacuucccaacagaaggucucuccccaucacaaguaaccauguucccacacauuauaguagacguucgccaacucgaaccaguacuaauuccccuccccgacguccgcaacaacuucuaccacuacaaccaaucaaacgacuccaccauaaaacuaauagcgaugcuauacacaccccuccgcgcaaacaacgccggcgacgacgucuucaccguuuccugccgcguacugacacgccccuccccagacuuugacuucaucuuccucgucccacccacagucgaaucacgcacuaaacccuucaccguccccauacucacagucgaagaaaugucuaacucgagauuccccaucccccuagaaaaacuauacaccggccccucaucagcauucguaguccaaccccaaaacggccgaugcacaaccgacggagucuuacucgguaccacccaacucuccgccguaaacaucugcaccuuccgcggcgacgucacacauaucgccggcucucaugacuacaccaugaaccucgcaucccaaaacuggaacaauuacgacccaaccgaagaaaucccagcaccccuaggcacacccgacuucguaggaaaaauacaaggaauacuaacacagaccacccgugaagacggcuccacacgagcccacaaagcaaccguauccacaggcucaguucacuucacccccaaacucggauccguccaauacaccaccgacacuaacaaugacuuccaaaccggacaaaacaccaaauucacgcccgucggcguaauccaagacgguaacaaccaccaaaacgaaccccaacaauggguccuccccuccuacucaggccgcacaggccacaacguccaucucgcccccgccgucgcccccaccuuccccggcgaacagcuucucuucuuccgcuccacaaugccaggcugcuccggcuacccaaacaugaacuuagacugccuccucccccaagaauggguccaacacuucuaccaagaagccgcccccgcacaaagcgaugucgcacuacuaagauucgucaacccagacaccggacgaguccucuucgaaugcaaacuccacaaauccggcuacgucacagucgcccacaccggaccacacgaccuaguaauaccaccaaacggcuacuuucgcuucgacucuugggucaaccaauucuacacccucgccccaaugggcaacggcgccggccgccgacgauaa

SEQ ID NO: 39088 - RNA, 1614 nt, Artificial Sequence
  derived and/or modified sequence opt11 from VP1__Norovirus_and/or_Norovirus-like__AY532113
augaaaauggccucaaacgacgccaaucccuccgacggcuccacagccaaccucgucccugaaguaaacaaugaaguaauggcccuugagcccgucgucggcgccgcaaucgcggcccccgucgcaggccaacaaaacaucauagacccauggauccguaacaacuuuguccaagcacccggaggcgaguucaccguauccccacgaaaugcuccaggagaaauccucugguccgccccacuuggcccagaccuaaacccauaccuuucccaccucgcucgcauguauaacggcuacgcuggcggcuucgaaguucaggucauacucgccggcaacgcauucaccgcaggaaaaaucaucuucgcagccguacccccaaacuuucccaccgaaggccuaucccccucccaagucacaauguucccccacauuaucgucgacguccgacagcucgaaccaguccuaaucccucuacccgacguccgaaacaacuuuuaccacuacaaccaauccaaugacucuaccaucaaacucauagccaugcucuacacaccccuccgcgcuaauaacgccggugaugacgucuucaccgucuccugccgcguacucacccgacccucccccgacuucgacuucauauuccucgucccucccaccgucgaaucccguaccaagcccuucacaguccccauacugacagucgaagaaauguccaauuccagauuccccauaccccucgaaaaacuauacacaggccccucauccgcauucguuguacaaccccagaacggccgcugcaccacagacggaguccuacucggaaccacccaacucuccgcagucaacaucuguacauuccgaggcgacguaacacacaucgcuggcucacacgauuacacaaugaaucucgcaucccaaaacuggaacaacuacgacccaaccgaagaaauccccgcaccgcucgguacacccgacuucguaggcaaaauccaaggcaugcucacccaaacuacacgcgaagacggcuccacacgagcucacaaagccacaguaucgaccggcagcguccacuucacacccaaacuaggcuccguccaauacaccaccgacaccaacaacgauuuccaaaccgggcaaaacaccaaguucaccccaguaggcgucauccaagacggcaacaaccaccaaaacgaaccccaccaauggguccuacccaacuacuccggccgcaccggacacaacguacaccuagccccugccgucgcccccaccuucccaggagaacaacuccucuucuuccgcuccacaaugcccggaugcuccggauauccaaacaugaaccucgacugccuccuaccacaagaauggguccaacauuucuaccaagaagccgccccagcacaauccgacgucgcucuccuacgcuucguaaacccggacaccggacgcguccucuucgagugcaaacuacacaaaucaggcuacgucaccgucgcccacaccggaccccacgacuuaguaauacccccaaacggauacuuucgcuuugacuccugggucaaccaauucuauacccucgcacccaugggcaacggagccggccgcagaagauga

SEQ ID NO: 39089 - RNA, 1614 nt, Artificial Sequence
  derived and/or modified sequence opt11 from VP1__Norovirus_and/or_Norovirus-like__EU078406
augaaaauggcuucauccgacgcaaaccccuccgacggcuccgcugccaaccucguccccgaagucaacaacgaaguaauggcacuugaacccguagucggcgcagccauagccgcacccgucgccggccaacaaaacauuaucgaccccuggauacgcaacaacuucguacaggcaccaggcggcgaguucaccgucucaccccgcaacgcccccggcgaaauccuguggagcgcaccccucggucccgaccuuaacccauaccucucacaccucucccgcauguacaacggcuacgccggaggauucgaaguccaaguaauucuugccggcaaugccuuuaccgccggaaaaauuauauucgcagcaguacccccuaacuuccccacugaaggccugucuccuucacaagucaccauguucccacacgucauagucgacgucagacaacucgaacccguccucaucccccuccccgacguacgcaacaacuucuaccacuacaaccaagcccacgaccccaccaucaaacuaauagccaugcucuacacccccuuacgcgccaacaacgccggcgacgacguauucacagucuccugccgcguccuaacccgaccaucaccagacuucgacuucauauuucuugucccacccaccguugaaagccggaccaaacccuucaccguccccauacuuacggucgaagaaauguccaacucccgauuucccauaccacuagaaaaacuuuacaccggccccuccucugauuucgucguccaaccccaaaacggacguugcaccaccgacggcguccuucuuggcacuacccaacucuccgccgucaauauaugcaacuucaaaggcgacgucacccacaucgccgggagccgcgacuaccgcaugaaccucgucucacaaaacuggaacaacuacgaucccaccgaggaaauacccgccccgcucggcacccccgacuuccaaggcaaaauccaaggccuccucacccaaaccaccggcgccgacgguaguacacgcgcccacaaagccacugucucaaccggcgcugccaacuucacaccaaaacuaggcagcguacaauucaccaccgacacagacaacgauuuccaaacaggacaaaacacaaaauucaccccuguaggagucauccaagacggcucacaccaccaaaacgaaccccaacaauggguccuccccaacuacucaggacgaaccguccauaacguacaccucgcccccgccgucgcccccaccuuucccggcgaacaacuccuauucuuccgauccaccaugccuggcugcuccggauaucccaacaugaaccuagacugccuacucccccaagaauggguaaugcacuucuaccaagaggccgcccccgcacaaucagaugucgcccuccuacguuuugucaaccccgacaccggccgcguccucuucgaaugcaaacuccacaaagccggcuacauaaccguagcccacaccggacaacacgaccucgucaucccacccaacggcuacuuccgauucgauuccuggguaaaccaauuuuauacucuagcccccaugggcaacggcgccggccgccgccgcuaa

SEQ ID NO: 39090 - RNA, 1614 nt, Artificial Sequence
  derived and/or modified sequence opt11 from VP1__Norovirus_and/or_Norovirus-like__AF472623
augaaaauggccucaaaugacgcaaaccccucagauggcuccacugcaaaucucguccccgaagucaacaacgaagucauggcccuagaacccguuguaggcgccgccaucgccgcccccguugccggacaacaaaacauaauugaucccuggauccgcaacaacuucguccaggcccccggcggcgaguucacaguuucaccacgaaacgcccccggcgaaauccuuuggucagcaccccucggccccgaccucaacccauaccuaagccaccucgcgcgcauguacaacggcuacgccggcggcuucgaaguccaaguaauccuagccggcaacgcauucaccgcgggcaaaauaaucuucgccgccguacccccaaacuucccaaccgaaggacuaucccccucccaagucaccauguucccucauauaaucgucgacguucgccagcucgaacccguccuuaucccacuccccgacguccgcaacaauuucuaccacuacaaccaauccaacgacuccaccaucaaacucaucgccaugcucuacacaccccuccgggccaacaacgccggcgacgacguauucaccgucagcugccgcguccucacccgcccauccccagacuucgacuucauauuccuagucccacccaccguugaaucccgcaccaaacccuucaccguccccauacucaccgucgaagaaauguccaacucccgcuuccccauuccgcuagaaaaauuauacaccggccccuccucggcauucgucguacaaccacaaaacgggcgcugcacaacugacggaguccuacucggcaccacccagcucucagcagucaacaucugcaccuuccgcggugacguaacacacauugcaggaucucacgacuacaccaugaaucucgccucacaaaacuggaacaacuaugacccaaccgaagaaauccccgcuccccuuggcaccccagacuucgucggcaaaauucaaggcaugcucacccaaacaacccgcgaagacggcuccacccgugcccacaaagcaaccgugucaacuggcucaguccacuucaccccaaaacugggaucuguacaauacacaaccgacaccaacaacgacuuccaaacgggacaaaacaccaaauuuaccccagucggcguaauacaagacggcaacaaccaccaaaacgaaccacaacaauggguccuucccaacuacucuggccgcaccggucacaacguccaucuagcacccgccgucgcccccaccuuuccaggagaacaacuacucuucuuccgauccacuaugcccggcuguuccggcuacccaaacaugaacuuagacugccuccuaccccaggaauggguccaacacuuuuaccaagaagccgccccagcccaaucagacgucgcacuccuuagauuugucaaccccgacacaggccgaguccucuucgaaugcaaacuccacaaauccgguuacguuacaguagcccauaccggcccucacgaccucgucauacccccuaacggcuacuuccgauucgacuccugggucaaccaauucuauacccucgcucccaugggaaacggcgcuggcagacgccgauaa

SEQ ID NO: 39091 - RNA, 1614 nt, Artificial Sequence
  derived and/or modified sequence opt11 from VP1__Norovirus_and/or_Norovirus-like__AF427114
augaaaauggccucaaacgacgccaaccccuccgacggcuccaccgcaaaccuaguacccgaaguaaacaaugaaguaauggcacuggaaccagucgucggcgcggccaucgccgcaccagucgcuggccaacagaacgucaucgaccccuggauccgaaacaacuucguccaagccccaggcggcgaauuuaccguaucuccccgcaacgcaccuggcgaaauccuaugguccgcaccccucggccccgaucuaaaccccuaccucucccaccucgcccggauguacaacggcuacgccggcggcuucgaaguacaagucauccucgcaggcaacgccuucacagccggcaaaaucauuuucgccgccguuccacccaacuuccccacugaaggacuuuccccaucucaagucaccauguucccccacauaauagucgacguacgccaacucgaacccguccuaauaccacuacccgacguccgaaacaacuucuaccacuacaaccaauccaacgacagcacaaucaaacuaauagccaugcuauacacaccccuccgcgccaacaacgcaggagacgacgucuucaccgccagcugccguguccuuacccgaccgucaccagacuucgacuucaucuuccucgucccaccuacagucgagucucguaccaagccuuucaccgucccaauccuuacugucgaagaaauguccaacucccgauucccaauaccccucgaaaaacucuacacuggccccuccuccgccuucgucguccaaccccaaaacggccgcugcaccaccgacggagugcuccucggcacaacccaacucucagccguaaacauauguaccuuccgcggcgaugugacacacauagccggaucccacgacuacacuaugaaccucgccucccaaaauuggaacaacuacgaccccaccgaggaaauaccagccccacucggaaccccggacuucgucggcaaaauacaaggaguccuaacacaaaccacacgagaagacggcuccacccgagcccacaaagccaccgucucuacaggcagcguccacuucacacccaaacucggcagcguacaguacaccaccgacacaaauaacgacuuucaaaccggacaaaacacuaaauuuacccccgucgguguaauccaagacggcuccaaccaccaaaacgaaccacaacaauggguacucccaaacuacucgggccgcacgggccacaacguccaccucgcccccgccgucgccccaaccuucccaggcgaacaacuacucuucuuccgaaguacaaugccaggaugcuccggcuaccccaacaugaaccucgacugucuccucccccaagaauggguccaacacuucuaccaagaagccgcccccgcucaauccgacgucgcacuauuacgcuucguaaaccccgacacuggccgcguccucuucgaauguaaacuccacaaaagcggauacguaacagucgcucacaccgguccacacgaccucgucaucccacccaacgguuacuuccgauucgacuccuggguaaaccaauucuacacacuugcccccaugggcaacggugccggccgccgacgcuaa

SEQ ID NO: 39092 - RNA, 1614 nt, Artificial Sequence
  derived and/or modified sequence opt11 from VP1__Norovirus_and/or_Norovirus-like__AY532114
augaaaauggccucgaaugacgccaaccccuccgacggcuccacagccaaccucguaccagaaguaaacaacgaaguuauggcccucgagcccguagucggugcagccaucgcagcccccguagccggucaacaaaacguaaucgaccccuggaucagaaauaacuucguccaagccccaggcggcgaguucaccgucucacccagaaacgcacccggcgaaauccucugguccgccccacugggcccagaccuaaaccccuaccuaagccaccuggcccgcauguauaacggcuaugccggcgguuucgaaguccaaguaauccucgccggcaacgcauuuaccgccggcaaaauaaucuucgcugccgucccucccaacuuccccaccgaaggccuauccccaucgcaaguaaccauguucccccacaucaucgucgacguacgccaacucgaaccaguccucaucccacuccccgacguacggaauaacuucuaccacuacaaucaauccaacgacuccaccauaaaacuaauagccaugcucuacacuccccuccgagccaacaacgccggcgacgacgucuucacagucucaugccgaguacucacacgucccucacccgacuucgauuucaucuuccucgucccaccaaccguugaaucccguacaaaaccauucaccguccccauucucacaguagaagaaauguccaauucccgcuuccccauaccccuagaaaagcucuacaccggcccuuccagcgcauucgucguccaaccucaaaacggcagauguacaaccgacggcguccuccuuggaaccacccaacuaagcgccgucaacaucuguaccuuccgcggagacgucacacacaucgccggcucccacgacuacaccaugaaccucgccagccaaaauuggaacaacuacgacccaacagaagaaauucccgcaccccuaggcacacccgacuuuguaggcaaaauacaaggcaugcucacacaaaccacaagagaagacggauccacacgcgcccacaaggccaccgucuccacaggaucaguccacuucacaccaaaacuaggcagcguacaauacaccaccgacacaaauaacgacuuccaaaccggccaaaacacaaaauucaccccaguaggugucauccaagacggcaacaaccaccaaaacgaaccccaccaauggguccuaccuaacuacucaggccgcacaggccacaacguccaccuagccccagcaguagcccccacauucccaggcgaacaacuguuauucuucagaucgaccaugcccgguugcucuggcuaccccaacaugaaccuagauugccuccucccccaagaauggguccaacacuuuuaccaagaagccgcacccgcccaaagugacgucgcccuccuacgcuucgucaaucccgacaccggccgcguccuguucgaaugcaaacuacacaaauccggauacgucacuguggcccacacaggcccacacgaccucgucauacccccaaacggcuacuuucgcuucgacuccuggguaaaccaauucuauacacuugccccaaugggcaacggagcaggccgaagacgcuaa

SEQ ID NO: 39093 - RNA, 1614 nt, Artificial Sequence
  derived and/or modified sequence opt11 from VP1__Norovirus_and/or_Norovirus-like__KF806505
augaagauggccuccaacgacgccucccccucagacggcucagccgcaaacuugguccccgaagucaacaacgaagucauggcccuugaacccguaguaggcgccgccauagccgccccgguagccggccaacaaaacgugaucgaccccuggauacgcaacaacuuuguacaagcaccaggaggagaauuuaccgucucacccagaaacgcacccggcgaaauacuauggucugcaccccuaggaccagaccucaaucccuaucuuucccaccucgcccgaauguacaaugguuacgcaggcggcuucgaaguccaaguaauccucgccggcaacgcuuucacagccggcaaaauaaucuucgccgcaguacccccaaacuucccaaccgaaggccuaucucccucccaagucaccauguucccacacauagucguggacguccggcaacucgaacccguccucauacccuuacccgacguccguaacaacuucuaccacuacaaccagucaaaagacccuacaaucaaacucauagccaugcucuacacaccccuacgggccaacaacgccggugaagacguuuuuaccgucuccugccgcguacucacccguccuucccccgacuucgacuucaucuuccucgucccacccacagucgaaucacgcuccaaacccuucaccgucccaauccuaacaguugaagaaaugacaaauagccgauuccccaucccucucgaaaaacucuucacagguccaucuggcgccuucguaguacaaccacaaaacggccgcugcaccaccgacggcguacuccucggaaccacucaacucucccccguaaacaucugcacuuuccgaggcgaccuaacccacuucacaggcacauccgaauacgcuaugaaccucgcaucccaaaacuggaacaacuacgaccccacagaagaaauacccgcaccccuuggagcgcccgacuucgucggcaaaauacgcgguaugcucacccaaaccacccgacgagacggcucaacccgcggacaccgagcaacccucagcaccggauccgcccacuucacccccaaacucggcuccauccgauucucaaccgacaccaauaacgacuucgaagccggccaaaacacaaaauucaccccagucggagucuuccaggaaggcgacaaccaccaaaacgaaccccaacaauggguccuccccaacuacuccggcgccacugcccacaacguccaucucgcccccgcuguagcaccagccuuccccggcgaacaacuccuuuucuuccgcucaacaaugcccggaugcggcggcuaccccaacaugaaccucgacugccuccuaccccaggaauggguucaacacuucuaccaagaagccgcuccugcacaauccgaugucgcccuacuucgauucgucaauccagacacaucacgcguccucuucgaaugcaaacuccacaaaucuggcuacgucacagucgcacacaccggccagcacgaccucgucaucccgcccaacggcuauuuccgcuuugacucaugggucaaccaauucuacacacucgccccaaugggaaacggcaccggccgccgacgauag

SEQ ID NO: 39094 - RNA, 1614 nt, Artificial Sequence
  derived and/or modified sequence opt11 from VP1__Norovirus_and/or_Norovirus-like__JQ478407
augaaaauggccucaaacgacgcauccccauccgacggcucuaccgcaaaccuuguaccagaagucaacaacgaagucauggcucucgaacccguaguuggagccgccauagcagcacccguagccggccaacaaaacguaaucgaccccuggauccgcaacaacuuuguccaagcgcccggcggagaauuuacagucucuccccgcaacgcacccggcgaaauccuuugguccgcgccccucggccccgaccucaacccauaccuaucccaccucgcccgcauguacaacggcuacgccggaggauucgaaguccaagucauucucgccggcaacgccuucaccgccgguaaaaucaucuucgccgccgucccacccaacuuccccaccgaaggccuaucccccucucaagucaccauguucccccacaucaucguagacguccgacaacuagaacccguccucaucccacucccagacguacgcaacaacuuuuaccacuacaaccaaagcaacgauucaacuaucaaacuaaucgccaugcuuuacaccccacuccgcgcgaacaacgcaggcgacgacgucuucaccgucuccugccgcguccuaacucgcccaucgccagacuucgacuucaucuuccuaguacccccaaccgucgaaucccgcacaaaacccuucacggucccaauccucacugucgaagaaaugucuaacagccgguuccccauaccacuagaaaaacuauacacaggcccaagcagcgcauucgucguccagccccaaaacggucgcugcacaaccgacggcguccuacucggcaccacacagcuauccgccgucaacauaugcaccuuccgcggagacaucacacacauugcaggcucacacgauuacacaaugaaccuugcaucacaaaacugguccaauuacgaucccaccgaagaaauccccgcaccccucggaaccccagacuucgucgguaaaauccaagguaugcucacccaaaccaccagggaagacggcuccacccgcgcccauaaagcaaccgucucaaccgguucuguacacuucacaccaaaacucggcuccguacaauacaccaccgauacaaacaacgacuuccaaaccggccaaaacacaaaauucaccccagucgguguuauacaagacggaggcaaccaccaaaacgaaccccagcaauggguccuccccaacuacuccggccgcacaggucacaauguacaccucgccccagcagucgcccccaccuucccaggagaacaacuccuauucuuccguuccaccaugcccgguugcuccggcuaccccaacaugaaccucgacugccuacucccccaggaauggguccaacacuucuaccaagaagcagccccugcccaauccgacgucgcccuccuccgauucgucaaccccgacacaggccgaguccuauucgaaugcaaacuccacaaauccgguuacgucaccgucgcccacaccggcccccacgaucuagucaucccacccaacggcuauuuccgcuucgacuccuggguaaaccaauuuuacacccuagcccccaugggaaacggcgccggccgacgccguuaa

SEQ ID NO: 39095 - RNA, 1614 nt, Artificial Sequence
  derived and/or modified sequence opt11 from VP1__Norovirus_and/or_Norovirus-like__AB303923
augaaaauggcaucuaaugacgccaaccccuccgacggcuccacagccaaccucgucccugaaguaaauaaugaagucauggcacuagaacccgucgucggcgccgcaauugccgccccagucgccggccaacaaaacgucauagacccauggauccguaacaacuucguccaagcccccggcggugaguucaccgucuccccacguaacgcccccggugaaauccuuuggagugccccacuaggccccgaucuaaaccccuaccucucccaccucgcccgcauguacaacggauacgcaggaggcuucgaaguucaagucauccucgccggaaacgcauucacagcaggaaaaaucaucuucgccgcaguacccccuaacuuccccaccgaaggacugucacccucccaagucaccauguucccucacaucaucgucgacguccgccaacucgaaccuguccucauuccccuacccgacguccgaaacaacuucuaccacuauaaccaaucuaacgacucaaccaucaaacucaucgccaugcucuacacuccccuccgcgcuaauaaugccggcgacgacgucuucaccguaucuugccgcguccuaacccgacccucacccgacuucgacuucaucuuccuagucccacccaccgucgaaucccguaccaaaccauucacuguccccauacucaccgucgaagaaauguccaauucccgcuucccaaucccccuggaaaaacucuacacgggccccuccuccgcuuucgucguacaaccacaaaacggccgcuguacaacagacgguguccuacuaggcacaacccagcuaucagccgucaacaucugcacauuccgcggcgacgucacccacaucgccggcucucacgacuacaccaugaaccucgccucccaaaacuggaacaacuacgacccaacugaagaaauaccagcuccccucggaacccccgacuucgucggcaaaauccaaggcaugcuuacccaaaccacccgagaagacggcuccacccgcgcacacaaagcaaccgucagcacaggcuccguacacuucacccccaagcuaggauccguacaauacacuaccgacaccaacaacgacuuccaaaccggacaaaacacaaaauucacccccguuggcgucauccaagacggcaacaaccaucaaaacgaaccacaacaauggguccuccccaacuacuccggccgaaccggccacaacguccaccucgcaccagccgucgcacccaccuucccaggcgaacaacuccuauucuuccgaucaaccaugcccggcugcucaggauacccaaacaugaaccucgacugucuccucccccaagaauggguccaacacuucuaccaagaagccgccccugcccaaucugacgucgcccuacuucgcuucgucaaccccgauaccggccgaguccucuucgaaugcaaacuccacaaauccggcuacgucacaguagcccacaccgguccccacgaccucguaaucccucccaauggcuacuuccgcuucgacuccuggguaaaccaauucuacacccuagcacccaugggcaacggugccggaagacgccgauaa

SEQ ID NO: 39096 - RNA, 1614 nt, Artificial Sequence
  derived and/or modified sequence opt11 from VP1__Norovirus_and/or_Norovirus-like__AF427120
augaaaauggccuccaacgacgccaaccccuccgauggcucaacagccaaccuaguccccgaagucaacaacgaaguaauggcacuugagcccgucguaggagccgccaucgccgccccagucgccggccaacaaaacgucaucgaccccuggauacgcaacaacuucguucaagcccccggcggcgaguucaccguaucucccagaaacgccccaggagaaauccucugguccgcaccacucggcccugaccucaacccauaccuaucucaccucgcccgcauguacaacggcuacgccggcggcuucgaaguccagguuauucuagcaggcaaugccuucacagccggcaaaaucaucuucgccgcagucccacccaacuuccccacugaaggacuaucaccaagccaagucaccauguucccacacaucaucgucgauguucgccaacuagaaccaguccuaauaccucuacccgacguccgaaacaacuucuaccacuacaaccaaucuaacgacuccaccauaaaacucaucgccauguuauacacaccccuacgagccaacaacgccggcgacgacgucuucaccguaagcugucgaguccucacacgcccaucccccgacuucgacuucaucuuccucguaccaccaacaguagaaucucgaaccaaaccuuuuaccguccccauccuaaccgucgaagaaauguccaauucuagauuccccauuccccucgagaaacuuuacacuggccccuccucagccuucauuguacaaccccaaaacggaagaugcacaaccgauggaguacuacuagguaccacccaacucuccgccguaaacaucugcacauuccgcggcgacgucacccacaucgccggcucccacgacuauacgaugaaccucgccucccaaaacuggaauaacuacgaccccaccgaagaaaucccagcaccccuaggcacacccgacuucgucggaaaaauacaagguauguugacucaaaccacccgcgaagacggcucuacccgcgcccacaaagccaccgucucaacuggcuccguccacuucacucccaaacuaggaucagugcaauacaccaccgacaccaacaacgacuuccaaacaggucaaaacaccaaauucaccccaguaggcgucauccaagacggcaauaaccaccaaaacgaaccccaacaguggguacuccccaauuauuccggccgcaccggacacaacguucaccucgcccccgccguagccccaaccuucccuggcgaacaacuccuuuucuucagauccacaaugcccgguugcucagguuacccaaacaugaaccucgauugccuccucccucaagaauggguucaacauuucuaccaagaagccgcacccgcgcaauccgacguagcccuccuccgcuucgucaaucccgacaccggccgaguacucuucgaaugcaaacuccauaaauccggcuacguuacagucgcacacacaggaccgcacgaccucguaaucccacccaacggauacuuccgauucgacuccugggucaaccaauuuuacacccucgcccccaugggcaauggcgccggccgccgccgauga

SEQ ID NO: 39097 - RNA, 1614 nt, Artificial Sequence
  derived and/or modified sequence opt11 from VP1__Norovirus_and/or_Norovirus-like__AY532134
augaaaauggcaagcaacgacgcgaaccccucagacggcagcacagccaaccucgucccagaagugaacaacgaagucauggcacucgaacccguagucggagcugcuauagccgcccccguagccggccaacaaaacaucaucgaucccuggauacgcaacaacuucguccaagcccccggaggagaauuuaccgucagcccccgaaacgcccccggcgaaauucucugguccgcuccccuaggcccagaccucaaccccuaccucucccaccuagcccgcauguacaacggcuacgccggaggauucgaaguccaagucauccucgccggcaacgccuucacagccggcaagaucaucuucgcagccgucccacccaacuuccccacagaaggcuuaucccccucacaagucaccauguucccccacaucaucgucgacguacgacagcuagaacccguccucauaccccuccccgacguccgaaacaacuucuaccacuauaaccaaucaaacgacuccacaaucaaacuuaucgccaugcucuacacaccccuacgcgcuaacaacgccggagacgacgucuucaccguaucaugcagaguccucacucgacccuccccagacuucgacuucaucuuccuagucccacccaccguagaaucccgcaucaaaccauucaccguaccaauccucacaguagaagaaauguccaacucucgcuuccccaucccccucgaaaaacuauacacaggccccucgucagcauucgucguccaaccucaaaacggccgcugcacaaccgacggaguccuacuugguacaacucaacucucggccgucaacaucugcaccuuccgaggcgacgucacccacauugcaggcucacacgacuacaccaugaaccuagccucccaaaacuggaacaauuacgaccccaccgaagaaaucccugcuccacuaggcacccccgauuucgucggcaaaauccaaggcguccuuacucaaacgacccgcgaagacggcucaacccgagcccacaaagccaccgucucuacaggaucaguacacuuuacaccaaaacucggcuccguccaauacacaaccgacaccaacaacgacuuccaaacaggccaaaacaccaaauucacccccgucggcgucauacaagauggaaacaaccaccagaacgaaccccaacaauggguccuccccaacuacuccggacgcgccggacacaacguccaccuugcaccagccgucgcuccaaccuucccuggcgaacaacuccuuuucuuccgaucaacaaugccagguugcuccgguuacccgaacaugaacuuagacugcuuacucccccaagaauggguucaacacuucuaccaagaagccgcuccagcccaaagcgacguagcccuacuaagauucgucaacccagacacaggccgaguacuauucgaaugcaaacuacacaaauccggguacguaacaguagcccacacaggaccccacgaccucguuaucccaccaaacggcuacuuccgauucgauuccugggucaaccaguucuacgcccucgcuccaaugggaaauggugccggccgccgucgguag

SEQ ID NO: 39098 - RNA, 1614 nt, Artificial Sequence
  derived and/or modified sequence opt11 from VP1__Norovirus_and/or_Norovirus-like__AY532116
augaagauggcguccaacgacgccaaccccagcgacggcuccacagccaaccucgucccagaaguaaauaacgaaguaauggcccuagaaccggucgucggcgcagcaauagcaacgcccgucgcgggucaacaaaacgucauagacccauggauacgaaacaacuucguccaagcucccggcggagaguucaccguauccccacgcaacgccccaggcgaaauacucugguccgccccacuaggacccgaccuaaaccccuaccucucacaccuagcccggauguacaacggcuacgccggcggcuuugaaguacaagugauccucgccggcaacgccuucaccgccggcaaaaucaucuucgccgccguaccucccaauuucccaaccgagggccuauccccaagccaaguuaccauguucccucacaucauagucgacguccggcaacuagaaccaguccuaaucccccuaccugacguccgcaacaacuucuaccacuacaaccaaucaaacgacuccacaaucaaacuuaucgcaaugcucuacaccccacuacgcgccaacaacgcaggcgacgacgucuucaccgucuccugcagaguacucacacgcccuucaccugacuucgacuucaucuuccucgucccacccacagucgaaucacggacaaagcccuucacuguacccauccucaccguagaagagauguccaacucccgcuuccccaucccccucgaaaaacucuacaccggcccaucuucugccuucgucguccaaccccaaaacggccgaugcaccacagauggcguacucuuagggaccacacaacuuagcgccgucaacaucugcaccuuccgaggcgacgucacacacaucgccggaucccacgacuacacaaugaacuuagccucccaaaacuggaacaacuacgacccuaccgaagaaaucccagcaccccucggcacccccgacuucguaggcaaaauccaaggcaugcuaacccaaacaacucgagaagacggaucuacccgcgcccacaaagccacaguguccaccggaucaguacacuuuacccccaagcucggcucuguccaauauacaaccgacacuaacaacgacuuccagacaggacaaaacacaaaauucacacccgucggaguaauccaagacggcaacaaucaccaaaacgaaccacaacaauggguacuacccaacuacuccggcagaacaggccacaacguccaccuagcccccgccguagccccaacauuuccuggcgaacaacuccucuucuuccgauccaccaugcccggcuguucaggcuaccccaacaugaaucuggacugccuccucccccaagaguggguacaacacuuuuaccaagaagccgcacccgcucaauccgacguagcacuacuccgcuucgucaaccccgacacaggccgcguccucuucgaaugcaaacuccacaaaucgggcuacgucaccgucgcccacaccggaccccaugaccucgucaucccacccaacggauacuucagguucgacuccugggucaaccaauucuacaccuuagcccccaugggaaacggcgccggccgccgccgcuga

SEQ ID NO: 39099 - RNA, 1614 nt, Artificial Sequence
  derived and/or modified sequence opt11 from VP1__Norovirus_and/or_Norovirus-like__AY532112
augaaaauggccuccaacgacgcuaacccaucugacggcuccacagcaaaccucguacccgaaguuaacaacgaagucauggccuuagaacccgucgucggagcagccaucgccgcaccagucgccggccaacaaaacaucaucgaccccuggauacgcaacaacuucguacaagcaccaggaggcgaguucaccgucuccccgcgaaacgcccccggcgaaauccuauggucagccccacuaggacccgaucucaacccauaccuaucccaccuagcccgaauguacaacggcuacgccggagguuucgaaguccaaguaauccuagccgguaacgccuucacugccgguaaaaucaucuucgcagccgucccacccaacuuccccaccgaaggccucucucccucucaaguaaccauguucccccacauaauagucgacguccgacaacucgaaccaguccucauaccccucccugacguccgcaauaacuucuaccacuacaaccaauccaacgacuccacuaucaaacucaucgccaugcucuacacacccuuacgggcgaacaacgccggcgacgacguauucacaguauccugccgaguccucacccgcccaucccccgacuucgacuucauuuuccucgucccacccaccgucgaaucaaggaccaaacccuucaccgcgcccauacuaacugucgaagaaaugucaaacucccgcuucccuaucccccucgaaaaacuauacaccggucccuccuccgccuucgucguccaaccccagaacggccgcugcaccaccgacggcguacuacucggcaccacccaacucucagccguaaacauuugcacauuccgaggagacgucacucacaucgcaggaucccacgacuauaccaugaaccucgcgagccaaaacuggaacaacuacgaccccaccgaagaaauuccagcaccccucggaacccccgauuucgucggcaaaauacaaggaauguugacccaaaccacucgagaagacggcuccacccgcgcccacaaagccaccguauccaccggcucaguccacuucaccccaaaacuaggauccguacaauacaccaccgacacgaacaaugacuuccaaacaggccaaaacacaaaauucacucccguuggugucauccaagacggcaauaaccaccaaaacgaaccccaacaguggguucucccaaacuacuccggacgaaccggccacaacguucaccucgcccccgcaguagcccccaccuucccaggcgaacaacuacucuucuuucgcucaacaaugcccggcugcuccggcuaccccaacaugaaccucgacugccuccucccccaagaauggguccaacacuucuaccaagaagcagcacccgcccaaucagacgucgcccuccuacgauucguaaacccagacaccggacguguauuauucgaaugcaaacuccacaaauccgguuacguuaccguagcucacacaggaccccacgaccucgucaucccacccaacggcuacuuccgauucgacuccugggucaaccaauucuacacccucgcacccaugggcaacggcgcaggacgcagacgauaa

SEQ ID NO: 39100 - RNA, 1614 nt, Artificial Sequence
  derived and/or modified sequence opt11 from VP1__Norovirus_and/or_Norovirus-like__KX514275
augaaaauggccucaaacgacgccaauccauccgacggcucugcagcaaaccuuguacccgaagucaacaacgaagucauggcuuuagaaccaguagucggagccgccauagccgccccuguagcuggacaacagaacgucaucgaccccuggauccgaaacaacuucguccaggcccccggcggcgaguucaccgucucccccagaaacgcacccggggaaauccuaugguccgcaccccucggaccagaccucaaccccuaccucucacacuuagcgcguauguacaacggauacgcaggcggcuucgaaguccaaguaauccucgccggcaacgccuucaccgcuggcaaaaucaucuucgccgcagucccacccaacuuccccacagaaggccuaucccccucccaagucaccauguucccacacaucauugucgacguccgccaacucgaacccguccucauaccacuacccgauguccgcaauaacuucuaccacuauaaccaaucgaaugacuccaccauuaaacucaucgccaugcucuacacgccccuccgagcuaacaacgcaggcgacgaugucuucaccgucucuugcagaguccucacccgaccuuccccagacuucgacuucaucuuccucguuccacccacaguagaaucccgcacaaaacccuucucuguccccauacuaaccguaggcgaaaugacaaacucccgcuuccccaucaaccucgaacgccuuuucaccggccccuccuccgcaaacgucguccaaccccaaaacggccgcugcaccaucgacggcgaacuccucggcacuacacagcuuuccuccgucaacauaugcaccuuccguggagacgucacccacauuggcucaacucaccacuggacaaugaaccuagccucccccaacuggaacaacuacgaccccaccgaagaaacccccgcaccacuaggcacccccgacuuuguaggcaaaauccacggcaugcuaacccaaaccacccaggaaaacggcuccacccgagcacaccgagccaccgucuacguaggcuccgccgauuuuacacccaaacuagguaaaguccaauucgaaaccgacacagaagacgaucucgccauccgacaaaauaccaaauucacaccaguaggagucauacaauccuccgaucaccaccgcgacgaaccccaacaguggcgacuccccaacuacucaggugccaacaccuucaacguccaccucgcccccgcaguugccccaaacuucccaggcgaacaacugcuuuucuuccgcucaacauuaccaggcugcggcggacacccaaacauggaccuagacugccuccuuccccaagaauggguacagcacuucuaccaagaagcagccccugcacaaucagacgucgcccuccuccgcuucgucaacccagacaccagccgaguucucuucgaauguaaacuccacaaauccggcuacgucaccgucgcccacaccggacaauaugaccucguccuacccuccaacggcuacuucagauucgacuccugggucaaccaauucuacacccuugcccccaugggaaacggcacaggccgccgacgauaa

SEQ ID NO: 39101 - RNA, 1614 nt, Artificial Sequence
  derived and/or modified sequence opt11 from VP1__Norovirus_and/or_Norovirus-like__KF806510
augaaaauggcuucaaacgacgccagccccagcgacggaucggccgcaaaccucguucccgaagucaacaacgaagucauggcacucgaacccgucgucggcgccgcaaucgcagcccccgucgcgggccaacaaaacgugauagacccauggauccgaaacaauuucguccaagcaccuggcggugaguucacgguaucuccccgcaacgcccccggagaaauccuaugguccgcaccccucggccccgaccucaaucccuaccucucacaccucgcacgcauguacaacggauacgcaggcggauucgaaguacaagucauccucgcaggaaacgccuuuacagcaggaaaaaucaucuucgccgcaguacccccuaacuuccccaccgaaggccucucccccucucaagucaccauguucccccacauagucgucgacgucagacaauuagaacccguucucaucccccuccccgacguacggaacaacuuuuaccacuacaaccaauccaaagaccccacgaucaaauuaaucgccaugcucuacacaccccuaagagcaaacaacgccggcgaggacgucuucacagucaguugccgcguccuaacccgacccucccccgacuucgacuucaucuuccucgucccuccaacagucgaaucacgauccaaacccuucaccguaccuauccucaccguagaagaaaugaccaacucccguuuccccaucccccucgaaaaacucuucaccggccccuccggcgccuucgucguccaaccacagaacggaagaugcaccaccgacggcguccuccuaggcaccacacaacuaucccccgucaauaucugcaccuuccgcggcgaccucacccauuucaccggcaccagcgaauacgccaugaaccucgcaucccaaaacuggaacaacuacgacccaaccgaagaaauccccgccccacucggagccccugacuucguaggaaaaauacgcggcaugcuaacccaaacaacaagacgggacggcuccacccgcggccaccgcgcuacucucuccaccggcuccgcccacuucacucccaaacucggaaacauccguuuuucaacagauacaaacaacgacuucgaagccggacaaaacaccaaauucacaccagucggcgucuuccaagaaggcgacaaccaccaaaacgagccacaacaauggguccuacccaacuacuccggagcaacagcacacaauguacaccucgcucccgccguagccccugccuuccccggcgaacagcuccucuucuuccgauccaccaugccaggaugcggcggauaccccaacaugaacuuagacugccuauuaccucaagaauggguccaacacuucuaccaagaagcggcgcccgcacaauccgaugucgcacuacucagauucgucaaccccgacaccucccgaguacucuucgaauguaaacuccacaaauccggcuacgucacaguagcacacaccggccaacacgaccuaguaauaccaccgaacggcuauuuccgcuucgacucuuggguaaaccaauucuacacacucgcacccaugggcaauggaaccggacgccgccgauaa

SEQ ID NO: 39102 - RNA, 1614 nt, Artificial Sequence
  derived and/or modified sequence opt11 from VP1__Norovirus_and/or_Norovirus-like__EU078410
augaaaauggccuccucagacgccaauccaucagacggcagcaccgcaaaccucguaccugaagucaacaaugaaguuauggcccucgaacccgucguaggcgccgcaaucgcagcaccuguagccggccaacaaaacgucaucgauccauggauucguaacaacuucguccaagcccccggaggcgaauuuacugucucccccagaaacgccccuggcgaaauccucuggucugcaccccucgguccagaccuaaaccccuaccuaucacaccucgcacgaauguacaacggauacgccggcggcuucgaaguacaaaccauccucgccggaaaugcauucaccgccggcaaaauaaucuucgccgccguucccccuaacuuccccacagaaggucuuuccccaagccaagucacaauguucccccacaucaucgucgacguaagacaacuagaacccguacucauaccccuacccgacguccgcaauaacuuuuaccacuacaaccaaucaaacgaccccacaaucaaacuaaucgcaaugcuuuacacaccccuccgcgcaaacaaugccggagacgacgucuucaccgucuccugccgaguccucacucgacccucacccgacuucgacuucauauuccugguaccacccaccguugaaucccgaaccaagcccuucacagucccaauucugaccguugaagaaauguccaacucccgauuccccaucccucuagaaaaacucuacacaggacccucaucagcauuugucguccaaccccagaacggccgcugcaccacagacgguguccuccuugguaccacccaacucuccgccgucaacaucugcaccuuccguggagacguaacucauaucgcaggaagccacgacuacacaaugaaccuagcaucacaaaacuggaacaauuacgaccccaccgaagaaauccccgcaccccucggaacucccgacuucguagguaaaauacaaggcaugcucacccaaaccacacgcgaagacggcuccacacgcgcccacaaggccacugucuccaccggcagcguacacuucacaccaaaacuaggcucuguccaauacaccaccgacaccaacaacgacuuccaagccggacaaaacaccaaauucaccccagucggcgucauacaagacggcaacaaccaucaaaaugaaccgcaacaguggguacuccccaacuacuccggacgcaccggucauaacguacaccucgccccagccguagcccccaccuuccccggagaacaacuacuauucuuccgcucaaccaugccaggcugcuccggcuaucccaacaugaaccuagacugccuccucccccaagaauggguccaacauuucuaccaagaagccgccccugcgcaaucugacgucgcccuacuacguuucguaaacccagacaccggacgaguccuuuucgaaugcaaacuccacaaauccggauacgucacagucgcacacaccggaccccacgaccuugucauucccccaaacgguuacuuccgauuugauuccugggucaaccaauuuuauaccuuagccccaaugggcaacggaaccggccgccgcagauaa

SEQ ID NO: 39103 - RNA, 1614 nt, Artificial Sequence
  derived and/or modified sequence opt11 from VP1__Norovirus_and/or_Norovirus-like__AF427123
augaaaauggccagcaacgacgcaaaccccucagauggcucuaccgcaaaccucguccccgaagugaacaacgaagucauggcccucgaacccgucgucggcgccgccauagccgccccagucgccggccaacaaaacgucaucgaccccuggaucagaaauaacuucguacaagcgccaggcggagaguucaccgucagcccacgcaacgcccccggagaaauccucugguccgcaccccuaggccccgaccuaaaccccuaccuaucacaccuagcacgaauguacaacggauaugcgggcggcuucgaaguccaagucauacucgccggcaacgccuucacagccggcaagaucauauucgccgccgucccacccaacuuccccacagaaggccugucccccucccaagucacaauguucccccacaucauagucgacguaagacaacucgaacccguccuaauuccccuacccgacguacgcaacaacuucuaccacuacaaccaaagcaacgauucaacaaucaaacuaauagccaugcucuacacaccccucagagccaacaacgccggagacgacguauucaccgucucaugccgcguccucacccgcccaucacccgacuucgacuucaucuuccucguaccacccaccguagaaucccgaaccaaacccuucaccgucccgauccuaacaguagaagaaaugaguaacucucgauucccuaucccccuagaaaaacuauacacaggacccucaagcgcauucguaguacaaccacaaaacggccgcugcaccaccgauggcguauuacucggcacaacacaacuuuccgccgucaacaucugcaccuuccgaggcgacgucacacacaucgcuggaucccacgacuacaccaugaaccuagcaucucaaaacuggaacaacuacgaccccacagaagaaauccccgcaccccucggaacccccgacuucgucgguaagauucaaggcguccuaacccaaaccacccgagaagacggcuccacccgagcccacaaagccaccgucucaacaggaucuguacacuuuacccccaaacuaggcuccguacaauacacaaccgacacaaacaacaauuuccaaacaggccaaaauacaaaauucacucccgucggcgucauccaggacggcaauaaccaccagaacgaaccccaacaauggguccugccaaacuacuccggucgcacaggccacaauguccaucucgccccugccgucgcccccaccuuccccggcgaacaacucuuauucuuccgcuccacaaugccaggaugcucaggauaucccaacaugaaccuagacugccuccuaccccaggaauggguccaacacuucuaccaagaggccgccccagcccaauccgacguagcccuucuccgauucgucaacccagacaccggacguguccuauucgaaugcaaacuucacaaauccggauaugucaccguagcacacacaggaccccacgaccucgucauaccacccaacggcuacuuuagauucgacucuugggucaaccaauucuacacccucgcccccaugggcaacggcgccggacgccgccgcuaa

SEQ ID NO: 39104 - RNA, 1614 nt, Artificial Sequence
  derived and/or modified sequence opt11 from VP1__Norovirus_and/or_Norovirus-like__AY532135
augaaaauggcuagcaacgacgccaacccaccggacggcucgacagcgaaccuaguacccgaggucaacaacgaaguaauggcacuagaacccguugucggugccgcaauagcugccccaguagccggccaacaaaacaucauagacccauggauacgcaacaacuucguccaagcuccgggcggagaguucacaguaucaccccgaaaugcucccggcgaaauacuuugguccgcuccccucggucccgaccuaaaccccuaccuuucacaucucgccagaauguauaacggauacgccggagguuuugaaguccaagucauccucgccggaaacgccuucacagcuggaaaaauaauuuucgcagccguaccaccuaacuuccccaccgaaggccuaucgcccucccaagucacaauguucccccacauaaucgucgacgugcgccagcucgaaccaguccucaucccacucccugacguccgcaacaauuucuaccacuacaaccaauccaaugacucaacaaucaaacuaaucgcaaugcuauacacaccccuccgcgccaacaacgcaggagacgacguauucaccguaagcugccgcguccuaacccgcccaucacccgauuucgacuucaucuuccuugucccaccuaccguagaaucccgaacaaaacccuucaccguucccauccucacugucgaagaaaugagcaacucucgauuccccaucccccuugaaaagcucuacaccggccccucauccgcauucgucguucaaccccaaaacggacggugcacaaccgacggcguccuccuaggcaccacacagcucuccgcagucaacauaugcaccuuccgcggggacgucacucacauagccggcagccaugacuacacaaugaaccucgccagccaaaacuggaacaacuacgacccaacagaagagaucccagcaccccucggcacccccgacuucgucggaaaaauccaaggaguccuaacccagaccacccgagaagacggcagcacccgcgcccacaaagccaccguaucuacaggcuccguccacuucacaccaaaacuaggcuccguccaauacacaaccgacaccaauaacgacuuccaaacaggacaaaauaccaaauucacccccgucggcgucauccaagauggcaacaaccaccaaaacgaaccccaacaauggguacucccaaauuacucaggccggaccggccacaacguccaucucgccccagccguagcccccaccuuccccggcgaacaacuccucuucuuccgaucaaccaugccuggauguucaggcuaccccaacaugaaccucgacugccuacucccccaagaguggguccaacacuucuaccaagaagccgccccugcccagucugacgucgcacuccuacgcuucguaaacccagacaccggacgcguacucuucgaaugcaaacuccacaaaagcggcuacguuaccguugcccacaccggcccacacgaccuugucauaccucccaacggcuacuucagauucgacucaugggucaaccaauucuacacccucgcccccaugggcaacggagcaggccgccgccgcuaa

SEQ ID NO: 39105 - RNA, 1614 nt, Artificial Sequence
  derived and/or modified sequence opt11 from VP1__Norovirus_and/or_Norovirus-like__AY532125
augaaaauggccucaaacgaugcaaaucccuccgacggcuccaccgcaaaccucgucccagaagucaacaacgaagucauggcccucgaacccguagucggugcagccaucgccgccccagucgccggccaacagaacguaaucgacccauggauacgcaacaacuucguccaagcccccggcggugaguucaccgucucaccccgcaacgcccccggcgaaauacuaugguccgccccacucggccccgaccucaacccuuaccuaucccaccucgcccggauguacaacggcuacgcaggagguuucgaaguccaaguuauacucgccggcaacgccuucacugccggaaaaguaaucuucgccgccguucccccgaacuuccccacagaaggccucuccccaagccaagucaccauguuuccccacauaauagucgacguccgacagcuagaacccguccuaauaccccucccagacgucagaaacaacuucuaccacuacaaccaauccaacgacuccaccauuaagcucaucgccaugcuauacacuccccuccgcgccaacaacgcgggcgacgacgucuucaccguaagcugccgagucuuaacccgcccaucccccgauuucgauuucauauuccucgucccacccaccgucgagucacguaccaaaccauucacaguccccauccucacaguagaagagauguccaacucacgcuuccccauaccccuagaaaaauuauacacuggaccaaguuccgcuuucguaguucaaccccaaaacggccgcugcacaacagacgggguccuacuuggcaccacccaacucagcgccgucaauaucugcaccuuccgaggcgacgucacacacaucgccggcucacacgacuacaccaugaaccuagccucccaaaacuggaacaauuacgaccccacagaagaaauacccgccccacugggcacucccgacuuuguaggcaagauccaaggcaugcucacacagaccacccgcgaagacggcucaacaagagcucacaaagccacaguaucaacaggcuccguacacuucacgccaaaacucggcucaguccaauacacaacugacacaaacaacgacuuucaaacaggacaaaacacaaaauucacccccgucggagucauacaagacggaaacaaccaccaaaacgaaccccaacaauggguacucccaaacuacuccggacggacuggccauaacguccaccuagcuccugccgucgcccccacauuccccggcgaacagcuacucuucuuccgcucaaccaugcccgguugcuccggcuaccccaacaugaaucuagacugccuccucccccaagaauggguacaacacuucuaccaagaagccgcccccgcccaaucagacgucgcccuccuacgauucguaaacccagacacgggccgcguccucuucgaaugcaagcuccacaaauccggcuacgucacugucgcccacacgggaccucaugaccucgucaucccgcccaacggauacuuccguuucgacuccugggucaaccaauucuacacacucgcccccaugggcaacggcgccggccgccgucgcuaa

SEQ ID NO: 39106 - RNA, 1614 nt, Artificial Sequence
  derived and/or modified sequence opt11 from VP1__Norovirus_and/or_Norovirus-like__AJ277619
augaaaauggccuccaacgacgcaaaccccuccgacggguccaccgccaaccucguccccgaaguaaacaacgaggucauggcacucgaaccagucgucggcgcagccaucgccgcccccguagccggccaacaaaacgucauagacccauggaucagauccaauuucguccaagcacccggaggagaguucaccgucucaccccgcaacgccccaggcgaaauccucugguccgcaccccucggcccggaccucaacccauaccuaucccaccuagcacgcauguacaacggcuacgccggcggccuagaaguacaaguuguccucgccggcaaugcauucacagccggaaaaaucaucuucgccgccguacccccaaacuuucccacugaaggccucuccccaucacaaguaacaauguucccccacaucaucguagacguccgccaacuagaacccguccuaauaccacucccagacguucgcaacaauuucuaccacuacaaccaaucaaacgacuccacaauaaaacucaucgcuaugcucuacacaccccuucgagccaacgacgcuggagacgacgucuucaccgucuccugccgaguccucacccgccccucuccagacuucgacuucauauuccucguacccccuacagucgaaucccguaccaagcccuucacagucccaauccuaaccgucgaagaaauguccaacucccgcuucccaaucccccuugaaaaauuauacaccggaccauccuccgccuucgucguccaaccccaaaacggccgcugcacuaccgacggaguacuacucggaacaacucaacucuccgccgucaauauaugcacauuccgaggcgacgucacccacauagcuggcucacacgacuacaccaugaacuuagccagucaaaauuggaacaacuacgacccaaccgaagaaaucccugcaccccucggaaccccugauuucgucggcaaaauccaaggcaugcucucccagaccacccgcggcgacgacuccacccgcgcccacaaagccaccgucagcacgggcuccguacacuucaccccaaaacucggcuccguccaauacaccaccgacaccaauaacgauuucgaaaccggucaaaacaccaaauuuacccccguaggagucauacaagacgguaacaaccaccaaaacgaaccccaacaauggguccuccccaacuacuccggccgcaccggccacaauguacaccuagccccugcagucgcaccaacauucccaggcgagcaauuacucuucuuccgcucuacaaugcccggcugcagcgguuacccaaacaugaaccuagacugccuccucccacaagaauggguccaacacuuuuaccaagaagcagcaccagcccaauccgacguugcccuacuccgcuucgucaaccccgacacuggacgaguccucuucgaaugcaaacuacacaaauccggauauguaacagucgcccacacuggcccccacgaccuagucaucccacccaacggauacuuccgcuucgacucuuggguuaaucaacucuacacccucgcccccaugggcaacggagccggccgucggcgguaa

SEQ ID NO: 39107 - RNA, 1614 nt, Artificial Sequence
  derived and/or modified sequence opt11 from VP1__Norovirus_and/or_Norovirus-like__AF080556
augaaaauggccucaaacgacgccaaccccuccgacggcagcaccgccaaccucguccccgaagucaacaacgaggucauggcacuagaacccgucguaggagccgcaaucgccgcuccagucgcaggccaacaaaacgucaucgaccccuggaucagaaacaauuucguccaagcaccuggaggagaguucacaguuucaccccguaacgcccccggcgaaauccucugguccgcaccccucggacccgaccuaaaccccuaccuaucccaccucgcccgcauguacaacggcuacgcaggcggcuucgaaguacaaguuauacucgcaggcaaugccuucacagcaggcaaaauaauauucgccgccguaccgcccaacuuccccaccgaaggccucucccccucccaagucaccauguucccgcacaucaucgucgacguccgccaacucgaacccguccucaucccccuccccgacguccgcaacaacuucuaccauuacaaccaauccaacgacucaacaauaaaacucaucgcaaugcucuacaccccacuccgugcgaacaacgccggcgacgacgucuuuacagucuccugccgaguacuaacacgccccuccccugacuucgacuucauauuccuaguucccccaacagucgaauccagaaccaaaccauucaccguccccauacucaccgucgaagaaauguccaacucccgcuucccaauaccuuuagaaaaacucuauaccggacccucauccgccuucguuguacaaccccaaaacggccgcugcaccacagacggcguacuccucggaaccacccaacuaucugccguaaacauuuguacguuccgaggcgacgucacacacaucgccggaucacacgacuacacaaugaaucucgcuucccaaaacuggaacaacuacgauccuacagaagaaauacccgcaccccucggaacccccgacuucgucgguaaaauacaaggaaugcugacccagacaacacgagaagacggaucaaccagagcccacaaagccaccgucuccaccggauccguccacuucacccccaagcuaggcucuguucaauacaccaccgacaccaacaacgauuuccaagccggccaaaauaccaaauucaccccagucggcgucauccaagacggcaacaaccaccaaaacgaaccucaacaauggguccuacccaacuacuccggccgaaccggccacaacguccaccucgcccccgcagucgcucccaccuuccccggagaacaacuccuauucuuucgauccacgaugcccggaugcuccggcuaccccaacaugaaccucgacugccuucucccccaagaauggguccaacacuucuaucaagaagcugccccagcccaauccgacgucgcccuccuaagauucgucaaccccgacaccggccgcguccuuuucgaauguaaacuacauaaauccgguuacgucaccguugcccacaccggaccccacgaccucguaauuccacccaacgguuacuuccguuucgauuccugggucaaucaguucuacacacucgcucccaugggcaacggcgcaggacgccgucgcuaa

SEQ ID NO: 39108 - RNA, 1614 nt, Artificial Sequence
  derived and/or modified sequence opt11 from VP1__Norovirus_and/or_Norovirus-like__AF080550
augaaaauggccaguaacgacgcuaacccaucugacggaagcaccgccaaccucguucccgaaguaaacaacgaaguaauggcccucgaacccgucgucggugccgccauugccgcacccguagcaggacaacagaacgucaucgaccccuggauccgaaacaacuucguucaagcucccggcggcgaguucacaguaucaccccguaacgccccaggggaaauccuaugguccgcuccccucggcccagaucucaaccccuaccucucccaucuagcccgcauguacaacggauacgccggcggcuucgaaguacaagugauccucgccggcaacgccuucaccgccggcaaaaucauauucgccgcaguaccacccaacuuccccacagaaggcuuaucccccucacaagucaccauguuuccccacauaaucgucgauguccgccaacuagaacccguccucaucccacuccccgacguccgcaacaacuucuaccacuacaaucaauccuccgacuccaccaucaaacugaucgcaaugcucuacacaccccuccgcgccaacaacgccggcgacgacguauucaccguauccugccgcguccucacccgccccucucccgacuucgacuuuaucuuccuaguucccccaacggucgaaucccgaaccaaacccuuuaccgucccaauacuaaccgucgaagaaauguccaacucacguuuccccauuccccucgaaaaacucuacaccggacccuccuccgccuuugucguccaaccacaaaacggucgcugcacuaccgacggcguccuccugggcacaacacaacucucugccgucaacaucugcaccuuccgaggugacgucacccauaucgcaggaucccacgacuacaccaugaaccuggccucccaaaacuggaacaacuacgacccaaccgaggaaauucccgcaccccucggaacacccgacuucgucggaaaaauccaaggcaugcuaacccaaacaacacgcgaagacggcucaacccgcgcccacaaagccaccguuuccacaggcucuguacacuucacacccaaacucggcuccguccaauacaccaccgacacaaacaacgacuuccaaaccggacaaaacaccaaauucacccccgucggaguaauccaagacggcaacaaucaccaaaacgaaccccaacaauggguccucccuaacuacuccggccgcaccggccacaacguccaccucgccccugccguagccccaaccuucccaggcgaacaacuucucuucuuucgcucgaccaugcccggcugcuccggauaucccaacaugaaccucgauugccuacucccccaagaauggguacaacacuucuaccaagaagcugcaccagcacaauccgacguugcccuacuccgcuucguuaaccccgacaccggcaggguucucuucgaaugcaaacuacacaaauccggcuacguuaccgucgcccauaccggaccacacgaccuaguuaucccaccgaacggauacuuccgcuucgacucauggguaaaccaauucuacacucuugccccaaugggaaacggagcaggccgccgacgcuaa

SEQ ID NO: 39109 - RNA, 1614 nt, Artificial Sequence
  derived and/or modified sequence opt11 from VP1__Norovirus_and/or_Norovirus-like__EU078407
augaaaauggccucaaacgacgccaaccccagcgacggcuccaccgccaaccucguacccgaagucaacaacgaagucauggcccuagaacccgucgucggugccgccaucgcagccccagucgccggacagcaaaacguaauugacccauggauccgcaacaacuucguacaagcccccggcggagaguucaccgucucgccccggaacgcccccggcgaaauacucugguccgcaccccuaggaccagaccucaaccccuaucucucccaccucgcucguauguacaacggcuacgcaggcggcuucgaaguacaaguaauccucgcaggcaacgcauucaccgccggaaaaaucauuuucgccgccgucccacccaacuuucccacagaaggccucucccccucccaagucaccauguucccucacaucaucgucgacguacgacaacucgagcccguccuaaucccacugccagauguccguaacaauuucuaccauuauaaucaauccaacgacuccaccaucaaacuuauagccaugcucuacacaccccuccgcgccaacaacgccggugacgauguauucacagucucuugcagaguucucacacgcccuucccccgacuucgacuucaucuuucucguuccucccaccgucgaaucaagaaccaaacccuucaccguccccauccucacagucgaagaaauguccaacagccgcuuucccaucccccucgaaaaacuauacaccggaccuagcucugcauucgucguucaaccccaaaacggaagaugcaccaccgacggcguacuacuaggaacaacccaacuaucagcagucaacaucugcacauuccgaggcgacguaacccacaucgccggcucccacgauuacaccaugaaucucgccucccaaaacuggaacaacuaugacccaaccgaagaaaucccagcaccacucggcacucccgacuucguagguaaaauacaaggcauguuaacccaaaccacccgcggcgacggcucaacacgcgcccacaaagcaaccgucuccacaggcuccguccacuucacccccaaacucgguuccguccaauucaccaccgauacaaacaacgacuuucaaaccggacaaaacaccaaauucacccccgucggcgucauccaagacggcgacaaccaccaaaacgaaccccaacaauggguucucccaaacuauuccggacgaaccggccacaacguucaucucgcgcccgcaguggccccuaccuuccccggcgaacaacuccuuuucuuccgcuccaccaugccuggcugcuccggauaccccaauaugaaccuagacugccuccuuccacaagaguggguacaacacuuuuaccaagaagccgccccugcccaauccgacgucgcccuucuaagauuuguuaaccccgacacaggacgcguacucuucgaauguaaacuccauaaauccggauacguuacagucgcucacacuggcccccacgaccucgucauaccacccaacggcuacuuucguuucgacuccuggguaaaccaauucuacacccucgcucccaugggaaauggcaccggccgucgccgauaa

SEQ ID NO: 39110 - RNA, 1614 nt, Artificial Sequence
  derived and/or modified sequence opt11 from VP1__Norovirus_and/or_Norovirus-like__AB083781
augaaaauggccuccaacgacgccaaccccuccgauggaucuacugccaaccucguccccgaagucaauaacgaggucauggcacuagaacccgucgucggagccgcaaucgcagcaccagucgcuggccaacaaaacgucaucgaccccuggaucagaucaaauuuuguucaagcacccggcggcgaguucacugucucaccacgcaacgcccccggcgaaauccucugguccgcaccccucggcccugaccucaauccauaccuaucacaccucgccagaauguacaacggcuacgccggcggauucgaaguccaaguuauauuagccggaaacgccuucaccgccggcaaaaucaucuucgccgcgguaccacccaacuuccccacggagggacucucacccucucaaguaacaauguucccccacaucaucgucgacguccgacaacucgaaccuguccuaaucccccuacccgauguacgcaacaauuucuaccacuacaaccaauccaacgacucaacaaucaaacuaaucgcaaugcuuuacacaccccuccgcgccaacaacgccggcgacgacgucuucaccguuuccugccgcguccuuacacgaccaucucccgacuucgacuucaucuuccuagugcccccaaccgucgaauccagaacaaaaccauucacaguccccauacuaaccgucgaagagauguccaacucuagauuccccaucccucucgaaaaauuauauaccggccccuccuccgccuuuguaguccaaccucaaaacggucgcugcaccaccgacggcguccuacucggaacgacccaacuaucagccgucaacaucugcacccugcgaggcgacgucacccauaucgccggaucccacgacuacaccaugaaccuagccucccaaaacuggaacaacuacgaccccaccgaagaaauccccgcuccccucggcacccccgacuucgucggcaaaauccaaggaaugcucucacaaacaacacgcggugacggcagcacacgcgcccacaaagccacagucuccaccggauccguucacuucaccccaaaacucggcuccguccaauacaccaccgacaccaacaacgacuucgaaaccgggcaaaacaccaaauucacgcccguuggcgucauccaagacgguaacaaccaucaaaacgaaccccaacaauggguccuacccaacuacuccgggagaacaggccacaauguccaccucgccccugcugucgcccccaccuuccccggcgaacaacuccucuuuuuccgauccacaaugccaggcugcucaggcuaccccaacaugaaccucgauugccuacucccccaagaauggguacaacauuucuaccaagaagcagcacccgcccaaucagacguagcauuacuccgcuucgucaaccccgacacaggccguguccucuuugaaugcaaacuccacaaaucaggauacgucacagucgcccacaccggcccacacgaccucgucauacccccaaacggauacuuccgcuuugacuccuggguuaaucaauucuacacacuagcaccaaugggcaacggagccggccgccgccgcuaa

SEQ ID NO: 39111 - RNA, 1614 nt, Artificial Sequence
  derived and/or modified sequence opt11 from VP1__Norovirus_and/or_Norovirus-like__AF427122
augaaaauggccuccaacgacgccaaccccucugacggaucaaccgccaaccucguccccgaagucaacaacgaagucauggcccuugagccagucguaggcgccgccaucgccgccccaguagccggccagcagaacgucauagaccccuggaucagaaacaacuucguacaagccccaggaggcgaguucacuguauccccacgcaaugccccgggcgagauccuuugguccgcaccccuaggcccagaccucaaccccuaccucucccaccuagcccgcauguacaacggcuaugccggaggcuucgaaguccaagucauccucgccggcaacgccuucacagccggaaaaauaaucuucgcagccguaccaccaaacuuccccacagagggccuauccccaucacaagucaccauguucccccauauaaucgucgacguacgucaacucgaaccaguccuaaucccccucccugacguccgcaacaacuucuaucacuauaaccaauccaacgacucuaccaucaaacuaaucgccaugcucuacacaccccuacgugcgaacaacgccggcgacgacgucuucaccgucuccugccgaguacucacccgaccauccccugacuucgacuucauuuuccucgucccacccaccgucgaaucccgaaccaaacccuucacggucccaauuuuaaccgucgaagaaauguccaacucccgguuccccauaccccuugaaaaacucuacacaggcccauccucagcauucgucguacaaccacaaaacggaaggugcacaacagacggcguacuccucggcaccacccgacucuccgccgucaacaucugcacauucagaggcgacgucacacacaucgccggcucccgugacuacaccaugaaccuggccucacaaaacuggaacaacuacgacccuaccgaagaaauccccgcuccccucggcacccccgacuucgucggaaaaauccaaggaguccucacccaaacuacccgcgaagacggguccacccgagcccacaaagccaccguauccaccggcuccguccacuucacccccaaacucggcuccguccaauacaccacagacacaaacaacgacuuccagaccggacaaaacaccaaauucacccccgucggcguaauccaagacggcaacaaucaccaaaacgaaccacaacaauggguccuccccaauuacucgggccgcaccggccacaacguucaucucgcccccgccguagccccaacuuuccccggagaacaacugcuauuuuuccgauccacuaugcccggcugcagcggcuacccaaacaugaaccuagacugccuccuaccacaagaauggguccaacacuucuaucaagaagccgcccccgcccaaagcgacgucgcccuccuccgauucguaaaccccgacaccggacgaguacuauucgagugcaaacuccacaaauccggauacguaaccgucgcccacacgggcccacacgaccuagucaucccucccaauggcuacuuucgauucgacucaugggucaaccaauucuacacccucgcccccaugggcaacggaguaggccgccgccgcuaa

SEQ ID NO: 39112 - RNA, 1614 nt, Artificial Sequence
  derived and/or modified sequence opt11 from VP1__Norovirus_and/or_Norovirus-like__AY532133
augaaaauggccucaaacgacgccaacccauccgacggcucaaccgccaaccucguccccgaagucaacaacgaaguaauggcacucgaacccgucguaggcgccgccaucgcugcccccgucgccggccaacagaacguaaucgaccccuggauccggaacaacuucguacaagccccaggcggcgaguucaccgucucaccccgaaacgccccaggcgaaauacucugguccgcaccacucucccccgacuuaaaccccuaucuaucccaccuagcccgaauguacaacggcuacgcaggcggauucgaaguacaagucauucucgccggcaacgccuucacagcuggcaaaauaaucuucgccgcaguaccacccaauuuccccaccgaaggccuuagcccaagccaagucaccauguucccacacaucaucguagacguccgucaacucgaaccaguccuaaucccacuccccgacguacgcaacaacuucuaccacuacaaccaguccaaugacuccacaauaaagcugaucgccaugcucuacacaccccuacgcgccaauaacgcuggcgacgacguauucacagucucaugccgaguccuaacccgcccaucccccgauuucgacuucaucuuucucgucccacccaccgucgaaagccgcaucaaacccuuuacaguccccauccucaccgucgaagaaaugagcaacucccgcuuccccaucccccucgaaaaacucuacaccggucccuccuccgcauucgucguucaaccccaaaacggccgcugcacuaccgacgguguccuacucgguacuacucaacucuccgccguaaacaucugcaccuuccgcggcgacguaacucacaucgccggcagccacgacuacaccaugaaucuagccucccaaaacuggaauaacuacgaccccaccgaagaaauccccgcaccccugggcacucccgauuucguaggcaaaauacaaggcaugcucacucagaccacccgcgaagacggcucaacccgcgcccacaaagccacugucagcacuggcuccguccacuucacacccaaacuaggcuccguccaauacaccaccgauacaaacaacgacuuccaaacaggccaaaacaccaaauucacccccgucggggucauccaggacggcaacaaccaccaaaacgaaccccaacaauggguccuacccaacuacucaggccgaaccggccacaacgugcaccucgcccccgccguugcccccacauuccccggcgaacaacuacucuucuucagauccaccaugcccggcugcuccggcuaucccaacaugaaccuagacugccuacuaccccaagaauggguccaacacuucuaccaagaagccgcccccgcccaguccgacguagcccuccuacgcuucgucaaccccgacaccggucgaguccucuucgaauguaaacuccacaaaucaggcuacgucaccgucgcacauaccggcccucacgaccucgucauacccccuaacggcuacuuccgcuucgacuccuggguaaaccaauucuauacccuagccccaaugggcaacggggccggacgccgcagauaa

SEQ ID NO: 39113 - RNA, 1614 nt, Artificial Sequence
  derived and/or modified sequence opt11 from VP1__Norovirus_and/or_Norovirus-like__AY532131
augaaaauggccuccaacgacgccaacccaucugacggcuccacugccaaucuaguaccagaaguaaacaacgaaguaauggcacucgaacccgucgucggugccgccaucgccgcaccaguagccggccaacaaaacaucaucgacccuuggauccgaaacaacuucguccaagccccaggaggcgaauuuaccgucuccccaagaaacgccccaggggaaauacuuuggagcgcuccccucggcccugaccuaaaccccuaccuaucccaccuugcccgaguuuacaacggauacgcugguggcuucgaaguccaagucauucuagccggcaaugccuucaccgccgguaaaauaaucuucgccgcaguaccacccaacuucccuaccgaaggccuuuccccaucccaagucaccauguucccccacaucaucguagacguccgccaacuggaacccguacucauaccccuccccgacguccgaaacaacuucuaccacuacaaccaaucuaacgacucuacaaucaaacucauagcaaugcucuacaccccacuccgcgcuaacaacgccggcgacgacgucuucaccgucuccugucgaguacuaacaagacccucucccgacuucgauuucaucuuccucgucccacccacagucgaaucccggaccaaacccuucacaguacccauacucaccguagaagaaauguccaacuccagauuucccauaccccuugaaaaacucuacacaggacccuccuccgccuucgucguccaaccccaaaacggccgaugcaccacugacggcguccuacucgggaccacccagcucucggccgucaacauaugcaccuuccgcggagacgucacucauauagcuggcagccacgacuacaccaugaaccucgccagucaaaacuggaacaacuacgauccaaccgaagaaauccccgccccacuaggcaccccggacuucgucggcaaaauccaaggaaugcucacccaaacaacccgcgaagacggaagcacccgcgcucacaaagccaccgucagcaccggcucaguacacuucacucccaaacucggcucaguccaauacaccaccgauaccaacaacgacuuccaaaccggucaaaauaccaaauucacacccguugggguaauacaagacggcaacaaccaccagaacgaaccucaacaauggguccuacccuccuacucaggccgaaccggccacaacguccaucuagcccccgccgucgcucccaccuuucccggcgaacaacuccuauucuuccgauccacaaugccaggcuguuccggcuaccccaacaugaaccucgacugccuacucccucaagaauggguccaacacuucuaccaagaagcagccccagcacaauccgacguagcccuucuccgcuucgucaacccagauaccggcagaguccucuucgaaugcaagcuccacaaauccggauacguaacaguagcccacaccggcccccacgaccucgucaucccacccaacggcuacuuccgcuucgauucaugggucaaccaauuuuacacccucgcccccaugggcaacggcgccggccgccgccgauaa

SEQ ID NO: 39114 - RNA, 1614 nt, Artificial Sequence
  derived and/or modified sequence opt11 from VP1__Norovirus_and/or_Norovirus-like__AY532121
augaaaauggcauccaacgacgccaaccccuccgacggaucaaccgccaaccucgucccagaagucaacaacgaagucauggcccucgaacccgucgugggcgccgccauagccgcacccguagcuggacaacaaaacgucaucgaccccuggauccgcaacaauuucguccaagcccccggaggugaguucaccgucuccccacgcaacgcucccggagagauacucugguccgcaccccucggacccgaccucaacccauaccuuucacaccucgcccgcauguacaacggcuacgccggcggauuugaaguucaagucauccucgcaggcaaugccuucaccgccggcaaggucaucuucgccgcaguucccccaaacuuucccacagaaggccucuccccaucccaggucaccauguucccccacauaaucgucgacguacgacaacucgaaccaguacucauuccacuccccgacgucagaaauaauuucuaccacuauaaccaauccaacgacuccaccaucaaacuaaucgccaugcucuacacuccucuccgcgcaaacaaugcuggcgacgacgucuucaccguauccugccgcguucuaacacgcccuucccccgacuucgacuucauauuccucguucccccgaccgucgaaucuagaaccaaacccuucaccguccccauccucacaguagaagaaauguccaacucccgauucccaauaccccuagaaaaacuuuacacaggccccucauccgccuucgucguccaaccacaaaacggccgaugcaccacagauggcguccugcucggaaccacccaacucucagccgucaacauuuguacauuccgaggcgacguuacacacauagcaggaucccacgacuacacaaugaaccuugccucccaaaacuggaacaacuacgacccuacagaagaaauacccgcaccccucgguacccccgacuuugucggcaagauccaaggcacucuaacacaaaccacccgagaagauggaucuacccgagcccacaaagccaccgucucaaccggcuccguacacuucaccccaaaacucgguagcguccaauacaccaccgauaccaacaaugacuuccaaaccgggcaaaacaccaaguucacucccgucggcgucauccaagacggcaauaaucaccaaaaugaaccccaacaauggguccucccaaacuacuccggccgcaccggccacaacguccaccucgcccccgccgucgcccccaccuuccccggugagcaauuacucuucuuucgcuccaccaugccaggcugcuccggcuaucccaacaugaaccucgacugccuccucccacaagaguggguacaacacuuuuaccaagaagcagcucccgcccaaucagacgucgcacuucuccgauucgucaaccccgacacaggccgaguucuguucgaauguaaacuacacaagucaggcuacgucaccgucgcccacacaggaccacacgaccucgucaucccacccaacggcuacuucagauucgacucauggauaaaucaauucuacacacuagcccccaugggcaacggcgcaggcagacgccgauaa

SEQ ID NO: 39115 - RNA, 1614 nt, Artificial Sequence
  derived and/or modified sequence opt11 from VP1__Norovirus_and/or_Norovirus-like__AY532115
augaaaauggccucaaacgacgccaaccccuccgacggauccaccgccaaccuuguacccgaaguuaacaacgaagucauggcccucgaacccgucgucggcgcugcaaucgcugcacccguagccggacaacaaaacguuaucgaccccuggauccgaaacaacuucguccaagcccccggcggugaguucaccguuuccccacgcaacgcacccggcgaaauucugugguccgcaccacuaggccccgaccucaauccauaccuuucccaccuagcccguauguacaacggauaugccggcggcuucgacguacaagugauccucgcaggcaacgcauuuaccgccgguaaaaucaucuucgccgcaguaccgcccaauuuccccacagaaggacucuccccuucccaagucacuauguucccacacaucauagucgauguccgccaacucgaacccgugcucaucccacuccccgauguccgaaacaacuucuaccacuacaaucaaagcaacgacuccaccauuaaacuaaucgcaaugcucuacacaccccuaagagcaaacaacgccggcgacgacguauucaccgucucuugccgcguacucacccgcccaucccccgacuucgacuucaucuuucuagucccacccaccguagaaucccgcaccaaacccuucaccguccccauucucacagucgaagaaaugucaaacucccgcuuccccaucccacucgaaaaacuauacacaggaccauccuccgcauucgucguccaaccacaaaacggccgaugcaccacagacggaguccuccucggaaccacccaacucucagccgucaacauuugcacauuuagaggcgacgucacccacaucgcagguucccacgauuacacaaugaaccuggccucccaaaacuggaacaacuacgacccuaccgaagaaauacccgcaccccucggcacccccgacuucguaggcaaaauccagggcaugcuaacccaaacaacccgugaagacggcuccacacgcgcccacaaagcaacagucuccacaggcucaguacacuuuacacccaaacucggcucaguccaauacaccacagacaccaauaacgacuuccaaacaggccaaaacaccaaauuuacccccguaggcgucauccaagacggcaacaaccaccaaaacgaaccucaacaauggguccuacccaacuacuccggacgaacuggccacaacguccaccuagcacccgcuguagcccccacauuccccggcgaacagcuccucuuuuuccgcucaaccaugcccggaugcucaggcuauccaaacaugaaccuugacugccuucuaccccaggaauggguacaacacuuuuaccaagaagcagccccagcccaauccgacguagcacuccuucgcuucguaaacccugacaccggccguguacuauucgaaugcaaacuccacaaauccggauacgucaccguagcccacacaggaccccaugaccucgucauaccacccaacggcuacuuccgauucgacagcugggucaaccaauucuacacccuagcccccauggguaacggugccggacgccgccgcuaa

SEQ ID NO: 39116 - RNA, 1614 nt, Artificial Sequence
  derived and/or modified sequence opt11 from VP1__Norovirus_and/or_Norovirus-like__KF806530
augaaaauggccuccaacgacgccucccccucugacggcucugccgccaaccuagucccagaagucaacaacgaagucauggcccuagaacccgucgucggcgccgccaucgccgcccccguagccggacaacaaaacgucaucgaccccuggauccgcaacaacuucguacaagccccaggcggagaguucacagucucuccaagaaacgccccaggcgaaauucucugguccgcaccccucggacccgaucuuaaccccuaccucucacaccuagcccgcauguacaacggcuacgccggcggauucgaaguccaagucauacuagccggcaacgcauucaccgccggcaaaaucauauucgccgccguacccccaaacuuccccacugaaggccuaucacccagccaagucaccauguucccacacaucgucgucgacguccgccaacuagaacccguccuaaucccacuccccgacguccgaaacaacuucuaccacuacaaccaaagcaaagacccuacaaucaaacucaucgcuaugcucuacacaccccucagagccaacaacgccggcgaagacgucuucaccgucuccugccgaguccucaccaggccaucacccgacuucgacuucaucuuccuaguaccacccaccgucgaaucccgauccaaacccuucaccguacccauccucaccgucgaagaaaugaccaauucccgauuccccaucccccuagaaaaacuuuucaccggccccuccggcgccuucgucguccaaccccaaaacggccguugcacaaccgacggugucuuacuagggacaacccaacucucccccguaaacaucugcacauuccgcggagaccucacccacuucgccggcacacacgaauacgccaugaaccucgccucacaaaacuggaacaacuacgacccaacagaagaaauacccgcaccccucggcgccccugacuucguaggcaaaauacgaggcguccuaacccaaacaacccgccgcgacgguuccacacgcggccaccgcgccacacucuccacuggauccgcccacuuuacccccaaacuaggcucuauccgcuuuuccacagacaccaacaacgacuucgaagcaggacaaaacacaaaauucacccccguuggcgucuuccaggacggcgacaaucaucaaaacgaaccccaacaaugggugcuaccuaacuacuccggagccacugcacacaacguccaccucgcucccgccgucgccccagccuuccccggcgaacaacuccucuucuucagauccacuaugcccgguugcucaggauaccccaauaugaaccucgauugccuccucccacaagaauggguccaacacuucuaccaagaagccgcccccgcucaaucagaugucgccuuguuacgauucgucaaucccgacacauccagaguccuauucgaaugcaaacuccauaaaucaggauacgucacagucgcacauacaggccagcaugaccuagucaucccacccaacggcuauuuccgauuugauuccugggucaaccaauucuacacccucgcccccaugggaaacggaacaggccgccgccgauaa

SEQ ID NO: 39117 - RNA, 1614 nt, Artificial Sequence
  derived and/or modified sequence opt11 from VP1__Norovirus_and/or_Norovirus-like__KF806513
augaaaauggccucaaacgacgccucacccuccgacggauccgcugccaaccuuguccccgaaguauccaacgaagucauggcccucgaacccgucguaggagccgcaaucgccgccccaguagcaggacaacaaaacgucaucgaccccuggauacgaaacaacuucguccaagcgcccggaggcgaguucaccgucucaccccgcaacgcccccggagaaauccucuggagcgcaccccucggcccagaccuaaaccccuaccucagccaccucgcacgcauguacaacggcuacgccggcggauucgaaguccaaguuauucuagcaggaaaugccuuuaccgccggcaaaaucauuuucgcagccgucccaccaaacuuccccaccgaaggacuuucacccucccaggucacgauguucccccacaucgucgucgauguccgccaacucgaaccaguacuuaucccccuccccgacgugcgaaacaacuucuaccacuacaaccaauccaaagaucccacaaucaaacucaucgccaugcucuauacuccacuccgcgccaacaacgcaggcgaagacgucuucaccguauccugcagaguccucacacgccccuccccagacuucgacuucauauuccuagucccacccacaguagaaucacgaucaaaacccuucaccguccccauacucacagucgaagaaaugacaaacucccgcuucccaaucccccuagaaaaacuuuucaccgguccguccggcgcauucgucguacaaccccaaaacggccgauguaccaccgacggcguccuacucggcacaacccaacuaucgcccgucaacaucugcaccuucaggggugaccucacccacuucacaggaacauccgaauacgccaugaaccucgcaucacaaaacuggaacaacuacgacccaacugaagaaauaccugcaccacucggcgcgcccgacuuugucggaaaaauccgaggcaugcuaacgcaaacuacccgccgcgacggcuccacccgcggccaccgugccacccucuccaccggcucugcccacuucacacccaaacucggcuccauccgauucuccacagacaccaacaaugacuucgaagcaucccaaaacaccaaauuuaccccagucggcgucuuccaagaaggcgacaaccaccaaaacgaaccccaacaaugggugcuccccaacuacucaggcgccacagcccacaacguacaucuugcucccgccgucgcccccgccuuccccggagagcaacuacucuucuuucgcucgaccaugccaggcugcggaggcuaucccaacaugaaccucgacugccuccucccccaagaguggguacaacacuucuaccaagaagccgcccccgcacaauccgacguagcauuacuccguuucgucaaccccgacacaagcagaguccucuucgaaugcaaacuacacaaauccgguuaugucacagucgcucacacaggacaacacgaccucguaauuccucccaacgguuacuucagauucgacuccugggucaaccaauucuacacacuagcccccaugggcaacggcaccggaagacgaagauaa

SEQ ID NO: 39118 - RNA, 1614 nt, Artificial Sequence
  derived and/or modified sequence opt11 from VP1__Norovirus_and/or_Norovirus-like__AY741811
augaaaauggccuccaacgaugcuaacccgucugacggauccaccgccaaccuaguccccgaaguaaacaacgaagucauggcccucgaacccguagucggugccgcaauugccgcucccgucgccggccaacaaaacguuauagaccccuggauccgcaauaacuucguacaagcccccggcggugaguucaccguaucaccucgcaaugcuccaggagaaauccuuuggucagcaccccuaggccccgaccuaaaccccuaccucucccaccuagcccgcauguacaacggcuacgccggcggauucgaaguacaagucauccuagcaggcaacgccuucacagccggcaaaguaauuuuugccgccguaccacccaacuuccccacagaaggccucucacccucccaaguaaccauguucccccacauuaucgucgacguacgacaacuagaacccguccuaaucccgcuccccgacguacgaaacaacuucuaucacuacaaccaaagcaacgacuccaccauuaaacuuaucgccaugcuauacacaccccuuaaagccaacaacgccggcgacgacguauucaccgucagcugccgaguccuaacccgccccucccccgacuucgacuuuauauuccuagucccucccaccguggaaucccgcaccaaacccuucaccguccccauccuaacugucgaagaaauguccaacucacgauuccccaucccccucgaaaaacucuacacaggccccuccuccgcauucgucguacaaccucaaaacggacgaugcaccaccgacggcguucuacuaggcaccacccagcucucagccguuaacauuugcacauuccgcggcgacgucacccacaucgcugggucccaugacuacacaaugaaccuagccucccagaacuggaacaacuacgaccccacagaagaaauccccgccccucucggcaccccagacuuugucggcaaaauccaaggaaugcucacccaaacaacccgagaggacggauccacucgagcucacaaagcaaccgucuccacagguagcguccacuucacgccaaagcucggauccguacaauacaccacagacaccaacaaugacuuccaaaccggccaaaauaccaaauucacucccgucggagucauccaagauggcaacaaccaccaaaacgaaccccaacaauggguccucccaaacuacucaggccgcaccggccacaacguacaccuagcccccgccgucgccccaacuuuccccggagaacaacuccuuuucuuccgcuccaccaugccaggaugcucaggcuaccccaacaugaaccucgacugccuccuuccccaagaauggguacaacacuucuaccaagaagcagcccccgcccaauccgacguugcccuacuacgcuucguaaacccagacacaggccgcgucuuauucgaaugcaaacuccacaaauccggcuacgucacagucgcccacacaggcccacacgaccuagucaucccacccaacggauacuuccgauucgacucguggguaaaccaauucuacacccuugcccccauggguaauggagcaggccgccgccgauaa

SEQ ID NO: 39119 - RNA, 1614 nt, Artificial Sequence
  derived and/or modified sequence opt11 from VP1__Norovirus_and/or_Norovirus-like__AY532122
augaaaauggcauccaacgacgccaaucccuccgacggcuccacagccaaccucguaccugaagucaacaacgaagucauggcacucgaacccguagucggugccgcgaucgccgcucccguggcaggccaacagaacgucaucgaccccuggauccggaacaauuucguccaagcaccaggcggagaguucaccgucuccccucguaacgcacccggagagauacuaugguccgcaccccugggccccgaccuuaaccccuaucucucccaccucgcccgcauguacaacggcuacgccggaggcuucgagguccaaguaauacuagcggggaacgccuucaccgccggaaaagucaucuucgccgccgucccgcccaacuuccccacagaaggacucucacccagccaagucaccauguucccccacauaaucguagacguccgccaacucgaaccaguacucaucccccuaccagauguccguaacaacuucuaccacuacaaccaaagcaacgacucaacaaucaagcucaucgcaaugcucuacacuccccuacgcgcaaacaaugcuggcgacgacgucuucaccguuuccugccgcguccuaacccgcccauccccagacuucgacuuuaucuuccucgucccacccaccgucgaaucccgcaccaaacccuucacaguccccauccucaccguugaagagaugucuaauucucgcuuccccaucccccuagaaaaacuuuacaccggaccaucaucugcuuucgucguccaaccacaaaauggccgaugcacaaccgacgguguacuacucggcacgacccaacucucagccguaaacauaugcaccuucggcggagacgucacccacauagcaggcucccacgacuacaccaugaaccuagcgagccaaaacuggaacaacuacgacccaacagaagaaaucccagcaccccucggaaccccggacuucgucggaaaaauccaagguaugcucacccaaacaacccgcgaggacggcuccacacgcgcccacaaagcaacugucucuacaggaucaguacauuucacacccaaacucggcuccguccaauacaccaccgacaccaauaacgauuuccagacaggccaaaacaccaaauucaccccagucggagucauccaagauggcgauaaccaccaaaacgaaccccaacaauggguccuuccaaacuacucaggccguaccggccacaacguccaccuggcccccgcagucgcacccacauuccccggagaacaacuccucuucuuccgcuccaccaugcccggcugcuccggauacccaaacaugaaccuagacugccuccuaccccaagaauggguccaacacuuuuaccaagaagcagccccugcacaauccgacgucgccuuacuaagauuuguaaacccagacaccggccgcguacuuuucgaaugcaaacuacacaaauccgguuacguaaccguagcccacaccggcccacaugaccucgucauacccccaaauggcuacuuccgcuuugacuccugggucaaccaauucuacacucucgcccccaugggcaacggcgccggccgccgccgcuag

SEQ ID NO: 39120 - RNA, 1614 nt, Artificial Sequence
  derived and/or modified sequence opt11 from VP1__Norovirus_and/or_Norovirus-like__AY532120
augaaaauggcuuccaacgacgccaaccccagcgacggcucuacagccaaccucgucccagaagucaacaacgaagucauggcccucgaaccaguagucggcgccgccaucgccgcccccgucgccggccagcaaaacaucaucgaccccuggauccgcaauaacuucguccaagcaccaggaggugaguucaccgucucaccccgaaacgcacccggcgaaauccuaugguccgcaccccucggccccgaccucaaccccuaccucucacaccuagcccgaauguacaacggcuacgccggcggcuucgaaguccaaguaauccucgcaggcaacgccuuuacagcggggaaaauaaucuucgccgccgucccucccaacuuccccacugaaggucucucacccucccaagucacaauguucccccacauaaucgucgacguaagacaacuagaacccguccucaucccacuaccagacgucagaaacuccuucuaccauuauaaccaauccaacgacucaaccaucaaacuaauagcaaugcuauacacaccacucagagcaaacaacgcaggcgacgacgucuucaccguuagcugccgcguacucacucgccccucucccgacuucgacuucaucuuccucgucccacccacagucgaaucacgcacuaaacccuucacaguccccauacuuaccgucgaagaaaugucaaacucccgcuuccccaucccccucgaaaaacucuacacaggaccauccuccgcauucgucguccaaccacaaaacggacgaugcaccaccgacggcguccuucucggcacaacucaacuaucagcaguaaauauaugcaccuuccgcggcgacguaacacacauagcaggcucucacgacuacaccaugaaccucgccagccaaaacuggaauaacuacgaccccaccgaagaaaucccagcaccccuggggacuccugacuuuguuggaaaaauacaaggaauguuaacccaaacaaccagagaagacggauccacacgagcccacaaagccaccguauccacaggcucaguacacuucaccccaaaacucggcuccguacaauacaccaccgacaccaacucagacuuccaaacaggacaaaacaccaaauucacccccgucggcgucauccaagacggcaacaaccaccagaacgaaccacaacaauggguccuccccaacuacuccggcggcaccggacacaacguacaccucgcaccagccguagccccaacauucccaggggaacaacuucuauucuucagaucaaccaugcccggcugcuccggcuaccccaacaugaaccucgacugcuacucaccccaagaauggguccaacacuucuaucaagaagcagccccugcacaauccgauguagcacuccuacgcuuugucaaccccgacaccggacgaguacucuucgaauguaaacuacacaaauccggcuacgucacagucgcacacacaggcccacacgaccucgucauacccccaaacggauacuuccgcuucgauuccugggugaaccaauucuacacccucgcacccaugggaaacggcgccggccgccgucguuaa

SEQ ID NO: 39121 - RNA, 1614 nt, Artificial Sequence
  derived and/or modified sequence opt11 from VP1__Norovirus_and/or_Norovirus-like__AY532111
augaaaauggcaucgaacgacgccaacccguccgacggcuccaccgccaaccucguccccgaaguaaacaaugaagucauggcccuagaacccgucgucggcgcggccaucgccgcaccaguagcaggacaacaaaaugucaucgacccauggauacgaaauaacuucguacaagcacccggaggcgaguucacuguaucaccccgcaacgccccaggcgaaauccucugguccgccccacucucccccgaccuaaaccccuaccucucccaccuugcccgaauguacaacggcuacgccggaggcuucgaaguacaaguaauccucgccggcaacgccuucacagcaggcaaaauuauuuucgcagccgucccacccaacuuucccaccgaaggacucagcccgucucaggucacaauguucccccacaucauagucgauguccgccaacuagaacccguccuaauaccucucccagacguccgcaauaauuucuaccacuacaaccaaucaaacgacuccaccauaaaacucauagccaugcucuacacaccccuccgagcaaauaacgccggagacgacgucuucaccgucuccugccgcguccucaccagacccucccccgacuucgacuuuauuuuccucguacccccaacuguugaaucaaggaccaaaccauucaccguccccauucucaccguagaagaaaugucaaacucccgauuccccaucccccucgaaaaacucuacaccggucccuccuccgcauucguaguccaaccacaaaacggccgcugcaccaccgacggcguccuucuaggcacuacacaacuaucagcaguuaacaucugcaccuuccgcggcgacgucacccacaucgccggaagccacgacuacacuaugaaccuggccucucaaaacuggaacaacuacgaucccaccgaagaaauaccagcaccccuaggcacccccgauuucguagguaagauacaagguaugcucacccaaacuaccagagaagacggcuccacccgcgcccacaaagcuaccgucuccaccggcucaguccacuucaccccgaaacucggcucuguacaauacaccaccgacaccaacaacgacuuccaaacaggacaaaacacaaaauucacccccguaggcguaauacaggacggcaacaaccaccaaaacgagccccaacaauggguccuacccaacuauuccggccgcaccggccacaacguccaccucgcccccgccgucgcccccaccuuccccggcgaacaacuucuauucuuccguucaaccaugcccggcugcuccggauauccuaacaugaaccucgacugccuccuaccccaagaauggguucaacacuucuaccaagaagcagcccccgcacaauccgacguugcccuguuacgauucgucaacccagacacagggcgcguccucuucgaaugcaaacuccacaaaucgggcuacguaaccgucgcccacaccggcccccacgaccucgucaucccucccaacggcuacuuucgcuucgacucuuggguuaaccaagucuacacccucgcccccaugggcaacggcgccggacgccgacgcuaa

SEQ ID NO: 39122 - RNA, 1614 nt, Artificial Sequence
  derived and/or modified sequence opt11 from VP1__Norovirus_and/or_Norovirus-like__AF080558
augaaaauggccuccaacgacgccaaccccuccgacggcucaaccgccaaccucguucccgaaguuaacaacgaaguaauggcacucgaacccguaguuggcgccgccaucgccgcucccgucgcaggccagcaaaacgugauugacccauggaucagaaauaacuucguccaggcccccggcggcgaauuuaccguauccccaagaaacgcuccaggcgaaauacuuuggagcgcaccccucgguccagaccuaaaccccuaccuaucucacuuagcccgcauguacaacggauacgcaggaggauucgaaguccaagucauccucgccggcaacgcuuucaccgcgggcaaaaucauauucgcagcugucccacccaacuuccccaccgaaggacuuucccccucacaagucaccauguucccccacaucaucgucgacguccgccaacucgaacccguucucaucccccucccagacguacgcaacaacuucuaucacuacaaccaauccaacgacucaaccaucaaacucauagcaaugcucuacaccccacuccgagcaaacaacgccggcgacgacguuuucacagucuccugccgcguccucacaagacccucaccugauuucgacuucauauuccuagucccacccacagucgaaucacggacaaaacccuucacaguuccgauccuuaccgucgaagaaauguccaacucccgcuucccaauaccccuugaaaaacucuacaccggaccuuccuccgccuucgucguccagccccaaaacggccgcugcaccaccgauggcguccuccucggcaccacccagcucuccgccgugaacaucugcaccuuccgcggagacguaacccacauagcaggcucucacgacuacaccaugaaccuagccucucaaaauuggaacaacuacgacccaaccgaagaaaucccagccccucucggcacaccagacuuugucggcaagauucaaggaaugcucacacaaaccacacgcggcgacggauccacccgcgcacacaaagccaccgucuccaccggcuccguccacuucacccccaaacucggcucaguucaauucaccaccgacaccaacaacgauuuccaaaccggacaaaacacgaaauucacacccgucggagucacucaagacggagacaaccaccaaaacgaaccacaacaauggguccuacccaacuacuccggccgcaccggacacaacguccaccucgcccccgcagucgcacccaccuuccccggugaacaacuacuauucuuccgguccaccaugcccggcugcuccggcuacccaaacaugaaccucgacugccuccucccccaagaauggguacaacacuuuuaccaagaagccgccccagcccaaagcgacgucgcauuacuaagauucgucaaccccgacaccggccgcguacuuuucgaauguaagcuacacaaaucuggcuacgucacuguagcccacacaggcccacacgaccucguaauaccacccaacggauacuuccgauucgacucaugggugaaucaauucuacacccuagcucccaugggcaacggagccggacgucgacgcuaa

SEQ ID NO: 39123 - RNA, 1614 nt, Artificial Sequence
  derived and/or modified sequence opt11 from VP1__Norovirus_and/or_Norovirus-like__KF806508
augaaaauggcuucaaacgacgccucacccucugacggauccgcagccaaccucguaccugaaguaucaaacgaagucauggcacuagaacccgucguaggcgccgcaaucgccgcaccagucgccggccaacagaacgucauagaccccuggauccgcaacaacuucguccaagcacccgguggagaguucacggucucaccccgcaacgcacccggagaaauccuaugguccgccccacucggccccgaccucaacccauaccuaucccaucucgcccgcauguacaacggauacgccggcggauucgaaguacaagucauccucgccggaaacgccuucacugccggcaaaaucaucuucgccgccgucccucccaacuuccccacugaagguuuaucccccucccaagucaccauguuuccacacauagucguagauguaagacagcucgagcccguccucaucccccucccagacgucagaaacaacuucuaucacuacaaccaaucaaaagaccccaccauaaaacucaucgccaugcuauacacaccucuucgcgcaaacaacgccggugaagacgucuucaccgucuccugccgcguccucacacggccuucaccugacuucgacuucauauuccucgucccacccacaguagaaucgcgcuccaaacccuucaccguucccauccuuacagucgaagaaaugaccaacagccguuuccccauuccacuagaaaaacuauucaccggcccauccggcgccuucgucguccaaccccaaaauggucgaugcaccaccgacggcguccuccuagggaccacccaacucucccccgucaacauaugcacauucagaggugaccucacacacuucaccggaacuucugaauacgcaaugaaccucgcaucccagaacuggaacaacuacgaccccaccgaagaaauccccgcccccuuaggcgcacccgacuucguaggaaaaaucagagggaugcuaacccaaaccacccgccgugacggcuccacccgcggacaccgggccacacucuccaccggcucagcccacuucaccccaaagcucggcuccauccgcuuuuccaccgacacaaauaacgacuucgaggccggccaaaacaccaaauucacccccguaggcauauuccaagaaggcgacaaccaccaaaacgaaccccaacaauggguacuacccaacuacucaggcgccacagcccauaacguacaccuagccccagcagucgccccugccuuccccggggaacaacuccucuucuuucgauccaccaugcccggaugcggcggauaccccaacaugaaccucgacugccugcuaccccaagaguggguacaacacuucuaccaagaagccgcccccgcacaauccgacgucgcccuucuucgcuucgugaaucccgacacaagcaggguacucuucgaaugcaaacuccacaaaagcggcuacgucaccgucgcucacaccggccaacacgaccucgucaucccacccaacggcuacuuccgcuucgacagcugggucaaccaauucuacacacucgcccccaugggcaacggcaccggccgacgccgcuga

SEQ ID NO: 39124 - RNA, 1614 nt, Artificial Sequence
  derived and/or modified sequence opt11 from VP1__Norovirus_and/or_Norovirus-like__AF425766
augaaaauggccucaaacgacgccaaccccuccgacggcagcacugccaaccuagucccugaagucaacaacgaagucauggcccuugaacccguugucggcgccgccaucgcagcaccagucgccggacaacaaaauguaaucgaccccuggauuagaaacaauuucauccaagcuccaggaggcgaguucaccguaagcccccgcaacgccccaggcgaaauccucugguccgcaccccucggaccugaucucaacccauaccuaucccaccuagcccguauguacaacggauacgccggcggcuucgaaguccaagucauccucgcaggcaacgccuuuacagccggcaaaaucaucuucgccgccguacccccaaacuuucccaccgaaggacuaucgcccucucaagucaccauguucccacacauaauugucgacguccgacaacuagaacccguccucaucccgcuccccgacguccgaaacaacuuuuaccacuauaaucaauccaacgacaguacaauuaaacucaucgccaugcucuacaccccacuacgagccaacaacgccggcgacgacgucuucaccgucuccugcagaguccuaacucgccccucaccagacuucgacuucaucuuccucguaccacccaccgucgaauccagaaccaaacccuucaccguccccauccucaccgucgaagaaaugucaaacucccgcuuccccaucccccuugaaaaacuguacacuggcccuucaagugccuuuguaguccaaccccaaaacggccgcugcacaaccgacggcguacuccuaggcaccacacaacucagcgccgucaauauaugcacauuccgaggcgacgucacucacaucgcugguucccacgacuacaccaugaaccucgcaucgcaaaauuggaauaacuacgaucccacagaagaaauaccagcuccucuaggaacccccgaccugguaggcaaaauacaaggcaugcucacccaaacuaccagagaagacggcuccacccgcgcccacaaagcaaccgucucaaccggcucaguacacuucacccccaaacuaggcuccguacaauacacaaccgacacauccaacgacuuccaaaccggccagaacaccaaauucacuccagucggcguaauccaagacggcaacaaccaccaaaacgaaccacaacaauggguccuccccaacuacucaggccgaaccggccacaacguccaccucgcucccgccguagcccccacuuuccccggcgaacagcuccucuucuuccgcagcaccaugccaggcugcucaggguaccccaacaugaaccuagacugccuacuaccacaggaauggguccaacacuucuaccaagaagcugccccugcccaaucagaugucgccuuacucagauucguaaacccugauaccggccgaguccuauucgaaugcaaacuacacaaauccggcuacgucacagucgcacacaccggaccccacgaccucguuauacccccaaacgguuacuuccgcuucgacuccugggucaaccaauucuacacccucgcccccaugggcaauggcgcaggcagacgacgauaa

SEQ ID NO: 39125 - RNA, 1614 nt, Artificial Sequence
  derived and/or modified sequence opt11 from VP1__Norovirus_and/or_Norovirus-like__AJ583672
augaaaauggcauccaacgacgccaaccccuccgauggcuccaccgccaaccucgucccagaaguaaacaacgaaguaauggcacucgaacccguagucggagcagccaucgccgcacccguagccggccaacaaaacgucaucgacccauggauccgcaacaacuucguccaagcaccuggcggcgaguucaccguuucaccccgcaacgcucccggagaaauccucugguccgcaccucucgguccagaucuaaacccauaccucucccaccucgcaagaauguacaacggcuacgcgggcggauucgaaguccaagucauccucgccggaaacgcuuucaccgcgggcaaaaccauauucgccgccguacccccuaacuucccaaccgaaggucuauccccuucccaagucaccauguucccccacaucaucgucgacguccgccaacccgaacccguacuaaucccccuucccgauguccgcaacaacuucuaccacuacaaccaauccaacgaccccaccauuaaacucauagcuaugcucuacacaccccuccgagccaacaacgccggcgacgacguauucaccgucagcugccgcguacuaacccgacccucacccgacuucgacuuuauuuuccuaguaccaccaaccguagaaucaagaaccaaacccuucacuguccccauccucaccgucgaagaaaugaccaacuccagauuuccaaucccacuagaaaaacucuucaccggaccaucuaacgccuucgucguacagccccaaaacggccgaugcaccaccgacggcguacuacucggaaccacccaacucucuccagucaacauaugcaccuuucgcggagacguuacccacaucgcaggcacacacgacuacacuaugaaucucgcgucccaaaacuggaacaacuaugacccaaccgaagagauccccgccccacucggcacucccgacuucgucggcaaaauccaaggcguacucucacagaccacccguggagacggcuccacccgcggacacaaagccacggucagcaccggcuccguucacuucacacccaaacucggcuccguucaauacacuaccgauacaaacaacgaccucgaagccggccaauccaccaaguucacaccaguuggaguaguccaagacggcaacaaccaccagaacgaaccacaacaauggguccuccccaacuacucuggccgcaccggucacaacguccaccucgugccagccguagcaccuacauuccccggcgaacaacuccucuucuucagaagcacuaugcccggcuguucaggcuauccgaacaugaaucucgacugccuccuaccacaagaguggguacaacacuuuuaccaagaagccgcacccgcccaauccgaugucgcucuacugcgcuucguaaaccccgauaccggccgcguccucuucgaaugcaaacuccacaaauccggcuacgucaccgucgcccacaccgguccccacgaccuagucauacccccaaacggcuacuucagauucgacuccuggguaaaccaauucuacacacucgccccuaugggcaacgggacuggacgacgacgauag

SEQ ID NO: 39126 - RNA, 1614 nt, Artificial Sequence
  derived and/or modified sequence opt11 from VP1__Norovirus_and/or_Norovirus-like__AY532119
augaaaauggcauccuccgacgccaaccccucugacggcucaacagcaaaccugguacccgaagucaauaacgaaguuauggcccucgaacccgucguuggagccgccaucgccgccccugucgcaggccaacaaaacgucauagaccccuggauaagaaacaacuucguccaagccccaggcggagaguucaccguaucaccccgaaacgcuccaggcgaaauacucugguccgcaccccuaggcccugaccucaaccccuaccucucccaccuagcccgcauguacaacggauacgccggcggauucgaaguacaagucauacucgccggaaacgccuucacugccggcaaaaucaucuuugccgccgucccacccaacuuccccaccgaaggacucucucccucccaagucacaauguucccccacauaaucgucgacguccgacagcuugaaccaguacucaucccccuccccgacguccgcaacaacuuuuaccacuacaaccaauccaacgacuccacaaucaaacuuaucgccaugcucuacacccccuuacgagccaauaacgccggcgacgacgucuuuacugucucuugccgcguccucacccgucccucuccagacuuugacuucaucuuccuugucccacccaccgucgaaucccgcaccaaacccuucacaguccccauccucacaguagaagaaauguccaacucccgcuuucccauuccccuagaaaaacucuacaccggaccauccuccgccuuugucgugcaaccacaaaacggacguugcacaaccgacggaguucuccucggaaccacccaacucuccgcagucaacauaugcaccuuccgcggcgacguaacccacaucgcaggcucccacgacuacacaaugaaccucgccucacaaaacuggaauaacuacgacccgaccgaagaaauacccgcaccacuaggcacccccgacuucgucggcaaaauccaaggcauguuaacccaaacaacccgcgaagacggcucuacccgugcccacaaagccaccgucuccaccggcagcguccacuucacccccaaacucggaagcguacaauacacaaccgacacuaacuccgacuuccaaaccggacaaaacacaaaauuuacaccaguaggagucauccaagacggcaacaaucaccaaaacgaaccccaacaauggguccuacccaacuacucaggccgaaccggccacaacguacaccucgccccagccguagcuccaacuuucccaggcgaacaacuccucuucuucagauccacaaugccaggcugcuccggcuauccaaacaugaaccucgacugccuccucccccaagagugggugcaacacuucuaccaagaagccgcccccgcccaauccgacgucgcccuccuccgauucguuaaccccgauaccggccgcguacuuuucgagugcaaacuacacaagucagguuacguaaccguagcacacaccggcccccaugaccuaguuauaccaccaaacggcuacuucagauucgacucaugggucaaccaauuuuacacgcuugcaccaaugggcaauggagcagggcgccgccgcuaa

SEQ ID NO: 39127 - RNA, 1614 nt, Artificial Sequence
  derived and/or modified sequence opt11 from VP1__Norovirus_and/or_Norovirus-like__AF080552
augaaaauggccucuaacgacgccaaccccucagaugggagcaccgccaaccucguccccgaaguaaauaacgaaguuauggcccucgaacccgucgucggcgccgcaaucgcugcucccgucgccggucaacaaaacgucaucgaccccuggauccgcaacaacuucguccaagcacccggcggcgaguucacagucagcccacgcaacgcuccuggcgaaauccucuggucagcaccccuaggcccugaccuaaaccccuacuuaucccaccucgccagaauguacaacggcuacgccggaggcuucgaaguccaagucauucuagccggcaacgccuucacagccggcaaaauaaucuuugccgccgucccacccaacuuccccaccgaaggccucucgcccucccaaguaaccauguucccccacaucaucgucgacguccgccaacuugaaccagugcuuaucccccuucccgacguacgcaacaacuucuaccacuauaaccaauccaacgacuccacaaucaaacuaauagccaugcuguacacaccccuccgcgccaacaacgcaggagacgacguauucaccguauccugccgagucuuaacccgccccucaccagacuucgacuucaucuuccuagucccacccacagucgaaucccgaacaaaacccuucaccguacccauccuuaccguugaagaaauguccaacagccgcuuccccaucccccuugaaaaacucuacacaggccccuccuccgcauucgucguccaaccacaaaacggcagaugcacaaccgacggaguccuccucggcacuacccaacucucugccgucaacauaugcaccuuccgaggcgacgucacgcacaucgcuggaucucaugacuacacuaugaaccucgccucccaaaacuggaacaacuacgaccccacagaagaaauccccgcgccccucggcacuccagacuucgucggcaaaauccaaggaaugcucacccaaaccacccgagaagacggcuccacccgcgcccacaaagccacugucuccaccggaucaguacacuucaccccuaaacuaggcuccguccaauacaccacagacaccaauaacgacuuccagacuggccaaaacacaaaauucacaccugucggugucauacaagacggcaacaaucaccagaacgaaccacaacaauggguccucccaaacuacucuggacgcaccggacauaacguucaccucgccccugccgucgcccccaccuucccaggugaacaacuccucuucuuucgauccaccaugccaggcugcagcgguuaccccaacaugaaccuagauugccuccuaccccaagaauggguccaacacuucuaccaagaagcugccccugcccaauccgacguagcccuccuacgauucgucaacccagacaccggccgcguacucuucgaaugcaaacuccacaaaucaggcuacgugacaguagcccacacaggcccccacgaccuaguaaucccacccuccggauauuuccgcuucgacucgugggucaaccaauucuauacccucgcccccauggguaacggcgccggacggcgccgcuaa

SEQ ID NO: 39128 - RNA, 1614 nt, Artificial Sequence
  derived and/or modified sequence opt11 from VP1__Norovirus_and/or_Norovirus-like__KX514177
augaaaauggccuccaacgacgccaaccccuccgacggcuccgcugccaaccuagucccagaaguaaauaacgaaguaauggcgcuagagccagucgucggcgccgcgaucgccgccccugucgcaggacaacaaaacgucaucgacccauggauuagaaacaacuuuguccaagccccaggaggcgaguucacagucagcccacgaaacgcacccggagaaauacucuggucugccccacucggccccgaucucaaccccuaccucucccaccuugcucgaauguacaacggcuacgccggcggcuucgaaguccaggucauccuagccgguaacgccuucacugcagggaaaaucaucuucgcugccguaccaccaaccuuccccaccgaaggccucuccccaucacaagucaccauguucccccacaucauagucgauguccgccaacucgaaccaguccuaauaccccuccccgacgugagaaacaacuucuaccacuacaaccaaucaaacgacuccacaauuaaacucaucgccauguuauacacccccuuacgcgccaacaacccaggagacgacgucuucaccguaucaugccgcguccuaacccgacccucccccgacuucgacuucauuuuccuagucccacccacagucgaaucacgaaccaaacccuucuccguccccauccucaccgucggcgaaaugaccaacucccgauuccccgucaaccucgaacgacucuucaccggucccucuuccgccaacguaguccaaccacaaaacgguagaugcaccauagacggagaacuacuaggcaccacccaacucucaucaguuaacaucugcaccuuucgcggcgacguaacccacauuggcacaacacaacacuggacuaugaacuuagcuucccccaacuggaacaacuacgaccccacugaagaaacccccgccccucucggaacaccagacuucguaggaaaaauccacggcaugcucacacaaaccacccaagaaaacggaagcacccgagcucaccgugccaccguuuacgucggcuccgccaacuucacaccaaaacuaggaaaaguccaauucgaaacugacacaggcgacgaccuggcaauccgacaaaacaccaaauuuacccccgucggcguaauccaauccagcgaccaccaccgcgacgaaccccaacaguggcgacuccccaauuacuccggagcuaacaccuucaauguccaccucgccccagcaguagcccccaacuuccccggcgaacaacuccucuucuuccguucaacccucccaggaugcggcggccaccccaauauggaccucgacugcuuacuaccccaagaaugggugcaacacuucuaccaagaagcagccccagcccaaucugacgucgccuuacuccgcuucgucaaccccgacacaucccgcguccucuucgaaugcaaacuacacaaaucaggauacgucaccgucgcccauaccggccaauacgaccucguccucccuucaaacggcuauuuccgcuucgacuccugggucaaccaauucuacaccuuagcaccaaugggaaacggcacaggccgccgcagauaa

SEQ ID NO: 39129 - RNA, 1614 nt, Artificial Sequence
  derived and/or modified sequence opt11 from VP1__Norovirus_and/or_Norovirus-like__KF806514
augaaaauggccuccaacgacgcuuccccauccgacggcuccgcagcgaaccucgucccugaagucaacaacgaagucauggcccuagaacccgucguaggcgccgccauagcggcaccagucgcaggccaacaaaacgucaucgaccccuggauccgcaacaacuucguccaagccccgggaggagaguucaccgucagcccucgcaacgccccuggugaaauccuauggucugcaccccuaggacccgaccuaaaccccuaccuuucccaccucgcccgcauguacaacggauacgcuggaggauucgaaguccaaguaauacuagccggcaacgccuucacagccggcaaaaucaucuucgccgcagucccaccuaacuuccccacagaaggccuaucccccucacaagucaccauguucccacacaucgucguugacguacgccaacucgaaccagugcuuaucccccuacccgauguccgcaacaacuuuuaccacuauaaccaauccaaagaccccaccauaaaacucaucgcaaugcuauacaccccacucagagcaaacaacgcaggcgaagacgucuucaccgucucuugccgcguccucacccguccaucuccagacuucgacuucaucuuccuagugccacccacuguugaauccagaucuaaacccuucacaguccccauccucaccguagaagaaaugaccaacucucgcuucccaaucccccuagaaaagcuauuuacuggccccucuggcgccuucguaguacaaccacaaaacggccgaugcaccacagacggcguccuccucggcacaacccaacucuccccaguaaacaucugcaccuuccguggcgaccuaacacacuuuaccggcaccuccgaauaugccaugaaccuagcaucccaaaacugggacaacuacgaccccacagaagaaauacccgcaccccucggcgcccccgacuucgucggcaaaauaagaggaaugcucacccaaaccacccgucgcgacggcucaacccgcggccaccgcgcaacccuuucaaccggauccgcccacuucacccccaaacucggcaacauccgcuucuccaccgacaccaauaacgauuucgaagccggccaaaacaccaaauuuaccccagucggcgucuuccaagaaggagacaaucaccaaaacgaaccccagcaaugggucuuacccaacuacucuggugcaacugcucacaacguucaccuagcccccgcggucgccccugccuuccccggcgaacaacuccuuuucuuccgcucgaccaugcccggcuguggaggcuaccccaacaugaacuuagacugccuccucccccaagaauggguccaacacuucuaccaagaagccgcucccgcccaauccgacguagcacuacuacgcuucgucaaucccgacacaucccgcguacuauucgaaugcaaacuccacaaauccggauacguuaccguagcacacacaggacaacacgaucucgucaucccacccaaugguuacuucagauucgacuccugggucaaccaauucuacacccucgcacccauggggaacggcaccggucgaagacgauaa

SEQ ID NO: 39130 - RNA, 1614 nt, Artificial Sequence
  derived and/or modified sequence opt11 from VP1__Norovirus_and/or_Norovirus-like__AB303925
augaaaauggccuccaaugacgcaaaccccucggacggaucuaccgccaaccucguacccgaagucaacaacgaagucauggcacucgaaccagucgucggcgcagccauagccgccccagucgccggccaacaaaacguaaucgacccauggauacgaaacaacuucguccaggccccuggcggcgaguucacagucucaccccgcaacgccccaggagaaauccucugguccgccccacucggccccgacuuaaaccccuaccucucccaccucgcccgcauguacaauggguacgcaggaggauucgaaguacaagucauccucgcagguaaugccuucaccgccggcaaaaucauauucgcugccgucccucccaacuuccccaccgaaggucuuucccccucgcaagucacaauguucccccacaucauaguagacguccgccaauuagaacccgugcucaucccccuaccagacguucgcaacaacuucuaccacuacaaccaauccaacgacuccacaaucaaacucaucgcgaugcucuacaccccucucagagccaacaacgcaggcgacgacguauucacugucuccugccguguccuaacacgacccucccccgacuuugacuucauauuccuaguacccccaacaguugaaucccgaacaaaacccuucacugucccaauccucacaguagaagaaauguccaauucccgcuucccuauuccccuagaaaaacuauucaccggucccuccuccgccuucgucguccaaccccaaaacggacgaugcacaacagacggcguccuacuuggcaccacccaacucuccgcugucaacaucugcaccuuccgcggcgacgucacucacaucgccggcucccacgacuacacaaugaaucuagcaucccaaaacuggaacaacuacgaccccacagaagaaauacccgcaccccucgguacuccagauuuuguaggcaaaauccaaggcaugcuaacccaaacaacccgagaagacggcuccaccagagcccacaaagccaccguauccacuggcuccguccacuucacccccaaacucggcuccguccaauacaccacugacaccaacaacgacuuucaaacaggccagaacaccaaauucacccccgucggagucauccaagacggcaauaaccaccaaaacgaaccccaacaauggguccugcccaacuacuccggacgaaccggccacaacguccaccucgcccccgccgucgcacccaccuucccaggcgaacagcucuuauucuucagauccacaaugcccggaugcucaggauacccaaacauggaccucgacugccuacuaccccaagaauggguccaacacuucuaccaagaagcugcccccgcacaauccgacgucgcccuucuacgcuucguaaacccagacaccggccgaguccucuucgaaugcaaacuacacaaaucuggauacgucaccguagcccauacuggaccccacgaucuagucaucccgcccaacggauacuuccgcuucgauuccuggaucaaccaauucuacacccuagcccccaugggaaacggagccggacgccguagauaa

SEQ ID NO: 39131 - RNA, 1614 nt, Artificial Sequence
  derived and/or modified sequence opt11 from VP1__Norovirus_and/or_Norovirus-like__KF806534
augaaaauggcauccaacgaugcuucuccguccgacggcuccgccgccaaccucguucccgaagucaacaacgaggucauggcacucgaaccgguugucggcgcagcaaucgcagcccccgucgccggccagcaaaacgucaucgacccuuggauucguaacaacuucguccaagccccaggcggcgaguucaccgucucaccacgcaacgcaccaggcgaaauccucuggucagccccuuuaggcccggaccucaaccccuaccuaucucaccuagcucgcauguacaacggauacgcaggaggcuuugaaguccaagucauccucgccggcaacgcauucacagccggcaaaaucauuuuugccgccgucccacccaacuuccccaccgaaggccuaucacccucucaagucaccauguucccccacauagucgucgauguccgacaacuagaacccguccucauaccccuccccgacguucgcaacaacuucuaucauuacaaccaaucaaaagaucccaccaucaaacucauagccaugcucuacacaccccucagagccaacaacgccggcgaagacgucuucaccgucucaugccgaguauuaacccgaccuucacccgacuucgauuucaucuuccuagucccucccacaguagaaagccgaucaaagccauucacaguccccauccuaacgguagaagaaaugaccaacucccgauuccccauaccacucgaaaaacucuucaccggccccucuuccgcuuucguuguacaaccccaaaauggacgaugcacaacugacggaguucuacucggaaccacccaacuaagcccaguuaauauuugcacauuccgaggcgaccuaacccacuucgcaggaaccucagaauacgcaaugaaccuagccucucaaaacuggacaaacuacgacccaaccgaagaaauccccgcaccacucggagccccagacuucgucggcaaaauccgcggaguccuaacacaaacaacacgacgagacggcucaacccgcggacaccgcgccacccucucuaccggcucagcccacuucacccccaaacucggcucaauacgcuucuccaccgacacaaauaacgacuucgaagcuggccaaaacacaaaauucacccccgucggcgucuuucaagacggcgacaaucaccaaaacgagccccaacaauggguucucccaaauuacucaggagcaacagcccacaacguacaccuagcucccgccgucgcccccgccuucccuggcgaacaacuccuauucuuucgcuccaccaugcccggaugcuccggcuaccccaacaugaaccucgauugccuacucccacaggaguggguacaacacuucuaccaagaagcagcccccgcccaaucagacgucgcacuacuccgcuucgugaaucccgauaccucccgcguccuauucgaaugcaaacuccacaaauccggauaugucaccguagcccacacaggccaacacgaccucgucauacccccuaacgguuacuuccgcuucgacagcugggucaaccaauucuauacccucgcccccaugggcaacggaaccggccgaaggcgcuaa

SEQ ID NO: 39132 - RNA, 1614 nt, Artificial Sequence
  derived and/or modified sequence opt11 from VP1__Norovirus_and/or_Norovirus-like__KF806519
augaaaauggcauccaacgacgccucacccucugacggauccgcagccaaccucguccccgaagucaacaacgaaguaauggcacucgaaccaguuguaggagccaccaucgccgcccccgucgccggccagcagaacgucauagaccccuggauacgcaacaacuucguccaagcacccggcggagaguucaccgucucuccccgcaacgcccccggcgaaauacucuggucagcaccccuaggcccagaccucaaccccuaccucucacaccucgcccgcauguauaacggauacgcaggcggauucgaaguccaagucauccuagcaggcaacgcuuucaccgcaggaaaaaucauauucgccgcugucccacccaacuuccccacugaaggucucucucccucccaaguaaccauguucccacacaucguaguagacguccgacaacuagaacccguccucaucccccuacccgacguccgcaacaacuuuuaccacuacaaucaauccaaagacccaacaauaaaacuuaucgccaugcuauacacaccacuccgagcaaacaacgccggagaagacgucuuuaccguuuccugucgaguccucaccagacccagccccgacuucgauuucaucuuccuuguauccccaaccgucgaaucacgcucaaaaccauucaccguccccauacucacagucgaagaaaugacgaacucacgcuucccaaucccacucgaaaaacuauucaccggucccucaggcgccuucguaguacaaccacaaaacggccgaugcaccacagacggaguacuucuaggaacaacacaacucucacccguaaauaucugcaccuuccguggagaccuaacucacuucaccggaaccuccgaauacgccaugaaccucgcuucccaaaacuggaacaacuacgacccaaccgaagaaauaccagcaccccuaggagcccccgacuucguaggcaaaauacgcgguaugcucacccaaacaacccgccgugacggcucaacccgcggacaccgcgccacacuuucgacaggauccgcucacuucacccccaaacuaggcaacauccgauucuccaccgacaccaacaacgacuucgaagccggccagaacaccaaauucaccccuguaggaguauuccaagaaggcgacaaccaccaaaacgagccccaacaauggguacuccccaauuacuccggcgccaccgcccacaacguacaccuugcccccgcugucgcccccgccuuccccggagagcaacuccuauucuuucguuccacuaugcccggaugcggcggauaccccaacaugaaccucgacugccuccuaccccaagaauggguccaacacuucuaucaagaagccgcacccgcccaaucagacguagcccuucuacgcuucguaaacccagacacaucacgcguucuguucgaaugcaaacuccauaaauccggauacgucaccgucgcccacacaggucaacacgaccuaguuauaccacccaacggcuacuucagauucgacuccugggucaaccaauucuacacacucgcacccaugggcaacggcaccggccgccgccgauaa

SEQ ID NO: 39133 - RNA, 1614 nt, Artificial Sequence
  derived and/or modified sequence opt11 from VP1__Norovirus_and/or_Norovirus-like__AB303924
augaaaauggcguccaacgacgcaaaccccagugacgguucaaccgcaaaccucguccccgaagucaacaacgaaguaauggcccucgaaccagucgucggagccgcaaucgccgccccuguagcaggacagcaaaacgucaucgacccguggauacgcaacaacuucguccaagcccccggcggcgaguucaccguaucccccagaaacgcccccggagaaauccuaugguccgcaccccucggcccagaucuaaaccccuaccuaucccaccucgcccgcauguacaacggguacgccggcggcuucgaaguacaagucaucuuagccggcaacgcauucaccgcaggcaaaaucaucuucgcagccguuccacccaauuuccccaccgaaggccucucgcccucccaaguaaccauguuuccccacaucaucgucgacguccgucaauuagaaccagugcuaaucccucuaccagacguacgcaauaacuucuaccacuacaaccaauccaacgacuccaccaucaaacuuaucgccaugcuauacaccccacucagagcaaacaacgccggugaugacguauucaccgucuucugccgcguacucacccgccccagcccagacuucgacuucaucuuccucgucccacccacuguagaaucacgcaccaaaccauucaccguccccauccucaccguugaagaaaugucuaacucccgcuucccaauaccacuggaaaaacuauacaccgguccaagcuccgcuuucguaguacaaccccaaaauggccgcugcacaaccgacggcguccuccucggcacaacccaacuauccgccguaaacaucugcacauuccgcggagacgucacacacauagcuggaucccacgacuacaccaugaaccuagcaucccaaaacuggaacaacuacgaucccacagaagagaucccagccccucuaggcaccccagacuucgucggcaaaauccaaggaaugcucacucaaacaacgcgagaagacgguuccacccgcgcccacaaagccaccgucuccaccggcuccguccacuucacccccaaacucggauccguccaauacacaaccgacacuaacaacgacuuccaaacuggacaaaauaccaaauuuacccccguaggagucauccaagacggaaacaaccaccaaaacgaaccccaacaauggguccuaccaaacuacuccggccgcaccggccacaacguccaccuagcacccgccgucgcacccacuuuccccggugaacagcuccuauucuuccgcuccacuaugcccggaugcuccggcuaccccaacaugaauuuagacugucuccuaccacaagaauggguccaacacuucuaccaggaagccgcuccagcccaaucagacgucgcacuccuccgcuucguaaaccccgacaccggccguguuuuauucgaaugcaaacuccacaaauccgguuaugucaccgucgcccacaccggcccccacgaccucgucauucccccaaacggcuacuuccgauuugacucaugggucaaccaauucuacacacucgcccccaugggcaacggagccggccgcagacguuag

SEQ ID NO: 39134 - RNA, 1614 nt, Artificial Sequence
  derived and/or modified sequence opt11 from VP1__Norovirus_and/or_Norovirus-like__DQ975270
augaaaauggccucaaacgacgccaaccccucugacggaucaaccgccaaccucguccccgaagucaacaacgagguuauggcccucgaacccgucguaggagcugccaucgccgcaccaguugccggccaacaaaacgucaucgacccauggauccgaaacaacuucguucaagcccccggaggcgaguucacaguauccccucgcaacgcccccggcgaaauacucuggucagcuccccucggcccagaccuaaaccccuaccucagccaccuagccagaacuuacaacggcuacgcaggcggcuucgaaguacaagucauacuagcuggaaacgcauucacagccgguaaaauaauauucgcagccguuccaccaaacuuccccaccgaaggcuuaucccccucccaagucaccauguuuccacacaucaucgucgacguccgucaacucgaaccuguacuaaucccccuacccgacgucagaaacaacuucuaucacuacaaccaaucaaacgacucaaccauaaaacucauagccaugcucuacacaccccuccgcgcaaacaacgccggcgacgacgucuucaccgucucaugccgcguacuaacccgcccaagccccgacuucgauuuuauuuuccucguaccacccaccgucgaaucccguaccaaaccauucaccguacccauccucaccgucgaagaaaugucuaacucccgauuccccauaccccucgaaaaacuauacaccggcccauccagcgccuucguaguccaaccgcaaaacggccggugcacuaccgacggcguauuauugggcaccacacagcuaucagccguaaauauuugcaccuuccguggagacgucacccacaucgcuggcucccacgacuacacaaugaaccucgccucccaaaacuggaacaauuacgaccccaccgaagaaauccccgccccacuaggcacccccgacuucgucggcaaaauccaagguaugcucacccaaaccacccgcgaagacggcagcacacgcgcccacaaagccacagucagcacaggauccguccacuucacccccaaacuaggauccguccaauacaccacagacacaaauaacgacuuucagaccggacaaaacaccaaguucaccccaguuggcguuauacaagacggcaauaaccaccaaaacgagccccaacaauggguccuacccaacuauaguggacgcaccggccauaacgugcaucucgccccugccgucgcccccaccuucccaggagaacaacuccucuucuuccgcuccaccaugccuggcuguucagguuauccuaacaugaaccucgacugccuccuaccucaagaauggguccaacacuucuaccaggaagcugcccccgcacaaucggacgucgcucuacucagauuuguaaaccccgacaccggacgaguccuauucgagugcaagcuccacaagucaggcuacguuaccgucgcacacacuggcccacacgaccuagucauuccacccaacggcuacuuccgcuucgacagcuggguaaaccaauuuuacaccuuagcccccaugggcaacggagccggacgucgccgcuaa

SEQ ID NO: 39135 - RNA, 1614 nt, Artificial Sequence
  derived and/or modified sequence opt11 from VP1__Norovirus_and/or_Norovirus-like__AF414424
augaaaauggccucuaacgacgccaaccccuccgacggaucaaccgcaaaccuaguacccgaaguuaacaacgaggucauggcucuugaaccugucguaggcgcugcaauagccgccccagucgcaggacaacaaaacguuaucgaccccuggauccgaaacaacuucguccaggcccccggcggagaguucaccguaucuccccguaacgccccaggcgaaauacucugguccgcaccucucggccccgaccuaaaccccuaccucucccaccuagcacgcauguauaacggcuaugccggaggcuucgaaguccaagucauccuagccggcaacgccuucacagccggaaaaauuaucuucgccgccgucccacccaacuuccccaccgaaggccucucacccucgcaaguuaccauguucccacauaucaucgucgacgucggccaacuagaacccguccugaucccccuccccgacguccgcaauaacuuuuaccacuacaaucaguccaaugacuccacuaucaaacucaucgccaugcuauacacaccccuccgcgccaacaacgccggcgacgacguauucaccgucucaugcagaguacucacccgccccucccccgacuucgacuuuauuuuccuaguacccccaaccgucgaaucccgcaccaaaccuuucaccgucccuauacucaccguugaagaaauguccaacucccgcuucccuaucccacucgaaaagcuauacaccggaccauccucugcauucguaguacaaccccaaaacggccgcugcaccaccgacggaguacuucucggaaccacccaacucucagcaguuaacaucugcaccuuccgcggcgacgucacacauauagccggaucacacgacuacaccaugaaccuggccucacaaaauuggaacaacuacgaccccacagaagaaauccccgccccacuaggcaccccugacuuugucggcaaaauacaagguguccuuacccaaacaacccgagaagacggcuccacccgagcccacaaagccaccgucuccaccgggucaguccacuucacccccaaacucggcucaguacaauacaccaccgacacaaacaacgauuuccaaaccggccaaaauacaaaauucacaccagucggcgucauccaagacggcaacaaccaucaaaacgaaccacaacaguggguccuccccaacuacucaggccgcaccggccacaacguccaccuagcacccgccgucgcccccaccuuccccggcgaacaacuucucuucuuccgauccacuaugcccggcugcuccggcuaccccaacaugaaucuugacugucuccucccccaagaauggguacaacacuucuaccaagaagccgcccccgcccaauccgacgucgcccuauuaagauucgucaaucccgacaccggccgcguccuauucgaaugcaaacuccauaaaucaggcuacgucacaguugcacacaccgguccccaugaccuagucaccccacccaacggcuacuuccgauucgacuccugggucaaccaauucuauaccuuagcccccaugggcaacggagccggacgccgacgcuaa

SEQ ID NO: 39136 - RNA, 1614 nt, Artificial Sequence
  derived and/or modified sequence opt11 from VP1__Norovirus_and/or_Norovirus-like__LC048964
augaaaauggccucaaacgacgccaaccccuccgacggcucaaccgccaaccuagucccagaagucaauaacgaagucauggcccucgaacccguaguaggagccgcuauagcagcaccagucgccggacaacaaaacguaaucgauccauggauccgauccaacuucguccaggcccccggcggagaguucaccgucuccccacggaacgcccccggagaaauccucugguccgcuccccuggguccagacuuaaacccuuaccucucccaccucgcccgcauguacaacggcuacgccggaggcuucgaaguccaagucauccuagccggcaacgccuucaccgcaggaaaaauuaucuucgcugcagucccucccaacuucccuaccgaaggccucucccccucacaagucaccauguucccacacaucaucguagacguucgccaauuagaacccguccucauaccccuacccgacgucagaaacaacuucuaccacuacaaccaaagcaacgacucuaccaucaaacuaaucgccaugcucuacacuccccuccgcgccaacaacgcuggugacgacgucuucaccguaagcugccgcguccuaacccgccccucccccgacuucgacuucaucuuccucguacccccaacugucgaaucgcgaacaaaaccauucaccgucccaauccuaaccguagaagaaauguccaacucccgauucccaaucccucuagaaaaacucuacacaggccccucauccgccuucgucguacagccccaaaacggccgcugcacgacagacggcguacuucuaggcacaacacaacuuucagccgucaacaucugcacauuucguggagacgucacccauauagccggaucacacgacuacaccaugaaucucgccucccaaaacuggaauaacuacgaccccaccgaagaaauacccgcaccccucggcacacccgacuuugucggcaaaaaccaaggccuccuuucccaaaccacccgcggcgacggcucaacccgagcccacaaagccaccguaucaaccggaucaguccacuucaccccuaaacucggcucaguucaauacaccaccgauaccaacaacgacuucgaaaccggccaaaacacaaaauucacccccgucggcgucauacaagacggaaacaaccaccaaaacgaaccccaacaaugggcccuacccaauuacucaggccgcacaggccacaacguccaccucgcccccgccgucgcccccaccuucccaggcgaacaacuacuauucuuucgaucaaccaugccaggaugcuccggcuacccaaacaugaaccuugacugucuacucccgcaagaauggguccagcacuucuaccaagaagccgcacccgcccaguccgacgucgccuuacuacgauucgucaacccugacacugggcgcguacuauucgaaugcaaacuucacaaaucaggauacgucacugucgcccacaccggcccacacgaccucgucaucccacccaacggcuacuucagauucgacuccugggucaaccaauucuacacucucgcccccauggguaacggcgccggacgacgccgcuga

SEQ ID NO: 39137 - RNA, 1614 nt, Artificial Sequence
  derived and/or modified sequence opt11 from VP1__Norovirus_and/or_Norovirus-like__AB684705
augaaaauggccagcucggacgccaaucccuccgacgguuccgccgcuaaccucgucccugaaguaaacaacgaagucauggcccucgaaccugucgucggagcagccaucgccgcacccguagccggacaacaaaacaucauugaucccuggauccgaaacaacuucguucaagccccuggcggcgaguucaccgucucuccccguaaugcacccggcgaaauccugugguccgcaccacucucccccgaccuaaacccauaccucucacaccucucacguauguacaacggcuacgcaggcgguuucgaaguccaagucauccucgccggcaacgccuucacagccggcaaaguaaucuucgccgccguucccccaaacuucccaacagaaggccucuccccuucccaaguaaccauguucccccacauaaucgucgacguacgccaacucgaaccaguccuuauaccacuccccgacguacgcaacaacuucuaccauuauaaccaaacccacgacuccacgcuaaaacucaucgccaugcucuacacaccccuccgcgcaaacaacgccggagacgacguauucaccguaucaugcagaguccuuacaagaccaucccccgacuucgacuucauauuccucguacccccuaccgucgaauccagaaccaaacccuucaccguccccauccuuacaguugaagaaaugucuaacucacgauuccccauaccccucgagaaacuauacaccggacccucauccgccuucgucguccaaccucagaauggcagauguaccaccgacggcguccuccuaggaaccacccaacucuccgcugucaacaucugcaacuucaggggcgacgucacccgcgucggcaucucccacgacuacacuaugaaccuagucucccaaaacuggaacaauuaugaccccacagaagaaauccccgcuccccucggcacacccgacuucgucggcaaaauacaagggcuccucacacaaacaacacgugccgacuccagcacccgagcccauaaagccacccuaucaaccggcuccguccacuucacaccaaagcuaggcuccguccaauucaccacagacaccaacaacgacuuccaaaccggccaaaacaccaaauucaccccagucggagucauccaggacucagaccaccaccaaaacgaaccccaacaauggguccuccccaacuacuccgguuccagcggucacaacguacaccucgcuccagccgucgcccccacuuucccgggagaacaacuccuguucuuccgauccaccaugcccggcugcucaggcuacccaaacaugaaccucgacugccuacuaccccaagaauggguccuccacuucuaccaagaggcugcacccgcacaauccgaugucgcccuacuccgcuucgucaaccccgauacuggccgcguucuauucgaaugcaaacuccacaaauccggcuacaucacagucgcccacaccggccccuacgaccucguaaucccacccaacggcuacuuccgcuucgacuccuggguaaaccaauucuacacccucgcgcccauggggaacggcaccggccgccgccgcuaa

SEQ ID NO: 39138 - RNA, 1614 nt, Artificial Sequence
  derived and/or modified sequence opt11 from VP1__Norovirus_and/or_Norovirus-like__KF806523
augaaaauggccucaaacgacgccucucccuccgacggcucagcagccaaccuaguacccgaaguaaacaacgaagucauggcacuagaaccagucgucggcgcggccauugccgcccccguugccggccagcaaaacguaaucgaccccuggauccgcaacaacuucguccaagccccaggcggcgaguucaccguaucuccccgcaacgcccccggcgaaauccucugguccgcccccuuaggcccagaccugaaccccuacuuaucccacuuagcacgaauguacaacggcuacgcaggaggcuucgaaguccaaguaauccuagccggcaacgcauucacagccggcaaaaucaucuucgccgcagucccgcccaacuuccccaccgaaggacuuucaccuucccaaguaacaauguucccccauaucgucgucgacgugcgccaacuagaacccguccucauaccucuacccgacguacgcaauaacuucuaccacuacaaccaaucuaaagaccccacaauaaaacuaaucgccaugcucuacacaccccuccgagccaacaacgcaggcgaagacguguucaccgucuccugccguguccucacccgcccgucaccagauuucgacuucauauuccucgucucccccaccgucgagucccgaucaaaacccuucaccguccccauccuaaccguagaagaaaugaccaauucacgcuucccaauaccccucgaaaaacuuuucacaggcccauccggagccuucgucguccaaccccaaaacggccgcugcaccaccgacgguguccuccuagguaccacccaacucuccccaguaaacauaugcaccuuccgcggugaccuaacacacuucaccggcaccuccgaauaugccaugaaccucgccucgcaaaacuggaacaacuacgacccaaccgaagagauccccgccccacucggcgccccggacuucguuggcaagauccgcggaaugcuaacccaaaccacacgccgcgacggauccaccagaggccaccgugcaacccucucaacagguuccgcccacuucacacccaaacucggcaacauacgcuucuccacagacaccaacaacgacuucgaagcuggccagaacaccaaauucacacccgucggagucuuccaagaaggagacaaccaccaaaacgaaccacaacaauggguccuacccaacuacucaggagccacugcacacaacguucaccucgcacccgccgucgcccccgccuuuccuggcgaacaauuauuauucuuccgcuccaccaugcccggcugcggcggcuacccuaacaugaaccucgacugccuccuaccccaagaauggguacagcacuucuaccaagaagccgcacccgcacaauccgacguugcccuauuacgcuuugucaaccccgacacaucccgcguccucuucgaaugcaaacuccacaaauccggauaugucaccgucgcccacacaggucagcacgaucucgucaucccucccaacggauacuuccgauucgacucgugggucaaccaauucuacacccucgcacccaugggaaacgggaccggacgccgacgcuaa

SEQ ID NO: 39139 - RNA, 1614 nt, Artificial Sequence
  derived and/or modified sequence opt11 from VP1__Norovirus_and/or_Norovirus-like__AY532129
augaaaauggcaucaaacgacgccaauccaagcgacggaucaacagcaaaccuagucccagaagucaacaacgaagucauggcccuugaacccguagugggcgccgccaucgccgcccccguagcaggccagcaaaacguaaucgaccccuggauccguaacaacuucguacaagcacacggcggagaauuuaccgucucccccaggaacgcacccggugaaauccucugguccgccccacucggcccagaccucaaccccuaccucagccaccuugcccggauguacaacggauacgccggcggauucgaaguccaagucauccuugccggcaacgccuucacagccggcaaaaucaucuucgcagccgugccuccuaacuucccaaccgaagggcuaucucccucccaagucaccauguucccccacaucaucgucgacguccgccaacucgaacccguccucauaccccuacccgacguccgcaacaacuucuaccacuacaaucaaaguaacgacucaacgaucaaacucaucgccaugcucuacacaccccucagagccaacaacgcaggcgacgacgucuucaccgucucaugccgaguccucacccgcccaucacccgauuucgacuucauauuccuagucccaccaaccguagaaucccgcaccaaaccauucacuguaccaauccugacagucgaagaaaugucgaacucccgcuucccaaucccccuagaaaaacucuacaccggacccucaagcgccuucgucguccaaccccaaaacggccguugcaccacugacggcguccuacucgguacaacucagcuaucagcugucaauaucugcaccuucagaggagacgucacccacaucgccggcucccacgacuacaccaugaaccucgccucccaaaacuggaacagcuacgaccccaccgaagaaauccccgcccccuuaggcacccccgauuucguaggaaaaauccagggaaugcucacacaaaccacccgcgaagacggcuccaccagagcucacaaggccaccgucagcaccggcuccguccauuucaccccaaaacucggauccguccaauacaccacagacacaaacaacgacuuccaaaccggacaaaauaccaaauucacccccguaggcgucauacaagacggcaacaaccaccagaacgaaccacaacaauggguacuacccaauuacuccggccgcacaggccauaacguccaccucgcacccgcagucgcccccacauuccccggcgaacaacuccuauucuucagaucaaccaugcccggaugcuccggcuaccccaacaugaaccuagacugccuacucccccaagaauggguccaacacuuuuaccaagaagccgcaccagcacaaucagacguugcccuacuccguuucgugaacccagacaccggccgaguacuauucgaaugcaaacuucacaaauccggcuacgucacagucgcccacaccggcccucacgaccucgugauacccccaaacggcuacuuccgcuucgacucaugggucaaccaauucuacacccucgcaccaaugggaaacggcgcaggucgccgccgcuaa

SEQ ID NO: 39140 - RNA, 1614 nt, Artificial Sequence
  derived and/or modified sequence opt11 from VP1__Norovirus_and/or_Norovirus-like__AY532124
augaagauggcuucaaacgaugccaaccccuccgacggcucuaccgcaaaccucguacccgaggucaacaacgaagucauggccuuagaaccagucgucggcgcagcuauugccgcacccgucgccggacaacaaaacgucaucgaccccuggauacgcaacaacuucguacaagcacccggcggcgaguucacagucucaccccgcaacgcacccggcgaaauccucugguccgcaccacugggacccgaccucaacccauaccucucacacuuagcccgaauguacaacggcuacgccgggggcuucgaaguccaagucauccucgcucgcaacgccuucaccgccggcaaagucaucuucgcagcagucccuccaaauuucccaaccgaaggccucucccccucacaaguuaccauguucccacacauaaucguagacguucgccaacucgaacccguccucaucccccucccagacguccgcaacaacuucuaccacuacaaccaauccaacgacuccaccauuaaacucaucgccaugcucuacacaccacuaagagcuaacaacgccggcgacgacguauucacugucuccugccguguccucacccgaccaucccccgacuucgacuucaucuuccucguacccccuacagucgaaagccgcaccaaacccuucacaguccccauccucaccguggaagaaauguccaacagccgauuccccaucccacuagaaaagcucuacacaggccccuccuccgccuucguuguccagccccagaacggaagaugcaccacagacggcguccuccuaggcaccacacaacuaucagcagucaacaucugcacauuuagaggugaugucacccacauagccggcucacacgacuacaccaugaaucucgccucccaaaacuggaauaacuacgaccccacugaagaaauacccgcaccccugggcacccccgacuucgucgguaaaauccaaggcaugcucacccaaacuacccgagaagacggcuccacacgagcccacaaagccacagucucuacaggcagcguccacuucacacccaaacuaggcucuguccaguacaccacagacaccaacaacgacuuccaaacaggucaaaacacuaaauucacacccguaggagucauccaagacgguaacaaccaccaaaacgaaccacaacaauggguccuucccaacuacucaggucgcaccggccacaacguccaucucgcccccgccgucgcccccacauucccuggcgaacaacuccuuuucuuccgcuccaccaugcccggcugcuccggcuaccccaacaugaaccuagacugccuccucccccaggaauggguccaacacuucuaccaagaagccgcccccgcgcaauccgacguugcccucuuacguuuuguuaaccccgacacggggcgaguucuauucgaaugcaaacuucacaaauccggcuacgucaccgucgcccauacagguccucacgaccuaguaaucccucccaacggcuacuuuagauucgacuccugggucaaccaauucuacacccuggcacccaugggcaacggcgccggucgccgccgauaa

SEQ ID NO: 39141 - RNA, 1614 nt, Artificial Sequence
  derived and/or modified sequence opt11 from VP1__Norovirus_and/or_Norovirus-like__KX514309
augaaaauggccucaaacgaugccaaccccucugacggaucagccgcuaaccuaguacccgaagucaacaacgaaguaauggcccuagaacccguagucggcgccgcuaucgccgcaccagucgccggacaacaaaacguaaucgaccccuggauccgaaauaacuucguacaagcaccagguggcgaauuuacagucucaccccgaaacgcccccggcgaaauccucugguccgccccacuaggccccgaccucaaccccuaccuaucccaccucgcccggauguacaacggcuacgccgguggauucgaaguccaagucauacucgccggcaacgccuucacagccggaaaaauaauauucgcagccguuccacccaacuuccccaccgaaggccuuucccccucccaagucacaauguucccccacaucaucguagacgucagacaacucgaacccguacuaaucccccuccccgacguccgaaacaacuucuaccacuacaaccagucaaaugacucaacuaucaaacuaaucgcaaugcucuacacaccccuccgugcuaacaaccccggcgacgacgucuucaccgucuccugccgcguacuaacccgaccaagcccagacuucgacuucaucuuccucgucccacccaccguagaaagcagaaccaaacccuucuccguccccauacuaaccguaggcgaaaugaccaacucacgcuuuccaaucaaccucgaacgccucuucacuggcccguccucggcaaaugucguucaaccucaaaacggccgaugcaccaucgacggcgaauuacuaggaaccacccaacuaagcuccgucaacauaugcaccuuucgcggcgacgucacacaccccggaggcucaaaaauauacacaaugaaccucgcaucccccaacuggaacaacuacgaccccaccgaagaaauccccgcuccccuaggcacccccgacuucgucggcaaaauccacggaaugcuaacccaaaccacuaaaggggaaggaaguacccggggucaccgcgccaccguauacguaggaggcgcaaacuucacccccaaacucggcaaaguccaauucgaaaccgacacaggcgacgaccucgccauacgccaaaacacaaaauucacccccgucggcgucauccaaucguccgaccaccaccgcgacgaaccacaacaauggagacuccccaacuacuccggugccaacacuuuuaacguccaccuagcccccgcaguagcacccaacuucccuggcgaacaacuccuauucuuccgaucgacacuccccggcugcggcggucaucccaacauggaccuggauugccuacuuccacaagaauggguccaacacuucuaccaagaagccgcacccgcccaaucagacguugcccuacuacgauucguaaacccagacacaucccgaguccucuuugaaugcaaacuccacaaaagcggcuacgucacagucgcccacaccggucaacacgaccucguaauaccaccaaacggauacuuccgcuucgacucgugggucaaccaauucuacacccuagcgccaaugggcaacggcacaggacggaaacgcuaa

SEQ ID NO: 39142 - RNA, 1614 nt, Artificial Sequence
  derived and/or modified sequence opt11 from VP1__Norovirus_and/or_Norovirus-like__KX514308
augaaaauggccaguuccgaugccaaccccucugacggcucuaccgcaaaccucguacccgaagucaauaacgaagucauggcccuugaaccagucgucggcgcagccaucgccgcaccagucgccggacaacaaaacgucaucgaccccuggauacgaaacaacuucguccaagccccuggcggcgaguucacuguuucuccccgcaacgcgcccggagaaauccucuggucagcaccccuaggccccgaccucaaccccuacuuaucccaccuagcucgaauguacaauggcuacgccggcggguucgaaguccaggucauccuugccggcaacgccuuuacagcugguaaaaucaucuucgccgcagucccacccaacuuccccacagaaggccuaucacccucccaagucaccauguucccacacaucaucguagacguccgccaacucgaaccuguccuaauaccucuaccagacgucagaaacaacuucuaccacuacaaccaguccaacgacuccaccauaaaacuaaucgcaaugcucuauaccccucuacgugcaaacaaccccggcgacgacgucuucacugucucuugccgaguccucacacgacccucacccgacuucgacuucauauuccuagucccgccaaccgucgaaucacgcacaaaacccuucucaguccccauccucaccguuggugaaaugaccaauucacgcuucccaaucaaccuagauaaacuuuuuaccggccccagcucagccaacguaguacaaccccaaaacggacgcugcacuauugacggcgaacuccucggcaccacccaacucuccagcguuaacaucugcaccuuccgcggagacguuacccacaucgguagcacccgacauuggacaaugaaccuagccucccccaacuggaacaacuacgacccuaccgaagaaacccccgcaccccuaggcacucccgacuucguaggaaaaauacacggcaugcuaacccaaaccacccaagaaaauggcucuacccgagcccaccgugccaccguauacgucggcagugccgacuucacacccaaacucgguaaaguccaauucgaaacugacaccgaagacgaccuugccauccgacaaaauaccaaauucacccccgucggcgucauccaauccuccgaucaucaccgagaugaaccccaacaauggcgccuccccaacuacagcggagcaaacacuuucaacguacaccuagcccccgccguagcaccaaacuucccuggagaacaacuccucuucuuccguucaacccuacccggcugcggcggccaccccaacauggaccucgacugccuccucccacaagaauggguucaacacuucuaccaagaggccgccccugcccaauccgacgucgcccuccuaagauucgucaaucccgacacuucaagaguccuauucgaaugcaaacuccacaaauccggcuacgucacagucgcucacaccggccaauacgaccucguacuccccagcaacggcuacuuccguuucgauuccuggguaaaccaauucuauacccuugccccaaugggaaacggaaccggccgacgccgcuga

SEQ ID NO: 39143 - RNA, 1614 nt, Artificial Sequence
  derived and/or modified sequence opt11 from VP1__Norovirus_and/or_Norovirus-like__KX514283
augaaaauggccucaaacgacgccaaccccucagacggcucagccgccaaucucgucccagaagucaacaacgaagucauggcccuagaacccguagucggagccgcaaucgccgcccccgucgccggccagcaaaacguaauagaccccuggauccgcaacaacuucguccaagccccaggcggugaguucaccgucuccccacgaaacgcaccaggcgaaauacuaugguccgcaccccucggucccgaccuaaacccauaccucagccaccuagcccgcauguacaacgguuacgccggcggauucgaaguccaagugauacuugcaggcaacgccuucacagccggcaaaauaauauucgccgccgucccuccaaacuuccccaccgaaggccucuccccaucucaagucacgauguucccacacauuauugucgacguccgacaacuagaacccguacucaucccgcugcccgacguccgcaacaauuucuaucacuauaaccaauccaaagacucaaccaucaaauuaauagccaugcucuacaccccgcuaagagcaaauaacgccggcgacgacgucuucaccgucucuugcagaguccuuacacgcccuucaccagacuucgacuucauauuccucgucccacccacagucgagucaagaucaaaacccuucuccguacccguacuuaccguagaagaaaugaccaauucccgcuuccccgucacccucgacaaacucuucaccggaccaucaucaaccauaguaguccaaccacaaaacggccgcugcaugaucgacggcgugcuccucggcacaacacaacucucccccguaaacaucuguaccuuccgaggcgacgucacccacccacgcgacuccacuauauauaccaugaaucucgccucaccuaacuggaacaauuacgacccaacagaagagauccccgcaccccucggcacacccgauuucacaggaaagauacagggcaugcucacccaaacaaccaaaggcgaaggcuccacccgcggccaccgcgccaccgucuacgucggauccgccgaguucacacccaaacuaggcaaaguccgauuugaaacugacacagaagacgaccucgucauacgccaaaacaccaaauucacaccagucgguguaauccaauccucagaccaccaccgcgacgaaccccaacaauggcgacucccaaacuacuccggcgccaacaccuucaacguucaccucgcccccgccgucgcccccaacuuccccggcgaacaacuacucuucuuccgcucaacacuaccaggcugcggaggacacccuaacauggaccuggacugccuacucccacaagaauggguucaacacuucuaccaagaagcagccccagcccaaucugacgucgcccuccuacgcuucguaaaucccgacacuucccgcguccuauucgaaugcaaacuccacaaauccggcuacgucacaguugcacacaccggccaauacgaccucguacuccccagcaauggcuauuuccgauucgacucaugggucaaccaauucuacacacuagcccccaugggcaauggcaccggccgucgccgguga

SEQ ID NO: 39144 - RNA, 1614 nt, Artificial Sequence
  derived and/or modified sequence opt11 from VP1__Norovirus_and/or_Norovirus-like__KX514194
augaaaauggccucaucagacgccaacccaucggauggcagcgccgccaaccucgucccugaagucaacaacgaaguaauggcccuagaaccugucguaggagccgccauagcagcaccagucgccgggcaacaaaacgucauagaccccuggauccgcaacaacuucguccaagcacccggcggagaauuuaccgucagcccccgcaacgcccccggagaaauacucugguccgcaccacuuggacccgaccucaacccauaccucucccaccuagcacgcauguacaacggcuaugccggcggcuucgaaguccaggucauccuagccggcaaugccuucacagccggcaaaaucaucuucgcagcaguaccacccaccuuccccaccgaaggacuuucccccucccaagugaccauguucccccacauuaucguagacguccgccaacuugaaccuguucucaucccccugcccgacguacgcaacaacuucuaccacuacaaccaaucaaacgauuccaccauaaaacuaaucgccaugcucuauacuccccuaagagccaauaacccaggcgacgacgucuucaccgucuccugucgcguccuuacccgcccaucccccgacuucgacuucaucuuccucgugcccccaaccgucgaaucccgaacuaaacccuuuuccguccccauccuaaccgucggcgaaaugacaaacucccgauucccaaucaaccuugaacgucuauucaccggccccagcuccgccaacgucguccaaccucaaaacggccgcugcaccaucgauggugaacuacuaggcaccacacaacugucaucagucaacaucugcaccuuccgaggcgaugucacucacauaggcuccacccaccacuggacaaugaaccuagcuucaccuaacuggaacaacuacgaccccacagaagaaacacccgcuccacucggcaccccugacuuugucggcaaaauccacggaaugcuaacacaaaccacacaaggaaacggcuccacgcgaggucacagagccacagucuacguuggcuccgccgaauuuacccccaagcucggaaaaguccaauucaaaaccgaaacagaucacgaucucgcuauccgucaaaacaccaaauucacccccgucggcgucauccaagaauccgaccaccaccgcgacgaaccccaacaauggcgacuccccaacuacucgggcgcaaacaccuucaacguccaccuagcacccgccgucgcccccaacuucccuggcgaacaacuccuauucuuucgaucaacccuccccggcugcgguggucaucccaacauggaccucgacugccuauuaccacaagaauggguccaacacuucuaccaagaagcugcuccagcgcaaucagacgucgcccuacuccgauucguaaacccagacaccagccgcguccucuucgaaugcaagcuacacaaauccgguuacguaaccgucgcccacaccggacaauacgaccucguacuccccucaaacggcuauuuccguuucgacucuuggguuaaccaauucuacacacuagcccccaugggaaacggaaccggacgaagacgcuaa

SEQ ID NO: 39145 - RNA, 1614 nt, Artificial Sequence
  derived and/or modified sequence opt11 from VP1__Norovirus_and/or_Norovirus-like__KY424340
augaaaauggccucauccgacgccaaccccuccgacggaagcgcagccaaccuaguacccgaagucaacaacgaaguaauggcacucgaacccgucgucggagccgccauagccgcccccguagccggacaacaaaauaucaucgauccauggauccgcaacaacuucguucaagcccccggaggcgaguucacugucuccccucgcaacgccccaggcgaaauccucugguccgcuccucugggacccgaccuaaaccccuaccucucccaccuaucccgcauguauaacggcuacgccggcggcuucgaaguucaagucauccuagccggcaacgcauucaccgccggaaaaguuaucuucgccgcagucccaccuaacuuccccaccgaaggccucucaccgucacaagucaccauguucccccacaucaucgucgauguccgacaacucgagccgguccucauuccccuacccgacguccgcaacaauuucuaccacuacaaccaaucacaugauuccacacucaaguuaauugcaaugcucuacacgccccuccgagccaauaacgccggcgacgacgucuucaccgucucuugcagaguacuaacccgcccaucucccgacuucgacuucauauuccuagucccaccaaccguugaaucccgcaccaaacccuucaccguacccaucuuaaccgucgaagaaaugagcaacuccagauucccaaucccccuugaaaaacuauacacaggccccuccucagccuucgucguccaaccccaaaacggccgcugcaccacugauggcguccuacucggcaccacacaacucuccgccgucaacaucugcaacuuccgcggcgaugucacccacaucgucgguucacaugacuacacuaugaaccuugccagccaaaacugguccaacuacgacccgaccgaagaaaucccagcaccauuaggcacuccagauuucguaggcaaaauccaaggccuccuuacccaaacaacacgcgcagacggaucaacccgggcccacaaagcuacugucuccaccggcuccguccacuucacacccaaacuaggcucaguccaguucaccaccgacaccaacaacgacuuucaaaccggccaaaacaccaaauucacccccgucggagucauacaagacggugaccaccaccaaaacgaaccacaacaauggguacuccccaacuacucaggccgcaccggccacaacguacaccuagccccagcugucgcacccacguuccccggcgaacaacuacuauucuuucgcucaacaaugccaggcugcucaggcuaccccaacaugaaccucgacugccuccucccacaagaguggguccuccacuucuaccaggaggcagcacccgcccaaucugaugucgcccuccucagauucguaaaccccgacaccggccgaguccuguucgagugcaaacuacacaaauccggcuacauaaccguagcccacaccgguccuuacgaccucguaaucccacccaacggauauuuccgauucgacuccugggucaaccaauucuacacccuugcccccaugggcaacggaaccggaagacgucgauaa

SEQ ID NO: 39146 - RNA, 1614 nt, Artificial Sequence
  derived and/or modified sequence opt11 from VP1__Norovirus_and/or_Norovirus-like__LC016606
augaaaauggccuccaacgacgccucccccucagacggcuccaccgccaaccuagucccagaagucaacaacgaaguaauggcacuggaacccguagugggagcagccaucgccgcccccguagccggccaacaaaacguaauagaccccuggauccgaaacaacuucguacaagcccccggcggagaguucaccgucagcccccgcaacgccccaggagaaauccucugguccgcaccacucggaccagaccuuaaucccuaccuuucccaccucgcccgcauguacaacggcuacgccggaggauucgaaguacaaguuauacucgccggcaacgccuucacugcaggaaaaauaaucuucgccgccguaccucccaacuucccaaccgaaggacucagccccagccaagucaccauguuuccacacaucauaguagacguccgccagcuagaacccguacucaucccucucccggacguacgcaacaacuucuaccacuacaaccaauccaacgacuccacaaucaaacucaucgcaaugcuauacacaccccuccgagcaaacaaugcaggagacgacgucuucaccguauccugccgaguccucacgcgucccucccccgacuucgacuucauauuccuuguaccacccaccgucgagucccgcaccaaacccuucaccguccccauacugaccguagaggaaaugacuaacucgagauuccccaucccccucgaaaaacucuucaccggcccauccucagcauucgucguacaaccccaaaauggaagauguaccacagacggaguacuacucgguaccacccaacucucacccguaaauaucugcaccuuccgaggcgacgucacacacauaaguggcacacacacauaucgcaugaaccuagccucccaaaacuggaacaacuacgacccgaccgaagaaauccccgcaccccuaggcacccccgacuucgucggcaaaauccaaggcaugcucacgcaaaccaccaaaggcgauggauccaccagaggccacaaagccaccguuucaacaggcucagucgacuucacacccaaacucggauccguacaauucgcaaccgauacaaacaacgauuucgagaccggccagaacaccagguucacacccgucggagucauccaagacggauccgcccaccgcaacgaaccacaacaauggguccucccagacuacuccggaaaaaccguccacaacguccacuuagccccggccguggccccuacauucccuggcgagcaacuccucuucuuccgcuccaccaugcccggcugcucaggcuaccccaacauggaucuagacugccuacucccccaagaauggguccaacauuucuaccaagaagccgcgcccgcacaauccgacgucgcacuacuccgauucguuaaccccgacacaggcagaguccucuucgaaugcaaacuacacaaaacgggauacgucaccgucgcccacaccggccaacacgaccuaguaaucccucccaacggcuacuuccgcuucgacuccuggguuaaccaauucuacacccuugcccccaugggcaacggcgccggucgucgccgcuaa

SEQ ID NO: 39147 - RNA, 1614 nt, Artificial Sequence
  derived and/or modified sequence opt11 from VP1__Norovirus_and/or_Norovirus-like__FJ537136
augaaaauggcauccucagacgcaaacccguccgauggcuccgcagcaaaccucguacccgaaguuaacaacgaagucauggcucuagaaccagucgucggagccgcaauugccgcgcccgucgcaggccaacaaaacauaauagacccauggauucgcaacaacuucguacaagcaccaggcggcgaauuuacugucuccccucgaaacgcccccggagaaauacucugguccgcuccccuaggaccagaccucaaccccuaccucucacaccuuucccgcauguacaacggauacgccgguggauucgaaguccaaguaauccuagcaggcaacgccuucaccgcuggcaaagucaucuucgcugccguaccacccaacuuccccaccgaaggccucucacccucccaagucaccauguucccccacaucaucguagacguccggcagcucgaaccuguccuaauaccccucccugacguccgcaacaacuucuaccauuacaaccaaucccacgacagcacccuaaagcucauagccaugcucuacaccccacuaagagccaacaacgcaggcgacgacgucuucacagugagcugccgcguccucacacguccaagccccgacuucgacuucauauuccucguacccccuaccgucgaaucccgaacaaagcccuucaccgucccaauacucaccgucgaagaaauguccaacucccgcuuccccaucccccuggaaaaacuauauaccgguccaucuuccgcauucgucguucaaccccaaaacggccgcugcaccaccgacggcguccuccucggcaccacacaacucuccgccgucaacaucugcaacuuccgaggcgacguaacacacauaguaggcucccacgacuacaccaugaaccuagucucccaaaacugguccaacuacgaccccaccgaagaaaucccggccccacucggcacaccagacuucgucggcaaaauccaaggccuccugacucaaaccacccgagcagacggcuccacccgcgcucacaaagcaacagucucaaccggcuccguccacuucaccccaaaacuugguucaguccaauucaccaccgacaccaauaacgacuuccagaccggacaaaacaccaaauucacccccgucgguguuauccaagacggcgaccaccaccaaaacgaaccccaacaauggguacucccaaacuacucuggccgaaccggacacaacguccaucucgcccccgcagucgcccccacauucccaggagaacaacuccuauucuuccguuccaccaugcccggcuguucaggauacccaaacaugaaccuagacugccuccucccccaggaauggguccuacauuuuuaucaagaagcagcaccggcacaauccgacguagcccuacuccgcuucguaaacccagacaccggccgcguucucuucgaaugcaaacuccacaaaucaggcuacaucaccguugcccacacaggacccuacgaccucgucaucccucccaacggcuacuuccgcuucgacagcuggguaaaccaauucuacacacuggcccccaugggcaacggaaccggccgccgacgcuaa

SEQ ID NO: 39148 - RNA, 1614 nt, Artificial Sequence
  derived and/or modified sequence opt11 from VP1__Norovirus_and/or_Norovirus-like__AY532117
augaaaauggccagcaacgacgccaaccccagcgacggauccaccgcaaaccucguccccgaagucaauaacgaaguaauggcccucgaacccgucguuggugccgccauagcagccccaguagcaggccaacaaaacguaauagacccauggauucguaacaacuucguccucggccccuggggugaauuuacagucucaccccgcaaugcucccggcgaaauccucugguccgccccacucggacccgaccucaaccccuaccuuucccaccucgcccgcauguacaauggcuacgccggagguuucgaaguucaaguaauucucgccggaaacgccuucacagccggaaaaaucauuuucgccgcagucccacccaacuuccccacugaaggacucucccccucccaaguaacaauguuuccccacaucaucgucgacgugagacaacuagaacccguauuaaucccacuaccagacguucgaaacaacuucuaccacuacaaccaauccaacgacucuacaauuaaacugaucgccaugcuguauacuccccuccgcgcaaacaaugccggagacgacgucuucaccguguccuguagaguacuuacccgucccucaccugacuuugacuucaucuuccucguaccacccaccgucgaaucccgcaccaaacccuucaccguccccauccucaccguugaagaaauguccaacucacgauucccgaucccccuugaaaaacuauacacuggacccucgucagccuucgucguacaaccccaaaacggacgcugcacaacagacggaguccuccucggaaccacccaacucuccgccguaaacauuugcacauuucgcggagauguaacccacauagccggcucacacgacuacaccaugaaccucgccucccaaaacuggaacaauuacgaccccacagaagaaauacccgccccucugggcacccccgacuucguaggcaaaauccaaggaguccuaacccaaacaacacgcgaagacggcuccacccgcgcucacaaagccaccgucucaacuggcucaguucacuucacacccaaacuaggcuccguccaauacacaacagacaccagcaacgacuuccaaaccggucaaaacaccaaauucacacccguaggcguuauccaagacggcaacaaucaccaaaacgaaccccaacaauggguacuacccaacuacagcggacguaccggccacaacguccaccucgcccccgccgucgcucccacguuccccggagaacaacuccuuuucuuccgcucaaccaugccaggcugcagcgguuaucccaacaugaaccucgacugccuccucccccaagaauggguacaacacuucuaccaagaagccgccccagcccaauccgacguagcccuccuccguuucgucaaccccgacaccggccgcguacucuucgaaugcaaacuccacaaaagcggcuacgucaccgucgcacacacaggacccuacgaccuagucaucccacccaacggauacuuucgcuucgacucaugggucaaccaauucuacacccucgcccccaugggaaacggcgccggccgucggcgauaa

SEQ ID NO: 39149 - RNA, 1614 nt, Artificial Sequence
  derived and/or modified sequence opt11 from VP1__Norovirus_and/or_Norovirus-like__KX514279
augaaaauggccuccaacgacgccaacccuuccgacgguucagccgccaaccucguccccgaagucaacaaugaagucauggcacuugaaccagucgucggcgccgcuaucgccgccccaguagcaggccaacaaaacgucauugauccauggauccgcaacaacuucguacaagcccccggcggcgaguucacagucucuccccgcaacgcacccggcgaaauacucugguccgccccacucggccccgaccuaaaccccuaccucucccaccucgccagaauguacaacggauacgccggcggcuucgaaguccaagucauccucgccggaaacgcauuuacugccgguaaaauaaucuucgccgccguacccccaaccuuccccaccgaaggucuaagucccucacaggucacaauguucccccacauaaucgucgacguccgccaacuagaaccuguccuaaucccacuacccgacguccgcaacaacuucuaucacuacaaccaauccaacgacucgacgaucaaacuaaucgccaugcuauacacaccccuccgagccaacaaccccggcgacgacgucuucaccguauccugccgagucuuaacccggcccuccccugacuucgacuucaucuuccucgucccacccaccguagaauccagaacuaaacccuucuccguccccauucuaaccgucggcgaaaugacaaacucccgauuccccaucaaccucgaacgacuauucacaggucccuccucagcaaacgucguccagccccaaaacggucgcugcaccaucgacggcgaacuccuuggaacaacccaacuaagcuccgucaacaucugcaccuuucgaggcgaugucacccaaaucggcucaacacaccacuggaccaugaaucuagcaucccccaacuggaacaauuacgaccccacugaagaaacaccggcaccccucggcacucccgacuucgucggaaaaauccacggcaugcuaacacaaacaacccaagaaaacggcucaacccgcgcccaccgcgccaccgucuacgucggcucagccgacuucacccccaaacucggaaaaguccaauucgagaccgacacagaagacgaccuugccauacgccaaaacacaaaauucacccccguaggcgucauacagucgagugaccaccaccgagacgaaccacaacaauggcgccuccccaacuacuccggugccaacacauuuaacguccaccucgccccagccgucgcccccaacuuccccggcgaacaauuacuuuucuuccgcucaacccuccccggaugcggcggccaccccaacauggaccucgauugccuacuaccucaagaauggguacaacacuucuaccaagaagcagcaccggcgcaaucagacguagcccuccuccgcuuuguaaacccagacacaucacgaguccuauucgaaugcaaacuccacaaaucaggcuaugucaccguagcacacaccggacaauacgaccuaguccuccccuccaacggcuacuuccgcuucgacuccugggucaaccaauucuauacccuagccccaaugggcaauggaacaggccgccgccgguaa

SEQ ID NO: 39150 - RNA, 1614 nt, Artificial Sequence
  derived and/or modified sequence opt11 from VP1__Norovirus_and/or_Norovirus-like__LC016602
augaaaauggccuccaacgacgcaucucccuccgacggcagcaccgcaaaccuagucccggaagucaacaacgaaguaauggcccucgaaccuguagucggcgcagccauagccgcacccguagccggccaacaaaacgucaucgacccauggauccgcaacaacuucguacaagcccccggcggugaguucacuguaucaccccgcaacgcacccggugaaauacuaugguccgcaccccucgguccggaccuaaaccccuaccuaagccaccucgcccgaauguacaacggcuacgccggcggauucgaaguccaaguaauccuugcaggcaaugccuucaccgcaggcaaaauaauuuucgccgccguaccaccaaacuuccccaccgaaggacucucccccagccaagucaccauguucccccacauaauagucgauguacgccaacuagaaccuguccuaaucccacucccagacguccgcaacaacuucuaccacuacaaccaauccaaugacagcaccaucaaacuaaucgccaugcucuauacaccgcuucgcgcaaacaacgccggcgacgacguauucacugucuccugccgaguccucacccgacccucacccgacuucgacuucauuuuccuagucccaccaaccguagaaucaagaacuaaaccauucaccguaccaauacucacaguagaagaaaugaccaacucacgcuucccaauaccucucgaaaaacucuucaccggccccuccuccgccuucgucguccagccacaaaacggucgaugcaccaccgacggaguccuacuaggcaccacgcaacucucuccaguaaacaucugcacuuuccgcggagacguaacccacauauccggcaccucaacauaccgaaugaaccucgcuucacaaaacuggaacaacuacgaccccaccgaagaaaucccugcaccccuaggcacacccgauuuuguaggcaaaauccagggcaugcucacccaaaccaccaaaggcgacggcuccacccgcggccauaaagccaccguguccacgggcucagucgacuucaccccuaaacucggcagcguacaauucgauacagacaccaacaacgaccuagaaaccggacaaaacacacgcuucacaccagucggagucauacaagacgguuccgcacaccgcaaugaaccccaacaauggguccucccugacuacagcggccgaaccguccacaacguucaucucgcccccgccgucgccccaacauucccaggagaacaacuccuauucuuccgcuccaccaugccaggaugcucaggcuacccuaauauggaccuagauugucuacucccccaagaauggguacagcacuucuaccaagaagccgcccccgcacaauccgacgucgcccuccuccgcuucguaaacccagacacaggccgaguccucuucgagugcaagcuccacaaaacaggcuacgucaccguugcccacaccggccaacacgaccuagucaucccucccaacggcuacuucagauucgacuccugggucaaccaauucuacacacucgcacccaugggcaacggcgccggccgacgccgcuaa

SEQ ID NO: 39151 - RNA, 1614 nt, Artificial Sequence
  derived and/or modified sequence opt11 from VP1__Norovirus_and/or_Norovirus-like__AF145896
augaaaauggccagcucagacgccaaccccuccgacggaucagcagccaaccucguccccgaaguuaauaacgaaguaauggcccucgaacccgugguaggcgccgcaaucgccgcacccgucgcaggccaacaaaacaucaucgaccccuggauccgaaacaacuucguccaagcccccggcggcgaguucaccgucucaccccgaaacgcccccggcgaaauccucugguccgcaccccugggcccagacuuaaacccuuaccucucccaccucucccgcauguacaacggauacgccggcggcuuugagguccaagucauccuugccggcaacgcauuuaccgccggaaaagucaucuucgccgccguaccucccaauuuccccaccgaaggccuaucccccucccaagucaccauguucccucauaucaucguagacguaagacaacucgaacccguccuaaucccacuccccgacguucgcaacaacuuuuaccacuacaaccaaucccacgauucuaccuuaaaacucaucgccaugcuauacacuccccuccgagccaacaacgcgggcgacgacgucuucaccguaucaugccgcguccucacccgccccucacccgacuuugacuucauauuccuugucccacccacagucgaauccagaacaaaacccuucacaguccccauccucaccgucgaagaaaugucaaauucccgcuuccccaucccacucgaaaaacuauacaccggcccaucguccgccuucguuguucaaccacaaaacggccgcugcaccaccgacggcguccuccucgguacuacccaacuauccgccguaaacaucugcaacuuccgcggagacgucacccacaucgucgggucacacgacuacaccaugaaccuagccucccaaaacugguccaacuaugaccccacagaagaaauccccgcaccccucggcacccccgacuucgucggcaaaauacaaggacuacuaacccagacaacccgcgccgacggcuccacacgagcccacaaagccaccgucuccaccggcucaguccauuucacacccaaacucggcuccguucaauucaccaccgauacaaacaacgacuuccaaaccggccaaaacacaaaauucacccccgucggagucauccaagacggcgaccaccaucaaaacgaaccccaacaauggguccuccccaacuauuccggcagaacaggccacaacguccaccuagcccccgccgucgcaccgacauuccccggcgagcaacuacucuucuuccgauccaccaugcccggcugcucaggcuaccccaacaugaaccucgacugccuacuaccccaagaguggguccuucacuucuaccaagaagccgcucccgcacaaucagacgucgcccuccuacgcuucguaaaccccgacacaggacgcgucuuauucgaauguaagcuccacaaaucuggcuauaucaccgucgcucauaccggcccuuuugaccuagucauucccccaaacggcuacuuccguuucgacagcugggucaaccaauucuacacccucgcuccgaugggcaacggaacaggccgccgccgguaa

SEQ ID NO: 39152 - RNA, 1614 nt, Artificial Sequence
  derived and/or modified sequence opt11 from VP1__Norovirus_and/or_Norovirus-like__AB684704
augaagauggcaucguccgacgccaacccuucagacggcucagccgccaaccuaguaccugaagucaacaacgaggucauggcccucgaacccgucgucggcgcagccaucgccgccccugucgcuggccaacaaaacaucaucgacccauggaucagaaauaacuucgugcaagcccccgggggcgaguucaccguaucgccccgcaacgcaccaggcgaaauacucugguccgccccacuauccccugaccucaacccauaccucucccaccuuucccgcauguauaacggauaugccggcggauucgaaguccaagucauccuagcaggcaaugcauucaccgcuggaaaaguaaucuucgcagcagucccacccaacuuccccaccgaaggccuaagccccucccaaguaaccauguuuccccacaucaucgucgacguccgccaacucgaacccguucuuauaccucuacccgacguucguaacaacuucuaccacuacaaccaagcucacgacuccacccuaaaacuaaucgccaugcucuacacuccacuccgcgcaaacaacgccggagacgacguauuuaccguauccugccgcguacuuacacgccccucccccgacuucgacuucauuuuccucguuccucccacaguagaaucccggaccaaacccuucacuguccccauucucaccguggaagaaaugucaaauucaaaauuccccauaccccucgaaaaacuauacaccggacccucauccgcuuucguaguccaaccccaaaacggacgcugcacaaccgauggcguacuacuuggaacuacccaacuauccgccgucaacaucuguaacuuccgcggcgacgucacacgagucgguacaucccacgacuacaccaugaaccucguuucccaaaauuggaacaacuacgacccaacagaagaaauccccgcaccccucgguacccccgacuucguaggcaaaauccaaggccuccucacccaaaccacccgcgccgacggcucaacacgagcccacaaagcaaccgucuccaccggcuccguacacuucacaccgaaacucggaucuguacaauucaccaccgacacaaacaaugacuucgaaaccggucaaaacaccaaauuuacccccguaggugucauacaagacggcgaccaccaccaaaacgaaccacaacaauggguccucccuagcuacagcggcuccuccggucauaacguucaccuagcuccagcagucgcccccacauuccccggcgaacaacuccucuucuuccguucaaccaugcccggcugcucaggcuaucccaacaugaaccucgacugccuacuaccucaagaauggguacuccacuucuaucaagaagccgcccccgcccaaucagaugucgcacugcuccgcuucgucaacccagacacaggccgcguacuauucgaaugcaaacuccacaaaucaggauacaucacaguagcacacaccggccccuacgaucuagucauucccccaaacggcuacuuccgcuucgacuccuggguaaaccaauuuuacacccucgcccccaugggcaacgguacaggacgccgcagauaa

SEQ ID NO: 39153 - RNA, 1614 nt, Artificial Sequence
  derived and/or modified sequence opt11 from VP1__Norovirus_and/or_Norovirus-like__JX401279
augaaaauggccucuuccgacgcaaacccgucagacggcuccgccgccaacuuaguaccagaagucaacaacgaaguaauggcacucgaaccagucgucggcgccgcaaucgcagccccugucgccggccaacaaaacauuaucgaccccuggauccgcaacaacuucguccaagcccccggaggcgaguucaccguaucaccccgaaacgcccccggggaaauucuaugguccgccccucuaggacccgaccucaacccauaccucucccaucucucucgcauguacaacggcuacgccggcggauucgaaguacaaguuauacucgcaggaaaugccuucaccgcaggcaaggucaucuucgccgccguaccacccaacuuccccaccgaaggccucucacccucccaagucaccauguucccccacaucauagucgacguacgccaacucgaaccgguacuaaucccgcuccccgacguccgaaacaacuucuaccacuacaaccaagcccacgacucaacccucaaacuuaucgccaugcucuacaccccacuucgcgccaauaacgccggcgacgacgucuucaccgucuccugucgcguacuaacaagacccucucccgacuucgauuucauauuccucgucccucccaccguagagucccgcacaaaaccauucaccguuccaauccucaccgucgaagaaauguccaacucccgcuuccccauuccacucgaaaaauuauacacaggccccucaucagccuucgucguacagccacaaaacggccguugcaccaccgacggcgucuuacuaggaaccacacaacucucggcagucaacauaugcaacuuccgcggcgacguuacuagagucggcaccucccacgacuauaccaugaaccucgucucgcaaaacuggaacaacuacgaccccacagaagaaauccccgcuccucuaggcacccccgacuucguaggcaaaauucaaggccuccucacacaaaccacacgcgccgacggcagcacacgagcccacaaagccacagucuccaccggaucaguccacuucacaccuaaacucggcuccguacaauucaccacugacacagacaaugacuuccaaaccggccaaaacaccaaauucaccccagucggcgucauccaagacggcgaucaccaccaaaacgaaccacaacaauggguccucccuaacuacucuggcaccuccggccacaacguacaccucgcccccgccgucgcacccgccuucccaggcgaacaacuccucuucuucagauccaccaugccaggcugcagcggcuacccaaacaugaaccuagauugccuccucccccaagaauggguccuccacuucuaccaagaagccgccccugcccaauccgacgucgcauugcuacgcuucgugaacccagacaccggacgaguccucuucgaaugcaaacuacacaaaagcggcuacaucacaguugcacacacaggaccauacgaccucguaauaccacccaacggauauuuccgauucgacucauggguaaaccaauucuacacccuagcccccaugggcaacggcacaggacgccgccgcuaa

SEQ ID NO: 39154 - RNA, 1614 nt, Artificial Sequence
  derived and/or modified sequence opt11 from VP1__Norovirus_and/or_Norovirus-like__GQ389627
augaaaauggccuccaaugacgcuaaccccuccgacgguucaaccgccaaccucgucccugaagugaauaacgaagucauggcgcuagaaccagucgucggcgccgccaucgcugcccccgucgccggucaacaaaacgugaucgaccccuggauaagaaauaacuuuguccaagcaccuggcggcgaguucaccgucuccccucgcaacgccccaggagaaauacucuggucagcuccccuaggccccgaccuaaaccccuaccuaucacaccucgcccgaauguacaauggcuacgccggcggcuucgaaguccaaguaauccuagccggcaacgcauucacagcaggaaaaaucauuuucgccgcagucccacccaacuuccccacagaaggucucucucccucccaggucaccauguucccccacaucaucgucgacguccgccaacuugaaccaguacucaucccccuccccgacgucaggaacaacuucuaucacuacaaccaauccaacgacucaaccaucaaacucaucgcuaugcucuacacaccccuccgcgccaacaacgccggagacgaugucuucaccgucucuugccgaguucucacccgccccucccccgauuucgacuucauauuccucgucccacccaccgucgaaucccgcaccaaacccuuuaccguccccauccucaccguagaagaaauguccaacucucgcuuccccaucccacuugaaaaacuauacaccggccccuccuccgccuucguaguacaaccccaaaacggacgaugcaccaccgacgguguccuacucggcaccacacaauuauccgcagucaacaucugcacauuccguggcgacguaacacacaucgccggaucccacgacuacacaaugaaccucgccucucaaaacuggucaaacuacgacccaaccgaagaaaucccugcccccuuagguacacccgacuucgucgguaaaauccaaggcaugcuuacgcaaaccacgcgugaagacggaucaacccgugcccacaaagcaacugucuccaccggauccguccauuucaccccaaaacuagggucaguccaauacacaaccgacaccaacaacgacuuucaaaccggacaaaacaccaaauucacccccguaggagucauccaagacggcaacaaccaccaaaacgaaccccaacaauggguccuacccaacuacagcggccguacaggccacaacguccaccuagcucccgcaguagcucccaccuuccccggugaacaacuccuauucuuucguuccaccaugcccggcuguucaggauaccccaacaugaaccuagauugccugcucccccaagaauggguccaacacuuuugccaagaagccgcucccgcccaaucggacguagcacuacuccgcuuugucaacccagacaccggccgagucuuauucgaaugcaaacuccacaaaucuggauacgucaccgucgcccacaccggaccccaugaccuagucaucccacccaacggauacuuccgauuugacucauggguuaaccaauucuacacccucgcccccaugggaaauggagcaggccgccgucgcuaa

SEQ ID NO: 39155 - RNA, 1614 nt, Artificial Sequence
  derived and/or modified sequence opt11 from VP1__Norovirus_and/or_Norovirus-like__AF425763
augaaaauggcaucaaacgacgccaaccccuccgacggguccacagcuaaccucguacccgaagucaacaacgaagucauggcccuagaacccgucguaggagcagccaucgcagcucccgucgccggccaacaaaacgucauagaucccuggauaagaaacaacuucguacaagcaccccggggcgaguucacagucagcccccgcaacgcccccggcgaaauccuaugguccgcaccacucggacccgaccuaaaccccuaccucucccaccucgcccgaauguacaacggauacgccggcggcuucgaaguacaaguaauccucgccggaaacgccuucaccgccgguaaaaucaucuucgccgcgguacccccaaacuucccaaccgaaggacucucccccagccaagucacgauguucccccacauuauuguagacgucagacaacucgaacccguucucaucccccuccccgacguacgcaauaacuuuuaccacuacaaucaaucaaacgauucuaccaucaaacuaauagccaugcccuacacaccccuccgcgccaacaacgcaggcgacgacgucuucaccgucuccugccgaguccuaacccgcccauccccagacuucgacuucaucuuccuagucccacccacaguagaaucccguacaaaacccuucaccguccccauccucaccgucgaagaaauguccaacucaagauuccccaucccccucgaaaaacuuuacaccgggccaucauccgccuucgucguacaaccucaaaacggucgcugcacaacagacggcguccuccucgggaccacucaacuaucagccgucaacauaugcacauuccgcggcgacguaacccacauugccggaucacacgacuacaccaugaaccucgcaucacaaaacuggaacaacuacgaccccaccgaagaaauaccagccccacucgguacccccgacuucguaggaaagauccaaggcaugcucacacaaacaacuagagaagauggcucuacccgagcccacaaagcgacagucucaaccggauccguccacuucaccccgcgccucggcucuguccaauacaccaccgacaccaacaacgacuuccaaacaggccaaaacaccaaauuuacccccguaggcguaauacaagacggcaacaaucaucaaaacgaaccacaacaauggguacuacccaacuacuccggccgaacaggccacaauguccaccucgcuccagccgucgcucccacauuccccggcgaacaacuccuauucuuccgcucuacuaugcccgggugcucuggauacccaaacaugaaccucgacugccuccucccacaagaauggguccaacacuucuaccaagaagccgccccggcccaaucagacguagcccuccuacgauucgucaacccagacacaggacgcguccuuuucgaaugcaaacuccacaaaucaggcuacgugaccgucgcacacaccggcccacacgaccucguaaucccacccaacggauacuuccgauucgacuccugggucaaccaauucuacacauuagcccccaugggcaacggagcgggccgccgacgauaa

SEQ ID NO: 39156 - RNA, 1614 nt, Artificial Sequence
  derived and/or modified sequence opt11 from VP1__Norovirus_and/or_Norovirus-like__AY532127
augaaaauggccuccaacgacgccaaucccucagacggcuccacugcaaaccuugucccugaagucaacaacgaaguaauggcacuagaacccgucguaggcgccgccauagcugccccagucgccggccaacaaaauguuaucgacccauggauacgaaacaacuucguccaggcccccggcggcgaguucacaguaagcccccgaaacgcacccggcgaaauacucugguccgccccucuaggcccugaccucaauccauaccucucucaccuagcacgaauguacaauggcuacgccggcggauucgaaguccaagucauccuugccggcaaugccuucacugccggcaaaaucauauuugccgccgucccacccaacuuccccacagaaggccuauccccaucccaaguaaccauguucccacacaucaucgucgacguccgccagcuagaaccaguccuuaucccccuuccugacggccguaacaacuucuaccauuacaaccaauccaacgacuccacaauaaaacuaaucgcaaugcuauacacuccacuaagagccaacaacgccggcgacgacgucuucacggucucaugccggguccuaacgcggcccucccccgacuucgacuucaucuuccucgucccacccaccguagaauccagaacaaaacccuucaccguaccaauccucacuguugaagaaaugucuaacucccgcuuccccaucccccucgaaaaacuauacaccggucccuccuccgcauucgucguccaaccccaaaacggccgcugcaccacagacggaguccuccuuggcacaacacaacucuccgcugucaacauaugcacauuccgaggcgacgucacacacauugccggcucacacgacuacaccaugaaccucgccucccaaaauuggaacaacuacgaccccaccgaagaaauccccgccccacuaggcacccccgacuucguaggcaaaauccaaggaacacuaacccaaacaacccgcgaagacggcuccacccgcgcccacaaagcaaccguauccacgggcucuguucauuucacccccaaacucggcuccgcucaguacaccaccgacacaaacaacgacuuccaaacaggccaaaacaccaaauucaccccugucggcgucauccaagacggaaacaaccaccaaaacgaaccccaacaauggguacuacccaacuacuccggccgcacaggccacaacguccaccuagcaccggccgucgccccaaccuuccccggcgaacaacuacuuuucuucagaucgaccaugcccggcugcucaggauaccccaacaugaaccucgacugucuacuaccacaagaauggguacagcacuucuaccaagaagcagcccccgcccaauccgacguagcccuacuccgauucgucaaccccgacacaggccgcguccuauucgaaugcaaacuccacaaauccgguuacgucaccguagcccacaccggcccccacgaccuaguaaucccucccaacggcuacuuccgauucgacuccugggucaaccaauucuacacccucgcccccaugggcaacggagcaggacgacgacgcuga

SEQ ID NO: 39157 - RNA, 1614 nt, Artificial Sequence
  derived and/or modified sequence opt11 from VP1__Norovirus_and/or_Norovirus-like__AY532118
augaaaauggccuccaacgacgccaaccccuccgacggcagcaccgccaaccuaguccccgaagucaacaacgaagucauggcccuugaacccgucgucggcgcugccauugccgcccccgucgcaggacaacaaaacauaaucgacccauggauccgcaacaauuucguccaagcacccggcggcgaguucacugucagcccacgcaacgcccccggcgaaauacuaugguccgcaccccucggcccagaccucaacccguaccucucacaccucgcccgaauguacaacggcuacgcuggcggauucgaaguccagguaauccucgcaggaaacgccuucaccgccggcaaaauaauauucgccgccguacccccaaacuucccuaccgaaggccucggcccgucacaagucacaauguucccccacaucaucgucgacguccgccaacuagaaccaguccucaucccacuccccgacgucagaaacaacuucuaccacuacaaccaaucuaacgauuccacuauaaagcucauagcaaugcucuacaccccgcuccgcgcaaacaacgccggcgacgacgucuucacagucucaugcagaguccucacucgucccucuccagacuucgacuucaucuuccucguacccccuaccgucgaauccaggaccaaacccuuuacagucccuauccucaccgucgaagaaaugucuaacucucgauucccggucccacucgagaaacucuacaccggcccauccuccgccuucgucguccaaccccaaaacggacgcugcaccacugacggaguccuccucggcacaacccaacucuccgccguaaacaucugcaccuuccgcggagacgucacccacauagccggcucccgugacuacaccaugaaucucgcuucccaaaacuggaacaacuacgaccccacagaagaaauccccgcaccccucggcaccccagacuucguaggcaaaauacaaggcguucucacacaaaccacaagagaagacggauccacccgugcccacaaagccaccgucuccacaggcucgguccacuucacuccaaaacucggcucgguacaauacaccaccgacaccgacaacgacuuccaaaccggccaaaacaccaaauuuacacccgucggugucauccaggacgguaauaaccaccaaaacgaaccccaacaauggguacuccccaacuacuccggccgacccggccacaacguccaccucgcccccgcaguagcccccaccuuccucggagaacaacuccucuucuuccgcuccaccaugccuggaugcucaggcuauccaaacaugaaccuugacugccuacucccccaagaauggguacaacacuucuaccaagaagccgccccagcacaauccgaugucgcauuacuucguuucgucaaccccgacaccggccgcguccucuucgaaugcaaacuccacaaaucaggcuacgucacaguagcacacaccggcccccacgaccuagucauaccacccaacggcuacuuccgauucgacuccugggucaaccaauucuacacacuugcccccaugggaaacggugcaggccgccgcagauaa

SEQ ID NO: 39158 - RNA, 1614 nt, Artificial Sequence
  derived and/or modified sequence opt11 from VP1__Norovirus_and/or_Norovirus-like__KX514326
augaaaauggccuccaacgacgccaacccaucagacggcucugccgcuaaucuuguacccgaagucaacaaugaaguaauggcacuagaacccgucgucggcgccgccaucgccgccccagucgccggccagcaaaacgucaucgaccccuggauccgcaacaacuucguccaagcacccggaggcgaguucaccgucaguccacgaaacgcccccggcgaaauacucuggucagcuccccucggcccagaucugaacccauaccuaucgcaccuagcccgcauguacaacggcuacgccggcggauucgaaguccaaguaauccuagccgguaacgcauucaccgcgggcaaaaucaucuuugcugccguacccccaaacuucccuacagaaggccuaucccccucccaagucaccauguucccccacaucaucgucgacguccgucaacuagaacccguccucauaccccuccccgauguccgcaacaauuucuaccacuacaaccaaaguaacgacuccaccauuaaacucaucgccaugcuauacacaccacucagagccaacaaccccggugacgacguuuucacaguauccugcagaguacucacccgacccucccccgacuucgacuucauauuccucgucccaccaaccgucgaaucacgcacuaaaccauuuuccguccccauacuuaccgucggcgaaaugacaaauucccgauuccccaucaaccucgaacgccucuucaccgggccaucguccgccaaugucguccaaccacaaaacggccgcugcaccauagacggagaacuacuuggcacaacccaacucagcuccgucaacaucugcacauuccgcggagacguaacacaaaucggcuccaccaaacacuggacaaugaaccucgcuucuccuaacuggaauaacuacgaccccacagaagaaacucccgcacccuuaggcacaccugacuucguaggcaaaauccacggcauguuaacacagaccacccaggaaaacggcagcacccgagcccacagagccacuguguacgucgguggagccaauuucacccccaaacucggaaaaguccaauucgaaaccgauaccgucgacgacuuagaaauccgucaaaacaccaaauucacacccgucggagucauccaguccucagaccaccaccgcgacgagccccaacaauggcgccuacccaacuacucaggcgccaacacauuuaacguacaccuugccccugcagucgcccccaacuuccccggcgagcaacuccucuucuuccgauccacacuucccgggugcggcggccacccaaacauggaucucgacugccuccucccccaagaauggguacaacacuucuaccaagaagccgcccccgcccaauccgacgucgcccuacuccgcuucguaaaccccgacaccucaagaguacucuuugaaugcaaacuacacaaauccggcuacgucacaguagcccacaccggccaguacgaccuaguacuccccucaaacggcuacuuccgauucgacuccugggucaaccaauucuacacacucgccccaaugggcaacggcacaggaagacgccgauaa

SEQ ID NO: 39159 - RNA, 1614 nt, Artificial Sequence
  derived and/or modified sequence opt11 from VP1__Norovirus_and/or_Norovirus-like__KX514264
augaaaauggccuccaacgacgcaaacccuucugacggcucugcagccaaccucguucccgaagucaauaacgaagucauggcacucgaaccgguugucggagccgccauagccgcacccgucgcaggccaacaaaacgucaucgacccauggauccgcaacaauuuugugcaagcacccgggggcgaauuuaccgucagcccccgcaacgccccaggcgaaauccucugguccgcgccccuaggaccagaccucaaccccuaccucucccaccuagcccgcauguacaacggauacgccggcggcuucgaaguucaaguuauccucgcuggcaacgccuucaccgccggcaaaaucaucuucgcagccgucccacccaacuuucccaccgaaggccucagcccaucccagguaacaauguucccacacaucaucgucgacguacgucaacucgaacccguccucaucccacuacccgacguccgcaacaacuucuaccacuauaaccaaucaaacgauuccaccaucaaacuaaucgccaugcuauacacaccccuacgugcuaacaacccaggagacgacguauuuaccguaucgugcagaguccucacacgccccuccccugacuucgacuucauauuccucgucccacccacaguagaaucacgaaccaaacccuucagcguccccauccucacaguaggcgaaaugacaaacagccgcuucccagucaaucuugaaagacuauucacaggcccauccucugcuaacgucguccaaccccaaaacggccgaugcacaauugacggagaacuacugggaaccacacaacucucaucaguuaacaucugcaccuuccgcggcgacgucacccacaucggaucaacccaccacuggaccaugaacuuagccucacccaacuggaacaacuacgaccccaccgaagaaacccccgcuccccuaggcacccccgacuucguuggcaaaauccacggcaugcucacccaaaccacacagggcuccggcucaacccgagcccacagagccaccgucuacguaggcuccgccgaauuuacccccaaacucggcaaaguacaauuccaaacagaaaccgaagacgaccuagucauccgccaaaacaccaaauucacccccgucggagucauccaagaauccgaccaccaccgagacgaaccccaacaguggcgccuccccaacuacucaggagccaacaccuucaacguccaccucgcccccgcuguagcccccaacuuccccggagaacaacuuuuauucuucagaucaaccauccccggaugcggcggacaccccaacaugaaccuagacugccuccucccccaagaauggguccaacacuucuaucaagaagcagcccccgcccaauccgacguagcgcuacuccgauucgucaauccagacacaucgcgcguccucuucgaaugcaaacuccacaaauccggcuacgucaccgucgcccacacaggucaacacgaccucguaauacccccaaacggcuacuuccgguucgacucaugggucaaccaauucuacacccucgcacccauggguaacggcaccgguagaaaacgcuaa

SEQ ID NO: 39160 - RNA, 1614 nt, Artificial Sequence
  derived and/or modified sequence opt11 from VP1__Norovirus_and/or_Norovirus-like__KX514171
augaagauggcaucaaacgacgccaaucccuccgacggaucagcagcuaaccuuguaccagaaguaaacaaugaaguaauggcccucgaaccaguugucggcgcagccaucgcugcccccgucgccggacaacaaaacguaaucgauccauggauccgaaacaacuucguccaagcccccggcggcgaguucaccgucuccccucgcaaugcccccggagaaauccuuugguccgcaccccucgguccagacuuaaaucccuaccucucacaccuugcacgcauguacaacggcuacgccggcggcuucgaaguccaagucauucuugccggcaacgccuucaccgccggaaaaauaaucuucgcagcaguacccccuacauuucccaccgaaggccuaucgcccucccaaguaacaauguucccccacaucauagucgacguccgccaacucgaaccaguccuaaucccacuacccgacguccgcaacaacuucuaccauuacaaccaaagcaacgacuccaccaucaaacucauagccaugcucuacacaccacuccgggccaacaaccccggugacgacguuuucacaguauccugccgaguccucacccgccccagccccgacuucgacuucauuuuccucgucccucccaccgucgaaucacguaccaaaccauucucuguuccaauacucacaguaggagaaaugacaaacucccgauuccccgucaaccucgaaagacucuuuaccggccccucaucagcaaacgucguucaaccacagaauggccgcugcacaaucgacggcgaacuccucgggacaacccaacuaagcucaguaaacauaugcaccuuccgcggagacgucacucacauaggaacaacccaacacuggaccaugaaucucgcaucgcccaacuggaacaacuacgacccaacagaagaaacacccgcaccccucggaacgccugacuucgucgguaaaauacacggcaugcuaacacaaaccacacaaggaucaggcuccacccgagcacacagggccacugucuacguaggauccgccgaguucacccccaaacuaggcaaaguccgcuucgaaaccgacacagaagacgaucucgucauucgacaaaacaccaaauucacacccguaggcgucauacaauccagcgaacaccaccgagacgaaccccaacaauggcgccucccaaacuacucaggcgcuaacacuuucaacguccaccucgcccccgccgucgcccccaauuuccccggagaacagcuacuauucuuccgauccacccuacccggaugcggcggccacccaaauauggaccuagacugccuccucccucaagaauggguccagcacuucuaccaagaagcagccccagcccaaagcgacgucgcccuauuaagauucgucaacccagauaccagccgaguacuauucgaaugcaaacuccacaagagcggauacguaaccguagcccacacaggccaauacgaccucguacuaccaagcaacggauacuuccgcuucgacuccuggguaaaccaguuuuacacccuagccccgaugggcaacggaacaggccgccgccgcuga

SEQ ID NO: 39161 - RNA, 1614 nt, Artificial Sequence
  derived and/or modified sequence opt11 from VP1__Norovirus_and/or_Norovirus-like__KX514170
augaaaauggccuccaacgacgcaaaucccuccgacggcucagccgccaaccucguccccgaagucaacaacgaagucauggcccucgaacccgucgucggcgcagccaucgccgcaccagucgcuggccagcaaaacgucaucgaccccuggauucguaacaacuucguacaagccccuggcggcgaguucacagugucaccccgaaacgcccccggggaaaucuuaugguccgcuccccucggacccgaccucaacccauaccucucccaccuagcccguauguacaacggcuacgccggcggauucgaaguacaaguuauacuugccggcaacgccuucaccgccggcaagaucaucuucgcagccgucccacccaccuuucccaccgaaggacucuccccaucccaagucaccauguucccccacauaauagucgacgucaggcagcuagaaccaguccuuaucccacucccagacguccgcaauaauuuuuaccacuacaaccaauccaacgacuccaccauaaagcucaucgcaaugcuuuauacaccacuacgcgccaacaacccaggcgaugacgucuuuacagucagcugccgaguauuaacccgcccauccccagacuuugauuuuaucuuucuuguucccccaaccgucgaaucacgaacaaaaccauucucaguuccaauccucaccgucggcgaaaugacaaacucacgauucccagucaaccucgaacgacucuucaccggucccagcuccgcaaacguaguccaaccacaaaacggccgcugcaccaucgacggcgaacuucuggggacaacgcaacucuccuccgucaacauaugcaccuuccgcggcgacgucacccacaucggcaccacccaacacuggaucaugaaccucgcaucccccaacuggaauaacuacgaccccaccgaagaaacccccgcaccccuaggcacccccgacuucgucggcaaaauacacggaaugcucacacaaaccacccaaggauccgguagcacccgcgcccaccgagcaaccgucuaugugggcucagccgaguucacaccaaaacuuggaaaaguacgcuucgaaaccgacaccgaagaugaccucguaauccgccaaaacaccaaauucacccccgucggugucauccaaagcuccgaacaccacagagacgaaccacaacaauggcgacuacccaauuacuccggcgccaacaccuucaacguccaccuagcuccagccguagcacccaacuucccaggagagcaacuacucuucuucagauccacccucccgggcugcggaggucaccccaacauggaccucgacugccuacucccccaagaauggguacagcacuucuaccaagaagccgccccagcacaauccgacguagcacuccuacgcuucguaaaccccgacaccucacgaguacuauucgaaugcaaacuccacaaauccggauacgucaccguagcccacaccggccaauacgaccuaguacuccccucaaacggguacuuccgcuuugacuccugggucaaccaauucuacacccucgcccccaugggaaacggcaccggaagacgccgcuaa

SEQ ID NO: 39162 - RNA, 1614 nt, Artificial Sequence
  derived and/or modified sequence opt11 from VP1__Norovirus_and/or_Norovirus-like__KF806533
augaaaauggccucuaacgacgcaucuccaucagauggaucugccgccaaccucguccccgaagucaacaacgaaguaauggcccuagaacccgucgucggagccgccauagccgcacccguagcaggccagcaaaacgucaucgaccccuggauccgaaauaauuucguucaagcgcccggaggagaguucaccguauccccacgaaacgcaccgggcgaaauccucuggagcgcuccccucggacccgaccucaaccccuaucucucccaccucgcccgaauguacaacggcuaugccggcggauuugaaguccaagucauccuagcaggaaacgccuucacugccggcaaaaucauauucgccgccguaccucccaacuuccccacugaaggccucucccccucucaaguaaccauguucccccacauaguaguugacguccgccaacuugaacccguccucaucccccuccccgacguccgcaacaacuuuuaccacuacaaccaaucuaaagaccccacaaucaaacuaauagccaugcuguacaccccacuacgcgccaauaacgccggcgaagacguuuucaccguauccugccgaguccucacccgccccucccccgacuucgauuucaucuuccucgucccacccaccgucgaaagccgauccaaacccuucaccguccccauccucacagucgaagaaaugacaaacucccgcuuccccaucccccucgaaaaguuauucacaggaccuuccuccgcuuucgucguccaaccacaaaacggccgcugcaccacagacggcguccuccuaggcaccacccaacuuaguccagucaacaucugcacauuccgcggcgaccucacccacuucgcaggcacacacgaauacgccaugaaccucgcaucccaaaacuggaccaacuacgacccaaccgaagaaauaccagcuccccuaggcgcccccgacuucgucggaaaaauucgcggcguacucacccaaacaacccguggcgacggauccacccggggccaccgcgccacacucucuaccgguagcgcccacuuuacccccaaacuaggcucuguccgcuucuccaccgauaccaacaacgacuucgaagccggacaaaacaccaaauuuaccccagucggcgucuuucaagacggcgacaaccaccaaaacgaaccacaacaauggguccuuccuaacuauucaggagccaccgcccacaacguacaccucgccccugccguagcacccgccuucccuggcgaacaacuccucuucuuccgauccaccaugcccgguugcuccggcuaccccaacaugaaccucgacugccuacuaccccaagaauggguccaacacuucuaccaagaagccgccccugcccaaucagacgucgcacuccuacgcuucguaaauccugacacuucacgcguccucuucgaaugcaagcuacacaaauccggauacguuacagucgcccacaccggccaacacgaccuagucaucccaccaaacggcuacuuccgcuucgacuccugggucaaccaauuuuacacacuugcccccaugggcaacggcaccggacgaagacgcuaa

SEQ ID NO: 39163 - RNA, 1614 nt, Artificial Sequence
  derived and/or modified sequence opt11 from VP1__Norovirus_and/or_Norovirus-like__KF806528
augaaaauggccagcaacgacgcuuccccaucagacggcucagccgccaaccucguacccgaagucaacaaugagguaauggcucucgaacccgucgucggggccgcaaucgccgcccccgucgccggacaacaaaacgucauagaccccuggauacgaaacaacuucguccaagcacccggaggugaguucaccgucucaccucgaaacgcacccggagaaauacuaugguccgcaccacucggcccugaccuaaaccccuaccuuucgcaucucgccagaauguacaacggcuacgccgggggauucgaaguccaaguaauccuagccggcaacgccuucaccgccgguaaaauaaucuucgcugccguuccacccaacuuccccacugaaggacucucccccucacaagucacaauguucccccacaucgucgucgacgucagacaacucgaaccaguccucauaccacucccagacguccgcaacaacuucuaccacuauaaccaauccaaagaccccacaaucaaacucaucgcaaugcuuuacacuccccuccgcgcuaacaacgccugggaagacgucuucaccgucucaugccgaguccugacgcgccccucacccgacuucgacuucauauuccucguucccccaaccgucgaaagccgcagcaaacccuucaccguccccauccucacagucgaagaaaugacaaauagccgcuuuccaaucccucucgaaaaacucuucacaggccccuccggcgcauucgucguacaaccccaaaacggccgaugcacaacagacggcguacuacuuggcacaacacaacugucacccgucaacauaugcacauuccgcggcgaucuaacccauuucgccggcacccacgaauacgccaugaaccucgccucccagaacuggaacaacuacgacccuaccgaagaaaucccagcaccacucggugccccagacuucguaggcaagauucgaggcguacuaacccaaaccacccgacgcgacgguucgacccgcggccaccgagcuacgcucuccaccggcucagcacacuucacucccaaacuaggcuccauccguuucucaaccgacacaaacaacgacuucgaagccggccaaaacaccaaauucacccccgucggagucuuucaagacggugacaaccaucaaaacgagccucaacaaugggucuuaccuaacuacucaggcgccaccgcccacaauguucaucuagcacccgccguagcaccagccuucccaggcgaacaacuacuauucuuucgcucaacaaugccaggcugcagcggauaccccaacaugaaccuugacugucuccucccccaagaauggguccagcacuucuaccaagaggccgcccccgcccaaagcgacguagcccuacugcgcuucgucaaccccgacaccagccgcguacucuucgaaugcaaacuacacaaaucaggauacgucaccguagcacauaccggccaacacgaccucgucauuccuccaaacggcuacuuccguuucgacuccugggucaaccaauucuacacacucgcccccaugggaaacggcacaggccggcgacguuaa

SEQ ID NO: 39164 - RNA, 1614 nt, Artificial Sequence
  derived and/or modified sequence opt11 from VP1__Norovirus_and/or_Norovirus-like__KF806527
augaaaauggccuccaacgacgccucaccaucagacgguucugcagcaaaccuagucccagaagucaacaacgaagucauggcccucgaaccagucgucggcgccgccauagcagcccccguagccggacagcaaaacguaaucgacccuuggaucagaaacaacuucguccaagcccccggcggcgaguucaccgucuccccaagaaacgcacccggagaaauccuauggucugcaccgcuaggcccugaccuaaaucccuaccuaucccaccuagcccgcauguacaauggcuacgccggcggcuuugaaguccaaguaauccucgccggcaacgccuucacugcuggaaaaaucaucuucgcugcugucccacccaacuuucccaccgaaggacucucacccucccaaguuacuauguucccccacaucgucgucgacguacgucaacucgaaccgguccucaucccacucccugacgugcgcaacaacuucuaccacuacaaucaaucaaaagaccccaccauaaaacucaucgccaugcucuacaccccacuccgcgcaaacaacgcaggagaagacgucuucacugucuccugcagaguccuaacccgcccauccccagacuucgacuucauauuccucgugcccccaacagucgaaucacgcuccaaaccauucacaguccccauucuaaccgucgaagaaaugaccaacucccgcuucccaaucccucucgaaaaacucuuuaccggccccuccuccgccuucguaguccaaccacaaaacggucgcugcaccaccgacggcguccuccucggcaccacucaacuaucucccgucaacaucugcaccuuccgaggagaccucacccauuucgcaggcaccuccgaauacgccaugaaccucgcaucccaaaacuggaccaacuacgaccccaccgaagaaauacccgcccccuuaggcgccccggacuucgucggcaaaauacgaggaguacucacccaaacaacccguggcgacggcuccacaagaggccaccgcgccacccuuuccaccggcagcgcccacuucacacccaaacucggcucuguccgcuucuccaccgacacaaacaacgacuucgaggccggacaaaacacaaaauuuacacccguaggcgucuuccaagacggcgacaaccaccaaaacgaaccccaacaauggguccucccaaacuacagcggagccaccgcccauaacguacaccuagcacccgcaguagccccagcguucccaggcgaacaacuacucuucuuccgcuccaccaugcccggcugcucuggcuaccccaacaugaaucucgacugccuccuaccacaagaauggguccaacacuucuaccaagaagccgcgccggcccaauccgacguagcucuccuccguuucgucaaccccgacaccucccguguucucuucgaaugcaaacuccauaaaucaggcuacgucaccguagcgcacaccggacaacacgaccuuguaauacccccaaacggauacuuccgauucgacuccugggucaaccaauucuacacacucgcacccaugggcaacggcacaggacgacgccgcuaa

SEQ ID NO: 39165 - RNA, 1614 nt, Artificial Sequence
  derived and/or modified sequence opt11 from VP1__Norovirus_and/or_Norovirus-like__KX514261
augaaaauggcauccagcgacgcuaauccaucagacggcuccgcagcaaaccuuguacccgaaguaaacaacgaagucauggcacucgaacccgugguaggagccgccaucgccgcccccguagccggccaacaaaacgucaucgaccccuggauccguaacaauuucguccaagcacccggcggcgaguucaccgucucaccccgcaacgccccaggcgaaauacucugguccgcaccccucggaccagaccucaauccuuaucuaucccaccucgcccgcauguacaacggauacgcaggcggcuucgaaguccaagucauccucgccggaaacgcauucaccgccgguaaaaucauauucgccgcagucccacccaccuucccaacagaaggucucucacccucccaagucaccauguucccacacauaauuguagacguacgccaacucgaacccguccucauaccccuaccagacguccgcaacaacuucuaccacuacaaccaaucaaacgacuccaccauuaaacucaucgccaugcuuuacacaccacuccgcgccaacaauccaggagacgacgucuucaccguaucaugccgaguccucacccguccuucccccgacuucgauuucaucuuccucgucccgcccaccgucgaaucucgaaccaaaccauucucaguccccauccuaacuguaggcgaaaugaccaacucucgauuccccgucaaccuugaacgccuauucacaggaccuucgucagccaacguaguccaaccacaaaauggacgcugcacaauagacggcgaacuacuaggcaccacccaacucaguucugucaacaucugcacuuuccgcggagacguaacucacauaggaagcacacaccacuggaccaugaaccucgcauccccaaacuggaacaacuacgacccaacagaagaaacaccagccccacucggcaccccagacuucgucggcaaaauccacggcaugcuuacacaaaccacccaaggcuccggauccacccgugcucaccgcgccaccgucuacguaggaucugccgaguucacacccaaacuugggaagguccaauuccaaaccgaaaccgaagacgaccuagucauccgccagaacacaaaauucaccccugucggcgucauccaagaauccgaccaccaucgcgacgaaccccaacaauggcgacucccuaacuacuccggcgccaacaccuucaacguccaccucgccccagcagucgccccaaacuucccaggcgaacaacuucuauucuuccgcuccacacugccuggcugcggcggacaccccaauauggaccucgauugccugcucccccaagaauggguacaacauuucuaccaagaagcagcacccgcacaauccgacgucgcacuucugcgcuucgucaaccccgacaccucacgcguccuauuugaaugcaaacuucacaaguccggcuauguaacaguugcucacacaggccaauacgaccucguacuacccuccaacggauacuucagauucgacagcugggucaaccaauucuacacacuugccccuaugggcaacggcacaggaagacgccgguaa

SEQ ID NO: 39166 - RNA, 1614 nt, Artificial Sequence
  derived and/or modified sequence opt11 from VP1__Norovirus_and/or_Norovirus-like__AB684720
augaaaauggccagcucagaugccaaccccucagauggcucaaccgccaaccuaguccccgaaguaaacaacgaagucauggcucucgaaccagucgucggcgccgcuaucgcagcacccgucgccggccagcaaaacgugaucgaccccuggaucagaaacaacuucguacaagcacccggaggcgaguucaccguaaguccccgcaacgcccccggugaaauccucuggucugccccacuaggccccgaccucaacccauaccucucacaucucucacgcauguacaacggcuacgccggcggcuucgaaguccaagucauccucgcaggaaacgccuucacagccggcaaaauaauauuugccgcugucccgcccaacuuccccacugaagggcucucccccucccaagucacuauguucccacacauaaucgucgacguacgacaacuagaacccguucucauaccccucccagacguccgaaacaacuucuaccauuacaaccaagcccacgacuccacccuaaaacuuaucgccaugcuauacacaccccuacgagcaaauaacgccggcgacgacguauucaccguauccugccgcguucuaacccgccccuccccugacuuugacuucauauuccuaguucccccaacagucgaaucccgcaccaaaccauucuccguccccauccuaaccguagaagagaugucaaacucccgcuucccaaucccccuagaaaaacucuacaccggccccucauccgccuucgucguacagccccaaaacggucgaugcaccaccgacgggguacuacucggaaccacacaacuuucagccguuaacaucugcaacuucagaggagacgucacccacauucgcggcucacgcgacuacaccaugaaucuugucucccaaaacuggaacaacuacgaccccacugaagaaauuccagccccucuaggcacaccggacuucgucggaaaaauccaaggacuacucacccaaaccacccgcgcugacggauccacacgagcccacaaagccaccgucuccaccggaucagugcacuucacacccaaacucggaucaguccaauucaccaccgacaccgacaacgacuuccaaaccggacaaaacacaaaauucacuccuguaggcgucauccaggacuccgaccaccaccaaaacgaaccucaacaaugggucuuacccaacuacuccggcgccagcggucacaacguacaccuagccccugccgucgcucccacauuccccggcgaacaacuacuauucuuccgcucgacaaugccaggcugcagcggcuaccccaacaugaaccucgacugccuccucccccaagaauggguucuacauuucuaccaagaagccgcccccgcccaaagcgacguagcccuacuccgcuucgucaauccagacaccggccgcguccucuuugaauguaaacuccacaaaucaggauacauaaccguagcacacaccggcccauaugaccuaguuaucccacccaacggcuacuuccgcuucgacuccugggucaaucaauucuacaccuuagcccccauggguaacggaaccggacgacgcagauaa

SEQ ID NO: 39167 - RNA, 1614 nt, Artificial Sequence
  derived and/or modified sequence opt11 from VP1__Norovirus_and/or_Norovirus-like__LC016605
augaaaauggcuagcaacgacgccucccccagcgacggcuccaccgccaaccucguccccgaaguaaacaacgagguuauggcccuagaacccguuguaggcgccgccauagcagccccagucgccggccaacaaaacgucauagaccccuggauacgcaacaacuucguccaagccccagguggagaguucacaguuucaccccgcaaugcaccaggagaaauccuaugguccgcaccacucggccccgaccucaaccccuaucuaucccacuuagcgcgcauguacaacggcuacgccggcggcuucgaaguccaaguaauacucgcuggcaacgcguucacagccggcaaaauaaucuucgcagccgucccacccaauuuccccacagaaggccucucacccucacaaaucacaauguucccccacaucauagucgacgucagacaacuagaacccguccucauaccccuaccugacguccgcaauaacuuuuaccacuauaaccaauccaacgauuccacaauaaaacuuaucgcaaugcuauacaccccacucagagccaacaacgccggcgacgacgucuucacagucuccugccgcguccucacccgacccuccccagacuucgacuucauauuccucguaccaccaaccguggaaagccgaaccaaaccauucaccguccccauacucacugucgaagaaaugaccaacucacgauuuccaauuccacucgaaaaacuauucaccggacccuccuccgcauucgucguccaaccccaaaacggacguugcaccacugacggaguccuccuugguaccacccaacugucacccgucaacauaugcaccuuccgcggagacgucacccacauaccuggaaccagaaccuaucgcaugaaccuagcuucacaaaacuggaauaacuaugaccccaccgaagaaauccccgcuccacucggcaccccagacuucgucggcaaaauccaaggcaugcucacccaaaccacaaaaggugacggcuccacccgcggccacaaagcaacagucagcacuggcuccgucgacuucacacccaaacucggcuccguccaauucgacaccgacaccaacaacgaccucgaaacaggacaaaacacacgcuucaccccagucggcgugauacaagauggcuccgcccaccgaaacgaaccccagcaauggguccucccugacuacucaggccgcacaguacacaacguacaucucgccccagccgucgcaccaacauuuccaggugagcaacuccucuucuuccgauccaccaugcccggcugcucuggcuaccccaacauggaccuugacugccuccucccccaagaauggguucaacacuucuaucaagaagccgccccagcccaauccgacguagcccuccuacguuucguaaaucccgacaccggccgcguccuuuucgaaugcaaacuccacaaaacaggauaugucacagucgcccacaccggacaacacgaccucgucauaccacccaacggauacuucagauucgacucuugggucaaccaauucuacacccucgcacccaugggaaacggcgcgggccgucgccgcuaa

SEQ ID NO: 39168 - RNA, 1614 nt, Artificial Sequence
  derived and/or modified sequence opt11 from VP1__Norovirus_and/or_Norovirus-like__KF806529
augaaaauggcauccaacgacgccagucccucagacggauccgccgcaaaccucguccccgaggucaacaacgaaguuauggcacuugaaccaguaguaggugcagccauagccgcccccguggccggacaacaaaacgucaucgaccccuggauccguaacaacuucguccaagcacccggaggagaguucaccguuucaccccgcaacgccccaggagaaauccuauggucagccccgcuuggccccgaccuuaaccccuacuuaucccaccuagcccggauguacaacggauaugccgguggauucgaaguacaagucauccucgccggaaacgccuucaccgccggcaaaaucaucuucgccgccguucccccaaacuucccaaccgaaggucuaucacccucccaggucaccauguucccccacaucgucgucgacguccgccaacucgaacccguccuaaucccccuacccgacguacgcaacaacuucuaccauuacaaucaauccaaagaccccaccaucaaacuaaucgcgaugcucuauacaccccuccgcgccaacaacgccggugaagacgucuucaccgucuccugccgaguccuaacaagacccucgccagacuucgacuuuaucuuccucgucccucccaccguagaaucccgauccaaacccuucaccguaccaauacuaaccgucgaagaaaugacaaacucucgcuuccccaucccccucgaaaaacuauucaccggccccuccggugccuucgucguucaaccacaaaacggccgcugcaccacagacggcguacuacuaggaacaacucaacuuucucccgucaacauuugcaccuuccgaggcgaccucacucacuucgccggcacccacgaauacgccaugaaccucgccucccaaaacuggucuaacuacgaccccacagaagaaaucccagcaccacuaggggcccccgacuucgucggcaaaauccgcggcguccuaacucaaacaacccgaggagacggauccaccaggggccaccgcgcaacacucagcacaggauccgcacacuucaccccaaaacuaggcagcauccgauucucuaccgacacaaacaacgacuucgaagcuggacagaacacaaaauucaccccugucggaguauuccaagacggagacaaccaccaaaacgagccccaacaguggguacucccgaacuacucaggcgccacugcccacaacguacacuuggcccccgccguagccccagccuuccccggcgaacaacuccuuuucuuccgcucuaccaugcccggcugcuccggauaccccgacaugaaccuugacugccuccucccccaagaauggguacaacacuucuaccaagaagcagcccccgcccaauccgacgucgcacuacuacgcuuugucaauccagacacuagccgcguccucuucgaaugcaaacuccacaaauccggauacgucaccguagcccacaccggccaacacgaccucgucaucccacccaacggcuacuuccgcuucgacucaugggucaaccaguucuacaccuuagcccccaugggcaacggaaccggccgccgccgauaa

SEQ ID NO: 39169 - RNA, 1614 nt, Artificial Sequence
  derived and/or modified sequence opt11 from VP1__Norovirus_and/or_Norovirus-like__JX023286
augaaaauggccuccucagaugcaaaucccucagacggcagcgccgcuaaccucgucccagaagucaacaacgaagucauggcucuggaaccuguuguuggcgcagcaauagccgcgcccgucgccggacagcaaaacauaauagaccccuggauacgcaacaacuucguccaagcccccggcggagaguucacuguaucuccccgcaacgcgcccggcgaaauccucuggucagccccacuagguccagaccuuaaccccuaccucucccaccucucccgcauguacaacgguuaugccggaggcuucgaaguccaagucauccucgccggaaacgcauucaccgcaggcaaagucauauucgcagccguacccccaaacuuccccaccgaaggccucucccccucgcaagucaccauguucccccacaucaucgucgacguuagacaacucgaacccguccucaucccacuccccgacguccgcaacaacuucuaucacuauaaccaagcccacgacucaacccucaaacucaucgccaugcucuacaccccacuccgcgccaacaacgcaggcgacgacguauucacgguuucaugccgaguccuuacccgucccucccccgacuucgacuucauauuccuagucccacccaccgucgaaagccgcaccaaaccauucaccgucccaauccuaacagucgaagaaauguccaacucacgcuucccaaucccgcuagaaaaacuuuacaccggacccagcuccgcauucgucguacaaccucaaaacggcagauguaccaccgacggcguccuucuaggcaccacccagcucuccgccgucaacaucugcaacuuccgcggcgacguaacacgagucggcaucucccacgacuacaccaugaaccucgucucacaaaacuggaacaacuaugaccccaccgaagaaauccccgcaccacuaggcacacccgacuucguagguaaaauacaaggacuccucacccaaaccacccgggccgacggcucaacacgugcccacaaagccacagucuccaccggaucuguacacuucaccccaaaacuaggcucuguccaauucaccaccgacaccaacaacgacuuccaaaccggucaaaacaccaaauucacacccgucggagucauucaagacggagaccaccaccaaaacgaaccacaacaauggguacuacccaacuacuccggaaccuccggucauaacguacaccuugcacccgccguagccccaacauuccccggcgaacaacuccucuucuuccguuccaccaugcccggcugcuccggcuacccaaacaugaaccuugacugccuucucccccaagaauggguacuucauuucuaccaagaagcagcccccgcccaauccgacguggcccuccuccgauuuguaaaccccgacacuggacgcguccucuucgaaugcaaacuacacaaaucuggcuacaucaccgucgcacacacugguccauacgaucuagucaucccacccaacggcuacuuccgcuucgauagcugggucaaccaauucuacacccuagccccaaugggaaacggcacaggacgccgaagauaa

SEQ ID NO: 39170 - RNA, 1614 nt, Artificial Sequence
  derived and/or modified sequence opt11 from VP1__Norovirus_and/or_Norovirus-like__FJ537137
augaaaauggccucaaacgacgccaacccauccgacggauccgcugccaaccucguacccgaagucaacaaugaagucauggcccuugaacccgucgugggagcagccauagccgcacccgucgccggccaacaaaacgucaucgaccccuggauccgcaacaacuucguacaagcccccggcggugaguucacugucucaccccguaacgcccccggcgaaauccuuugguccgcaccccucggcccagaccuaaaccccuaccuaucccaccucagccgcauguacaacggauacgccgguggcuucgaaguccaaguaauacucgcaggaaacgcauucaccgcaggcaaggucauauucgccgccguaccucccaauuuccccacagaaggccucuccccaucccaagucaccauguucccccacaucauagucgacgucaggcaacuagaaccaguucuaauuccccucccagacguucgcaacaacuucuaccacuauaaccaagcccacgacuccacacugaaacucaucgccaugcuauacaccccgcuucgcgccaacaacgcaggcgacgacgucuucaccguauccugccgcguccucacccgccccuccccagacuucgacuucaucuuccucguaccacccacaguagaaucucguacaaagcccuucacugucccaauacucaccgucgaagaaauguccaacucccgcuuccccaucccacuagaaaaacuuuacacaggcccaucuuccgcguucgucguccaaccucaaaauggacgcuguaccaccgacggcguccuuuuaggaaccacccaacucuccgcugucaacaucugcaauuuccgcggcgacgucacacacaucguaggcucacaugacuacacaaugaaccucguuucacaaaacugguccaacuaugaccccaccgaagaaauacccgccccacuaggcacacccgacuucguagguaagauccaaggccucuuaacacaaacaacccgagccgacgguuccacccgcgcccacaaagcgacagucuccaccgguucaguccacuucaucccaaaacucggcuccguacaauucaccacugacacaaacaacgauuuccaaacaggccagaacaccaaauucaccccagucggcguaauacaagacggcgaccaccaccaaaacgaaccccaacaauggguccuuccaaacuacuccggacgcaccggccacaacguccaccucgcacccgccgucgccccaaccuucccaggcgaacaacucuuauuuuuccgcucaacaguccccgguugcucuggauacccuaacaugaaccucgacugccuccucccacaagaauggguaucccacuuuuaccaagaagccgcacccgcccaaucagauguggcccuacuaagauucgucaaccccgauacuggacgcguucuauucgaaugcaagcuacacaaauccggcuacaucacagucgcccacaccggcccguacgaccucguucucccacccaacggcuauuuccgauucgacuccugggucaaccaauucuacacccuugcucccaugggcaacggaacuggcagaagacgcuaa

SEQ ID NO: 39171 - RNA, 1614 nt, Artificial Sequence
  derived and/or modified sequence opt11 from VP1__Norovirus_and/or_Norovirus-like__X76716
augaaaauggccuccaacgacgcaaacccauccgacggcuccgcagccaauuuaguccccgaagucaacaacgaagucauggcacuagaacccguaguaggugcagccaucgccgcucccgucgcaggccaacaaaacguaaucgacccauggauccgcaacaacuucguccaagcccccggaggcgaauuuacagucucccccagaaacgccccaggagaaauccucuggucagcuccccucggccccgaucuuaaccccuaccuaucccaccucucccgaauguacaacggauacgccggcggcuucgaaguccaaguaauccucgcaggcaacgccuucacagccggcaaagucaucuucgcagccguaccacccaacuucccaaccgaaggccuaucacccagccaggucacaauguucccacacaucaucguagauguacgucaacuagaacccguccucaucccccuacccgacguucgcaacaacuucuaccauuauaaccaagccaacgacagcacccuaaaacuaaucgccaugcucuacaccccacuccgagcaaacaacgccggcgacgacguauucacaguaucaugcagaguccuuacccgccccuccccagacuucgacuucauuuuccuagucccacccaccgucgaaucacgaaccaaacccuuuacuguacccguccucaccgucgaagaaaugucaaauucaagauuccccaucccccuugaaaaacuguacaccggccccuccuccgcuuucgucguacaaccccaaaacggcagaugcaccaccgacggcguacuacuuggcacaacucaacucuccgcugucaacaucugcaacuuccgcggugacguaacccacauagccggaucccacgacuacacaaugaaccuagcaucccaaaacuggagcaacuacgaccccacagaagaaauaccagcccccuuaggcacaccagacuucgucggcaaaauccaaggccuccucacccaaaccacacgagcagacggauccacacgagcccacaaggcuacaguauccaccggcuccguacacuucacccccaaacuaggaagcguccaauuuacaaccgacaccaacaacgacuuccaagcaggucaaaacaccaaauucacucccguaggcgucauccaagacggagaucaccaccagaacgaaccccaacaauggcuccuccccaacuauucaggacgaaccggccacaacguccaccucgcccccgccguagcucccacauuccccggcgaacaacuccuauucuuccggucaacuaugcccggcuguuccggauacccaaacaugaaccuugacugccugcucccucaagaauggguccuacacuucuaccaggaagcagcuccagcacaauccgacgucgcccuccuacguuucguaaacccagacaccggaagaguccuauucgaaugcaaacuucacaaguccggauauaucaccgucgcucacaccggccccuacgaccucguacuaccucccaacggcuacuuccgcuucgacagcugggucaaccaauucuacacucucgcccccaugggcaacggcacaggccgacgaagauaa

SEQ ID NO: 39172 - RNA, 1614 nt, Artificial Sequence
  derived and/or modified sequence opt11 from VP1__Norovirus_and/or_Norovirus-like__KX514328
augaaaauggccuccaacgacgcuaaccccucagacggcucagcggccaaccuaguccccgaaguaaacaacgaagucauggcucucgaaccaguagucggcgccgccaucgccgcccccguagccggucagcaaaacgucauugacccuuggauccgaaauaacuucguacaagcacccgggggcgaguucacagucucaccaagaaacgcacccggagaaauccuauggucagcaccccuaggucccgaccucaacccauaccucagccaccucgcccgaauguacaacggauacgccggaggcuucgaaguccaaguaauccuagccggaaaugcuuucaccgcuggaaaaauaauauuugccgccguaccgcccacauuccccaccgaaggccuaagccccucacaagucaccauguucccccacaucaucguugacguacgccaacuagaaccaguccuaaucccacuccccgacguacgcaacaacuucuaccacuacaaccaauccaacgacucaacgaucaaauuaaucgcuaugcuauacacaccccuccgugccaacaaccccggcgacgacguauucaccgucucaugccgcguccucacccgcccaucacccgacuucgacuucaucuuccuagucccacccacaguagaaucacgcaccaagcccuucagcguucccauccuaaccgucggcgaaaugacuaacucacgcuuccccaucaaccucgaacgccuauucacaggccccaguucagcaaacgugguacaaccucaaaauggacgcugcacaaucgacggagaacuccuuggcaccacacaacuaucauccguaaacaucugcaccuuccgcggcgaugucacacaaauaggcucuaccaaacacuggaccaugaaccucgccuccccaaacuggaacaacuacgaccccaccgaagaaacccccgcaccccucgguacccccgacuucguaggcaaaauacacggaaugcucacacaaacaacacaagaaaacggguccacccgcgcccaccgcgccaccgucuacgucggcggcgccaacuucacccccaaacuaggcaaaguacaauucgaaacugacacagucgacgaccucgaaauacgccaaaacaccaaauucaccccagucggaguuauccaauccucugaccaccaccgagacgaaccacaacaauggcgccuccccaacuacuccggcgccaacacauucaacguccaucuagcucccgccgucgcccccaacuucccuggcgaacagcuacucuucuuccgcucaacacuaccuggcugcggcggacacccaaacauggaccuagacugccuccucccacaagaauggguccagcacuucuaccaagaagccgcacccgcccaauccgauguagcucuccuacgauucgucaaucccgacaccucccgaguccuauucgaaugcaaacuucacaaguccggcuacguaaccgucgcccacaccggucaauacgaccuaguccuacccuccaacggauacuuccgauuugauuccugggucaaccaauucuacacccuagcacccaugggcaacggcacaggccgucgucgauag

SEQ ID NO: 39173 - RNA, 1614 nt, Artificial Sequence
  derived and/or modified sequence opt11 from VP1__Norovirus_and/or_Norovirus-like__KX514201
augaaaauggcuuccagcgacgcaaacccaagcgacggauccgccgcaaaccucguaccagaaguuaauaacgaaguaauggcacucgaaccugucgugggagcagccaucgccgcaccagucgcaggccaacaaaacgugaucgaccccuggauccgaaacaacuucguccaagccccaggcggcgaguucacagucucuccccgaaacgcucccggcgaaauacuaugguccgcaccccuaggccccgacuuaaaccccuaccuaucccaccuugcccgcauguacaacggcuacgccggcggcuucgaaguccaagucauccucgcuggaaaugcauucaccgccggcaaaauuaucuucgcagccguuccaccaacauuuccaaccgaaggccucucccccucacaaguaaccauguucccccacgucaucgucgacguacgccaacuagaacccguucucaucccccuccccgacguccgcaacaacuucuaccacuauaaccagucuaacgauuccaccauaaaacucauagccaugcuuuacaccccacucagagccaacaaccccggcgacgacguuuucaccguaucgugccgaguccuaacccgaccuucccccgacuucgacuucauuuuccucguacccccaaccgucgaauccagaaccaagccauucucaguaccgauccucaccgucggagagaugaccaacagccgcuuccccaucaaccuagaacgccucuucacaggcccgucauccgccaacguaguccaaccacaaaauggccgaugcacaaucgacggcgaacuccuaggcacuacccaacuuuccagcguuaacaucugcaccuuccgaggcgacgucacccacauaggcucuacucaccacuggaccaugaaccucgcaucuccaaacuggaacaacuacgacccaaccgaagaaaccccugcaccacucggcacccccgacuucguaggaaaaauccacggaaugcucacccaaacaacccaaggcuccggcuccacacgcgcacaccgcgccacagucuacgucggauccgccgaguucacccccaaacucggcaaaguucaauucaaaaccgaaacagaccacgaccucaccauacgucaaaacacuaaauucacaccaguaggcgugauccaagaauccgaccaccauagagacgaaccacaacaauggcgacugccuaacuacucuggcgccaauacuuucaacguccaucuugcacccgccguagccccuaacuucccaggcgaacaacuucucuucuucagauccacccuacccggcugcggcggacaccccaacauggaccucgacugccuucucccccaagaauggguacaacauuucuaccaagaagcagcccccgcacaauccgacguugccuuacuccgcuucgucaaccccgacacgucccgaguucuauucgaauguaaacuccacaaaucugguuauguaacagucgcccacacaggccaauacgaccuuguacuacccuccaacggcuacuuccgcuucgauagcugggucaaccaauucuacacccucgcccccaugggaaacggcacaggcaggcgccgcuaa

SEQ ID NO: 39174 - RNA, 1614 nt, Artificial Sequence
  derived and/or modified sequence opt11 from VP1__Norovirus_and/or_Norovirus-like__AB985442
augaaaauggcauccucugacgccaaccccuccgacggcucagccgccaacuuagucccggaagucaacaacgaggucauggcacucgaaccugucgucggagccgccaucgccgcccccgucgccggccaacaaaacauuaucgacccauggauccgcaacaacuuuguacaagcuccuggcggagaguucaccguauccccacgaaacgcacccggagaaauccucugguccgccccacuuggccccgaccucaaucccuaccucucccaccucucccgcauguacaacgguuacgccggcggcuucgaaguccaagucauccucgccggcaacgcauucaccgcaggcaaagucaucuucgcugcagucccacccaacuucccaaccgaaggccucagccccucccaagucaccauguuuccacacaucauagucgauguccgacaacucgaacccguucucauaccacuccccgacguccgcaacaacuucuaccacuacaaccaaucccacgacagcacucugaaacuaaucgcaauguuauacacaccccuccgagcuaacaacgccggagacgacguauucaccgucucuugcagaguacucacacgccccuccccagacuucgacuuuaucuuccucgucccucccaccguugaaucccgcaccaaacccuuuaccguccccaucuuaacagucgaagaaauguccaauucacgcuuccccaucccccucgaaaaacuauacaccggccccucauccgccuucgucguccaaccccaaaacggccgcugcacaaccgacggcguccuccuaggaacuacccaacucuccgcagucaauaucugcaacuucagaggagacguaacccacauagucggcucccacgacuacacaaugaaccucgccucccaaaacuggucuaacuacgaccccacagaagaaauacccgcaccacucggaacucccgacuucgucggcaaaauacaaggacuacgaacacaaacaacccgagccgacggaucaacccgcgcucacaaagccacaguuucgaccggcuccguccacuucaccccaaaacucggcucgguccaauucaccaccgacacaaacaacgacuuccaaaccggccaaaacaccaaauucacaccaguaggcgucauccaagacggagaccaccaccaaaacgaaccccaacaauggguccuacccaacuacucgggacgaacaggucacaacguucaccuagcccccgccgucgcuccuacauuccccggcgaacaacugcuuuucuuucgaagcaccaugccaggcugcagcggcuaccccaacaugaaccuagauugccuccuaccucaagaauggguccuacacuucuaccaagaagccgcccccgcccaaucugacguagcccuccuacgcuucgucaacccagacaccggacgcguccucuuugaauguaaacuccacaaauccggguacauaacuguagcacacaccggccccuacgaccucguaauacccccaaacggauauuuccgcuucgacucaugggucaaucaauucuacacacuagccccaaugggcaacgggaccggacgcagacguuaa

SEQ ID NO: 39175 - RNA, 1614 nt, Artificial Sequence
  derived and/or modified sequence opt11 from VP1__Norovirus_and/or_Norovirus-like__LC016604
augaaaauggcuuccaacgacgcaucccccucagacggauccacagcaaaccucgucccggaaguuaacaacgaagucauggcccuugaaccugucguaggcgcagccaucgccgcacccguagccggacaacaaaacguaaucgaccccuggauccgcaacaacuucguccaagcuccaggcggagaguucaccgucagcccccgcaacgcaccaggagaaauccucugguccgcccccuuaggccccgaccuaaacccauaccuaucccaccuagcucgaauguacaacggcuacgccggcggcuucgaaguacaagucauacucgcuggaaacgccuucaccgccggcaaaauaauauucgccgccgucccacccaacuuccccaccgaaggacugucccccucccaaguaacuauguucccccacaucaucgucgauguucgccaacucgaaccuguccucaucccacuacccgacguccgcaacaacuucuaccacuacaaccaaagcaacgacuccacaauaaaacucauagcaaugcucuacaccccacuccgugccaacaacgccggcgacgacguauucacagucucuugucgcguacucacacgucccucacccgacuuugacuuuauauuccucgucccacccacaguagaaucacgcaccaaacccuucacgguccccauccuaacagucgaagaaaugaccaacuccagguuccccaucccccucgaaaaacuauucaccggccccagcuccgccuucguuguccaaccccaaaacggacgaugcaccacagacggagugcuccucggcacaacccaacuuucccccgucaacaucugcaccuuucgcggcgaugucacucacaucccaggcacccgcaccuaccgcaugaaccucgcaucacaaaauuggaauaacuacgacccaaccgaagaaaucccagcaccccucggcaccccggacuucgucggcaaaauccaaggcaugcucacacaaacaaccaaaggcgacgguuccacacgcggccacaaagccacaguauccacaggcucugucgacuucacaccuaaacuagguuccguccaauucgacaccgacaccaauaacgaccuagaaaccggccagaauacacgcuucacaccggucggaguaauccaggacgguucggcccaccgcaacgagccacaacaauggguccuacccgacuacuccggccgcaccguccacaacguccaccuggcacccgccguugcaccaaccuuuccuggcgaacaacuacucuucuuucgcuccaccaugccuggcugcucgggcuaucccaacauggaccucgacugccuccucccccaagaguggguccaacacuucuaccaagaagccgcccccgcacaauccgacguagcacuacuacgcuucgucaaccccgauaccggacgaguccucuucgaaugcaaacuccacaaaaccgguuacgucacagucgcacauacaggucaacacgaccucgucauacccccgaacggauacuucagguucgacuccugggucaaccaauucuacacacucgcccccauggguaacggagcaggccgacgccgauaa

SEQ ID NO: 39176 - RNA, 1614 nt, Artificial Sequence
  derived and/or modified sequence opt11 from VP1__Norovirus_and/or_Norovirus-like__KF806532
augaaaauggcauccaacgaugccucccccuccgacgguucagccgccaaccuuguaccagaagucaacaacgaagucauggcuuuagaaccggucgucggcgcagccaucgccgccccaguagccggccaacaaaacguuaucgaccccuggauccgaaacaauuucguccaagccccaggcggcgaguucaccgucucaccccgaaaugcccccggcgaaauccuaugguccgcgccccucggucccgaccucaacccauaccucucacaccuagcccgaauguacaacggguacgccggcggcuucgaaguccaagucauccuagccgguaaugccuucacagccggcaaaaucaucuucgccgcagucccacccaacuuccccacagaaggccuaucccccucacaagucacaauguucccgcacauagucgucgacguccgucaacucgaacccguccuaaucccacuccccgacguccgcaacaacuuuuaccacuacaaccaauccaaagacccaacaaucaaacucaucgccaugcucuacacuccccuccgcgcaaacaacgccggcgaagacguuuucaccgugucaugccgcguccuuacccgacccuccccagacuucgacuucaucuuccucgucccacccacuguugaaucccgcuccaagcccuucacaguaccaauacucaccguagaagaaaugacaaauucccgauuccccauaccucucgaaaaacuauucaccggacccucauccgccuucgucguacaaccucaaaacggucgcugcaccaccgacggcguacuccucggaaccacccaacucucacccgucaacaucugcaccuuccgcggugaccuaacacacuucgcaggcacaucagaauacgccaugaaccuagccucucaaaacuggacaaacuacgaccccaccgaggaaaucccagcaccccuaggcgcaccugacuucgucggcaaaauccgcggaguccucacccaaacaacaagaagagacggauccacccgaggccaccgagcaacccucuccaccggcuccgcccacuuuacucccaaacucggcuccaucagauucucaacugacaccaacaacgacuucgaagcgggccaaaauaccaaguucacccccgucggcguauuccaagacggcgacaaccaucaaaacgaaccccaacaauggguacucccaaacuacuccggagccacagcacacaacguacaccucgccccagcagucgcuccagccuuccccggcgaacaacuacuauucuuccgauccaccaugcccggcuguucuggauaccccaacaugaaccucgacugccuucucacacaagaauggguccaacacuucuaccaggaagcagccccagcccaauccgacgucgcacuccuucguuuugucaacccagacaccucccgaguacucuucgaaugcaaacuccacaaaucaggcuacgucacggucgcucacacuggccaacacgaccuagucauacccccaaauggcuacuuccgauucgauuccuggguaaaccaauucuacacccucgcccccaugggcaaugguaccggccgacgucgcuaa

SEQ ID NO: 39177 - RNA, 1614 nt, Artificial Sequence
  derived and/or modified sequence opt11 from VP1__Norovirus_and/or_Norovirus-like__FJ537138
augaaaauggccuccucagacgccaaccccagcgacggcuccgcagccaaccucgucccugaagucaacaaugaagucauggcucucgaaccagugguuggcgcagcuaucgcagcacccgucgccggccaacaaaacguuauagacccauggauucgaaacaacuucguccaagcucccggcggcgaauuuaccgucuccccacgcaacgccccuggcgaaauucuauggucagccccacuuggucccgaccuaaaccccuaccuaucccaccuaucccgaauguacaauggauacgccggcgguuucgaaguacaggucauacucgcagguaaugccuucacagcaggcaaagucaucuucgcagccgucccacccaacuuucccaccgaaggccucucccccucccaagucaccauguucccccacauaauuguagacguccgccaacucgaacccguucuaaucccacucccagacgugaggaacaacuucuaccacuacaaucaagcacacgacuccacccucaaacucauagcaaugcucuacacaccccuacgcgccaacaacgccggcgacgacguauucaccguauccugccgcguacuaacccgccccuccccagacuucgacuucauauuccucgucccucccaccguugaaucccgcaccaaacccuucacggucccaauacucaccgucgaagaaaugagcaacucucgcuuccccaucccacucgaaaaacuauacacuggacccuccagcgcauucgucgugcaaccccaaaacggaagaugcaccaccgacggcguccuccucggcaccacacaacucucagccguaaacauuuguaacuuccgaggcgaugucacccgcgugggcauaucacaugacuacaccaugaaccucgucucccaaaacuggaacaacuacgaucccaccgaagaaaucccagcgccccucggcacacccgacuucgucggcaaaauccaaggccucuuaacacaaaccacccgagccgacgguucaacccgcgcacacaaagccaccgucagcacaggcuccguccauuucacacccaaacucggcuccguccaauucacaaccgacaccaacaaugacuuucaaaccggccaaaauaccaaauucacccccguaggcguaauacaagacggagaccaccaccagaacgaaccccaacaaugggugcuaccaaacuauucaggcaccuccggucacaacguacaccucgcccccgccguugcccccaccuuccccggagaacaacuccuauucuuccgcuccacaaugcccggcuguucagguuacccuaacaugaaccucgacugccuccucccccaagaauggguccuccacuucuaccaagaagccgcccccgcccaauccgacgucgcauuacuccgcuucgucaaccccgauacaggacgcguccucuucgaaugcaaacuccauaagucaggcuacaucaccgucgcccacacaggccccuaugaccucgucaucccucccaacggcuacuuccgauucgacagcuggguaaaccaauucuacacccucgcccccaugggcaaugguacuggacgacgucgguaa

SEQ ID NO: 39178 - RNA, 1614 nt, Artificial Sequence
  derived and/or modified sequence opt11 from VP1__Norovirus_and/or_Norovirus-like__AY030098
augaaaauggccucaagcgaugccaaucccucagauggcuccaccgcuaaccucguacccgaaguaaacaacgaagucauggcacucgaacccgucgucggagccgccaucgccgcccccguugccggccaacaaaacauaaucgacccuuggauccgcaacaacuucguccaagcacccggcggcgaauuuacggucucuccccgaaacgcccccggcgaaauccuauggagcgcaccccucggcccugaccuaaaccccuaccucucccaccuaucccgcauguacaacggcuacgccgguggcuucgaaguacaagucauccucgccggcaaugccuucacugcaggcaaaguuaucuucgcagccguacccccaaacuucccaaccgaaggacucuccccaucacaggucaccauguucccccauaucaucgucgacguccgccaacuagaacccgucuuaauaccucuacccgacguccgcaacaacuucuaucauuacaaccaaucccacgauucaacacuaaaacuuauagcuaugcucuacacaccacuacgggccaacaacgccggugacgacguguucaccgucagcugcagaguccucacccggcccucccccgacuucgacuucaucuuccucgugccucccacagucgaaucccgaaccaaaccauucaccguccccauucuuaccgucgaagaaaugucuaacucccgcuuccccaucccacuugaaaaacucuacaccggaccuuccuccgcauucgucguacaaccccaaaacggccgaugcaccacagacggcguacuacuagguaccacucaacucagcgccguaaacauuugcaacuuucgcggugacgucacccauauagucggaucccacgacuacaccaugaaccucgucucccaaaacuggucuaacuacgaccccaccgaagaaaucccagcaccccucggcacacccgacuucgucggcaaaauccaaggccugcucacgcaaaccacccgcgccgacggcucaaccagagcccacaaagccaccguuucaacagguuccguacacuucacccccaaacuuggauccguccaauucacaaccgacaccaacaacgacuuccaaaccggccaaaacacaaaauucacaccagucggcguuauccaagacggcgaccaccaccaaaacgaaccccaacaauggguccuacccgacuacucuggacgcacagggcacaacguacaccucgcucccgccguagcccccacauuccccggcgaacaacuccuauucuuccgaucaaccaugcccggcugcucaggcuaccccaacaugaaucucgacugccuacuaccacaagaauggguccuccacuucuaccaagaagccgcuccugcccaaucagacguagcccuacuccgauucguaaacccugacacaggccgaguccuauucgaaugcaaacuacacaaauccggcuacaucacagucgcgcacaccggaccauacgaccuagucaucccacccaauggcuacuuccgauucgacuccugggucaaucaauucuauacacuggcccccaugggaaacggaacaggacgccgcagauaa

SEQ ID NO: 39179 - RNA, 1614 nt, Artificial Sequence
  derived and/or modified sequence opt11 from VP1__Norovirus_and/or_Norovirus-like__AY532130
augaaaauggccagcaacgacgccaaccccagcgacggcucuaccgccaaccucguaccugaagucaacaacgaaguaauggcccuagaacccgucguaggcgccgccaucgccgccccagucgcaggccaacagaacaucauugacccauggauccgcaacaacuucguacaagcuccaggcggugaguucaccgucagcccccgaaaugccccaggcgaaauacucuggucagcgccccucggccccgaccuaaaccccuaccugucacaccucgcccguauguacaacggauacgccggcggcuucgaaguccaagucaucuuagccggcaaugccuccaccgcaggaaaaauaaucuucgccgcuguaccacccaacuuccccaccgaaggccucucacccucacaagucaccauguucccccacauaaucgucgauguccgccaacucgaacccguacucauaccccucccagacguccgaaacaauuucuaucacuacaaccaauccaacgacucaacaaucaaacucauagccaugcucuacacaccccuccgagccaacaacgcaggcgacgacgucuuuaccgucuccugucgaguccucacccgccccucaccagacuucgacuucaucuuccucgucccucccaccgucgaaucccgaauaaaacccuuuaccgucccaauacucacagucgaagaaauguccaacucucgcuucccuaucccccucgagaaacucuacacuggccccucaucggcauucgucguccaaccccaaaacggccgaugcacaacagacggcguacuccucggcacuacacaacucucggccguuaacauaugcaccuuccgaggcgacgucacccacauagccggcucccacgacuauaccaugaaccucgccucccaaaacuggaacaacuaugaccccaccgaagaaaucccugcaccccuaggcaccccagacuucgucggcaagauccaaggcaugcucacacagacaacccgcgaagacggaagcacacgcgcucacaaggcaaccgucuccacaggcuccgcccacuucacaccuaaacuaggcuccguccaauacaccacugacaccaacaacgacuuccaaaccggacagaacacaaaauuuacccccgucggcgucauccaagacggcaacaaccaccaaaaugaaccgcagcaauggguucucccaucuuacucgggucgcacaggacauaacguacaccucgcccccgccgucgcccccaccuuuccaggcgaacaacuacucuucuucagauccaccaugcccggcuguucgggauaccccaacaugaaccuagacugccuccuaccccaagaauggguccaacacuucuaccaggaagccgcccccgcacaauccgacguagcucuacuacgcuucguuaacccggacaccggccgcguccucuucgaaugcaaacuccacaaguccgguuacgucaccgucgcccacaccggcccucacgaucucgucaucccuccaaacggcuacuuccgcuucgacucaugggucaaccaauucuacacccucgcgccaaugagaaacggggccggccgccgcagauaa

SEQ ID NO: 39180 - RNA, 1614 nt, Artificial Sequence
  derived and/or modified sequence opt11 from VP1__Norovirus_and/or_Norovirus-like__KX514286
augaaaauggccucauccgacgcaaaccccuccgacggcuccaccgccaaccucgucccugaaguaaacaaugaagucauggccuuagaaccaguagucggcgccgccaucgcagccccggucgccggccaacaaaacguaauagaccccuggauccgaaacaacuucgugcaagcacccggcggcgaauuuacagucuccccuagaaaugcacccggagaaauccucugguccgccccacuaggccccgaccucaacccauaccucucccaccucgcacgaauguacaacggauacgccggaggcuucgaaguacaagucauucucgcaggaaacgccuucaccgccggaaaaaucauuuucgccgccguaccucccaccuuccccacugaaggccucucccccucccaagucacuauguucccccacauaaucgucgacguucgccagcucgaacccguccucaucccccuacccgacguccgcaacaacuucuaccacuauaaccaaucaaaugacucaacuauaaaacucaucgcaaugcuauacacaccccuccgagcuaacaacccuggcgacgacgucuucaccgucuccugcagaguacucacccgcccaucccccgacuucgacuucaucuuccucguaccacccaccgucgaaagccgcacaaaacccuucuccguacccauccucaccgucggcgaaaugacuaacucacguuuccccauuaaccucgaaagauuauucacuggacccucauccgccaaugucguccaaccccaaaacggccgcuguaccauugacggcgaacuccucggcaccacccaacucucaucagucaacaucuguaccuuccgaggcgaugucacacacauagguuccacccaccacuggaccaugaaucucgccucccccaacuggaacaacuaugaccccaccgaagaaacccccgcacccuuaggcacccccgacuucgucggaaaaauccacgguaugcucacacaaaccacccaggaaaacggcucaaccagagcccaccgcgccacugucuaugucggcuccgcagacuucaccccaaaacuuggcaaaguccaauucgaaaccgauaccgaagacgaccuagcaauccgccaaaacaccaaauucacucccgucggcgugauucaauccuccgaccaccaccgagaugaaccacaacaauggcgccuaccaaacuacucuggcgccaacacauucaacguacaccuagccccugcuguagcccccaacuuccccggcgaacaacuccuauucuuccgcucuacgcuacccgguugcggcggccaccccaacauggaccucgacugccuucucccucaggaauggguccaacacuucuaccaagaagcagcacccgcccaauccgacgucgcccuccuacgcuucgucaacccagacaccucacgcguccuuuucgaaugcaaacuccacaaaagcggcuacgucacaguagcccacaccgggcaauacgaccucguacuccccucaaacggcuacuuccgcuucgacuccuggguaaaccaauuuuacacccuagcccccaugggaaauggcacaggccgacgucgauaa

SEQ ID NO: 39181 - RNA, 1614 nt, Artificial Sequence
  derived and/or modified sequence opt11 from VP1__Norovirus_and/or_Norovirus-like__KX514202
augaaaauggcauccucagacgccaaccccuccgacgguuccgccgccaaccucguucccgaaguuaacaacgaagucauggcauuagaaccgguaguuggcgccgcaauagcagcacccguagccggccagcaaaacguaaucgaccccuggauccgaaacaacuucguccaagcaccaggcggcgaguucacggucucuccccgaaacgcaccuggagaaauauuaugguccgcaccacucggcccagaccucaaccccuaucuaucucaccucgcacgcauguauaacggcuacgcaggcggcuucgaaguacaagucauacuggcaggaaacgccuucacggccggaaaaaucaucuucgccgcagucccucccaccuuccccacagaaggauuaucucccucccaagucacgauguucccccacauaaucgucgacguacgccaacuagaaccaguacucaucccacuccccgacguccgaaacaacuucuaccacuacaaccaauccaacgacucuaccauaaaacucaucgccaugcucuacacaccccuccgcgcaaacaaccccggagacgacgucuucacagucuccugccgaguacucacccgccccagucccgacuucgacuucauuuuccucgucccucccaccgucgaaucccgcaccaaacccuucucaguacccauacuaaccgucggcgaaaugacuaacucccgcuucccuaucaaccucgaacgccucuucaccggacccucuucagccaauguaguccaaccacaaaacggccgcugcacaaucgacggcgaauuacucggcaccacccaacucuccuccguaaacaucugcacauuucgaggagacgucacccacaucggcucaacccaccacuggaccaugaaccucgcaucaccaaacuggaacaacuacgaccccaccgaagaaaccccagccccacucggcacccccgacuucgucggcaaaauacauggcaugcucacacaaaccacacagggguccggguccacgcgggcucaccgagcaacaguauacgucggcagcgccgaguucaccccaaaacucggcaaaguccaauucaaaaccgaaaccgaccacgaccuuaccauacgccaaaauacaaaauucacccccguaggagucauacaagaaucugaccaccaccgcgacgaaccacaacaauggcgccucccaaacuacuccggcgccaacaccuucaacguacaccucgccccagccguagccccgaacuucccaggcgaacaacuccucuucuuccgcuccacacugccaggcugcgguggccacccuaacauggaccucgacugccuucucccucaagaauggguacaacacuucuaccaagaagccgcuccggcacaaucagacguagcacuccuccgauucgucaacccagacaccucccggguucucuucgaaugcaaacuccacaaauccggauacgucaccgucgcccacacaggucaauacgaccucguccucccaucaaacggguauuuucgcuucgacagcugggucaaccaauucuacacacuagcaccaaugggcaacggcacaggccgccgccgauaa

SEQ ID NO: 39182 - RNA, 1614 nt, Artificial Sequence
  derived and/or modified sequence opt11 from VP1__Norovirus_and/or_Norovirus-like__DQ358208
augaagauggccuccaacgacgccaaccccucagacggcucggccgccaaccuaguccccgaaguaaacaaugaagucauggcauuagaacccguaguaggagccgccauagccgcccccgucgccgggcaacaaaaugucaucgaccccuggauccgcaauaacuucguccaagcacccggcggugaguucaccguuagcccccgcaacgccccaggcgaaauacuaugguccgcaccccuaggcccagaccuaaaccccuaucugucccaucuuucccgaauguacaacggcuacgccggcggcuucgaaguccaggucauccuugccggcaacgcauucacagccggcaaagucaucuucgccgccgucccacccaacuuccccaccgaaggcuuaucccccucccaagucaccauguucccccacaucaucguagacguacgccaacuagaaccaguucucauaccacucccggacguccgaaacaacuucuaccacuacaaccaagccaacgacucaacccuuaaacucaucgcaaugcucuacacaccucuacgugccaacaacgccggcgacgacgucuucacugucagcuguagaguccucacccgaccaucgccagacuucgacuucaucuuccuagucccucccaccguugaaucccgaaccaaacccuucacaguacccguauuaaccguugaagagauguccaacuccagauuccccaucccccucgaaaaacucuacaccgguccauccuccgccuucgucguccaaccccagaacggacgcugcaccacugauggcguauuacucggaacaacccaacuauccgccgucaacaucugcaacuuccgcggugacguaacccacaucgccggcucccacgacuacaccaugaaccucgccucacaaaacugguccaacuaugaccccaccgaagaaaucccugccccacucggcacccccgacuucguaggcaaaauccaaggacuacuaacacaaaccacccgcgccgacggcuccacucgcgcccacaaagcaacagucagcacaggcagcguccacuucacccccaaacucggaucaguccaguucaccaccgauaccaacaacgacuuccaggccggucaaaacacuaaauucacacccgucggcgucauccaagacggcgaccaucaccaaaacgaaccccaacaauggucccuucccaauuacuccggccgcaccggccacaacguccacuuagccccagccgucgccccaacauucccgggcgaacaacuucucuucuuccguagcacuaugcccggcugcucaggauaccccaauaugaaccucgacugccuucucccacaagaauggguccugcacuucuaccaagaggccgcccccgcacagucagacgucgcucuccuccgauucguaaaccccgacaccggccgcguacucuucgaaugcaaacuacacaaaucuggcuacaucaccguugcucauaccggaccauacgaccucguccucccucccaacggcuacuuccguuucgacucuugggucaaccaauucuacacacucgcccccaugggcaacggcacaggacgccgucguuga

SEQ ID NO: 39183 - RNA, 1614 nt, Artificial Sequence
  derived and/or modified sequence opt11 from VP1__Norovirus_and/or_Norovirus-like__AF414425
augaaaauggccuccaacgacgcaaacccguccgacggcucaaccgcaaaccucguccccgaagucaacaacgaaguaauggcccuagaaccgguaguaggagccgcaauagcggcacccgucgcaggccaacaaaacguaaucgacccuuggauccgcaacaacuuuguccaagcacccggcggcgaguucacagccucccccagaaaugcaccaggagaaauccucugguccgcaccccucggccccgaccucaacccauaccucucccaccuagcccgcauguacaacgguuacgccggagguuucgaaguccaagucauccucgccgguaacgccuucaccgcaggcaaaauaaucuuugcagccguacccccaaacuuccccaccgaaggacuaucacccagccaaguaaccauguucccacacauaauuguagacguccgccaacuagaacccguccucaucccccugcccgacguccgaaacaauuucuaccacuacaaccaaucaaacgacuccacuaucaaacucaucgcaaugcucuacacccccuuacgagcuaacaacgccggcgacgacguauucacugccucaugccgcgugcuaacucgucccuccccugacuuugacuucaucuuccuaguacccccaaccgucgaaucgcgcaccaaacccuucacaguccccauccucacagucgaggaaaugucaaacuccagauuccccauaccccucgaaaaacucuacaccggcccaucaagcgccuucguaguacaaccccaaagcggacgcugcaccaccgacggcgugcuucugggcacaacccaacuuuccgcagucaacaucugcaccuuccgcggagacgucacccacaucgcaggcucccacgacuacaccaugaaccuagcaucacagaacuggaacaacuacgaccccacugaagaaauacccgcgccccuagguacccccgauuucguaggaaaaauccagggaaugcucacacaaacaacccgcgaagacggcuccacccgagcccacaaagcgaccgucucaacaggcucaguccacuucacgcccaaauuaggcagcguacaauacaccaccgauaccaauaacgacuuccaaaccggccaaaacaccaaauuuacaccaguaggcgucauacaggacggaaacaaccaccaaaacgaaccccaacaauggguacuacccaacuauucuggcagaacgggccacaacguccaccucgcccccgccgucgcaccaacauucccaggcgaacaacuccucuucuucaaaucaacaaugccaggaugcuccggcuaccccaacaugaaccucgacugccuccucccccaagaauggguccaacacuucuaccaagaagcagcacccgcacaguccgacguagcacuacuacgguucguaaaccccgacaccggacgcguccucuucgaauguaaacuacauaaaucaggcuacguaaccgucgcacacacaggcccgcacgaucucguaauacccccaaacggcuacuuccgauucgauuccugggucaaccaauucuacacacucgcccccaugggcaacggcgcaggucgccgccguuaa

SEQ ID NO: 39184 - RNA, 1614 nt, Artificial Sequence
  derived and/or modified sequence opt11 from VP1__Norovirus_and/or_Norovirus-like__KX514348
augaaaauggccuccaacgacgccaaccccucugacggcuccgccgcaaaccuaguccccgaaguuaacaacgagguaauggcccuagaaccagucgucggugccgccauagcugcuccaguagcaggccaacaaaacgucauagaccccuggauccgaaacaacuucguccaagcacccggaggcgaguucaccgucucgccccgcaacgcccccggagaaauauuaugguccgcuccauuaggccccgaccuaaacccauaccucucccaccucgcccgcauguacaacgguuacgccggcggauucgaaguacaaguaauccuagcuggaaacgccuucacagcuggcaaaaucauauucgcagccgucccacccaccuuucccaccgaagggcucucacccucacaagucacaauguucccccacauaaucgucgacguacgucagcucgaacccguccucaucccccuccccgacguucgcaacaacuuuuaccacuacaaccaauccaaugacucaaccaucaaacucaucgccaugcucuacaccccacuccgagcaaacaacccaggagacgaugucuucaccguaucaugccgaguccuuacccguccaucaccagacuucgacuucaucuuucucguuccacccaccgucgaaucccgcacaaaacccuucagcguccccauccuaaccguuggcgaaaugaccaacucaagauuccccgucaaccuugaacgacucuucaccggccccuccuccgcaaacguagugcaaccccaaaacggccgaugcaccaucgacggcgaacuccuaggaacaacccaacucuccagcguuaacauaugcaccuuccgcggcgacgucacacaaaucggcucaaccaaacauuggaccaugaauuuagccucacccaacuggaacaacuacgacccaaccgaagaaacaccagcaccccugggcacccccgacuucgugggcaaaauacauggcaugcuaacccaaaccacccaagaaaacggcucuacccgcgcccaccgcgccaccguauacgucggcggcgcuaacuucacaccaaaacucggcaagguccaauuugaaacugacaccguagacgaccucgaaauccgccaaaacacaaaauucaccccagucggagucauacaauccuccgaccaccaccgugacgaaccccagcaauggguccuaccaagcuacuccggcagagacacccccaacguacaccuagcacccgccgucgcaccaaacuuccccggcgaacaacuacuguucuuccguuccacacuccccggaugcgggggacaccacaacauggaccucgacugccuacucccccaagaguggguccaacauuucuaccaagaagcagcccccgcacaaagcgauguagcacuccuacgcuuugucaaccccgacaccucgagaguucuauucgaaugcaaacuccacaaauccggauacguuacaguagcccacacuggccaauacgaucucguccuccccagcaacggcuacuuccgguucgacuccugggucaaccaauucuacacccuagcccccaugggcaacggaaccggccgccgacgcuaa

SEQ ID NO: 39185 - RNA, 1614 nt, Artificial Sequence
  derived and/or modified sequence opt11 from VP1__Norovirus_and/or_Norovirus-like__KX514287
augaaaauggcuuccuccgacgccaauccauccgacggcucagccgcuaaccucguacccgaagucaacaacgaagugauggcucucgaacccgucguaggcgccgccaucgcugcccccgucgccggccaacagaacgucaucgaccccuggauacgaaacaacuucguccaggcccccggcggcgaauuuaccgucuccccacgcaacgcaccaggagaaauccuauggucagccccacuaggcccugaccucaaucccuaucuaucccaccuagcccgcauguacaauggcuacgcaggcggauuugaaguucaagucauccuagccggcaacgcauucaccgccggcaaaaucaucuucgcagccgucccaccaaccuuccccaccgaaggacucucccccucccaaguaacuauguucccccacaucaucguagacguaagacaacuagaacccguacuaauaccacucccagacguacgcaacaacuucuaccacuacaaccaaagcaacgacuccaccaucaaacucaucgccaugcucuacacaccccuucgcgccaacaacccaggugacgacgucuucaccgucuccugccgcguacucacccgccccucuccagacuucgacuucaucuuccucgucccucccacagucgaaucccgaacaaaacccuucucagucccuauccuaaccgucggagaaaugacaaacucacgcuuccccauaaaccucgaacgccuuuucaccggccccuccucagcgaacgucguccaaccacaaaauggccgcugcaccaucgacggcgaacuacuuggaaccacccaacuauccucugucaacaucugcacauuucgcggcgacguaacacaaaucggcuccacacaccacuggacaaugaaucuagccuccccaaacuggaacaauuacgacccaacagaagaaacccccgcaccacucggcacaccagacuucgucggcaaaauccacggcaugcuaacccaaaccacacaagaaaacggcuccacaagagcccaccgcgccacuguauacgucggaucggcagacuuuacaccaaaacucgguaaaguacaauucgaaacagacaccggcgacgaccucgccauaagacaaaauaccaaauucacuccuguaggcgucauccaauccagugaccaccaccgcgacgagccacaacaauggagacuccccaacuacucaggcgcaaacaccuucaacguacaccucgccccagcugucgcacccaacuuccccggcgagcaacuccucuucuucagauccacccuaccaggaugcggcggacaccccaacauggaccuagacugccuucuaccacaagaauggguacaacacuucuaccaagaggccgcacccgcccaaagcgacguagcccuucuccgauucguaaaccccgacaccucccgcguacuauucgaaugcaagcuccacaaauccggcuacgucaccgucgcucacacaggacaauacgaccucguccuucccucaaacggauacuucagauucgacuccugggucaaccaauucuacacccuagcccccaugggcaauggcacuggccgucgucgauaa

SEQ ID NO: 39186 - RNA, 1614 nt, Artificial Sequence
  derived and/or modified sequence opt11 from VP1__Norovirus_and/or_Norovirus-like__KX514183
augaaaauggcuucaucagaugcuaacccauccgacggcucagccgcaaaucuagucccggaagucaacaacgaagucauggcacuagaacccguugucggcgccgcaaucgcagcccccguugccggacaacaaaacguaaucgaucccuggauccgaaacaacuucguccaagccccaggaggcgaguucaccgucucaccccgcaacgccccaggcgaaauccucugguccgcaccccucggccccgaccucaaccccuaccucucucaccucgcccgcauguacaacggauacgccggaggcuucgaagugcaagucauucucgccggaaacgccuucaccgcaggaaaaauuauuuucgccgcugucccacccaccuuccccaccgaaggccucucacccucgcaagucaccauguucccucacauaaucgucgacguccgacaacucgaaccaguacucaucccauuacccgacguccguaacaacuucuaccacuacaaccaaucuaacgacagcaccaucaaacucaucgcaaugcuguacacccccuuacgcgcgaacaaccccggcgaugacgucuucacagucucuugccgcguacuaacccggccaucccccgacuucgacuucaucuuccuugucccacccacagucgaaucccgaacaaaacccuucuccgucccaauacucaccguaggggagaugacaaauuccagauucccugucaaccucgaacgccucuucaccggccccucguccgcaaacgucguccaaccccagaacggccgcugcacaauugacggcgaauuacucggaaccacccaacucucaagcgucaacauaugcaccuuccgcggcgacguaacucacaucggcaccacccaacacuggaccaugaacuuagccucacccaacuggaacaacuacgaccccaccgaagaaaccccagcaccccuuggaacacccgacuucguaggcaaaauccacggaaugcucacccaaacuacccaaggcagcggcuccacacgcgcccaccgcgccaccgucuauguuggaucggccgaguucacccccaaacucggcaaagugcgcuucgaaaccgauaccgaagacgaccucgucauucgccaaaacaccaaauucacaccaguaggcguaauccaauccuccgaacaccaccgcgacgaaccacaacaauggcgccuacccaacuacagcggcgccaacaccuucaauguccaccucgccccugcagucgccccuaacuuucccggagaacaacuccuauucuuccgcuccacacuacccggaugcggaggccaccccaacauggaccucgacugccuccuaccccaagaauggguccaacacuucuaccaagaagccgccccagcacaaucagacgucgcccuuuuacgcuucgucaaccccgacacaucccgaguccucuuugaaugcaaacuccacaaaucaggauacguaaccgucgcucacaccggccaauacgaccuuguccuccccuccaacggcuacuucagauucgacuccugggucaaccaauucuacacccucgcccccaugggcaacggcaccggccgccgccgcuaa

SEQ ID NO: 39187 - RNA, 1614 nt, Artificial Sequence
  derived and/or modified sequence opt11 from VP1__Norovirus_and/or_Norovirus-like__KX514174
augaaaauggccuccaacgacgcaaacccauccgacgggagcgcugccaaucucguccccgaagucaacaacgaaguaauggcacucgaaccagucgucggcgccgccauagccgcccccgucgcaggacaacaaaaugucaucgaccccuggauccgcaacaacuucguacaagccccaggaggagaauuuacugucuccccucgcaacgcacccggcgaaauccuaugguccgcuccccucggacccgaucucaacccauaccucucccaccucgcccgcauguacaacgguuacgcgggcggauucgaaguacaaguaauccuagccggcaacgcauucacagccggaaaaaucauauucgccgccguacccccgaccuucccuacagaaggacucucaccaucacaagucaccauguucccccacauaauagucgacguccgacaacuagaaccuguccuuauaccccuacccgacguccgcaacaacuucuaccacuacaaucaauccaacgacuccaccaucaaacucaucgccaugcuauacacuccacuccgagccaacaaccccggcgacgacguauucacagucuccugccgaguccucacccgcccuuccccagacuuugauuucauauuccucguuccaccaacagucgaaucucgcacgaaacccuucuccguccccauccucaccgucggagaaaugacuaacucucgcuuccccguaaaucucgaacgccuuuucaccggccccuccuccgcuaacguuguccaaccccaaaacggccgaugcaccaucgacggcgaacuccuuggaaccacacaacuguccuccgucaauaucugcacauuccgcggagacgucacgcacaucggcacuacccaacauuggaccaugaaucucgccagccccaacuggaacaacuacgaccccaccgaagaaacccccgcgccccucggcacccccgacuucguagguaaaauacacggcaugcuuacccaaaccacccaaggcucagguuccacccgcgcacaccgcgccacagucuacgucggcucggcagaguucaccccgaaacucggcaaaguccgauucgaaaccgacaccgaagacgaccuuguaauacgacaaaacaccaaauucacaccagucggagucauccaauccuccgaacaccaccgcgacgaaccccagcaauggcgacucccaaacuacucaggagcaaacacuuucaacguccaccucgccccagcagucgcccccaacuucccaggcgaacaacuacucuucuuccgcucgacacucccuggaugcggcggccacccaaacauggaucucgacugccuccuuccccaagaauggguccaacauuucuaccaagaagccgcucccgcccaaucagacguggcccuccucagauucguaaaccccgacaccucccgcguacucuucgaaugcaaacuacacaaauccggcuacgucaccguugcccacacaggccaacacgaccucgucaucccacccaacggcuacuuccgcuucgacuccuggguuaaccaauucuacacacuagcccccaugggcaacggcacaggccguaaaagauaa

SEQ ID NO: 39188 - RNA, 1614 nt, Artificial Sequence
  derived and/or modified sequence opt11 from VP1__Norovirus_and/or_Norovirus-like__KF429791
augaaaauggccaguuccgacgccaacccauccgacggcucgacggccaaccuaguccccgaagucaacaacgaaguaauggcccuugaacccguagugggagcagccaucgcagcaccagucgccgggcaacaaaacguaaucgacccauggaucagaaacaacuucguccaagccccaggcggcgaguucaccgucuccccucguaacgcccccggcgaaauccuaugguccgcaccccucggccccgaccuaaaccccuaucuuucccaccuugcccgaauguacaacggcuacgccggcggcuucgagguucaagucauccucgccggcaacgccuucaccgcaggcaaaaucauuuucgccgcagucccucccaacuuccccaccgaaggccuaucacccggccaagucaccauguucccccacaucauagucgacguccgccaacucgaaccuguauuaaucccccucccugacguucggaacaauuucuaucacuacaaccaauccaaugacccaaccaucaaacucgucgccaugcucuacacaccccuccgcgccaacaacgccggcgaugacguguuuaccgucucaugccgcguccucacccgccccuccccagacuucgacuucauauuccucguucccccaaccauagaauccaagaccaaauccuucucaguccccauccucaccaucgaagaaaugaccaacucccgcuuucccaucccccucgaaaaacucuucaccggcccaagcucgacccucgucguacaaccccaaaacggucguugcacaacugacggaguccuacucggcacaacccaacucuccccaguaaacaucugcacauuccgcggcgauguaacccagaucaccaacacccacagcuacgagaugaaucuagccgcccaaaacuggaacucauacgaccccaccgaagaaauaccagcaccccucggcaccccagacuucgucggcaaaauacaaggcguccucacccaaaccacuaaagaaaacgguuccacacgcgcccacaaagcaacagucuacaccgguuccaccgguuucacccccaaacuaggaaggguccaauucgucacagauaccgaccgagaccucgaaaccaaccaagacacgaaauucaccccaguaggcguaauccaagacggagacgcacaccaaaacgaaccacaacaauggguccucccauccuaccucggcaccaacaaccacaacguccaccuagcccccgccgucgcacccaccuucccuggcgaacaacuccucuucuuccgaucaacaaugcccggcuguuccggcuacccaaacaugaaccucgauugccuacucccccaagaguggguccaauacuuuuaccaagaagccgcacccgcccaguccgauguagcacuacuccgcuucgucaacccagacaccggacgcgucuuauucgaaugcaaacuacacaaaucaggcuacgucaccgucgcccacaccggacgccacgaccuagucaucccacccaacggcuacuuccgcuucgacuccugggucucccccuuuuacacccucgcccccauggguaacggcaccggcagacgccgcuaa

SEQ ID NO: 39189 - RNA, 1614 nt, Artificial Sequence
  derived and/or modified sequence opt11 from VP1__Norovirus_and/or_Norovirus-like__AF427115
augaaaauggccagcaacgacgcaaacccaucagacggauccaccgccaaccucguacccgaagucaacaacgaagucauggcccucgaacccgucguaggcgcagcuaucgcagcacccgucgcaggccaacaaaacguuauugaccccuggauacggaacaacuucguccaagcaccaggcggagaauuuaccguuuccccucgcaacgcccccggcgaaauacuauggucagcaccccuaggcccagaccucaaccccuaccucagccaucuagcccgcauguacaacggcuacgccggaggcuucgaaguccaagucauccucgccgguaacgccuucacagccggaaaaaucaucuucgccgccgucccacccaauuuccccaccgaaggccuaagccccucccaaguuaccauguucccccacauaauugucgacguacgacaacucgaacccgucuuaaucccucucccagaugugcgaaacaacuucuaccacuacaaccaauccaacgacuccaccauuaaacuuauagccauguuauacacgccccuccgagccaacaacgcaggcgacgacguauucaccgucuccugccgaguacuaacccgacccaguccugacuucgacuucauuuuccuagucccucccaccguagaaucccgcaccaaacccuucaccauccccauucugacaggugaagaaauguccaacucccgcuuccccaucccccucgaaaaacuauacacuggccccuccucugccuucgucguacaaccccaaaacggacgaugcaccaccgacggcguacuccucggaaccacccaacuaucagcugucaauaucugcaccuucaaaggcaacgucauccacaucgccggaucccacgacuacaccaugaaccucgcaucccaaaacuggaacaacuaugacccaaccgaagaaacccccgcaccccucggcacccccgacuucguuggcaaaauccagggccuccucacacaaaccacacgcgaagacggcucaacccgcgcccacaaagccaccgucuccgccggcucuguacacuucacccccaaacucggauccguccaguacacuaccgacaccaacaacgauuuccaaacaggccaaaacaccaaauucacccccguaggagucauacaagauggcaacaaccaccaaaacgaaccccaacaauggguacuccccaauuauagcgggcgugccggacacaacguccaucuagcaccagcaguagccccaacauucccaggagaacagcuccuguucuuucgcuccaccaugcccggcugcucaggcuaccccaacaugaaccucgacugccuacuuccccaagaauggguccaacacuucuaccaagaagcagcccccgcacaaucagacgucgcccuacuacguuucgucaacccagacacaggccgaguccuauucgaaugcaaacuacacaaauccggcuacgucacaguugcccacaccggcccccacgaccuugucauacccccaaacggauacuuccgcuucgacagcugggucaaccaauucuacacacucgcacccaugggcaacggcgccggacgacgaagguaa

SEQ ID NO: 39190 - RNA, 1614 nt, Artificial Sequence
  derived and/or modified sequence opt11 from VP1__Norovirus_and/or_Norovirus-like__KX514314
augaaaauggccucaaacgacgcaaaccccucagacggcuccaccgccaaccucguccccgaagucaacaacgaagucauggcacucgaaccagucguaggcgcagccaucgccgccccaguagcaggccaacaaaauguaaucgaccccuggaucaggaacaacuucguccaagccccaggaggcgaguucaccgucucuccccgaaacgcccccggcgaaauccuaugguccgcaccccuuggccccgaccuuaaccccuaccuuucacaccucgcccguauguacaacggcuacgccggcggcuucgaaguccaagugauccucgccggcaacgccuucaccgccggaaaaaucaucuuugcagcgguacccccuaacuuccccaccgaaggccucucucccucccaagucaccauguucccucacauaauagucgacguccgacaacucgaaccuguccucaucccccuccccgacguccgaaacaacuucuaccacuauaaccaaucgaacgacucaaccaucaaauugaucgcaaugcucuauacaccccuccgcgccaacaacccaggcgacgacgucuucaccguaucaugccgaguacuuaccagaccaucaccagacuucgacuuuauauuccucguuccacccacaguagaaucccgcaccaaacccuucucaguccccauucuaaccgucggcgaaaugaccaacucccgcuucccuaucaaucuggaacgacuauuuaccggacccagcucagcaaacgucguccaaccccaaaacggccgcugcaccaucgacggcgaacuccucggcacaacccaacucucaucgguaaacauuugcacauucagaggcgauguaacacaaaucggguccacuaaacacuggacaaugaaccuugcaagccccaacuggaacaacuacgaccccaccgaagagacaccagcaccccucggaacccccgacuuugucggaaaaauccacggcaugcucacccaaacaacccaggaaaacggaucaacacgcgcccaccgcgccacaguauacgucggaggcgccaauuucacaccaaaacucggcaaaguccaauucgaaaccgauaccggugacgaccucgccauccgccaaaacacaaaauucacccccguaggagucauacaauccucagaccaccaucgcgacgaaccacaacaauggagacucccaaacuacucaggugccaacaccuucaacguccaucucgccccagccgucgcccccaacuuccccggggaacaacuccucuucuuccgcucaacccucccaggcugcggcggacacccaaauauggaucuagauugccugcucccucaagaauggguccaacacuuuuaccaagaggccgcacccgcacaauccgacguugcccuccuccgcuucgucaacccugauaccucacgcguccuauuugaauguaaacuacacaaaucaggcuacguaaccgucgcccacaccggccaauacgaccucguccuaccaagcaacgguuacuuccgauucgacuccugggugaaccaauucuauacccuagcccccaugggcaacggaacgggucgacgacgauaa

SEQ ID NO: 39191 - RNA, 1614 nt, Artificial Sequence
  derived and/or modified sequence opt11 from VP1__Norovirus_and/or_Norovirus-like__KX514208
augaaaauggcauccuccgacgccaauccuuccgacggcuccgccgccaaccucguccccgaaguaaacaacgaagucauggcccuugaacccgucgucggcgcugccauagcagccccuguugccggccaacaaaacguuaucgaccccuggauccgcaacaauuuuguacaagcccccggcggugaguucacaguaucaccccgcaacgcccccggcgaaauccucuggucagcaccccucggccccgaccuaaaccccuaccuaucucaccucgcccgcauguacaacggauacgccggcggauucgaaguacaaguaauucucgcaggaaacgcauucacagcaggcaaaauaaucuuugccgccgucccucccaccuuccccaccgaaggacucucccccucacaagucaccauguucccccacaucaucguagacguccgacaacucgaaccaguccuaauaccccuccccgacguccguaacaacuucuaccacuacaaccaaucaaacgauagcacgaucaaacucauagccaugcucuacacaccccuccgcgcuaacaaccccggggacgacgucuucaccgucuccugccgcguccucaccagaccuucccccgacuucgacuuuauauuccucguucccccuacuguugaaucccgcacaaaacccuucuccguacccauccuaacugucggcgaaaugaccaacucgcgcuuccccaucaaccuugaacgacucuucaccggccccucaucugcaaacguuguccaaccacaaaacggaagaugcaccauagacggcgaacuccucggcaccacccaacucuccuccguaaacaucugcaccuuccgcggcgacguuacacacaucggauccacccaccacuggacaaugaaccuagcuucacccaacuggaacaacuacgaccccacagaagaaaccccagcaccccuaggcacacccgacuucgucggaaaaauccacggcaugcuuacccaaaccacccaaggcuccggauccacucgugcucaccgcgcaacagucuacgucggauccgccgaauuuacacccaaacucggaaagguccaauucaaaaccgaaacagaccaugaccuauccauccggcaaaacacgaaauucaccccagucggcguaauccaagaaucagaccaccaccgcgaugaaccacaacaguggcgccuccccaacuacagcggcgccaacaccuucaauguccaccucgcgcccgccgucgcccccaacuuccccggcgaacaacuccuauucuuccgcuccacccuccccggaugcggcggacaccccaacaugaaccucgacugucuccucccccaagaauggguccaacacuucuaccaagaagcagcccccgcccaauccgacgucgcccugcuccgauuuguaaaucccgacacaucccgaguccucuucgaaugcaaacuacacaaguccgguuacgucaccguagcccacacaggccaauaugaccuaguucuuccaucaaacggcuacuuccgcuucgauuccugggucaaccaauucuacacacucgcccccaugggcaacggaacgggccgaagacgcuag

SEQ ID NO: 39192 - RNA, 1614 nt, Artificial Sequence
  derived and/or modified sequence opt11 from VP1__Norovirus_and/or_Norovirus-like__KX514206
augaaaauggcauccuccgacgcuaaccccuccgacggauccgccgccaaccucguacccgaaguuaauaacgaagucauggcacucgaaccagucgucggcgcagcaauagcugccccagucgccggccagcaaaauguaauagaccccuggauccgcaacaauuucguacaggcccccggcggagaauuuacagucucccccagaaacgcccccggagaaauccucugguccgcuccccuuggcccagaccucaaccccuaccuuucccaccucgcccgcauguacaacggcuacgccggagguuucgaaguacaagucauccuagccggaaacgcauucaccgcuggcaaaaucaucuuugccgcagucccacccacuuuccccacagaaggacuuucacccucacaaguaaccauguucccccacauuaucgucgauguccgccaacucgaaccaguccucaucccacucccagacgucagaaacaacuucuaccacuacaaccaaucaaacgacucuacuauuaaacucaucgccaugcucuacaccccacugcgcgcaaacaaccccggagacgacgucuucaccgucuccugccgcguccucacccgccccuccccagacuucgacuucaucuuucucgucccacccaccgucgaaagccgaaccaaacccuucucagucccaauccucacagucggcgaaaugaccaacuccagauuccccaucaaccucgaacgccucuucacaggccccucaucagccaacgucguccaaccccaaaauggacgcugcaccaucgacggcgagcuacucggaacaacgcaacuuuccuccgucaacauaugcaccuuccgcggagacgucacccacauaggcuccacccaccacuggaccaugaaccuugccucccccaacuggaacaacuacgacccuacugaagaaacccccgccccucucggcacaccagacuucguaggcaaaauccacggcaugcucacacaaaccacacaaggcucaggcucaacacgcgcccaccgcgcaacaguauaugucggcucagcagaguucacuccaaaacuaggcaaaguccaauucaaaaccgaaaccgaccacgaucuauccauccggcaaaacaccaaguucacccccguuggcguaauacaagaaucagaccaccaccgagacgaaccccaacaauggcgccucccaaauuacucaggcgcaaacacauuuaacguccaucuagcacccgcaguagcucccaacuucccaggcgaacaacuucuauucuuccgcuccacucuucccggauguggcggccauccaaacauggaccucgacugucuacucccccaagaauggguucaacacuucuaccaagaagccgcccccgcacaauccgauguugcccuccuucgcuucguuaaccccgacaccucgagaguacucuucgaaugcaaacuccacaaaucaggcuacgucaccgucgcacacaccggccaauacgaccucguccuccccucuaauggcuacuuccguuucgacuccugggucaaccaauucuauacccucgcacccaugggcaacggcaccggccgacgccgauga

SEQ ID NO: 39193 - RNA, 1614 nt, Artificial Sequence
  derived and/or modified sequence opt11 from VP1__Norovirus_and/or_Norovirus-like__KX514198
augaagauggccuccuccgacgccaacccauccgacggcuccgcagcaaaccucgucccggaagucaauaacgaagucauggcauuagaacccguuguaggcgccgccaucgccgccccugucgcuggccaacaaaaugucauagaccccuggaucagaaacaacuucguucaagccccaggcggagaauuuacagucucuccccgaaacgcaccuggcgaaauacuuugguccgccccacuaggcccagaccucaaccccuaccucucacaccuugcacgcauguacaacggauacgccggcgguuucgaaguccaagucauauuagccggaaacgccuucacagccggcaaaaucaucuucgcugccguacccccaacauucccuaccgaaggacucuccccaucccaagucaccauguucccccacauuaucgucgacgugcgccaacucgaacccguacuaauaccccucccugacguccgaaacaacuucuaccauuacaaucaaucaaacgacuccacaauaaaacuaaucgcaaugcuauacaccccacuucgcgcaaacaacccaggugacgacgucuucacugugucaugccgcguccucacccgccccucccccgauuucgacuucauauuccucgucccucccaccgucgaaucacgaaccaaacccuucuccguccccauacucaccgucggggaaaugacuaacucccgguuccccaucaaccuagaacgacucuucaccggccccucauccgccaacgucguccaaccccaaaacggccguugcaccaucgacggagaacuacucggcaccacacaauuauccucagucaacaucugcaccuuccgcggcgacgugacccacaucggauccacccaccacuggacaaugaaccucgcaucgccaaacuggaauaacuacgaccccacagaagaaacccccgccccucuaggaacacccgacuucgucggcaagauccacgggaugcucacccaaacaacccaaggaucaggauccacccgcgcccaucgcgccaccgucuacguaggaucugccgaguucacacccaaacuaggcaagguccaguucaaaacagaaacagaccacgaccucacaacccgucaaaacaccaaguucaccccagucggcguaauucaagaaucagaccaccaccgagacgaaccacaacaguggcgucuccccaacuacuccggagcaaacaccuucaacguccaccucgcacccgccgucgccccaaacuuccccggcgaacaacuccucuuuuuccgcagcacccucccuggaugcggcggccaucccaacauggaccucgacugccuucucccacaagaauggguccaacacuucuaccaagaagccgcucccgcccaauccgacgucgcacuacuccgauucguaaaccccgauaccucccgaguccucuucgaaugcaaacuccacaaauccggcuacguaaccgucgcacauacaggacaauacgaccucguacuccccuccaacggcuacuuccgcuucgacucaugggucaaccaauucuacacccuagcccccaugggcaacggcacaggccgcagacgcuaa

SEQ ID NO: 39194 - RNA, 1614 nt, Artificial Sequence
  derived and/or modified sequence opt11 from VP1__Norovirus_and/or_Norovirus-like__KX514191
augaaaauggcaagcucugacgccaaccccuccgacggaagcgcagccaaccucguacccgaagucaacaacgaaguaauggcacuagaacccgucguaggcgccgccauagccgccccagucgcgggccaacaaaacgucaucgaccccuggauucgaaacaacuucguacaagcccccggaggcgaguucaccgucucaccccgcaacgccccaggagaaauccucugguccgcuccccucggcccagaccuuaaccccuaccucucucaccucgcccgcauguacaacggcuacgccgguggauucgaaguccaagucauccuagccggcaacgccuucacagccgggaaaaucaucuucgccgccgucccaccuaccuuccccaccgaaggccucucccccucccaaguaaccauguucccccacauaaucguagacguccgccaauuagaacccguacucaucccccucccagacguacgcaauaacuucuaccacuacaaccagagcaacgacuccaccauuaaacuaauagccaugcucuacacuccccuuagagccaacaauccaggagaugacguauucaccgucuccugucgaguccucacucgccccucccccgacuucgacuucaucuuccucguaccacccaccguugaaagccgcaccaaacccuucuccguacccauacucaccgucggcgaaaugaccaacagccgauuccccguaaaccuugaacgccuguucaccggccccuccuccgccaacgucguccaaccacagaacggccgaugcacaaucgauggcgaacuccucgguaccacccaacucagcucugucaacauuugcacauuccgaggagacgucacacacaucggcaccacccgacacuggaccaugaaccuagccucaccaaacuggaacaacuaugacccaaccgaagaaacacccgcaccccucggaacccccgacuucgucgguaaaauccaugguaugcuaacccaaacaacccaaggcuccggcuccacccgagcccaccgagccacagucuacgucggcuccgccgaauuuacccccaagcucggcaaaguacgcuucgaaaccgacacagaagacgaucucguaauacgccaaaacaccaaauucacacccgucggugucauccaaucaagcgaacaccaccgcgacgagccccaacaguggcgccucccaaacuacucaggcgcaaacacauucaauguccaccucgccccugccgucgcccccaacuuccccggagaacaacuccuauucuuucgcuccacccuccccggaugcggaggccauccaaacauggaccuagacugccuccucccacaagaguggguccaacauuucuaccaagaagccgcccccgcccaaagcgacgucgcccuacuccgauuugucaaccccgacacauccagagucuuguucgaguguaaacuacacaaaucaggcuacgucaccgucgcccacacaggacaauacgaucucguacucccaucaaacggauacuuccgcuucgacuccuggguuaaccaauucuacacccucgcccccaugggaaacggcacugggcgccgccgauaa

SEQ ID NO: 39195 - RNA, 1614 nt, Artificial Sequence
  derived and/or modified sequence opt11 from VP1__Norovirus_and/or_Norovirus-like__KX514187
augaaaauggccuccuccgacgccaacccuucagacggcuccgccgccaaccucgucccugaagucaacaaugaagucauggcacuagaacccguagucggcgcagccaucgccgcaccaguagccggccaacaaaacguaaucgaucccuggauccgaaacaacuucguacaggccccuggcggagaauuuaccgucucaccccgaaacgcucccggcgaaauccucugguccgcuccccuaggcccagaccucaaccccuaucuuucccaccucgcccgaauguacaauggcuacgccggcggcuucgaagugcaaguaauccucgccggaaacgcauucaccgccggcaagaucaucuucgccgccguacccccuaccuuccccacagaaggccucucccccucccaggucacuauguucccccacaucauagucgacguccgacagcuagaaccuguucuaaucccacugccagauguacgaaacaacuucuaucacuacaaucaguccaaugacucuacaaucaaacucauagcaaugcucuacacaccccuccgagccaacaaccccggcgaugacguauucaccguaucaugccguguccuaacccgaccuuccccugacuucgacuucauuuuccuagucccgcccaccgucgaaucccgcacaaaacccuucucaguccccauccucacaguaggagaaaugaccaacagccguuuccccguaaaccucgaacgacucuucaccggccccucguccgccaacguaguccaaccccaaaacggacgcugcacaaucgacggcgaacuucucggcacaacccaacuaagcucagucaacaucugcacauuccgcggcgacgucacccacaucggcaccacacgacacuggaccaugaaccucgucuccccgaacuggaacaacuacgacccuaccgaagaaacccccgcaccccucggaacccccgauuucgucggaaaaauucacggcaugcucacacaaaccacccaaggcucaggauccacacgcgcacacagagccacuguauacguaggcuccgccgaguucacacccaaacucggaaaaguccgcuucgaaaccgacaccgaagacgaccucgugauacgccagaauacaaaauucacccccgucggcgucauccaaucaucugaacaccaccgugacgaaccgcaacaauggcgccuacccaacuacuccggcgccaauaccuucaacguacaccuggcccccgcagucgcccccaacuucccaggcgaacaacuucucuucuuccgcuccacccuacccggcugcgguggccaucccaacauggaccucgacugccuccucccccaagaauggguacaacacuucuaccaagaagccgcccccgcacaauccgacgucgcccuccucagauucguuaaccccgacacauccagaguccuauucgaaugcaaauuacacaaaucggguuacgucaccgucgcccacaccggccaauacgaccucguccuccccuccaacggcuacuuccgcuucgacuccugggucaaccaauucuacacccuugccccuaugggaaacggcaccggccgccgcagguaa

SEQ ID NO: 39196 - RNA, 1614 nt, Artificial Sequence
  derived and/or modified sequence opt11 from VP1__Norovirus_and/or_Norovirus-like__KX514180
augaaaauggcauccuccgacgcaaaccccagcgacggcucagcagcaaaccuaguaccagaaguuaacaacgaagucauggcucuagaacccgucguuggagccgccaucgccgcccccgucgccggccaacaaaacgucaucgaccccuggauacgaaacaacuucauacaggcccccggaggcgaauuuaccguaucuccccgcaacgcccccggugaaauucuaugguccgcaccccuuggucccgaccuaaacccauaucucucccaccucgcccgcauguauaacggcuacgccgguggcuucgaaguacaagucauccuugccggcaacgccuucaccgccggcaaaaucaucuucgcugcaguuccucccaccuucccaaccgaaggacucuccccaucacaagucacaauguucccccacaucaucguagacguccgccaacucgaacccguacuaaucccucuccccgacguucgcaacaacuucuaccacuacaaccaauccaacgacucuacaaucaaacuaauagccaugcucuacacaccacuacgugccaacaaccccggagacgacgucuucacggucucaugcagaguucuaacacgccccucccccgacuucgacuucaucuuccucgucccacccaccgucgaaucacguaccaaacccuucuccguccccauccuuaccgucggcgaaaugaccaacagccgcuuccccaucaaccuugaacgcuuauucaccggucccucuucagccaacguaguccaaccccaaaacggccgaugcacuauugacggcgaacuacucggaaccacacaacuaucauccguuaacauaugcaccuuccgaggcgacgucacccagauagguuccacccaacacuggaccaugaaccuugccucccccaacuggaacaacuacgacccuaccgaagaaacaccagcuccccucggcacaccugacuuuguaggcaaaauacauggcaugcucacacaaacaacccaggaaaacggaucaacccgcgcccaucgggccaccgucuacguuggcucagccaacuucaccccaaaacuaggcaagguacaauucgaaacagacacuggagacgaccuagccauacgccaaaacaccaaguucaccccagucggagucauccaaucauccgaccaccaccgcgacgaaccacaacaauggcgccuacccaacuacuccggcgccaacacauucaauguccacuuagcuccagccgucgcacccaacuuccccggcgaacaacuccuauucuuccgauccacccuucccggcugcggcggacaucccaacauggaccuagacugccuccucccucaagaauggguccaacacuucuaccaagaagccgcacccgcgcaauccgacgucgcccuccuacgcuucgucaaccccgacacaucacggguccuuuucgaaugcaaacuccacaaaucaggauacgucaccguugcccacaccggccaauacgaccucguccucccauccaacggcuacuuucgauucgacagcuggguaaaccaauucuacacccuagcaccuauggguaacggcaccggccgacgccgcuaa

SEQ ID NO: 39197 - RNA, 1614 nt, Artificial Sequence
  derived and/or modified sequence opt11 from VP1__Norovirus_and/or_Norovirus-like__GU598213
augaaaauggcaucaaacgaugcaaaccccuccgacggcuccacagcuaaccucgucccagaagucaacaaugaagucauggcacuugaaccaguaguaggcgcagccaucgccgcccccgucgccggucaacaaaacguaaucgacuccuggaucaggaauaacuucguccaagcccccggaggcgaguucaccgucuccccgcgcaaugccccaggcgaaauccuuugguccgcaccccucgggcccgaccucaaccccuaucucucucaccucgcccgcauguacaacggcuaugccggagguuucgaaguacaagucauccucgcagguaacgccuucacagccggcaaaaucaucuucgcagcagucccgccuaacuucccuaccgaaggacucucacccucucaagucacaauguucccccacaucauagucgacguccgccaacucgaacccguucuaauuccccuccccgacguacgcaauaacuucuaccacuacaaccaaucaaacgacuccaccaucaaacucaucgccaugcucuacacuccccuccgagcuaacaacgccggcgacgacguguucaccguaagcugccgcguccuaacacgacccucccccgacuucgacuuuaucuuccucguuccacccacagucgaaucccgcaccaaacccuuuacuguccccauacucaccgucgaagaaaugucaaacagccgcuuccccaucccacucgaaaaacucuauaccggccccagcuccgccuucguuguccaaccccaaaacggccgcugcacaacugauggcguccuccucggaacuacccaacucuccgcagucaacauaugcaccuuucgcggagacgucacccacauugccggaucucacgacuacacaaugaaccuagccucccaaaacuggucaaacuaugaccccaccgaagagaucccugcaccccucggaacacccgacuuuguaggcaaaauccaagguaugcucacccagaccacccgcgaagacggcuccacccgcgcccacaaagccacagucuccaccggcucuguccacuucacccccaaacuuggaucgguacaauacacgacagacacaaacaacgacuuccaaacaggccaaaacaccaaauucacacccgucggaguaauccaagacggcaacaaccaccaaaacgaaccacaacaauggguacuucccaacuauagcggccgcaccggccacaacguacaucuagcccccgcaguagcccccaccuuccccggcgaacaacuccuauuuuuccgcuccacaaugcccggcugcagcggauauccaaacaugaaccuugauugccuauuaccccaagaauggguacaacacuucugccaagaagccgccccugcucaaucagacguagcccuucuccgcuucgucaaccccgacacgggacgaguacuuuuugaaugcaagcuacacaaauccggcuacgucaccguugcccacacaggcccucacgaccucgucauuccacccaacggcuacuuucgauucgacucaugggucaaccaauucuacacacuagcccccaugggaaacggugccggcagacgccgcuaa

SEQ ID NO: 39198 - RNA, 1614 nt, Artificial Sequence
  derived and/or modified sequence opt11 from VP1__Norovirus_and/or_Norovirus-like__KX514365
augaaaauggccagcucugaugccaaccccuccgacggaucuacagccaaccuaguacccgaagucaacaacgaagucauggcucuugaacccguaguaggcgccgccaucgccgcccccgucgccggacaacaaaauguaaucgaccccuggauccgcaacaacuucguccaagcccccggcggcgaguucaccgucucaccaagaaacgccccgggagaaauucuaugguccgccccacucgguccagaccuaaaccccuaccuaucucaucucgcccgaauguacaacggcuaugcaggcggcuucgaaguacaagucauccucgccggcaacgccuucaccgccggaaagaucauuuucgccgccgucccacccacauuccccaccgaaggccucucccccucccaagucaccauguucccccauaucaucgucgacguccgacaacucgaaccaguacuuauaccccucccugacgucagaaacaacuucuaccacuacaaccaaucaaacgacuccacaaucaaacucauagccaugcucuacacaccucuccgagccaauaauccaggcgacgacguauucacuguuucuugccgcguacuuaccagacccucccccgacuucgacuucaucuuccuagucccaccaaccguagaaucccgcaccaaacccuuuuccguaccaauccugaccgucggcgaaaugaccaacagccgauuccccauuaaccuugaacguuuauuuacaggccccuccucugccaaugucguccaaccccaaaacggucgcugcaccauagacggcgaacuccucggcaccacccaacuaucauccguaaauaucugcaccuuccgcggagacguaacccaaauccgcagcacacaacacuggaccaugaaccuagccucaccaaacuggaacaauuacgaccccacugaagaaaccccugcaccccucggaaccccagacuucguaggaaaaauacacggaaugcucacccaaaccacccaagaaaacggauccacccgcgcccaccgcgcuacggucuacgucggcuccgcaaacuucacgcccaaacucggcaaaguacaauucgaaacagacaccggagacgaccucgcaauacgucaaaacaccaaauucacuccagucggcguaauccaaagcucugaccaccaccgugaugaaccgcaacaauggcgccuccccaacuacuccggcgccaacaccuucaacguccaccucgcccccgccguagcacccaacuuucccggagaacaacuccuuuucuuccgcuccacacuaccuggcuguggaggccacccuaacauggaccucgacugccuacuuccccaagaauggguccaacauuucuaccaagaagcagccccagcccaauccgacgucgcccuccuucgcuucguaaacccagauaccucccgaguacucuucgaaugcaaacuccacaaauccggcuaugucaccgucgcgcacacuggccaauacgaccuuguccuaccuuccaacggcuacuuccgcuucgacucauggguaaaccaauucuacacccuagcccccaugggcaacggcaccggccgcaggcgauaa

SEQ ID NO: 39199 - RNA, 1614 nt, Artificial Sequence
  derived and/or modified sequence opt11 from VP1__Norovirus_and/or_Norovirus-like__KX514304
augaaaauggucuccaaugacgcaaaccccucugacggcucagcagccaaucucguccccgaaguaaacaacgagguaauggcucucgaaccagucgucggagcagccauugccgcucccguggccggccaacaaaacgucaucgaccccuggauacgaaacaauuucguccaagcacccggcggagaguucaccguuucaccccgaaacgcccccggcgaaauccuauggucagccccucucggaccagaccugaacccauaccuaucccaccucgcccgaauguacaacggcuacgccggcgguuucgaaguucaaguuauacucgccggaaacgcauucacagccggcaaaauaauauucgccgcaguucccccuacauucccuacagaaggccuauccccuucgcaagucaccauguucccacacauaauagucgacguccgacaacuagaaccuguccucaucccgcucccagacguccgcaacaacuucuaccauuacaaccaauccaacgauuccaccaucaaacucauagcaaugcuauacaccccacuucgggccaacaaucccggcgacgacgucuucaccgucucgugccgcguacucacacgcccuucuccagacuucgacuucauauuccucguucccccaaccgucgaguccagaaccaaaccuuucuccgucccaauacuaacagucggagaaaugaccaacucucgcuucccuaucaaccucgaacgccucuucaccggacccucaucagcaaacgucguccaaccacaaaacggccgaugcaccaucgauggugagcuacucggcacaacccaacucucauccgucaacaucugcacuuuccgcggggacgucacccaaaucggcagcaccaagcacuggacaaugaaccucgcuucccccaacuggaacaacuacgaccccacagaagaaacccccgcaccccucggcacaccugacuuuguuggcaaaauucacggcaugcucacccaaaccacccaagaaaacggcuccacccgugcccaccgugccaccgucuacgucggcggcgccaacuucacaccaaaacucggaaaaguccaauucgaaacugacaccggcgacgaccucgccauccgccaaaacaccaaguucacccccgucggcgucauccaauccuccgaccaccaccgagacgaaccccaacaguggcgccucccaaacuacuccggcgccaacaccuucaacguccaccucgcacccgccguagcccccaacuucccuggcgaacaacuucucuucuuccgcucaacccuaccuggcugcggaggccacccaaacauggaccuugacugccuccucccccaagaauggguccaacauuucuaccaagaagcagcacccgcccaguccgacgucgcccuacuccgcuucgucaaccccgauaccucacgaguacuuuucgaaugcaaacuucacaaauccggcuacguuaccguagcccacaccggccaauacgaccucguccuaccauccaacgguuacuuccguuucgauuccugggucaaccaauucuacacacuagcccccaugggcaacggcaccggccgucgucgauaa

SEQ ID NO: 39200 - RNA, 1614 nt, Artificial Sequence
  derived and/or modified sequence opt11 from VP1__Norovirus_and/or_Norovirus-like__KX514302
augaaaauggcauccucagacgccaaccccucagacggaucagccgccaaccucguucccgaagucaacaacgaagucauggcccuggaaccagucgucggugcagccauagccgcccccguagcaggucagcagaacgugaucgaccccuggaucagaaauaauuuuguacaagcccccggaggagaauuuaccguauccccaagaaacgcacccggcgaaauccucuggucugcaccacucggacccgaccucaaccccuaccuaucucaccucgcccgcauguacaacggcuacgcgggcggauucgaaguccaagucauccucgccggcaacgcauucaccgcaggaaaaaucauauucgccgccguacccccaaccuuccccacagaaggacuaucaccaucacaagucacaauguucccccacaucaucgucgauguacgccaacucgaacccguccucaucccccuccccgacguccgcaacaacuucuaccacuauaaccaaucuaacgacucuacaauaaaacucaucgccaugcuguacacgccccuaagagcuaacaaccccggcgacgacgucuucaccgucuccugccgaguccuaacccgccccagccccgacuucgacuucauauuccuaguaccacccaccguagaauccagaaccaaacccuucucaguccccauacuaacagucggcgaaaugaccaacucacgguuccccaucaaccucgaacgccuguucaccggacccuccuccgccaacguaguacaaccccaaaacggccgcugcaccauagacggcgaacuccucggcacaacccaacuuagcucagucaacauaugcaccuuccgaggcgacgucacccaaaucggaucuacucaacauuggaccaugaaccucgcaucacccaacuggaacaacuacgaccccacagaagaaacccccgccccacucggcacccccgacuucgucggcaaaauccacggcaugcucacccaaaccacucaagaaaauggaucaacccgagcccaccgcgcaaccgucuacgucggaggcgccaauuucacccccaaacugggacgcguccaauucgaaacugacaccacagacgaccuugacgcccaccaaaacaccaaauucacucccgucggcgucauccaauccucugaucaccaccgcgacgaaccucaacaauggcgccuacccaacuauucaggugcuaacacauucaacguacaucuagcacccgccguagcccccaacuuccccggcgaacaacuccucuucuuccgcuccacccuccccggcugcggcggucacccaaacauggaccuagacugccuccuuccccaagaauggguccaacacuucuaccaagaagccgcccccgcccaauccgacgucgcccuccuccgauucgucaaccccgacacaucccguguccuguucgaaugcaaacuccacaaauccggcuacgucacagucgcacacaccggacaauacgaccuuguccuccccuccaacgguuacuuccgauucgauagcugggucaaccaauucuacacacuagccccuaugggaaacggaacaggccgacgccguuaa

SEQ ID NO: 39201 - RNA, 1614 nt, Artificial Sequence
  derived and/or modified sequence opt11 from VP1__Norovirus_and/or_Norovirus-like__KX514207
augaaaauggcuuccucagaugcaaaccccucugacggcuccgccgccaaccucgucccagaaguaaacaacgaagucauggcccucgaaccagucguaggagcagcaauaaccgcccccgucgccggccaacaaaacguuaucgaucccuggauaagaaacaacuucguccaagccccaggaggagaguucaccguaucaccccgcaacgcccccggcgaaauacuaugguccgcaccccucggacccgaccuaaaccccuaccucucccaccuugcccgaauguauaacggcuacgcaggcggcuucgaaguccaagugauccucgcaggcaacgccuucaccgcaggcaaaaucaucuucgccgccguacccccuacuuuucccacugaaggacuaucccccucucaggucaccauguucccgcacauaaucguagacguccgacaacuagaaccaguacuaaucccccucccagacguacgcaacaacuucuaccauuacaaccaaucaaacgacuccacuaucaaacucaucgcaaugcucuacacuccccuacgcgcaaacaaccccggcgacgacguauucaccgucuccugccgcguccucaccagacccucccccgauuucgacuucaucuuccuagucccacccacugucgaaucacgcacuaaacccuucucaguacccauacuaacagucggcgaaaugacaaacucccgcuuccccauaaaccuugaacgacucuucaccggacccuccuccgccaacgucguccaaccccaaaacggaagaugcacuaucgacggugaacuccuagguaccacucaacuaucuucagucaauaucugcaccuuccgcggcgacgucacccauaucggcagcacccaccauuggaccaugaaucuggucucccccaacuggaacaauuacgacccaaccgaagaaacacccgcaccccucggaacucccgacuucgucgguaaaauccacggcaugcuaacucaaaccacacaaggcucaggcucaacccgcgcgcaccgagcaaccgucuacgucggcucagccgaguucacccccaaacucggaaagguccaauucaaaacagaaacagaucacgaccuaucaauacgccaaaacacuaaauucacacccgucggaguuauccaagaauccgaccaccaccgcgacgaaccacaacaauggcgccuacccaacuacuccggcgcuaaugcauucaacguccaccuagcccccgccguagccccaaacuuccccggcgaacaacuccucuucuuucgcuccacccuccccggaugcggcggccacccuaauauggaucucgacugccuucucccccaagaauggguacaacacuucuaccaagaagcagcacccgcucaauccgacguagcccuacuacgcuucguaaacccugacaccuccagaguauuauucgaaugcaaacuccacaaauccgguuacgucaccguugcccacacaggucaauacgaccuaguacucccaucuaacggcuacuuccgcuucgacuccugggucaaccaguucuacacacucgccccaaugggcaacggcaccggccgccgccgcuaa

SEQ ID NO: 39202 - RNA, 1614 nt, Artificial Sequence
  derived and/or modified sequence opt11 from VP1__Norovirus_and/or_Norovirus-like__KX514192
augaaaauggccuccucugacgccaaccccuccgacggcuccgcagccaaccucguacccgaagugaacaacgaggucauggcccuagaacccguagucggcgcagccauagcagcacccguagcaggccagcaaaacgucauagaccccuggauacgcaacaacuucguacaagcacccggcggcgaguucacugucucaccccgcaaugccccaggcgaaauccucugguccgcaccccucggccccgaccucaaccccuaccucucccaccuugcccgcauguacaacgguuacgccggcggcuucgaaguccaagucauccuagccggcaacgccuucaccgcaggaaaaaucauauucgcugccgucccacccaccuuccccaccgaaggacucucccccucccaaguaaccauguucccccacaucaucguagacgucagacagcucgaaccaguccucauaccacucccagacguccgaaacaacuucuaccacuacaaccaauccaacgacuccacaauaaaacucaucgccaugcuauacacaccccuccgagccaacaaccccggugacgacguauucaccgucuccugucgcguacuaacccgaccauccccagacuucgacuucaucuuccucguacccccaacugucgaaucucgcaccaagcccuucuccguccccauacuaaccgucggcgaaaugaccaacucacgauuccccguaaaccucgaacgacucuucaccggcccaucuagcgccaacgucguacaaccccaaaacggacgcugcaccaucgacggagaacuccucggaaccacacaacucucaucgguaaauaucugcacauuccgaggcgacgucacccacauaggugccacucgccacuggaccaugaaccuggccuccccuaacuggaauaacuaugauccuaccgaagaaacccccgccccacucggcacaccagacuucgucggcaaaauucacggcaugcuaacccaaaccacacaaggcucaggcuccaccagagcucaccgcgccaccgucuacgucggcuccgcugaguucacaccaaaacuaggcaaaguccgauucgaaaccgacaccgaagacgaccuuguaauucgacaaaacacuaaauucacaccaguaggugucauacaauccucagaacaccauagagacgaaccccaacaauggcgccucccaaacuacuccggcgccaacacauuuaacgugcaccucgccccagccguagcgcccaacuucccaggcgaacaacuccuuuucuuccgcuccacccucccaggcugcggcggccacccaaacauggaccuagacugccuccuaccccaagaauggguccagcacuucuaccaagaagccgcuccagcucaauccgacgucgcccugcuccgauucguaaaccccgacaccagccgcguucucuucgaaugcaaacuacauaaauccggcuacguaaccguugcgcacacaggccaauacgaccucguacucccuucaaacggauacuuccgauucgauuccugggucaaccaauucuacacccuagccccaauggggaacgguaccggacgccgacguuaa

SEQ ID NO: 39203 - RNA, 1614 nt, Artificial Sequence
  derived and/or modified sequence opt11 from VP1__Norovirus_and/or_Norovirus-like__KF806525
augaaaauggccuccaacgacgccagccccuccgacggauccgccgcaaaccucgucccggaaguaaacaacgaagucauggcccucgaacccgucguaggcgcugcgaucgccgcccccguagcaggccagcaaaacgucaucgaucccuggauccgaaacaacuucguccaagcccccggcggagaguucacaguaucuccacgcaaugcccccggcgaaauccuauggucggcaccccucggccccgaccuuaaccccuaccucucccaccuagcccggauguacaacggcuacgccggcggcuucgaaguccaagucauacuagccggcaaugccuucaccgccggcaaaauaaucuucgccgccguacccccuaacuucccaacagaaggccucuccccaucccaagucaccauguucccccacauagucgucgacguacgccagcucgaaccaguccuaaucccccuuccugacguacguaacaacuucuaccacuacaaccaauccaaagacccaaccauaaaacucaucgccaugcucuacacuccccuccgcgccaacaacgccggcgaagacgucuucaccgucucaugucgcguccucacccgcccuuccccagacuucgacuucaucuuucucguacccccuaccgucgaaucccgcucaaaacccuuuacaguacccauccuuaccguagaagaaaugaccuacucccgcuuccccaucccccucgaaaaacucuuuaccggcccauccuccgccuuuguuguacaaccccaaaacggacguugcaccaccgacggaguccuacucggcaccacccaacucucaccugucaacaucuguaccuuucgcggcgaccugacccacuucgcaggaacuucagaauacgccaugaaucucgcaucccaaaacuggaccaacuacgacccaacagaagaaauccccgcaccccuaggagccccugacuucgucggaaaaauaagagggguccucacacaaaccacccgcggcgauggaucaacccggggacaccgcgccacccuaucaacaggcucagcccacuucacaccuaaacucggaagcguccgauuuucaaccgacacaaacaacgacuucgaagccggccaaaauaccaaauucacucccgucggagucuuccaagauggcgauaaccaccaaaacgaaccccagcaguggguacuucccaauuacuccggagccaccgcccacaacguccaccuagcacccgcagucgcccccgccuuccccggcgaacaacuccucuucuuccgcuccaccaugcccggcugcuccggcuaucccaacaugaaucuagacugccuccuuccacaagaauggguacaacacuucuaccaagaagccgcacccgcccaauccgacgucgcccuccuacguuuuguuaaccccgacacuucccgaguccuuuucgagugcaaacuccacaaaucuggauacguaaccgucgcccacacuggccaacacgaccuuguuauucccccaaacggauauuuccgcuucgacuccugggucaaccaauucuacacacucgcacccaugggcaacggcaccggccgccgccgauaa

SEQ ID NO: 39204 - RNA, 1614 nt, Artificial Sequence
  derived and/or modified sequence opt11 from VP1__Norovirus_and/or_Norovirus-like__KC462195
augaaaauggcuuccaacgacaccauccccucagacggcucaaccgccaaccucguccccgaagucaacaacgaaguaauggcccuagaacccguagucggcgcggccaucgccgcuccugucgcuggccaacaaaacguaauagaccccuggauacgcaauaacuuuguccaagcaccaggcggcgaguucacagucuccccacguaacgcccccggcgaaauccucuggucuaugccacucucucccgaccucaaccccuaccuaucacaccuaucucgaauguacaacggcuacgccggcggcuucgagguccaagucauccuagcuggcaacgccuucacugccggaaaaaucaucuucgcagcgaucccacccaacuucccaacagauggacugucacccucacaaguuacuauguucccccauaucaucgucgacguacgccaacucgaacccguccucaucccucuccccgacguccgcaacaacuucuaccacuauaaccaagucaacgacagcacucuaaaacuaauagccaugcuauacacaccccuccgagccaacaaugccggagacgacguauucacagucuccugccgcguacugaccagaccaucccccgacuucgacuuuaucuuccucgugcccccaaccgucgagucucgcaccaaacccuucacaguuccaauucuuacagucgacgaaaugaccaacucccgcuuccccaccccacucgagcgccuccacaccggccccaauaacucccuagucguccaaccccagaacggccguugcaccaucgacggcguacuacucggaaccacccaacucuccgcugucaacaucugcuccuucagaggcgacuccacaacccgcgaaggacaaucccacgccuacaccaugaaccucgcaucgcaaaacuggaccaacuacgauccuaccgaagacauucccgcaccacucgguacacccgacuucguuggcaagauagucggaaugcuuucccaaacuacccgagaaaacuccuccacccgcgcccacaaagccacaguauccaccggagacgcccacuucaugcccaaacuuggcuccguccuauucacaaccgacaccgaagaccuucagaacggccaaaacacccgauucacucccgucggcgucgcacaagauggagaaccacaccaaaacgaaccacagcaauggcgucuacccaacuacucagguaccccuggccacaacgugcaccuugcacccccagucgcccccacauucccaggcgaacaacuacucuucuuccguuccaccaugccaggaugcgguggcuaccccaacauggaccucgacugccuccucccccaagaauggguccgucacuucuaccaagaagccgccccagcccaauccgacguggcucuacuccgcuucguaaaccccgacacagggcgaguacucuucgagugcaaacuccacaaagcaggcuacauuaccgucucucacaccggcccguacgaccucgucauuccacccaacggcuacuuccgauucgacuccugggucaaccaauucuacgcccucgcccccauggggacaggcaccggccgacgccgcuaa

SEQ ID NO: 39205 - RNA, 1614 nt, Artificial Sequence
  derived and/or modified sequence opt11 from VP1__Norovirus_and/or_Norovirus-like__AF427116
augaaaauggccucuaacgacgccaaccccuccgacggcuccaccgccaacuuagucccagaagucaacaacgaaguaauggcccucgaacccguagucggagcagccaucgccgcccccgucgccggccagcaaaacgucauagaccccuggauacgcaauaacuucguccaagcacccggaggagaauuuaccgucuccccaagaaacgcucccggugaaauccucuggucagcuccacucggccccgaccuaaaccccuaccucucccaccuggcccgcauguacaauggauacgcaggcggcuucgaaguccaaguaauucucgccggaaacgccuucaccgccggcaaaauaauauucgcagcagucccacccaacuucccaacugaaggccucucaccaucccaagucacaauguucccccauaucaucguggacgucagacaacucgaaccaguccucaucccccuccccgacguacgcaacaacuucuaccacuacaaccaaucuaacgacucaaccaucaaacucauagccaugcucuacacaccccuccgugccaacaacgccggcgacgacgucuucaccguuuccugccgcguccucacccgcccgucucccgacuucgacuucaucuuccuugucccacccaccguagaaucucgaacaaagcccuucaccaucccaauacucacagucgaagaaauguccaacucacgcuuccccaucccucucgaaaaacucuacacaggcccaagcuccgccuucguaguccaaccccaaaacggacgaugcaccacagacggaguacuccuaggaaccacacaacucagcgccgucaacaucugcaccuuccgcggcaacgucauccacaucgcuggcucccacgacuacaccaugaaucuagcuucccaaaacuggaacaacuacgaucccacagaagaaacaccagcaccccuaggcacauccgacuucgucggcaaaauccaaggccuccuaacccaaacgacacgugaagacggauccaccagagcacauaaagccacugucucaacaggauccguucauuucacacccaaauugggaucaguacaauacacaacagacacaaacaacgacuuucaaaccggacaaaacaccaaauucacccccgucggcgucauccaagacggcaacaaccaccaaaacgaaccccaacaauggguccucccaaacuacucaggacgcgccggucacaacguccaccucgccccagcuguagccccaacauuuccuggagaacaacuccuguucuuccgaagcacgaugccgggaugcuccgguuaccccaacaugaaccuagacugccuccucccccaagaauggguacaacacuucuaccaagaagcagcaccagcccaauccgacguagcacuucuccgcuucguuaaccccgacaccggucgcguccucuucgaaugcaaacuccacaaauccggauacgucaccguggcucacacuggaccccacgacuuagucaucccacccaacggauacuuccgcuucgacucaugggucaaccaguucuacacacucgcucccauggguaacggagccggccgucgccgcuaa

SEQ ID NO: 39206 - RNA, 1614 nt, Artificial Sequence
  derived and/or modified sequence opt11 from VP1__Norovirus_and/or_Norovirus-like__KX514337
augaaaauggccuccaacgacgccaacccguccgacggcucagccgccaaccucguccccgaaguaaacaaugaagucauggcccucgaaccaguagucggcgcagcuaucgccgcccccguagccggucaacaaaaugucaucgaucccuggauccgcaacaacuucguacaagccccuggcggcgaguucacaguauccccacgcaacgcccccggagaaauccucuggucagccccucucggaccagaccucaacccguacuuaucucaccucgcccgcauguauaacgguuacgccggcgguuucgaaguccaagugauacucgccggcaaugccuucaccgccggcaaaaucaucuucgccgcagucccacccaacuuccccaccgaaggccuuagcccaucccaaguaaccauguucccccacaucauagucgacguccgccaacucgaaccaguccucaucccacuacccgacguccgaaacaauuucuaccacuacaaucaaucaaacgauuccacuauaaaacuaaucgccauguuauacaccccacuccgagccaacaacgccggcgacgacguuuucacagucucaugccgcguacuaacacgacccucaccggauuucgacuucaucuuccuuguacccccaacugucgaaucccgcaccaaaccuuucuccgucccaauccucaccgucggugaaaugaccaacucccgguuccccgucaaccuagaacgccucuucacuggcccgagcucagccaacgucguccaaccccaaaacggcagaugcacaaucgauggagaacuacuuggcacaacacaacucucauccguuaacauaugcaccuuucgaggcgacguaacccaaauaggcgcuaccagacacuggacaaugaaucucgcuucccccaacuggaacaacuacgaccccaccgaagagacccccgccccacuuggcacccccgacuucgucggcaaaguccauggaaugcucacccagacaacccaaggcuccggcuccacucgagcccaccgugccaccguauacgucggaggcgcugaguucaccccaaaacucggcaaaguacgcuucgaaaccgauaccgaagaugaccugguaauacgccaaaacaccaaauucacaccugucggcgucauccaauccucagaacaccaccgcgacgaaccacaacaauggcgucuccccaacuacagcggcgcaaauacauucaacguccaccucgcacccgccgucgcccccaacuucccaggagaacaacuccuuuucuuccguucaacccuccccggcugcggaggccaccccaacauggaucuagacugccuacucccacaagaauggguacaacacuucuaccaagaagccgcccccgcccaauccgacguagcccuccuccgcuucgucaaccccgacaccucccgcguacuauuugaaugcaaacuacacaaauccgguuacgucaccguugcccacaccggccaacacgaccucgucauacccccaaacggauacuuccguuucgacuccuggguaaaccaauucuauacacucgccccuauggguaacggcacuggccgcaaaagauaa

SEQ ID NO: 39207 - RNA, 1614 nt, Artificial Sequence
  derived and/or modified sequence opt11 from VP1__Norovirus_and/or_Norovirus-like__KX514255
augaaaauggccucuuccgacgccaacccuucagacggauccacagccaaccucguacccgaaguaaacaacgaagucauggcacuagaacccguagucggggccgcaaucgccgcuccaguagcaggccaacaaaacguaaucgaccccuggauccgcaacaacuucguacaagccccaggcggcgaguucaccgucucaccccgcaacgcacccggagaaauccucuggucagcuccccuagggccagaccucaaucccuaccuaagucaccucgcccgaauguacaacggcuacgccggcgguuucgaaguacaagucauccucgccgguaaugcauucaccgcuggcaaaaucaucuucgcagcagucccacccacauuccccaccgaaggccuaagccccucccaaguuaccauguucccccacaucauagucgacguaagacaacucgaaccaguacucauaccccuucccgacguucgcaacaauuucuaccacuacaaccaaucaaacgacuccaccaucaaacucaucgccaugcuauacacaccccuacgcgcaaacaaccccggcgacgaugucuucaccgucuccugcagaguucucacuagaccaucccccgacuucgacuucauauuccuaguaccgcccaccguugaaucccgaacaaaacccuucucuguucccauucucacuguaggugaaaugacuaacucccgcuuccccaucaaccucgaacgccuauucaccggacccuccuccgcaaacguaguucaaccacaaaacggacgcugcaccaucgacggcgaacuacucggcaccacccaacucucauccgucaacaucugcaccuuccgcggagaugucacccacaucgguuccacacaccacuggacuaugaaccucgccagccccaacuggaacaauuacgaccccaccgaagaaacccccgcaccccuaggcacccccgacuuuguaggcaaaauccauggcaugcucacccaaacaacccaagaaaauggaagcacacgagcacaccgcgccaccgucuacgucggcuccgccgacuucacacccaaacuggguaaaguacaauucgaaacugaaaccgacuacgaccucgccauucgacaaaacaccaaauucacccccguaggcguaauccaagaaucagaccaucaccgagacgagccccaacaauggcgacuucccaacuacagcggcgccaacaccuucaacguccaccucgcaccggccgucgcccccaacuuccccggcgaacaacuccucuucuuccgcucaacacuccccggcugcggaggacaccccaacauggaccucgacugccuccuuccacaagaauggguacaacacuucuaccaagaagcagcccccgcccaauccgacguagcccuacuacgcuucgucaacccagacaccuccaggguccuauucgaaugcaaacuacacaaauccggcuacgucacugucgcacacaccggccaauacgaccuuguccuuccaucaaacgguuacuuccgauucgacucuugggucaaccaauucuacacccucgcccccaugggcaacgguaccggcagacgccgcuaa

SEQ ID NO: 39208 - RNA, 1614 nt, Artificial Sequence
  derived and/or modified sequence opt11 from VP1__Norovirus_and/or_Norovirus-like__KX514210
augaaaauggcaucaucagacgccaacccaucagacggcucagccgccaaccucguccccgaagucaacaacgaagucauggcccucgaaccagucguuggggcagccaucgccgcaccagucgcaggccaacaaaacgucaucgaccccuggauccgcaacaacuucguccaagcccccggcggcgaguucaccgucucaccccgaaacgcuccaggcgaaauucucugguccgcaccccucggccccgaccuaaaccccuaccugucccaucucgcucgaauguacaacggcuacgccggcggauucgaaguccaaguaauccuugccggcaacgcauuuaccgccggcaaaauuaucuucgcugcagucccacccaccuuccccacugaaggccuaucccccucccaagucacgauguucccucacauaaucgucgacguccgucagcucgaaccaguccuaauaccccuuccugacguucgcaacaacuucuaccacuauaaccaauccaacgauuccaccaucaaacucauagccaugcuauacacuccccuacgagcuaacaaccccggcgaugacguauucaccgucucuugccgaguacucacacgcccuucaccagacuucgauuucaucuuccuugucccucccacaguagaaucucgcaccaaaccauucucagucccaauucuaaccguuggcgaaaugaccaacagccgcuuccccgucaaccucgaaagacucuuuacaggcccauccuccgccaacguaguccaaccccaaaauggacgcugcaccaucgauggcgaacuacuaggcaccacucaacuauccagcguaaacauuugcaccuuccgcggagacgucacacacaucggauccacccaccacuggaccaugaaccucgccucacccaacuggaacaacuacgacccaaccgaagaaacccccgccccacuaggcaccccugacuucguaggaaaaauccacgguaugcuaacccaaacaacccaaggcagcggcuccacccgagcccaccgcgcaaccguauaugugggcuccgccgaguucacacccaaacuaggcaaaguccaauucaaaacagaaacagaccacgaccucaguacccgucaaaacacuaaauucacccccgucggcgucauacaagaauccgaccaccaccgcgaugaaccccaacaauggcgucuaccuaacuacuccggcgccaacaccuucaacguccaccuagcccccgcaguagcccccaacuuccccggcgaacaacugcuguucuuccgauccacccuacccggcugcggaggccaccccaacauggaccuagacugccuacuaccccaagaauggguccaacacuucuaccaagaagcugcacccgcucaauccgacguagcccugcuucguuuuguuaaccccgacaccucccgaguccucuucgaaugcaaacuucauaaauccggguacgucacaguagcacacacaggccaauaugaccucguacuacccucaaacggcuacuuccgcuuugacucaugggucaaccaauucuacacacucgccccuaugggcaacggcaccggccgaaggcgcuaa

SEQ ID NO: 39209 - RNA, 1614 nt, Artificial Sequence
  derived and/or modified sequence opt11 from VP1__Norovirus_and/or_Norovirus-like__KX514182
augaaaauggcauccucagacgcaaacccauccgacgguuccgcagccaaccucguacccgaagucaacaacgaagucauggcccucgaacccgucgucggagcagcaaucgccgcccccgucgccggacaacagaacgucaucgacccauggauccgcaacaacuucguccaagcccccggcggagaguucaccgugucaccccgcaacgcccccggagaaauauuaugguccgcuccccucggccccgaccucaaccccuaccucucccaucuggcccgcauguacaacggauacgccggcggcuucgaaguacaagucauccuagccggcaacgccuucaccgcaggcaaaaucauauucgccgccgucccacccacauucccaacagaaggccuuucccccucccaagucacaauguucccacacauuauagucgacguccgccaacuagaaccaguccuaauuccccucccagacguucgaaacaauuuuuaccacuacaaucaauccaaugacucaacaaucaaacucauagccaugcucuacacacccuuacgagcaaacaacccaggcgacgauguauucaccguuuccugccgaguacuuacgcgcccaagccccgacuucgacuucaucuuccucgugcccccuaccgucgaaucccgcaccaaaccauucagcguccccauacuuaccgucggcgaaaugaccaacucccgauuccccgucaaccucgaacgccucuucaccggacccucaucagcaaacguaguccaaccacaaaacggccgaugcaccaucgacggcgaacuccucgguaccacucaacuuucaucagucaacauaugcaccuuucguggagacgucacccacauaggcaccacccaacacuggaccaugaaccuagccagucccaacuggaacaauuacgaccccacagaagaaaccccagcaccacucggcacucccgacuucgucggcaaaauacacggcaugcuuacacaaaccacacagggaucuggauccacccgagcacaccgcgccacagucuacgucggcuccgccgaguucacccccaagcucggcaaaguccguuucgaaaccgacaccgaagacgaccucgucauccgccagaacaccaaauucacccccgucggcguuauacaauccuccgaacaccaccgcgacgaaccccaacaauggcgucuuccaaacuacucuggcgccaacacauucaacguccaccucgccccagccgucgcacccaacuucccaggagaacaacuacucuucuuccguucaacccuccccggcugcggagggcaccccaacauggaccucgacugccuccuaccccaagaauggguccaacacuucuaccaagaagccgcaccagcacaauccgacgucgcacuccuacgcuucgucaacccagacaccucacgcgugcuguucgaauguaaacuacacaaauccggcuacgucaccgucgcccacaccggacaauacgaccucguacucccaucaaacggcuacuuccgcuucgacucaugggucaaccaauucuacacccuggcccccaugggaaacggaacaggccguaaacgauag

SEQ ID NO: 39210 - RNA, 1614 nt, Artificial Sequence
  derived and/or modified sequence opt11 from VP1__Norovirus_and/or_Norovirus-like__AF425764
augaaaauggcuagcaacgacgccaaucccucagacggaaguaccgccaaccuaguccccgaagucaauaacgaaguaauggcucuagaacccgucguaggcgccgcaauagccgcccccgucgcuggucaacaaaacgucaucgaccccuggauaagaaacaacuucguacaagccccuggcggugguuucacaguaucuccccgcaacgcccccggcgaaauccucugguccgcaccccucgguccagaccucaacccauaccuaucccaucuggcccgaauguacaacggcuacgccggcggcuucgaaguacaagugauccuagcaggcuccgccucaacugccggaaaaaucaucuucgccgcagucccucccaauuuccccaccgaaggccucuccccuucacaagucacuauguucccccacaucaucguagacguccgccaacucgaacccguucucauuccacucccugacgucaggaacaacuucuaccauuacaaccaauccaacgacuccaccauuaaacucaucgcaaugcuauauacaccccuccgcgccaacaaugccggcgacgacgucuucaccgucuccugccgaguccucacccgccccucccccgacuucgacuucaucuucuuaguaccacccaccguagaaucccgcacaaaacccuucaccguacccauccuuacaguagaagaaaugucaaacucacgcuuccccauaccccucgaaaaacucuacaccggcccaucauccgcuuucguaguccaaccacaaaacggacgcugcacaaccgacggcguccuccuaggcaccacccaacucucugccgucaauaucugcaccuuucgaggagacgucacccacauagccggcucccacgacuacaccaugaaucuagccucccaaaacuggaacaacuacgacccaaccgaagaaauccccgcaccccuuggcacaccagacuucguagguaaaauccaaggcaugcuaacacaaacaaccagggaagacggcuccacccgcgcccacaaagccaccgucuccaccggaucaguacacuucacuccaaaacucggcuccguccaauacaccaccgacacaaacaacgacuuucaaaccggccaaaacaccaaauucacccccgucggagucauacaagacggaaacaaucaccaaaacgaaccccaacaauggguccuccccaacuacuccggccgcaccggccacaacguacaccuagccccugcuguagcccccacauuccccggcgaacagcuacucuucuuccgcucuacaaugcccggaugcucaggcuaucccaacaugaaccucgacugccuacucccccaggaauggguucaacacuucuaccaagaagccgcccccgcacaaucagacguagcccuccuccgcuucgucaaccccgacaccggccgaguccuauuugaaugcaaacuccacaaauccgguuacgucacugucgcacacaccggcccccacgaccucgucauuccacccaacggauacuucagauucgacuccugggucaaccaauuuuacacccucgcccccaugggaaauggcgccggaagacgccguuaa

SEQ ID NO: 39211 - RNA, 1614 nt, Artificial Sequence
  derived and/or modified sequence opt11 from VP1__Norovirus_and/or_Norovirus-like__KX514355
augaaaauggcguccucagacgcuaacccaucagacggauccacagcaaaccucguccccgaagucaacaacgaaguaauggcccucgagccagucgucggcgcagccaucgcagcucccguagccggacaacaaaacgucaucgaccccuggauaaggaacaacuucguccaagccccagguggcgaguucaccgucuccccacgaaacgcaccaggagaaauccucuggucagccccucucggccccgaccucaaccccuaccuaucccaccuugcacgaauguacaacggauacgccggaggcuucgaaguccaagucauccucgcuggcaacgccuucaccgcaggcaaaaucauauucgcagccguucccccuacuuucccaacagaaggccucucacccucacaagucacaauguucccccacauaauaguugacguccgccagcuugaacccgucuuaauuccccuaccagacguccgcaacaacuucuaccacuacaaucaauccaacgacuccaccauaaaacuuauagccaugcuauacacaccccuacgugccaacaaccccggugacgacgucuucaccguauccugccgcguccuaacccgacccucccccgacuucgacuucauuuuccucgucccuccaaccguagaaucccgcacuaagcccuucagcgucccaauccuaaccgucggagaaaugaccaacucccguuuccccaucaaccuggaaagacuuuucaccggcccauccuccgccaacguaguccaaccccagaacggccgcugcaccaucgacggcgaacuccucggaacgacccaacucuccucugucaacaucugcaccuuccgaggcgacgucacacaaaucggcucaacccaacacuggaccaugaaccuagccucccccaauuggaacaacuaugacccaaccgaggaaacacccgccccacuaggcacccccgacuucgucggaaaaauacacggaaugcucacccaaaccacccaagaaaacggcucaacccgcgcccacagagccaccgucuacguaggaggagccaacuucacuccuaaauuaggcaaaguacaauucgaaaccgacaccuccgacgaccucgcaauaagacaaaacaccaaauucacccccgucggcgucauccaaucauccgaccaccaccgcgacgaaccccaacaauggagacuccccaacuacagcggcgccaacaccuucaacguacaccucgcgccagcuguagccccuaacuucccaggcgaacaacuucucuucuuccgcuccacccuaccuggcugcggcggacacccaaacauggacuuagacugccuacucccccaagaauggguccaacacuucuaccaagaagcagccccugcccaaucugacgucgcccuccuccgcuucgucaacccugacacaucacguguucucuucgaaugcaaacuacacaaauccggcuaugucacagucgcucacaccggccaauacgaccucgucuugccuuccaacgguuacuuccgcuucgacuccuggguuaaccaauuuuauacccucgcccccauggguaacgguaccggucgccgccgcuaa

SEQ ID NO: 39212 - RNA, 1614 nt, Artificial Sequence
  derived and/or modified sequence opt11 from VP1__Norovirus_and/or_Norovirus-like__KX514345
augaaaauggccucaaacgacgcaaaccccucagacggauccgccgccaaccuaguccccgaaguaaacaacgaagucauggcucucgaacccguugucggcgccgccaucgccgcacccgucgcuggccaacaaaacgucauugauccuuggauacgaaacaacuucguccaagccccaggaggugaauucaccguaagcccacgaaacgcaccuggcgaaauacuauggagugccccacucggcccagaucucaacccauaccucucacaccuagccagaauguacaacggcuacgccggcggcuucgaaguacaagucauacucgccggaaacgccuucaccgccggaaaaauaaucuucgccgccguacccccuaacuuccccaccgaaggccucucaccaucacaggucaccauguuuccccacaucaucgucgacguccgccaacucgaacccguccuaaucccccucccggacguccgaaacaacuucuaccacuacaaucaauccaacgacucaaccaucaaacuuaucgccaugcuauacaccccccuccgagccaacaacgccggagacgacgucuucacaguauccugucgaguccucacccgaccauccccagacuucgacuucauuuuccuaguucccccaacagucgaaagucgcuccaagcccuucuccguccccguccucaccgucgaagaaaugaccaacucccgcuucccaguaaaccucgaacgacucuucacaggcccauccuccgccaacguaguccaaccccaaaacggacgcugcaccaucgacggcgaacuacucggaacuacucaacucucgucaguaaacauaugcaccuucagaggcgacgugacucaaauaggagccacacgccacuggacuaugaaccucgcaucacuuaacuggaacaauuaugaccccacagaagaaacucccgccccacucggcacccccgacuucguaggcaaaauccacggaaugcuaacccaaaccacacaaggauccggcucaacccgagcccaccgagcaaccgucuacguaggagccgccgaauucacaccuaagcucggcaaaguccgcuucgaaaccgacacagaagacgaccuagucauccgccaaaacaccaaauucacacccgucggagucauacaaucaucagaacaccaccgagacgaaccacaacaguggcgucuacccaacuacucuggugcaaacacauucaacguccaccuagcaccagccguagcuccuaacuuccccggugaacaacuccuauucuuccgcucaacccuacccggaugcggaggacaccccaacauggaccucgacugccuccuaccccaagaauggguccaacacuucuaucaagaagccgcccccgcacaguccgacguagcacuccuacgcuucguaaaccccgacaccuccagaguccucuucgaaugcaaacuacacaaaucaggcuacgucaccgucgcccacaccggccaauacgaccucguccucccaucaaacggcuacuuccgcuucgacucuugggucaaccaauucuacacccucgcccccaugggcaacggaaccggaagacgccgguga

SEQ ID NO: 39213 - RNA, 1614 nt, Artificial Sequence
  derived and/or modified sequence opt11 from VP1__Norovirus_and/or_Norovirus-like__KX514204
augaagauggccuccuccgaugccaaccccuccgacggcuccgccgccaaccucguccccgaggucaauaacgaagucauggcccuagaacccgucgucggcgcagccauagccgccccuguagccggacaacaaaacgucaucgaccccuggauccgcaacaacuucguccaagcgcccggaggcgaauuuaccgucuccccacgaaacgcccccggcgagauucuguggucugcaccacucggccccgaccuaaacccauaccucucccaccucgcccguauguacaacggcuaugccggcggcuucgaaguccaagucauucucgccggcaacgccuuuacagccggcaaaaucaucuucgcagccgucccacccacauuucccaccgaaggccucucccccucccaagucacaauguucccacacaucaucguagacguccgccaacucgaaccaguccucaucccccucccagacguccgcaacaacuucuaucacuacaaccaauccaacgacucaaccaucaagcucaucgccaugcucuacacaccacuccgcgcaaacaaccccggcgacgacguauucaccgucagcugccgcguucuaacccgacccucacccgacuucgacuucauauuucucgucccuccaaccgucgaaucccgaaccaaaccauucuccguacccauccucaccguaggcgaaaugaccaacuccagauuccccaucaaccucgaacgccuauucaccggccccuccucggcaaauguaguccaaccccaaaauggccgaugcaccaucgauggcgagcuccucggcacaacucaacuuuccagcgucaauauaugcaccuucagaggcgaugucacacacauaggcucaacacaccacuggaccaugaaccucgccucccccaacuggaacaacuacgacccuaccgaagaaacccccgcuccccucggaacucccgacuucguaggcaaaauccacggaaugcucacccaaacgacacaagguuccggcucgacaagggcccaucgcgccaccguauacguaggcggcgccgaguucacaccuaaacuaggaaaaguacaauucaaaaccgaaacagaccaugaccuaucaauacgucagaacaccaaauucaccccagucggagucauacaagaguccgaccaccaccgggaugaaccacaacaauggcgccucccuaacuauuccggcgccaacaccuucaacguccaccucgccccagccgucgcccccaacuuccccggcgaacaacuucucuucuuucgcuccacccuccccggcugcggcggccaccccaauauggaccucgacugccuccucccccaagaauggguccaacauuuuuaccaagaggccgcucccgcccaauccgacgucgcacuccuccgauucguaaacccagauacaucccgcguccuuuucgaauguaaacuacacaaaucaggauacgucacagucgcacacaccggacaauaugaccucguacuccccucaaacgguuacuuccgcuucgacagcugggucaaucaauucuacacccuagcacccaugggcaacggcacaggccgacggcgcuaa

SEQ ID NO: 39214 - RNA, 1614 nt, Artificial Sequence
  derived and/or modified sequence opt11 from VP1__Norovirus_and/or_Norovirus-like__KF712492
augaaaauggcaucaucugacgccaaccccuccgacggaagcaccgcuaaccucguaccagaagccaacaacgaaguaauggcccucgaacccguaguaggagcagccaucgccgcuccagucgccggacagcaaaacguaauagacccuuggauccguaacaacuucguccaagcccccggcggagaauuuaccgucagcccacgcaaugcccccggcgaaauccuauggagcgcucccuuaggccccgaccucaaccccuaccucagccaccucucccgcauguacaacggcuacgccggcggcuucgaaguccaaguaauacucgccggcaacgcauucgccgccggcaaaauaaucuucgccgccgugccacccaacuuccccacagaaggacucucccccucacaagucaccauguucccccaccucaucguagacgucagacaacucgaacccgucaugaucccccuacccgacauccgcaacaacuucuaccacuacaaccaaucaaaugaccccaccaucaaacucauagccaugcuauacacaccccuccgcgccaacaacguaggcgacgacgucuucaccgucucaugccgcguccuuaccagacccucacccgacuucgacuucaucuuccucguacccccaacugucgaaucuaaaacaaacccauucuccguccccauccuaaccaucgaagaaaugaccaacucccgauuccccauaccacuugaaaaacucuucaccggcccuuccucugcacucgucguccaaccccaaaacggucgcugcaccacugacggcguccuccucggaaccacacaacucucuccggucaacauaugcaccuuccgaggugacguuacccacaccaccaaaacccacaccuaccaaaugaaccucgcagcacaaaacuggaacuccuaugaccccaccgaagaaauccccgccccacuaggcacccccgacuucgucgguaagauccagggaguccugacccaaacaaccaaaggcaacggcuccacccgcgcccacaaagccaccgucuacaccggcuccgcagaguucacccccaaacucggccggauccagcucuuuaccgacaccgacaacgaccucgaagccaaccaaaacaccaaauuuacccccgucggcguuauccaagacggcgacacccaccaaaacgaaccccaacaauggguccuccccucuuacucaggccgcaacaaucacaacguucaccucgcacccgccguagcgcccaccuucccaggcgaacaacuccucuucuuccgcuccaccaugccuggaugcuccggcuacccaaauaugaaccucgacugucugcuaccacaagaauggguccaguacuucuaccaagaagccgcccccgcacaauccgacgucgcccuccuccguuucguaaaccccgacacaggacgcgucuuauucgaauguaaacuccacaaauccggcuacgucaccgucgcccauaccggccaccacgaucucuucaucccucccaauggcuacuuccgauucgacuccugggucagccccuucuacaccuuagcuccaaugggcaacggcacuggucgcagacgauaa

SEQ ID NO: 39215 - RNA, 1614 nt, Artificial Sequence
  derived and/or modified sequence opt11 from VP1__Norovirus_and/or_Norovirus-like__DQ078829
augaaaauggcaucuaacgacgcuaacccaucagacggcucugccgccaaccuaguccccgaagucaacaaugaagucauggcacuagaaccagucguaggcgccgccauagcugcgcccgucgccggacaacaaaacgucauagaccccuggauccgaaacaacuucguccaagccccagguggcgaguucaccgucucuccccguaacgcuccuggagaaauacuauggucugcaccccuaggccccgaccucaacccauacccgucucaccucgcccgaauguacaacggauaugccggcggcuucgaaguucaagucauacuugcaggcaacgccuucaccgccgguaaaaucaucuuugccgccguaccacccaacuuccccacagaaggccugucccccucucagguaacuauguucccccacaucaucgucgacguccgccaacucgaucccguccuaauacccuccccagacguacgaaacaauuucuaccacuacaaccaauccaacgacucaaccauuaaauuaaucgccaugcuauauaccccacuccgcgccaacaacgcaggcgacgacgucuucaccguuuccugcagaguacucacccgcccaucacccgacuucgacuucauauuccuuguaccucccacuguugaauccagaacaaaacccuuuaccgucccaauccuaacagucgaagaaaugucaaauucccgcuuccccaucccacuagaaaaacucuacaccggcccauccucagcauucguaguccaaccccaaaacggaagaugcaccaccgacggcguccuacucggaacaacacaacuaucagccguaaacaucugcaccuuccgaggcgacgucacccacaucgcaggcucacacgacuacaccaugaaccuagccucccaaaacuggauaaauuacgauccaaccgaagaaaucccagcaccucugggcacacccgacuucgucggcaaaauccaaggaaugcuuacccaaaccacccgagaagacggcuccacccgcgcccacaaagccaccgucuccaccgggucaguacacuucacacccaaauuaggcagcguccaauacaccacagacaccaacaacgacuuccaaacaggccaagacacaaaauucacccccgucggcguaauccaggacggcaacaaccaccaaaacgaaccccaacaauggguucuaccuaacuacuccggccggacaggccacaacguccaccuagcgcccgccguagcccccaccuuccccggugaacaacucuuauucuuccgcuccaccaugcccggcugcucgggcuaccccaacaugaaccucgacugccuacuaccccaagaauggguacaacacuucuaucaggaagccgcccccgcucagccggacgucgcccuccuacgcuucgucaacccagacaccggccgaguccuauucgaaugcaaacuacacaaaucaggcuacgucaccguagcccacacaggcccacacgaccuaguaauuccaccaaacgguuacuuccgcuucgauuccuggguuaaccaauucuacacccucgccccuaugggcaacggugccggccgccgaagauaa

SEQ ID NO: 39216 - RNA, 1614 nt, Artificial Sequence
  derived and/or modified sequence opt11 from VP1__Norovirus_and/or_Norovirus-like__KX514370
augaaaauggccuccaacgacgcaaaccccagcgacggcagcgcugcaaaucuaguccccgaaguaaacaaugaagugauggcccuagaacccguagucggcgcagcaauagcagcucccgucgccggccaacaaaacguaauagaccccuggaucagaaacaacuucguucaggccccaggaggcgaguuuacagucuccccgcgcaacgcccccggugaaauccucugguccgcaccccucggacccgaccuaaaccccuaccuuucccaccucgcccgaauguacaacggcuacgcaggaggauucgagguccaagucauacucgccggcaaugcauucacagccggcaaaauaaucuucgcagccgucccacccacauuccccaccgaaggacucucccccucacaagucacgauguucccccacaucaucgucgacguucgccaacuagaacccguacucauuccccuacccgacguccgcaacaacuucuaccacuacaaucaauccaacgauuccaccaucaaacucauagccaugcucuacacaccccuacgcgccaauaacccaggcgacgaugucuucacagucucaugccgaguucucacccgccccucccccgacuucgacuucaucuuccucgugcccccaaccguagaaucacgaaccaaaccuuucuccgucccaauccucacugucggcgaaaugaccaacucucgcuuucccgucaacuuagaacgacucuucacagguccuucaucagcaaaugucguccaaccucaaaacggacgcugcaccauugacggugaacuccucggcaccacccagcuuuccagcgucaacaucugcacauuccgaggagacgucacacaaaucggagcaacccgacauuggacaaugaaccucgcuucacccaacuggaacaacuacgaccccaccgaagaaacuccagcuccacucgguacccccgacuuuguaggcaagauccacgguaugcuaacacaaacaacccaaggauccggcucaacuagagcccaccgcgcaaccgucuauguaggcggcgccgaguucacccccaaacucggcaaagugcgauucgaaaccgacaccgaagacgaccuagucauccgacaaaacacuaaauucacaccagucggagucauccaauccuccgaacaccaccgagacgaaccccagcaauggcgacucccaaauuacucaggcgcaaacacauucaacguccaccucgcaccagccgucgcaccaaacuuccccggcgaacaacuucuauucuuccgcuccacccuccccggcugcggagggcaccccaacauggaccucgacugccuccuuccacaagaauggguccaacacuucuaccaagaagccgcacccgcccaauccgacgucgcacuccugcgcuucguaaaccccgacaccucaagaguccucuucgaaugcaaacuccacaaauccggauacguaaccgucgcacacaccggucaauacgaccuaguccucccuuccaacgguuacuuccgcuucgacagcugggucaaccaauucuacacgcucgcccccaugggcaacggcacggguaggcgccgcuga

SEQ ID NO: 39217 - RNA, 1614 nt, Artificial Sequence
  derived and/or modified sequence opt11 from VP1__Norovirus_and/or_Norovirus-like__KX514332
augaaaauggccuccucugacgccaaccccuccgacggcucaacagcaaaccuaguccccgaagucaacaacgaagucauggcucucgaacccguagucggcgccgccaucgcugccccaguagccggccaacaaaacguaaucgaucccuggauccgcaauaauuucguccaagcacccggcggugaguucacaguuagcccccgcaacgcacccggcgaaauucucugguccgcuccccucggaccagaccuaaaccccuaccucucucaccucgcccgcauguacaacggcuacgccggcgguuucgaaguucagguaauccucgccggcaacgccuucaccgccggaaaaaucaucuucgccgccgucccaccaaccuuccccaccgaaggucuaucacccagccaagucacaauguucccgcauaucaucgucgacguacgccaacucgaaccaguccucauaccgcugccagauguacgaaacaacuucuaccacuacaaccaauccaaugacucuacaaucaaauuaaucgccaugcucuacaccccucuacgcgccaacaaucccggagacgacguauucaccgucucuugucgcguccucacacgucccucccccgauuucgacuucaucuuccucguaccaccaacagucgaaucccgaaccaaacccuucuccguacccauacuaaccgucggcgaaaugaccaacucacgcuuccccaucaaccucgaacgccuauucaccggaccuuccuccgcuaacgucguccaaccacaaaacggccgcuguaccaucgacggcgaacuacucggcaccacacaacucuccucaguaaacauuugcacauuccgaggcgacgucacgcaaaucggcucaaccaaacacuggacuaugaaccucgcaucccccaacuggaacaacuacgauccaaccgaagaaacccccgcuccuuuaggcacccccgacuucgucggcaaaauccacggaaugcucacacaaaccacccaagaaaacggcaguacccgcgcccaccgugcuacuguauaugucggcggcgccaacuuuacacccaaacucggcaaaguccaauuugaaacagacaccgucgacgaccuagaaauacgccaaaacacaaaauucacccccguaggcgucauccaauccucggaccaucaccgcgacgaaccacaacaauggcgccuaccuaauuacuccggcgccaacaccuucaacguccacuuagccccagccgucgccccgaacuuccccggagaacaacuccucuucuuccgaucuacccuucccggcugcggaggccauccaaacauggacuuagacugccuacucccccaagaauggguccaacacuucuaccaagaagccgcccccgcccaaagcgacgucgcccuacuccguuucgucaaccccgacacaucccgcguccuauucgaaugcaaguuacacaaauccggcuacgucacuguggcccacaccggacaauacgaccuaguucuccccuccaacggauacuuccgcuuugacuccugggucaaccaauuuuacacccuagcacccaugggcaacggcacuggccgccgacgcuaa

SEQ ID NO: 39218 - RNA, 1614 nt, Artificial Sequence
  derived and/or modified sequence opt11 from VP1__Norovirus_and/or_Norovirus-like__KX514276
augaaaauggccuccucugacgccaauccaagcgacggaucggcagcaaaccuuguccccgaagucaacaacgaaguuauggcacucgaaccaguggucggcgcagccauagcagcccccguagccggccagcaaaacgucaucgaccccuggauucgcaacaacuuuguccaagcacccggaggcgaauuuacagucucccccagaaaugccccaggcgaaauacucugguccgcuccccuaggccccgaccucaaccccuaccucucacaccuagcccgcauguacaacggcuacgccggaggauucgaaguccaggucauccucgccgguaacgccuuuaccgcaggcaaaauaauauucgccgccgucccacccacauuccccaccgaaggccuaucccccucccaaguaacuauguucccacacauaauugucgacguacggcaacucgaacccguucucauaccccugcccgacguccgcaacaacuucuaccacuacaaccaaagcaacgacucaaccaucaaacucaucgccaugcucuacacaccccuccgagccaacaacccgggagacgacgucuucaccguauccugcagagucuuaacccgaccaucccccgacuucgacuuuaucuuccucgugcccccaaccgucgaaucccgcaccaaacccuuuucagucccaauccucaccguuggcgaaaugaccaacucccgcuuuccagucaaccucgaacgacucuucacuggccccagcuccgccaacguaguccaaccucaaaacggacgcugcacaaucgacggcgaacugcucggcacaacacaacuauccuccguaaacaucugcacauuccgaggagacgucacccacauaggaacaacccaccacuggaccaugaaccuagcaaguccaaacuggaauaacuacgaccccaccgaagaaacccccgccccucucggaacccccgacuuuguaggaaaaauacacgguaugcucacccaaaccacacaaggauccggcucuacaagagcccaccgagcuaccgucuacgucggcagcgcugaguucaccccuaaacuaggcaaaguccguuucgaaacagacacagaagacgaucucguaauaagacaaaacaccaaauucacccccgucggcguuauccaaucauccgaccaccacagagaugagccccaacaauggcgacuacccaacuacucaggcgcaaauacauucaacguacacuuagcccccgcugucgccccaaacuuccccggagaacaacuucucuucuuccgaucaacucuccccggcugcggcggacaccccaauauggaccucgauugccuacuuccccaagaauggguccaacacuucuaucaggaagccgccccagcacaguccgacguagcacuccuaagauucgucaaccccgacaccagccgcguccucuucgaaugcaaacuacauaaauccggcuacgucaccguagcacacaccggacaauacgaccuuguccucccauccaacggcuacuuccgcuucgacuccugggucaaccaguucuacacccucgcccccaugggcaacggaacaggaagacgccgcuaa

SEQ ID NO: 39219 - RNA, 1614 nt, Artificial Sequence
  derived and/or modified sequence opt11 from VP1__Norovirus_and/or_Norovirus-like__KX514256
augaaaauggccucaucggacgcaaaccccucugacggaucagcugccaaccuaguccccgaagucaauaacgaagucauggcccucgaacccgucgucggcgccgccauagccgcccccgucgccggccaacaaaacgucaucgaccccuggauccgcaacaacuucgugcaagcccccggcggcgaauuuaccgucuccccacgcaacgcaccaggagaaauacuauggagcgcuccacuaggucccgaccucaacccauaccucucacaccuagcccguauguacaacggauacgccggcggcuucgaaguacaagucauacucgccggcaacgccuucaccgccggcaaaauaaucuucgcagccguaccucccacuuuccccaccgaaggccuaucgcccucgcaagucacaauguuuccccacaucaucgucgacgucagacaacucgaaccaguacucauaccccuacccgacguaagaaauaacuucuaccacuacaaccaauccaacgacucaaccaucaaacuaauagccaugcuauacacaccccuccgagccaacaacccaggagacgaugucuucacugucuccugccgcguacucacccguccaucccccgacuucgacuucaucuuccuaguuccacccaccgucgaauccaggaccaaacccuucagcguccccauccucacaguaggagaaaugacaaacucaagauucccuaucaaccucgaaggccucuucacaggacccuccucugcaaacguaguccaaccccaaaacggacgcugcacaauagacggagaacuccucggaaccacccaacuaucaagcguaaacaucugcacauuccgcggugacgucacacacaucggcuccacccaccacuggacaaugaaucuugccucuccaaacuggaacuccuacgaccccaccgaagaaacccccgcaccacuuggcaccccagacuucgucggcaaaauccacggcaugcucacacaaacaacccaaggguccggcucuacccgcgcccaccgcgcaaccgucuacguagguucagcagaguucacaccaaaacuaggcaaaguccaauuuaaaacugaaaccaaccacgaccuauccauccgccaaaacacaaaauucacaccagucggcguaauccaggaauccgaccaccaucgcgacgaaccacaacaauggcgccucccaaacuacuccggcgccaacaccuucaacguacaccucgccccagcaguagcccccaacuuccccggugaacaacuccucuucuuccgcucaacacuccccggcugcgguggccaccccaacauggaucucgacugccuucuaccccaagaauggguacaacauuuuuaccaagaagccgcccccgcccaauccgacgucgcccuccuacguuucgucaaccccgacaccuccagaguucucuuugaaugcaaacuccacaaauccggcuacgucacugucgcccacaccggucaauacgaccuuguacucccucccaacgguuacuuccgcuucgacuccugggucaaccaauucuauacccucgcucccaugggcaacggcacaggacgccgacgauaa

SEQ ID NO: 39220 - RNA, 1614 nt, Artificial Sequence
  derived and/or modified sequence opt11 from VP1__Norovirus_and/or_Norovirus-like__KX514209
augaaaauggcauccuccgacgcaaacccauccgauggcuccgcagccaaccucguccccgaaguaaacaacgaagucauggcacuugagcccgucgucggcgccgcaaucgccgcccccgucgccggccaacaaaaugucauagaccccuggauccgcaacaacuucguccaagcccccggcggcgaguucacugucucuccacgcaaugcccccggagaaauccucuggucugcaccccuaggacccgaccuaaauccauaccucucacaccucgccagaauguacaacggcuacgccggcggcuucgaaguacaaguaauccuagccggcaacgccuucaccgccggaaaaaucauauucgccgccgucccaccaaccuuucccaccgaaggccucagccccucccaagucacaauguucccucacauaaucgucgacgucagacaacucgaacccguacucaucccucuccccgacguccgcaacaacuucuaccacuacaaccaaagcaacgacuccaccaucaaauuaaucgccaugcucuacacaccccuccgcgccaacaacccaggggacgacgucuucaccgucucaugccgcguccucacccgccccucccccgacuucgaccucauauuccucgucccucccaccgucgaaagccgaaccaaacccuucucggucccaauccucaccgucggagaaaugaccaacucccgcuuccccgucaaccuggaacgccuauucaccggccccucuucagccaacgucguacaaccacaaaacggccgcugcaccauugacggcgagcuucuaggcaccacccaacucuccuccgucaacauaugcaccuuccgcggcgacguaacccauauaggcuccacacaccacuggaccaugaaccuagccucacccaacuggaacaacuacgacccgacagaagaaacacccgcaccccucggcacucccgacuucgucggcaagauccacggcaugcuuacacaaacaacccaaggcuccggcucaacccgcgcccaccgagccaccgucuacguaggauccgccgaguucaccccuaaauuaggaaaaguccaauucaaaacugaaaccgaccacgaccuaucaauucgacaaaacaccaaguucacucccgucggcgucauccaggaaagcgaccaccaucgagacgaaccccaacaauggcgacuacccaacuacuccggcgccaacacauucaacguacaccucgcccccgccgucgcccccaacuuccccggcgaacaacuacucuucuuccgaucuacacucccaggcugcggcggacaccccaauauggaccucgauugcuuacucccacaagaauggguccaacacuucuaccaagaagccgcccccgcccaaucagacguagcccuccuccgauucgucaaccccgauaccucgcgcguccucuucgaaugcaaacuacacaaaucuggauacguuaccgucgcccacaccggacaauacgaccucguccuacccuccaauggauacuuccgcuucgacucaugggucaaccaauucuacacccucgcccccauggguaacggcacaggccgccgccguuaa

SEQ ID NO: 39221 - RNA, 1614 nt, Artificial Sequence
  derived and/or modified sequence opt11 from VP1__Norovirus_and/or_Norovirus-like__KX514205
augaaaauggcuuccuccgaugccaaccccucagacggcucagccgccaaccuaguacccgaagucaauaacgaagucauggcccuugaaccaguaguaggcgcagccaucgcagcccccgucgccggccaacaaaacgucaucgaccccuggaucagaaacaacuucguccaggcaccuggcggcgaguucaccgucaguccccgcaacgccccaggagaaauccuguggagcgcaccccucggccccgaccucaacccauaccucagccaccucgcccggauguacaacggauacgcuggcgguuucgaaguacaagucauccucgccggaaaugcguucaccgcagguaaaaucaucuucgcagcggucccacccaccuuccccaccgaaggacucucacccucucaaguaaccauguuuccccacauuaucguagacgucagacaacuagaacccguccucaucccccuccccgauguacgaaacaacuucuaucauuacaaccaauccaacgacuccaccaucaaacuaaucgcaaugcucuacacaccccuuagagcuaauaaccccggagacgacguauucacagucucaugccgaguccuaacccgacccucccccgacuucgacuucaucuuccucguuccacccaccgucgaaucacgcaccaaacccuucagcguacccauucucaccguaggcgaaaugacuaacagccgauuccccauaaaccuugaacgacuuuucacuggcccauccagcgccaaugucguccaaccccaaaacggccgcugcaccaucgacggcgaacuccucggaacaacccaacucuccucaguaaacaucugcacuuuccgcggagacguaacccacauuggaucaacccaccacuggacuaugaaccuagcaucccccaacuggaacaacuacgaccccaccgaagaaacccccgcaccccucggcaccccagauuucgucggaaaaauccacggcaugcucacacaaaccacacaaggauccgggucaacucgagcccaccgcgccaccgucuacgucggcggcgccgaauuuaccccgaaacucggaaaaguacaauucaaaacagaaaccgaccaugaucucucuauacgccaaaacaccaaauucaccccagucggcguaauacaagaaagcgaucaucaccgcgaugaaccccaacaauggcgccucccuaacuacucaggcgcuaacaccuucaacguacaccucgcccccgcagucgccccgaacuuccccggcgaacaacuacuauucuuccgcuccacacucccaggcugcggcggccaccccaauauggaccucgacugccuccucccccaagaauggguccaacacuucuaccaagaagccgcccccgcccaaucggacguggcccuccuacgauuuguaaaccccgacaccucccgcguccucuucgaaugcaagcuacacaaaucaggcuauguuaccguagcccacacaggccaacaugaccucgucauacccccaaacggcuacuuccgauucgacagcugggucaaccaauucuacacucucgcaccuauggggaacggcacgggaagacgccgcuaa

SEQ ID NO: 39222 - RNA, 1614 nt, Artificial Sequence
  derived and/or modified sequence opt11 from VP1__Norovirus_and/or_Norovirus-like__KX514200
augaaaauggccucauccgacgccaaccccagcgacgguucagccgccaaccuagucccagaagucaacaacgaagucauggcacucgaacccgucgucggcgccgccaucgccgcccccgucgccggacaacaaaacgucaucgaucccuggaucagaaacaacuucguacaagcccccggcggcgaauuuaccguaucuccacgcaacgcccccggcgaaauccugugguccgccccacucggaccagaccucaaucccuaccugucccaucuagcucgcauguacaacggcuacgcaggaggauucgaaguccaagucauccucgcuggcaacgcauucaccgccggcaaaauuaucuucgccgcagucccucccaccuuccccaccgaaggucuuucccccucccaaguuaccauguucccccacauaauagucgacguucgccaacuugaacccguccucaucccccuccccgacguacgcaacaauuucuaccacuacaaccaaucaaacgacuccacuaucaaacucaucgccaugcucuauacaccccuccgcgccaacaaccccggagacgacguuuucaccgucuccugccgcguccuaacccgccccucaccugacuucgacuucaucuuccuagucccucccaccguagaaucccgcacaaaacccuucuccguacccauccucaccgucggugaaaugaccaacucccgauuccccaucaaccucgaacgccucuucaccggaccauccucugcaaacgucguacaaccacaaaauggccgcugcaccauagacggcgaacuccucgguaccacacaacuaucaccagucaacaucugcaccuuccgcggcgacgucacccacauaggaacgaccagacacuggaccaugaaccucgcaucgcccaacuggaacaacuacgaucccacugaagaaacacccgcaccacuaggcacccccgacuucgucggcaaaauccacggaaugcucacccaaaccacacaaggauccggcagcacacgcgcccaccgcgccaccguauacgucggcuccgcagaguucaccccaaaacuaggcaaaguacaauucaagaccgaaacugaccacgaccucuccauccgucaaaacaccaaauucaccccagugggcgucauacaaaaauccgaccaccaccgagacgaaccucaacaauggcgccucccaaauuauuccggagccaacacauucaacguacaccucgcccccgcagucgcucccaacuuccccggggaacaacuccucuuuuuccgcuccacccuccccggcugcggaggccaccccaauauggaccuagacugucuccuuccccaagaauggguccagcacuucuaccaagaagcagcccccgcacaaucagacgucgcucuacuccgcuucguaaaccccgacaccucccgaguccuauucgaaugcaagcuacacaaauccgguuacguuaccguugcacacaccggacaauacgaccucgucuuaccaucuaacggauacuuccgcuucgacucaugggucaaccaauuuuacacacuggccccaauggguaacgguaccggacgcagaagauaa

SEQ ID NO: 39223 - RNA, 1614 nt, Artificial Sequence
  derived and/or modified sequence opt11 from VP1__Norovirus_and/or_Norovirus-like__KX514196
augaaaauggccucaagcgacgcaaaccccuccgacggguccgccgccaaucuuguucccgaaguaaacaacgaagucauggcacuagaaccagucgucggcgcagccauagccgcaccaguugccggacaacaaaauguaaucgacccauggaucagaaacaauuucguccaagcccccggcggcgaguucaccguaucgccccgcaaugccccuggcgaaauccucugguccgccccucucggcccagaccucaacccuuaccucucccacuuagcccgcauguacaacggcuacgccggcggcuucgaaguacaagucauccucgccggcaacgucuucacagccggaaaaauaauauucgcugccgucccacccaccuucccuacugaaggacucucacccagccaaguaaccauguucccccacaucauaguugacguccgccaacuagaacccguccugauaccccuucccgauguccgaaacaacuucuaccacuacaaccaaucaaacgacucuaccaucaaacuaauugccaugcuauacacaccccuccgcgcaaauaacccaggcgaugacgucuucacagucuccugucgcguacuaacucgccccucaccugacuucgacuucaucuucuuaguaccacccaccgucgaaucccguaccaaacccuucuccguucccauacuuaccgucggcgaaaugaccaacucucgcuucccaaucaaccucgaacgccucuucaccggccccagcuccgccaacguagugcaaccacaaaacggccgcugcaccaucgacggcgaacuccugggcacaacccaacugucaagcgucaacauaugcaccuuccgaggcgacgucacccacauaggaucaacucaccacuggaccaugaaccucgcaucacccaacuggaacaacuacgaccccacugaagaaacacccgcaccccucggaaccccagacuucgucggaaaaauccacggcaugcucacacaaaccacccaaggcuccggcucuacccgcgcacaucgagcaacaguguacguagguggcgcagaguucacaccaaaacuuggcaaagugcaauuuaaaacugaaacagaccacgaccucaccauccgacaaaacaccaaauucacacccguaggcgucauccaagaauccgaccaucacagagacgaaccccaacaauggcgccuaccaaacuacuccggugcaaacaccuucaacguccaccuagcccccgcaguagcaccaaauuuucccggcgaacagcuucucuucuuccguuccacacuacccggcugcggcggucaccccaacauggaccuagacugccuccucccccaagaauggguccaacacuucuaccaagaagccgcacccgcacaaagcgaugucgcccuccuccgcuucgucaaccccgacaccucacgcguccuauucgaaugcaaacuccacaaauccgguuacgucaccgucgcacacaccggacaauacgaccucguacuccccagcaacggcuacuuccgcuucgacuccugggucaaccaauucuacaccuuagcccccauggguaacggcaccggcagacgacgauaa

SEQ ID NO: 39224 - RNA, 1614 nt, Artificial Sequence
  derived and/or modified sequence opt11 from VP1__Norovirus_and/or_Norovirus-like__AB985437
augaaaauggccuccaacgacgcgaaccccucugacggaucggccgccaaccucguacccgaagucaacaaugaagugauggcccucgaacccguagucggcgccgccaucgccgccccaguugccggccaacaaaacgucaucgaccccuggauccgaaacaacuucguucaagccccuggcggcgaguucaccgucucgccacgcaaugcucccggugaaauccucuggucugccccacucggcccagaccuuaacccauaccucucccaucucucccgcauguauaacggcuacgcaggcgguuucgaaguucaaguaauacucgccggcaacgccuucaccgccggcaaaguuaucuuugccgccguaccucccaacuuccccacagaaggucuaucaccaucccaggucaccauguucccacacaucaucguugacguccgacaacucgaaccaguacucauaccccucccagacguacgcaacaacuucuaccacuacaaccaagcacaugacuccacucucaaacucauugcaaugcucuacacaccccuacgggcaaacaacgcuggcgacgacgucuucaccgucuccugccgcguacuuacacgacccucucccgacuucgacuuuaucuuccucgucccacccacaguagaauccagaacaaaacccuucacagucccuauccuuacaguagaagaaauguccaacucacgcuucccaaucccacucgaaaagcucuacaccggcccgagcucagcauucguaguacaaccacaaaacggcagaugcaccaccgacggagucuuacucggcacgacccaacuauccgcaguaaauaucugcaacuucagaggugacgucacacacaucguaggcagccacgacuacacaaugaaccucgucucccaaaacuggaacaacuacgaccccacagaagaaauccccgccccucucggcacacccgacuucgucggaaaaauacaaggacuacucacccaaaccacccgcgccgacgggucaacccgcgcacacaaagcaaccguaucaaccggcuccguacauuuuacacccaaacuagguuccguccaauuuaccaccgacaccaacaacgacuuccaaaccggccaaaacacaaaauuuacaccaguaggagucauacaagacggcgaccaucaccaaaacgaaccacaacaauggguccuaccuaacuacuccggcaccucaggccacaacguacaccuagccccagccgucgcgcccacauuccccggcgaacaacuccucuucuuccgcucaaccaugcccggcugcuccggauaccccaacaugaaccuagacugccuccuaccccaagaauggguccuccacuucuaucaagaagcagcccccgcccaauccgacgucgccuuacuuagauucgucaacccagacacaggcagaguccucuucgaaugcaaacuccacaaauccucauacaucacugucgcacacaccggucccuacgaucuugucaucccacccaacggcuacuuccgcuucgacucauggguaaaccacuucuacacccucgcacccaugggcaacggcaccggaggacgacgauga

SEQ ID NO: 39225 - RNA, 1614 nt, Artificial Sequence
  derived and/or modified sequence opt11 from VP1__Norovirus_and/or_Norovirus-like__KF712494
augaaaauggccucauccgaugccaacccaucagacggcuccacagcaaaccucguucccgaagccaacaacgaagucauggcccuagaacccgucgucggagccgccaucgcugcccccgucgcaggccaacaaaacguaaucgacccuuggauccgcaacaacuucguacaagcccccggcggugaauuuacaguuagcccccgcaacgccccuggcgaaguacucugguccgccccacucggacccgaccucaaccccuaccuaucccaccucgcccgaauguacaacggcuacgccggcggcuucgaaguccaaguaauccuagccggaaacgcauuugccgccggcaaaauaauauucgcagcaguacccccaaacuuccccaccgaaggccuaucccccucccaagucaccauguucccacaucucaucaucgacguccgccagcucgaaccugucaugaucccccugccagacguccguaacaacuucuaccacuacaaccaauccaacgaccccaccaucaaacucaucgccaugcucuacaccccacuccgagccaacaacguuggcgacgacguauucaccgucucuugccgcguccuaacccgccccucgcccgacuucgacuucauauuccucguuccacccacuguagaaaguaaaaccaaccccuucuccguccccauucuaaccaucgaggaaaugaccaacucaagauucccaaucccccucgaaaaacucuucacaggccccuccucagcacucguaguacaaccccaaaacggccgcugcaccaccgacggaguacuccucggcaccacccaacucucucccgucaacaucugcaccuuccgcggcgacguaacucauaucaccaaaacucacucauaccaaaugaaccucgccgcccaaaauuggaacuccuacgacccaaccgaagaaauccccgcuccccucggcacccccgacuucguuggcaaaauacagggagucuuaacccaaaccacaaaaggcaacggaucaacacgcgcccacaaagccacagucuacacggguucaacugaguucaccccuaaacuaggacgcauccaacucguaacagacaccgacaaugaccucgaaacaaaccaaaacacgaaauucacccccguuggcgucauccaagacggcgacacacaucaaaacgaaccucaacaauggguccucccauccuaccuaggccgaaacaaccacaacguccaccucgccccagccgucgcaccaaccuuccccggcgaacagcuccuauucuuccgcuccaccaugcccggcugcucuggauaccccaacaugaaccuagacugccuccucccucaagaauggguccaauacuucuaucaagaagccgccccugcccaaucagacgucgccuuacuccgcuucgucaacccagacaccggccggguccuauucgaaugcaaacuccacaaauccggcuaugucaccgucgcccacacuggucaccaugaccuuuucaucccacccaacggcuacuuccgauucgacuccuggguuagccccuucuacacgcucgccccaauggggaacggcaccggucgccgccgauga

SEQ ID NO: 39226 - RNA, 1614 nt, Artificial Sequence
  derived and/or modified sequence opt11 from VP1__Norovirus_and/or_Norovirus-like__KX514315
augaaaauggccagcucagacgccaacccauccgacggauccacggccaaccuugucccagaagucaacaacgaaguuauggcucuagaacccguagucggcgcagccauagccgccccagucgccggccaacaaaauguaaucgaccccuggauucguaacaacuucguacaagcacccggcggugaguucaccgucagcccccgaaacgcuccuggcgaaauccucugguccgcaccacucggcccugaucucaaccccuaccuaucccaucuagcccguauguauaacggauacgcaggcggcuucgaaguacaaguuauccuagcaggcaaugccuucaccgccggaaaaaucaucuucgcagccguaccaccuaacuuucccacagaaggcuuaucccccucacaagucacaauguucccccacauaaucguagacguccgccaacucgaaccuguccugaucccccucccugacguacgaaacaacuucuaccacuacaaccaaucaaacgacucaacaaucaaacucauagcaaugcucuacacuccccuccgcgccaauaaccccggcgacgacguuuucaccguuuccugccgcguccuaacccgccccucaccagacuucgacuucaucuuccucgucccaccaaccguagaaucccgcacuaaacccuucuccguuccaauccuuacagucggagaaaugacaaacucccgcuuccccauaaaucucgaacgccucuucaccggacccuccagcgcaaacguaguccaaccacaaaauggucgcugcaccauagauggagagcuacuaggcacuacacaacucuccuccgucaacauuugcacauuccgcggcgacgucacacaaaucggcuccacaaagcacuggacuaugaacuuagcauccccuaacuggaacaacuaugaccccacagaagaaacccccgccccacucggcacccccgacuucgucgguaaaauccacggcaugcuaacccaaacaacccaagaaaacggauccacccgcgcccaccgagcaaccgucuacgucggcggcgcuaacuucacaccuaaacucggcaaaguacaauuugaaacugacacaggcgacgaccucgcaauccgccaaaacaccaaauucacccccgucggcgucauacaauccuccgaccaccaccgcgaugaaccccaacaauggagacuccccaacuacuccggagcuaacacauucaacguccaccuagcccccgccgucgcaccuaacuucccuggagaacaacuccuauucuuccgcucuacucuccccggcugcggcggccaccccaacauggaccucgacugccuacuaccucaagaauggguccaacacuuuuaccaagaagccgcccccgcccaaucagacguagcucuacuccgauucgucaacccggacaccucgcgcguccucuucgaauguaaacuccauaaaucuggcuacgucacaguagcccacacaggccaguacgaucucguccuccccuccaacggcuacuuucgguucgauagcugggucaaccaauucuacacguuagccccaauggguaacggcacaggaagacgccgcuaa

SEQ ID NO: 39227 - RNA, 1614 nt, Artificial Sequence
  derived and/or modified sequence opt11 from VP1__Norovirus_and/or_Norovirus-like__KX514199
augaaaauggccucauccgacgccaaucccucggacggcuccgcagccaaccuaguccccgaagucaacaacgaaguaauggcccucgaacccguagucggugccgccaucguagcacccgucgcaggccaacaaaaugucaucgaucccuggauacguaauaacuucguccaagcacccggcggggaauuuaccguaucgccccgcaaugcccccggcgaaauccuaugguccgccccacucggccccgaccucaaccccuaucuuucacaccuagcacgcauguacaacggauacgccggcggcuucgaaguccaagucauacucgccggcaacgccuucaccgcuggcaaaaucaucuucgccgcaguucccccaaccuuccccacagaaggccuaucaccaucacaagucacaauguucccacacaucauagucgacguccgccaacuagaacccguacuaaucccccuccccgacguacgaaacaacuucuaccacuacaaccaaucaaacgacucuaccauaaaacucauugcuauguuauacacaccacuccgcgccaacaacccaggcgacgacguauucacagucucuugccgcguccuaaccagaccaucacccgauuuugacuuuauuuuccuagucccacccacagucgaaucccgcaccaaacccuucucaguucccauacuaaccguaggugaaaugaccaacucccgcuuccccauaaaccucgaacgacuguucaccgguccaucauccgcaaauguaguccaaccccaaaacggccguugcaccauagacggcgaacuucucggcacuacccaacuaucaagcgucaacaucugcaccuuccgcggugacguaacacacaucggaucaacacaccacuggaccaugaaccuagcaucccccaauuggaacaacuacgaccccaccgaagaaacaccagcaccucucggcacccccgacuuugucggcaaaauacacgguaugcucacacaaaccacccaaggcuccggcuccacccgugcccaccgcgccaccguauacgucgguagcgccgaguucacacccaaacuaggcaaaguacaauucaaaacagaaacagaccacgaccuaaccauccgccaaaacacaaaauucacacccguuggcguaauccaagaauccgaccaccaccgcgacgaaccccagcaauggcgccuccccaacuauuccggagccaauaccuucaauguccaccucgcccccgcagucgcaccuaacuuccccggcgaacaacuccuauucuuccgcucaacccuacccggcugcggcggccaccccaauauggauuuagacugccuccucccacaagaaugggugcuccauuucuaccaagaagccgcaccagcccaauccgacgucgcacuucuucgcuucgucaacccagacaccucccguguccuuuucgaaugcaaacuccacaaaucaggcuacguaaccgucgcccacaccggacaauacgaccucguccuccccuccaauggcuacuuccgauucgacucuugggucaaccaguucuacacucucgccccuaugggcaacgggaccggccgccgcagauaa

SEQ ID NO: 39228 - RNA, 1614 nt, Artificial Sequence
  derived and/or modified sequence opt11 from VP1__Norovirus_and/or_Norovirus-like__KX514176
augaaaauggccucaucagacgccaaccccagcgacggcagcgcggccaaucuagucccugaagucaacaacgaagucauggcccuagaacccguagucggcgcagccauagccgccccagucgccggccaacaaaacgucaucgaccccuggauccgcaacaacuucguccaagcacccggaggagaauuuaccgucagcccccgcaaugcccccggagaaauacucugguccgcaccccuaggccccgaccuuaaccccuaccuuagccaccucgcacgcauguacaacggcuacgccggaggcuucgaaguccaaguuauccucgccggcaacgcauuuaccgcuggcaagauaauauucgccgcagucccucccaccuuccccaccgaaggccuaucacccagucaagugaccauguucccccacaucaucgucgacguacgccaauuagaacccguacugaucccacuaccagacguacguaacaacuucuaccacuacaaccaaucuaaugauucaaccaucaaacuaauagcaaugcucuacacuccacuacgagcaaacaacccaggagacgacgucuucaccgucuccugccgcguacucacccgcccaucacccgacuucgacuucaucuuccuagucccaccuacugucgaaagccgcacaaaaccuuucucuguacccauccuaacagucggcgaaaugaccaacucccgcuucccuguaaaccucgaacgacuauucacaggucccucaucagccaacgucguccagccccaaaacggccgcugcaccaucgacggcgaacuccucgggaccacacaacuaucauccguaaacauaugcaccuuccgaggcgacgugacacgcaucggaaccacccaacacuggaccaugaaccuugcaucuccaaacuggaacaacuacgaccccaccgaagaaacucccgcgccucucgguacaccugacuucguaggcaaaauacacgggaugcuaacacaaaccacccaaggcuccgguuccacgcgcgcccaccgggccacagucuacgucggcagcgcugaguucacccccaaacugggcaaaguacgcuuugaaaccgauacagaagacgaucuagucauucgacaaaacaccaaauucacacccguaggcgucauacaauccuccgaacaccaccgagacgaaccacaacaauggcgacuccccaacuacagcggcgcaaacaccuucaacguccaccuagccccugcaguugcccccaacuuccccggagaacaacuccuauucuuccgaucaacucuuccaggauguggcggccaccccaacauggaccucgacugccuccucccacaagaauggguccagcacuucuaccaagaagccgccccagcccaaucagacguagcacugcuccgcuucgucaaccccgauaccucacgcguacucuucgaaugcaaacuccacaaaagcggauacgucaccgucgcccacaccggccaauacgaccuaguccuccccagcaacggcuacuucagguuugacuccugggucaaccaauucuacaccuuagcucccaugggcaacgggacaggacgccgccguuaa

SEQ ID NO: 39229 - RNA, 1614 nt, Artificial Sequence
  derived and/or modified sequence opt11 from VP1__Norovirus_and/or_Norovirus-like__KX514360
augaaaauggccuccucagacgccaaccccuccgacggcuccaccgcaaaccucguccccgaaguaaacaacgaagucauggcacucgaacccgucgucggagccgccauugccgcccccgucgccggacaacaaaacgucaucgaccccuggauccgaaacaacuucguacaagcccccggcggagaauuuaccguuagcccucgaaacgcccccggagaaauccugugguccgccccacuaggacccgaucuaaacccauaccucucccaccucgcccgcauguacaauggcuacgccggcggcuucgaaguccaaguaauccuagcaggaaacgcguucaccgccggcaaaauaaucuucgcagccgucccgcccaccuucccuaccgaaggccuaucccccucccaaguuaccauguucccacauauaaucgucgacguacgucaacucgaacccguccuaauacccuuacccgacguccgaaacaacuucuaccacuacaaccaauccaaugauuccaccaucaaacucauagccaugcucuacacaccccuccgugcaaacaacccaggcgacgacgucuucaccgucuccugccgcguccuuacuagaccgucaccagacuuugauuuuaucuuccugguacccccgacagucgaaucccggacuaaaccauucagcguccccauccucaccgucggagaaaugacgaacucccgcuucccuaucaaccuugaacgucuguucaccggccccuccagcgccaacgucguacaaccccaaaacggccguugcaccaucgacggcgaacugcucggcaccacccaacucagcucggucaacauaugcacauuccgcggcgacgucacccaaaucggauccaccaagcauuggacgaugaaccucgcaucaccaaacuggaacaacuacgacccaaccgaagaaacacccgcaccucucggcacacccgacuucgucggcaaaauucacgguaugcucacccaaacuacacaagaaaacggcucaacccgcgcccaucgagccaccgucuacgucggcggagccaacuucacacccaaacucggcaaaguccaauucgaaaccgacacaggagacgaccucgccaucagacaaaacaccaaauucaccccugucggcguaauccaauccucagaccaucaccgggacgaaccacaacaauggcgucucccuaacuacucuggcgccaacaccuucaacguccaccucgcacccgccgucgcccccaacuucccaggcgaacagcuccuauucuuccgaagcacccuacccggaugcggaggccaccccaacauggaccucgacugccuccucccccaagaauggguacaacacuucuaccaagaagcagccccggcccaauccgauguagcccuccuccgauucgucaacccagacaccucacgaguccuauucgaauguaaacuccacaaaucaggcuacgucacagucgcacacaccggucaauaugaccucguccuccccucaaacggauacuucagauucgacuccugggucaaccaauucuacacccucgcccccaugggaaacggaacaggccgccgccgcuaa

SEQ ID NO: 39230 - RNA, 1614 nt, Artificial Sequence
  derived and/or modified sequence opt11 from VP1__Norovirus_and/or_Norovirus-like__KX514347
augaaaauggccucuaacgacgcaaaccccagcgacggcuccgccgccaaccucguaccagaagucaacaacgaaguaauggcccuugaacccgucgucggagccgccauagcugcccccguagccggccaacaaaacguaaucgacccuuggauacgaaacaacuuuguccaagcaccaggcggcgaauuuacaguuuccccucgcaacgcaccaggagaaauccuaugguccgcuccacuagguccagaccuaaaccccuaccuaucacaccucgcccgaauguauaacggauacgccggcgguuucgaaguacaagucauccucgccggaaacgccuucaccgccggcaaaaucaucuucgcagcaguacccccaaacuucccuaccgaaggauuaucaccaucacaagucaccauguucccacacauuaucguagacguccgccagcucgaaccuguccuaaucccccuccccgacguccguaauaacuucuaccacuacaaucaguccaacgauuccaccaucaaacucaucgcuaugcucuacaccccacuccgcgccaacaacgccggugacgacguauucacaguauccugccgcguucuaacccgacccucccccgacuucgacuucaucuuccuugucccuccaaccguagaaucacgcagcaagcccuucucuguccccguccucacagucgaagaaaugaccaacucccgauucccagccacucucgacaaacucuucaccggaccauccucaaccuucgucguccaaccccaaaacggccgcugcaugaucgacggcguccuccucggcacaacccaacuuagcccaguuaacaucugcacauuucgcggcgacguuacccaauccggcaacaccaaaaucuacaccaugaaccuugccucuccaaacuggaacaacuacgauccaaccgaagaaauaccagccccucuaggaacccccgacuucgucgguaaaauucacggcaugcucacccaaacaacccaaggauccggcuccacccgcgcccaccgcgccacggucuacguaggaggcgccgaguucacaccuaaacucgguaaaguacgcuucgaaacggacaccgaagacgaccucgucauccgacagaauaccaaguucacccccgucggaguaauccaauccuccgaacaccaccgugaugaaccacaacaauggcgucuccccaacuacucgggcgccaacaccuucaauguacaccuagcccccgccgucgcccccaacuucccuggagaacaacuccucuucuuccgauccacccuacccggcugcggcggccacccaaacauggaccucgacugucuccucccccaagaauggguccaacacuucuaccaagaagcagccccugcccaaucagacguagcccuccugcgauucgucaaccccgacaccucccgaguccucuucgaaugcaaacuccauaaaucaggauacgucaccguagcccauacaggccaacacgaccuuguacucccuucuaacggcuacuuccgcuuugacuccugggucaaccaguucuacacacuugcccccaugggcaacggcacgggucgccgccgcuaa

SEQ ID NO: 39231 - RNA, 1614 nt, Artificial Sequence
  derived and/or modified sequence opt11 from VP1__Norovirus_and/or_Norovirus-like__AB684675
augaaaauggccuccuccgacgccaaccccagcgacggcucggcugcaaaccucguccccgaagucaauaacgaaguaauggccuuagaacccgucgucggagcagccauagccgcccccgucgccggacaacagaauauaaucgaccccuggauccgcaacaacuucguccaagcuccaggaggcgaauuuaccguaucaccccgcaaugcccccggcgagauccuuuggucagcuccccuagggcccgacuuaaaccccuaccucucccaucuaucucgcauguacaacggauacgccggcggcuucgaaguccaagucauucucgcuggcaacgccuucaccgccggcaaagucaucuuugccgccgucccacccaacuuccccaccgaaggucucagucccucccaagucacgauguucccccacauaauagucgacguccgacaacuugaacccguccucaucccacucccugacgucagaaacaacuucuaccacuacaaccaagcgcacgacuccacccucaaacuaauagcgaugcuauacacaccccuccgugcuaacaacgcaggcgacgacgucuucaccgucucaugccgaguccuaacccgacccucccccgacuucgacuucaucuucuuagucccucccaccguagaaagcagaaccaaaccauucaccguacccauccuuaccguggaagaaauguccaacagccgauucccaauccccuuagaaaaacucuacaccggccccucauccgccuucguuguccaaccccaaaacggccgcugcaccaccgacggcguccuccucggcaccacccaacucucagccgucaacauaugcaacuuccuaggcgacgucacccgcgucggcaccucccacgacuacaccaugaaccucgucucccaaaacugggacaacuacgacccaaccgaagaaaucccagcaccccucggcacaccugacuuugucggcaaaauccaaggccuacuaacccaaaccacgcgagccgaccgaucuacaccggcccacaaagccacagucuccacuggcuccguccauuucaccccaaaacucgguucuguccaauucaccacagacaccaacaacgacuuccagacuggccaaaacacaaaauucacaccugucggcgucauccaagacucagaccaccaccaaaacgaaccccaacaauggguccuacccaauuacuccggcaccaccggccacaacguccaucuugcacccgccgucgcacccacauuccccggagaacagcuccuauucuuccgugucaccaugcccggaugcucgggguaucccaacaugaaccuagacugccuccuaccccaagaauggguccuacauuucuaccaagaagcagccccagcccaauccgaugucgcccuacuccgauucguaaaccccgacaccggcagaguacucuucgaaugcaaacuacacaaauccggcuacauaaccgucgcucacaccggcccauacgaucuggucaucccucccaacgguuacuuccgauuugacucauggguaaaccaauucuacacccuagcacccaugggcaacggcacaggacgacgacgguaa

SEQ ID NO: 39232 - RNA, 1614 nt, Artificial Sequence
  derived and/or modified sequence opt11 from VP1__Norovirus_and/or_Norovirus-like__KX514369
augaaaauggccuccuccgaugcuaacccaucagacggauccgccgcaaaucuuguacccgaagucaacaacgaagucauggcccucgaaccagucgucggcgccgccaucgcagcacccgucgccggccaacaaaauguaaucgaccccuggauccgcaacaacuucguacaggcaccuggaggcgaguucaccgucuccccaagaaacgcccccggcgaaauacuauggucagcaccacucggcccagaccucaaccccuaccucucacaccuugcacgcauguacaauggcuacgccggcgguuucgaaguccaagucauccucgcaggcaaugcauucaccgccgggaaaauaauauucgccgccguaccacccacuuuccccaccgaaggccuaucaccaucccaaguaacaauguucccccacaucauagucgacguccgacaacuagaacccguccuaaucccccuaccagacgugcgaaacaacuuuuaccauuacaaccaauccaacgacucuaccaucaaacugaucgccaugcucuacaccccacuacgagcuaacaacccaggagaugacgucuucacagucucaugccgcguacucacccgucccucccccgacuuugacuucauuuuccuugucccaccaacagucgaaucccgcaccaaacccuucuccguacccauccucaccgucggagaaaugaccaacucccgauuucccguaaaccucgaacgccucuucaccggcccaucuuccgccaacguaguccaaccacaaaacggccgcugcaccaucgacggcgaacuccucggaaccacacaacucucauccguaaacaucugcacauuccgaggcgacguuacccaaaucggcgccacccgccacuggaccaugaaucuagccucacccaacuggaacaauuacgaucccaccgaagaaacucccgcuccccucggcacuccugacuucgucggcaaaauccacgguaugcucacacaaaccacccaagguuccggcuccaccagagcccaccgcgccacagucuauguaggcggagcagaguucacccccaaacucggcaaagugcgcuucgaaaccgacaccgaagacgaccucgucauacgacaaaacaccaaauucacccccgucggcgucauccaaagcucagaacaccaccgcgacgaaccccaacaauggcgccucccuaacuacuccggagccaacacauucaacguucaucucgcccccgccgucgcccccaacuuccccggagaacaacuccuauucuuccgauccacccuacccgguugcggcggccaccccaauauggaucuagacugccuacucccccaagaauggguccaacacuucuaccaagaagccgcccccgcccaaucugauguugcccuucuccgcuucgucaaccccgacaccucccgcguccucuucgaauguaaacuccacaaauccggcuacgucaccgucgcccacaccggacaauacgaucucguacuccccucuaacggauacuuccgcuucgacuccugggucaaccaauucuacacucucgccccuaugggaaacggcacaggccgccgacgcuaa

SEQ ID NO: 39233 - RNA, 1614 nt, Artificial Sequence
  derived and/or modified sequence opt11 from VP1__Norovirus_and/or_Norovirus-like__KX514310
augaaaauggcaucaaacgacaccaaccccucugacggaucagccgccaaccucguaccagaagucaacaacgaagucauggcccuugaacccgucgucggcgcagccauagccgcaccagucgccggccaacaaaacguaaucgacccauggauacgaaacaacuuuguccaagccccaggaggcgaguucaccguaucaccccgaaacgcucccggagaaauccuuuggucagcaccccuuggccccgaccucaaccccuaccucucccaccucgcccguauguacaacggauacgccggcggauuugaaguccaagucauacucgccggcaaugccuucaccgccggaaaaauaaucuucgccgccguuccgcccaauuuccccacagaaggcuuaucuccaucucaagucaccauguucccucauaucauaguagacguccgccaacuagaaccgguccuaauuccccuacccgacguccgcaacaacuucuaccacuacaaccaaucaaacgacucuacaaucaaacucauagccaugcucuacacaccccuacgugccaauaacgccggugacgacgucuucaccguaucuugccgcguccuuaccagaccaucacccgacuucgacuucauauuccuggucccacccaccgucgaaucccgcucaaaaccauucagcgucccaguccuaacagucgaagaaaugaccaacucacgcuuccccgcaacccuagacaaacucuucaccggcccauccuccaccuucgugguucaaccccaaaacggccgaugcaugaucgacggcguucuccucggcacuacacaacucucucccgucaacauuugcaccuuccguggcgacgucacccacccacgcgacucaaagauauacaccaugaaccuugccucccccaacuggaacaacuaugaccccaccgaagaaauacccgcuccccuaggcacaccagauuucguaggcaaaauccacggcaugcucacacaaaccacccaagaaaacggcuccacccgcgcccaccgagccacuguuuacgucggaggcgccaacuucacacccaaacucggcaagguccaauucgaaaccgacaccggagacgaccucgccauccgacaaaacacaaaauucacacccgucggaguaauccaaucaucugaccaccaccgcgacgaaccccagcaauggcgccuccccaacuauuccggcgccaacaccuucaacguccaccucgcccccgccgucgcccccacauucccaggggaacaacuccuauucuuccguucaaccauccccggcuguggcggacaccccaacaugaaccuugacugccuacuaccccaagaaugggugcaacacuucuaccaagaagcugccccagcacaauccgacgucgcccuucuucgguucguaaacccugacaccucccgaguccucuucgaaugcaaacuccacaaauccggcuacgucacaguagcccacacuggccaauacgacuuaguucucccuucaaacggauacuuccgcuucgacucauggguaaaccaauucuacacacucgcacccaugggcaacggaaccggccgccgaagauaa

SEQ ID NO: 39234 - RNA, 1614 nt, Artificial Sequence
  derived and/or modified sequence opt11 from VP1__Norovirus_and/or_Norovirus-like__KX514185
augaaaauggccucauccgacgcaaacccauccgacggauccgcagccaaccucgucccagaaguaaacaacgaagucauggcccucgagcccgucgucggagccgccauagccgcccccgucgccggccaacaaaacgucaucgacccauggauccgaaacaacuuuguccaagcacccgggggagaguucaccgucuccccuagaaaugcccccggagaaauccucuggagugcaccacuagguccagaccuaaacccauaccucucccaccucgcaagaauguacaacgguuacgccggcggcuucgaaguacaaguuauccucgccggcaacgcauucaccgccggcaaaaucauauucgccgccguacccccaaccuuucccacagaaggacuuucccccucacaaguaacuauguucccccacaucaucgucgacgucagacaacucgaacccguacucaucccccuacccgauguccgcaacaauuucuaccacuacaaccaaucaaacgacucaaccauaaaacuuaucgcaaugcuauacaccccucuaagagccaacaauccaggcgacgacguauucaccguuuccugccgcguccuaacccgaccuucuccugacuucgacuuuauauuucucguacccccaaccgucgaaucccgcaccaaacccuucuccguccccauccucacagucggagaaaugacaaacagccgauuccccguaaaccuagaacgacucuuuaccggccccuccagcgccaacguaguccagccccaaaacggucgaugcaccaucgauggcggacuauuaggcaccacccaacuaucauccgucaacaucugcacauuccgcggggaugucacccacaucggcaccacccgucacuggaccaugaaccucgccucucccaacuggaacaacuacgacccaaccgaagagaccccugcccccuuaggaacgcccgacuucgucggaaaaauacacggcaugcucacccaaaccacccaaggauccggcucaacgcgagcccacagggccaccgucuacgucggauccgcagaguucacacccaaacuaggcaaaguccgcuucgaaaccgacacagaagacgaccuugucauccgucaaaacacaaaauuuacccccguuggcguaauccaaagcuccgaacaccaccgcgacgaaccucaacaauggcgccuccccaacuacuccggcgcaaauaccuucaacguacaccucgcccccgccgucgcccccaacuuccccggcgaacaacuccuauucuuccgaucaacacucccaggaugcgguggucacccaaacauggaccuagacugccuccuuccccaagaauggguccaacacuucuaccaagaagccgcccccgcacaaucggacguagcuuuacuacgauucgucaaccccgacacaucccguguucuauucgaaugcaaacuucacaaauccgguuacgucaccguagcccacaccggccaauacgaucuaguccuccccagcaacggcuacuuccgauucgacucauggguaaaccaauucuacacccucgcacccaugggcaauggcaccggacguagaagauaa

SEQ ID NO: 39235 - RNA, 1614 nt, Artificial Sequence
  derived and/or modified sequence opt11 from VP1__Norovirus_and/or_Norovirus-like__KX514181
augaaaauggccucaagugacgcaaaucccagcgacggauccgccgccaaccuaguaccggaagucaacaaugaagucauggcccuugaacccgucguaggagcagcaauagccgcccccgucgcaggccaacaaaauguaaucgacccuuggauccgcaacaacuucguccaagccccaggcggugaauuuacaguuuccccacgcaacgcccccggcgaaauccuuugguccgcuccccugggaccagaucuaaacccauaccuaagccaccuagcccgcauguacaacggguacgccggaggauucgaaguacaaguuauccuagccggcaacgccuucaccgccggaaagaucauuuucgccgcagugccuccaacauuccccacagaaggccuaucacccucccaagucaccauguucccccacauaauagucgacguccgacaacucgaaccaguacuuaucccccuucccgacguaagaaacaacuucuaccacuacaaccaguccaacgacuccaccaucaaacucaucgcaaugcucuacaccccacuucgcgccaauaaccccggcgacgacguauucaccguuuccugccgcguccuaacccgcccaucacccgacuucgacuucaucuuccuuguaccaccaaccguggaauccagaacaaaacaauucuccguccccauccuaaccgucggcgaaaugacaaauucacgauuucccgucaaccuagaacgacuauucaccggccccuccucagccaauguaguccaaccccaaaacggacgcugcaccaucgacggagaacuccucggcacuacacaacucuccucugucaacaucugcaccuuccguggugacgucacucacaucggcacaacccggcacuggacuaugaaccuagccagcccuaacuggaacaacuacgauccaaccgaagaaaccccagcaccccucggcacaccagacuucgucggaaaaauacacggcaugcucacacaaaccacccaagguagcggcucaacuagagcccaccgagccacaguauacguaggauccgccgaguucaccccaaaacuaggcaagguccgcuucgaaaccgacaccgaagacgaccuagucauccgucaaaacaccaaauucacccccguaggagucauccaauccuccgaacaucaccgcgacgaaccacaacaauggcgccuccccaacuacuccggcgccaacaccuucaacguccaccuagccccagccgucgcacccaauuuccccggcgaacaacuccuauucuuccgcucaacccucccaggaugcggcggccacccaaacauggaccuggacugcuuacuuccccaagaauggguccaacacuucuaccaagaagcugcccccgcccaaagcgacguagcccugcuucgauucgucaacccagacaccucacgcgugcuauucgaaugcaaacuucacaaauccggcuacgucaccgucgcccacacaggccaauacgaccuuguccuccccagcaauggcuacuuucgcuuugacagcuggguaaaccaauucuacacacucgccccaaugggcaacggcaccggccgccgucgcuaa

SEQ ID NO: 39236 - RNA, 1614 nt, Artificial Sequence
  derived and/or modified sequence opt11 from VP1__Norovirus_and/or_Norovirus-like__KF712493
augaaaauggcauccucggacgcuaacccauccgacggcuccacagcaaaccuugucccagaagccaacaacgaaguaauggcccucgaacccgucgucggcgccgccaucgccgccccaguagccggccagcaaaacguaauugaccccuggauccgcaacaacuucguccaagccccuggcggcgaguucaccgucucccccagaaacgcccccggcgaaguacuuugguccgcaccccuaggccccgaccuaaacccauaccugucucaccucgcccgcauguacaacggauacgcaggcgguuucgaaguccagguaauacuagccggcaacgcauucgccgccggcaaaauaaucuucgccgccguucccccaaacuuccccaccgaaggccuaucccccagccaagucacgauguucccacaccucauagucgacguccgccaacuagaacccgucaugaucccccucccagacauacgaaacaacuucuaccacuacaaccaaagcaacgauccaaccaucaaacucaucgcuaugcucuacacaccccuacgcgccaacaacguaggagacgacguuuucaccgugagcugccgcguccuaacccguccaucucccgacuucgacuucauauuccuagucccucccaccgucgaaagcaaaaccaaccccuucucaguucccaucuuaaccauugaagaaaugacaaacucccgguuccccauaccccucgaaaaacucuucaccggccccucauccgcccuagucguccaaccacagaauggccgcugcaccaccgacggaguccuacucgguacaacccaacucagucccguaaacaucugcaccuuccgcggcgacgucacacacaccaccaaaacucacaccuaccaaaugaaccucgcugcacaaaacuggaacuccuacgacccaaccgaagaaaucccagcaccccucggaacaccagacuucgucggcaaaauccaaggcguccuaacucaaaccacaaaaggcaauggcuccacccgggcccacaaagcaaccgucuacaccggcggcguagaguucaccccaaaacucggccgaauccaacucuucaccgacaccgauaacgaccuagaagccaaccaaaacaccaaguucacccccguaggagucauacaagacggagacacccaccaaaacgaaccccaacaauggguccucccuagcuacuccggccguaacaaccacaacguucaccuugcccccgccguagccccaaccuucccaggagaacaacuacucuuuuuccgguccaccaugcccggcugcuccggauacccuaacaugaaccucgacugccuccuaccccaagaauggguccaauauuucuaccaagaagcagcccccgcccaauccgacguagcacuucuucgcuucguuaaccccgacaccggccgcguccucuucgaaugcaaacuccacaaauccggcuacguaacagucgcccauacaggccaucacgacuuauucaucccacccaaugguuacuuccgcuucgacucauggguaucaccauucuacacacuugccccaaugggcaacggaaccggaagacgccgauaa

SEQ ID NO: 39237 - RNA, 1614 nt, Artificial Sequence
  derived and/or modified sequence opt11 from VP1__Norovirus_and/or_Norovirus-like__FJ411169
augaaaauggccagcaacgacgccaaccccucagacggcucuacagccaaccuaguccccgaagucaacaaugaaguaauggcacucgagccaguuguuggugcagcaaucgcagcuccugucgccggccaacagaacgucauagaccccuggauacgcaacaacuuuguccaagcccccggcggcgaguucaccguuagcccacgcaacgcaccaggcgaaauacuauggucugccccacucggccccgaucuaaacccauaucucucccaccucgcccgaauguacaauggcuacgcaggcggcuucgaaguacaaguaauccuugcagguaacgccuucaccgccggcaaaaucauuuucgcugcagucccacccaacuuucccaccgaaggacuaucaccaucccaagucaccauguucccucacaucaucgucgacguccgccaacuagaaccgguacucaucccccuacccgacguacgaaacaacuucuaccacuacaaccaaucaaacgacuccacaauaaaacucaucgcuaugcucuacacuccacuucgcgccaacaacgcaggcgccgacgucuucacagucucccgccgaguccucacccgcccuucucccgacuucgacuucauauucuccgucccacccacaguagaaucacgaacaaaacccuucacaguccccauacucaccguugaagaaaugucgaacuccagauuuccaauuccacucgaaaaacuauacacaggcccaagcuccgcauucguaguccaaccccaaaacggccgaugcaccaccgacggaguuuuacucggcaccacccaacucagcgcugucaacaucuguaccuuccgcggcgacguaacccauaucgccggcucccacgacuacaccaugaaccucgccucccaaaacuggaacaacuacgaccccaccgaagaaauccccgccccgcuuggcacuccagacuucgucggaaaaauacaaggcaugcucacccaaaccacccgagaagacggauccacccgagcccauaaagcuaccguauccaccggcuccguccacuucacccccaaacucggaucaguccaauacacaacagacacuaacaacgauuuccaaaccggccaaaacacaaaauucacccccgucggugucauccaagacggcaacaaccaccaaaacgaaccccaacaauggguccucccuaacuacuccggacgcaccggccacaacguacaucuugccccagcagucgcccccaccuucccuggcgaacaacuacucuucuuccgaucaaccaugcccgguugcuccggcuaccccaacaugaaccucgacugucuacuuccccaagaauggguacaacacuuuuaccaagaagcagcccccgcccaaucggacgucgccuuacuccgauucgucaacccagacacaggcagaguacuauucgaaugcaaacuacauaaaucaggcuacgucaccguugcccacaccggcccccacgaccucguaaucccucccaacggcuacuuucgcuucgacuccugggucaaccaauucuacacccuugcccccaugggcaacggagcgggccgccgccgcuga

SEQ ID NO: 39238 - RNA, 1614 nt, Artificial Sequence
  derived and/or modified sequence opt11 from VP1__Norovirus_and/or_Norovirus-like__AF427121
augaaaauggcaucaaacgacgccaaccccuccgacggauccaccgccaaucucguacccgaaguaaacaacgaaguaaugacguuagaacccgucgucggugcagcaauagccgcacccguugccggacaacaaaacgucauagacccauggauaggaaacaacaucguccaagcccccggaggcgaguucacagucucaccccgaaacgcacccggcgaaauacuuugguccgcaccccuaggaccagaccucaaccccuaccucucccaucucgcccggauguacaauggcuacgccgggggcuucgaaguccaagucaucuuagcaggcaacgccuucaccgccggcaaaaucaucuucgccgccguacccccaaacuucccaacagaaggccuaucccccucccaagucacagucuucccgcacauuauagucgacguccgccaacuagaacccguccuaaucccacuccccgacguccgaaacaacuuccaccauuacaaccaauccaacgacucaaccaucaaacuaaucgccaugcucuacacaccccuaagagcaaauaacgccggagacgacgucuucaccguauccugccgcguccucacccgcccauccccagacuucgacuucaucuuccucgucccuccaacaauagaaucccgaaccaaaccuuuuaccgucccaauacucacaguagaagaaauguccaacucacgauuccccauaccccucgaaaaacucuacacuggcccguccuccgcuuucguaguccaaccacaaaacggccgaugcacaaccgacggcguucuacucggcacuacacagcuauccgccgucaacauaugcaccuuccgcggcgacgugacucacauagccggaagccacgacuacaccaugaaccucgccucacaaaauuggaacaacuacgacccuaccgaagaaaucccugcgccccucggcaccccugacuucgugggcaaaauccaaggcguccucacccaaaccacccgcgaggacggcagcacgcgugcgcacaaagccacugucuccaccggcuccguccacuuuacccccaaacucggauccguccaauacaccaccgacaccucuaacgacuuccaaaccggccagaacaccaaauucacccccguaggcgucauccaagacggaaauaaccaccaaaacgaaccucaacaauggguucuacccaacuacuccggccgcaccggccacaacguccaccucgcccccgcagucgcucccacauucccuggcgaacaacuacucuucuuccguucaacaaugccuggcugcuccggcuaccccaacaugaaccuagacugccuccuaccccaagaauggguccaacacuucuaccaagaagcagccccugcccaaagcgacgucgcccuccuucgcuucguaaauuccgacaccggccgaguccucuucgaauguaaacuccacaaaucaggcuacgucacugucgcccacacuggcccccacgaccuagucaucccacccaacggguacuuccguuucgacucaugggucaaccaauucuacacccuagcacccaugggaaacggagccggacgacgaagauaa

SEQ ID NO: 39239 - RNA, 1614 nt, Artificial Sequence
  derived and/or modified sequence opt11 from VP1__Norovirus_and/or_Norovirus-like__KF429787
augaaaauggccuccaaugacgccacgccuucugacgggagcucagccaaccuuguaccagaagccaacaacgaagucauggcccuugaaccagucgcaggcgccgccaucgccgccccaguagccggccaacaaaaugucaucgaccccuggauccgaaacaacuucguccaagcccccggcggugaauuuaccgucucaccccgcaacgcccccggcgaaauccucugguccgccucccuaggacccgaccuuaaccccuaccucucacaccucucccgaauguacaauggcuacgcuggauccuucgaaguccaagucauucucgccggaaacgccuucacagccggcaaaauaaucuucgcagccguacccccaaacuuucgcaccgaaggccucuccccaucccaaaucaccauguucccccacauaaucaccgacgucagacaacuugaacccguccuaaucccccuccccgauauccgcaacaacuucuaccauuacaaccaauccaacgaucccaccaucaaacuuaucgcuaugcuauacacaccccuccgcgccaacaacgccggcgacgaugucuucacugucucuugccgaguacuuacccgacccucucccgacuucgacuucaucuuccucguuccaccaaccgucgaaagccgcaccaaacccuucuccguaccaguccucaccguagaagaaaugaccaacucccgauuccccaucccccucgaaaaacucuucacaggaccauccuccgccuucguaguccaaccccaaaacggccgcugcaccaccgacggcguccuccuaggcaccacccaacuuucccccgucaacauaugcaccuuccgcggagacgucacccgcaucggaaacucccgagaauaccgcaugaaccucgccucccucaacuggaacaacuacgacccuaccgaagaaaucccagcuccccucggcacccccgacuucgccggaaaaauacaaggaguacucacucaaacuacacgccacgacggaucgacacgcggccacaaagccaccguauacacaggcucagccggcuuuacacccaaacucgguuccguacaauucucaaccgacaccgacaacgaccucgaagccaaccaaaacacccgcuucacucccgucggcgucauacaggacggcaacgcccaccaaggcgaaccccaacaauggguccuccccaacuacgccggccgcgacggccacaacguacaccuagccccagccgucgccccaacguuccccggagaacaacuccucuuuuuccgaucaacuaugcccggcuguuccggauaccccaacaugaaccucgacugccuccuaccccaagaauggguccaacacuucuaccaagaauccgcccccgcccaguccgacgucgcccugcuccgcuucguaaaccccgacaccggccgcguucucuucgaaugcaaacuacacaaaucuggauacgucaccgucgcacacacaggaccucaugaccuagucauacccccuaacgguuacuuccgcuucgacagcugggucaaccaauucuacacccucgccccaaugggcaacggugccggccgccgcagauaa

SEQ ID NO: 39240 - RNA, 1614 nt, Artificial Sequence
  derived and/or modified sequence opt11 from VP1__Norovirus_and/or_Norovirus-like__AB933728
augaaaauggccuccaacgaugcaaaccccucagacggcuccgcugcuaaccucguacccgaaguaaauaacgaaguaauggcacuagaacccgucgucggggccgccaucgccgccccagucgcuggacaacaaaacgucaucgaccccuggauacgaaacaacuucguacaagcccccggcggcgaguucaccguuucgccccgcaacgcccccggcgaaauccucugguccgcaccccuagggcccgaccucaaccccuaccuaucccaccucgcccgaauguacaacggauacgccgggggcuuugaaguccaagucauccucgcaggcaacgccuucacggccgguaaaaucaucuucgcagccauacccccaaacuuucccacagaaggauuaucccccucucaagucaccauguucccccacauagucguagacguccgccaacucgaacccguccuuauaccccuacccgacguaagaaacaacuucuaccacuacaaccaaaccaaggaauccacuaucaaacuggucgcaaugcucuacacaccacucagagccaauaacgccggcgacgacguauucacagucucaugccgcguacuaacuagacccagccccgacuucgacuucaucuucuuaguaccacccagcguugaaucucgcaccaaacccuucaccguacccauccuuacugucgaagaaaugaccaacucacgcuuccccaucccacucgaacgacuauucacaggaccauccagcgccuucgucguccaaccacaaaacgggcgcugcacaaccgacgguguccuacucggcaccacccaacucucccccguaaacaucugcaccuuccguggcgacgucacacgaguuucaaccacccacguauacgaaaugaaccuagccucccagaacuggaauaacuacgaccccaccgaagaaguccccgccccacucggcacacccgacuucguaggcaaaauccaaggcguccuaacccaaacaacccgaacugacggaucaacccgcgcccacaaagcaacagucagcaccggugccgcugacuuuacccccaagcuaggcuccauccgcuucgaaaccacaaccaaccgcgaucucgaaacccaccaaaacacaaaguucaccccagugggagucauccaagacggugauaaccaucaaaacgagccucaacaauggagacuccccggauacgcaggacgcgacgcccacaacguccaccucgcaccagccguagcgcccacguuccccggagaacaacuacuauucuucagaucuaccaugcccggcugcucaggcuaccccaacaugaaccucgauugccucuuaccccaagaauggguacagcacuucuaccaagaagccgcacccgcccaaagcgacguagcccuccuccgauucgucaacccagauaccggccgaguccucuucgaaugcaaacuccacaaaucgggcuaccucacagucgcccacacuggacccuacgaccucgucauaccacccaacggcuacuuccgcuucgacuccuggguuaaccaauucuacacucucgcccccaugggaaacggcaccggaagacgccgcuaa

SEQ ID NO: 39241 - RNA, 1614 nt, Artificial Sequence
  derived and/or modified sequence opt11 from VP1__Norovirus_and/or_Norovirus-like__KX514346
augaaaauggcaagcaacgacgcaaaccccuccgauggauccgccgccaaccucguaccugaaguaaauaacgaaguaauggcccuagaacccguuguuggugccgcaaucgcagcccccgucgccggacaacaaaacgucauagaccccuggauacguaacaacuucguccaagcccccggaggcgaguucaccgucuccccuagaaacgcccccggagaaauccucuggucagcccccuuaggccccgaccuaaaccccuaccucucacacuuagcacgcauguacaacggcuacgcaggcgguuucgaaguccaaguaauucuugccggcaacgccuucaccgcugguaaaaucauauucgccgccgugccacccaccuuucccacagaaggccuuucuccaucacaggucacuauguucccccacauaaucguagacguccgucaacuugaaccaguccucaucccccuccccgauguacgaaacaacuucuaccacuacaaccaaucaaacgacuccacaaucaaacuuaucgccauguuauacacuccccuccgugcaaacaaccccggcgacgacguauuuacaguauccugccgcguccucacacgacccagccccgacuucgacuuuaucuuccucguaccucccaccgucgaaucccgcaccaagcccuuuuccguccccauccucaccgucggagaaaugacaaacucccgcuuccccgucaaccucgaacgccucuucaccggccccucaagcgcaaacgucgugcaaccucagaauggacgcugcacaaucgacggcgaacuccucgggaccacccaacuauccagcgucaacauaugcaccuuccgcggagacgucacacagaucggcucuaccaaacacuggaccaugaaccucgcaucacccaacuggaacaacuacgacccaaccgaagaaacccccgcaccacuaggcacacccgacuucgucgguaaaauccacggcaugcucacccagacaacacaagaaaacggcuccacacgugcccaccgcgccaccgucuacgucggcggcuccaacuucaccccaaagcuaggcaaaguccccuucgaaacagacacaggugacgaccucgccauccgccaaaacaccaaauucacuccagucggaguaauacaaucauccggccaucaccgcgacgaaccacaacaauggcgccuaccaaacuacuccggcgccaacaccuucaacguccaccucgcccccgccgucgcaccuaacuuccccggcgaacaacugcuuuucuuccgaucaacacuccccggcugcggaggccacccuaacauggaccuagacugccuccuuccacaagaauggguccagcacuucuaccaagaagcugcaccagcccaauccgacgucgcccuucuucgcuucguaaacccggacaccuccagaguccucuucgaaugcaaacuccacaaauccggguacgucacaguagcccacaccggacaauacgaucuaguucuaccauccaacggcuacuuccgauucgacuccugggucaaccaauucuauacccuugccccaaugggcaacggaaccggccgccgacgauag

SEQ ID NO: 39242 - RNA, 1614 nt, Artificial Sequence
  derived and/or modified sequence opt11 from VP1__Norovirus_and/or_Norovirus-like__KX514249
augaaaauggccucaucagacgccaaccccuccgacggcucagcagcuaaucucguccccgaagucaacaacgaagucauggcccucgaacccguugucggagcagccaucgccgcacccgucgccggccagcaaaacgucauagaccccuggauacguaacaacuucguacaagcacccggcggcgaguucaccguaucuccccgcaacgccccaggagaaauccuaugguccgcaccccuuggccccgaucuuaacccauaccuaucccaccucgcccguauguacaacggcuacgccggcgguuucgaaguacaagucauccucgcaggcaacgccuucacugccggaaaaaucaucuucgccgccgucccacccacauucccaaccgaaggccucucccccucacaaguaacaauguucccccacaucaucgucgacguccgccaacuagaaccaguccuuaucccccuacccgacguccgcaauaacuucuaccacuacaaucaaucaaacgacuccaccaucaaacucauagccaugcucuacaccccucuccgagccaacaaccccggugacgacgucuucaccguaucaugccgcguccucacccgacccucccccgacuucgaccuaaucuuccucgucccgccaaccguggaaagccgaacaaaacccuucuccgucccuauacucaccguaggcgaaaugaccaacucccgcuucccaauaaaccucgaaggacuuuucaccggccccucauccgccaacguaguccaaccgcaaaaugguagaugcaccauagacggugaacuccuuggcaccacccaacuuucauccguuaacauaugcaccuuccgaggcgacgucacccacaucggcuccacccaccacuggaccaugaaucuagcaucuccaaauuggaacaacuacgaucccaccgaagaaacgcccgccccacucggcacccccgacuucguaggcaagauucauggaaugcucacacaaacaacucaaggcucuggcucuacccgcgcacacagagccaccgucuacguaggcggcgccgaguucacccccaaacuaggcaagguacaauuuaagaccgaaaccaaccacgaccucagcauccgucaaaacacgaaauucacccccguaggcgucauccaagaaucugaccaccaccgagacgaaccccaacaguggcgacuaccaaacuacuccggcgccaacacauucaauguccaccucgcaccagcugucgcacccaacuuucccggcgaacaacuccucuucuuccgcucuacacuucccggaugcggcggccacccgaacauggaccuagacugccuccucccacaagaauggguccaacauuucuaccaagaagccgccccagcacaauccgacgucgcccuccuccgcuucguaaaccccgauaccucccgaguccucuucgaaugcaaacuccacaaauccggcuacgucaccgucgcccauacagggcaauacgaccuuguccuccccucaaacggcuacuuccgauucgacuccugggucaaccaauucuacacccucgcacccaugggcaacggcaccggccguagacgcuaa

SEQ ID NO: 39243 - RNA, 1614 nt, Artificial Sequence
  derived and/or modified sequence opt11 from VP1__Norovirus_and/or_Norovirus-like__KF429760
augaaaauggccuccaacgacgcaacaccaucugacggaucaucagccaaccucguaccagaaguaaacaacgaagucauggcccucgaacccgucgcaggagccgccaucgccgccccuguagcaggccaacagaacgucaucgacccauggauccgcaacaacuucguacaagcacccggcggagaguucacagucagcccccgcaacgcccccggcgaaauccucuggucagcaucacucggccccgaccuaaaccccuaccucucccaccucucccgaauguacaacggcuaugcuggcagcuucgaaguccaaguuauccucgcaggcaacgcauucaccgccggaaaaaucauauucgccgcagucccacccaacuucagaaccgaaggcuuaucccccucccagaucacaauguuuccccacaucaucaccgacguacgccaacucgaacccguccucaucccccucccagacauacgcaacaacuucuaucacuacaaccaauccaacgacccaaccauaaaacuaaucgccaugcucuacacaccacuccgagccaacaacgccggagacgacgucuuuaccguaucuugccguguucucacccgacccucacccgacuucgacuuuaucuuccucgucccaccaaccgucgaaucucgcaccaaacccuuuuccguccccguccucacagucgaagaaaugacaaacucccgcuucccuaucccccucgaaaaacuauucacaggcccauccuccgcauucgugguucaaccccaaaacggacgaugcacaaccgacgguguccuccuaggaacaacacaauuaagucccgucaacaucugcaccuucagaggcgacguaaccagaaucggcaacucccgagaauaccgaaugaacuuagcaucucuaaacuggaacaacuacgaccccaccgaggaaauccccgcaccacucggaaccccagacuucgccggcaaaauccaaggaguccucacgcaaacaacccgacacgacggaucaacacgcggacacaaagcuacagucuauaccggcagugccggcuucacccccaaauuaggaucaguacaauucaguaccgacaccgacaacgaccucgaagcaaaccaaaacacacguuucacaccagucggcguaauacaagacggcaacgcacaccaaggcgaaccccagcaauggguucuacccaacuacgccggccgcgacgggcauaacguccaccuagcccccgcuguagccccaaccuuccccggugaacaacuacucuucuuucgcuccaccaugccaggcugcucaggcuaccccaacaugaaccucgauugccuccuaccccaggaauggguccaacacuucuaccaagaauccgccccagcccaauccgacgucgcacuccuaagauucgucaaucccgacaccggccgcguacuauucgaauguaaacuacacaaauccggcuacguuaccgucgcccacaccggcccccacgaccuagucaucccaccgaacggauauuucagauucgacuccugggucaaccaauucuacacacucgcacccauggguaacggcgccggacgcagaagauaa

SEQ ID NO: 39244 - RNA, 1614 nt, Artificial Sequence
  derived and/or modified sequence opt11 from VP1__Norovirus_and/or_Norovirus-like__AB303929
augaaaauggccucaaacgacgcaaaccccucagauggcucggccgccaaccucguucccgaagucaacaacgaaguaauggcucuugaaccagucguaggcgcagcaauagcagcccccgucgccggccaacaaaauaucauagaccccuggauccgcaacaacuucguacaagcccccggcggcgaauuuaccgucucaccacgcaacgcccccggagaaauacugugguccgcgccccucggccccgaccuaaacccguaucuaucacaccucucacguauguacaacggcuacgccggaggcuucgaaguccaagucauccucgccggcaacgccuucacggccggcaaggucaucuucgccgccguaccacccaacuuccccacagaaggccucucacccucccaagucaccauguucccccacaucauuguggacguucgccaacucgagccaguccucaucccccucccagauguccgcaacaacuucuaucauuauaaccaagcccacgacucaacacuaaaacuuaucgccaugcucuacacaccccuccgcgccaauaacgccggcgacgacgucuucaccgucucuugccgcguccuaacccgaccaucccccgacuucgacuucauauucuuagucccacccaccgucgagucacgcaccaaacccuucaccguccccguuuuaacaguugaagaaaugacaaacucccguuuccccaucccccuagaaaaacucuacaccggcccuuccagcgccaucguaguccaaccacaaaacggcagaugcacaaccgacggaguacuccuaggcacaacccaacucuccgccguuaacaucugcacauuucgaggagacgucacccacaucgccggcucccggaauuacaccaugaaccucgccucccaaaacuggaacaacuacgacccaacugaagaaauucccgccccacucggcacacccgacuucguaggcaaaauucaaggccuacucacccaaaccacaagagccgacggcuccacccgagcccauaaagccaccgucuccacagguuccgugcacuucacucccaaacugggcuccguccaauucagcaccgacaccgacaacgacuuccaacccggacaaaacaccaaauuuacccccgucggcgugauccaagacggcgaccgccaccaaaacgagccccaacaauggguccuucccgauuucuccggacguacuggucacaacguacaccucgcucccgccgucgcaccaaccuucccuggcgaacaacuccuauucuuccgcucaaccaugcccggacgcucgggcuacccuaacaugaaccuagacugccugcucccacaagaauggguccugcacuucuaccaagaaucugcccccgcccaauccgacgucgcccuccuccgcuuugucaaccccgacaccaacagaguacucuucgaaugcaaacuccacaaaagcggcuacaucaccgucgcccacacaggccaccacgaccucauccucccgcccaacggauacuuccgcuucgacucuugggucaaucaguucuacacacuugcccccaugggaaacggugccggcaggcgacgauaa

SEQ ID NO: 39245 - RNA, 1614 nt, Artificial Sequence
  derived and/or modified sequence opt11 from VP1__Norovirus_and/or_Norovirus-like__KX514363
augaaaauggccucuucagacgccaaccccucagacggauccaccgcaaaccuuguccccgaaguaaacaacgaaguuauggcacuagaacccgucguaggagccgccaucgccgcaccaguugccggccaacaaaacgucaucgaccccuggauccgcaacaacuuuguacaagcccccggaggugaauuuaccgucucucccagaaacgcccccggcgaaauccucugguccgcaccccucggccccgaccucaaccccuaccucucucaccucgcccgcauguacaacggcuacgccggcggauucgaaguccaagucauacuugccggaaacgccuuuaccgccggaaaaauaaucuucgcagccguaccacccaccuuccccaccgaaggacucucccccucccaggucaccauguucccccacaucaucgucgacguccgccaacuagaacccguccucaucccccuccccgacguccgcaacaacuucuaccacuacaaccaguccaacgacucuaccaucaagcucauagccaugcuuuauaccccacuccgugcaaacaacccaggugaugaugucuucacugucuccugcagaguacuaacccgacccucccccgacuucgacuucauauuucuagucccacccaccguugaaucacgaaccaaacccuuuucaguccccauucucacagucggcgaaaugaccaacucaagauuccccaucaaccucgaacgccucuucaccggccccuccucagcaaacgucguccaaccccaaaauggccguugcacaaucgacggugaacuacucggcaccacccaacucuccucagucaacauaugcaccuuccgcggcgacguaacccaaauagguuccacacaacacuggaccaugaaucucgcauccccaaacuggaacaacuacgacccaaccgaagaaacccccgcaccacucggcaccccagacuucgucggcaaaauacacggaaugcucacccaaacaacccaagaaaacggauccacacgcgcacacagagcaaccguauacguuggcggagccaacuuuacaccaaaacuugguaaagugcgcuucgagacugacaccggcgacgaccuagccauaagacaaaacaccaaauucacacccguuggagucauccaauccagcgaccaccauagagacgagccccaacaauggcgacucccaaacuauuccggagccaacaccuucaacguccaccuagcgcccgccgucgccccuaacuuccccggagaacaacuccuauucuuuagauccacccugcccggaugcggcggacaccccaacauggaccucgacugccuucuaccccaggaauggguccagcacuucuaccaagaagccgcgccagcccaaucugacguagcccuccuccgcuucgucaacccagacacaucacgcguacucuucgaaugcaaacuucacaaaucaggauacgucaccguagcacacaccggccaauaugaccucguacucccguccaacggcuacuuccgcuucgacuccuggguaaaccaauucuacacacucgcccccaugggcaacggaaccggccgccgccgauaa

SEQ ID NO: 39246 - RNA, 1614 nt, Artificial Sequence
  derived and/or modified sequence opt11 from VP1__Norovirus_and/or_Norovirus-like__KX514357
augaagauggccucauccgacgccaaccccuccgacggcagcgccgcaaaucucguucccgaagucaacaacgaagucauggcacuagaacccguagucggagcagccaucgccgcccccguugcaggacagcagaacgucaucgaccccuggauucgcaacaacuuuguccaggcccccggcggugaguucaccgucucacccagaaacgcccccggcgagauccucugguccgcaccccuaggaccugaccucaaucccuaccucagccaucuagcccgcauguacaacggcuacgccggcgguuucgaaguccaagucaucuuagcuggaaacgccuucacagcaggcaaaauaaucuuugcagccguacccccaacauucccgacagaaggacucucccccucccaagucacaauguuuccacacauaauuguagacguccgccaauuagaacccguacucaucccccuaccagacguacgcaacaacuuuuaccacuacaaccaaagcaacgacucaaccauaaaacucauagcaaugcuauacaccccacuccgcgccaacaaccccggcgacgacguauucaccguauccugccgcguccucacucguccauccccugacuucgacuucauuuuccuugucccacccaccgucgaaucgcgcacaaaacccuucucaguccccauccuaaccguaggcgagaugacaaacucccgcuuccccaucaaccucgaacgacucuucaccggccccuccucggccaacgucguccaaccccaaaacggacggugcacaauugacggcgaacuccuaggaaccacacaacucucguccgucaacauauguacauuccgcggcgacguaacccacauuggcuccacccaccacuggaccaugaacuuagccucccccaacuggaacaacuacgacccuaccgaagaaacccccgcaccacucggcacccccgacuucgucggcaagauccacggcaugcucacccaaaccacacaaggcuccggcagcacccgugcacaccgcgccaccgucuacguaggcuccgccgacuucacccccaaacucggaaaagugcaauucgagaccgaaaccgaccacgaccucgccauccgucaaaacacaaaauucacccccgucggagucauccaagaaucagacaaccaccgagacgaaccccaacaauggcgccuccccaacuacuccggagccaacaccuucaacguccaccucgcccccgccgucgccccaaauuuuccaggagagcaacuccucuucuuccgauccaccauccccggcugcggcggccaccccaacaugaaucuagacugccuccucccacaagaguggguccagcacuucuaccaagaagcagcccccgcacaaucagacgucgcccuccuccgcuuugucaaccccgacaccucaagaguccucuucgaaugcaaacuacacaaaucaggauacguaacagucgcacauaccggucaacacgaccucgucauuccacccaacggcuacuuuagauuugauucauggguaaaccaauucuacacccuagcccccaugggaaacggaaccggccgcaagcgauga

SEQ ID NO: 39247 - RNA, 1614 nt, Artificial Sequence
  derived and/or modified sequence opt11 from VP1__Norovirus_and/or_Norovirus-like__KX514240
augaaaauggccuccaacgaugcaaaccccucagacggaucugcagccaaucucguacccgaaguaaacaaugaagucauggcacuagagccagucgucggcgcagccaucgcagcccccgucgccggccaacaaaacguaauagaccccuggauccgaaauaauuucguccaagccccuggcggcgaguucacagucucaccccguaacgcacccggagaaauccuaugguccgcaccccucggcccagaucucaacccauaccucucccaccuugcccgcauguacaacggauacgccggcggcuucgaaguccaaguuauccucgcaggaaacgccuucaccgccgguaaaaucauauucgccgccgucccgccaaacuuccccaccgaaggccucucccccagccaaguuaccauguucccccacaucaucguggacguccgacaacucgaaccgguccucaucccacucccugacguacgaaacaauuucuaucacuacaaccaauccaaugacuccacaauaaaacucaucgccaugcucuacaccccacuacgugcaaacaacgccggcgacgacgucuucaccgucuccugcagaguccuuacccggccgucgcccgacuucgacuucaucuuccucgucccacccaccgucgaaucccguuccaagcccuucuccguccccguccucaccgucgaagaaaugaccaauucccgcuuccccgccacacuagacaaacucuucacaggccccuccuccacauucguaguacaaccucaaaacgggcgcugcaugaucgacggcguccuacucgguaccacacaacuaucacccgugaacaucugcaccuuucgaggcgauguaacccacccacgagacuccccaaucuacaccaugaaccucgccucccccaacuggaacaauuacgaccccaccgaagaaauucccgccccucuuggaacccccgauuucguaggcaaaauccacgguaugcuuacccaaaccacacaaggauccggaucuacccgcgcccaccgcgccaccgucuacgucggcucugccgaguucacccccaaacucggaaaagugcaauuccaaaccgaaaccgaagaugaccuagucauacgccaaaacaccaaauuuacccccgucggcgucauucaagaauccgaccaucaccgagacgaaccccaacaauggguccucccuuccuauuccggccgcgacacccccaacguucaccucgcccccgcugucgcacccaccuuccccggagaacaacuccucuucuuccgaucaacaauccccggcugcggcggucaccccaacaugaaccucgacugccuacuaccucaagaauggguccaacacuucuaccaagaagccgccccagcccagucagaugucgcccuacuccgauucguaaauccugacacaagccgcgucuuauucgaaugcaaacuucacaaaagcggcuacgucaccgucgcccacacaggucaacacgaccucguaauacccccuaacggauacuuccgcuucgacuccugggucaaucaauucuacacacucgcccccaugggcaacggcacaggccgcaaacgguaa

SEQ ID NO: 39248 - RNA, 1614 nt, Artificial Sequence
  derived and/or modified sequence opt11 from VP1__Norovirus_and/or_Norovirus-like__AF414417
augaaaauggccuccaacgacgccaaucccucagacggcucagccgccaaccucguccccgaaguaaacaacgaagucauggcccucgaacccguaguugacgccgccauagccgcccccguagcaggacaacaaaacguuaucgauccauggauccgcaacaacuucguacaagcacccggaggagaauuuaccgucuccccacgcaacgcccccggagaaauccucugguccgcuccccuaggcccggacccaaaccccuaccuaucgcacuuaagccgaauguacaacgguuaugccggaggcuucgaaguccaagucauccuugccggcaacgccuucacugccggaaaaguaaucuucgccgccgucccuccaaacuuccccacagaaggccucucgccaucccaagucacuauguucccccauauaaucgucgacguacgacaacuagaacccaugcucauaccccuacccgacgucagaaacaacuucuaccauuacaaccaagccaacgacucaacucucaaacucaucgccacccuauauacuccccugcgcgcaaacaacgccggagacgacgucuucacaguaucaugccgugugcucacccgccccucccccgacuucgacuucaucuuccuugucccacccaccgucgaauccagaacaaaacccuucaccguccccguacuuacaguugaagaaauguccaacucacgcuuccccaucccccuugaaaaacucuacaccggccccagcucagccuuugucguccaaccccagaacggccgcugcaccacugacggcguccucuuaggcacuacgcaacucuccgcaguaaacauaugcaacuuccgcggagacgucgcucacaucgccgguucccaugacuacaccaugaaccuugccucucagaauugguccaacuacgaucccaccgaagaaauccccgcaccccucggcaccccagacuucgucggcaagauccaaggacuccucacccaaacuacccgcgccgacggucuaacacgcgcccacaaagccacagucuccacuggcucaguacacuuuacuccaaagcuaggcuccguccaauucacaaccgacaccaacaacgacuuccaagccggccagaacaccaaauucacacccgucggaguaauccaagacggcgaucaccaccaaaacgaaccacaacaauggcuacuacccaacuacuccggacgcaccggccacaacguucaccuugcccccgcagucgcaccaaccuucccuggcgaacaacuccucuucuuucgcagcaccaugcccggaugcuccggauaccccaauaugaaucucgacugccuccuuccucaagaauggguccuccacuucuaccaagaagcagcccccgcccaauccgacgucgcucuacuccgcuucgucaacccugacacgggccgcguccucuucgaaugcaaauuacacaaauccggcuacauuacugucgcacacaccggcccauacgacuuaguucuaccacccaacggauacuuccgcuucgacucuugggucaaccaauucuacacacucgccccaaugggcaacggaaccggccgcagacgcuaa

SEQ ID NO: 39249 - RNA, 1614 nt, Artificial Sequence
  derived and/or modified sequence opt11 from VP1__Norovirus_and/or_Norovirus-like__KX514303
augaaaauggcaucauccgacgccaaucccuccgacggauccacagcaaaucuaguaccagaagucaacaacgaagucauggcacuagaaccgguaguaggagccgcaaucgccgcacccgucgccggacaacaaaacgucaucgaccccuggauccgaaauaacuucguacaagcaccuggcggcgaauuuaccguaucaccucgaaacgcccccggcgaaauccuuuggucagcaccacuuggaccggaccucaaccccuaccucucccaccucgcccgcauguauaacggauacgcaggagguuucgaaguccaagucauacucgcaggaaacgcuuucaccgccggaaaaaucaucuucgcagcaguaccucccacauuccccaccgaaggccuauccccaucccaaguaacaauguucccccacaucauaguagacguccgccaacuagaacccguccucaucccacuccccgacguccgcaacaauuucuaccacuacaaccaaucaaacgacuccaccaucaagcucaucgcgaugcucuacaccccacucagagccaacaacccgggagaugacgucuucaccguaucuugccgagucuuaacccguccaucccccgacuucgacuucauauuccucgucccgcccaccguagaaagccgcaccaagccauucuccguacccauccuaacagucggcgaaaugacaaacuccagauuccccguuaaccucgaacgccuauuuacuggaccgucauccgccaacgucguacaaccccagaacggaaggugcaccaucgacggcgaacugcucggcacaacacaacucuccucaguaaacauaugcaccuuccgaggugacguaacccaaaucggaucaacucgacacuggacuaugaaccuggccuccccuaacuggaacaacuacgaccccaccgaagaaacacccgcaccccucggaacacccgacuucguaggcaaaauccacggaaugcucacacaaaccacccagggcagcggcuccaccagagcccacagagccaccgucuauguaggcucagccgaguucacccccaaacucggaaaaguacgcuucgaaaccgacaccgaagacgaccucgucauccgccaaaacacaaaauucaccccagucggagucauccaauccuccgaccaccaccgcgacgaaccccaacaauggcgccucccaaacuacucaggcgccaacaccuuuaauguacaccuagcacccgccgucgcaccuaacuuccccggcgaacaacuacucuucuuccgcuccacacuccccggcugcggcggccacccuaacauggaccuagacugccuccucccacaagaauggguacaacacuuuuaccaagaagccgccccugcccaaagcgacguagccuuacuacgguucguuaacccagauacaucccgaguucucuuugaaugcaaacuacacaaauccgguuacguuacugucgcccacaccggccaauacgaucuaguacuccccucaaacggcuacuuccgcuuugacucauggguuaaccaauucuacacacucgcccccaugggaaacggcaccggccgccgccgcuaa

SEQ ID NO: 39250 - RNA, 1614 nt, Artificial Sequence
  derived and/or modified sequence opt11 from VP1__Norovirus_and/or_Norovirus-like__KX514273
augaaaauggccagcagcgacgccaaccccagugauggauccaccgcaaaccucguucccgaagucaacaacgaagucauggcccuagaaccaguagucggcgcagccaucgcagcccccgucgccggucagcaaaauguaaucgacccauggauuagaaacaacuucguacaagcccccggcggagaguucaccgucucgccacgaaacgcccccggcgaaauccuauggucagccccacugggccccgaccuaaacccuuacuuaucccaccucgcccgaauguacaacggcuacgcaggcggcuucgaaguccaggucauccucgccggcaacgcuuucacagccggcaaaaucauuuucgcagccgucccacccaccuuccccaccgaaggacucucccccucccaagucaccauguucccccacaucauagucgauguccgccaacucgaaccgguccucauaccacuacccgacguacgaaacaacuucuaccacuacaaccaauccaacgacucaaccaucaaacuuaucgccaugcuauacacaccccuccgagcaaacaacgccggcgaugacgucuuuaccguaucaugccguguccucacccgcccaucacccgacuucgacuucaucuuccucguaccucccaccgucgaaucccgcucaaaaccauuuucagucccuguccuaaccguugaagaaaugacaaacucccgauuccccgccacccuagacaaacucuucaccggccccuccucgaccuuugucguccaaccacaaaauggccgaugcaugaucgacggaguccuccuaggaaccacccaacucucccccgucaacauaugcaccuucagaggcgacguuacacacccccgcgacucucccaucuacaccaugaaccucgcaucccccaacuggaauaacuacgauccuacagaagaaauacccgcaccacucgguacgcccgacuucacaggaaaaauccaaggcaugcucacacaaacaaccaaaggcgaagguuccaccaggggacaccgcgccacagucuacgucggcucagccgaguucacacccaaacucggaaaaguacgauucgaaacugacacagaagacgaccucguaauccgccaaaacaccaaauucacuccaguagguguuauacaguccuccgaccaucaccgcgacgaaccccaacaauggcgccugcccaauuacucuggcgccaacacauucaacguacaccucgcccccgccgucgcaccaaacuucccaggcgaacaacuccucuuuuucagaucuacccuaccaggcugcggcggccaccccaacauggaccuagacugccuccuuccacaggaauggguccaacacuucuaccaagaagcugccccagcccaaucagacguagcccuacuacgauucguaaauccagacacuucccgcguacucuucgaaugcaaacuacacaaauccggcuaugucaccgucgcccacacaggucaauacgaccuuguacuacccucaaacggcuacuucagauucgacagcugggucaaccaauucuacacccuagccccuaugggaaacgguacaggucgccgccgcuaa

SEQ ID NO: 39251 - RNA, 1614 nt, Artificial Sequence
  derived and/or modified sequence opt11 from VP1__Norovirus_and/or_Norovirus-like__KX514323
augaagauggccagcaacgaugccaaccccuccgacgguuccgcggccaaccucguccccgaagucaauaacgaagucauggcgcuagaacccguggucggagccgcaaucgccgcccccguagccggacaacaaaacguuaucgaucccuggauacgaaacaacuucguccaagcaccuggcggagaauuuacaguaagcccccgcaacgcccccggagaaauacucugguccgcaccccuaggcccagaccucaaccccuaccuuucacaccucgcucgcauguacaauggauacgccggcggcuucgaaguccaagucauccuagcaggcaacgcauucaccgccggaaaaaucauauucgccgcugucccacccaacuuccccacggaagggcucucacccucccaggucaccauguucccccacaucauaguagacguccgccaacucgaacccguucucaucccccugccagacgucagaaauaacuucuaccacuacaaccaauccaacgacagcacaaucaaacucaucgccaugcucuacacaccccuucgcgccaacaacgcuggagacgacguauucaccgucuccugccgcguccucacccgccccuccccggacuucgacuucauauuccucgucccucccaccguagaaucacgauccaaacccuucucugucccaguucuaaccguugaagaaaugaccaacagccgauucccggccacccucgacaaacucuucaccggccccagcagcaccuucgucguccaaccacaaaacggccgcugcaugaucgacggagugcuccucggcacaacccaacucucuccagucaacaucugcaccuuccgcggagacguuacacauccaggcaauucaaaaaucuacaccaugaaccucgccagccccaauuggaacaacuaugaucccaccgaagaaaucccagcaccccucggaacccccgacuucgucggcaaaauacacggcaugcucacacagaccacccaagaaaacggauccacacgcgcccaccgcgccacaguauacgucggcggcgccaacuucacccccaaacucggcaaaguccaauucgaaaccgacaccggugacgaccucgccauccgccaaaacaccaaauucacccccgucggagucauacaauccuccgaccaccacagggacgaaccacaacaguggcgccuccccaacuacuccggugccaacaccuucaacguccaccucgcacccgcugucgcucccaacuuccccggcgaacaacuacucuucuuccgauccaccaucccaggcugcggaggccacccaaacaugaaccuagacugucuccuaccccaagaauggguccaacacuucuaccaagaagcugccccagcccaaucagacgucgcacuucuacgauucgucaaccccgacaccucacgcguccuauucgaaugcaaacuacacaaaagcggauacguaacggucgcucacaccggccaacacgaccucguuaucccacccaacggcuacuuccgcuucgauuccuggguaaaccaauucuacaccuuagcccccaugggcaacggcacuggacgaaaacguuaa

SEQ ID NO: 39252 - RNA, 1614 nt, Artificial Sequence
  derived and/or modified sequence opt11 from VP1__Norovirus_and/or_Norovirus-like__KX514364
augaaaauggcaucgucugacgcuaaccccuccgacggauccacagccaaccuuguccccgaagucaacaacgaagucauggcccucgaaccaguugucggcgccgcaaucgccgcaccagucgccggccaacaaaacguaaucgaccccuggauucgcaacaacuucguacaagcacccggcggagaguucaccgucucaccccgaaacgcccccggcgaaauccucugguccgcaccacuaggucccgaccucaaccccuaccuaucccaccucgcacguauguacaacggauacgccgggggcuuugaaguccaagucauccuagccgguaacgccuucacagccggcaaaauaaucuucgccgccguuccacccacauucccaacagaaggacucuccccaucccaagucaccauguucccacacauaauugucgacguccgacaacuagaacccguccuaauaccccuaccagacguccgcaacaacuucuaucacuacaaccaauccaacgacuccacaauaaaacuaauagccaugcuauacacgccacuccgcgccaacaaccccggagacgacgucuuuaccgucagcugccgaguccuaacccgacccucccccgacuuugauuucaucuuccuagucccacccacaguugaaucucgcaccaaacccuucuccguacccauccuaaccgucggagaaaugaccaacucccgcuuccccauaaaccucgaacgucuuuucacuggacccuccucugccaacgucguacaaccgcaaaauggaagaugcacaaucgacggcgaacuccucggcaccacccaacucucauccguaaacaucugcaccuucagaggagacgucacccaaauaggcuccaccaaacacuggacaaugaaccucgccucaccaaacuggaacaacuaugacccaaccgaagaaacacccgcuccccucggcaccccagauuucgucggaaaaauccacggcaugcucacccaaaccacccaagaaaacggcucaacaagagcccaccgggccaccguauaugucggcggcgccaauuuuacccccaaacucggcaaaguccaguucgaaacugacacuggagacgaccuugccauccgccaaaacaccaaauucacacccgucggagucauccaaucauccgaccaccaccgcgacgaaccacaacaauggcgcuuacccaacuacucaggcgccaacacuuucaacguccacuuagcucccgccgucgcaccaaacuuccccggcgaacaacuucuauucuuccgcuccacacuaccagguugcggcggccacccaaacauggaccuugacugccuccucccccaagaauggguccaacacuucuaccaagaggccgccccagcucaauccgauguagccccacuccgcuuuguaaacccggacaccucgcgaguacuauucgaauguaaacuccacaaguccggcuacgucacagucgcccacacuggucaauacgaccuaguacuccccucuaacggcuauuuccgcuuugacuccugggucaaccaauucuacacccuagcccccauggguaacggaaccggccgccgccgcuaa

SEQ ID NO: 39253 - RNA, 1614 nt, Artificial Sequence
  derived and/or modified sequence opt11 from VP1__Norovirus_and/or_Norovirus-like__KX514338
augaaaauggccuccaacgacgccaacccauccgacggcuccgcagccaaccucguaccagaagucaacaaugaagucauggcacuggaaccaguagucggugcugccauugcagcucccgucgccggccaacaaaaugucauagacccauggauccgcaacaacuucguccaagcacccgguggcgaguucacaguaucacccagaaacgcccccggcgaaauccucuggucugcccccuuaggccccgaccucaacccauaccuuucucaccucgcacgaauguacaacggauacgccgguggcuucgaaguacaaguaauccucgcaggcaacgccuucaccgccggaaagaucauauucgccgcggucccaccaaauuuccccaccgaaggccuaucccccucacaagucaccauguuuccccacauaaucguugacguacgccaacucgaaccaguucucauaccacuccccgacguacgaaauaacuuuuaccacuacaaucaaucaaaugacagcaccauaaaacuuaucgccaugcucuacacaccccuacgugccaacaacgcaggagacgacgucuucaccguaucaugccgcguucucacccgcccuucccccgacuucgauuucaucuuccucguaccacccaccgucgaaucccgaucgaaaccauucaguguacccguccucacagucgaagaaaugaccaacagccgauuccccgccacccucgacaaacucuucaccggaccauccucaaacuuuguaguccaaccgcagaacggccggugcaugauagacggcgugcuccucggcacaacucaacucuccccuguaaacauuugcaccuuccgcggcgauguaacccaaaucggauccaccaaacacuggaccaugaaccucgccucacccaacuggaacaacuacgacccaaccgaagagaccccugcaccccuaggcacaccugacuuugucggcaaaauucacggcaugcucacccaaaccacacaagaaaacggcuccacacgagcccauagagccaccguauaugucgggggcgccaacuucacaccaaaacuuggaaaaguccaauucgaaaccgacacaguagacgaucuagagauccgacaaaacaccaaauucacccccgucggcguaauccaaucgucugaccaccaccgcgacgaaccacagcaauggcgacucccuaacuauucaggagccaacaccuuuaacguacaccucgccccagccguggcccccaacuuccccggagaacaacuccucuucuuccgauccacccugcccggaugcggcggccaccccaauauggaucucgacugccuacucccccaagaauggguccaacacuucuaccaagaagccgcccccgcccaaucagacguagcacuccuacgcuucgucaaccccgacaccucucgaguacucuucgaaugcaaacuccauaaauccggcuacgucaccguagcgcacacaggccaauacgaccucguccucccauccaacggcuacuuucgcuucgauuccugggucaaccaauucuacacacucgcccccauggguaacggcaccggccgccgccgcuaa

SEQ ID NO: 39254 - RNA, 1614 nt, Artificial Sequence
  derived and/or modified sequence opt11 from VP1__Norovirus_and/or_Norovirus-like__KX514316
augaaaauggccagcucggacgccaacccaucugacggcucaaccgcaaaccuaguccccgaagucaacaacgaaguaauggcccucgaacccgucguaggcgcagccaucgccgcaccaguagccggccaacaaaacguaaucgaccccuggauuagaaacaacuucguucaagcuccagggggcgaguucaccguuucaccccgcaacgccccaggugaaauccucugguccgcuccccucgguccagaccucaaccccuaccucucccaccuagcccgcauguacaacggcuacgccgguggcuucgaaguccaagucauccuugccggcaacgccuucacugccggaaaaauaauuuucgccgcaguucccccuaccuucccaacggaaggccucucccccucacaaguaaccauguucccccauauaauaguagauguacgccaacucgagcccguccuaauaccucucccagacguccgaaacaacuuuuaccacuacaaccaaucaaacgacuccacaaucaaacucauagcaauguuauacacaccccuacgcgccaacaacccgggagacgacgucuucaccguaagcugccgcguccucacccgacccuccccagacuucgacuucauauuccucguacccccaaccgucgaaucacgcuccaaaccauucuccguccccguacuaaccgucgaagaaaugacuaacucacguuucccagccacccuagacaaacucuucaccggcccaucaucaaccuuuguuguccaaccccaaaacggacgcugcaugauagacggcguacuccucggcacgacccaacuaucacccgucaacaucugcaccuuccgcggcgacgucacccauccacgcgacucaaaaaucuacaccaugaaccucgccucccccaacuggaacaacuacgacccaaccgaagaaauucccgccccacucgguaccccagacuuugucggcaaaauucaaggaaugcuuacccaaacaacaaagggcgaaggcuccacacgcggccaccgcgccacaguauacguaggcagcgccaacuacgcccccaaacuaggccguguacaauucgaaacagacacaaccgacgaccucgacgcccaccaaaacaccaaauucacccccgucggaguaauccaauccucggaccaccaccgcgacgaaccccaacaguggcgcuuacccaacuacuccggagccaacacauucaacguucaccucgccccagcaguagcacccaacuuccccggcgaacaacucuuauucuuccgcuccacacuacccggaugcggcggccacccaaacauggaccuagacugccuccuuccacaggaauggguacaacacuucuaccaagaagcugcccccgcccaauccgacgucgcccuccuccgauucgucaaccccgauacuucucgcguccucuuugaaugcaaacuacacaaaucaggcuacgucaccguagcccacaccggccaguacgaccucguucuacccuccaacggauacuuccguuucgacuccuggguaaaccaauuuuacacacuggccccgauggguaauggcaccggccgaaaacgcuaa

SEQ ID NO: 39255 - RNA, 1614 nt, Artificial Sequence
  derived and/or modified sequence opt11 from VP1__Norovirus_and/or_Norovirus-like__KX514356
augaaaauggcauccagcgacgccaaccccucagacggcagcgcugccaaccuaguccccgaaguaaacaaugaaguaauggcccuagaacccgucgucggcgccgcaaucgcagccccagucgccggacaacaaaacgucauagaccccuggauccgaaauaacuucguccaagcccccgguggagaauuuaccguaucaccucgcaacgccccaggcgaaauccuuugguccgcccccuuaggccccgaccucaaccccuaccuaucucacuuagcacgcauguacaacggauacgccggagguuucgaaguccaagucauccucgcaggaaacgcauucaccgccggcaaaaucaucuucgccgccgucccucccaccuucccaaccgaaggucucucccccagccaaguaacuauguucccccacauaaucgucgacguccgccaacucgaaccaguacucauacccuuaccagacguccgcaauaacuguuaccacuauaaccaguccaacgacucuaccaucaaacuaaucgccaugcucuacacaccccuccgagccaacaacccaggcgacgacguuuucaccgucuccugcagagucuuaacccgccccagccccgacuucgacuucaucuuccucguaccacccaccgucgaaucccgcacaaaacccuucuccguccccauccuaacugucggcgaaaugaccaacagccgcuuccccaucaaccuagaaagacuauucaccggacccucauccgcgaacgucguccaaccccaaaacggcagaugcacaauagacggcgaacuacucggaaccacccaacucucaucugucaacaucugcacauucagaggcgacgucacccauauuggauccacacaccacuggaucaugaaccuugcgucccccaacuggaauaauuacgaccccaccgaagaaacaccagcaccccucggaaccccagacuucguaggcaagauccacggcaugcucacacagaccacccaaggauccggcagcacacgcgcgcaccgcgccaccgucuacgucggcuccgcugacuucaccccaaaacucggaaaaguccaguucgaaaccgaaaccgaccacgacuuagccauccgccagaacacgaaauucacccccgucggcgucauccaagaaucggaccaccaccgcgacgaaccccaacaauggagacuaccuaacuacuccggcgccaacacauuuaacguacaucuagccccagccgucgcccccaccuucccgggugaacaacuacucuucuuccgcuccaccauacccggcugcgguggccaccccaacaugaaccucgacugucuccucccccaagaaugggugcaacacuucuaccaagaagcagcccccgcccaauccgaugucgcacuucuccgauucguaaaccccgacaccucccgcguccucuucgaaugcaaacuccacaaauccggauacguuacgguagcucacaccggacaacacgaccucgucaucccacccaacggcuacuuccgauucgacucuuggguaaaccaauucuacacccuagcccccaugggaaacggcacagguagaaaacgcuaa

SEQ ID NO: 39256 - RNA, 1614 nt, Artificial Sequence
  derived and/or modified sequence opt11 from VP1__Norovirus_and/or_Norovirus-like__KX514349
augaaaauggccuccaacgacgccaacccaucagacggcucagccgccaaccucgucccagaaguaaacaacgaagucauggcccuagaacccgucguuggcgccgccaucgccgcacccgucgccggccaacaaaacguaauagacccauggauccgcaacaacuucguacaagcaccaggaggugaguucaccgucucuccccgaaacgcucccggggaaauacuguggucagcaccucuaggccccgaccuaaaccccuaucucucucaucuggcacgcauguacaacgguuacgcgggcggauucgaaguacaaguuauccucgccggaaacgccuuuacagccggcaaaauaaucuucgccgccguacccccaaacuucccaaccgaaggccucuccccaucacaagucacuauguucccgcacauaaucguagacguacgacaacucgaacccguacucaucccccuucccgauguacgcaacaacuucuaucacuacaaccaauccaaugacagcacgaucaagcucauagcaaugcucuacaccccacuccgugcaaacaaccccggcgacgacgucuucaccgucucaugccgcguccuuaccagacccucccccgacuucgacuucaucuuccucguaccuccaacaguagaaucccgauccaaaccuuucagcguccccguccucaccgucgaagaaaugacaaacucccgcuucccggccacccuugacaaacucuucacaggacccucauccaccuucgucguacaaccacagaacggacgcugcaugaucgauggcguccuauuaggaaccacccaauuaucccccguaaacaucugcaccuuccgaggcgacguuacacaauccggcaacacuaagauauacacaaugaaccucgcaucccccaauuggaacaacuacgauccaaccgaagaaauacccgcaccccucggaacuccugacuucgucggaaaaauccaagguaugcucacccaaaccacaaaaggcgaaggcucaacucgcggucaccgagcgaccgucuacgucggcggcgcugaguucacccccaaacuaggaaaaguacgauucgaaaccgauaccgaagacgaccuugucauccgccaaaauaccaaauucaccccagucggcgucauccaaacaucagaaaaccacagagacgaaccccaacaauggcgccuccccaacuauuccggccgcgacacacccaacguacaccucgcccccgccgucgccccaacauuccccggcgaacaacuccuauucuuucgauccacgauaccaggcugcggaggccaccccaacaugaaccuagacugccuacucccccaagaaugggugcaacacuucuaccaagaagcagccccagcccaauccgacgucgcccuccuccgcuucguaaaccccgacaccucccgaguccuuuucgaaugcaaacuucacaaauccgguuacgucaccguagcccacaccggccaacacgaccuagucaucccaccgaauggauacuuccgcuucgacuccuggguaaaccaauuuuacacccuagccccaaugggaaacggcaccggcagaaaacgcuaa

SEQ ID NO: 39257 - RNA, 1614 nt, Artificial Sequence
  derived and/or modified sequence opt11 from VP1__Norovirus_and/or_Norovirus-like__KX514217
augaaaauggccucaaacgacgcaaaccccucagacggcucugccgcuaaucuuguccccgaaguuaacaacgaaguaauggcccucgaaccagucguaggcgccgcaauugccgcgcccguagcaggccaacagaacgucaucgacccauggauccguaacaacuucguccaagcccccggcggcgaguucaccguuuccccacgcaacgcccccggcgaaauccuuugguccgcaccacucggccccgaccugaaccccuaccuaucccaccucgcccgcauguacaacggauacgccggcggcuucgaaguccagguaauccuagccggcaacgccuucaccgccgguaagaucauauucgccgcugucccgccaacauuccccaccgaaggccucuccccaucucaagucaccauguucccccacauaaucguagacguacgccaacucgaacccguccucaucccacuccccgacguuagaaacaacuucuaccacuacaaccaauccaacgacucuaccaucaaacucaucgccauguuauacacuccccuccgagcaaacaacgccggagacgacguauucaccgucucaugccgcguccucacacgcccaucacccgacuucgacuucauauuccucgucccacccaccguagaaucccgaagcaaacccuucucaguacccguacucacaguggaagaaaugacaaacucccgcuucccagccacucucgacaaacucuucaccggaccaucauccaccuucguuguccaaccucaaaacggacggugcaugaucgacggcguucucuugggcacaacccaacucucccccgucaacauaugcaccuuccgcggagacgucacacauccacgagacucaccaaucuacacaaugaaccucgccuccccaaacuggaacaacuacgacccaaccgaagaaauccccgcaccccuuggcacacccgacuucguuggaaaaauacaaggcaugcucacccaaacaacccagggcucaggcuccacccgcgcccaccgagccaccgucuacguagguucagccgaguucacccccaaacuaggaaaaguacaauuccaaaccgaaaccgaccacgaccucguaauacgucaaaacaccaaauucacccccgucggcgucauccaagaauccgaccaccaccgagacgaaccccaacaauggcgccuccccaacuacucaggagccaauacuuucaauguacaccuagccccugccguugcucccaacuuccccggagaacaacuccucuucuuccgcuccacccuccccggcugcggcggccaccccaacauggaccucgacugccuccuaccccaagaauggguacaacacuucuaccaagaagcagcccccgcucaauccgacgucgcacuucucagguucguaaacccugacaccucacgcguccuauucgaaugcaaacuacacaaauccgguuacguaaccgucgcccacaccggacaauacgaccucguucuacccagcaacggcuacuucagguucgacuccugggucaaccaauucuacacccucgcccccaugggcaauggcacaggccgacgcagauag

SEQ ID NO: 39258 - RNA, 1614 nt, Artificial Sequence
  derived and/or modified sequence opt11 from VP1__Norovirus_and/or_Norovirus-like__KX514324
augaaaauggcuuccuccgacgccaaccccuccgacggcuccacugcaaaccuuguaccugaagucaacaacgaaguaauggcucucgaacccguuguaggcgcggcaaucgcagcacccguagccggacaacaaaacgucaucgaccccuggauacgcaacaacuucguccaagccccgggcggcgaguucacagucuccccacgcaacgcucccggcgaaauucucuggucagccccucuaggccccgaccucaaccccuaccuaucccacuuagcacguauguacaacggcuacgccggcggauucgaaguacaagucauccuggccggaaacgcuuuuacggcuggaaaaaucauuuucgccgccguucccccaacuuuuccuaccgaaggacuaucuccaagccaagucacaauguucccacacaucauagucgacguccgccaacucgaacccguucuaaucccccucccugacguccgaaacaacuucuaccacuacaaccaaagcaacgacuccaccaucaaacucaucgccaugcuauacacuccucuccgagccaacaaccccggagaugacgucuucaccgucuccugccgcguacucacacgaccaucccccgacuucgauuucauuuuccuaguacccccgaccguagaaucccgcuccaaacccuucucaguccccguccucaccgucgaagagaugaccaacucccguuuccccgcaacacucgacaaacucuucacaggaccuagcuccacauucgucguccaaccacaaaacggccgcugcaugaucgacggcguccuccucggaaccacccaacucuccccaguaaacaucugcacauuccgcggcgacgucacccacucaggaaacuccaaaauauacacuaugaaccucgccucacccaacuggaacaacuacgacccuaccgaagaaauaccagcaccccucggcacaccugacuucguaggcaaaauccaaggcaugcucacacaaacuaccaaaggagaaggcuccacccgcggccaccgcgccacuguauacgucggcggcgccaacuucacgcccaaacuggguaaaguacaauucgaaaccgacaccgucgacgaccucgaaauacgccaaaauaccaaguucacacccgucggagucauccaauccucugaccaccaccgcgacgaaccccaacaauggcgccuccccaacuacucgggagccaacaccuucaauguccaccucgcccccgccgucgccccaaacuuccccggcgaacaacuacuuuucuuccgcucuacccuccccggcugcggcggacacccaaacauggaccucgacugccuccuuccccaagaauggguucagcacuucuaccaagaagccgcccccgcccaauccgacguagcccuccuccgcuucgucaacccagacaccucccgaguccucuucgaaugcaaacuccacaaauccggcuacguaacagucgcccacaccggacaacaugaccuugucaucccgccuaacggcuacuuccgauucgacagcuggguuaaccaauucuacacccucgccccuaugggcaacggcaccggccgcaaacgcuaa

SEQ ID NO: 39259 - RNA, 1614 nt, Artificial Sequence
  derived and/or modified sequence opt11 from VP1__Norovirus_and/or_Norovirus-like__KX514306
augaaaauggccuccucagacgccaaccccucagauggauccaccgcaaaccucguccccgaagucaacaacgaagucauggccuuagaaccagucgucggcgucgccaucgcagcucccgucgccggucaacaaaacgucaucgacccauggauccgcaacaacuucguccaagcucccggcggagaauuuacaguaucuccccgcaacgcccccggcgaaauccucugguccgcuccccucggacccgaccuuaaccccuaccuaagccaccucgcccgaauguacaacggcuacgccggaggcuucgaaguccaaguuauccuagcaggcaacgccuucaccgcugggaaaaucauauucgccgccguacccccuacuuuccccaccgaaggccucuccccuagccaagucaccauguucccccacaucauagucgacgucagacaacuagaacccguccucaucccccuccccgacguacguaacaacuucuaccacuacaaccaauccaacgacucuaccauaaaacuuaucgccaugcucuacacgccccuccgugccaacaaccccggagacgauguauucauuguauccugccgaguccuaacccgacccucaccagacuucgacuucaucuuccucgucccucccacagucgaaucccguaccaaacccuucuccgucccaauauuaaccguuggcgaaaugacaaacucccgcuuccccauaaaccucgaacgucuuuucacuggcccauccucagcuaaugucguacaaccacaaaacggaagaugcaccaucgacggcgaacugcuaggcaccacacaacucagcucugucaacaucugcaccuuccgcggcgacgucacccaaaucggcuccacccaacacuggaccaugaaccuagccuccccuaacuggaacaauuacgacccaaccgaagaaacacccgcaccacuaggcaccccugacuucgucggcaaaauccaaggaaugcuuacacagaccacucaagaaaacggcucaacacgagcacaccgagccacaguauacgucggcggcgccaacuacgcccccaaacuaggcaaaguacaauucgaaaccgacaccggagacgaccuagccauacgccaaaacacaaaauucacccccgucggcgucauccaauccagcgaccaccaucgcgacgaaccccaacaauggcgacucccuaacuacuccggugccaacaccuucaauguccaccuugcccccgcugucgcccccaacuucccaggagaacaacuacuauuuuuccguucaacacucccuggcugcgguggccaccccaacauggaccuagacugccuccuuccccaagaauggguccaacacuucuaccaagaagccgcccccgcucaaagcgacgucacccuccuacgauucgucaacccagacaccucccguguccuauuugaaugcaaacuccacaaauccggauacgucaccguugcccacaccggucaauacgaucucguucuuccauccaacggcuacuuccgcuucgacuccugggucaaccaauuuuacacucucgcaccuaugggcaacggcaccggccgaagaagguaa

SEQ ID NO: 39260 - RNA, 1614 nt, Artificial Sequence
  derived and/or modified sequence opt11 from VP1__Norovirus_and/or_Norovirus-like__AB186063
augaaaauggccucgaacgacguaaacccauccgacgguucagccgccaaccucguccccgaagucaauaacgaagucauggcccucgaacccgucgucggcgcugccauagcagcuccugucgccggacaacaaaacauaauagacccauggauccgcaacaacuucguccaagccccaggcggcgaauuuacagucaguccccgaaacgcccccggcgaaauacucuggucagcuccucucggccccgaccuaaacccauaccucucucaucuuucccguauguacaacggcuacgccggcggcuucgaaguccaaguuauccucgccggcaacgccuucacagccggcaaaguaauauucgcagcaguaccacccaacuuccccacagaaggccucucucccucacaagucacaauguucccccacauaaucgucgauguccgacagcucgaacccguccuaaucccccuccccgacguacgaaacaacuucuaccacuacaaccaagcccacgacucaacccuaaaacuuauagccaugcuuuacacaccccuaagagccaacaacgccggcgacgacgucuucaccgucuccugccgcguccucacccgccccucaccagacuucgacuucaucuuccuuguaccacccaccguagaaucccgcaccaaacccuucacuguucccguacucaccgucgaagaaaugacaaacucgcgcuuccccaucccccuagaaaaacuuuacacaggaccuuccucggccuucgugguccaaccccaaaauggacgaugcaccacugacggcguccuucucggcacaacccagcucuccgcagucaacaucugcaccuuccgcggcgacguuacucacaucgccggaucccgaaauuacacaaugaaccuagccagccaaaacuggaacaacuacgaccccaccgaagaaauccccgcaccacuaggaacgcccgacuucgucggcaaaauccaaggccuccucacccaaaccacacgcgccgacggcucaacccgugcccacaaagccaccgucuccaccggcucuguccacuucaccccuaaacuaggcucuguccaauucucaaccgacaccgacaaugacuuccaaccaggucaaaacaccaaauucacccccgucggagucauccaggacggcgaccgacaccagaaugaaccacaacaauggguacucccagacuacucaggaagaacaggacacaacgugcaccuagccccagccgucgcccccaccuucccaggcgaacaacuccuauucuuccgaagcacuaugcccgguugcuccggcuaccccaacaugaaccucgacugucuauuaccccaagaauggguucuacacuucuaucaagaaagugcccccgcccaguccgacgucgcccuccuccgcuucguuaacccagacaccaaucgcguccucuucgaaugcaaacuacacaaaucuggcuacaucacagucgcacacacaggccaacacgaccucauccucccacccaacggcuauuuccgauucgacucuugggucaaccaauucuacacccuagcccccaugggcaacggagccggccgacgccgcuaa

SEQ ID NO: 39261 - RNA, 1614 nt, Artificial Sequence
  derived and/or modified sequence opt11 from VP1__Norovirus_and/or_Norovirus-like__AF406793
augaaaauggccuccucggacgcaaaccccuccgauggauccacagccaaccucguccccgaagucaacaacgaagucauggcacucgaacccgucgucggcgccgcuauagccggaccugucgcaggucaacaaaacguaauagacccauggauccgcaauaacuucguccaggccccuggcggcgaguucaccguaagccccaccaaugcuccaggagaaaucuuauggucagcaccccucggucccgaccucaaccccuaccuaucccaccucgccaggauguacaauggauacgcaggcggauucgaaguccaagucauucuagcaggcaacgcuuucacagccggcaaaaucaucuucgcagccguaccacccaacuuuccaaccgaaggucuaucucccucccaagucaccauguucccccacauuaucguugacguccgccagcuagaaccaguucucaucccccuccccgacgcacgcaauaauuucuaccacuacaaccaauccaaugacuccacaauaaaacugaucgccaugcucuauacgcccuugagagcuaacaacgccggcgacgacgucuucaccgucuccugccgcguucugacgcgccccuccccugacuucgacuucaucuuccucgucccacccaccgucgaaucucgcacaaaaccuuucacgguccccauccuaaccguagaagaaaugucaaacucuagauuccccaucccucucgaaaaacucuacaccggacccuccucgguauucguaguccaaccccaaaacggccgcugcacaaccgacggcguccuacucggaaccacucaacucuccgccgucaacaucugcacauuccgaggugacgucacccacauugccggcucacacgacuacacaaugaaccucgccagccaaaacuggaacaacuacgacccaaccgaagaaaucccugcaccccuuggcacccccgauuuugucggcaagauccaaggcaugcuaacccaaaccacccgugaagaugguagcacccgcgccacaaaagccacaguauccacaggcuccguccacuucacccccaaacuaggcucaguacaauauaccgccgauaccaacaacgacuuccaaaccggacaaaacaccaaauuuacgccagucggcguaauacaagacggcuccaaccaccaaaacgaaccccaacaaugggugcuaacaaacuacuccggcagaaccggccacaacguccaucucgcaccagcaguagcccccaccuucccaggcgaacaacuccucuucuuccgauccaccaugcccggcuguuccggauaccccaacaugaaccuggacugcuuacuuccacaagaauggguccaacacuucuaucaagaagcagcccccgcccagucagacguagcccuccugcgcuuugucaaccccgacaccggcagaguccucuucgaaugcaaacuacacaaaucaggcuacgucacagucgcccacaccggaccacacgaccucgucaucccacccaacggcuacuuccgcuucgaccccuggguuaaccaauucuacacccuagcccccaugggcaacggagccggccgacgacgauag

SEQ ID NO: 39262 - RNA, 1614 nt, Artificial Sequence
  derived and/or modified sequence opt11 from VP1__Norovirus_and/or_Norovirus-like__KX514223
augaaaauggccucauccgaugccaaccccuccgacggauccacagcaaaccucguccccgaagucaacaacgaaguaauggcccucgaacccgucgucggcgccgcuaucgccgcaccaguagccggccaacaaaacgucaucgaccccuggauccgaaacaacuucguccaagcccccggcggugaguucaccguaucaccccgcaacgccccaggcgaaauccucugguccgcaccccucggucccgaccucaacccauaccucucccaccucgcccgcauguacaacggcuacgccggcgguuucgaaguacaagucauacuugccggaaacgccuucacagcuggcaaaaucaucuucgcagcagucccacccacauucccaaccgaaggccuaagccccucccaaguaacaauguucccucacaucaucguggauguccgccaacuugaaccaguacuaaucccccucccggacguccguaacaacuuuuaccacuacaaccagucaaacgauagcacuauaaaacucaucgcuaugcucuacacaccccuccgagcaaacaaccccggcgacgacgucuucaccgucucuugccgaguccucacccgacccucaccagacuucgacuucaucuuccucguaccacccaccgucgaaucacguacgaaacccuucucuguccccauccucaccgucggcgaaaugaccaacucccgauuccccaucaaucucgaaagacucuucaccggccccagcuccgccaacgucguacaaccucaaaacggcagaugcaccauagacggcgagcuucucggaaccacccaauuauccucaguaaauaucugcacauuccgaggcgacgucacgcacauaggcucuacccaucacuggaccaugaaccuugccucuccaaacuggaacaauuacgacccaacugaagaaaccccggcgccccuaggaacccccgacuucgucggcaaaauccacggcaugcuuacucaaacaacccaaggcucaggcucaacacgugcacaccgcgccaccguguacgucggauccgcagacuucacacccaaacuaggaaaaguccaauuugaaacagaaaccgaccacgaccuagcaaucagacaaaacacaaaauuuacccccgucggagucauacaagaaucagaccaccaccgcgacgagccccaacaauggcgccucccuaacuauucaggagccaacaccuucaacguccaccucgccccggcugucgcuccaaacuuccccgacgaacagcuccuauucuuucgcuccacacuacccggcugcgguggccaccccaacauggaucuagacugccuacuuccccaagaauggguacaacauuucuaccaagaagccgcccccgcucaauccgacgucgcccuacuccgcuucgucaaccccgacaccucucgaguccucuucgaaugcaaacuccacaaauccggcuaugucacagucgcccacacaggacaacacgaccucgucaucccucccaacggauacuuccgcuucgacuccugggucaaucaguucuacacacuagcccccaugggcaacggcaccggcagaaagcgcuga

SEQ ID NO: 39263 - RNA, 1614 nt, Artificial Sequence
  derived and/or modified sequence opt11 from VP1__Norovirus_and/or_Norovirus-like__KX514318
augaaaauggccuccaacgacgcaaaccccuccgacggauccgcagccaaccuaguccccgaggucaacaaugaaguuauggcccucgaaccuguagucggugccgccaucgccgcaccagucgcaggccaacaaaacgucaucgaccccuggauccgaaacaacuucguucaagcccccggcggcgaguucacgguaucaccccgcaacgcacccggagaaauccucugguccgcaccccucggcccagaccuuaacccauauuuaucccaccuagcccgcauguacaacggauacgccggcggcuucgaaguccaaguaauccuugccggcaacgccuuuaccgccggaaaaaucauauuugccgccgucccgcccaccuucccaaccgaaggucucucucccucccaagucaccauguucccccacaucauagucgauguccgccaacuagaacccguccuaaucccucuacccgacguucguaacaacuucuaccacuacaaccaaucaaaugacucuaccaucaaacuuauugccaugcuauauaccccacuacgcgcaaauaacccaggcgacgacgucuucacaguaucaugccgaguccugacccgacccucucccgacuucgacuucaucuuucuugucccuccaaccgucgaaucccgaaccaaaccauucuccguccccauccucaccgucggagaaaugaccaacucccgauuccccgucaaccuagaacgucuauucaccgguccgagcagcgccaacguaguccaaccacaaaacggccgcugcaugaucgacggcguacuacucggaaccacccaacuaucacccgugaacaucugcacauuccgcggagacguaacccaccccggaggauccaaaaucuauaccaugaaccucgccucccccaacuggaauaacuacgaucccaccgaagaaaucccagcaccccuuggcaccccagacuucgucgggaaaauucacggcaugcucacacaaacaacccaagaaaacggaucuacacgcgcccaccgcgcaaccguauacguaggcggcgcaaacuucacccccaaacucggcaaaguccaauucgaaacagacaccgaagacgaccucgccauacgccaaaacaccaaauucacccccgucggcgucauucaauccagcgaccaccaccgcgacgaaccgcaacaauggcgacuccccaauuacucagguagagacacccccaacguacaccucgcacccacuguagcccccaacuuuccaggcgaacaacuccuauucuuccgcuccacccuacccggaugcggcggccaccccaacauggaccuagauugccuccucccccaagaauggguccagcacuucuaccaagaagccgcucccgcucaauccgacguaacacuacuccgauucgucaaccccgacaccucccgcguccucuucgaaugcaaacuccauaagucaggauacgucacagucgcccacacaggucaacacgaccuaguaaucccucccaauggcuacuuccgauucgacuccugggucaaccaauucuacacccuugcucccaugggcaacggcacaggccgcaaacgauga

SEQ ID NO: 39264 - RNA, 1614 nt, Artificial Sequence
  derived and/or modified sequence opt11 from VP1__Norovirus_and/or_Norovirus-like__AB186065
augaaaauggccuccaacgaugucaaucccuccgacggcucugcugccaacuuaguccccgaaguaaacaacgaagucauggcacucgaacccguagucggcgcggcaauagccgcacccgucgccggccaacaaaacaucauagacccauggauacgcaacaacuucguccaagccccaggcggcgaguucacagucucaccccgcaacgcccccggcgaaauccucuggagcgcgccccucggccccgaccugaaccccuaccugucccaccucucccgcauguacaacggcuacgccgguggauucgaaguccaagucauccucgcaggaaacgcauucaccgcaggcaaaguaauauuugccgccgucccacccaacuuccccacagaaggccucucccccucacaaguuaccauguucccucacaucaucgucgacguacgccaacuagaaccaguccuaauaccccugccagacgucagaaauaacuucuaccacuacaaccaagcacacgacuccacacucaaacucaucgccauguuauacacaccacucagagcuaauaacgcaggagacgacgucuucaccgucuccugccgcguccucacuagacccucccccgacuucgauuucaucuuccuagucccacccacugucgaaucccgcaccaaauccuucaccguccccguccucaccgucgaagaaaugacaaacagccgcuuccccauaccacucgaaaaacucuacaccggcccaaguucagccuucgucguacaaccccaaaacggccgaugcaccacagacggaguccuccucggcacaacucaacuuuccgccguaaacauaugcaccuuccgcggagacgucacucacaucgcaggcucccgcaacuacaccaugaaccucgccucccaaaacuggaacaacuaugacccaaccgaagaaaucccagcaccucuaggcauucccgacuucguaggcaaaauccaaggccuucucacccaaacaaccagagccgacggcuccacccgcgcgcauaaggcuaccguaagcaccggaucaguucacuucacacccaaacuaggcuccguacaauucuccaccgacaccgauaacgacuuccaaccaggccaaaacacaaaauuuacccccgucggcguaauccaagacggcgaccgccaccaaaacgaaccacaacaguggguccucccagacuacucuggacgcacaggccacaacguccaccucgccccugcaguagcccccacauuccccggagaacaacucuuauucuuccgcuccacgaugccagggugcuccggcuacccaaacaugaaucuagacugccuccucccacaagaauggguccuccacuucuaccaagaaagcgccccggcccaauccgacguagcacuccuccguuucgucaaucccgacaccaaccgcguccuuuucgagugcaaacuccacaaauccggcuacaucaccguagcccacacuggccaacacgaccucauacucccacccaauggauacuuccgcuucgauuccuggguuaaccaauuuuacacccuagcccccaugggcaacggcgcuggccgccgccgcuaa

SEQ ID NO: 39265 - RNA, 1614 nt, Artificial Sequence
  derived and/or modified sequence opt11 from VP1__Norovirus_and/or_Norovirus-like__KX514307
augaagauggccaguuccgacgccaaccccuccgacggcucaaccgcaaaucucguacccgaaguuaacaacgaaguaauggcgcucgaacccgucgucggcgcagccaucgccgccccuguagucggccaacaaaacgucaucgaccccuggauacgcaauaacuucguccaagcuccuggaggagaguucaccgucucgccccgaaaugcccccggugaaauacuauggucugcuccccucggcccagaccuaaaccccuaucucucccaccucgcccgaauguauaacggauacgccggaggcuucgaaguccaggucauccucgccggaaacgcauucaccgccggcaaaaucauauucgccgccguuccacccacauuccccaccgaaggccucucccccucccaagugaccauguucccccacaucauagucgacguccgccaacucgaaccagucuugaucccccuucccgacguacgcaacaacuucuaccacuacaaccaauccaacgacucaacaauaaaacuuaucgccaugcucuacacaccgcuucgcgccaacaaccccggcgacgacgucuucaccgucucaugccgcguacuaacccgcccauccccagacuuugacuucauuuuccuaguacccccaaccgucgaaucccgcaccaaacccuucucagucccaauccuaaccgucggcgaaaugaccaacucucgcuuccccaucaaccucgaacgccuauucaccggaccaucaucggcaaacgucguccaaccacaaaacggccgcugcaugaucgacggcguccuucuaggcaccacacaacucuccccagucaacauaugcacuuuccgaggcgacgucacacaccccggagguuccaaaaucuauaccaugaaccucgccuccccuaacuggaacaacuacgaccccaccgaagaaaccccagcaccccuaggcacaccugacuucguuggcaaaauacacggcaugcucacccaaacuacccaagaaaacggcuccacacgcgcccaccgcgccaccguauacgucggcggagcgaacuucacccccaaauuaggcaaaguccgcuucgaaaccgacacuggcgacgaccucgcuauucgccaaaauacgaaauucacccccguaggagucauccaguccuccgaucaccaccgugacgaaccacaacaguggcgccuaccaaacuacucaggcgccaacaccuucaacguccaccucgcucccgccguagcacccaacuuccccggagaacaacuacuuuucuuccgcucuacacuacccggcugcggcggccaccccaacauggaccuagacugccuccuuccacaagaguggguacaacacuucuaccaagaagcugcaccagcccaaagcgacguagcacuccuucgcuucgugaaucccgacacaucccgcguacuauucgaaugcaaacugcacaaauccggcuaugucaccguagcccacaccggacaauacgaccuagugcuccccuccaacggcuacuuccgcuucgacucuuggguuaaccaauucuacacacucgcacccaugggcaacggcacaggccgacgacgcuaa

SEQ ID NO: 39266 - RNA, 1614 nt, Artificial Sequence
  derived and/or modified sequence opt11 from VP1__Norovirus_and/or_Norovirus-like__LC048948
augaaaauggcgucauccgacgcaaacccaucagacggcucugccgccaaccuaguccccgaagugaacaacgaagucauggcacucgaacccguuguaggcgccgccauugccgcaccugucgccggacaacaaaacaucaucgaccccuggauccgaaacaacuucguacaagccccuggcggagaguucaccgucuccccacgcaacgccccaggcgaaauccucuggucagcuccccuuggcccagaucuuaacccauaccugucucaccuaucccgcauguacaauggauacgccggcggcuucgaaguccaagucauccucgccggcaacgccuucaccgcaggcaaaguaaucuuugcugcugucccacccaacuuccccacagaaggccuuucccccucucaaguuaccauguucccccauaucaucguagacguccgccaacuagaaccaguccuuaucccucuccccgacguccggaacaacuucuaccacuacaaccaaagccacgacucaacacucaaacucauagccguccuauacacaccccuacggacaaacaacgccggcgacgacguauuuaccgucuccugccgaguucuaacccgucccucuccugacuucgacuucaucuuccucguaccacccaccgucgaaagccgcaccaaacccuucacagucccaauccucaccgucgaagaaaugucaaacuccagauuccccaucccccucgaaaaacucuacaccggucccuccuccgccuuugucguccaaccccaaaacggccgcugcaccaccgacggcgucuuacuaggaaccacccaacucucugccguaaauauaugcaacuuccgaggcgacgucacucacaucgucggcucccacgaaacaaccaugaaccuagccucacaaaacugguccaacuacgaccccacacagaaaauacccgcaccccuaggcacaccccacuucguaggcaaaauucaaggccuccuuacacaaaccacccgagcccacggauccacccgcgcccacaaagccaccguaucaacaggcuccguacacuucacaccuaaacucggcucuguacaauucacaacagauacuaacaacgacuuccaaacaggccaaaacacaaaauucaccccagucggagucauucaagacggcgaccaccaccaaaaugaaccccaacaauggguucuacccaacuacuccggccgcaccggccacaacguccaccucgccccggccgucgcacccaccuucccaggcgaacaacuacuauucuuccgauccaccaugcccggcugcuccggcuaucccaacaugaaucuagacugccuacucccccacgaauggguccuccacuucuaccaagaagcggcacccgcccaaucugacgucgcacuucuccgcuucguuaaccccgacacuggccguguccuauucgaauguaaacuccacaaauccggcuacaucaccguugcccacaccggccccuucgaccucgggauaccacccaacggcuacuuccgcuucgacucaugggucaaccaauucuacacacucgcacccauggguaacggaacaggcagacgcagauaa

SEQ ID NO: 39267 - RNA, 1614 nt, Artificial Sequence
  derived and/or modified sequence opt11 from VP1__Norovirus_and/or_Norovirus-like__LC048908
augaaaauggccagcuccgacgcaaaucccucagacggauccgcagcaaaccucguccccgaagucaacaacgaagucauggcacuagaacccgucgucggcgcagcaaucgccgcuccggucgccggccaacaaaacauaaucgacccuuggauccgcaacaacuucguacaagccccaggaggcgaauuuaccguaucaccccgcaacgccccuggcgaaauacuuugguccgcaccccucggucccgaccuaaaccccuaccuaucucaccuuucuagaauguacaacggauacgccggaggauucgaaguccaagucauacuugccggcaacgccuucacagcaggcaaagucaucuucgccgccgucccacccaacuuccccaccgaaggccuaucucccucccagguaacaauguucccccacaucaucguagacguccgacaacucgaacccguccucaucccccuacccgauguucguaacaacuucuaccacuacaaccaaucacacgacucaacccugaaacucaucgccaugcucuacacuccccucagagccaacaacgcuggcgacgacguauucaccgucucuugccgcgucuuaacccgccccucaccagacuucgacuucaucuuccuagucccacccaccguugaaucacgaaccaaacccuucacaguacccauacucacagucgaagaaaugucaaauucccgcuuccccauaccccucgaaaaacuauacaccggccccuccucagccuucgucguccaaccccaaaacggacgcuguacaaccgacgguguacuccucggaaccacccaacucucagccgucaacaucuguaacuuucggggcgacgucacacacaucguaggcucucacgacuacaccaugaaccuagccucccagaauugguccaacuacgauccaaccgaagaaauaccagccccucucggcaccccggacuucgucggcaaaauacaaggccuccucacccagaccacccgggcacacggcagcacacgagcccacaaagccaccgucuccacagguagcguucacuucacccccaaacuaggcuccguccaauucacaaccgacaccaacaacgauuuccaaacaggccaaaacaccaaauucacccccgucggagucauccaagacggugaccaccaccaaaacgaaccacaacaauggguccuccccaauuacucuggaagaaccggacacaacguccaccucgcccccgccgucgccccuaccuuccccggcgaacaacuacucuucuuccgcucuacuaugccuggcugcagcggcuaccccaauaugaaccucgacugccuccucccacaggaauggguccuacacuucuaccaagaaacagcccccgcccaacccgacguagcccuucuccgcuucgucaaccccgacaccucccgcguccucugcgagugcaaauuacccaaauccgguuacaucacagucgcacacacaggacccuaugaucuagucaucccucccaacggauacuuccguuucgacuccugggucaaccaauucuacacccucgcacccaugggcaacggcacaggccgacgccgcuag

SEQ ID NO: 39268 - RNA, 1614 nt, Artificial Sequence
  derived and/or modified sequence opt11 from VP1__Norovirus_and/or_Norovirus-like__KX514312
augaaaauggccagcuccgacgccaaccccucagacggcagcgccgccaaccucguacccgaagucaacaacgaggucauggcacucgagccagucguaggcgccgcaaucgccgcacccguugcuggccaacaaaacguaaucgaccccuggauccgaaacaacuucguacaagcccccggaggcgaauuuaccgucucgccacgaaacgcacccggagaaauccucugguccgccccacucgguccagaccucaaucccuaccuaucucaccucgcccgcauguacaacggauacgccggcggcuucgaaguccaaguaauccucgcuggaaaugccuuuaccgccggaaaaauaauauucgccgcaguaccacccaccuuccccaccgaaggccuaucccccagccaagugaccauguucccccauaucauaguagacguucgccaacuagaaccgguccuuaucccucuccccgacguaaggaacaacuuuuaccacuacaaccaauccaacgacagcaccaucaaacucaucgccaugcucuacacccccuugcgagcuaauaaccccggcgacgacgucuucacagucuccugccgcguucucacacgaccaucccccgacuucgacuucaucuuccuaguacccccaaccgucgaaucccgcuccaagcccuuuuccguacccguucuaacagucgaagaaaugaccaacucaagauuucccgccacucuagacaaacuauucacaggccccucaucaacauucguaguccagccacaaaacggccgcugcaugauagacggcguacuccuaggcacaacucaacuaucuccagucaacauaugcacauuccgcggcgaugucacccaccccggcggcuccaaaaucuacacuaugaaccucgcuucccccaacuggaacaacuacgaccccaccgaagaaauccccgcaccccuuggcaccccagacuucgucggaaaaauccacggcaugcuaacccaaaccacacaagaaaacggauccacacgcgcccaccgugccacaguauacgucggcggcgcgaacuucacccccaaacuaggcaaaguccaauucgagaccgacaccggagacgaccuagcaauaaggcaaaacaccaaauuuacccccguaggcguaauccaauccuccgaccaccaccgcgacgaaccccaacaguggcgccucccgaacuacuccggccgcgacaccccgaacguccacuuagccccugccgucgcacccacauuccccggugaacaacuccucuucuuccgauccaccauacccggaugcgguggccaccccaacaugaaccucgacugccuacucccccaggaguggguccaacacuucuaccaagaagcagcccccgcccagucagacguagcauuacuccgcuucguuaacccugacaccucacgcguccuauucgaaugcaaacuccauaaauccggcuaugucaccgucgcccacaccggccaacaugaccucguuaucccucccaacggcuacuuccgcuucgacucuugggucaaccaauucuacacacuagcccccaugggcaacggaaccggacgcaaacgauaa

SEQ ID NO: 39269 - RNA, 1614 nt, Artificial Sequence
  derived and/or modified sequence opt11 from VP1__Norovirus_and/or_Norovirus-like__KX514237
augaaaauggccuccaacgacgcaaaccccuccgacggaucagcggccaaccucguacccgaaguuaacaaugaagucauggcucuugaacccgucgucggcgccgccaucgcagcucccgucgccggccagcaaaacguaauagaccccuggauaagaaacaacuucguccaagccccaggcggagaguucaccguaucgccccgaaacgcucccggcgaaauucuuuggagcgcaccccucggaccagaccuaaacccauaccucucacaccucgcccgcauguacaauggcuacgcuggcgguuucgaaguccaaguaauccucguaggcaaugccuucacagccgguaaaaucaucuucgccgcuguacccccaaacuuccccaccgaaggacuuucuccaagccaggucacaauguucccccacaucaucgucgacguccgccaacuagaacccguacucauaccccuaccagacguccgaaacaacuucuaccacuacaaccaaucuaacgacuccaccaucaaacucauugccaugcuauacacuccacuccgagcuaacaacgccggcgacgacguuuucaccgucagcugccgcgucuuaacccgaccaagcccagacuucgacuucaucuuccucguaccucccaccgucgaaucacgaucaaaaccauucuccguccccguccucaccguugaagaaaugaccaacagucgcuuccccgccacccuugacaaacucuucacagguccuuccagcacauuugucguccaaccacaaaauggccgaugcaugauagacggcguacuccucggaaccacucaacucucaccugucaacauauguacguucaggggcgacguaacccaccccagagacucaccaaucuacaccaugaaccucgcuucccccaacuggaacaacuacgaccccaccgaagaaauccccgcgccccuaggcacaccugacuucguuggaaaaauccaaggcaugcucacccagaccacccaaggcuccggauccacacgcgcacaccgcgccaccguguacgucggcuccgccgacuucacuccaaaacuagguaaaguccaauucgagaccgaaacagaccacgaccuagcaauacgccaaaacaccaaguucacccccgucggcguaauccaagaguccgaccaccaccgcgacgaaccacaacaguggcgccuccccaacuacucaggugcaaauaccuucaacguucaccucgcccccgccgucgcccccaacuuccccggagaacaacuccucuucuuccgauccacccuccuaggcugcggcggucaccccaacauggaccucgacugccucuuaccccaagaauggguccaacacuucuaccaagaagcagcacccgcacaauccgacgucgcccuacuacgcuucgucaaccccgacaccucccgaguacucuucgagugcaaacuccacaaauccggcuaugucacugucgcccauaccggccaauacgaccucguccucccauccaacggcuauuuccgauucgacucauggguaaaccaauucuacacccucgcccccaugggcaacggaaccggccgacgccgcuaa

SEQ ID NO: 39270 - RNA, 1614 nt, Artificial Sequence
  derived and/or modified sequence opt11 from VP1__Norovirus_and/or_Norovirus-like__DQ419907
augaaaauggccuccaacgacgccucaccauccgacggauccacagccaaccucgucccggaagucaacaaugaagucauggcacuagaaccagucgucggugcagcgauugcggcacccguagccggccaacaaaacgucauagaccccuggauucgcaacaguucaguccaggcccccggaggugaguucaccguaucuccccgcgacgccccaggcgaaauccucugguccgccccgcucggcccggaccuaaauccauaccuuucucaccucgcccgcauguacaauggauacgcaggcggcuuugaaguccaagucauccuugccggaaacgcguucacagcugguaaaauaaucuucgcugccgccccacccaacuuccccacagaaggacuaucccccucccaagucaccauguucccccacaucauagucggcguccgacaacuagaacccguccucauaccccuuccagacgucagaaacaacuucuaccacuacaaucaaucuaacgacucgaccaucaaacuaaucgcuaugcuauacacaccccuccgagcaaacaacgccggugacgacgucuucaccgucuccugcaggguccucacccgacccucccccgacuucgacuucaucuuccucgucccacccaccgucgaaucccgcacaaaacccuucaccguccccauccuaaccgucgaagaaaugacaaacucccgauucccaauaccacuagaaaacugcucccgagucccugccgucccccucuccucaaaucauaaaaugcaaugcacaacagacggcguauuacucggcaccacacaacuaucccccgucaacauaugcaccuuccgcggcgacguaacacacauccccggcacccgaaccuaccgcaugaaccuggccucacaaaacuggaacaacuaugacccaaccgaagaaaucccagccccucucggcacaccagacuucgucggcaaaauccaaggaaugcucacccaaaccaccaaaggggacggcuccacgcgcggccacaaagccaccgucagcacuggaucugucgacuucaccccaaaacucggcucaguccaauucgccaccgacacagacaaugacuucgaaaccggccaaaacacccgcuucaccccagucggagucauccaagacggauccuccacccaccgaaacgaaccccaacaaugggucuuaccugacuacucaggccgcaccguccacaacguccaccucgcccccgccgucgcccccaccuucccuggcgaacaacuacucuucuuccgauccacaaugcccggcugcagcggcuaccccaacauggaucuagacugccuacucccccaagaauggguccaacacuucuaccaagaagcagcaccaucccaauccgacgucgcccuccuccgcuucguaaaccccgacacaggacgaguccuauucgaaugcaaacuccacaaagcaggcuacgucacagucgcucacacgggccaacacgacuuagucauaccaccaaacggcuacuuccgcuuugacagcugggucaaucaguucuacacccuagcacccaugggaaacggcgcaggaagacgacgcuaa

SEQ ID NO: 39271 - RNA, 1614 nt, Artificial Sequence
  derived and/or modified sequence opt11 from VP1__Norovirus_and/or_Norovirus-like__JN975543
augcgcauguccgacggagcagcccccaaagccaacggcucagaagcaagcggacaagaccucgucccaaccgcaguagaacaagccguacccauacaaccugucgccggcgcugcacuugcugcaccugccgccggccaaauaaaccaaaucgaccccuggaucuuccagaacuucguccaaugcccacucggagaauucuccauauccccccgcaacacacccggagaaauucucuucgaccuagcacucggaccaggccuaaaccccuaccucgcccaccucuccgccauguauaccggcugggucggaaauauggaaguucagcuuguccucgccggaaacgccuucacugccggcaaagucgucguagcacucguccccccguacuuccccaaaggcagccuaaccacagcccaaaucaccugcuucccgcacguuaugugcgacguccgcacccucgaacccauccaacuaccccuccuagauguacguagaguccuauggcacgccacucaagaccaagaagaauccaugcgccuugucugcaugcucuacaccccccuacgcaccaacuccccaggcgacgaaucauucguagucagcggcagacuguuguccaaacccgcagccgauuucaacuuuguauaccucaccccacccauagaacgcaccauauaccgaauggucgaccuaccaguccuacaaccacgacucugcacucacgcaagauggccagcacccgucuacggccugcuggucgaccccucccugccauccaauccccaauggcaaaauggccgaguccacgucgacggcacacuacugggcaccacacccgucuccggcuccuggguauccuguuucgcagcagaagccgccuacgaauuccaaucuggcacaggagaaguagccaccuucacucucauagaacaagacggcaccgccuacgugcccggcgaccgggccgccccccucggcuaucccgacuucagcggccaacuagaaaucgaaguacaaaccgaaaccaccaaagcaggcgacaaacuaaaaguuacaaccuucgaaaugauacucggccccacuaccaacguagaccaagcaccauaccaaggccgcguuuacgcaagcaucacagccauggccucccucgaccucgucgacggacgcguccgcgcaguuccacguucaauuuacuccuuccaagaugucauccccgaauacaacgacggccuacucguuccccucgccccacccauaggccccuuccucccaggagaaguacuccuacgcuuccgaacuuacaugcgccaacucgacacugcugacgcagcugcggaagccauagacugcgcccuaccccaagaauucauauccugguucgccucaaaugcauucaccguacaauccgaagcacuacucuuacgcuaucgaaauacacuuaccggccagcuacucuucgaaugcaagcucuacuccgaaggcuacaucgcccucuccuacuccggcucaggcgcacuaaccuuccccaccgacggcuucuucgaagucguauccugggucccccgccucuaccaacucgccuccguaggcucccuagcgacaggccgcuaa

SEQ ID NO: 39272 - RNA, 1614 nt, Artificial Sequence
  derived and/or modified sequence opt11 from VP1__Norovirus_and/or_Norovirus-like__JN975541
augcgaaugucugacggugcugcacccaaagccaacggcuccgaggccucaggccaagaccucguacccacagccgucgaacaagccguccccauacaacccguugcaggcgcagcccuagccgcaccagccgcaggacaaauaaaccaaaucgaccccuggauauuccaaaacuucguacaaugcccacucggcgaguucuccauaucaccacgcaacacuccgggagaaauccucuucgaccuugcacucggccccggccuaaaccccuaucucgcacacuuaucagccauguacacuggaugggucggaaauauggaaguccaacucguccucgccggcaacgcuuucaccgccggcaaagucgucgucgcacucgucccgccauacuuccccaaaggcucacuaacgacagcucaaauaaccugcuucccccacgucaugugcgacguccggacucuagaaccaauccaacuuccccuccucgacguacgccgcguacucuggcacgccacccaagaccaagaagaaucaaugcgccuugucuguaugcuuuacaccccacuccgcacgaacagcccaggcgacgaauccuucgucguaucaggccgccuucuaucaaaaccggcagcagacuucaacuuuguauaccuaacaccacccauagaacgcaccaucuaucgaauggucgaccuacccguccuccaaccccgccucugcacacacgcccgcuggccugcccccgucuacggccuccuaguugacccaucccuccccucaaacccacaauggcaaaacggacgcguccacguagacggaacccuacucggaaccacccccguauccggcucaugggucuccugcuucgccgccgaagccgccuacgaguuccagucaggcaccggcgaagucgcaacauucacccucauagaacaagacggaaccgccuauguaccaggagaccgcgccgcaccccuaggauacccugacuucuccggccaacucgaaaucgaaguccaaaccgaaacaaccaaaacuggugacaaacuaaaaguaacaaccuucgaaaugauacucggccccaccacaaacgucgaccaagcccccuaccaaggccgaguauaugccuccaucaccgccgccgcauccuuagaccucgucgacggcagaguacgcgcagucccccgcucuaucuacucauuccaggacgccauccccgaguacaaugacggccucuuagucccgcuagcacccccaauaggaccauuccuccccggcgaaguccuacuccgcuuccgcaccuacaugcgucaacucgacaccgccgacgccgccgcggaggcuaucgacugcgcacucccacaagaguucaucagcugguucgcaagcaacgcauucacaguccaauccgaagcacuccuccuccgcuaccgcaauacccucaccggucaauuacucuuugaaugcaaacucuauucagaaggguacauugcacuaucuuacucgggauccggcgcccuuaccuuuccuacagauggauucuucgaaguggucucuugggucccacgccucuaccaacucgccuccgucggcucacucgcaacuggacgauaa

SEQ ID NO: 39273 - RNA, 1614 nt, Artificial Sequence
  derived and/or modified sequence opt11 from VP1__Norovirus_and/or_Norovirus-like__KF113526
augcgcauguccgacggcgccgccccaaaagccaacggaagugaggcaucaggccaagaucucgucccuacugccguagaacaagccguccccauccaacccgucgccggagccucccucgccgcacccgcggccggccaaaucaaccaaaucgaccccuggaucuuccaaaauuuuguccaaugcccccucggcgaguucagcaucagcccacgcaacacccccggagaaauucuuuucgaccucgcccuaggcccaggccucaaccccuaccuugcacaccucuccgccauguacaccggaugggucggaaacauggaagugcaacucguacucgccggaaacgccuuuacagcugguaaagucgucguagcccuaguuccacccuacuuccccaaaggcucacucacugccgcccagauuaccugcuucccccaugucaugugcgacguccgcacccuugagccaauccaacuuccccuacuagacguccgacgcguucucuggcacgccacccaagaccaagaagaaucuaugcgccuugucugcaugcucuacacgccccuaagaacaaacucccccggagacgaaucauucguugucucaggucgccuacuauccaaacccgcugccgacuucaacuuuguauaccuuaccccucccaucgaacgaaccauuuaccgcauggucgaccuacccguucuccaacccagacuaugcacacacgcccgcuggcccgccccagucuacggccuacucgucgauccaucacucccauccaauccccaauggcaaaacggaagaguacaugucgacggcacacuucucggcaccacacccguaucgggaagcuggguuucaugcuucgccgccgaagccgcuuacgaguuccaauccggaaccggagaaguagccaccuucacccucaucgagcaagacggcucugcauacguuccaggagaccgggccgcaccccuaggcuacccugacuucuccggucaacuagaaauagaaguccagacagaaaccacaaaagccggcgacaaacucaaaguaaccaccuucgaaaugauccucggccccacaaccaacguugaccaagcacccuaccaaggacgcguguacgccucucuaaccgccgccgcaucccucgaccuaguagacggacgcguacgcgccguaccccgcuccauauacggauuccaagaucaaauccccgaauacaacgauggccuccucgucccacuagccccaccaguaggcccuuuccuccccggcgaacuccuccuacgcuuccgcaccuacaugagacaaaucgacuccgccgacgccgccgcagaagccauugacugcgcacucccacaagaguucauuucuugguucgcuuccaacgccuucaccguucaauccgaagcccuccuccuacgcuaccgaaacacccucaccggccaacuacuuuucgaauguaaacucuacucugaaggcuacaucgcccucucauacuccgguuccggcccccucaccuuccccaccgacggcuuuuucgaaguaguuucauggguaccucgccucuaccaacucgccuccgucggcucacucgccacaggccgcuaa

SEQ ID NO: 39274 - RNA, 1614 nt, Artificial Sequence
  derived and/or modified sequence opt11 from VP1__Norovirus_and/or_Norovirus-like__KF113527
augcguaugucggauggcgcagcccccaaagccaacggcuccgaagccucaggacaagaccucguacccaccgccgucgaacaagccguccccauccaacccguagccggggcuucccuugcagcccccgccgccggccaaaucaaccaaaucgacccauggaucuuccagaacuucguacaauguccccucggcgaauuuuccaucuccccacgaaacgcacccggcgaaauccuauucgaccucgcacucggccccggucucaaucccuaucucgcccaccuuucugccauguacaccggcugggucgguaacauggaaguccagcuaguccucgccggcaacgccuucacagccagcaaaguagucguggcccucgucccacccuacuucccaaaaggcucacucacaaccgcccaaauuaccugcuucccccaugucaugugcgaugucagaacccucgaaccuauccaacuaccccuacucgacguccgccgcguccuauggcaugccacccaagaccaagaagaaucaaugcgccuugucugcaugcucuacacuccccuccgcaccaacucucccggagacgaauccuucgucgucagcggccgcuuacuauccaaacccgccgcagacuucaacuucgucuaccuaaccccaccuaucgaacgaaccauauaccgaauggucgaccuacccguacuccaaccccgccucugcacccaugcccgauggcccgcaccuguuuacggucuccuggucgacccaucccugccguccaauccccaauggcaaaacggacgcguccacguagacggcacccuccuaggaaccaccccuguuuccgguuccuggguaucuugcuucgccgccgaagcagccuacgaguuccaauccggcacaggcgaaguugccacuuucacacuaaucgaacaagacggcuccgcuuauguaccuggcgaccgcgccgcaccacucggcuaccccgacuucucuggccaacucgaaaucgaaguccaaaccgagaccaccaaggccggcgacaaacugaaagucaccacguucgaaaugauacuaggccccacuaccaacguagaccaagcuccuuaccaaggacgcgucuaugccucccucacagcugcagcaucccucgaccuagucgacggccgcguccgagcuguaccccgcuccauauacgguuuccaggaccaaauccccgaauacaacgacggccuccuagucccccucgccccacccgucggccccuuucuucccggugaacuccuucuccgauuccgaacauacaugcgacaaaucgauucggccgacgccgccgccgaagccauugacugcgcacuaccccaagaguucaucuccugguucgcauccaacgccuucacaguucaaucagaagcccuccuccuccgauaccgaaacacccucacaggccaacuacuauucgaaugcaaacucuacucagaaggcuacauagcucucuccuacuccggcuccggaccccuaacauuucccacagacgguuucuuugaagucgucucauggguaccccgccuuuaccaauuagcuucggucggcucacuagccaccggccgcuaa

SEQ ID NO: 39275 - RNA, 1614 nt, Artificial Sequence
  derived and/or modified sequence opt11 from VP1__Norovirus_and/or_Norovirus-like__KM458057
augcgcaugucagacggagccgcccccaaagcagacggcagcgaagcauccggacaagaccuuguacccaccgccgucgaacaagccguaccaauccaaccaguugcaggagcagcccucgccgcccccgccgcuggacaaauaaaccaaaucgaccccuggaucuuccaaaacuucguccagugcccccucggcgaguucuccaucucaccccgcaacacuccaggcgaaauccuuuucgaucuagcacucggccccggccuaaacccauaccucgcccaccucuccgccauguauaccgguugggucggaaacauggaaguccaguuaguccuugccgggaacgccuucacugccggcaaagucgucgucgcccucgucccuccguacuucccaaagggcucccucacaacagcucaaauuaccugcuucccccacgucaugugcgacguacgcaccuuagaacccauccaacuuccacuacucgacguccgccgcguccucuggcacgcaacccaagaccaagaagaauccaugcgccucguuugcaugcucuauacuccccuacgcacaaacucccccggcgacgaaucuuucgucguaucaggucgacuacuuucaaaacccgcagccgacuucaacuucgucuaccucacacccccuauagaacgcaccaucuaccgcaugguugaccuacccgucauccaaccccgccuuugcacccacgcacgauggccagccccaguauacggccuccucguugaccccucacuccccagcaacccucaauggcagaacggccgaguacacguagacggcacacuccucggaaccacuccaguauccggauccugggucucgugcuuugccgccgaagccgcauacgaguuccaauccggcaccggccaagucgcuaccuucacucuuauagaacaagacggaucagccuacguaccaggcgaccgcgccgcaccccucggcuacccagacuucuccggacaacucgaaaucgaaguccaaaccgaaaccaccaaaacuggagauaaacucaaagugaccaccuucgaaaugauccuaggccccacaaccaacguugaccaagcccccuaccaaggcaaaguauucgccagcauuacagcagccgccucucuagaccuaguagauggccgcguccgcgcuguaccccgcuccaucuacggcuuccaagauguaauccccgaauacaacgacggccuccucgucccccuagccccacccaucggccccuuccuacccggggaaguccuccuccgauuccgcacauacaugagacaacucgauaccgcagaugcagcagcagaagcaauagacugcgcacucccccaagaguucaucucuugguucgcauccaacgucuucaccguccagucagaagcccuacuucuccgauaccgcaacacauuaacaggacaacuacucuucgaaugcaaacucuacuccgaaggauacaucgcccugagcuacuccggcuccggcccccucacauuccccaccgacggcuucuucgaagucguauccugggucccccgccucuaccaacuagccucuguaggcucucucgccacaggccguuaa

SEQ ID NO: 39276 - RNA, 1614 nt, Artificial Sequence
  derived and/or modified sequence opt11 from VP1__Norovirus_and/or_Norovirus-like__AB662855
augaagauggccuccaacgacgcugcucccucaaccgacggcgccgccggccuaguccccgaauccaacaacgaaguaauggcucuugaaccugucgccggcgccgcacuagccgccccaguaacgggccaaacaaacaucaucgaccccuggauacgugcaaacuucguccaagccccuaacggcgaguucacgguaucaccacgaaaugcacccggcgaaguccuccuaagccucgaacuuggccccgaacuaaaccccuaccuagcacaccuugcccgcauguacaacggccacgccggcggcauggaaguccaaguaaugcuagcaggaaacgccuucaccgcaggcaaacucgucuuugccgcugucccaccccauuucccggucgaaaaccucucuccccagcaaaucacuauguucccacacgucauaauagacguccgcacacucgaaccagucuuauuaccauuacccgacguccgcaauaauuucuuccacuacaaccaaaaagacgacccaaaaaugcgcaucgucgcaaugcucuacaccccacuccgcuccaacggcuccggcgacgacguauucaccgucuccugccguguccucacgcgccccucacccgacuucgacuucacauaccucgucccaccuacagucgaauccaaaaccaaacccuucacccucccaauccucacacucggugaacuaucaaacucacgcuucccuguaucuaucgaccaaauguacaccuccccaaacgagguuaucagcgugcaaugccaaaacggacgcugcacacucgacggcgaacuccaaggaacuacccaacuccaaguaagcggcaucugcgcguucaaaggugaagucaccgcacaccuccacgacaacgaccaccuuuacaacguaacaauaaccaaccucaacggcucaccauuugaccccuccgaggauguccccgcuccccuaggcguuccggacuuccaaggccgaguauucggcguaauaucccaacgugacaaacaaaacgccgccggacauaacgaacccgccaaccgcggacacgaugccguaguacccaccuacacagcccaauacacaccuaaacugggacaaguacaaauaggaaccuggcaaaccgacgaccuccaagucaaccaacccguaaaauucacacccguaggacugaacgacacugaacacuucaaccaaugggucgucccacgcuacgccggcgcccuaaaccuuaacaccaaucucgcgcccuccgucgccccagucuucccaggcgaaagacuccucuucuuccgcagcuacaucccacucaagggaggauacggaaaccccgccaucgacugccuucuaccacaagaauggguccaacacuucuaccaagaagcagccccuucaaugagcgaaguugcccuaguacgauacaucaaccccgacaccggacgugcccucuuugaagccaaacuccaccgagccggauucaugacagucuccagcaacacuuccgcccccgucguagugccagcaaacggcuacuuccgauucgacuccuggguaaaccaauucuacagccucgcaccuaugggcacagggaacggauaa

SEQ ID NO: 39277 - RNA, 1614 nt, Artificial Sequence
  derived and/or modified sequence opt11 from VP1__Norovirus_and/or_Norovirus-like__AB809997
augaaaauggccuccaacgacgcagcacccuccaacgacggcgcagccucccuuguccccgaagcaauaaacgagacaaugccccucgagcccguagccggcgcauccaucgcugcacccgucgccggccaaacgaacauaaucgacccauggauccgcacaaacuucguccaagcccccaacggcgaguucaccguaucuccccgcaacucccccggcgaaauacuccuaaaccuagaacucggcccugaccucaaccccuaccucgcccaccuaucccgcauguacaacggcuacgccggcgguguagaaguccagguacuacucgccggcaacgccuucaccgccgguaaaauccuauucgcagccaucccucccaacuucccagucgacaugaucuccccagcccaaaucaccaugcucccacaccucaucguugacguccgcacacucgaacccaucaugaucccgcuucccgacgucaggaacgucuucuaucauuucaauaaccaaccacagccccggaugcgucucgucgcaaugcuuuacacaccccuacgaucuaacgguucaggugacgacguauucacaguauccugccgaguccuaacccgacccacacccgacuuugaguucaucuaccucguucccccauccgucgaaucuaaaaccaaacccuucacccuacccauccuaacaaucuccgaacuuaccaauagccgauuccccauacccauugaacagcucuauaccgcucccaacgaaaacaacgucguccaaugccaaaacggucgcugcacccucgauggcgaacuucaaggaacaacacaacuccuuucguccgccguuugcucuuacagaggccgcacagucgcaaacuccggcgauaacugggaccaaaaccuccuccaacucaccuaccccuccggcgcuucauacgaccccacagaugaaguacccgcaccccucggcacacaagacuucuccggcauccuauacggcguccuuacccaagacaacgaacgagaaggcaccggcgaagccaaaaacgcaaaaggagucuacauaucaacaaccucaggcaaauucacccccaagauaggcucaauaggccuucacuccaucaccgaaaacguacaccccaaccaacaaucucgauucaccccagucggagucgcacaaaacgaaaacacacccuuccaacaauggguccucccacacuacgccggagcacuagcacuuaacaccaaccucgcaccagcagucgcccccaccuuccccggcgaacaacuccuguucuuccgaucaagaguccccugcguccaaggccuccgcggccaagacgcauucauugacugccuccucccacaagaauggguaaaccacuucuaccaagaagcagcccccucccaagcagacgucgcacuaauccguuacgucaaccccgacaccggacggacccucuucgaagcaaagcuccacagauccggauucaucaccgucucacacaccggcgccuacccgcucgucguaccacccaacggacacuuccgauucgacucuugggucaaccaauuuuacucucucgcacccaugggcaccggcaacggauaa

SEQ ID NO: 39278 - RNA, 1614 nt, Artificial Sequence
  derived and/or modified sequence opt11 from VP1__Norovirus_and/or_Norovirus-like__AB810001
augaaaauggccucaaacgacgccgcaccauccaacgacggcgccgccucccucguccccgaagcaaucaaugaaaccaugccccucgaaccgguagccggggccuccaucgccgcaccagucgccggccaaacaaacaucaucgacccauggauacgcaccaacuucguucaagccccaaacggcgaguucacugucuccccacgcaacucccccggagaaauacuucucaaccuagaacuuggccccgaccucaaccccuaccucgcccaccucucacgcauguacaacggcuacgccggaggggucgaaguccaaguccuccuggccgguaacgccuucacagccggcaagauccucuucgcagccauuccucccaacuuccccguugacaugaucucacccgcacaaauaacuaugcuuccccaccuaauaguggacguccgcacacuagaacccaucaugaucccccuccccgaugucagaaacgucuucuaccacuucaacaaccaaccccaaccacgcaugcgccucgucgcaaugcucuacacaccccuacgauccaacggcucaggcgacgacguauucacagucucaugccgcguccuaacccgcccuacaccggacuucgaguucaucuaccuuguaccacccagcguggaaucaaaaacuaaacccuucacuuuacccauccuuacaaucucugaacuaaccaauucacgcuuccccaucccaaucgaacaacucuacaccgccccaaacgaaaacaacguaguccaaugccaaaacggccgaugcacccuagauggagaacuccaaggaacaacccaacuucucucuucagccgucugcuccuacagaggccgaacaguagcaaacuccggcgacaacugggaccaaaaucuccuccaacucaccuaccccucaggagccucauacgacccaaccgacgaagucccggcaccucucggcacccaggacuucuccggcauacuuuacggcguccucacacaagacaacgucucugaaggcaccggagaggccaaaaacgccaaagguguauacauuucaaccacuuccggaaaauucacccccaaaauaggcucgaucggacuacacucuaucacagaaaacguccaccccaaccaacaguccagauucaccccagucggcguagcacagaaugagaacacccccuuccaacaauggguccucccacacuaugccggcgcacucgccuuaaacacaaaccucgcacccgccgucgcaccaaccuuccccggagaacaacuccuauucuuccgcucacgcgugcccuguguccaaggccuccgcggccaggacgccuucaucgacugccugcucccccaggaaugggucaaccacuucuaccaagaagccgcacccucacaagcagacgucgcccuaauccgcuacguaaaccccgacacaggccgcacccuauucgaagcaaaacuacaccgauccggauucauaaccgucucccacaccggcgcauacccccucgucgucccacccaauggccacuuccgauucgacuccugggucaaccaauucuacucacucgcccccaugggcaccggaaacggcuaa

SEQ ID NO: 39279 - RNA, 1614 nt, Artificial Sequence
  derived and/or modified sequence opt11 from VP1__Norovirus_and/or_Norovirus-like__AB809992
augaagauggcuuccaacgacgccgcccccucaaacgacggugccgccucccucguacccgaagccauaaaugaaaccaugccccucgaacccguagccggugcaucaauagccgccccaguagccggccaaacaaacaucaucgaccccuggauccgaaccaauuuuguucaagccccaaacggcgaguucacaguauccccucgcaacucuccaggcgaaauacuucucaaccucgaacucggcccugacuuaaaccccuaccuagcucacuuaucccgaauguacaacggcuacgccggcggcgucgaaguacaaguccuacucgccggcaacgcuuucaccgccggcaaaauccucuucgcggcgaucccacccaacuuucccgucgacaugaucucccccgcccaaaucacaaugcugccucaccucaucgucgacgugcguacccuugaacccauaaugauaccacucccagacguaagaaacgucuucuaccauuucaacaaccaaccccaaccacgaaugagauuagucgccaugcuauauacaccccuccgauccaacggcucaggcgacgacguguucaccgucuccugccgcguucuuacccgcccuacccccgacuucgaauuuaucuaccuugucccacccuccgucgaauccaaaaccaaacccuucacccuccccauccuaaccaucucagaacucaccaacucaagauucccaauccccaucgaacaacuuuauaccgccccaaacgaaaacaacgucguacaaugccaaaacggccgcugcacccucgacggagaacuucaaggcaccacacaacuacuuuccagcgccgucugcuccuaccgcggucgcaccgucgcaaacuccggcgacaacugggaucaaaaccuccuacaacucaccuaucccuccggcgcauccuacgaccccacagacgaaguacccgcaccacuugguacccaagacuucuccgguauacucuacggcguccucacccaagacaauguuuccgaaggcaccggcgaagccaaaaacgcaaaaggaguauacauauccacaacaucagguaaguucacccccaaaaucggcucaaucggccuacacuccauuaccgaaaacguccaccccaaccaacaaucacgcuucacccccgugggagucgcccaaaacgaaaacacacccuuucaacaguggguccucccacacuacgccggcgcccucgcucucaacaccaaccuagcacccgccguagcacccaccuuccccggcgaacaacuccucuucuuccguucccgcguacccugcguccaaggccuccguggacaagacgccuucaucgacugccuucucccccaggaaugggucgaccauuucuaccaagaagccgcacccucucaagccgacgucgcccugauucgcuacgucaacccagacaccggccgcaccuuauucgaagccaaacuacaucgauccggauucaucaccgucucucacaccggagccuacccccucguggucccaccaaacggccacuuccgauucgacuccugggucaaccaauucuacucccucgccccaaugggcacaggcaacggauag

SEQ ID NO: 39280 - RNA, 1611 nt, Artificial Sequence
  derived and/or modified sequence opt11 from VP1__Norovirus_and/or_Norovirus-like__AY130761
augaaaauggcuucaaaugacgccacacccuccgacgacggcgcagcaggccucgucccagaaaucaauaacgaagucauggcccucgaacccguagccggcgccucuauugcugcacccgucguaggucaacaaaauaucauagaccccuggauacgcaacaacuucguucaagcacccgccggcgaauuuacagucucgccccgcaacucccccggcgaacuacuccucgaucucgaacuaggaccagaacucaaucccuaccucgcccaccuagcccgcauguacaacggccaugccggcgggauggaaguccaaaucguacuugccggcaacgcauucaccgcaggcaagauccuuuucgccgccauuccucccuccuuccccuacgaaaaucuaucccccgcccaacuaaccaugugcccucacgucaucgucgacguccgccaacucgaacccguacuauuacccaugcccgacaucagaaacgucuucuaccacuacaaccaaaacaacuccccuaaacuccgccucguagccaugcucuacacaccccuacgagccaacaacuccggugacgauguauucaccguauccugccgaguccuuacccgcccaucacccgacuuccaauucaccuuccucguaccaccuacaguggaauccaaaacuaaaaacuucacacuccccguucuccgagucagcgaaaugacaaacucccgauuccccgucguccucgaccaaauguacaccucacgaaacgaaaacauaauaguccaaccccaaaacggccgcugcaccacagacggcgaacuccucggaacaacgacacuccaauccguaucaaucuguaacuuccgcggcacaaugcaggccaaacuuaacgaacaaccacgcuaccagcuacaacugacaaaucucgauggcucccccaucgacccgaccgacgacaugcccgcaccucucggcaccccggacuuccaagcaaugcucuacggcguugccucccaacgauccucccgcgacaacgccacccgagcucacgacgcgcaaaucgacacagccggagauaccuucgccccaaaaaucgggcaaguccgauucaagucaucaucagacgacuuugaucuacacgaccccaccaaauuuacucccauaggcgucaacguagacgaccaacaccccuuccgccaguggucccuccccaacuacggcggccaccucgcccuaaauaaccaccucgcccccgcaguaacaccccuuuuccccggagaacaaauccucuucuuucgcucccacauccccucugccgguggacacaccgacggcgccaucgacugccuccucccacaagaauggauagaacacuucuaucaagaagccgcacccucacaaagcgacaucgcccucguacgauuuaucaaccccgacaccggccgcguccuacucgaagcaaaacuccacaaacaagguuuccucacugucgccgcauccggagaccauccaaucgucaugcccaccaacggcuacuuccgauuugaagccugggucaaccccuucuacacccuugcccccgucggcacaggauccggccgccgccgcauucaauaa

SEQ ID NO: 39281 - RNA, 1611 nt, Artificial Sequence
  derived and/or modified sequence opt11 from VP1__Norovirus_and/or_Norovirus-like__KF806495
augaaaauggccuccaacgacgcaaaccccucagacggcucagcagccaaccuaguccccgaaguaaacaacgaagucauggcccuagaaccugucgucggagccgccaucgcagccccagucgccggacaacaaaacguaaucgaucccuggauccgcaacaacuucguacaagcccccgguggcgaguucacuaucagcccccgaaacgcccccggagaaauacucugguccgccccacuuggccccgaccucaaccccuaccuaucccaccucgcccgcauguacaacggauacgcaggcggcuucgaaguccaagugguccucgccggcaacgccuucaccgccggaaaaaucaucuucgcagcaguaccacccaauuuccccaccgaaggccucucccccagccaaguuaccauguucccccacaucaucguugacguccgacaacucgaaccaguccuaaucccacucccagacgucagaaacaacuucuaccacuauaaucaaagcaacgauucaaccaucaaacucaucgccaugcucuacacuccccuaagagccaacaacgcuggagacgacguauucaccgucuccugucgaguacuuacccgaccuucacccgauuucgacuucaucuuucuagugccacccaccgucgaaucacguaccaaacccuucaccguaccaguccucaccgucgaagaaaugacuaauucccgcuuccccauuccucucgaaaaacucuucacaggacccucauccgccuucgucguacaaccacaaaacggacgaugcacaaccgacggcguccuacucggaaccacccaacuuucagccguuaacauaugcaccuuccgcggagacguaacacacgucuccgacaaaaccuucgcaaugaaccucgcaucccccaacuggaacaacuacgaccccaccgaagacaucccagcaccccucggcaccccugacuucgucggccgaauccacgguaugcucacacaaacaacacgacgcgacggcgccacccguggccacaaagccaccguaucuacuggcggcgcugacuucacaccuaaacucggcuccguacgcuacauaaccgacacuaccgacgaccuugaaguccgcgaaaacaccaaguucacccccauaggcguccuccacucauccggcgaacaccgcgccgaaccugaccaauggcgccucccagaauauuccggccguaacguccacaacguccaccuagcccccgccgucgcccccaccuuccccggcgaacaacuccuauucuuccgauccgccuuaccaggcugcggcggcuacccaaacacggaccuagacugccuccuaccccaggaauggguacaacacuucuaccaagaagccgcccccgcccaauccgacguagcacuccuccgcuucgucaacccagacaccggacgcguacuuuucgaaugcaaauuacacaaauccggcuacguaaccgucgcccacaccggcccacacgaccucguaauacccccuaacggcuauuuccgauucgacuccugggucaaccaauucuacacucuagcccccaugggcaacggaaccgggcgcagacguuaa

SEQ ID NO: 39282 - RNA, 1611 nt, Artificial Sequence
  derived and/or modified sequence opt11 from VP1__Norovirus_and/or_Norovirus-like__KF806503
augaaaauggcauccaacgacgccaaccccagcgacggcucagccgcaaaucucguccccgaagucaacaacgaagucauggcccucgaacccgucgucggcgccgccaucgccgccccaguggccggccaacaaaacgucauagacccauggauccgaaacaacuucguccaagcacccggcggcgaguucaccaucucuccacgaaacgccccaggcgaaauacucugguccgccccacucggccccgaccuaaacccauaucucucacaccuagcacgcauguacaacggcuaugcaggcggcuucgaaguccaaguaguccucgccggcaaugcauucaccgcaggaaagauaaucuucgcagcagugcccccaaacuucccuacggaaggccucucccccucccaaguaaccauguucccccacauaaucguagacguccgacaacuugaaccaguccucauaccccugcccgacguccguaacaauuucuaucacuacaaccaaagcaacgacucaaucauaaaacuuaucgcaaugcucuacacaccucuccgcgccaacaacgccggcgacgacgucuucaccgucucaugcagaguccuaacucgacccucccccgacuuugacuucaucuuccucguacccccaaccgucgaaucacgaaccaaacccuucaccguacccguccucaccguagacgaaaugaccaacucaagauucccaaucccacuagaaaaauuauuuacaggucccuccucagccuucgucguccaaccccagaacggccgcuguacaacagacggcguccuccucggaaccacccaacucucagcugucaacaucugcaccuuccgaggcgacgucacccaugucucugacaaaaccuucgccaugaaucuagcaucacccaacuggaacaacuaugacccuaccgaagaaauaccagcaccccuaggcacccccgacuucguaggacgcauccacggcaugcucacccaaacuacccgccgcgacggcgccacccgcggacacaaagccaccgucucaacuggcggggcagauuucacacccaaacuaggaucagucagauacaucacagacacaaccgacgaccucgaaguccgugaaaacaccaaauucaccccuaucggaguccuucacuccuccggcgaacaccgggcagaacccgaccaauggcgacuuccagaauacuccggacgaaacguccacaacguacaccuagcccccgcagucgcccccacauucccaggagaacaacuccuuuucuuccguucagcacucccuggaugcggcggcuaccccaacaccgaccucgacugccuccucccccaagaauggguccaacacuucuaccaagaagccgcacccgcccaauccgacgucgcccuacuccgcuucgucaacccagacacaggccgaguccuauucgaaugcaaacuccacaaaaguggauacgucacaguugcccacaccggcccucacgaccuagucauacccccuaacggauacuuccgcuucgacucauggguaaaccaauucuacacccuugcaccaauggggaacggcaccggccgccgacgcuaa

SEQ ID NO: 39283 - RNA, 1611 nt, Artificial Sequence
  derived and/or modified sequence opt11 from VP1__Norovirus_and/or_Norovirus-like__KF712506
augaaaauggcaucauccgacgccaacccuuccgacggcuccaccgccaaccucgugccagaagccaauaaugaagucauggcccuagaacccguagucggagcagccaucgcagcccccguugccggacaacagaacguaaucgaccccuggauaagaaacaacuucguccaagcacccggcggagaguucaccgucucgccccgcaacgcccccggugaaguccucugguccgcaccccucggacccgaccuaaaccccuaccuaucccaccucgcccgaauguauaacggcuacgcaggcggcuucgaaguacaaguaauccuagccggaaacgcuuucgccgccggcaaaauaaucuucgccgcugucccacccaacuucuccacugaaggauuaucccccucccaaguuacaauguucccccaccucaucgucgacguccgucaacucgaacccguaaugaucccccuccccgacauccgcaauaacuucuaccacuauaaccaaucaaacgaucccaccauaaaacucaucgcaaugcucuacaccccacuccgagccaacaacgucggcgacgacguuuucacugucaguugccgagugcucacucgccccucaccagacuuugacuucaucuuccuagucccacccacagucgaaagcaaaacuaaucccuucucuguccccauacucacaauugaagaaaugacuaacucccgguuccccaucccccuagaaaaacucuucaccggccccuccuccgcccucguaguacagccccaaaauggaagauguacaaccgacggcguccuacuaggcaccacccaacucucacccguaaauaucugcaccuuccgcggcgacgucacacauaccacuaaaacccacaccuaccaaaugaaccucgcagcacaaaacuggaacuccuacgacccaaccgaagaaaucccagcaccccucggaacacccgacuucgucggaaaaauucaaggcguccucacccaaaccacaaaagaaaacggcucaacacgcgcccacaaagccaccgucuacacaggaaccgucgaguucacccccaagcucggccgcauacaacuauucaccgacaccgacaacgaccucgaagccaaucaaaacacaaaauuuacccccgucggagucauccaagacggugaccaccaaaacgaaccccaacaauggguacucccuuccuacuccggucgcaacaaucacaacguucaccuagcccccgccguagcccccacauucccgggcgaacaacuccuauucuuuagauccaccaugcccggaugcuccgguuacccaaacaugaaccucgacugccuccucccccaagaauggguccaauacuucuaccaagaagcagcccccgcccagucggacgucgccuuacuacgauuuguaaaccccgacaccggccgaguacuauucgaaugcaaacuacacaaauccggcuacguaacagucgcccacacuggacaccacgaccucguaauacccccaaauggcuacuuccgcuucgacucaugggucuccccauucuacacccuagcccccaugggaaacggcaccggccgccgccgcuaa

SEQ ID NO: 39284 - RNA, 1611 nt, Artificial Sequence
  derived and/or modified sequence opt11 from VP1__Norovirus_and/or_Norovirus-like__KF712507
augaagauggcuucaucagacgcuaaccccucagacggcucaaccgcaaaccucguuccagaagcgaacaacgaaguuauggcccucgaacccguuguaggcgcagccauugccgcccccgucgccggacagcaaaacguaaucgacccauggaucagaaauaacuucguccaagcgcccggcggagaguucacagucucaccccgcaacgcacccggggaaguccucugguccgcaccccuaggucccgaccucaaccccuaucuaucccaccucgcccgcauguacaauggcuacgccgguggcuucgaaguacaaguaauacucgccggcaacgcauucgccgcaggcaaaaucauauucgccgccguuccacccaacuucucuaccgaaggccucucccccucccaggucaccauguucccccaccuuauaguagacguacgccaacucgaacccgucaugaucccccuacccgacauccguaauaauuucuaccacuacaaccaaucaaacgacccgaccaucaaacucaucgccauguuauacaccccacuccgugcuaacaacgucggcgacgacguauuuaccguaagcugccgaguacucacccgcccaucaccggacuucgacuucauauuccucgucccacccacagucgaaaguaaaacuaaccccuucuccguacccauccuuaccauagaagaaaugaccaacagcagauuccccauaccccuagaaaaacuauuuaccggccccuccagcgcccucgucguccaaccccaaaacggacguugcaccaccgacggaguccuccucggcacaacccaauuaagccccgucaacaucugcacauuccgcggagacguaacccacacaacgaaaacccacacauaccagaugaaccucgccgcccagaacuggaacucguacgaccccaccgaagaaauucccgccccacucggcacacccgacuucguaggcaaaauacaaggaguccucacccaaaccacaaaaggcaacggaagcacccgcgcucacaaagccaccguuuacaccggcaccguugaguucacccccaagcucggacgaauccaacucuuuaccgacaccgacaacgaccucgaagccaaccaaaacaccaaguucacgcccguaggagucauccaagacggcgaccaccaaaacgaaccccaacaauggguacuuccaucauacuccggcagaaacaaccacaacguacaccucgcccccgcagucgccccaaccuucccuggcgaacaacuccucuucuuccgcucuaccaugcccggcugcucaggauaccccaacaugaaccucgacugccuucucccacaagaauggguccaauacuucuaucaggaagcagcacccgcacaauccgacguagcccuccuaagauuugucaaccccgacacugguagaguacuuuucgaaugcaaacuccacaaaucuggcuacguaacgguagcccacaccggucaccacgaccucguaaucccacccaacggauacuuccgcuuugacuccugggucucccccuucuacacccucgcacccauggggaacgguaccggacgccgccgcuaa

SEQ ID NO: 39285 - RNA, 1611 nt, Artificial Sequence
  derived and/or modified sequence opt11 from VP1__Norovirus_and/or_Norovirus-like__JX401281
augaaaauggccagcaacgaugccaacccauccgacgguuccgcugccaaccuuguccccgaagucaauaacgaagucauggcccuagaaccugucguuggugcagccaucgccgccccagucgccggccaacaaaacgucaucgaucccuggauccgaaacaauuuuguacaagcccccggcggagaauuuacaguaucaccccgaaaugcccccggcgaaauccuaugguccaugccccucucccccgaacucaacccauaccuuucccaccucucccgcauguacaaugguuacgcuggaggcuucgaaguccaagucauccucgccggcaacgccuucacagcaggaaaaaucaucuucgcagcaaucccaccaaacuuccccaccgauggacucucccccucgcaagucacaauguucccccacaucaucgucgacguucgccaacucgaacccguccucaucccccuccccgacguccgcaacaacuucuaccacuacaaucaggcaaacgacucuacccucaaacucauagcaaugcuauacacuccccuccgagccaacaacgccggcgacgacgucuucaccguuuccugcagaguccucacccgccccucccccgacuucgacuucaucuuccucguaccacccaccgucgaaucacgcaccaaacccuucaccgugccuauccuaaccguagacgaaaugacuaacucccgcuucccaacaccccucgaaaaacuccacaccggaccaaauaacucaaucgucguacaaccacaaaacggucgaugcaccaucgacggcguccuacucggcaccacucaacucuccacugucaacaucugcaacuuccgaggauccacaacccgcgccggucaaucacacgccuacaccaugaaccucgucagccaaaacuggaacaacuacgaccccaccgaagaaauaccagccccacuuggaacccccgacuuugucggcaaaaucgucggaauguuaucccaaaccacacgcgaaaacuccucuacccgcgcacacaaagccaccgucucuacuggugacgcccacuucacacccaaaucaggaucaguccuauucaccaccgacaccgacgaccugcaaaacggacaaaacacacgauucaccccagucggagucgcccaagacggcgaaccccaucaaaacgaaccacagcaguggcgucuacccaacuacuccggcacacccggccacaacguacaccuagccccucccgucgcacccacauuccccggcgaacaacuccucuucuuccgauccaccaugccuggcuguggcggcuaccccaacauggacuuagacugccuccucccccaagaauggguccgccacuucuaccaagaagccgcaccagcacaauccgaugucgcacuucucagguucguaaacccggacaccggaagaguccuuuucgaaugcaaacuccacaaagccgguuacaucaccguaucacacacuggccccuacgaccuaguaaucccacccaacggcuacuuccgcuucgacuccuggguuaaccaauuuuacgcacuagcacccaugggcacagguaccggccgacgccgcuaa

SEQ ID NO: 39286 - RNA, 1611 nt, Artificial Sequence
  derived and/or modified sequence opt11 from VP1__Norovirus_and/or_Norovirus-like__KF806526
augaaaauggcauccaacgacgccuccccaucagacggcuccgcagcaaaccugguccccgaagucaacaacgaggucauggcccuggaacccguaguuggagccgcaaucgccgcccccgucgccggccaacaaaacgucaucgaccccuggaucagaaacaaauucguacaagccccaggaggcgaguucacaguaaguccccgcaacgcucccggcgaaauccuaugguccgcaccacuaggccccgaccucaacccauaccucucacaccucgcacgaauguacaacggauacgcuggcggcuucgaaguccaagucauccucgccggcaaugccuucacagccggcaaaaucaucuucgcagccguacccccaaacuuucccaccgaaggacucuccccaucccaagucaccauguucccacacaucgucgucgacguccgccaauuagaacccguacuaauaccacuccccgacguccguaacaacuucuaccacuacaaccaauccaaagaccccaccaucaagcucaucgcaaugcuauacacaccccuccgugccaacaacgccggcgaagacgucuucacagucucaugccgaguacuaacccgccccagccccgacuucgacuucauauuccuaguacccccaacagucgaaucccgcucaaaaccuuucacaguacccauccucacugucgaagaaaugacaaacucccgcuuccccauaccccucgaaaaacucuucaccggacccucaggugccuucgucguucaaccccagaacggacguugcaccaccgacggcguucuccuaggaaccacacaacucagcccagucaacauaugcaccuucagaggcgaccuuacccacuucgcagggacccacgaauacgcaaugaaccucgccucccaaaacuggaacaacuacgaccccacugaagaaauccccgcaccccuaggcgcccccgacuucgucggcaaaauacgaggcguccuaacccaaacaacaagacgcgauggcaguacucgaggucaccgcgccacccucucaaccggcucagcccacuucacuccaaaacucggauccauucgcuucucaaccgacacaaacaacgauuucgaagccggccagaacacaaaauucaccccugucggcgucuuccaagauggcgacaaccaccaaaacgaaccucaacaauggguacuuccaaacuacucaggagccacugcacacaacguccacuuagcccccgccgucgcacccgcuuuucccggagaacaacuccuauucuuucgauccaccaugcccggcugcagcggcuaccccaacaugaaccucgacugccuccuuccccaagaauggguacaacacuucuaccaagaagccgccccagcucaaagcgacgucgcccuacuaagauuuguaaaccccgacaccucacgcguccuauucgaaugcaaacuccacaaaagcggcuacgucacagucgcccacacaggccagcacgaccucgucauucccccaaacggcuacuuccgcuucgacagcuggguuaaccaauucuacacacucgcccccaugggcaacggcacaggccgacgauaa

SEQ ID NO: 39287 - RNA, 1611 nt, Artificial Sequence
  derived and/or modified sequence opt11 from VP1__Norovirus_and/or_Norovirus-like__KF806500
augaaaauggccuccaacgacgcaaaccccuccgacggcuccgccgccaaccucguucccgaagucaacaacgaagucauggcccuagaacccgucguaggugcagcuaucgccgccccagucgccggccaacaaaacguaaucgaccccuggauucgaaacaauuuuguccaagccccaggcggcgaguucaccaucucccccaggaacgcaccaggagaaauacuauggagugcaccacucggccccgaucuaaaucccuaccuuucucaccucgcacgcauguacaacggcuacgcuggcggcuucgaaguccaagucguacucgccggcaacgccuucaccgccggaaaagucaucuucgccgcaguuccacccaauuuccccacugaaggacucuccccaucucaagucacaauguucccccacauaaucgucgacguaagacaacuagaaccaguacuaaucccccugcccgacgucagaaauaacuucuaccacuacaaccaauccaacgauucaaccauaaaacucauagccaugcucuauacaccccuccgcgccaacaacgccggcgacgacgucuucaccgucuccugccgcguccucacgagacccucccccgacuuugacuucauauuccucgucccacccaccgucgaaucccgaaccaaacccuucuccguccccguccucacaguagaagaaaugaccaacucacgcuuccccaucccccuugaaaaauuguucaccggccccagcuccgcauucguaguucaaccccaaaacggacgcugcaccaccgacggaguccuccuuggcaccacucaacuauccgccgucaacauauguaccuucagaggcgacguaacccacguagccggcgacaccuucgcuaugaaccucgccagccuaaacuggaacaacuacgacccaaccgaagagacacccgcaccccucggcacacccgacuucgucggccgcauccauggcaugcuaacccaaacaacccgauccgacggcgccacccgcgcacacaaagccaccgucucuaccggcggcgccgacuucacucccaaacucggcuccguccgcuacuccacagacacauccucggaccucgaaguccgcgagaacacaaaauucaccccaaucgguguccuucacuccagcgggggccaccgcgcagaaccagaccaauggcgacucccagaauacuccggccguaacguucacaacguccaccuggccccagcagucgcaccuaccuuccccggcgaacaacuacuauuuuuccgaucaaccaugcccggaugcggcgguuaccccaacauggaccucgacugccuccucccacaagaauggguccaacacuucuaccaagaagccgcccccgcacaaucagacgucgcccuccuacgcuucguaaaccccgacaccggccgcguacucuucgaaugcaaacuccacaaauccggauacguaacagucgcccauacaggcccucaugaccucguaaucccacccaauggauacuuccgcuucgacuccuggguaaaccaauucuacacccuagcucccaugggcaacggcacuggucgacgccgcuga

SEQ ID NO: 39288 - RNA, 1611 nt, Artificial Sequence
  derived and/or modified sequence opt11 from VP1__Norovirus_and/or_Norovirus-like__KF806498
augaaaauggccuccaaugacgccaaccccucagacggcuccgcggccaaccucguccccgaagucaacaacgaagucauggcacucgagccuguuguaggcgccgccaucgccgcacccgucgccggccaacaaaacgucaucgaccccuggauaagaaacaacuucguccaagcccccggaggcgaguucacgaucucccccagaaacgccccaggagaaauacuaugguccgcaccgcucggccccgaccucaaccccuaccugucucaccucgcacgaauguacaacggcuacgcaggcggcuucgaaguccaagucguccuugcaggcaacgcuuucaccgcaggcaaaaucaucuucgcagccgucccacccaacuucccgacagaaggucucucccccucccaagucaccauguucccacacaucaucguugacguccgacaacuagaaccgguacuaaucccccuccccgauguccgaaacaauuucuaccacuacaaccaauccaaagauucaaccaucaaacucauagcaaugcucuacacaccccuccgugccaauaacgcaggagacgacgucuucaccgucuccugccgcguacuaacccgccccagcccugauuucgacuucaucuuccuagugcccccaaccgucgaaucccgcacuaaacccuucuccguccccguccucaccgucgaagaaaugacuaacucccguuuccccaucccucuagaaaagcucuuuaccggccccuccucagccuucgucguccaaccucaaaacggcagaugcaccacagacggcguacuacucggcaccacacaacucagcgccgucaacaucugcacuuuccgaggagacguaacccacguugcaggcgacaccuucgccaugaaccucgcaucacuaaacuggaacaacuaugacccaaccgaagaaacacccgcaccacucggcacccccgacuucgucggaagaauccacggcaugcucacccaaacaacccgaagcgacggcgccacacgcgcccacaaagcuacagucuccaccggcggcgcagacuucaccccaaaacuuggguccguacgcuacuccaccgacaccuccuccgaccucgaaguucgcgaaaacaccaaauucaccccaaucggaguauuacacuccuccggcggacaccgcgccgaacccgaccaauggcgccuacccgaauacuccggacgaaacguccacaacguccaccucgcccccgcagucgcccccaccuuccccggcgaacaacuacuauucuucagaucaacaaugcccggcugcggcggcuacccgaacauggaccucgacugccuucucccacaagaauggguccaacacuucuaucaagaagcugcacccgcacaauccgacguagcccuucuccgcuucgucaacccagauaccggccgcguccucuucgaaugcaagcuacacaaauccggauacgucaccgucgcucacaccggcccucacgaccuagucauacccccaaacggauacuuccgcuucgacuccuggguuaaucaauucuacacccucgcacccauggggaacggcacaggccgccgacgcuaa

SEQ ID NO: 39289 - RNA, 1611 nt, Artificial Sequence
  derived and/or modified sequence opt11 from VP1__Norovirus_and/or_Norovirus-like__KF429768
augaaaauggcaagcucugacgccaaccccucugacggauccacagcaaacuuaguccccgaagcaaacaacgaagucauggcccucgaacccguagucggcgccgccauugccgcaccugucgccggccaacaaaacgucaucgacccauggauaagaaacaacuucguucaagcaccaggcggcgaguucaccgucagcccccgcaacgcccccggugaaguacuguggucagcaccccuaggccccgaccucaacccauaccucucccaccuagcccgcauguacaacggcuacgccggaggauucgaaguacaagucauacuagccggcaaugccuucgcugcaggcaaaauaaucuucgcugccguaccaccaaacuuuuccacagaaggccucucaccaucccaagucaccauguucccccaccugauagucgacguccgacaacucgaaccaguaaugaucccccuccccgacauccguaacaacuucuaccauuacaaccaauccaacgaccccacaaucaagcucaucgcaaugcucuacacuccccuucgcgccaacaacgucggcgacgacgucuucaccguaucaugccgcguccucacccgucccucaccagacuucgacuucaucuuucucguaccaccaacagucgagucaaaaaccaacccguucucagucccuauacucaccaucgaagaaaugacuaacucccgcuuccccaucccccucgaaaaacucuucacaggccccuccagcgcacucguaguccaaccacaaaacggacgcugcaccaccgacggcguacuccucggaacuacccaacucucccccguuaauauauguaccuuccgcggcgacgucacacacaccaccaaaacucacaccuaccaaaugaaccuggcugcacaaaacuggaacucuuaugacccaaccgaagaaacccccgccccacuaggcacccccgacuucgucggaaaaauccaaggcguucuaacacaaaccaccaaaggcaacggauccacacgcgcacacaaagccacugucuacacuggcacagucgaguucacccccaaacuuggcagaauccaacucuuuaccgacacagacaacgaccucgaagccaaccaaaacacuaaauucacccccguaggagucauccaagacggcgaccaccaaaacgaaccacaacaauggguacuaccaucuuacuccggucgcaacaaucacaacguccaccucgcucccgcuguagcccccaccuuccccggcgaacaacucuuauucuuccgcuccaccaugcccggcugcucaggcuaccccaacaugaaccuugacugccuccucccccaagaauggguucaauacuucuaccaagaagcagcaccagcccaaucagacguagcccuccuccgcuucguaaaccccgacaccggccgcguccuauuugaauguaaacuucacaaaucuggcuacguaacaguggcccacaccggccaucacgaccucgucauuccucccaacggcuacuuccgcuucgacagcuggguaucccccuucuacacccuagccccaaugggaaacggaaccggccgccgccgcuaa

SEQ ID NO: 39290 - RNA, 1611 nt, Artificial Sequence
  derived and/or modified sequence opt11 from VP1__Norovirus_and/or_Norovirus-like__KF806496
augaaaauggccuccaacgacgcaaaccccucagacggcuccgcagccaaccuaguccccgaaguaaauaacgaggucauggcccucgagcccgucgucggagccgccaucgcagcccccguugcaggccaacaaaacgucaucgaccccuggauacgcaacaacuucguacaggccccaggcggagaauuuacaaucucuccacgcaacgcccccggagagauccucugguccgccccacucggccccgaccucaaccccuacuuaucacaccuugcacgaauguacaacgguuacgccggcggcuucgaaguacaagucguccuagccggcaacgcauucacagccggcaaaaucauuuucgcagccguuccucccaacuucccaaccgaaggacuuucacccucacaaguaacgauguucccacacaucaucguagacguucgacaacucgaacccguccuaaucccacuccccgacguacgaaacaacuucuaccacuacaaccaauccaaagauucgaccaucaaacuaaucgcuaugcuauacacuccccucagagcaaacaacgcaggcgacgacgucuucaccgucuccugucgaguccuuacccgccccucucccgauuucgacuucauauuccuugucccacccacaguugaaagccgcacaaaacccuucuccguacccguccucacagucgaagaaaugacuaacucacgcuuccccaucccgcucgaaaaacucuuuaccggccccucaucagccuucguuguucaaccucaaaacggacgcugcaccacagacggaguacuccugggaaccacacaauuauccgccguuaacauuugcaccuuccgcggugacguaacccacgucgcaggcgacaccuucgccaugaaucuagccucacuaaacuggaacaacuacgaccccaccgaagaaacacccgcaccccucggaacaccagacuucgucggaagaauccacggcaugcucacacaaacaacccguucagacggagccacacgcgcccacaaagcaaccgucuccacaggcggcgccgacuucacacccaaacucggauccguccgcuacuccacugacaccuccggcgaccucgaaguccgggaaaauaccaaauucacgcccauugggguacuccacagcucuggugaacgacgcgcagaacccgaacaauggcgccuacccgaauacuccggccgcaauguccacaacguccaccucgccccugccgucgccccaaccuuccccggagaacaacuacucuucuuccggucaaccaugccaggauguggcggcuacccaaacauggaccucgauugucuccuuccccaagaauggguccaacauuucuaccaagaggccgcccccgcccaauccgacgucgcccuacucagauucguaaaccccgacaccggccgcguacuguucgaaugcaaacuacacaaaucaggcuacgucaccguugcccacacuggcccccacgaccucgucaucccacccaacggauacuuccgcuucgacuccuggguaaaccaauucuauacccuagcacccaugggcaacggcaccggccgucgccguuga

SEQ ID NO: 39291 - RNA, 1611 nt, Artificial Sequence
  derived and/or modified sequence opt11 from VP1__Norovirus_and/or_Norovirus-like__KF806499
augaaaauggccucuaacgacgcgaaucccuccgacggauccgcagccaaccucguccccgaaguuaacaacgaaguaauggcccuagaacccgucgucggcgccgccauugcugcccccgucgcuggccaacaaaacguaaucgaccccuggauccgcaacaacuucguucaagccccaggaggggaguucacaaucucaccccgcaacgcacccggcgaaauccuaugguccgcaccccucggcccagaccucaauccauaccucucccaccucgcccgcauguauaacggauacgccggaggcuucgaaguccaagucgucuuagcaggcaacgccuucaccgcgggaaaaaucaucuucgccgccguacccccaaacuuccccaccgaggggcuauccccaucccaagucacaauguuuccccacaucauaguagacguacgccaacuagaacccguucucauuccacuccccgacguacgaaacaauuucuaccacuacaaucaauccaaagacuccacuauaaaacuuaucgccaugcucuacacccccuuacgagcuaacaaugcuggcgacgacgucuucaccgucuccugccgcguccucacccgaccaagccccgacuucgacuucaucuuccuaguucccccuacagucgaaucgcgaacgaaaccguuuuccguccccgucuuaacugucgaagaaaugacaaacucccguuuccccaucccccucgaaaaacucuucacuggucccucuucagccuucguaguccaaccccaaaacggacgaugcacuaccgacggcguacuccucggcaccacccaacucucagcagugaacaucugcaccuuccgcggagacgucacccacgucgcgggcgacaccuucgccaugaaccuagccagccucaacuggaacaacuacgaucccaccgaagaaacacccgcaccccucggaacccccgacuucguuggacgcauccacggcaugcucacccaaaccaccagaagcgacggcgccacacgcgcccacaaagccaccguaucaacgggcggcgccgacuucacacccaaacuugguagcguccguuacucaaccgacaccaguucggaccuagaaguccgagaaaacacaaaauucacaccaaucggaguccuacacucauccggcggccaccgagccgaaccugaccaauggcgucuccccgaauacuccggccgaaacguccacaacguccaccucgcccccgccgucgcacccaccuuccccggagaacaacuccucuucuuccgcuccaccaugccaggcugcggaggcuacccaaauauggaccucgacugcuuacugccccaagaauggguacaacacuuuuaccaagaaaccgccccagcacaaucagacguagcccuacugagauucgucaacccagacacaggccgcguccuauucgaaugcaaacuccacaaaucaggcuacguaaccgucgcccacaccggaccucacgaccucguaaucccacccaaugguuacuuccgcuucgacaguugggucaaccaauucuacacacucgcacccaugggcaauggcaccgguagacgucgauaa

SEQ ID NO: 39292 - RNA, 1611 nt, Artificial Sequence
  derived and/or modified sequence opt11 from VP1__Norovirus_and/or_Norovirus-like__KF806497
augaaaauggccuccuccgacgccaaccccucagacgguuccgccgccaaucucgucccggaagucaacaacgaagucauggcccuagaaccaguagucggcgcagcaaucgccgcacccgucgccggacaacaaaacgucauagacccauggauccgaaacaacuucguccaagccccugguggcgaguucacuauaucaccacgcaacgcccccggcgaaauccucuggagugcaccccucggcccugaccuaaaccccuaccuaucacaccuagcccgcauguacaacggcuacgccggcggcuuugaaguucaaguaguccuagccgguaacgccuucaccgccggaaaaaucauauucgccgccguaccacccaacuuccccacagaaggacucucacccucccaaguaaccauguucccccacauuaucgucgacguccgccaacuagaaccaguccucaucccccuuccagacguccgcaacaacuucuaccacuacaaccaaucuaaagacuccacaauaaaacucaucgccaugcuauacacaccccuacgcgccaacaacgcaggcgacgacgucuucaccguaagcugccgcguacucacccguccauccccagacuucgacuucaucuuccuaguacccccaaccgucgaaucccgaaccaaacccuucucuguccccguccucaccgucgaagaaaugaccaauucccguuucccaauuccacucgaaaaacuauucaccggacccuccuccgcauucguaguucaaccccaaaacggccgaugcacuaccgaugguguacuacugggcaccacacaacuauccgcagucaacaucugcaccuuccgcggagacguaacccacgucgcaggcgacacauucgccaugaaccucgcaucccucaacuggaacaacuacgacccuaccgaagaaacacccgcaccccuuggcacacccgacuucguaggcagaauacacggcaugcucacccaaaccacccggucggacggugccacgcgagcccauaaagccaccgucagcacggguggagcugauuucacacccaaacucggcaguguccgcuacuccaccgacaccagcuccgaccucgaaguccgcgaaaacaccaaauucacccccauaggcgugcuccacucauccgguggccaccgcgcagaacccgaccaguggcgacuacccgaauacucaggacgcaauguccacaacguacaccuagcucccgccguagcacccacuuucccaggagaacaacuccucuucuucagauccaccaugccaggcugcggcggauaccccaacauggaucuugauugccuccucccccaggaauggguccaacacuucuaccaagaagccgccccagcgcaaucagacgucgcccugcuacguuucguuaaccccgacacaggcaggguccuauucgaaugcaaacuacacaaauccggcuaugucacagucgcccacaccggcccccacgaccucgucauacccccaaacggauacuuccgauucgacucauggguaaaccaauucuacacccucgcacccaugggcaacggcaccggcagacgccgguaa

SEQ ID NO: 39293 - RNA, 1611 nt, Artificial Sequence
  derived and/or modified sequence opt11 from VP1__Norovirus_and/or_Norovirus-like__JN699046
augaugauggcaucgaaagaugccucccccagcgccgacggcgccaacggcgccgggcagcucguccccgaaguaaacaaugccgaaccccuccccuuagaccccgucgcuggcgccuccaccgcacucgccaccgccggacaagucaacaugauugacccauggaucuucaacaacuucguacaagcuccccaaggcgaauuuacaaucucgcccaacaacacccccggcgacauccucuucgaccuacagcucggcccacaccuaaaccccuuccucgcccaccucucucaaauguacaacggcugggucggcaauaugcgcguucgcguuauacuugcuggcaacgccuucaccgccggaaaagucaucaucugcugugucccacccggauuccaaagcagaacccuauccauagcccaagccacccuauucccccacaucauugccgacgucagaacccuagaaccaauagaaauaccccuagaagacguccgaaauacccuauaccacaccaacgacaaccaaccuacaaugcgccuacuaugcaugcuauacaccccgcuacggacaggaggcgguucaggcgguacagacgccuucgucgucgccggacgaguacuaaccugccccuccucggacuucaacuuccucuuucucgucccucccaccguggaacagaaaacccgccccuucucaguccccaacaucccccuccaacuccucuccaacucccgaguccccaaccucauccaaucaaugguccucucucccgaccaagcacaaaacguccaauuccaaaacggccgcugcaccaccgacggccaacuucucgggaccacacccgucucugucucacaaauccucaaauuccgcggcaaaguaucagccggcucccgaguaauaaaccucacagaauuagacggaucacccuuccucgccuucgaagccccagcucccaccggcuuccccgaccucggcacaucagacuggcacguugaaaugucccucaacucgaacucacagucaucaggcaaccccauccuacuacgagacauccaacccaacuccuccgacuucgucccccaccucggcuccguuucugucaccacugcaaucgacguagccggcgacuacaccgguaccauccaauggaccucccaacccucaaaugucacaccugucccagacguuaacuucuggaccaucccccaauacggguccaaucucgccgaagccucccaacucgccccagugguauacccacccggauucggugaagcuaucguauacuucaugagccccaucccaggccccaacaccgcccacaaacccaaccuagucccaugccuccucccccaagaauuuguaacccauuucgucucugaacaagcccccucgaugggagaagccgcccuaguacacuaugucgaccccgacacuaaccgcaacuugggcgaauuuaaacucuaucccgaaggauucauaacaugcgucccuaacggcacaggaccccaacaacucccccuaaacggcgucuucguauucgcauccuggguuucccgcuucuaccaacucaaaccagugggaacugcauccuccgcccguuaa

SEQ ID NO: 39294 - RNA, 1611 nt, Artificial Sequence
  derived and/or modified sequence opt11 from VP1__Norovirus_and/or_Norovirus-like__AM263418
augaugauggcauccaaagacgccucccccuccgcugacggcgccaacggcgccggacaacuuguccccgaagugaacaacgccgaaccacucccccuagaccccgucgccggagcuagcacagcccuagcaaccgccggccaagugaacaugaucgaucccuggaucuucaacaauuucguacaagcgccccaaggagaguucacaaucucucccaacaacacgcccggcgacauccucuuugaccuccaacucggcccacaccucaauccauuccuagcccaccucucccaaauguacaacggcuggguugguaacaugcgcguucgcguaauccuagccggcaacgccuucaccgcuggcaaaguaauugugugcugcgucccacccggauuccaaucccgcacccucuccauagcccaagccacacuauucccccacaucaucgcagacgucagaacacucgaaccaaucgaaaucccccuagaagacguucgcaacacccuauaccacaccaacgacaaccaacccaccaugcgacuacucugcaugcuuuacacaccccuacgcaccggcggcggauccggaggcaccgacgccuucgucguugccggacgaguccuuacaugcccuuccuccgacuucaacuucuuauuucucgucccacccaccguagaacagaaaacucgucccuucucaguccccaacaucccacuccaacuacucucaaacucgcgcguccccaaccucauacaauccauggugcucucacccgaccaagcacaaaacguacaauuccaaaacggacgcugcacuaccgacggccaacuucucggaaccaccccagucucagucucacaaauccucaaauuccgaggcaaagugucagccggaucccgaguaauaaaccucaccgaacucgacggaucccccuuccuagccuucgaagccccagcacccacuggcuuccccgaccucggaaccucugacuggcacguagaaaugucccucaacucaaacucccaaucauccggcaaucccauccugcuccgcgacauccaacccaacucuuccgacuucguaccccaucuaggauccguagccgucaccacagcaauagacgucgccggagacuacaccggcaccauacaauggacuucacaaccuuccaauguaacccccgucccagaugucaacuucuggaccauaccccaauauggcuccaaccucgccgaagccucccaauuagcacccgucgucuaucccccaggcuucggcgaagccauagucuacuucaugucacccaucccaggccccaauaccgcgcacaaaccgaaccugguccccugccuccucccccaagaguucgucacccacuuugugucagaacaagcccccuccaugggagaagccgcccugguacauuacguagacccagacacaaaccgaaaccuaggugaguucaaacucuauccagagggcuucaucacaugcguaccuaacggcaccggcccacaacaacucccccuaaacggcgucuuugucuucgccuccugggucucacgauucuaccaacuaaaacccguaggaaccgccucuagcgccagauag

SEQ ID NO: 39295 - RNA, 1611 nt, Artificial Sequence
  derived and/or modified sequence opt11 from VP1__Norovirus_and/or_Norovirus-like__KT732278
augaugauggcaucaaaagacgccacaccuucugcagacggagccaacggcgcaggccaacucguccccgaagucaacaacgcugaaccccuuccccuagaccccgucgccggcgccuccaccgcacuagcaaccgccggccaaguaaauaugaucgacccauggauauucaacaacuucguccaagccccacaaggagaauuuacaauauccccgaacaacacacccggcgacauccucuucgaucuucaacugggcccccaccuuaacccauuucucgcacaccucucucaaauguacaacggcugggucggcaacaugcgcguccgagucauacuagccgguaacgcauucaccgcaggaaaagucaucaucugcugcgucccacccggcuuccaaucacgcacccucuccaucgcacaagccacucucuucccccacaucaucgccgacgugcgcacucucgaacccaucgaaaucccacucgaagacguacgaaacacccucuaccacaccaacgacaaccaacccaccaugcgccuccuaugcaugcucuacacgccccuccgcaccggcggcggcuccggagguaccgaugccuucguagucgcuggccgaguacucacauccccaucucccgacuucaacuuucuauuccucguacccccaacaguagaacagaaaacccgcccauucuccguccccaacauaccccuccaacuacuauccaacagccgaguccccaaccucauccaaucaaugguccucucgcccgaccaagcacaaaacguacaauuccaaaacggccgcugcaccacugacgggcaacuacucggcaccacccccgucucagucucccaaauccucaaauuccgaggcaaagucucugcgggcuccaaagucaucaaccucaccgaacuugacggcucaccguuccuggccuucgaagccccugcccccaccggauuccccgaucuaggcaccucagacuggcacauagaaaugucccucaacuccaacucccaauccagcggcaaccccauccuacuacgagacauacaaccaaacucauccgacuucgucccccaccucggcuccgucgccgucacaacugccauugacacugccggagacuacaccgguacuauccaauggaccucacaacccagcaacgucacccccguccccgacguaaauuucuggaccaucccacaauauggcuccaaccucgcagaagccucacaauuagcaccagucgucuacccacccggcuucggcgaagccaucgucuacuucaugucccccauccccggccccaacaccgcccacaaaccaaauuuagucccaugccuccucccccaagaauuuguaacccacuucgucuccgaacaagcccccagcaugggagaagcagcacucguccauuacguugaccccgacaccaaccggaaccuaggcgaguucaagcucuaccccgaaggauucaucaccuguguacccaacggaaccggaccccaacaacuuccccuaaauggcgucuuugucuucgcuucaugggucagccgcuucuaccaacuaaagccugucggcacugcaaacucagcacgcuag

SEQ ID NO: 39296 - RNA, 1611 nt, Artificial Sequence
  derived and/or modified sequence opt11 from VP1__Norovirus_and/or_Norovirus-like__KT732277
augaugauggcauccaaagacgccacucccuccgccgacggcgcaaauggcgcaggucaacucguacccgaagugaacaaugccgaaccucucccccuagacccagucgccggcgccuccacugcucuugccaccgcaggccaaguaaacaugaucgacccuuggaucuucaacaacuucguccaagcaccccaaggcgaauuuaccaucucacccaacaacacacccggcgacauccuauucgaccuucaacucggcccccaccuaaaccccuuccucgcccacuuaagccaaauguacaacggcugggucggcaacaugcgaguacgcguaauccucgcugguaacgcuuucaccgccggcaaagucauaauaugcugcgucccucccggcuuccaaucacgcacacucuccaucgcacaagccacacucuucccccauaucaucgccgacguccguacccucgaacccaucgaaaucccccuugaagauguccgcaacacccuauaccacaccaacgacaaccaacccaccaugcgcuuacuaugcaugcuauacaccccgcuacgcacugguggcggcuccggaggcaccgaugccuucgucgucgccggacgcguccucaccucccccucccccgacuucaacuuccucuuccuaguacccccuaccgucgaacagaaaacucgccccuucuccguccccaacaucccccuccaacugcuuucuaauucccgaguucccaaccucauacaaucaaugguacccucucccgaccaagcccaaaacguccaauuccaaaacgggcgcugcaccacagacggccaacuccuaggcaccacccccguauccgucagccaaauccucaaauucagaggcaaagucuccgcuggcuccaaaguaauaaaccucaccgaacuugacggauccccauuccucgccuucgaagcccccgcacccacagguuucccagaccucggcacaucagacuggcacauagaaaugagccuuaacucaaauucccaauccucaggcaacccaauccuacuccgagacauccaaccuaacucguccgacuucgucccccaucuaggaucagucgccguaacuacagccaucgacacugccggcgauuacacuggcacuauacaauggacuucacaacccucaaaugucacccccguccccgacgucaacuucuggaccauaccccaauacggauccaaccucgcagaagccucccaacuagccccagucgucuacccucccggcuuuggcgaagcuaucgucuacuucaugucccccaucccaggcccaaacaccgcccauaaaccaaaccucguacccugccuacuaccacaagaauuuguuacacacuucgucuccgaacaagcacccuccaugggcgaagcagcacucguucauuacgucgaccccgacaccaaccgcaaccucggcgaauuuaaacuauaccccgaaggauucaucacauguguacccaacggcacaggcccacaacaauuaccucuuaacggaguauucgucuucgcgucuugggucucccgcuucuaucaacucaaacccgucggaaccgccaacucagcccgauaa

SEQ ID NO: 39297 - RNA, 1611 nt, Artificial Sequence
  derived and/or modified sequence opt11 from VP1__Norovirus_and/or_Norovirus-like__KJ402295
augaugauggcuuccaaagacgccccaagcuccgccgauggcgccaacggcgcuggucaacuagucccagaagucaacaaugcugaaccccuaccccucgacccagucgccggcgccucuaccgcacuagcaaccgcaggacaagucaacaugaucgaccccuggauauucaacaacuucguacaagccccacaaggcgaauucaccaucagucccaacaacacccccggcgacauccucuucgaccuacaacucggcccucaccuaaaccccuuccuugcacaccucucccaaauguacaauggcugggucggaaacaugcgaguucgcgucauucucgccggaaacgccuucacugccggaaaaguaauuauaugcugcgucccccccggauuccaaucccgcacccuaucaaucgcccaagccacccuauucccacacauaaucgcagacguccgcacacuagaaccaaucgaaaucccucucgaagacguacgcaacacacucuaccacaccaacgacaaccaaccuaccaugcgccuccuuugcaugcucuacacuccacuccgcaccggcggaggcucgggcggcacagacgcuuucguaguagccggacgcguccucacuugcccguccucagacuucaacuuccucuuccuaguuccccccaccgucgaacaaaagacccgccccuucagcguuccuaacaucccccuccagcuacuuagcaacucacguguccccaaccucauccaauccaugguccuauccccagaccaagcccagaacguccaauuccagaacggacgcugcaccacagacggccagcuucucggaaccacccccguauccgucucccaaauccucaaauuccgcggcaaaguuucagccggcucuaaggucaucaaccucaccgaacucgacggaucaccauucuuagcauucgaagcccccgcucccacaggcuucccagacuuaggcacauccgacuggcacguugaaaugucccucaacuccaacucccaguccagcggcaauccaauccuacuccgcgacauccaccccaacucauccgaauucguaccccaccucgguuccguuugcguaaccgcagcaaucgaaguagcaggcgacuauaccggcacaauccaauggacaucccaaccaucuaacgucacacccguaccugacgucaauuucuggaccaucccccacuacggcucuaaccuugcagaggccagccaacucgcccccgucguauacccccccggcuuuggagaagccauagucuacuucauguccccaaucccaggccccaacacagcccacaaacccaaccuaguccccugccuccucccucaagaauucgucacccacuucgucuccgaacaggcccccucgaugggagaagcagcccuaguccacuacguugaccccgacaccaacagaaaccucggcgaauucaaacucuaccccgaaggcuucauaaccugcguucccaauggcaccggcccccaacaacucccccucaacggagucuucguuuucgcaucuugggucucacgcuucuaccagcucaaaccaguaggcacugcauccagugccagauga

SEQ ID NO: 39298 - RNA, 1611 nt, Artificial Sequence
  derived and/or modified sequence opt11 from VP1__Norovirus_and/or_Norovirus-like__AF414406
augaugauggccuccaaagacgcaucccccuccgccgacggcgccaacggagccggccaacuuguccccgaggucaacaacgcagaaccccucccccuugacccagucgccggagcaucaaccgcccucgccacagcaggucaaguuaacaugaucgacccuuggaucuucaacaacuucguccaagcuccccaaggcgaguucacaauauccccaaacaacacccccggcgauauccucuuugaucuccagcucggcccacaccucaacccuuuccuugcccaccuaucccaaauguacaacggauggguagguaacaugcgaguucgcguuauccucgcuggaaaugcauucaccgccggaaaagucaucgucugcugcgucccucccgguuuccaaucccgaacccuauccauagcccaagccacacucuuuccccauauaaucgcugauguccgcacccuagaacccaucgaaauuccccucgaagauguacgcaacacccucuaccacaccaacgauaaccaaccuacaaugagacuacucugcaugcuguacacaccccuacguacaggcggaggcuccggcgggaccgacgccuuugucgucgcaggccguguacuaaccugccccuccucugacuuuaacuuccucuuucucgucccucccaccguagaacagaaaacccgucccuucuccguacccaacaucccccuccaacuccucuccaacagccgcguccccaaccucauccaaucaaugguccccucucccgaccaagcccaaaacguccaauuccaaaauggccgcugcaccaccgacggccaacuccucgguacaacccccgucucagucucccaaauccucaaauuccgcggcaaagucuccgcaggaucccgcgucaucaaccucaccgaacucgacggaucaccuuuccucgccuucgaagcccccgcacccacaggcuuuccugaccuaggcaccagcgauuggcacgucgaaaugucccucaacuccaacucccaaucauccggaaaccccauacuacuccgagacauccaaccaaacuccuccgauuuuguaccacaccucggcuccguagccguaaccaccgccauugacgucgccggcgacuacacaggaaccauacaauggacaucccagcccuccaacgucacacccguccccgacguaaacuucuggaccauaccccaauacggcuccaaccucgcagaagccucacaacucgcacccgucgucuacccacccggcuucggcgaagccaucguauacuucaugucacccaucccgggcccaaacacagcccacaaaccaaaccucguaccacgccuccucccccaagaguucgucacacacuucguuuccgaacaagcacccaguaugggagaagccgcccuaguccacuacgucgaccccgauaccaaccgcaaccuaggugaguucaaacucuaccccgaaggcuucguuacuugcaugcccaacggcaccggcccccaacaacucccucucaacgguguauucgucuucgcauccugggucucucgauuuuaucagcucaaaccaguaggcaccgccuccucagcccgauaa

SEQ ID NO: 39299 - RNA, 1611 nt, Artificial Sequence
  derived and/or modified sequence opt11 from VP1__Norovirus_and/or_Norovirus-like__AB039774
augaugauggccucaaaagacgccacacccuccgccgauggcgccaacggugccggccaacucguaccggaaguaaauaacgccgaaccccuaccacuagaccccgucgcuggcgcaucaaccgcccuugccaccgcaggccaagucaacaugaucgaccccuggaucuucaacaauuucguacaagcaccccaaggcgaguucaccaucucccccaacaacacccccggagacauccucuucgaccuccaacuuggcccccaccugaacccauuccuugcccaccuaagccaaauguacaacggaugggucggcaacaugcgcgugcgcgucauccuagccggcaacgcauucacagcaggcaaagucaucauaugcugugucccucccggcuuccaaucccgcacccucuccauagcccaagccacccucuuuccccacguuauugccgacguccgcacucuagaaccccuagaaauaccccuugaagacguacgcaacacccuguaucacaacaacgacucacaacccaccaugagacuccucuguaugcucuacacaccccuacgcaccggcggcggcuccgggggcaccgaugccuucgucgucgccggccgcguccucaccugucccagccccgacuucaacuuucucuuccucgucccaccgaccguagaacagaaaacccgcccauucucugucccgaacauaccucuccaaaaccucucgaacucacgcguccccucccucauccaaucgaugguacucuccaacgaccacgcccaaaccguacaauuccagaauggccgcuguaccaccgacggccaccuccuaggcaccacccccgucuccgccggucaacuaaugaaauucagaggaaaagucaccucaggauccaaaguccucaaccucaccgaacucgacggcuccccuuucuuagcauucgaagcgcccgcccccgccggcuuuccagacuuagguaaaugcgacuggcacgucgaaaugucccuauaccaagacaacaaccacgccgacccuaucguccuacacgcaaucgaacccaacagcucaucuuucgugccucaccugggcucugucucguuuaaggagaacgucaacguugccggcgauuacgucugcaccauacaauacaccuccccuccauccgacccccacaaucccaaugcugacgucgacuucugguccaucccagacuacggcuccaaccucgcagaagccucccaacuagcccccguuguauacccucccggcuucggcgaagccauagucuacuucaugucccgcguacccggcuggaaccgcaccaaccgccucaaccucguccccugccuacucccccaagaguucaucggccauuucguauccgaacaagccccagcuaucggcgaagcagcccuucuccacuaugucgacccugacacaaaccggaaccucggcgaguucaaacucuacccugaaggcuucauaaccugcguccccaacggcacaggcccacaacagcucccccuaaacggugucuucgucuucucuucaugggucuccagauucuaccaacucaaacccguaggcaccgccucccucgcccgauaa

SEQ ID NO: 39300 - RNA, 1611 nt, Artificial Sequence
  derived and/or modified sequence opt11 from VP1__Norovirus_and/or_Norovirus-like__KP064095
auggcaucuaaagacgcaccccaaucggccgacggcgccuccggcgccggacaacucguccccgaaguuaacacagccgacccccuccccauggaacccguugccggacccaccaccgccgucgccacugccggucaaguaaacaugauagaucccuggaucgucaauaacuucguccaauccccacaaggugaauuuaccaucucccccaacaacacccccggcgacauacuauucgaccuccaacuuggcccacaccuuaaccccuucuugucccaccucucccaaauguacaacggcugggucggcaacaugcgcguacgcauccuccuagccgguaacgccuucagcgccggaaaaaucauagucugcugcguaccucccggcuucacauccuccucacuuaccaucgcccaagccacucuuuucccccaugucauagccgacguccgcacccuagaacccaucgaaaugccccucgaagacguccguaacguucucuaccacaccaacgacaaccaaccgaccaugcgccuaguaugcaugcucuacacuccccuacgaaccggcggaggcuccggcaacagcgacuccuucgucgucgccggccgcguacucacagccccaagcucagauuucucauuccuauuccuuguacccccgacaauagaacagaaaacacgcgcauucaccguccccaacaucccccuccaaacacuaucgaacucacgcuuccccucucucauacaagggaugauucuaucacccgaugccucccaagucguacaauuccaaaacggccgcugccuaauagacggccaacuacucggcaccacccccgccacaucaggccaacuauuccgaguacgcggaaaaaucaaccaaggcgcccgaacccucaaccuaacagaaguagacggaaaacccuucauggccuucgacucacccgcccccgucggauucccagacuucgguaaaugcgacuggcacaugagaauauccaaaacacccaacaacaccucgucaggcgaccccaugagauccgucucaguccaaacaaacguccaaggauucguaccccaucucggaagcauccaauucgacgaagucuucaaccaccccacaggcgacuacaucggcaccaucgaauggaucagccaacccucaacaccacccggaacugacaucaaccucugggaaauacccgacuacggauccucacuuucccaggccgccaaccucgccccacccguuuucccgcccggcuucggcgaagcucuggucuacuucguguccgccuuccccggccccaacaaccgcucagcacccaacgacgucccgugccuccucccccaagaauacauaacucacuucgucagcgaacaagcgccaaccaugggagacgccgcacuacuccacuacgucgaccccgauaccaaccgcaaccucggcgaguucaaauuauaccccggaggcuaccuaaccugcguacccaacggcgucggcgccggaccccaacaacuaccacuaaauggcgucuuccucuuuguuagcugggucucccgcuucuaccaacugaagcccgucggaaccgccucgaccgcccgcuaa

SEQ ID NO: 39301 - RNA, 1608 nt, Artificial Sequence
  derived and/or modified sequence opt11 from VP1__Norovirus_and/or_Norovirus-like__AB045603
augaaaauggcuuccuccgacgcagcccccuccaacgacggcgccgccggacucgucccagaagccaacaacgaaaccauggcacuagaacccgucgccggagcaucuauagccgcaccccucacaggacaaaacaauauaauagaccccuggauccgacucaacuucguccaagccccuaacggugaguucacagucuccccacgcaacucccccggcgaaguccuucucaaccucgaacucggccccgaacuuaauccauaccucgcccaccuaucacgcauguacaacggcuacgcaggcggcguagaaguacaaguccuccuagcuggcaacgcauucaccgccggcaaacucguauucgcagcugugccaccccacuucccccucgaaaauaucucacccggccaaauaacgauguucccccacgucauaauugaugucagaacccuagaaccuguacuacucccacuccccgacguccgaaauaacuucuuccacuacaaccagcaaaacgaacccagaaugcgccucguagccaugcucuauacaccccuaagaucaaacggcuccggagacgacgucuucaccgucagcugccgaguccuaacccgccccuccccagacuucgacuucaacuaccucgucccaccaaccguugaauccaaaacaaaaccuuucaccuuacccauccucaccauaggcgaacugacgaacucccgcuucccaguccccaucgacgaacuauacaccucacccaacgaaucccuugugguucaaccccaaaacggccgcugcgcauuagacggugaacugcaagguaccacccaacuccucccaaccgcgauaugcuccuuccgcggccguauuaaccaaaaaguuuccggcgaaaaccacguuuggaacaugcaaguaaccaacauaaacggaacgccguucgauccuaccgaagacguucccgccccacucggcacucccgacuucucuggcaaacucuucgggguccuaucacaacgcgaccacgacaacgcaugccgaucacacgacgcagucauagccaccaauucagccaaauucaccccaaaacucggcgccauccaaaucgggaccugggaagaagacgacguccacaucaaccaacccacaaaauucaccccggucggccucuucgaaaacgaaggauucaaucaauggacccucccaaauuacuccggcgcacucacccucaacaugggacucgcacccccugucgcccccaccuuccccggcgagcaaauacucuucuuccguucccacaucccucuaaaaggaggggucgccgacccagugaucgacugccuucuaccacaagaauggauacaacaccuauaccaggaauccgcccccagccaaagcgacgucgcucucauccgcuucacuaaccccgacacaggccgcguccucuucgaagccaaacuccacagguccggcuacaucaccguagccaacaccgguucgcgucccauugucguccccgccaacggcuacuuccgcuuugacagcuggguaaaccaguucuacucacuugcccccaugggcaccggaaacggccgccgccgcguacaauag

SEQ ID NO: 39302 - RNA, 1608 nt, Artificial Sequence
  derived and/or modified sequence opt11 from VP1__Norovirus_and/or_Norovirus-like__AF397905
augaaaauggcaucaucagaugccgccccauccaacgacggcgccgccggacucguccccgaagcaaacaacgaaaccauggcccucgaacccgucgcaggcgcauccauugccgcaccccucaccggccaaaauaauauuaucgaccccuggauccgccuaaacuucguccaagcccccaacggagaguucacugucagcccacggaacucccccggagaaguccuccucaaccuagaacucgguccagaacuaaacccauaucuugcccaucugucccgaauguauaacggauacgccggcggugucgaaguccaaguccuuuuagccggaaacgccuucaccgccggcaaacuugucuucgccgcagucccaccacacuucccacucgaaaacauaucaccgggucaaauaacaauguucccccacgucaucauagacguccguacccucgaacccguucuacuaccccucccugacguacgcaacaacuucuuccacuacaaccagcaaaacgaaccccgcaugcgacucguagccaugcucuacacaccccuccgcuccaacggcuccggugacgaugucuucaccgucucuugccgaguccucacccgacccucgcccgacuucgacuuuaacuaccucguaccucccaccgucgaauccaagaccaaacccuucacacuccccauccuaacaaucggugaacucaccaacucccgauucccagucccuaucgacgaacucuacaccucucccaacgaaucccucgucguccagccccaaaacggccgaugcgcccucgacggcgaacuacaagguaccacacaacuccuccccaccgcaaucugcucauuccgcggccgcauaaaccaaaaagucucaggagaaaaccacgucuggaacaugcaagucaccaacaucaacggcacacccuucgaccccaccgaagacguaccagcuccccucggcacccccgacuucucgggcaaacucuucggcguacucucccaacgcgaccacgacaaugccugccgcucacaugacgccguaaucgccacaaacuccgccaaauucacacccaaacuaggcgcaauccagaucggaacaugggaacaagaugacguccacaucaaccaacccaccaaauucacucccguaggccucuucgaaaacgaaggauuuaaccaauggacccucccuaacuacuccggugcacuaacacucaacaugggacuugcaccucccgucgcccccaccuuccccggcgaacaaauauuauucuuccgaucccacauaccucuuaaaggaggcguagccgaccccgucauagacugucuacucccucaagaauggauacaacaccucuaccaagaauccgcaccaucucaauccgacguugcacucauccgauucaccaaccccgacacuggccgcguccucuucgaagccaaacuacaccgcuccgguuacaucaccguugcaaacacaggcucccgccccaucgucguaccagccaacgguuacuuccgcuucgacucauggguaaaccaauucuacucucuagcacccaugggaaccggcaacggaagacgccgcguucaauaa

SEQ ID NO: 39303 - RNA, 1608 nt, Artificial Sequence
  derived and/or modified sequence opt11 from VP1__Norovirus_and/or_Norovirus-like__AF414420
augaaaauggccucauccgacgcagcccccucaaacgacggcgcggcaggccucguacccgaagccaacaacgaaacuauggcccuagaacccguugccggcgccuccauagccgcgcccuugaccggccaaaacaacauuaucgaccccuggauucgucuuaacuucguacaagccccuaacggcgaguucaccguaucuccacgcaacucccccggcgaaguacuacugaaccuagaacucggccccgaacucaauccauaccucgcccaccucucccguauguacaacggcuacgccggaggcgucgaaguacaaguccuucuagccggaaacgccuucaccgccggcaaacucguauucgccgccgugccaccccacuucccccuagaaaacaucucccccggccaaaucgcuauguucccccaugucauaauugauguacguacacucgaacccguucuccucccccuaccggacguacgcaacaacuucuuccacuacaaccaacaaaacgaaccccgaaugcgucuuguagccaugcuauacacaccccuccgcuccaauggcucgggagacgacguauucaccgucucaugccgaguccuaacacgccccucucccgacuuugacuucaacuaccuugucccacccacaguagaaucaaaaacaaaacccuucacacugcccauccucaccaucggugaacucaccaacucacgcuuccccgucccaauagacgaacucuacaccucccccaacgaaagccuaguaguucaaccccaaaacggccgcugcguucuagacggugaacuacaaggaacaacccaacuacuacccacugccauaugcucauuuaggggccgaauaaaccaaaaagucuccggcgaaaaccacguauggaacaugcaagucaccaauaucaacggcacccccuucgaccccacagaagaugucccugcaccccuaggcacucccgacuucuccggcaaacucuucggaguccuaucacaacgcgaccacgacaacgcaugccgcucacacgacgccgucaucgccaccaacuccgcaaaauuuacccccaaacuaggcgccauacaaaucggaaccugggaagaagacgacguccacauuaaccaaccuacaaaauucacccccgucggucucuucgaaaacgaaggauucaaccaauggacacucccuaacuacuccggcgcccuaacucucaacaugggccuagcucccccaguagcccccaccuuccccggugaacaaaucuuauucuuccgcucgcacaucccccucaaaggcggagucgccgaccccgucaucgacugccuccucccgcaagaauggauacaacaccuuuaccaagaaucugcccccucacaaucagacguagcccuaaucagauucacaaaccccgacacaggacgaguccucuucgaagccaaacuccaccgcagcggauacauuaccguugcuaauacagguucccgacccaucguugucccagcaaacggcuacuuccgcuucgacuccugggucaaccaauucuacucacuagcacccaugggcacaggaaacggccgucgacgcguccaauaa

SEQ ID NO: 39304 - RNA, 1608 nt, Artificial Sequence
  derived and/or modified sequence opt11 from VP1__Norovirus_and/or_Norovirus-like__AF427119
augaaaauggccucauccgacgccgcaccuucaaacgacggagcagcaggacuuguacccgaagcaaacaacgaaacaauggcccuagaaccagucgcgggagccuccauagcugcaccccuaaccggccaaaacaacguaaucgaccccuggauccgccucaauuucguacaagccccaaacggagaauuuaccguauccccacgaaacuccccaggagaaauccuauuaaaccucgaacucggaccagaacuaaaucccuaccuagcccaccucucccgcauguacaacgguuacgccgguggggucgaaguccaaguccuucucgcaggcaacgccuucaccgccggaaagcuaguuuucgcagcagucccaccccacuucccccucgaaaacaucagccccggccaaaucaccauguucccccacgucauaaucgacguucgaacccuugaacccguccuccucccccuaccugauguccgaaacucauucuuccacuacaaccagcaaaacgaaccccgaaugcgacucgucgcaaugcucuacacaccccuccgcuccaacggcuccggcgacgacgucuucacagucuccugccgcguccucacccgcccaucaccagacuucgacuucaacuaccucguucccccaaccgucgaaucaaaaacaaaaccauucacccucccaauacuuaccaucggugaacucacaaauucccgcuuccccgcccccauugacgaacucuacaccucccccaacgaaucgcucguaguccaaccccaaaacggccgaugcgcccucgauggcgaacuccaagggaccacccaacuccuccccaccgccaucugcuccuuccgcggacgcaucaaccaaaaaguauccggcgaaaaccacaucuggaacaugcaaguuacgaacaccaacggcacccccuucgaccccacagaagacguccccgccccgcuaggaacaccagacuucuccggacgucuguucggcguccuaucccaacgggaucacgacaacgcgugccgcucccacgacgcaguaaucgcaacgaacagcgccaaauucacacccaaacucggcgccauucaaaucggcaccugggaagaagacgacguucacauaaaccaacccaccaaguucacccccgucggccucuucgaacacggcgauuucaaccaauggacacuccccaacuacagcggcgcgcucacccuaaacaugggucuugccccacccgucgcucccaccuuccccggcgaacaaauccucuuuuucagaucccacauaccacuaaaaggcggcgucgcagaccccguaauagauuguuuacuaccccaggaauggauccaacaccuuuaccaagaaagcgcccccucccagagcgacguagcccuaauccgauucacaaacccugacaccggccgcguacucuuugaagcaaaacuucaccgaucuggcuacauaaccguggcaaacaccggcucacgccccaucgucgucccagccaacggauacuuccguuucgacucaugggucaaccaauucuauucccucgccccaaugggcaccggcaacggccgacgucgcguacaauaa

SEQ ID NO: 39305 - RNA, 1608 nt, Artificial Sequence
  derived and/or modified sequence opt11 from VP1__Norovirus_and/or_Norovirus-like__AB044366
augaaaauggccucauccgacgcugcccccucuaacgacggcgccgccggccuagucccggaagccaauaacgaaacaauggcccucgagccagucgcaggagccucuaucgcugccccacucacaggccagaacaacauaauagaccccuggauccgucuaaacuucguacaagcccccaacggcgaguucacugucuccccgcgcaacucacccggcgaaguacuccuuaaccuagaacucggccccgaacucaaccccuaccucgcccaccuuucuagaauguacaacggcuacgccggaggcgucgaaguacaaguacuacucgcaggcaacgccuucaccgccggcaagcuagucuucgcugccgucccuccccacuucccccuagaaaacaucucacccggccaaaucaccauguuuccccacguaaucauagauguacguacacuugagcccguacuccucccccuaccagacguacgcaauaacuucuuccacuacaaccaacaaaacgaaccacgaaugcgccucgucgcgaugcucuacaccccacuacgauccaacggcucuggcgaugacgucuucaccgucuccugccguguacucacacgacccucccccgacuucgacuucaacuaccuugucccacccaccguugaaucaaaaaccaaacccuucacccuacccauucucacaaucggcgaacucacgaacucccgcuuccccguccccaucgacgaacuuuacaccucccccaacgaaucccuagucguccaaccccagaacggccgcugcgcccuagacggcgaacuccaaggcaccacacaacuacuccccacagcaaucugcuccuuucgcggccgaauaaaccaaaaagucucuggcgaaaaccacguauggaacaugcaagucacaaacauaaacggcacccccuucgaccccacagaggacguacccgcgccccuaggcacacccgacuucucaggaaagcuauucgggguccucagccaacgcgaccaugacaacgccugccgaucacacgaugccgucaucgccaccaacagcgcaaaauucacacccaaacucggagccauccaaauuggcaccugggaagaagacgacguccacaucaaccaacccaccaaauucacccccgucggccucuucgaggacggcggcuucaaccaauggacccucccaaacuacuccggcgcacucacccuaaacaugggacuagcaccacccgucgcacccaccuuccccggcgaacaaauucucuucuuccgcucccacaucccccucaaaggcggcgucgccgaccccguuauugacugccuccuaccccaagaauggauccaacaccucuaccaagaaagcgcuccaucccaauccgaugucgcucucauacgcuucacuaacccagauaccggccgcguccucuucgaagccaaacuacacagauccggauacauaacagucgcgaacacaggcucacgcccuaucgucgucccagccaacgguuacuuccgcuucgacuccugggucaaccaauucuacucccuagcaccgaugggcaccggcaacggccgccgacgcguccaauaa

SEQ ID NO: 39306 - RNA, 1608 nt, Artificial Sequence
  derived and/or modified sequence opt11 from VP1__Norovirus_and/or_Norovirus-like__AB032758
augaaaauggccucuaacgacgccgccccaagcaacgacggcgccgccggccucgugcccgaagcaaacaacgaaacaauggcacucgaacccguagccggcgccuccaucgccgcaccacucaccggccaaaacaacaucaucgacccauggauccgccucaacuucguccaagcaccuaauggcgaauuuaccgucucuccccguaacucccccggcgaaguauugcuaaaccucgaacuaggccccgaacuuaaccccuaccucgcccaucuauccagaauguacaacggauaugccggcggcgucgaaguccagguccuucuugccggaaacgccuucaccgccggcaaacucgucuucgccgccguuccaccacacuucccccuagaaaauaucuccccaggacaaauaacaauguucccacacguaaucaucgacguccggacccuagaacccguccuccuaccacuccccgacguucgcaacaacuucuuccacuacaaccaacaaaacgaaccccgcaugcgacuugucgcaaugcucuacacuccccuccgauccaauggcucaggagacgacguauucacagucuccugccgcguacuaacccgacccucuccagacuucgacuucaacuaccucgucccucccacccucgaauccaaaacgaaaccuuucacccuccccauucuaaccaucggcgaacuaacaaacucccgauucccugucccaauagaugaacucuacaccucgccaaacgaaucucuagucguucaaccccagaacggccgcugcgcucuagacggagaacuccaaggcacgacccaacuccuacccacagcaauuugcucuuuccgcggccgcaucaaccaaaaagucuccggcgaaaaccacgucuggaacaugcaaguaaccaacaucaauggcaccccauucgaccccacgggcgacguuccagcuccccucggaacccccgacuucucaggaaaacucuucggcguccucucccagcgcgaccacgacaaugccugccgaucccaugaugccguaaucgcaaccaacuccgcgaaauucaccccaaaacucggagccauccaaauaggaacaugggaagaagacgacguccacauuaaccaacccaccaaauucacccccguaggucuauucgaaaacgaaggauucaaccaauggacauuacccaacuacuccggcgcccuaacucucaacaugggacucgccccacccguggcucccaccuuccccggugaacaaauccuauucuuccggagccacaucccccuaaaaggcggcguugccgacccaguuaucgacugucuccuaccacaagaauggauccaacaccucuaccaagaaucggcccccucccaguccgacguagcccuaauccgauuuaccaaccccgacaccggccgaguacucuucgaagccaaacuacaccgcucaggcuacaucaccguugcaaacacaggaucccgucccaucgucgucccagccaacggcuacuuccgcuucgacacaugggucaaccaauuuuacucccuagcccccaugggaacuggaaacggacgccgccggguucaauaa

SEQ ID NO: 39307 - RNA, 1608 nt, Artificial Sequence
  derived and/or modified sequence opt11 from VP1__Norovirus_and/or_Norovirus-like__AB039775
augaagauggccuccuccgacgccgcaccguccaacgacggcgccgcaggccugguccccgaagccaacaacgaaacaauggcucuagaacccguagccggcgcauccauagcagccccacuuaccggccagaacaacaucauagauccauggauccgacuaaauuuuguccaagcacccaacggcgaguucacagucucuccccgcaacucaccaggagaaguacucuuaaaccucgaacuuggccccgaacucaacccauaccucgcacaccugucacgcauguacaacggauacgcaggcgggguugaaguccaaguacuccucgcagguaacgcauucacagccggcaagcuagucuucgccgcagucccaccccacuucccccuggaaaauaucucccccggccaaaucaccauguucccccaugucaucaucgacguccgaacccucgaacccguccuccuaccccuccccgacguaagaaacaacuucuuccacuacaaccaacagaacgaaccccgcaugagacucgucgccaugcuauacaccccacuucgaucuaacggauccggcgacgauguuuucacagucucaugccgcguacuaacccgcccaucccccgacuucgacuucaacuaccucguaccacccacagucgaauccaaaaccaaacccuucacccuccccacccucaccaucggcgaacucacuaacucccgcuuccccgucccaaucgacgaacucuacaccagcccaaacgaaucccuugucguccaaccacaaaacggacgcugcgcacucgacggagaacuuaggggcaccacgcaacuccucccaacugccaucugccccuucagaggcagaaucaaccaaaaagucagcggcgaaaaccacguauggaacaugcaagugacaaacaucaauggaacucccuucgacccaaccgaagacguacccgcaccccucggaaccccagacuucucaggcaaacuguucggaguccucucucaacgagaucacgacaacgccugccgaucccacgacgccgucauagccaccaacuccgccaaauucacccccaaacuuggagccauccaaauuggaaccugggaagaagacgacguacacauaaaccaacccacaaaauucaccccugucggccucuucgaaaacgaaggauucaaucaguggacccuacccaacuauuccggagcccuaacccuaaacaugggucuggcaccaccagucgcccccacuuuccccggagaacgcauccucuucuuuagaagccacaucccccucaaaggcggcgucgccgacccugucaucgauugccuacuccaccaagaauggauacaacaccuauaccaagaaucagccccaucccagucggacgucgcccuaauacgcuucacaaaccccgacacaggccgcguccucuucgaagcaaaacuccaccgcuccggcuacaucaccguagcaaacacuggcucccgccccauaguaguacccgccaacggcuacuuucgcuucgacuccugggucaaccaauucuacucccucgccccaaugggcaccggcaauggccgccgccgaguucaauaa

SEQ ID NO: 39308 - RNA, 1608 nt, Artificial Sequence
  derived and/or modified sequence opt11 from VP1__Norovirus_and/or_Norovirus-like__AF414418
augaagauggcaucuaaugaugccgcccccuccaacgacggagcggccggccuaguccccgaaguaaacaacgaaaccauggcccuugaaccagucgccggcgccuccauagcagccccucucaccggccaaaacaacguaaucgaccccuggauccgcaugaacuucguccaagccccaaacggcgaauuuaccgucuccccacgcaauucaccaggcgaaauccuccuuaacuuagaacuagguccuggccuaaacccauuccucgcccaccuaucucguauguacaacggcuacgccggcggcgucgaaguccaaguacuacucgcaggaaacgccuucaccgcgggcaaacucgucuucgcagccauacccccucacuuccccaucgaaaaccuaucccccggccagaucaccauguucccucaugucaucauagacguacgaacccuagaacccguccuccuaccacuacccgacguacgcaauaacuucuuccacuacaaccaagaacccgaaccucgcaugcgucuaguagccaugcucuacacaccccucagauccaacggcucaggcgacgacgucuucaccgucucaugccguguacuaacccgacccucccccgacuucgacuucaacuaccucguucccccuaccgucgaaucaaaaaccaaacccuucacccuacccauccucacgauaggcgaacucuccaacucgcgcuuccccgcccccaucgacgaacucuacacuucccccaacgaaggccucgucguccaaccacaaaacggacgaucgacacucgacggagaacuccucggaacaacccagcuaguccccucaaacaucugcucccuacgaggacguaucaacgcccaccucuccgacaaucaacaccgcuggaacaugcaagucacaaacgccaacgguaccccuuucgaccccacagaagacguacccgcaccccucggcacccccgacuuccuagccaacaucuauggagucaccucacaacgcaacccagacaauaccugccgagcccacgacggaauccucgccacaugguccccaaaauucacacccaaacucggcuccguaguccucggcaccugggaagaccgagacuuugauauaaaccaacccacccgauucaccccuguagggcucuacgacacagaccacuucaaccaaugggcccuuccuaacuauucuggcgcccucacacuaaacaugaaccuagcacccuccgucgccccacucuuccccggcgaacaacuacucuucuuccgcucccauaucccccuaaaaggaggcaccucaaacggcgccaucgacugccuccucccacaagaauggguacaacacuucuaccaagaauccgcacccagcuccaccgacguugcccucauacgcuacaccaacccagacaccggccguguccucuucgaagcuaaacuacaccgccaaggcuucaucaccguagcaaacuccggaucccgaccuaucgucgucccuccaaacggcuacuucagauucgacucaugggucaaucaauucuacucccuagcccccaugggaacaggcaacggccgacgucgcguccaauaa

SEQ ID NO: 39309 - RNA, 1608 nt, Artificial Sequence
  derived and/or modified sequence opt11 from VP1__Norovirus_and/or_Norovirus-like__AF425769
augaaaauggccuccaacgacgccgcccccucaaacgacggggccgccggccuugucccagaaguaaacaacgaaacaauggcccuagaacccgucgcaggcgccucaaucgccgcaccccuuaccggacaaaacaacgucaucgaccccuggaucagaaugaauuucguccaagcacccaacggcgaguucaccguuagccccagaaacucccccggcgaaauccuccucaaccuagaacucgguccugaacucaacccauuccucgcccaccucucccgcauguacaacggauacgcuggcggcguagaaguccaaguccuacucgcuggaaacgccuucaccgcaggcaaacucguguucgccgcaauacccccacacuuccccaucgaaaaccuaucccccggccaaaucacaauguuuccccaugucaucauagacguccgcacccucgaacccguucugcucccccuccccgacgucagaaauaacuucuuccacuacaaccaagaacccgaaccccgcaugcgucuaguagccaugcuuuacacaccccuccgauccaacggcagcggcgacgacguauucaccgucuccugccguguccucaccagaccauccccagauuucgacuucaacuaucucgucccacccaccguugaaaguaaaaccaaacccuuuacccuccccauucucaccaucggugaacucucaaacucucgcuuuccugcccccaucgaugaacucuacaccucuccaaacgaaggccuagucguccaaccacaaaacggccguucuacccucgacggagaacuacuagguaccacccaacucguacccucaaacaucugcucacuccgcggccggaucaacgcccaccuaagcgacaaccaacaccgguggaacaugcaagucaccaacgucaacggcacucccuucgacccaaccgaagacgucccagcuccccucggcacuccagacuuccucgccaacaucuacggcgucacaucccaaagaaaccccgacaauaccugccgugcacacgacggaauccucgccacauggucacccaaauucacccccaaacuuggcucagucguacucggcaccugggaagaccgcgacuucgacauaaaccagcccacccgcuucacccccgucggucucuacgacaccgaccacuucaaccaaugggcccucccuaacuacucuggcgcccucacccuaaacaugaacuuagcccccuccgucgccccacucuucccuggcgaacaacuauuauucuuccgaucgcacaucccccucaaaggcggaaccagcaauggggccaucgacugucuacucccccaagaauggguccaacacuucuaccaagaaucagcacccuccucaaccgacgucgcccuaauccgcuacacuaaccccgacaccgggcgaguccucuucgaagcagaacuacaccgccaaggcuuuaucacugucgcaaacccuggcucccgccccaucgucguaccucccaacggauacuuccgauucgacucauggguuaaccaguucuacucccucgccccaaugggcaccggaaauggccgccgacgaguacaauaa

SEQ ID NO: 39310 - RNA, 1608 nt, Artificial Sequence
  derived and/or modified sequence opt11 from VP1__Norovirus_and/or_Norovirus-like__AF414421
augaaaauggccucuaaugacgcagcccccucgaacgacggcgccgccggucucguccccgaaguuaacaacgaaaccauggcucucgaacccguugcaggagccuccauagccgcaccccucacaggccaaaacaacgucauagaccccuggauccgcaugaacuucguccaggcccccaacggcgaguucaccguuucaccccgcaauucccccggcgaaaucuuacuaaaucuugaacucggccccgaacuaaaccccuucuuagcacaccuaucccgaauguauaacggcuacgccgguggcgucgaaguccaaguacuccucgccggaaacgcuuucacagccggcaaacucgucuucgccgccauaccaccccacuuccccaucgaaaaccucucccccggacagaucaccauguucccucacgucaucaucgacguccgcacucucgaacccguucuacugccccucccugacguccgcaacaauuucuuccacuacaaccaagaacccgaaccccgaaugcgccuagucgccaugcucuacacaccucuccgcuccaacggcagcggcgaugacgucuucaccgucucaugccgcguucucacucgccccuccccagacuucgacuucaacuaccuaguacccccaaccgucgaauccaaaaccaaacccuucacccuaccaauacucaccaucggagaacucuccaacucucgcuuuccagcgccuaucgacgaacucuauaccucgccaaacgaaggccucgucguccaaccccaaaacggacgccccacacucgacggcgaacuccuaggcaccacucaacugguaccuuccaacaucugcucccuacguggccgcaucaacgcacaccuaagcgacaaccaacaucguuggaacaugcaagucaccaacgccaacggcacacccuucgaucccaccgaagacgcccccgcaccccuuggcaccccagacuuccucgcaaacauauacggggucaccagccaacgcaaccccgacaauaccugccgcgcacacgaugguauccucgccacuuggucccccaaauucacaccaaaacucggaucaguuguccucggcacuugggaagaccgcgacuucgacaucaaccaacccacucgcuucacucccguaggccucuacgacacugaucacuucaaucaaugggcccuaccaaacuacucaggcgcccuuacccucaauaugaaucucgcccccucugucgcuccacucuuccccggcgaacaacucuuauucuuuagaucccacaucccacucaaaggcggcaccucuaacggcgccauagauugucuccucccccaagaauggguacaacacuucuaccaagaauccgcccccucaucaacagacgucgcccucauccgcuacacuaaccccgacaccggccgcguccuauucgaggccaaacuucaccgacagggcuucaucaccgucgccaacucuggaucacgccccaucguagucccacccaacgguuacuuccgauucgacuccugggucaaccaauucuacucccucgcccccauggguacagguaacggcagacgacgcguccaguaa

SEQ ID NO: 39311 - RNA, 1608 nt, Artificial Sequence
  derived and/or modified sequence opt11 from VP1__Norovirus_and/or_Norovirus-like__AF414416
augaaaauggccuccaacgacgccgcccccuccaacgacggcgccgccggccuuguccccgaagucaacaacgaaaccauggcgcuugaacccgucgccggcgccuccaucgccgcaccccuaaccggccaaaacaacgucaucgaccccuggauccgcaugaacuucguccaagcccccaauggcgaguucacaguaucaccaagaaacucuccaggagaaauccuacuaaaucuagaacucggccccgaacucaaccccuuccuagcccaccuuucucgcauguacaacggcuacgccggcggcgucgaaguucaaguccuccuagccgguaaugccuuuacagccggaaagcuaguauucgccgccaucccaccccacuuccccaucggaaaccucagccccggacaaaucgccauguucccccacgucaucaucgacguccgaacccucgaacccguacuccucccacuccccgauguccgcaacaacuucuuccauuacaaccaagaacccgaaccucguaugcgucucguagccaugcucuacacaccccuccgauccaacggaucaggcgacgaugucuucaccgucuccugccgcguccuuacccgaccaucacccgacuucgacuucaacuaccuagucccucccaccgucgaaagcaaaaccaaacccuuuacccucccaauccuuaccaucggcgaacucuccaacucucgcuucccuguacccaucgacgaacucuacaccucacccaacgaaggccuagucguccaaccccaaaacggccgauccacccucgacggagaauuacuaggcacaacccaacucguccccuccaacaucuguagccuucgcggacgcaucaacgcccaccucuccgacaaccaacaccgcuggaacaugcaagucaccaacgccaacggcaccccauucgaccccaccgaagauguccccgccccauuaggcacucccgacuuccuagccaauauauacggcguaacgucccaacgaaacccagauaacacaugccgagcacacgaugguauccucgccaccuggagccccaaauucacaccaaaacucggaagcgucguccucggcaccugggaagaccgcgacuucgacauaaaccaacccacccgcuucacacccgucggacucuacgacaccgaccacuucaaucaauggguccuccccuacuacucuggagcccuaacccucaacaugaaccucgcuccaucagucgcaccacucuucccuggcgaacaacuccucuucuuccgaucucacguaccccuaaaagguggcacauccaacggagccaucgacugccuccucccacaagaauggguacaacauuucuaccaagaaucagcccccuccuccaccgacguagcucuaauccgcuacaccaaccccgacacaggccggguccuauucgaagcaaaacuucaccgacaaggcuucauuaccgucgccaacuccggcucccgcccaauugucguacccccaaacggauacuuccgauuugacucaugggucaaucaguuuuacagccucgccccuaugggaacaggaaacggccgacgccggguccaguaa

SEQ ID NO: 39312 - RNA, 1608 nt, Artificial Sequence
  derived and/or modified sequence opt11 from VP1__Norovirus_and/or_Norovirus-like__AF414419
augaaaauggccucaaacgacgccgcccccuccaacgacggagcagccggccuuguacccgaagucaacaacgaaaccauggcccuagaacccguagccggagccuccaucgcagcaccccucaccggccaaaacaacgucaucgaccccuggauccgaaugaacuucguccaagcccccaacggagaguucaccgucuccccgcgaaacagccccggcgaaauacuacucaaucucgagcuuggccccgaacucaaccccuuccucgcccaccucucccgcauguacaacggcuacgccggcggcgucgaaguccaaguccuccuugccggcaacgcauucacagccggcaaacucguauucgccgcaaucccaccccacuuucccaucgaaaaccucucacccggccaaauaacaauguucccccacguuauaauagacguacgcacccucgaacccguccuacucccacuacccgacguccgcaacaacuucuuucacuacaaccaagaaccugaacccagaaugcgccuugucgcaaugcuguacaccccacucagauccaacggaagcggagacgacgucuuuacuguuagcugccgcguccuaacgcgccccagcccagacuucgacuucaacuaccucguuccacccacagucgaaucuaaaaccaagcccuucacccuacugaucuuaaccaucggcgaacuuuccaacucccgcuuccccgcacccaucgacgaacuuuacacuucaccaaaugaaggacucgucguccaaccacaaaacggccgcuccacccucgacggagaacuacuaggcacuacacagcucguacccuccaacaucugcucacuccgcggucguauuaacgcccaccucuccgauaaccaacaccgcuggaauaugcaagucaccaacgccaacggcaccccauucgacccuaccgaagacgucccagccccucuagggacaccagacuuccuugccaacaucuacggcguuacaagccaacgcaaccccgacaacaccugucgcgcacacgacggaauacucgccaccuggucucccaaauuuacccccaagcuaggcucaguuguccucggcacaugggaagaccgcgacuucgacaucaaccaacccgcacgcuucacaccagucggccucuaugacaccgaccacuucaaccaaugggcacuccccaacuacuccggcgcccuaacccuaaacaugaaccucgccccauccguagcaccccuauuccccggcgaacaacuacucuucuucagaucccacauacccuuaaaaggcggcaccucaaacggagccaucgacugccuccuaccacaagaauggguccaacacuucuaccaggaauccgcccccucuucuacagacguagcccucauaagauauaccaaucccgacacagggcgcguccuauucgaagcaaaauuacaccgccaaggcuucauaacagucgccaacuccggcucacgacccaucguagucccucccaacggauacuuccgcuucgacucaugggucaaccaauucuacucacuagcccccaugggcaccgguaauggcagacgacgcguccaauaa

SEQ ID NO: 39313 - RNA, 1608 nt, Artificial Sequence
  derived and/or modified sequence opt11 from VP1__Norovirus_and/or_Norovirus-like__AF425767
augaaaauggccucgaacgacgccgcccccucaaacgacggagccgcaggccuaguacccgaagugaacaacgaaacaauggcccucgaacccguagccggugccucaauagccgcaccccuaacaggccaaaacaacgucaucgaccccuggauacgcaugaacuucguccaagcccccaacggcgaauuuaccguaucuccccguaacucccccggcgaaauccuccucaaccucgaacucggcccagaacugaauccauucuuagcccaucucucacgcauguacaacgguuacgccggcggcguagaaguccaaguucuacucgccggaaacgcauucaccgcuggcaagcuaguauucgcagccaucccaccccacuucccaauagaaaaccuuucccccggccaaaucacaauguucccacacguaaucaucgacguacgaacccucgaacccguacuucuaccccuacccgacguccgcaacaauuucuuccacuacaaucaagaccccgaaccaagaaugcgccuagucgccaugcucuacaccccuuuacgaaguaacggauccggagacgacgucuucacaguauccugccgcguccuuacccgccccucccccgacuucgauuucaacuaccucguacccccaaccgucgaauccaaaacaaaaccauucacccuaccaauacuuacuaucggugaacucuccaacucccgcuucccggcccccauagacgaacuauacaccucccccaacgaaggacucguaguacaaccucaaaacggcggcucaacucucgacggcgaacuccucggaaccacacaacuugucccaucgaacauaugcucccuccgaggacgcauaaacgcccaccucucugacaaccaacaucgcuggaacaugcaagucacaaacgucaacggcacacccuucgacccaaccgaagacguccccgcaccacucggaaccccagauuuccucgccaacaucuacggcaucaccagucaacgaaacccggacaauacaugccgcgcccacgacggcauacucgcaacauggucucccaaauucaccccaaaacuaggcuccgucguccucggcaccugggaagaccgagacuucgacaucaaucaacccacacgcuucacuccagucggccuuuacgacaccgaccacuucaaucaaugggcacuccccaacuacuccggugcccuuacacucaauaugaaccuagcucccucagucgcaccccucuuccccggcgaacaacuucucuucuuccgcucacacaucccccucaaaggcggcacaucaaacggcgccaucgacugccuccuaccccaagaauggguacaacacuuuuaccaagaauccgccccaucaucuacagacgucgcccucaucagguauaccaaccccgacacaggcagaguccucuucgaagcuaaacuccaccgucaaggcuucaucacagucgccaacucaggaucccgcccaauaguagucccaccaaacggauacuuccgcuuugacucauggguaaaccaauucuacagccucgccccaauggguacaggcaacggccgccgccguguccaauaa

SEQ ID NO: 39314 - RNA, 1608 nt, Artificial Sequence
  derived and/or modified sequence opt11 from VP1__Norovirus_and/or_Norovirus-like__DQ093065
augaaaauggccuccaacgacgccgcacccuccaacgacggcgcagccggccuaguacccgaaguaaacaacgaaaugauggcccuagaaccagucgccggcgccucaauagcugccccacucacaggccaaaacaauguuaucgaucccuggauccgaaugaacuucguccaagcacccaacggagaguucacuguauccccacgcaacucccccggagaaauacuccuaaacuuagaacucggccccgaacucaacccauuccuugcccaccucucccgaauguacaacggcuacgccggcggcgucgaaguacaaguccuccucgccggcaacgcauucaccgccgguaaacucguauucgccgccauuccaccccgcuuccccaucgaaaaccucucucccggccaaaucacgauguucccccacgucaucaucgacguccgcacccucgaacccgugcuacuaccccugcccgacguccguaacaacuucuuccacuacaaccaggaaccugaaccacgcaugcgccuagucgccaugcucuacaccccucucagaucaaacggcuccggcgacgacgucuucacagucuccugcagaguccuuacacgcccauccccugacuucgacuucaacuaccucgucccucccacaguagaaucaaaaaccaaacccuucacccuccccauacucacuaucggagagcuuucaaacucccgcuuccccgcccccaucgaugaacucuacacuucccccaacgaaggacucgucguacagccccaaaacggccgcuccacccucgacggagaacugcuagggaccacccagcuggucccuucuaacaucugcucacuccgcggccgcaucaacgcacaccucccugacaaccaacaccgcuggaacaugcaagucaccaacgccaacggcacccccuucgacccaaccgaagacgucccugcaccccucggcacccccgauuuccucgccaacaucuacggcguaacuucccaacgcaacccagacaauaccugccgcgcccacgacggaauccucgcaacauggucacccaaauucacccccaaacuaggcuccguuguucucggaacuugggaagaucgcgacuucgacaucaaccaacccacccgauucacccccguuggacuauacgacaccgaccacuucaaccaaugggcccuuccaaacuacucaggcgcccucacccuaaacaugaaccuagcccccucaguugcuccccucuuccccggcgaacagcuccuauucuuccgcucccacauacccuuaaaaggcgguacguccaacggagccauagacugucuccuaccccaagaauggguccaacauuucuaccaagaaagcgccccauccucaaccgacgucgcccuaauccgcuacaccaaccccgauaccggacgcguccucuucgaagccaagcuccaccgccagggcuuuaucacaguagccaacucagguucacgccccaucguggucccacccaacggcuacuuccgcuucgacagcugggucaaccaauucuacucccucgcacccaugggcacaggcaacggacgacgccgcguccaauag

SEQ ID NO: 39315 - RNA, 1608 nt, Artificial Sequence
  derived and/or modified sequence opt11 from VP1__Norovirus_and/or_Norovirus-like__KJ194507
augaaaauggccucaaacgaugccgcccccuccaacgacggagccgcaggucucguaccugaagucaauaacgaaaccauggccuuagaacccgucgcaggagccuccaucgccgcuccccucaccggucaaaacaacguaauagacccauggauccgcaugaauuucguccaagccccaaacggagaguucaccgucuccccacgcaacuccccaggggaaguacuccucaaccuagaacucggccccgaacuaaaccccuuccuagcccaccucucccgcauguacaacggcuacgccggaggcgucgaaguccaaguccuccucgccggcaacgccuucaccgccgguaaacuugucuucgcugccauacccccacacuucccacucgaaaaccucucccccggccaaauaaccauguucccccacgucauuaucgacguccgaacacucgaacccguacuccuaccccuccccgaugugcgcaauaacuucuuccacuacaaccaacaacccgaaccccgcaugcggcucgucgccaugcucuauacaccccuccguucaaacggcucaggcgacgacgucuucaccgucagcugucgaguccuuaccagaccuucuccggacuucgacuucaauuaccucgucccacccaccgucgaauccaaaaccaagcccuucacccuccccauccucaccaucggagaacucucaaacucccgauuccccguuccaaucgacgaacucuacaccuccccuaacgaagggguugucguccaaccucaaaacggacgcucuacccucgacggagaacuccuaggcaccacucagcuaguucccucuaacaucugcgcccuacgaggccgcaucaacgcccaaguccccgacgaccaccaccaauggaaccuucaaguuaccaacacaaacggcacacccuucgaccccaccgaagacguccccgccccacuaggcaccccagacuuccuagccaacauauacggaguaacaucccaacgaaaccccaauaacacaugccgcgcccacgacggcgucuuagcuaccuggucaccaaaguucacccccaaacucggcuccgucguacucggcacaugggaagaaucagaccuugaccucaaucagcccaccagauucacccccgucggacuuuucaauaccgaccacuucgaucaauggguucucccaaacuauuccggccgcuuaacacucaauaugaaccucgcccccuccguaucgccccucuuccccggcgaacaaauccuauucuuccguucccacauuccccucaaaggaggcacaucagacggcgcuauagacugccuccucccccaagaauggauccaacacuucuaccaagaauccgcccccagcccaaccgacguugcccuaauacgcuacacaaaccccgacacuggccgcguccucuucgaagccaaacuccaccgccaaggauucaucaccgucgccaacuccggcucacgaccgauaguagucccucccaacggcuacuucagauucgacuccugggucaaccaauucuacucacucgcacccaugggcaccggaaacggccgccggcgaguacaauaa

SEQ ID NO: 39316 - RNA, 1608 nt, Artificial Sequence
  derived and/or modified sequence opt11 from VP1__Norovirus_and/or_Norovirus-like__KP064099
augaaaauggcaucaaacgacgccgcccccaguaacgacggcgccgcaggccucguccccgaagucaacaaugaaacuauggcccuugaaccagucgcaggcgcuucuaucgccgcaccccucaccggccagaacaaugucauagacccauggauccgccugaacuucguccaagcccccaacggcgaguucacugucucaccccgcaacuccccaggcgaaguuuuacucaaccucgaacuagguccagaacuaaaccccuaccuugcccaccucagccgcauguacaacggguacgccggcgguguagaaguccaaguacuccucgcuggcaacgcauucaccgccggcaaacucgucuucgccgcaguacccccucacuucccacucgaaaacaucagccccggccaaaucacaauguuuccccaugucaucaucgacguacgaacacuugaacccguccuacucccacucccagacguccgaaacaacuuuuuccauuacaaccaacaaaacgaaccccgcaugagacucgucgccaugcucuacacaccccuccgcuccaacggcucaggcgacgacguauucaccgucagcugccgcguacuaacgcgccccagccccgacuucgacuucaacuaccuagucccacccaccguagaaucaaaaaccaaacccuucaccuuacccauccucaccaucggcgaacucacaaacucaagauucccaguccccauagacgaacuauacacaucacccaacgaaucacucgucguccaaccacaaaacgggcgcugcgcccucgacggcgaacuccaaggcaccacccagcuccuccccacagccaucugcucauuccgcggcagaaucaaccaaaaagucuccggagauaaccacgucuggaacaugcagguaacuaacaucaacggaacucccuucgaccccacagaagacgucccagcaccacuaggaacacccgacuucucaggcaaacucuuuggaguacucucccaaagagaucacgacaacgccugccgaagccacgacgccgucaucgcaaccgacuccgcaaaauucacccccaagcucggugccauacaaauaggaaccugggaagaagacgacguccacauaaaccaaccaaccaaauucacccccguaggccuauucgaacgcgaaggauucaaccaauggacucuacccaacuacuccggcgcacuaacccuaaacaugggccucgcacccccgguagccccaacauuccccggagaacaaauccucuucuucagaucccacauaccucucaaaggcgguguugccgacccagucaucgacugccuucucccccaagaauggauccaacacuuauaccaagaauccgcacccucccaaacugacgucgcacugauccguuucaccaaccccgacaccggacgcguucucuucgaagcaaaacuccacagauccggauacauaacaguugccaacacaggaucccgacccaucguaguaccagcaaacggauauuuucgauucgacuccugggucaaccaauucuacagccuagcccccaugggaaccggaaauggccgacgccguguacaauag

SEQ ID NO: 39317 - RNA, 1608 nt, Artificial Sequence
  derived and/or modified sequence opt11 from VP1__Norovirus_and/or_Norovirus-like__AB303926
augaaaauggcauccaacgacgccacacccuccgacggcuccaccgcaaaccucguccccgaaguaaacaacgaagucauggcacuugaacccguugucggcgccgcaaucgccgcaagaguagccggacaacaaaacgucauagaucccuggaucagaaacaacuucgugcaagccccaggcggcgaguucacaguuucaccccgaaaugcacccggcgaaauccuuugguccgcuccccuuggucccgaccucaaccccuaccuuucacaccuagccagaauguacaacggcuacgccggaggcuucgaaguacaagucauacuagcaggaaacgccuucaccgcaggcaaaaucauuuucgcagccgucccacccaacuuccccacagaaggacuaucccccucacaaguaaccauguucccccacauaaucgucgacguccgccagcuagagccaguccuuauaccacuccccgacguccgcaauaauuucuaccacuacaaccaauccaacgacuccaccaucaaacuaaucgcaaugcuuuacacaccacucagagcaaacaacgccggcgaugaugucuucaccguaucaugccgcguccuaacacgacccagcccugacuucgauuucauauuucucgucccacccacagucgaaucacgaacaaaacccuucaccguacccauccucaccgucgaagaaauguccaacuccagauuccccgucccuuuagaaaaacucuacaccggcccuuccuccgccuucgugguccagccacaaaacggacgcugcaccaccgacggcguccugcucggcacaacacaacucucagcaguuaacauaugcaccuuccgcggagacguuacccacaucgcaggaucccacgacuauacuaugaaccuagccucacaaaacuggaacaacuacgaccccaccgaagaaauccccgcccccuuaggcacccccgacuucgucggaaaaauacaagguguacucacccaaaccacccgcgaagacggauccacucgugcacauaaagccacagucuccaccgguuccguacacuuuacccccaaacucggcuccguccaauacaccaccgacaccaacaacgacuuccaaacaggccaaaauaccaaauucaccccagucggcgucauccaggacggcagcaaccaccaaaacgaaccacaacaauggguccugcccaauuacuccggccgcaccggacacaacguccaccucgccccagcagucgcacccaccuuucccggcgaacaacuccuauucuuccgcuccaccaugccaggcugcucagguuacccgaacaugaaccucgacugccuccucccccaagaauggguacaacauuucuaccaagaagcugcacccgcccaauccgacgucgcacuacuacgcuucgucaaucccgacaccggccgaguacucuucgaaugcaaacuccauaagagcggcuacgucaccgucgcacacaccggaccacaugaccuagucaucccacccaacggcuacuuccgcuucgacuccugggucaaccaguucuauacccuagccccuaugggcaacggagcaggccgcuaa

SEQ ID NO: 39318 - RNA, 1608 nt, Artificial Sequence
  derived and/or modified sequence opt11 from VP1__Norovirus_and/or_Norovirus-like__KU985166
augaaaauggccuccagcgacgccaaccccuccgauggcucuaccgcaucacucguacccgaagucaacaacgaagucauggcacuagaacccgucguaggcgcagcuauagcugcaccaguagcaggccaacaaaauguaauugaccccuggauccgcaacaacuucguucaggcacccggaggagaguucacaguaucaccccgaaacgccccaggcgaaauacucugguccgcaccccuaggaccagaccuaaaccccuaccuaucccaccucgcccgcauguacaauggcuacgcuggcggcuucgaaguucaagucauccuagcaggcaacgcauuuaccgcaggcaaaauaaucuucgccgcugucccacccaacuuucccacugaaggccucucacccagccaagucaccauguucccccauaucauuguagacguacgacaauuagagcccguccucaucccccuccccgacguacgcaacaacuucuaucacuauaaccaaucaaacgacucgacaaucaaacucauugccaugcucuacacuccccuccgagccaacaacgcaggcgacgacguauucaccgucuccugccgcguccuaacucgacccucacccgacuucgacuuuaucuuccucgugcccccuaccgucgagucgcgcaccaaacccuucucuguccccauacuaaccgucgaagaaaugacaaacucccgcuucccaaucccccuagaaaaacucuucaccggcccuucaucaacauuugucguccaaccacaaaacggccgcugcaccaccgacggugucuugcucggaaccacccaacuauccccugucaacauaugcaccuuccgaggcggcaucacgcgaauaggccaaucggaaucauacaaaaugaaccuugcaucccaaaauuggaauaauuacgaccccaccgaagagauccccgcaccccuuggaacuccagacuucaaaggccguauacgaggacuuuuaacccaaacaaccaaaggagccggcuccacccggggacacaaagcaaccguucucacgggcggaucagacuucacccccaaacuugguacuguucgcuucgacacaaaauccaucgacuucgaaaauaaccaaaauaccaaauucacccccgucggagucguacaagacggcaacaaucacgacgaacccacccaguggguccuaccaaacuacucaggcccagacacccacaauguccaccucgcacccgcggucgcccccacauucccuggagaacaacuccucuucuuccgauccacaaugcccggaugcuccggcuaucccaaaauggaauuagacugccuccucccucaagaauggguccaacacuucuaccaagaagccgcacccgcccaaaccgacgucgcccuccuccgcuucgucaacccagacaccggccgcguccucuucgaaugcaaacuucacaaaucuggcuacgucacagucgcccacacaggcgaccaugaccucgucaucccacccaacggcuacuuccgcuucgacuccuggguaaaccaauucuacacacuagcccccauggguaacgguaccggccgcagacgcuaa

SEQ ID NO: 39319 - RNA, 1608 nt, Artificial Sequence
  derived and/or modified sequence opt11 from VP1__Norovirus_and/or_Norovirus-like__JN699045
augaugauggccuccaaagacgcccccaccucccccgacggcgcgucuggcgccggccaacucguacccgaagccaauaccgccgaacaaaucagcauggacccagucgcaggggccuccaccgccgucgccaccgcaggucaaguaaacaugaucgacccuuggaucuucaacaacuucgugcaagccccucaaggcgaauuuaccauuucccccaacaacacucccggcgacauacucuucgaccuccaacuaggcccccaccuuaaucccuuccuagcacaccucucacaaauguacaacggcugggucggcaacaugcgcguccguauacuccuagcaggaaaugcuuucaccgccggaaaaaucauuaucugcugcgucccucccggcuucgacgcccgcauacucaccaucgcccaagccacccucuucccccaccucauugccgacguccgcacccuggaacccguagaacuaccccuugaagacguccgaaacguauuauuucacaacuccucacaaccccaacccaccaugcgccucguagccaugcucuacacaccccuacgaaccggcggaggauccggcggcaccgacgccuuuguaguggcaggccgcguucuuaccugccccgcccccgacuucuccuuccucuuucucgucccacccuccgucgaacagaaaacccgcgucuucucaguccccaacgucccccucaaagaccuauccaacucacgagucccaguccccauccaaggcauguucaugagccccgacguaaaccaauccguccaauuccaaaacggaagaugccaaaucgacggccaacuccaaggaaccaccccagucucacucucacaacucugcaaaauccgaggcaaaacuagcucuaacgcccgcguccucaaccucagcgaagucgacggaacccccuucaucccccuagaaucccccgcgcccguaggcuuccccgaccucggagguugcgacuggcacgucaauuucaccuuccaagcacaaaaccaggaucccucucaaagcgucaccuuugcaacaaacgacgccuccuucguccccuaccuaggcuccaucuccccacacaacggcggagacuuucacuccggagacaucaucggcucacuaggcuggaucucggcaccuuccgacuccucccaacuaaacgucuggacaauaccuaaauauggcuccucccuccccgacgucacccaccucgcacccgccgucuuucccccaggcuucggcgaagucauccucuacuuccacucaaccuuccccggauccggccaacccggccaacuccaagucccgugccuccucccacaagaauuuaucacccacuucugcaaugaacaagccccaaucgcgggcgaagcagcccuucuccacuacguugacccagacaccggccgcaaccucggcgaguucaaacucuacccggacggcuucaugaccugcgucccaaacucuguuagcucuggcccccaaacccuaccaaucaacggagucuucguauucguaucaugggucucccgauucuaucaacuaaaacccgucggcacugccucugccgcaagacggcuauaa

SEQ ID NO: 39320 - RNA, 1608 nt, Artificial Sequence
  derived and/or modified sequence opt11 from VP1__Norovirus_and/or_Norovirus-like__EF547395
augaugauggccuccaaagacgcaccaaccuccccugacggagccuccggagccggccaacucgucccagaagcuaauaccgccgaacaaaucuccauggaccccgucgccggcgccagcaccgccgucgcaacugcaggccaagucaacaugaucgaccccuggauauucaacaacuucguccaagcaccacaaggcgaguucacuaucagccccaacaacaccccaggcgacauacucuucgaccuccaacuaggaccccaccuaaaucccuuccucgcccaccucucccaaauguacaacggcugggucggcaacaugcgaguacgaauccuccucgcaggcaacgccuuuacagccgggaaaaucauaaucugcugcgucccgcccggcuucgacgcacgcauccuuacuaucgcacaagccacccucuucccccaccucauugccgacguacgaacgcucgaacccgucgaacuaccccuugaagacguucgaaaugugcuauuucacaacuccucccaaccccagcccaccaugcggcuagucgcuaugcuauacacaccccucagaaccggcggcggcuccggcggcaccgacgcauucgucguagccggccgcguacucacaugccccgcccccgacuucuccuuccucuuccuaguuccucccucgguagaacagaaaacccgcgucuucuccguccccaaugucccccuuaaagaccuauccaacucgcgugucccaguccccauacaaggcauguucaugucacccgacgucaaccaauccguccaauuccaaaacggccgcugccaaauugacggccaacuacaaggcaccacccccguaucacucucccaacucugcaagauacgcggcaaaaccuccucgaacgccagaguccucaaccucuccgaagucgacggcucgcccuucaucccccucgaaucacccgccccagucggcuuccccgaccucggcggaugcgacuggcacgucaacuucaccuuccaagcccaagaccaagacccuucccaaagcguaacauuugcaaccaacgacgccuccuucguccccuaccucggaucaauuucuccacacaacggcggugacuuucacucaggagacaucauaggaucccucggauggaucucagcccccuccgauucaucccaacucaacgucuggaccauccccaaauacggcuccuccuuacccgacgucacgcaccucgcccccgccguauucccacccggcuucggagaaguuauccuuuacuucuacuccaccuuccccggcagcggccaaccaggccaacuccaaguccccugucuuuuaccccaagaguucaucacccacuuuugcaacgaacaagcacccaucgccggcgaagcagcccuccuccacuacguugaccccgacaccggccgcaaccuaggcgaguucaaacucuaccccgacggauucaugacaugcguccccaacagcgucucaucuggcccccaaacacuucccaucaacggaguauucgucuucguauccuggguaucccgauucuaccaacuuaaacccgucgguacagcaucuguagccagacgccucuaa

SEQ ID NO: 39321 - RNA, 1608 nt, Artificial Sequence
  derived and/or modified sequence opt11 from VP1__Norovirus_and/or_Norovirus-like__AY502008
augaugauggccuccaaagacgcccccacuuccccagacggcgccucuggcgccgggcaacucgucccagaagccaacaccgcugaacaaauaucaauggaccccgucgccggagccuccacagccgucgccacugccggacaagucaacaugaucgauccauggaucuucaacaacuucguccaagcaccccaaggcgaauuuaccauaucccccaacaacacuccaggcgacauccuuuucgacuuacaacuaggcccacaccucaacccauucuuagcccaccucucccaaauguacaacggauggguaggcaacaugcgcguccgcauccuacucgcagggaacgcuuucaccgcaggcaaaauaaucaucugcugcgugcccccaggcuucgacgcccgaauccuaaccauagcacaagccacucucuucccccaccucauagcagacguccgcacacucgaaccagucgaacucccccucgaagacguuagaaacguccuuuuccacaacuccucacaaccccaacccacuaugaggcuuguagccaugcuauacaccccacucagaaccgguggcggaucugguggcaccgaugcauucgugguagccggucgcguccuaaccugccccgcccccgacuucucuuuccucuucuuagucccacccuccgucgaacagaaaacacgcgucuucucaguccccaacgucccauuaaaggaccucuccaacagccgcgucccaguacccauucaaggcauguucaugucccccgacguaaaccaauccguccaauuccaaaacggccgcugccaaaucgacggccaacuacaaggcaccacaccagucucuuuaagccaacucugcaaaaucagaggcaaaaccuccuccaacgcccgcguacucaaucucuccgaagucgacggcucuccauuuauaccccucgaauccccagcccccgucggauucccagaccucggaggcugcgacuggcacguaaacuucaccuuccaagcccaagaccaagaccccucacaaucaguaaccuucgccacuaaugacgcauccuuuguccccuaccucggcucaaucucaccccacaacggaggcgacuuccacucaggggacaucaucggaucucuaggcuggaucucagccccaucagacuccucacaacucaacgucuggaccauccccaaauacggcucaucacuccccgacgucacccaccucgcccccgccgucuucccaccuggauucggagaaguaauccuauacuucuacucaaccuuccccggguccggccaacccguccaacuccaaguccccugccuccucccgcaagaauuuaucacccauuucugcaacgaacaggcaccaaucgcaggcgaagcagcccuacuccauuacguagaccccgacaccggccgcaaccucggagaguucaagcucuaccccgacggcuucaugaccugcgucccuaauucagucuccucuggcccccaaacacuccccaucaacggcgucuucgucuucguuuccugggucucacgauucuaccaacuuaaacccguaggaaccgcauccgucgcccgcaggcucuaa

SEQ ID NO: 39322 - RNA, 1608 nt, Artificial Sequence
  derived and/or modified sequence opt11 from VP1__Norovirus_and/or_Norovirus-like__AY502007
augaugauggccuccaaagacgcaccuaccucccccgacggcgccucaggcgccggacaacucguucccgaagccaauaccgccgaacaaaucuccauggacccagucgccggugccucgaccgccgucgcuaccgccggccaaguuaacaugaucgaucccuggauuuuuaacaacuucguacaagcaccccaaggcgaauuuacaaucuccccaaacaacacucccggcgauauccuauucgaccuacaacucggaccccaccuaaaccccuuccucgcccaccuaagccaaauguacaacggcugggucggcaauaugcgaguacggauacuacucgccggcaaugccuucaccgccggcaaaaucauaaucugcugcguuccucccggauucgacgcccgcauccucacuaucgcccaagccacacuauucccccaccucaucgccgacguccgaacccucgaacccgucgaauuaccccuagaagacguccgcaacguacucuaccacaacucaucccaaccccaaccaacaaugcgauugguagcuauguuauauaccccacuccgcaccgguggcggcuccggaggaaccgaugccuucgucgucgcaggccgcguccucacaugccccgcccccgauuucuccuuucuauuccucgucccacccuccguagaacagaaaacccgcguauucuccguccccaacauaccccucaaagaccucagcaacucccgcguacccguccccauccaagguauguucaugucucccgacgucaaccaauccguccaauuccaaaacggccgcugccaaaucgauggacaauuacaaggaaccacccccgucucccucucccaacucuguaaaauccguggcaaaaccuccuccaacgcacgcguccuuaaccucuccgaagucgacggcaccccauucgucccacuagaaucccccgcacccgucggauuucccgaccucggaggcugcgacuggcacgucaacuucaccuuucaagcccaaaaccaagaccccucccaaucugucaccuuugccaccaacgacgcauccuucguccccuaccucggcuccauuucaccccacaacggcggggacuuccaugccggcgacaucaucggaucacucggcuggauauccgcgcccuccgacaacacucaacucaacgucuggaccaucccuaaauacgguuccucccucccugacguaacccaccucgccccagccgucuucccacccggauucggcgaaguaauacuauacuucuacucaaccuucccaggcucaggucaaccuucccaauuacaaguccccugccuccucccccaagaguucauaacccacuucugcaacgaacaagcacccaucgccggugaagccgccuuacuccacuacgucgaccccgauacaggacgaaaccuaggcgaauuuaaacucuacccagacggcuucaugaccugcguaccaaacuccgucuccucaggcccacaaacacuacccauaaacggcgucuucgucuucguauccuggguaucacgcuucuaccaacucaaacccgucggcaccgccucagccgcccgccgccucuga

SEQ ID NO: 39323 - RNA, 1608 nt, Artificial Sequence
  derived and/or modified sequence opt11 from VP1__Norovirus_and/or_Norovirus-like__KC998959
augaugauggccucaaaagacgccccgaccucccccgacggagcuucgggcgccggacaacucguccccgaagccaacaccgccgaacaaaucagcauggaccccguagcaggcgccucaaccgcagucgccacagcuggccaagucaacaugaucgaccccuggaucuucaacaacuucguccaggcaccccaaggagaauuuaccauuucacccaacaacacuccuggcgacauccuauucgaccuccaacugggcccccaccucaaccccuuucucgcccaccucagccaaauguacaacggcugggucgguaauaugcgcguccgcauccuccucgccgguaacgccuucaccgccggcaaaaucauaaucuguugcguucccccaggcuuugacgcacgcauucucaccaucgcccaagccacccucuucccucaccucauagccgacguacgcacacucgaacccgucgaacuuccacuagaagacguccgcaacguccucuaccacaacuccucacaaccccaacccaccaugcgccuuguagccauguuauacaccccucuccgcacgggcggcggcuccggcggcaccgacgcauuugucgucgccggacgagucuuaaccugccccgcccccgacuucuccuuccuauuccuaguaccaccguccguagaacagaaaacacgcguuuucucaguaccaaacauuccucucaaagaccuuuccaacagccgcguccccgucccaguccaaggcauguucaugucaccagacgucaaccaaagcguccaauuccaaaacggcagaugccaaaucgacggccaauuacaaggcaccacaccugucagccucucccaacuaugcaaaauccgcggaaaaacuagcuccaacgcacgaguacuaaaccucuccgaaguggacggcaccccauucauaccccucgaaucaccagcccccguaggcuuucccgaccuaggaggcugcgacuggcacgucaacuucaccuuccaagcccaagaccaagacccaucacaaucgguaacauucgccaccaacgacgcuucauucguccccuaccuaggcucaauaucaccacauaacggaggcgacuuccacgcaggagacaucaucggcucccucggauggaucuccgccccaucaggcaacucccaacuaaacgucugggccauaccaaaauacggcucaucccuacccgaugucacgcaccuagcacccgccguauuucccccuggcuucggcgaaguaauacucuacuucuacucuaccuuccccggcuccggccaacccucccaacuccagguaccuugccuacucccucaagaauuuaucacccacuucugcaacgaacaagcacccaucgccggcgaagcagcauuacuacacuacguggaccccgacacuggccgcaaccucggagaguucaaacucuaccccgacggcuucaugaccugcguaccaaauuccgucuccuccggaccucaaacccuccccaucaacggagucuucguuuucguuuccugggucucccgauucuaccaacuaaaaccaguuggaacagccuccgccgcgcgccgccucuaa

SEQ ID NO: 39324 - RNA, 1608 nt, Artificial Sequence
  derived and/or modified sequence opt11 from VP1__Norovirus_and/or_Norovirus-like__GQ856464
augaugauggccagcaaagacgccccuaccucccccgacggugcauccggcgccggacaacucguucccgaagccaacaccgcugaacaaauauccauggacccagucgccggcgcauccacagccgucgcuacugccggccaagucaacaugauagaccccuggauuuuuaacaacuucguccaagcuccccaaggagaauuuaccaucucccccaacaauacacccggcgacauccucuucgaccuccaacucgguccacaccucaaccccuuccucgcccaccucucccaaauguacaacgggugggucggcaacaugcgaguacgcauccuccuugccggcaacgcauuuacagcaggcaaaaucaucaucugcugcguaccacccggcuucgacgcacgcauccucaccauagcucaagccacccucuucccccaccuaaucgccgauguccggacacucgaacccgucgaacuaccccucgaagacguacgcaacguccucuaccacaacuccucccaaccccagcccaccaugcgccuagucgcuaugcucuacacaccccuacgcaccggcggcggcuccggcgguaccgacgccuucgucguugccggucgcguccuuacuugccccgcacccgacuucucuuuccucuuccucgucccacccucagucgaacagaaaacccgcgucuucucaguacccaauaucccccucaaagacuuauccaacucccgcguccccguucccauucaagguauguuuaugucaccugacgucaaccaauccguccaauuccaaaacggacgaugucaaauugacggccaacuccagggcacaacaccaguuucccugucccaacucugcaaaauccgaggcaaaaccuccaguaacgcccgcguccucaaccugucagaagucgacggcacgccuuucauuccacuugaaucuccugccccugucggcuucccagaccucggcggcugcgacuggcacguaaacuucaccuuccaaacccaagaccgagaccccucccaauccguaaccuucgcgacaaacgacgccucauucguaccuuaccucggauccgucuccccucacaacggcgaaggauuccaagccggagacaucaucggaucccuuggcuggaucucagccccauccgacaauucccaauucaacguaugggccaucccuaaauacggcucuagccuucccgaugucacccaccucgcgccagcggucuucccacccggcuucggcgaagucauccuauacuucuacuccaccuuccccgguuccggccaaccaucccaacuccaaguccccugccuacucccccaagaauuuaucacccacuucugcaacgaacaagccccgaucgccggcgaagcagcccuccuucacuacgucgaccccgacaccggcagaaaccucggcgaguucaaacucuaccccgacgguuucaugacaugcguccccaacucaguauccuccggcccucaaacccuccccaucaacggagucuucguguucguuagcugggucagccgcuuuuaccaacucaaacccgucggcaccgccucugccgcccgccgccuuuaa

SEQ ID NO: 39325 - RNA, 1608 nt, Artificial Sequence
  derived and/or modified sequence opt11 from VP1__Norovirus_and/or_Norovirus-like__GQ856463
augaugauggcaaguaaagacgcccccaccuccccugacggcgccagcggcgccggccaacucguccccgaagcuaacaccgccgaacaaaucagcauggacccagucgcaggcgccuccaccgcaguugccaccgcaggccaagucaacaugguagaccccuggauauucaacaauuucguccaggcuccccagggugaauuuacaaucagccccaacaacacuccaggugacauucuguucgaccuccaauuaggcccacaccucaaccccuuccuagcccaccuaucucaaauguacaauggcuggguuggcaauaugcgcguacgaauccuccucgccggcaaugccuucaccgccggaaaaaucaucaucugcugcgucccacccggcuucgaugcccguauccucaccaucgcacaagccacccucuucccacaccuaaucgccgacguccgcacccuagaacccguugaacuuccucucgaagacguacgaaacguccucuaccacaacuccucccaaccccaacccaccaugcgccucgucgcaaugcuauacacaccccuucggacaggcggcggcucaggcggcacugacgccuucguuguagccggccgcguccucaccugucccgcccccgacuucuccuuccuuuuccucguaccacccucagucgaacagaaaacccgcguauucuccguccccaacauaccccucaaagaccuuucaaacucccgcguucccguccccauccaaggaauguuuaugagccccgaugucaaccaaucuguccaauuccaaaacggccgaugucaaauagacggacaacuccaaggcaccacuccagucucgcucucccaauuaugcaaaauccgagguaaaaccuccagcaacgcccggguccucaaccucuccgaaguagacggaacccccuuuaucccccuagaauccccugcccccguaggcuucccagaccucggaggcugcgauuggcacgucaacuucaccuuccaaacccaagaucgagaccccucucaauccguaacuuucgcaacaaaugacgcaucauucguacccuaccuaggauccguaucuccccacaacggagaaggcuuccaagccggcgacaucaucggaucccucggcuggaucuccgcccccagcgacaacagccaauucaacguuugggccauccccaaauacggaucaucacuacccgacguaacacaccucgcccccgccgucuuucccccuggcuucggcgaaguaauccuguauuucuacuccaccuuccccggcuccggccaaccaagccagcuucaagugccaugccuucucccccaagaauuuaucacacacuucugcaacgaacaagccccaauagccggugaagccgcccuacuccauuacguagacccagacaccggccggaaccucggcgaguucaaacuauacccagauggauucaugaccugcguccccaauuccgucaguuccgguccucaaacacuaccaaucaacgguguauucgucuucguauccugggucucccgauucuaucaacucaaacccguggguaccgccuccgccgcccgccgacucuaa

SEQ ID NO: 39326 - RNA, 1608 nt, Artificial Sequence
  derived and/or modified sequence opt11 from VP1__Norovirus_and/or_Norovirus-like__KM036372
augaugauggccucaaaagacgcccccaccucccccgacggcgccucaggagccggccaacucguacccgaagccaacaccgcggaacaaaucuccauggaucccgucgcaggagcuuccaccgccgucgcaaccgccggccaagucaacaugauugaccccuggaucuucaauaacuucguacaagcaccacaaggcgaauuuaccauuucucccaacaauaccccaggagacauccuauucgaccuucaacucggcccccaccuuaacccuuuccucgcccaccucucccaaauguacaacggcuggguaggaaacaugcgcgugcguauccuccuagccggcaacgcauucaccgcaggcaaaaucauaaucugcugcgucccaccagguuucgacgcccguauccucacaaucgcucaagcaacacucuucccacacuuaaucgcagacguccgaacccucgaacccgucgaacucccccuagaagacguacgcaacguacuauaccacaauagcucacaaccccaaccuacaaugcgacucguagccaugcuauacaccccacuacgcaccggugguggaucaggcggcacagacgccuucgucguagcaggccguguccucaccugucccgcucccgauuucuccuuccucuuccuaguuccaccuucgguagaacagaaaacacgcguauucuccguccccaacaucccauuaaaagaccucaguaacucccgcgucccaguccccguccaaggcauguucgucuccccagacgucaaccaaucaguccaauuccaaaacgggcgaugucaaauagauggccaacuccaagguaccacccccgucucccucucacaacuaugcaaaauccgcggaaaaaccucauccaacgcccgcguccucaaccucucugaaguagacggcacacccuucaucccccuggaaucccccgcccccgucggauuccccgaccuaggcggcugcgacuggcacgucaacuucaccuuccaaacccaagaccgcgacccaucucaauccgucaccuucgccaccaacgacgccucauucguccccuaccuaggaucuguuucuccccacaauggcgaaggcuuccaagccggcgacaucaucgguagccuaggcuggaucucagcacccagcgacaacucccaauucaacgucugggccauacccaaauacggcucaucccuccccgacgucacacaccuagcccccgccguauucccucccggcuucggagaaguuauccuauacuucuacuccaccuucccaggcucuggccaacccagucaacuucaaguccccugccuccugccccaagaauuuauaacccauuucugcaacgaacaagcccccaucgcaggcgaagccgcccuacuccacuacguggaccccgacaccggcagaaaccucggcgaguucaagcuauaucccgacgguuucaugacaugcguccccaacucaguuuccuccggcccccaaacccucccaaucaacggcguuuucgucuucgucuccugggucucccgcuucuaccaacucaaacccguuggcacugccucagcagcacgccgacucuaa

SEQ ID NO: 39327 - RNA, 1608 nt, Artificial Sequence
  derived and/or modified sequence opt11 from VP1__Norovirus_and/or_Norovirus-like__AF538678
augaaaauggcuuccaaagaugccccucccucccccgacggagccucuggcgcaggccaacuuguccccgaagucaacaccgccgaucaaauaagcauggaucccguagcaggcgcaucaaccgcagucgcaaccgccggucaagucaacaugaucgaccccuggauauucaacaacuucguccaagcaccccaaggcgaauuuacaaucucacccaacaacacccccggagacauccuuuucgaucugcaacuaggaccccaccuaaaccccuuccucgcucaccuaucgcaaauguacaacggcugggucggcaacaugagaguacgaauccuucuagccggcaacgccuucaccgccggaaagaucauuauaugcugcgucccacccggcuucgaugcccguauccugaccauagcccaagccacucucuucccccaccuaauagccgacguccgcacacucgaaccagucgaacucccccuagaagacguacgcaauguucuauaccacaacagcucacaaccacaaccaacaaugcgccuagucgcaaugcuauacacucccuuaagaaccggaggcggauccggaggcaccgacgccuucgucguagccggacgcguauuaacaugccccgcaccagauuucucauuucuuuuucucgucccucccuccguagaacagaaaacccgcgucuuuuccguccccaacaucccucucaaagaccucuccaacucccgaguccccacccuuauccaaggcauguucgucuccccagacgucaaccaauccguacaauuccaaaacggccgcugccaaaucgacggccaacuccaaggcaccacccccgucucccucucccaacucuguaaaauccgcgggaaaaccucuuccaacacccgcguacucaaccuauccgaagucgacggaacccccuucguaccccucgaauccccagccccagucgguuuccccgacaucggaggcugugauuggcaugucggcuucaccuucgaagcccgcgaccaagaccccucucaaaacgucaccuucgcaacaaacgacucauccuucguccccuaccuaggcuccaucucaccccacaacggcgacggcuuccacuccggcgacaucgucggcucacucgacuggauauccgccccuuccgacggcucugcacuggaugucugguccauccccaaauacggcuccucccuacccgacguaacccaccuugcuccagucguauucccacccggauucggagaagucauccucuacuuccacuccaaauuccccgguuccggacccaccgacaagcucagaguccccugccuaaugccccaagaauuuaucacucacuucugcaacgaacaggcccccaucgccggcgaagcugcccuacuucauuacgucgaccccgacacaggccgcaaccucggcgaauuuaaacucuauuccgacggcuucaugacaugcgucccaaacagcaucagcuccggcccacaaacucuacccaucaacggcgucuucgucuucgucuccuggguaucccguuucuaccaacuaaaacccgucggaacagccucagcagcccgacgacuauaa

SEQ ID NO: 39328 - RNA, 1608 nt, Artificial Sequence
  derived and/or modified sequence opt11 from VP1__Norovirus_and/or_Norovirus-like__KC294198
augaugauggccuccaaagacgcccccacauccccggauggagccuccggcgcaggacagcuaguccccgaagccaacaccgccgaacaaaucucuauggaccccguugccggcgcuucaaccgcuguugccacagccggccaagucaacaugaucgaccccuggaucuucaacaacuucguccaagccccacaaggcgaauuuaccaucucccccaacaacacccccggcgacauccucuucgaccuccaacucggcccccaccuaaaccccuuccuagcccacuuaucucaaauguauaacgguugggucggcaauaugcgcguccgcauacuccucgcuggcaaugccuucaccgcuggaaaaaucaucaucugcugcgugccucccggcuucgacgcccgaauccucacuaucgcacaagccacccuauucccacaccucaucgcagacguacgcacccuagaacccguugaacucccacucgaagacguccgaaacgucuuauuccacaacucaucucaaccucaaccgaccaugcgucuugucgccaugcuguacacaccccuccgcaccgguggcggcagcggcggcacagacgccuucgucgucgcaggccgcguacuuacaugccccgcaccagacuucuccuuccuauuccuaguacccccguccguugaacagaaaacccgaguauucuccguaccgaauauuccacucaaagaccuauccaauucccgcguacccguccccguacaaggaauguucaugaguccagacgucaaccaaagcguucaauuccaaaacggccgcugucaaaucgauggccaacuccaaggcaccaccccagucucccucucucaacuauguaagauccguggcaaaaccucguccaacgcccgcguacucaaccucuccgaaguagacggcacccccuucauaccacuugaaucacccgcccccgucgguuucccagaccuuggcggcugcgauuggcacgucaacuucaccuuccaagcccaaaaucaagaccccucucaauccguuaccuucgccaccaacgaugccucauucguacccuaccucggcuccauaucaccacacaacggaggagacuuccacgccggagacauaauuggcucucucggcuggaucuccgcccccucggacaacucacaacucaacgucuggaccauccccaaauacggaucuucgcuacccgacgucacccaccuagccccagcagucuucccucccggauucggcgaagucauacuauacuucuacuccaccuucccuggcuccggacaaucgucccaacuccaaguccccugucuacucccucaagaauuuaucacccacuucugcaacgaacaagcacccaucgccggcgaagcagcccuccuacacuacgucgacccagacaccggccgcaaccucggcgaauuuaaacucuaccccgauggcuucaugaccugcguccccaauuccgucuccuccggcccgcaaacacuaccaaucaauggagucuucgucuucguguccugggucagccgcuucuaccaacucaaaccagucggcaccgcaucagcugcccgccgccucuaa

SEQ ID NO: 39329 - RNA, 1608 nt, Artificial Sequence
  derived and/or modified sequence opt11 from VP1__Norovirus_and/or_Norovirus-like__KT732280
augaugauggcaucaaaagacgcacccaccucucccgacggcgcaucaggcgccggccaacucgucccagaagucaacaccgcagaccaaauaucaauggacccagucgccggcgccuccacagccgucgcaacugcaggccaagucaauaugaucgacccauggauauucaacaacuuugugcaagcuccacaaggcgaauuuaccauuagcccuaacaacacccccggcgacauacucuucgaucuucaacucggaccccaccucaacccauuccucgcacaccugagccaaauguacaacggaugggucggaaacaugagaguccgaauacuccucgcaggaaacgcuuucaccgccgguaagauaaucauaugcugcguaccacccgguuucgacgcccgcauacucacaauugcacaagcgacccucuucccccauaugaucgcugacgugcgcacccucgaacccgucgaacuaccccucgaagauguccgaaacguccucuaccacaacuccucacaaccacaacccacuaugcgccucguugccaugcuuuacacuccccuacgcaccggcggcggcuccggcggaaccgacgccuucgucgucgcaggccgcguacuaaccugcccagcccccgacuucuccuuccucuuccucgucccacccuccgucgaacagaaaacucgcgucuucucaguccccaacaucccccuaaaggaccucucaaacagccgcgucccaacccucauacaaggaauguucgucucacccgacgucaaccaauccguccaauuccaaaacggccgcugccaaauugacggccaacuucaaggaaccacccccguaucacugucccaacucugcaagauacguggaaaaaccuccuccaacgcccgaguccuaaaccuauccgaaguugacggcaccccauucguuccccucgaaucgccagcacccgucggcuuccccgaccucggcggaugcgacuggcacgucggcuuuacauucgaagcccgcgaccaagaccccucccaaaacgucacauucgccaccaacgacucuuccuucgucccuuaccucgguucaaucuccccacacaacggugacggcuuccacuccggcgacauaauaggaucacucgacuggauaucagccccaucagacggcuccacccucgacguauggagcauccccaaauacggaucaagccucccagacguaacccaccuagccccagcagucuucccacccggcuucggcgaaguaauacucuauuuccacucuaaauuccccggauccggccccacagacaaacuccgaguccccugccuaauaccccaagaauuuaucacucacuucugcaacgaacaagcacccauagccggcgaagccgcucuccuacacuacguagaccccgacaccggccguaaucucggagaguucaaacucuaccccgauggguucaugacaugcguacccaacuccaucucauccggcccccaaacccucccaaccaacggcgucuucguuuucgucuccugggucucacgauucuaccaacuuaaacccguuggcaccgccucuauggcucgacgccucuaa

SEQ ID NO: 39330 - RNA, 1608 nt, Artificial Sequence
  derived and/or modified sequence opt11 from VP1__Norovirus_and/or_Norovirus-like__LC101822
augaugauggccuccaaagacguacccaccuccccugacggagccagcggcgccggccaacucguacccgaagucaacaccgcagaccaaaucuccauggaccccgucgcuggagccagcacagccgucgccacagccggacaagugaauaugaucgauccauggaucuucaacaacuucguacaagccccacaaggagaauuuaccaucucccccaacaacaccccaggcgacauccucuucgaccuacaacuggguccccaccucaacccuuuccuagcccaccuaucccaaauguacaacggauggguaggcaacaugcgcguccgaauccuccucgcaggcaacgcauucacagccggcaaaaucaucauaugcugcgucccucccggcuucgacgccagaauccuaaccaucgcccaagccacccucuucccccaccucauagccgacguccgcacucuagaacccguagaacuaccccuagaagacguccgaaacgugcucuaccacaacuccagccaaccccaacccaccaugcgccuagucgccaugcucuacacaccccuccgcaccggcggcggcuccggaggcaccgacgcauucgucgucgccggccgcguccuaaccugccccgcccccgacuucucuuuccucuuccuugucccacccucuguagaacagaaaaccagagucuucucaguccccaacauaccacucaaagaccucuccaacucccgaguucccacccucauacaaggcauguucgucuccccugacgucaaccaaucaguccaauuccaaaacggcagaugccaaauagacggccaacuacagggcaccacccccgucucacuuucucaacuaugcaaaauccgcggcaagaccuccuccaacaccagaguccugaaccucucagaaguagacggaaccccuuucguuccccucgaaucccccgccccaguaggcuucccagacaucggaggcugcgacuggcacguaggcuucacauucgaagccagagaccaagguccaucccaaaacgugaccuucgccaccaacgauucaucauucguaccauaccucggcuccaucagcccccacaauggcgacggcuuccacuccggcgauauuauaggaucccuagacuggaucuccgcccccuccgacgguuccgcacuagacgucugguccaucccaaaauacggcagcucgcuccccgacgucacacaccucgcaccagccgucuucccucccggauucggagaaguaauccuauacuuccacuccaaauuccccggaucuggccccaccgacaaacuacgcguccccugccucaugccccaagaauuuauaacccacuucugcgacgaacaagccccuauagccggagaagcugcccuauuacauuacguagaccccgaugcaggccgcaaccuaggugaauuuaaacucuaccccgacggcuucaugaccugcguccccaacucaauauccuccggcccccaaacccuucccauaaacggcguauucguauucguuagcugggucucccgcuucuaccaacucaagccugugggcaccgccucaauggcccgucgucuuuaa

SEQ ID NO: 39331 - RNA, 1608 nt, Artificial Sequence
  derived and/or modified sequence opt11 from VP1__Norovirus_and/or_Norovirus-like__KP407451
augaugauggccuccaaagacgcucccacaucacccgacggugccuccggcgccggccagcuaguacccgaagccaacaccgccgaacaaaucuccauggaccccguagcuggcgccuccacugccgucgccaccgccggacaaguaaauaugaucgaccccuggaucuucaauaacuucguacaagccccacaaggagaauuuaccauaucccccaacaacaccccaggugacauacucuucgaccuccaacuaggaccacaccucaaccccuuccucgcccaccucucacaaauguacaacggcuggguaggcaacaugcgagucagaauacuccucgcaggcaaugccuucaccgccggaaaaaucauuaucugcugcgucccaccaggcuucgacgccagaauccuuacaaucgcacaagcaacccuauucccucaccuaaucgccgacguacgcacgcuagaacccgucgaacuaccccuagaagacguccggaacguccucuaccacaacuccucccaaccccaaccuaccaugcgccuugucgccaugcuuuauacuccccuacguaccggcggcgguagcgggggcaccgacgcauucgucgucgccgggcgaguccuuacaugccccgcacccgacuucagcuuccucuuccuaguuccucccuccgucgaacagaaaacacgugucuucagcguccccaacaucccccuuaaagaccucagcaacucacguguccccguccccauccaaggcauguuuaugucacccgacgucaaccaauccguucaauuccaaaauggccgaugccaaauugacggccaacuacaaggcacaacacccgucucccugucccagcucugcaaaauccgcggcaaaaccucgucaaacgcucgcguccuaaaccuauccgaagucgacggaacucccuucauuccccucgaaucccccgcccccgucggcuucccagaccuuggaggcugcgauuggcacgucaacuucucauuccaaacccaagaccgcgaccccucacaauccgucaccuucgcaacuaacgacgccucauucguccccuaccucggcuccguaucaccccacaacggcgaaggcuuccaagcaggagacauaaucggaucccugggauggaucuccgcaccuuccgacaauucccaauucaacguuugggccauaccaaaauacgguuccucccuacccgacgucacccaccucgcccccgccguauuucccccuggauucggagaaguaauucucuacuucuacaguaccuuccccggcucuggccaaccaucccaacuccaaguacccugccuccuaccacaggaauuuaucacgcacuucugcaacgaacaagcccccaucgccggcgaagccgcuuuacuucacuacgucgacccagacacaggccgcaaccugggcgaguucaaacucuacccugacggauucaugaccugcguccccaacucugucuccucugguccucaaacccuacccaucaauggcgucuucguauucguauccuggguuagccgcuucuaccaacucaaaccagucggaaccgccuccgccgcacgccgucuauaa

SEQ ID NO: 39332 - RNA, 1608 nt, Artificial Sequence
  derived and/or modified sequence opt11 from VP1__Norovirus_and/or_Norovirus-like__LN854564
augaugauggcauccaaggacgccccuaccucccccgauggagccuccggcgccggccagcuaguccccgaagccaacaccgccgaacaaauuucaauggauccaguggcaggcgccuccaccgcugucgcaacagccggucaagucaacaugauagaccccuggauauucaacaacuucguccaagcaccccaaggcgaauuuaccaucucccccaacaacacaccaggcgacauccuauucgaccuccaacucgguccccaccuaaaccccuuccuagcccaccuaucccaaauguacaacggcuggguuggcaacaugcgcguccgaaucuuacuggccggcaaugccuucaccgcgggcaaaaucauaaucugcugcguaccacccggauucgacgcucgcauacuaacaauagcacaagccacacuauucccucaucucaucgcagacguacgcacgcucgaacccguugaacugccccuagaagacgucagaaacguacucuaccacaacuccucccaaccacaacccacaaugcgccucgucgcuaugcucuacacaccccuacgaaccggcggcggaucuggagggaccgacgccuucguagucgccggacgcguacucaccugucccgcccccgacuucagcuuccucuuccucgucccacccucaguagaacagaaaacccgcguuuucuccguccccaacauuccccucaaagaccucucaaacucccgcguacccguaccaauccaaggcauguuuaugucacccgauguaaaccaaucgguccaauuccaaaacggacgaugccaaaucgacggacaacuccaaggcaccaccccagucucccugucccaacucugcaaaauccgaggcaaaaccucauccaacgcccgaguacucaaccuaucugaagucgacggaacaccauucauaccccucgaaucccccgcccccgucggcuuucccgaccucggaggaugcgacuggcacguuaacuucaccuuccaagcucagaaccaagaccccucccaguccgucaccuucgccaccaacgacgccuccuucgucccuuaccucggaucaaucucuccccacaacggcggagacuuccacgcaggcgacaucaucggcucccuaggcuggaucuccgccccgagcgacaacucccaacucaacgucuggaccaucccaaaauacggauccucacuccccgacgucacccaccucgccccagccgucuuucccccaggauucggggaaguuauccucuacuucuauucgaccuuucccgguuccggccagcccucccaacuacaaguccccugccuccucccacaagaauuuauaacacacuucugcaacgaacaggccccaaucgccggggaagcagccuuacuacacuacgucgaccccgacaccggacgcaaccucggagaauuuaaacucuaccccgacggauucaugacaugcgucccuaacagugucuccucaggcccccaaacccuccccaucaacggcgucuucgucuucguuuccuggguaucgcgcuucuaccaacuaaaacccguaggcaccgccuccgccgcacguagacucuaa

SEQ ID NO: 39333 - RNA, 1608 nt, Artificial Sequence
  derived and/or modified sequence opt11 from VP1__Norovirus_and/or_Norovirus-like__JQ388274
augaugauggccucaaaagacgcacccaccucucccgacggcgccuccggagccggccaacucguccccgaagccaacaccgccgaacaaaucucuauggaccccguugccggugcauccaccgcagucgccaccgccggccaggucaauaugaucgaccccuggaucuucaacaacuucguacaagcaccccaaggagaauuuaccaucucacccaacaacacucccggagacauccuauucgaucuccaacuugguccacacuuaaauccuuuccucgcacaccucucccaaauguacaacggcuggguaggcaacaugcgcgucagaauccuacucgcgggcaacgcauucaccgcaggcaaaauaauaaucugcugcguacccccuggcuucgacgcccgcauccucacuauugcccaagccacccucuucccacacuuaauugccgacguccguacccuagaaccagucgaacuaccccuagaagacguccgcaacguccucuaccacaacuccucccaaccccaaccaaccaugcgccucgucgcaaugcucuacacaccccuccgcaccggcggaggcuccggcgguacagacgccuucgucguugccggccgcguacuuaccugcccagcacccgacuucuccuuccucuuccucguacccccuagcgucgaacagaaaacccguguauucuccguacccaacauaccccucaaagaccucuccaacucacgcguacccguccccguccaaggaauguucaugucaccugacguaaaccaauccguccaauuccagaacggccgcugccaaaucgacggacagcuccaaggcaccaccccagucucccucucucaacucugcaaaauacgugggaaaaccuccucuaacgcgcgcguacuaaaccuaucagaaguagacggcacccccuucaucccccucgaauccccagcccccguaggauuccccgaccucggaggcugcgacuggcacgucaacuucacauuccaagcccaaaaccaagaccccucccaauccgucaccuucgccaccaaugacgcaucuuucguccccuaccuaggaucuaucagcccccacaacgguggagauuuccacgccggcgacaucaucgguucccucggcuggaucucagcccccuccgacaauucccagcuaaaugucuggacaaucccaaaauacggcuccucucuacccgacgucacccaccucgccccagccgucuuucccccagguuucggagaagucauccuuuacuucuacucuacauuccccggcuccggccaaccuucccaacuccaagucccgugucuccucccucaagaguucaucacucacuucugcaacgaacaagcccccauagcaggcgaagccgcucuacuacacuacgucgaccccgacaccggccgcaaccucggcgaguucaaacucuacccugauggauucaugacgugcguccccaacuccgucagcucaggcccccaaacccuccccaucaacggcguauucgucuucgucagcugggucucccgcuucuaccaacucaaacccgucggcacagccucagccgcacgccgacucuag

SEQ ID NO: 39334 - RNA, 1608 nt, Artificial Sequence
  derived and/or modified sequence opt11 from VP1__Norovirus_and/or_Norovirus-like__KP027330
augaugauggccuccaaggacgcacccaccucccccgacggcgcauccggcgccggacaacucguccccgaaguaaacaccgccgaccaaaucuccauggaucccguagcaggggccucaaccgccgucgcaacagcaggccaaguuaacaugaucgaccccuggauuuucaacaauuucguccaagcuccccaaggagaauuuaccauaucccccaacaacacccccggcgacauccucuucgaccuccaacucggcccccaccucaaccccuuccuugcccaccugucacaaauguacaacgguugggucggcaacaugcgcguccgaauccuccuugccggaaaugcuuucaccgcuggaaagaucaucaucugcugcgugcccccaggauucgacgcccgcauccuaacaaucgcacaagccacauuauucccucacaugaucgccgacgucagaacacuagaaccagucgaacucccacucgaagacguccguaacguccuuuaucacaacucaucacaaccccaaccaaccaugcgccuagucgccaugcuauacacuccacuacguaccggcggaggcuccggagggaccgacgccuucgucguugccggacgcguccuuaccugccccgccccggacuucuccuuccuauuccuuguacccccaucggucgaacaaaagacccgagucuucuccguacccaacaucccccuaaaagaccucuccaacucccgcguaccuacucuuauccaaggcauguucgucucccccgacgucaaccaaucuguacaauuccaaaacggcagaugccaaaucgacggacaacuacaaggcaccacgcccgucucccuaucccaacucugcaaaauccgaggcaaaacauccucuaaugcccgcguacuaaaccucucagaagucgacggcacucccuucgucccccuagaauccccagcccccguagguuuccccgaccuaggcggcugcgacuggcacguagguuucacauucgaagcacgagaccaagaccccucccaaaaugucacuuucgcaaccaacgacuccucauucgugcccuaccuaggaucaauuuccccacacaacggagacggauuccacuccggugacaucaucggaucucucgacuggaucuccgccccaucugacggcuccacccuagacgucuggucaaucccaaaauacgguuccucccugcccgacgucacccaccucgcacccgcagucuucccacccggcuucggagaaguaauccucuacuuccacucuaaauuccccggcucuggcccaaccgacaaacuucgcguaccaugccucaucccacaagaguucaucacacacuucugcaacgaacaagccccaaucgcaggcgaagccgcccuccuacacuacgucgaccccgacacggggcgcaaccuuggcgaguucaaacucuaccccgauggauacaugacaugcgucccaaacuccauuagcuccggcccccaaacccuccccaccaacggcgucuucgucuucgucucaugggucucucgauucuaccagcucaaacccgucggcaccgcgucgauggcacgaagacuauaa

SEQ ID NO: 39335 - RNA, 1608 nt, Artificial Sequence
  derived and/or modified sequence opt11 from VP1__Norovirus_and/or_Norovirus-like__AF093797
augaugauggcaucaaaggacgcaccaccaucacccgacggagccuccggcgcaggccaacucguccccgaaguaaacaccgcugaccaaaucucuauggaccccgucgccggcgccucuacagccgucgccaccgcaggccaagucaacaugaucgaccccuggauauucaacaacuucguccaggcaccucaaggagaauuuaccaucucccccaacaacacacccggcgacauccuuuucgaccuccaacuuggaccucaccuaaaccccuuccucgcccaccucagccaaauguacaacggcuggguaggcaacaugcgugucagaaucuuacucgcgggcaaugccuucacagcagguaaagucaucauaugcugcgucccacccggcuucgacgcccguauucuaacaauagcccaagcaacccuauucccccaccuaaucgcagacguccgcacacucgaacccguugaacuaccccucgaagacguccgcaacguccucuaccacaacuccucucaaccccaacccacaaugcgccuaguggcaaugcuauacacuccccuucgaaccggcgguggcuccggcgguaccgacgccuucgucguagccggacguguccucaccugucccgcaccagacuucuccuuccuguuccuagucccaccauccguagaacagaaaacccgagucuucuccgucccaaacaucccccuaaaagaccuuucaaacucacgcguaccaacccucauccaaggaauguucgucagccccgacgucaaccaauccgugcaauuccaaaacggccgcugccaaaucgacggccaauuacaaggcaccacccccgucagcuuaucccaacuaugcaaaauccggggucgcaccucauccaacacccgcguacucaaucucucugaaguggacggaacacccuucguuccccucgaaucccccgcucccguaggcuuccccgacauaggcgguugcgacuggcacguaggcuucaccuucgaagccagagaccaagauccaucucaaaacgucacauucgcaacuaacgacucauccuucguccccuaccucggcucaaucucaccccacaacggugacggcuuccacuccggagacaucaucggcucgcuugacuggauauccgcccccagcgacggaucggcacuagacgugugguccauccccaaauacggcucauccuuaccagacgucacccaccucgcccccgccguauucccacccggcuucggagaaguaauccucuacuuccacucaaaauuccccggcuccgggcccaccgacaaacuccgcguccccugccuaaucccacaagaauuuaucacacacuucugcaacgaacaagcccccaucgccggcgaagccgcccuccuccacuacgucgaccccgacaccggccgaaauuuaggagaguucaagcucuacccggauggauucaugacuuguguaccgaacuccaucuccagcggaccccaaacacuccccaucaacggcguauucgucuucguauccugggucucacgcuucuaccaacucaagccagucggcaccgccucagccgcacgccgacucuaa

SEQ ID NO: 39336 - RNA, 1608 nt, Artificial Sequence
  derived and/or modified sequence opt11 from VP1__Norovirus_and/or_Norovirus-like__AB810006
augaaaauggcgucuaacgacgcugcacccagcaacgacggcgcagcuucccucguaccagaagcaaucaaugaaacuaugccucuagaaccagucgcuggcgccagcaucgccgcccccguagccggccaaaccaacaucaucgacccauggauacgcacaaacuucguccaagcccccaacggcgaguucaccgucucaccacgcaacucaccaggcgaaauucuccucaaccucgaacucggaccagaccuuaacccguaccuagcccaccucucccgaauguacaacggcuacgccgguggagucgaaguccaaguccuacucgcaggcaacgcauucacagccggcaaaauacucuucgccgccaucccaccuaacuucccagucgacaugaucucccccgcccaaauuaccaugcuaccccaccuaauagucgacguacgcaccuuggaacccaucaugaucccccuacccgacguccgcaacgucuucuaccacuucaacaaccaaccccaaccccgcaugcgucuagucgccaugcucuacaccccacuacgaucaaauggcuccggugacgacguauucacagucuccugccguguacuaaccagaccuacccccgacuucgaguucauuuaccuuguucccccauccgucgaaucaaaaaccaaaccauucacccuccccauucucaccaucuccgaacuuaccaauucacgauuccccauccccaucgaacaacucuacacugccccaaacgaaaacaacguaguccaaugccagaacggccgcugcacccuugacggcgaacuccaaggcacaacccaacuccuaucauccgcaguuugcucauaccgcggccgaacaguugccaaccgcggcgacaacugggaccagaaccuccuucaacucaccuaccccuccggcgcauccuacgauccaaccgacgaagucccugcaccccucggcacacaagacuucucaggaauccucuacgguguuuuaacacaagacaaugugucggaaggaaccggcgaagccaaaaacgccaaaggcgucuauauaucaacaacauccggaaaauucaccccuaaaauuggauccaucggccuucacuccauaaccgaaaacguccacccuaaccaacaaagccgcuucacaccagucggcgucgcccaaaacgaaaacaccccauuucaacaauggguccuaccucacuacgccggugcacucgcucucaacaccaaccuagcucccgccgucgcaccuacauuccccggugaacaacuccucuucuuccgcucccgcgucccaugcguccaaggcuuacgcggccaagacgccuuuaucgacugccuccucccacaagaaugggucaaccacuucuaccaagaagcugcccccucccaagccgaugucgcccuaauccgauacgucaacccagacaccggccguacacuuuucgaggccaaacuccaucgcuccggauucaucacugucucccacacaggcgccuacccccuagucgucccacccaauggaccauuccgauucgacuccugggucaaccaauucuacucccucgcccccaugggcaccgguuaa

SEQ ID NO: 39337 - RNA, 1605 nt, Artificial Sequence
  derived and/or modified sequence opt11 from VP1__Norovirus_and/or_Norovirus-like__LC101825
augaugauggccucaaaagacgccacccccucagccgauggcgcuaacggcgcuggccaacucguaccagaagucaacaacgccgaaccacucccacuagacccagucgccggcgccuccacagcccuagcuaccgcaggccaagucaacaugauagaccccuggaucuucaacaacuucguccaagcaccccaaggugaauuuaccauaucacccaacaacacccccggagacauccucuucgaccuacaacucggcccccaccuuaaccccuuccucgcacaccuaucccaaauguacaacggcugggucggcaacaugcguguacgugucauccucgccggcaaugcauucaccgcaggcaaaguuaucauaugcugcgucccucccggcuuccagucccgcacacuaucaauagcccaagccacacucuucccacacguaaucgccgacgugcgaacucuagaaccacuagaaaucccccuagaagacguccgaaacacccucuaucacaacaacgacucccaaccaaccaugcgccuacucugcaugcucuacacaccccuccgaaccggaggcggcuccggcggcaccgacgcuuucguaguagcaggccgaguccuuaccugccccuccccugacuucaacuuccucuuccucguucccccaaccgucgaacagaaaacccgcccguucucaguacccaacaucccacuccaaaaucucuccaacucccgcgucccaucacucauacaauccaugguccucuccuccgaccacgcccaaaccguccaauuccaaaacggucgaugcacuacagacggccaucuacucgguaccacccccguaucuuccggccaacuuaugaaauuccgcggaaaaguaacaccuggcucaaaaguccucaaccucaccgaacuugacggaucaccauuccuugccuucgaaccaccagcacccgccggcuucccagaccucggcaaaugcgacuggcacaucgaaaugucccuguaccaaguaaacaaccaagacaaucccauuguccuacgcgccauagaacccaacucuagcuccuucgucccucaccucggauccgucucguucaaccaaaacgucgacgccgcaggagacuacgucugcacaauccaauacaccuccccacccucuaauucacacgacgccgacguagauuucuggucaaucccagacuacggauccaaccucgccgaagccucacaacucgcccccguaguauauccaccaggcuuuggcgaagcaauaguauacuucaugucucgcgucccaggauggaacagaaccaaccgccucaaccuaguccccugccuucucccccaagaauuuaucggacacuucgugucagaacaagcccccgccauaggcgaagccgcccuccuccacuacgucgacccagacaccaaccgcaaccucggugaauuuaagcucuaccccgaaggcuucaucacaugcguucccaacgguaccggcccacaacaacuaccccuaaauggcgucuucguguucuccuccuggguaucacgauucuaccaacucaaacccgucggcacagccuccuccgcgcguuaa

SEQ ID NO: 39338 - RNA, 1605 nt, Artificial Sequence
  derived and/or modified sequence opt11 from VP1__Norovirus_and/or_Norovirus-like__AB081723
augaugauggcaagcaaagaugcacccaccucacccgacggcgccuccggagccggucagcucguccccgaagcuaacaccgccgaacaaaucucaauggacccgguagcaggcgcauccaccgccguagcaacagcaggacaaguuaacaugaucgaccccuggaucuucaacaacuucguccaagcuccccaaggagaauuuaccaucucaccaaacaauacacccggcgacauacucuucgaucuccaacuaggcccccaccuaaaccccuuccuugcccaccugucccaaauguacaacggcuggguaggcaacaugcgcguacgcauccuccuagcagguaacgccuucaccgcaggcaaaauaaucaucugcugcgugcccccaggauucgacgcucgaauccucacuaucgcccaagcaacccucuucccacaccucauagccgacguccgcacccucgaaccuguagaacuaccccuagaagacguccgcaacguccucuaccacaacucaucccaaccccaaccaaccaugagacuugucgccaugcucuauacaccuuuacgcaccggaggcggcucaggcggaacagacgcauucgucguggcaggccgggucuuaaccugcccugccccagacuucucuuuccucuuccucgucccacccuccguugaacagaaaacccgaguauucuccguccccaauaucccacuuaaagaccucucaaacucacgaguucccgucccuauccaaggcauguucaugucucccgacgucaaccaauccguccaauuccaaaacggccgcugccaaaucgacggacaauuacaaggcaccacccccgucucccucucgcaacuaugcaaaauccgcggcaaaaccuccagcaacgcuagaguccucaaucuuucagaaguugacggcacccccuucauaccccucgaaucaccagccccagucgguuuccccgaccucggagggugcgacuggcacgucaacuucaccuuccaagcccaaaaccaagaccccucccaauccgucaccuucgcaaccaacgacgcauccuucguccccuaucucggcuccaucucaccacacaacggcggcgacuuccacgccggagacauaaucggcucccucggcuggauaagcgcccccuccgacaacacacaacuaaaugucuggacgauccccaaauacggcuccucucuccaaaugucccuuacccuacaccuccuuugcagcccccgucuaugggaagugauccucuauuucuacuccaccuucccaggcuccggacaaccaucccaacuacaaguacccugccuccuuccccaagaauuuaucacucacuucugcaacgaacaagcucccaucgcaggcgaagcugcccuacuccauuacguagaccccgacacuggccgcaaucuuggagaguucaaacucuaccccgacggauucaugaccugcgucccaaacuccguaagcuccggcccccaaacccucccaaucaacggcgucuucgucuucgucucgugggugucucgcuucuaccaacuaaaaccagucggcaccgccuccgcagcccgacgacucuaa

SEQ ID NO: 39339 - RNA, 1605 nt, Artificial Sequence
  derived and/or modified sequence opt11 from VP1__Norovirus_and/or_Norovirus-like__JN005886
augaugauggccuccaaagacgcaccuuccaacauggacggaacauccggcgccggccaacucguccccgaagucaacgcagccgaaccucuaccacucgaacccgucgucggagccgcaacagcagccgccacugcaggacaagucaaccucaucgacccauggauaaugaacaauuucguccaagcacccgaaggcgaauuuaccaucucuccaaauaauacccccggagacauucucuuugaucuucaccucggaccccaccuaaacccuuuccuccaacaccucucccaaauguauaacggguggguaggcaacaugcgaguacgcgucaugcucgccggaaaugcuuuuacagccggaaaaaucauuaucugcugugucccucccggauucgccucccaaaacaucucaaucggccaagccacaauguucccccacgucaucgccgacguccgcguccuagaaccaaucgaaauuccccucgacgaugucagaaacguccuuuuccacaccaacgaaaaucgccccacaaugcgacuccuuugcaugcucuacaccccacuacgagccgguggcgccuccuccggcacagaccccuucgucauagcaggcagaguccucaccugucccucuccagacuucaauuuccucuuccucgugcccccauccgucgaacagaaaacccgacaacuaacagucccuaacaucccccucaacaaccuagcaaacagcagaguccccgccaugauaaacaaaaugacagucuccacagaccaaaaccaagucguccaauuccaaaacggccgcugcacccucgaaggccaacuacuaggcacaacacccgucucagccucgcaaguagcacgaauccgcgguaaaguuuucuccaccgcauccggcaaaggccucaaccucacagaacuugacggcacccccuaccacgcauucgaguccccagcaccacucggcuucccagauaucggcgccugcgacuggcaugucuccaccuucaaggucgaccaaaaccucuccggcgaccccaugucccgucucgacguaaaacaaaacgcacccuucgccccacaccucggcuccaucgaauuuacauccgaccaagaccccaccggcgaccaacucggcacccucgcauggguuucccccucuacauccggagcccgcguagacccauggaaaaucccuuccuacggaagcaccguaacagaauccacacaccuugcaccacccauauucccucccggcuucggcgaggccaucgucuacuucaugucagacuuccccaucgucucaggcaacaccgcccaaguccccuguacccucccccaagaguucguaucacacuucguugaacaacaagcccccguccgcggugaagccgcccuccuacacuacguagaccccgacacacaccguaaucucggagaguucaaacucuaccccgauggcuucauuaccugcguccccaauaccggaggcggcccccaaaaccuccccacgaacggaguauucgucuucuccuccugggucucccgcuacuaucaacuaaaacccgucggcacagccggcccugcccgccgccuauaa

SEQ ID NO: 39340 - RNA, 1605 nt, Artificial Sequence
  derived and/or modified sequence opt11 from VP1__Norovirus_and/or_Norovirus-like__AB758449
augaugauggccuccaaagacgcacccuccaacauggacggaacgagcggagcuggccaacugguccccgaaguaaacgcagccgaaccuuuaccccucgaacccgucguaggagccgccacugccgcagcaaccgcagggcaaguaaaccucaucgaccccuggauaaugaacaacuucguccaagcccccgaaggcgaauuuaccauaucucccaacaacacccccggcgacauccucuucgaccuccaacuuggcccccaccucaaccccuucuuacaacaccuaucccaaauguacaacggcugggucggaaacaugaggguaagaguaaugcuagccggaaacgccuucaccgccggaaaaaucauaaucugcugcgucccacccggcuucgccucucaaaacaucucaaucggucaagccaccauguucccccacgucaucgccgacguccgcguacucgaaccaaucgaaaucccccuggaugacguccgcaacguucucuuccacaccaacgaaaaucgcccuaccaugaggcuccucugcaugcuuuacaccccgcuccgcgccggaggcgccuccuccggcaccgaccccuucgucaucgccggucgcguccuuaccugccccuccccugacuucaacuuccucuuccucguaccacccuccgucgaacagaaaacccgccaacucaccguccccaacaucccccucaacaaccuagcaaacucccgaguaccagccaugaucaacaaaaugaccguauccacagaccaaaaccaagucguccaauuccaaaacggcagaugcacccuagaaggccaacuacuugguacaaccccaguaucugcaucccaagucgcccgcauccgaggcaaagucuucuccacagcauccggaaaaggucuuaaccucacagaacucgacggaacucccuaccaugcuuucgaaucccccgcaccgcuaggcuuccccgacauaggcgcaugcgacuggcacgucuccaccuucaaaguggaccaaaaccuaagcggagaccccaugagccgcuuagacaucaaacaaaacgccccuuucgcaccccaccucgguuccaucgaauuuacauccgaccaggaaccaaccggcgaccaacuaggcacccuugcuuggguuucuccuucgaccuccggagcccgagucgaccccuggaaaauccccucauauggcuccaccgucaccgaaagcacccaccucgccccacccaucuucccucccggauucggagaagccaucgucuacuucaugagcgacuuccccaucgucagcggaaauaccgcccaggucccaugcacacucccucaagaguucgucucacacuucguagaacaacaagcccccauccgaggugaagccgcccuacuacacuacgucgauccagacacccaccgcaaccucggagaguucaaacuauacccagacgguuucauaaccugcguccccaacaccggcggcggaccccaaaaccuccccaucaacggaguauucguauucuccucaugggucucccgcuacuaccaacuuaaacccgucggcaccgccggaccugcccgacgucuuuga

SEQ ID NO: 39341 - RNA, 1605 nt, Artificial Sequence
  derived and/or modified sequence opt11 from VP1__Norovirus_and/or_Norovirus-like__KX907729
augaugauggccuccaaagacgcccccuccaacauggacggcaccucaggcgccggccaacucgucccagaagucaacgccgccgaaccucuaccccucgaacccgucgucggugccgcaaccgcagucgcaacagccggccaagucaaccuaaucgacccauggaucaugaauaacuuuguccaagccccagaaggcgaguucaccauaucccccaacaacacaccaggcgacauacucuucgaccuacaacucggcccccaccuaaauccuuuccuacagcaucucucacagauguacaacggauggguagggaacaugagaguccgcgucaugcuagccggcaacgccuucaccgcuggaaaaaucauaauauguugcgucccacccggauucgccucccaaaacaucuccaucggccaggcaacaauguucccccacguaaucgccgacgugcgaguacucgaacccauagaaaucccccuagacgacguccgcaacguccucuuccauacaaacgaaucucgcccaaccaugcgccuccuaugcaugcucuacacaccccuccgcgcaggaggcgccuccuccggcaccgacccguuugucaucgcaggccgaguccuaaccugcccaucgccugacuucaacuuccucuuccucgucccacccucuguagaacagaaaacacgccaacuuaccguccccaacaucccacucaacaaccuugccaacucccgcgucccagcaaugaucaacaaaaugaccgucucaacugaccaaucucaagucguacaguuucaaaacggacgaugcacccuagaaggacaacuucucggaacaacacccgucuccgccucccaagucgccagaaucagaggaaaagucuuuuccaccgcauccggaaaaggccucaaccuaacagagcuagacggaaccccauaccacgcuuucgaaucucccgccccacucggauuuccugacauaggugcaugcgacuggcauguuuccaccuucaaagucgaccaaaaccuauccggagaccccaugucacgccucgacaucaaacaaaacgccccuuucgccccucaccucggcuccaucgaguucacauccgaccaagaacccacaggagaccaacucggaacucuagccugggucuccccauccaccucaggcgcccgagucgacccauggaaaaucccaucauauggaucaaccguuacggaauccacacaccuugcacccccaaucuucccacccggcuucggcgaagccauagucuacuucaugucagacuuccccauaguauccggcaacacugcccaaguaccaugcacccucccacaagaguucgucucccacuucgucgaacaacaagcccccauccgaggagaagcagcccugcuccauuacguugaccccgacacucaccgcaaccucggagaauuuaaacuauaccccgacggauucauaaccugcguccccaacaccggcggcgguccucaaaaucuccccaucaacgguguauucguauuuucuuccuggguuucacgcuacuaccaacucaaaccagucggcaccgccggacccgcucgccgacucuaa

SEQ ID NO: 39342 - RNA, 1602 nt, Artificial Sequence
  derived and/or modified sequence opt11 from VP1__Norovirus_and/or_Norovirus-like__JN899243
augaugauggcaucaaaagacgccccaucaaacauggacggcacauccggcgccggacaacucgugcccgaagucaacaccgccgaaccucuaccacucgaaccagucgucggagccgcaaccgcagccgccaccgccggccaagucaaccuaaucgaccccuggaucaugaacaacuucguccaagcccccgaaggugaauuuaccauaucacccaauaacacaccuggcgacauucucuucgaccuacgucucggcccacaccucaaccccuuccuauuacaccucucccaaauguacaacggaugggucggaaauaugcgcauccgcgucaugcucgccggcaacgcauucuccgccggcaaaaucaucauuugcugcgucccacccggauucgaaagccaaaacaucuccaucggccaagccacaauguucccccacgucaucgcagacguacgaguccucgaacccaucgaaauuccacucgacgacguccgcaacguccuauaccauaccaacgaaaaccgaccuaccaugcggcuccucugcaugcucuacacaccccuacgggcuggcggcgccucgucgggcaccgaccccuucgucaucgcaggucgcguacuuacgugcccugcccccgauuucaacuuccucuuccuugucccacccuccgucgaacagaaaacccgacaacucaccauaccuaacauaccccuuaacaaccucgcgaacucacgaguacccgccaugaucaacaaaauggcagucuccgccgaccaaaaccagguaguccaauuccaaaacggcagaugcacccucgaaggccaacuccucggaaccaccccagucagcgccaaccaaguugcccgcauccgcggcaaagucuucucgacuaacucaggcaccggccucaaccuuaccgaaaccgacggaacacccuaccacgcuuucgaaagccccgcaccccucggcuucccagacaucggugacugcgacuggcacgucuaugcauucaaagucaaccaaaacaccggcgaccccauguacagacuagacaucacccaaggcaacuccuucgcuccccaccuaggcuccaucgaguucaccucugaccaacaccccuccggcgaccaacuuggcacacucacauggaucucaccccuaaacaacgccucccgaguagaucccuggaaaauccccucguacggcuccacacuaacagaauccaccaaccuagccccuccaauuuucccucccggcuucggcgaagcaaucgucuacuucaugucagacuuccccaucguuuccgguaacaccacccaaauccccugcacccucccccaagaauuuaucuccucauucguggaacaacaagccccaauccgcggagaagccgcccuucuacacuacguagaccccgacacccaccgaaaccuaggcgaguucaaacuauauccagauggauucauaaccugcguccccaauaccggcggaggaccccagaacuuaccauccaacggcgucuucaucuucagcuccugggucucccguuacuaccaacuaaaacccgucggcaccgccggccccgcaagacgucuuuaa

SEQ ID NO: 39343 - RNA, 1602 nt, Artificial Sequence
  derived and/or modified sequence opt11 from VP1__Norovirus_and/or_Norovirus-like__AB810004
augaaaauggccuccaacgacgcagcccccuccaacgacggagccgccucccucguccccgaagccauaaacgaaaccaugccacucgaacccgucgccggcgcuuccaucgccgcaccaguagccggccagaccaacaucaucgaccccuggauccgcaccaacuuuguccaagcacccaacggcgaguucacuguauccccucgcaauuccccaggcgaaauccugcuaaaccucgaacuaggacccgaccuuaaccccuaccucgcucaccuaucccguauguacaacggcuacgccggcggagucgaaguacagguacuacucgccgguaacgccuucaccgccggaaagauccucuucgcagcaaucccucccaacuuccccgucgacaugauaucucccgcccaaaucaccaugcucccccaccucauagucgacguccgaacacucgaaccaaucaugaucccucuacccgacguacgcaacgucuucuaccacuucaacaaccaaccacaaccccgcaugcgacucgucgccaugcucuauaccccacuacgcuccaacggcuccggcgacgacgucuuuaccgucucgugccgcguucuuacucgacccaccccugacuucgaguucaucuaccucgucccacccuccgucgaaucaaaaaccaaacccuucacacuucccauacucaccauauccgaauuaaccaacucccgauuccccauccccauagaacaacucuauaccgcccccaacgaaaacaacguaguccaaugccaaaacggacgcugcacccuugacggcgaacuccaaggcaccacacaacuccucucauccgccgucugcucauaccgcggacgaaccguagcuaacagaggagacaacugggaucaaaaccuccuccaacucacauacccuagcggcgcguccuacgacccaaccgacgaagucccagcaccccucggcacacaagacuucuccggaauacucuacggcguccucacccaagacaacguauccgaaggaaccggagaagccaaaaacgcaaaaggaguauacaucucuacuaccagcggaaaauucacccccaaaaucggcuccauaggccuccacucaaucaccgaaaacguccaccccaaucaacagucacgcuucaccccagucggugucgcccaaaacgagaacacacccuuccaacaauggguucuuccccacuacgcaggcgcccuagcucuaaacaccaaccucgcccccgccgucgcccccacauuccccggcgaacaacuccuauucuuccgcucacgcgugccaugcguacaaggccuccgcggccaagaugccuucauugacugccuccucccucaggagugggucaaccacuucuaccaagaagcagcccccucccaagccgacgucgcccucauccguuacgucaaccccgacacuggacgcacccuuuucgaagccaaacuucaccgcucaggauuuauaacaguaucccacaccggcgcauauccccuagucguucccccaaacggacacuuccgcuucgacuccugggucaaccaauucuauucccuagcccccaugggauaa
